United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 66

SEQ ID NO: 3002826 - RNA, 22 nt, Human
cgugagccacugcaccgggcca

SEQ ID NO: 3002827 - RNA, 19 nt, Human
cuaauaaaaaggugaccau

SEQ ID NO: 3002828 - RNA, 14 nt, Human
cuaaguuuuuaugg

SEQ ID NO: 3002829 - RNA, 19 nt, Human
cuacaaaaagcauaaaaau

SEQ ID NO: 3002830 - RNA, 20 nt, Human
cuacaaaaacacagcaaggg

SEQ ID NO: 3002831 - RNA, 18 nt, Human
cuaaguaucaaguauaga

SEQ ID NO: 3002832 - RNA, 20 nt, Human
cgguggcucacgccuguaau

SEQ ID NO: 3002833 - RNA, 22 nt, Human
cguacacauuuuauuuuauuau

SEQ ID NO: 3002834 - RNA, 12 nt, Human
cgggcucugccu

SEQ ID NO: 3002835 - RNA, 19 nt, Human
cgggcucagcaaaagaugc

SEQ ID NO: 3002836 - RNA, 17 nt, Human
cgggccacagagaaagu

SEQ ID NO: 3002837 - RNA, 17 nt, Human
cggagacggagucccac

SEQ ID NO: 3002838 - RNA, 20 nt, Human
cggagacggagucccaccuu

SEQ ID NO: 3002839 - RNA, 22 nt, Human
cggagucccaccuuggcugcag

SEQ ID NO: 3002840 - RNA, 21 nt, Human
cggagucccaccuuggcugca

SEQ ID NO: 3002841 - RNA, 23 nt, Human
cggagucccaccuuggcugcagg

SEQ ID NO: 3002842 - RNA, 12 nt, Human
ccuuuucccaac

SEQ ID NO: 3002843 - RNA, 23 nt, Human
cgccaaggcugggggaagaagcu

SEQ ID NO: 3002844 - RNA, 23 nt, Human
cgagggggcugcucccaccuggc

SEQ ID NO: 3002845 - RNA, 18 nt, Human
cgagggggcugcucccac

SEQ ID NO: 3002846 - RNA, 17 nt, Human
cgagggggcugcuccca

SEQ ID NO: 3002847 - RNA, 15 nt, Human
cgagggggcugcucc

SEQ ID NO: 3002848 - RNA, 18 nt, Human
cgcuggagugcagugagc

SEQ ID NO: 3002849 - RNA, 17 nt, Human
cgcuggagugcagugag

SEQ ID NO: 3002850 - RNA, 19 nt, Human
cgcugccccuggcagcccc

SEQ ID NO: 3002851 - RNA, 20 nt, Human
cgcugccccuggcagccccu

SEQ ID NO: 3002852 - RNA, 13 nt, Human
cuauguuaauauu

SEQ ID NO: 3002853 - RNA, 15 nt, Human
cuauguuaauauuuu

SEQ ID NO: 3002854 - RNA, 17 nt, Human
cuauguuaauauuuuag

SEQ ID NO: 3002855 - RNA, 14 nt, Human
cuauguuaauauuu

SEQ ID NO: 3002856 - RNA, 21 nt, Human
cuauguuaauauuuuaggugu

SEQ ID NO: 3002857 - RNA, 18 nt, Human
cuauguucuaagaaguga

SEQ ID NO: 3002858 - RNA, 22 nt, Human
cuauguugcccaggcaggucuu

SEQ ID NO: 3002859 - RNA, 21 nt, Human
cuauguugcccaggcaggucu

SEQ ID NO: 3002860 - RNA, 19 nt, Human
cuauguugcccaggcaggu

SEQ ID NO: 3002861 - RNA, 18 nt, Human
cuauguugcccaggcagg

SEQ ID NO: 3002862 - RNA, 13 nt, Human
cuaucucccccag

SEQ ID NO: 3002863 - RNA, 14 nt, Human
cuaucucccccagc

SEQ ID NO: 3002864 - RNA, 18 nt, Human
cuaucucauuuccaagca

SEQ ID NO: 3002865 - RNA, 14 nt, Human
cuaugugagaccau

SEQ ID NO: 3002866 - RNA, 23 nt, Human
cuaugucauuugcuggagcucug

SEQ ID NO: 3002867 - RNA, 17 nt, Human
cuaucacugguuugguu

SEQ ID NO: 3002868 - RNA, 12 nt, Human
cuauguuuuugu

SEQ ID NO: 3002869 - RNA, 21 nt, Human
cucaagugauucuccugccuc

SEQ ID NO: 3002870 - RNA, 23 nt, Human
cucaauuauuuugcauuuuuucu

SEQ ID NO: 3002871 - RNA, 18 nt, Human
cucaguagucagacugga

SEQ ID NO: 3002872 - RNA, 23 nt, Human
cucaggugucccugcacuugcag

SEQ ID NO: 3002873 - RNA, 16 nt, Human
cucaguccaugaagau

SEQ ID NO: 3002874 - RNA, 20 nt, Human
cucagucuggcccuuccuuu

SEQ ID NO: 3002875 - RNA, 17 nt, Human
cucaguccauagcagag

SEQ ID NO: 3002876 - RNA, 15 nt, Human
cucaguccauagcag

SEQ ID NO: 3002877 - RNA, 22 nt, Human
cucagucuggcccuuccuuuuc

SEQ ID NO: 3002878 - RNA, 22 nt, Human
cucagccucccgaauagcuggg

SEQ ID NO: 3002879 - RNA, 21 nt, Human
cucagccucccgaauagcugg

SEQ ID NO: 3002880 - RNA, 19 nt, Human
cucagccucccgaauagcu

SEQ ID NO: 3002881 - RNA, 23 nt, Human
cucagaagacacugaugggcaac

SEQ ID NO: 3002882 - RNA, 17 nt, Human
cucaccuuucccaucuu

SEQ ID NO: 3002883 - RNA, 22 nt, Human
cucagaagacacugaugggcaa

SEQ ID NO: 3002884 - RNA, 20 nt, Human
cucagaagacacugaugggc

SEQ ID NO: 3002885 - RNA, 17 nt, Human
cucagaagacacugaug

SEQ ID NO: 3002886 - RNA, 15 nt, Human
cucagaagacacuga

SEQ ID NO: 3002887 - RNA, 13 nt, Human
cucagaagacacu

SEQ ID NO: 3002888 - RNA, 16 nt, Human
cucaggccagcugcuu

SEQ ID NO: 3002889 - RNA, 17 nt, Human
cucaggccagcugcuug

SEQ ID NO: 3002890 - RNA, 18 nt, Human
cucaggccagcugcuugg

SEQ ID NO: 3002891 - RNA, 22 nt, Human
cucaggccugggggcugggcag

SEQ ID NO: 3002892 - RNA, 11 nt, Human
cucaggccugg

SEQ ID NO: 3002893 - RNA, 19 nt, Human
cucaggccaaacucaccug

SEQ ID NO: 3002894 - RNA, 20 nt, Human
cucaggccaaacucaccugc

SEQ ID NO: 3002895 - RNA, 21 nt, Human
cucaggccaaacucaccugcc

SEQ ID NO: 3002896 - RNA, 15 nt, Human
cucaggccagcugcu

SEQ ID NO: 3002897 - RNA, 16 nt, Human
cucucuguaauaaacu

SEQ ID NO: 3002898 - RNA, 21 nt, Human
cucucuguaauaaacucauuu

SEQ ID NO: 3002899 - RNA, 22 nt, Human
cucucuggccuucggccuccau

SEQ ID NO: 3002900 - RNA, 19 nt, Human
cucucccugcugcuccuag

SEQ ID NO: 3002901 - RNA, 16 nt, Human
cucucccugcugcucc

SEQ ID NO: 3002902 - RNA, 20 nt, Human
cucucccugcugcuccuagg

SEQ ID NO: 3002903 - RNA, 16 nt, Human
cucuccuccagaguca

SEQ ID NO: 3002904 - RNA, 13 nt, Human
cucucuggccuuc

SEQ ID NO: 3002905 - RNA, 16 nt, Human
cucucuggccuucggc

SEQ ID NO: 3002906 - RNA, 14 nt, Human
cucucuggccuucg

SEQ ID NO: 3002907 - RNA, 13 nt, Human
cucuccuccagag

SEQ ID NO: 3002908 - RNA, 15 nt, Human
cucuccuccagaguc

SEQ ID NO: 3002909 - RNA, 12 nt, Human
cucuccuccaga

SEQ ID NO: 3002910 - RNA, 14 nt, Human
cucucccugcugcu

SEQ ID NO: 3002911 - RNA, 13 nt, Human
cucucccugcugc

SEQ ID NO: 3002912 - RNA, 15 nt, Human
cucuccccaugaugu

SEQ ID NO: 3002913 - RNA, 16 nt, Human
cucuccccaugauguu

SEQ ID NO: 3002914 - RNA, 19 nt, Human
cucuauguucuaagaagug

SEQ ID NO: 3002915 - RNA, 16 nt, Human
cucgguguggagaagc

SEQ ID NO: 3002916 - RNA, 17 nt, Human
cucgguguggagaagcg

SEQ ID NO: 3002917 - RNA, 17 nt, Human
cuccuuugugaggaagc

SEQ ID NO: 3002918 - RNA, 18 nt, Human
cuccuuugugaggaagcc

SEQ ID NO: 3002919 - RNA, 16 nt, Human
cucuguacagagccca

SEQ ID NO: 3002920 - RNA, 14 nt, Human
cucugcugcuggcu

SEQ ID NO: 3002921 - RNA, 15 nt, Human
cucugcugcuggcug

SEQ ID NO: 3002922 - RNA, 16 nt, Human
cucugcugcuggcugg

SEQ ID NO: 3002923 - RNA, 14 nt, Human
cucuguacagagcc

SEQ ID NO: 3002924 - RNA, 15 nt, Human
cucuguacagagccc

SEQ ID NO: 3002925 - RNA, 13 nt, Human
cucuguacagagc

SEQ ID NO: 3002926 - RNA, 23 nt, Human
cucugcugacagacacaggcccg

SEQ ID NO: 3002927 - RNA, 13 nt, Human
cucugcugcuggc

SEQ ID NO: 3002928 - RNA, 20 nt, Human
cucugcugacagacacaggc

SEQ ID NO: 3002929 - RNA, 22 nt, Human
cucugcugacagacacaggccc

SEQ ID NO: 3002930 - RNA, 21 nt, Human
cucugcugacagacacaggcc

SEQ ID NO: 3002931 - RNA, 17 nt, Human
cucugcacuccccugcu

SEQ ID NO: 3002932 - RNA, 21 nt, Human
cucugcuccucuccccagcaa

SEQ ID NO: 3002933 - RNA, 20 nt, Human
cucugcuccucuccccagca

SEQ ID NO: 3002934 - RNA, 20 nt, Human
cucugcacaagcugcacccu

SEQ ID NO: 3002935 - RNA, 21 nt, Human
cucugcacaagcugcacccuc

SEQ ID NO: 3002936 - RNA, 19 nt, Human
cucugcacaagcugcaccc

SEQ ID NO: 3002937 - RNA, 15 nt, Human
cucugcacuccccug

SEQ ID NO: 3002938 - RNA, 16 nt, Human
cucugcacuccccugc

SEQ ID NO: 3002939 - RNA, 14 nt, Human
cucugcacuccccu

SEQ ID NO: 3002940 - RNA, 19 nt, Human
cucccuccaccucccugca

SEQ ID NO: 3002941 - RNA, 21 nt, Human
cucccuccaccucccugcaau

SEQ ID NO: 3002942 - RNA, 20 nt, Human
cucccuccaccucccugcaa

SEQ ID NO: 3002943 - RNA, 22 nt, Human
cucccuccaccucccugcaaua

SEQ ID NO: 3002944 - RNA, 20 nt, Human
cucccucuuucccucccuuc

SEQ ID NO: 3002945 - RNA, 20 nt, Human
cuccaggcuguaucccauga

SEQ ID NO: 3002946 - RNA, 23 nt, Human
cuccaggcuccuuuagcgcccag

SEQ ID NO: 3002947 - RNA, 15 nt, Human
cuccaggcuccuuua

SEQ ID NO: 3002948 - RNA, 23 nt, Human
cuccaggugcacaagcuccaagc

SEQ ID NO: 3002949 - RNA, 13 nt, Human
cuccucugcugcu

SEQ ID NO: 3002950 - RNA, 14 nt, Human
cuccucugcugcug

SEQ ID NO: 3002951 - RNA, 15 nt, Human
cuccucugcugcugg

SEQ ID NO: 3002952 - RNA, 22 nt, Human
cuccucugcuugccaucccucc

SEQ ID NO: 3002953 - RNA, 19 nt, Human
cuccuggcccacugcaucg

SEQ ID NO: 3002954 - RNA, 18 nt, Human
cuccugggcuaagugauc

SEQ ID NO: 3002955 - RNA, 19 nt, Human
cuccuggccucaagugauu

SEQ ID NO: 3002956 - RNA, 14 nt, Human
cuccuuguguuacu

SEQ ID NO: 3002957 - RNA, 15 nt, Human
cuccuuucaccacau

SEQ ID NO: 3002958 - RNA, 16 nt, Human
cuccuguaccucuuga

SEQ ID NO: 3002959 - RNA, 19 nt, Human
cuccggcccuccagagccc

SEQ ID NO: 3002960 - RNA, 23 nt, Human
cuccgcuuucuacccagcgagcc

SEQ ID NO: 3002961 - RNA, 11 nt, Human
uuugcagagua

SEQ ID NO: 3002962 - RNA, 14 nt, Human
uuugcagacaggca

SEQ ID NO: 3002963 - RNA, 21 nt, Human
uuugcauagauucccugagca

SEQ ID NO: 3002964 - RNA, 18 nt, Human
uuugccauguuggccagg

SEQ ID NO: 3002965 - RNA, 23 nt, Human
uuuggaaauuagguugaaacaua

SEQ ID NO: 3002966 - RNA, 15 nt, Human
uuugagcagggcuca

SEQ ID NO: 3002967 - RNA, 22 nt, Human
uuugaggucuguucuuuccaaa

SEQ ID NO: 3002968 - RNA, 17 nt, Human
uuugaggucuguucuuu

SEQ ID NO: 3002969 - RNA, 22 nt, Human
uuuguaaauuaacuuuuauaaa

SEQ ID NO: 3002970 - RNA, 21 nt, Human
uuuguauaaaauaauuuuuau

SEQ ID NO: 3002971 - RNA, 19 nt, Human
uuuguauaaaauaauuuuu

SEQ ID NO: 3002972 - RNA, 15 nt, Human
uuuguaaauuaacuu

SEQ ID NO: 3002973 - RNA, 17 nt, Human
uuuguaaauuaacuuuu

SEQ ID NO: 3002974 - RNA, 16 nt, Human
uuuguaaauuaacuuu

SEQ ID NO: 3002975 - RNA, 19 nt, Human
uuuggugguuucagaaaug

SEQ ID NO: 3002976 - RNA, 16 nt, Human
uuuguugucagcugaa

SEQ ID NO: 3002977 - RNA, 13 nt, Human
uuuguccccaccg

SEQ ID NO: 3002978 - RNA, 21 nt, Human
uuuguccccaccgcagacagg

SEQ ID NO: 3002979 - RNA, 16 nt, Human
uuugucccaagugcca

SEQ ID NO: 3002980 - RNA, 19 nt, Human
uuuucaauaacuggaacac

SEQ ID NO: 3002981 - RNA, 16 nt, Human
uuuucaauaacuggaa

SEQ ID NO: 3002982 - RNA, 13 nt, Human
uuuucaauaacug

SEQ ID NO: 3002983 - RNA, 23 nt, Human
uuuucaauaacuggaacacucua

SEQ ID NO: 3002984 - RNA, 17 nt, Human
uuuucaauuuuaaacau

SEQ ID NO: 3002985 - RNA, 15 nt, Human
uuuucacaguucucu

SEQ ID NO: 3002986 - RNA, 14 nt, Human
uuuucuucucccuc

SEQ ID NO: 3002987 - RNA, 17 nt, Human
uuuucuugcaugaggcu

SEQ ID NO: 3002988 - RNA, 16 nt, Human
uuuucuugcaugguuu

SEQ ID NO: 3002989 - RNA, 15 nt, Human
uuuuccuucagugcc

SEQ ID NO: 3002990 - RNA, 18 nt, Human
uuuuccaugaguccccug

SEQ ID NO: 3002991 - RNA, 19 nt, Human
uuuuccaugaguccccugu

SEQ ID NO: 3002992 - RNA, 13 nt, Human
uuuuauauagcaa

SEQ ID NO: 3002993 - RNA, 20 nt, Human
uuuuauaugcuucuguuuua

SEQ ID NO: 3002994 - RNA, 15 nt, Human
uuuuauaugcuucug

SEQ ID NO: 3002995 - RNA, 20 nt, Human
uuuuauaucaauuuaaaaaa

SEQ ID NO: 3002996 - RNA, 15 nt, Human
uuuuauauucucagc

SEQ ID NO: 3002997 - RNA, 10 nt, Human
uuuuauauuu

SEQ ID NO: 3002998 - RNA, 22 nt, Human
uuuuaucagaacuauguuuuug

SEQ ID NO: 3002999 - RNA, 18 nt, Human
uuuuaucgucacugcuua

SEQ ID NO: 3003000 - RNA, 17 nt, Human
uuuuaauuugguuuuca

SEQ ID NO: 3003001 - RNA, 21 nt, Human
uuuuaauuugguuuucacauu

SEQ ID NO: 3003002 - RNA, 22 nt, Human
uuuuacauaaauuuaguauuuu

SEQ ID NO: 3003003 - RNA, 14 nt, Human
uuuuaaacaaaaua

SEQ ID NO: 3003004 - RNA, 22 nt, Human
uuuauuuggaaaggaaugcaaa

SEQ ID NO: 3003005 - RNA, 19 nt, Human
uuucaauaggaaaaacuga

SEQ ID NO: 3003006 - RNA, 20 nt, Human
uuucaauaggaaaaacugau

SEQ ID NO: 3003007 - RNA, 22 nt, Human
uuucaauaggaaaaacugauuu

SEQ ID NO: 3003008 - RNA, 16 nt, Human
uuuauuuauuuauuca

SEQ ID NO: 3003009 - RNA, 15 nt, Human
uuucagcagcugcag

SEQ ID NO: 3003010 - RNA, 15 nt, Human
uuucagauaaucaca

SEQ ID NO: 3003011 - RNA, 22 nt, Human
uuucauugcugggcuugucugu

SEQ ID NO: 3003012 - RNA, 15 nt, Human
uuucagccaagaauu

SEQ ID NO: 3003013 - RNA, 15 nt, Human
uuuccaaaguacacu

SEQ ID NO: 3003014 - RNA, 12 nt, Human
uuuccaaaguac

SEQ ID NO: 3003015 - RNA, 13 nt, Human
uuuccaggaaggc

SEQ ID NO: 3003016 - RNA, 15 nt, Human
uuucugagaaagacu

SEQ ID NO: 3003017 - RNA, 22 nt, Human
uuucugagaaagacuauucaaa

SEQ ID NO: 3003018 - RNA, 16 nt, Human
uuucuaggacugaauu

SEQ ID NO: 3003019 - RNA, 15 nt, Human
uuucuagccagagga

SEQ ID NO: 3003020 - RNA, 14 nt, Human
uuucuaaagcugcc

SEQ ID NO: 3003021 - RNA, 17 nt, Human
uuucuaaagcugccagc

SEQ ID NO: 3003022 - RNA, 14 nt, Human
uuucuaaaggcuac

SEQ ID NO: 3003023 - RNA, 21 nt, Human
uuuccucuuuggucuacacug

SEQ ID NO: 3003024 - RNA, 23 nt, Human
uuuacuuuuuggaaaagaauaaa

SEQ ID NO: 3003025 - RNA, 12 nt, Human
uuuagaaacaca

SEQ ID NO: 3003026 - RNA, 15 nt, Human
uuuacuuuuuggaaa

SEQ ID NO: 3003027 - RNA, 22 nt, Human
uuuacauggcuggagcuagaau

SEQ ID NO: 3003028 - RNA, 15 nt, Human
uuuacuuuguguuca

SEQ ID NO: 3003029 - RNA, 20 nt, Human
uuuagaaacacaacuauauu

SEQ ID NO: 3003030 - RNA, 16 nt, Human
uuuacauggcuggagc

SEQ ID NO: 3003031 - RNA, 17 nt, Human
uuuacauggcuggagcu

SEQ ID NO: 3003032 - RNA, 14 nt, Human
uuuauaaacuuuac

SEQ ID NO: 3003033 - RNA, 16 nt, Human
uuuauaaacuuuaccu

SEQ ID NO: 3003034 - RNA, 16 nt, Human
uuuaucgucacugcuu

SEQ ID NO: 3003035 - RNA, 21 nt, Human
uuuaucgucacugcuuaacuu

SEQ ID NO: 3003036 - RNA, 14 nt, Human
uuuauugucaaagu

SEQ ID NO: 3003037 - RNA, 16 nt, Human
uuuauugucaaagugg

SEQ ID NO: 3003038 - RNA, 19 nt, Human
uuuauuuaguuccuugagu

SEQ ID NO: 3003039 - RNA, 12 nt, Human
uuuuuuacuaau

SEQ ID NO: 3003040 - RNA, 12 nt, Human
uuuuuucugaaa

SEQ ID NO: 3003041 - RNA, 17 nt, Human
uuuuuuccuucagugcc

SEQ ID NO: 3003042 - RNA, 19 nt, Human
uucuccagucauuauguua

SEQ ID NO: 3003043 - RNA, 17 nt, Human
uucuccagucauuaugu

SEQ ID NO: 3003044 - RNA, 16 nt, Human
uucuccaagcaggaca

SEQ ID NO: 3003045 - RNA, 13 nt, Human
uucuccacccugc

SEQ ID NO: 3003046 - RNA, 11 nt, Human
uucuccaggcu

SEQ ID NO: 3003047 - RNA, 22 nt, Human
uucucuccuguaccucuugagc

SEQ ID NO: 3003048 - RNA, 18 nt, Human
uucucuccagccccugga

SEQ ID NO: 3003049 - RNA, 16 nt, Human
uucugacccaugcugc

SEQ ID NO: 3003050 - RNA, 18 nt, Human
uucugacccaugcugccc

SEQ ID NO: 3003051 - RNA, 20 nt, Human
uucugacccaugcugcccug

SEQ ID NO: 3003052 - RNA, 21 nt, Human
uucugacccaugcugcccugu

SEQ ID NO: 3003053 - RNA, 21 nt, Human
uucugacccugcuucaaauau

SEQ ID NO: 3003054 - RNA, 17 nt, Human
uucucugauacagaaaa

SEQ ID NO: 3003055 - RNA, 14 nt, Human
uucucugauacaga

SEQ ID NO: 3003056 - RNA, 16 nt, Human
uucucugauacagaaa

SEQ ID NO: 3003057 - RNA, 15 nt, Human
uucucugauacagaa

SEQ ID NO: 3003058 - RNA, 14 nt, Human
uucuauuuauuugu

SEQ ID NO: 3003059 - RNA, 21 nt, Human
uucuauuuauuuauuuauuca

SEQ ID NO: 3003060 - RNA, 14 nt, Human
uucuauuguuucuu

SEQ ID NO: 3003061 - RNA, 17 nt, Human
uucuaugacacaugcaa

SEQ ID NO: 3003062 - RNA, 16 nt, Human
uucuaugacacaugca

SEQ ID NO: 3003063 - RNA, 12 nt, Human
uuccuagugaaa

SEQ ID NO: 3003064 - RNA, 23 nt, Human
uuccucauaguaugguggcuggg

SEQ ID NO: 3003065 - RNA, 22 nt, Human
uuccucccucccucuuucccuc

SEQ ID NO: 3003066 - RNA, 21 nt, Human
uuccucccucccucuuucccu

SEQ ID NO: 3003067 - RNA, 19 nt, Human
uuccucccucccucuuucc

SEQ ID NO: 3003068 - RNA, 12 nt, Human
uuccucccuccc

SEQ ID NO: 3003069 - RNA, 18 nt, Human
uucccuugaugaagaagu

SEQ ID NO: 3003070 - RNA, 19 nt, Human
uucccuuugacgccauccc

SEQ ID NO: 3003071 - RNA, 22 nt, Human
uuccccacuugagaauuacccu

SEQ ID NO: 3003072 - RNA, 19 nt, Human
uucggccuccauccugagg

SEQ ID NO: 3003073 - RNA, 18 nt, Human
uucggccuccauccugag

SEQ ID NO: 3003074 - RNA, 16 nt, Human
uucuaaaggcuaccuu

SEQ ID NO: 3003075 - RNA, 18 nt, Human
uucuaaaggcuaccuuug

SEQ ID NO: 3003076 - RNA, 17 nt, Human
uucuaaaggcuaccuuu

SEQ ID NO: 3003077 - RNA, 19 nt, Human
uuccuucauucaacccacc

SEQ ID NO: 3003078 - RNA, 23 nt, Human
uuccuucagugccuuauggaaca

SEQ ID NO: 3003079 - RNA, 16 nt, Human
uuccuucagugccuua

SEQ ID NO: 3003080 - RNA, 19 nt, Human
uuccuucagugccuuaugg

SEQ ID NO: 3003081 - RNA, 15 nt, Human
uuccuucagugccuu

SEQ ID NO: 3003082 - RNA, 18 nt, Human
uucaguuuaucuguucau

SEQ ID NO: 3003083 - RNA, 13 nt, Human
uucauaaugacuu

SEQ ID NO: 3003084 - RNA, 23 nt, Human
uucauaaugacuuaagcacacuu

SEQ ID NO: 3003085 - RNA, 15 nt, Human
uucaguuuaucuguu

SEQ ID NO: 3003086 - RNA, 19 nt, Human
uucagugccuuauggaaca

SEQ ID NO: 3003087 - RNA, 21 nt, Human
uucagugccuuauggaacacu

SEQ ID NO: 3003088 - RNA, 20 nt, Human
uucaucuuccaacucaaacu

SEQ ID NO: 3003089 - RNA, 11 nt, Human
uucaucuugaa

SEQ ID NO: 3003090 - RNA, 18 nt, Human
uucaugaaagauucaaug

SEQ ID NO: 3003091 - RNA, 12 nt, Human
uucaucuugaau

SEQ ID NO: 3003092 - RNA, 19 nt, Human
uucauuuaggugaggaagc

SEQ ID NO: 3003093 - RNA, 18 nt, Human
uucauuuaggugaggaag

SEQ ID NO: 3003094 - RNA, 21 nt, Human
uuccacuugagugucaagcug

SEQ ID NO: 3003095 - RNA, 17 nt, Human
uuccacuugagugucaa

SEQ ID NO: 3003096 - RNA, 19 nt, Human
uuccacuuauaggaauuga

SEQ ID NO: 3003097 - RNA, 17 nt, Human
uuccaugaguccccugu

SEQ ID NO: 3003098 - RNA, 18 nt, Human
uuccauuuacuuaagacu

SEQ ID NO: 3003099 - RNA, 19 nt, Human
uuccauuuacuuaagacuu

SEQ ID NO: 3003100 - RNA, 20 nt, Human
uucaaucuggauucauauuu

SEQ ID NO: 3003101 - RNA, 23 nt, Human
uucaaucuggauucauauuuaau

SEQ ID NO: 3003102 - RNA, 19 nt, Human
uucaaucuggauucauauu

SEQ ID NO: 3003103 - RNA, 19 nt, Human
uucaaugccccugaauuua

SEQ ID NO: 3003104 - RNA, 18 nt, Human
uucaauucucauuuguca

SEQ ID NO: 3003105 - RNA, 20 nt, Human
uuacuaaaaguuuugagaaa

SEQ ID NO: 3003106 - RNA, 19 nt, Human
uuacuaaaaguuuugagaa

SEQ ID NO: 3003107 - RNA, 13 nt, Human
uuacgugaguccu

SEQ ID NO: 3003108 - RNA, 14 nt, Human
uuacgugaguccug

SEQ ID NO: 3003109 - RNA, 13 nt, Human
uucaaagauauuu

SEQ ID NO: 3003110 - RNA, 23 nt, Human
uucagagcugcccucuccugggc

SEQ ID NO: 3003111 - RNA, 22 nt, Human
uucagagcugcccucuccuggg

SEQ ID NO: 3003112 - RNA, 21 nt, Human
uucagagcugcccucuccugg

SEQ ID NO: 3003113 - RNA, 22 nt, Human
uucagcuccagcucaccagccc

SEQ ID NO: 3003114 - RNA, 15 nt, Human
uucagagacuccugc

SEQ ID NO: 3003115 - RNA, 14 nt, Human
uucacucuccuugg

SEQ ID NO: 3003116 - RNA, 15 nt, Human
uucaggaagcucagg

SEQ ID NO: 3003117 - RNA, 20 nt, Human
uucaggaagcucagggccug

SEQ ID NO: 3003118 - RNA, 17 nt, Human
uucaggaagcucagggc

SEQ ID NO: 3003119 - RNA, 19 nt, Human
uucaggaagcucagggccu

SEQ ID NO: 3003120 - RNA, 18 nt, Human
uucagcugcauacaguuu

SEQ ID NO: 3003121 - RNA, 17 nt, Human
uucagcugacuuuucug

SEQ ID NO: 3003122 - RNA, 16 nt, Human
uucaggaagcucaggg

SEQ ID NO: 3003123 - RNA, 17 nt, Human
uucagcucugcaagaau

SEQ ID NO: 3003124 - RNA, 24 nt, Human
uucagcucugcaagaauugaagca

SEQ ID NO: 3003125 - RNA, 23 nt, Human
uucagcuccagcucaccagcccc

SEQ ID NO: 3003126 - RNA, 12 nt, Human
uugacuauuuuu

SEQ ID NO: 3003127 - RNA, 20 nt, Human
uugacgccaucccagcccca

SEQ ID NO: 3003128 - RNA, 14 nt, Human
uugaggacacugau

SEQ ID NO: 3003129 - RNA, 15 nt, Human
uugaggacacugaua

SEQ ID NO: 3003130 - RNA, 19 nt, Human
uugauagcacagacccugc

SEQ ID NO: 3003131 - RNA, 20 nt, Human
uugauagcacagacccugcc

SEQ ID NO: 3003132 - RNA, 20 nt, Human
uugaccgugaggccagagac

SEQ ID NO: 3003133 - RNA, 21 nt, Human
uugaccgugaggccagagaca

SEQ ID NO: 3003134 - RNA, 15 nt, Human
uugaccucaggugau

SEQ ID NO: 3003135 - RNA, 14 nt, Human
uugacgccauccca

SEQ ID NO: 3003136 - RNA, 22 nt, Human
uugacgccaucccagccccaau

SEQ ID NO: 3003137 - RNA, 12 nt, Human
uugaccugaggc

SEQ ID NO: 3003138 - RNA, 19 nt, Human
uugaccugaggcccuucuc

SEQ ID NO: 3003139 - RNA, 22 nt, Human
uugaccugaggcccuucucucc

SEQ ID NO: 3003140 - RNA, 16 nt, Human
uugcauacuauuaaac

SEQ ID NO: 3003141 - RNA, 18 nt, Human
uugcauacuauuaaacau

SEQ ID NO: 3003142 - RNA, 19 nt, Human
uugcauacuauuaaacaug

SEQ ID NO: 3003143 - RNA, 18 nt, Human
uugcauagauucccugag

SEQ ID NO: 3003144 - RNA, 16 nt, Human
uugcagacaggcaagc

SEQ ID NO: 3003145 - RNA, 18 nt, Human
uugaggguauguuuuaua

SEQ ID NO: 3003146 - RNA, 21 nt, Human
uugauagcacagacccugccc

SEQ ID NO: 3003147 - RNA, 12 nt, Human
uugaugaagaag

SEQ ID NO: 3003148 - RNA, 18 nt, Human
uugauuuccguuaaaaua

SEQ ID NO: 3003149 - RNA, 17 nt, Human
uugcaacaggcugggcu

SEQ ID NO: 3003150 - RNA, 14 nt, Human
uugcaacaggcugg

SEQ ID NO: 3003151 - RNA, 14 nt, Human
uugaaacuuuaaga

SEQ ID NO: 3003152 - RNA, 23 nt, Human
uugaaacugagaugugaacacau

SEQ ID NO: 3003153 - RNA, 16 nt, Human
uugaaaagacuccaaa

SEQ ID NO: 3003154 - RNA, 18 nt, Human
uugaaaagacuccaaaga

SEQ ID NO: 3003155 - RNA, 22 nt, Human
uugaaaagacuccaaagaaaug

SEQ ID NO: 3003156 - RNA, 23 nt, Human
uugaaaagacuccaaagaaaugu

SEQ ID NO: 3003157 - RNA, 19 nt, Human
uugaaaacacuguucucug

SEQ ID NO: 3003158 - RNA, 21 nt, Human
uugaaaacacuguucucugcc

SEQ ID NO: 3003159 - RNA, 18 nt, Human
uucuuuauaauucuacuu

SEQ ID NO: 3003160 - RNA, 17 nt, Human
uugaagacagagcuaca

SEQ ID NO: 3003161 - RNA, 19 nt, Human
uugaagacuuuucuuucag

SEQ ID NO: 3003162 - RNA, 19 nt, Human
uugaacucuucaaucucuu

SEQ ID NO: 3003163 - RNA, 16 nt, Human
uugaacugauaaagau

SEQ ID NO: 3003164 - RNA, 20 nt, Human
uugaacuuugaccucugcag

SEQ ID NO: 3003165 - RNA, 22 nt, Human
uugaacuuugaccucugcagca

SEQ ID NO: 3003166 - RNA, 18 nt, Human
uucuugguuuguaaauua

SEQ ID NO: 3003167 - RNA, 17 nt, Human
uucuugguuuguaaauu

SEQ ID NO: 3003168 - RNA, 23 nt, Human
uucuugguuuguaaauuaacuuu

SEQ ID NO: 3003169 - RNA, 16 nt, Human
uucuugguuuguaaau

SEQ ID NO: 3003170 - RNA, 13 nt, Human
uucuugguuugua

SEQ ID NO: 3003171 - RNA, 23 nt, Human
uucuuauuuaaugaaagacugua

SEQ ID NO: 3003172 - RNA, 19 nt, Human
uucuuauuuaaugaaagac

SEQ ID NO: 3003173 - RNA, 15 nt, Human
uucuuauuucauuuc

SEQ ID NO: 3003174 - RNA, 14 nt, Human
uucugagcauuuaa

SEQ ID NO: 3003175 - RNA, 15 nt, Human
uucugagaaagacua

SEQ ID NO: 3003176 - RNA, 17 nt, Human
uucuguccgagcuuuga

SEQ ID NO: 3003177 - RNA, 21 nt, Human
uucuguccgagcuuugaaaau

SEQ ID NO: 3003178 - RNA, 23 nt, Human
uucuguggguuucuaaagcugcc

SEQ ID NO: 3003179 - RNA, 17 nt, Human
uucuguccuacucugug

SEQ ID NO: 3003180 - RNA, 21 nt, Human
uuggaaaggaaugcaaagaug

SEQ ID NO: 3003181 - RNA, 23 nt, Human
uuggaaagaguaggaagacuuug

SEQ ID NO: 3003182 - RNA, 23 nt, Human
uuggaaauuagguugaaacauau

SEQ ID NO: 3003183 - RNA, 21 nt, Human
uuggaaauuagguugaaacau

SEQ ID NO: 3003184 - RNA, 20 nt, Human
uugcuggggccgaaagaaca

SEQ ID NO: 3003185 - RNA, 15 nt, Human
uuggacauuuuaugu

SEQ ID NO: 3003186 - RNA, 16 nt, Human
uuggacauuuuauguc

SEQ ID NO: 3003187 - RNA, 17 nt, Human
uuggacauuuuaugucu

SEQ ID NO: 3003188 - RNA, 18 nt, Human
uuggacauuuuaugucuu

SEQ ID NO: 3003189 - RNA, 20 nt, Human
uuggacauuuuaugucuuuc

SEQ ID NO: 3003190 - RNA, 11 nt, Human
uuggaaggaac

SEQ ID NO: 3003191 - RNA, 19 nt, Human
uuggaaggaacguccccug

SEQ ID NO: 3003192 - RNA, 17 nt, Human
uuggcaaaaaggcagga

SEQ ID NO: 3003193 - RNA, 14 nt, Human
uuggauuguccccg

SEQ ID NO: 3003194 - RNA, 13 nt, Human
uugcuaacagcaa

SEQ ID NO: 3003195 - RNA, 20 nt, Human
uugcuaacagcaacacaaag

SEQ ID NO: 3003196 - RNA, 19 nt, Human
uugcugauggugcaaugac

SEQ ID NO: 3003197 - RNA, 20 nt, Human
uugcugauggugcaaugacc

SEQ ID NO: 3003198 - RNA, 22 nt, Human
uugcugauggugcaaugaccuu

SEQ ID NO: 3003199 - RNA, 18 nt, Human
uugccucugccucugaca

SEQ ID NO: 3003200 - RNA, 16 nt, Human
uugccucugccucuga

SEQ ID NO: 3003201 - RNA, 14 nt, Human
uugccucugccucu

SEQ ID NO: 3003202 - RNA, 11 nt, Human
uugccucugcc

SEQ ID NO: 3003203 - RNA, 15 nt, Human
uugcccagccuggau

SEQ ID NO: 3003204 - RNA, 18 nt, Human
uugccagucaccccggcc

SEQ ID NO: 3003205 - RNA, 13 nt, Human
uugccagucaccc

SEQ ID NO: 3003206 - RNA, 11 nt, Human
uugcccaggca

SEQ ID NO: 3003207 - RNA, 23 nt, Human
uugcccacgcuggagugcaguga

SEQ ID NO: 3003208 - RNA, 20 nt, Human
uuguacacucauucauuacu

SEQ ID NO: 3003209 - RNA, 12 nt, Human
uuguacagacaa

SEQ ID NO: 3003210 - RNA, 13 nt, Human
uuguacagacaac

SEQ ID NO: 3003211 - RNA, 11 nt, Human
uuguaaaugug

SEQ ID NO: 3003212 - RNA, 14 nt, Human
uuguaaaugugcuu

SEQ ID NO: 3003213 - RNA, 18 nt, Human
uuguaaaugugcuuuuaa

SEQ ID NO: 3003214 - RNA, 12 nt, Human
uugguccugcug

SEQ ID NO: 3003215 - RNA, 22 nt, Human
uuggucccccuuccauggacuu

SEQ ID NO: 3003216 - RNA, 16 nt, Human
uuggucccccuuccau

SEQ ID NO: 3003217 - RNA, 16 nt, Human
uuguaaaggaauuuaa

SEQ ID NO: 3003218 - RNA, 14 nt, Human
uuguauuacaaauc

SEQ ID NO: 3003219 - RNA, 21 nt, Human
uuguauucucuccuguaccuc

SEQ ID NO: 3003220 - RNA, 19 nt, Human
uuguaucacaaaucuuaac

SEQ ID NO: 3003221 - RNA, 15 nt, Human
uuguagagccagggu

SEQ ID NO: 3003222 - RNA, 14 nt, Human
uuguagagccaggg

SEQ ID NO: 3003223 - RNA, 20 nt, Human
uuggccagaagucaaggcuu

SEQ ID NO: 3003224 - RNA, 16 nt, Human
uuggcugcugaaggcu

SEQ ID NO: 3003225 - RNA, 18 nt, Human
uuggcugggggccucagu

SEQ ID NO: 3003226 - RNA, 22 nt, Human
uuggcugggggccucagugcca

SEQ ID NO: 3003227 - RNA, 21 nt, Human
uuggcugggggccucagugcc

SEQ ID NO: 3003228 - RNA, 24 nt, Human
uuggccaaagccaaagcuaggccu

SEQ ID NO: 3003229 - RNA, 22 nt, Human
uuggccagaaaccuuccugcug

SEQ ID NO: 3003230 - RNA, 14 nt, Human
uuggccaggcuggu

SEQ ID NO: 3003231 - RNA, 13 nt, Human
uuggcauucccca

SEQ ID NO: 3003232 - RNA, 12 nt, Human
uuggguuuauuu

SEQ ID NO: 3003233 - RNA, 17 nt, Human
uuggguuuauuuggaaa

SEQ ID NO: 3003234 - RNA, 16 nt, Human
uuggguggaugccugg

SEQ ID NO: 3003235 - RNA, 12 nt, Human
uugggaggcuga

SEQ ID NO: 3003236 - RNA, 16 nt, Human
uugggaggccauuugu

SEQ ID NO: 3003237 - RNA, 22 nt, Human
uuggcuuuggguugcaggaccu

SEQ ID NO: 3003238 - RNA, 20 nt, Human
ugugaaugcagguuuuauca

SEQ ID NO: 3003239 - RNA, 14 nt, Human
ugugaaugcagguu

SEQ ID NO: 3003240 - RNA, 21 nt, Human
ugugacaaggauugcuacugu

SEQ ID NO: 3003241 - RNA, 21 nt, Human
ugugaauaaagagggugggug

SEQ ID NO: 3003242 - RNA, 16 nt, Human
ugugaauaccccaaga

SEQ ID NO: 3003243 - RNA, 22 nt, Human
ugugaccacugcagaagacagu

SEQ ID NO: 3003244 - RNA, 21 nt, Human
ugugauacaaugcugugcccu

SEQ ID NO: 3003245 - RNA, 19 nt, Human
ugugaguacuacaguccuc

SEQ ID NO: 3003246 - RNA, 20 nt, Human
ugugaguacuacaguccucc

SEQ ID NO: 3003247 - RNA, 23 nt, Human
ugugaguacuacaguccucccau

SEQ ID NO: 3003248 - RNA, 18 nt, Human
ugugaguacuacaguccu

SEQ ID NO: 3003249 - RNA, 23 nt, Human
ugugaaaaaauuuacuuuaaacu

SEQ ID NO: 3003250 - RNA, 17 nt, Human
ugugaaaaaauuuacuu

SEQ ID NO: 3003251 - RNA, 12 nt, Human
ugugaaaaaauu

SEQ ID NO: 3003252 - RNA, 14 nt, Human
ugugaaaggaaaga

SEQ ID NO: 3003253 - RNA, 13 nt, Human
ugugaaaggaaag

SEQ ID NO: 3003254 - RNA, 17 nt, Human
ugucuuuggacccugag

SEQ ID NO: 3003255 - RNA, 18 nt, Human
ugucuuuggacccugagg

SEQ ID NO: 3003256 - RNA, 19 nt, Human
ugucuuuggacccugaggc

SEQ ID NO: 3003257 - RNA, 22 nt, Human
ugucuuuggacccugaggccca

SEQ ID NO: 3003258 - RNA, 16 nt, Human
ugucuuuuuucacuac

SEQ ID NO: 3003259 - RNA, 21 nt, Human
ugucucaguccaugaagaugu

SEQ ID NO: 3003260 - RNA, 14 nt, Human
ugugcguccugucg

SEQ ID NO: 3003261 - RNA, 20 nt, Human
ugugcgugcauguguguuca

SEQ ID NO: 3003262 - RNA, 17 nt, Human
ugugccucugggacugg

SEQ ID NO: 3003263 - RNA, 16 nt, Human
ugugccucugggacug

SEQ ID NO: 3003264 - RNA, 15 nt, Human
ugugccucugggacu

SEQ ID NO: 3003265 - RNA, 13 nt, Human
ugugccucuggga

SEQ ID NO: 3003266 - RNA, 22 nt, Human
ugugcacaugcacgugugugca

SEQ ID NO: 3003267 - RNA, 16 nt, Human
ugugcacaugcacgug

SEQ ID NO: 3003268 - RNA, 15 nt, Human
uguguacuuuuaaga

SEQ ID NO: 3003269 - RNA, 12 nt, Human
uguguacuuuua

SEQ ID NO: 3003270 - RNA, 12 nt, Human
ugugggaagggg

SEQ ID NO: 3003271 - RNA, 12 nt, Human
uguggagaagcg

SEQ ID NO: 3003272 - RNA, 21 nt, Human
uguggagaagcggcuggcagc

SEQ ID NO: 3003273 - RNA, 15 nt, Human
uguggacacagcucu

SEQ ID NO: 3003274 - RNA, 13 nt, Human
uguggacacagcu

SEQ ID NO: 3003275 - RNA, 14 nt, Human
uguggacacagcuc

SEQ ID NO: 3003276 - RNA, 21 nt, Human
uguaacuguuuagaugaaugu

SEQ ID NO: 3003277 - RNA, 15 nt, Human
uguaaucacagcuac

SEQ ID NO: 3003278 - RNA, 14 nt, Human
uguaaucacagcua

SEQ ID NO: 3003279 - RNA, 17 nt, Human
uguaaauuaacuuuuau

SEQ ID NO: 3003280 - RNA, 16 nt, Human
uguaaauuaacuuuua

SEQ ID NO: 3003281 - RNA, 15 nt, Human
uguaaauuaacuuuu

SEQ ID NO: 3003282 - RNA, 14 nt, Human
uguaaauuaacuuu

SEQ ID NO: 3003283 - RNA, 13 nt, Human
uguaaauuaacuu

SEQ ID NO: 3003284 - RNA, 20 nt, Human
uguaaacacaucuaguaguu

SEQ ID NO: 3003285 - RNA, 13 nt, Human
uguaaacacaucu

SEQ ID NO: 3003286 - RNA, 17 nt, Human
uguagauaauacaguuc

SEQ ID NO: 3003287 - RNA, 16 nt, Human
uguacgucugacaggc

SEQ ID NO: 3003288 - RNA, 17 nt, Human
uguacgucugacaggca

SEQ ID NO: 3003289 - RNA, 14 nt, Human
uguaccucuugagc

SEQ ID NO: 3003290 - RNA, 22 nt, Human
uguaccucuugagccuugaacu

SEQ ID NO: 3003291 - RNA, 23 nt, Human
uguaccucuugagccuugaacuu

SEQ ID NO: 3003292 - RNA, 22 nt, Human
ugucaguuguuauuuauugaaa

SEQ ID NO: 3003293 - RNA, 19 nt, Human
ugucaguucugauauggaa

SEQ ID NO: 3003294 - RNA, 17 nt, Human
ugucaguuguuauuuau

SEQ ID NO: 3003295 - RNA, 18 nt, Human
ugucaguuguuauuuauu

SEQ ID NO: 3003296 - RNA, 19 nt, Human
ugucagucugcuuagaaau

SEQ ID NO: 3003297 - RNA, 17 nt, Human
ugucagucugcuuagaa

SEQ ID NO: 3003298 - RNA, 20 nt, Human
ugucagucugcuuagaaaua

SEQ ID NO: 3003299 - RNA, 12 nt, Human
ugucagugugac

SEQ ID NO: 3003300 - RNA, 20 nt, Human
ugucagugugacugaucucu

SEQ ID NO: 3003301 - RNA, 23 nt, Human
uguaucccaugagccucagcauc

SEQ ID NO: 3003302 - RNA, 19 nt, Human
uguaucccaugagccucag

SEQ ID NO: 3003303 - RNA, 16 nt, Human
uguaucccaugagccu

SEQ ID NO: 3003304 - RNA, 15 nt, Human
uguaugcacacacau

SEQ ID NO: 3003305 - RNA, 21 nt, Human
uguaugcacacacauauauua

SEQ ID NO: 3003306 - RNA, 19 nt, Human
uguaugcacacacauauau

SEQ ID NO: 3003307 - RNA, 17 nt, Human
uguaugcacacacauau

SEQ ID NO: 3003308 - RNA, 16 nt, Human
uguaugcacacacaua

SEQ ID NO: 3003309 - RNA, 16 nt, Human
uguaugauucccagcc

SEQ ID NO: 3003310 - RNA, 16 nt, Human
uguugaaacuuuaaga

SEQ ID NO: 3003311 - RNA, 11 nt, Human
uguugaaagau

SEQ ID NO: 3003312 - RNA, 22 nt, Human
uguucuuucuggcuaugcauuu

SEQ ID NO: 3003313 - RNA, 20 nt, Human
uguucuuucuggcuaugcau

SEQ ID NO: 3003314 - RNA, 20 nt, Human
uguucuuuccaaaguacacu

SEQ ID NO: 3003315 - RNA, 15 nt, Human
uguucugacccugcu

SEQ ID NO: 3003316 - RNA, 19 nt, Human
uguucucugcccuccaaga

SEQ ID NO: 3003317 - RNA, 18 nt, Human
uguucugacccugcuuca

SEQ ID NO: 3003318 - RNA, 14 nt, Human
uguucuuucuggcu

SEQ ID NO: 3003319 - RNA, 21 nt, Human
uguucuccagucauuauguua

SEQ ID NO: 3003320 - RNA, 12 nt, Human
uguucucugccc

SEQ ID NO: 3003321 - RNA, 18 nt, Human
uguucucugaggacacua

SEQ ID NO: 3003322 - RNA, 16 nt, Human
uguucucugaggacac

SEQ ID NO: 3003323 - RNA, 13 nt, Human
uguucucugagga

SEQ ID NO: 3003324 - RNA, 20 nt, Human
uguucaugaaagauucaaug

SEQ ID NO: 3003325 - RNA, 15 nt, Human
uguuuaaugguaguu

SEQ ID NO: 3003326 - RNA, 13 nt, Human
uguuuaaaaucau

SEQ ID NO: 3003327 - RNA, 14 nt, Human
uguuggccaggcug

SEQ ID NO: 3003328 - RNA, 19 nt, Human
uguugaagagguuuuaaag

SEQ ID NO: 3003329 - RNA, 21 nt, Human
uguuggagaagaacugaaauc

SEQ ID NO: 3003330 - RNA, 11 nt, Human
uguuggccagg

SEQ ID NO: 3003331 - RNA, 15 nt, Human
uguuggccaaagcca

SEQ ID NO: 3003332 - RNA, 19 nt, Human
ugugugcguccugucggag

SEQ ID NO: 3003333 - RNA, 18 nt, Human
ugugugaauaccccaaga

SEQ ID NO: 3003334 - RNA, 16 nt, Human
uguguagggcgggagg

SEQ ID NO: 3003335 - RNA, 16 nt, Human
uguucacagccagacu

SEQ ID NO: 3003336 - RNA, 14 nt, Human
uguucagcuccagc

SEQ ID NO: 3003337 - RNA, 11 nt, Human
uguucagcugg

SEQ ID NO: 3003338 - RNA, 16 nt, Human
uguucagcuccagcuc

SEQ ID NO: 3003339 - RNA, 15 nt, Human
uguucagcuccagcu

SEQ ID NO: 3003340 - RNA, 14 nt, Human
uguuagugcaaauu

SEQ ID NO: 3003341 - RNA, 13 nt, Human
uguuacauuuuua

SEQ ID NO: 3003342 - RNA, 22 nt, Human
uguuacauuuuuaagugcugca

SEQ ID NO: 3003343 - RNA, 15 nt, Human
uguuacugucuucag

SEQ ID NO: 3003344 - RNA, 16 nt, Human
uguuacugucuucagu

SEQ ID NO: 3003345 - RNA, 15 nt, Human
uguuuuuauuauuaa

SEQ ID NO: 3003346 - RNA, 18 nt, Human
uguuuuuauuauuaacaa

SEQ ID NO: 3003347 - RNA, 17 nt, Human
uguuuugcucaauagau

SEQ ID NO: 3003348 - RNA, 23 nt, Human
uguuuugccaauuugcacauuaa

SEQ ID NO: 3003349 - RNA, 13 nt, Human
uguuuuugucuua

SEQ ID NO: 3003350 - RNA, 20 nt, Human
uguuuccuggcacugcuucc

SEQ ID NO: 3003351 - RNA, 21 nt, Human
uguuuccuggcacugcuucca

SEQ ID NO: 3003352 - RNA, 22 nt, Human
uguuuccuggcacugcuuccag

SEQ ID NO: 3003353 - RNA, 15 nt, Human
uguuuccuggcacug

SEQ ID NO: 3003354 - RNA, 17 nt, Human
uguuuguugucagcuga

SEQ ID NO: 3003355 - RNA, 16 nt, Human
uguuuguugucagcug

SEQ ID NO: 3003356 - RNA, 11 nt, Human
uuaaaugcacc

SEQ ID NO: 3003357 - RNA, 16 nt, Human
uuaaaugcaccuggaa

SEQ ID NO: 3003358 - RNA, 18 nt, Human
uuaaaugcaccuggaaua

SEQ ID NO: 3003359 - RNA, 17 nt, Human
uuaaaugcaccuggaau

SEQ ID NO: 3003360 - RNA, 15 nt, Human
uuaaagcuuccauug

SEQ ID NO: 3003361 - RNA, 19 nt, Human
uuaaauagcuuuuuucucu

SEQ ID NO: 3003362 - RNA, 17 nt, Human
uuaaaugcccagccccu

SEQ ID NO: 3003363 - RNA, 18 nt, Human
uuaaaugcccagccccuu

SEQ ID NO: 3003364 - RNA, 19 nt, Human
uuaaaagaaugauuaugaa

SEQ ID NO: 3003365 - RNA, 13 nt, Human
uuaaaagaaugau

SEQ ID NO: 3003366 - RNA, 18 nt, Human
uuaaacuuaaucuaaaug

SEQ ID NO: 3003367 - RNA, 16 nt, Human
uuaaacuuaaucuaaa

SEQ ID NO: 3003368 - RNA, 20 nt, Human
uuaaacuuaaucuaaaugga

SEQ ID NO: 3003369 - RNA, 20 nt, Human
uuaaagcuuauuaaaacuca

SEQ ID NO: 3003370 - RNA, 18 nt, Human
uuaauaauguuucaaaca

SEQ ID NO: 3003371 - RNA, 16 nt, Human
uuaauagguuuggaca

SEQ ID NO: 3003372 - RNA, 16 nt, Human
uuaauaauguuucaaa

SEQ ID NO: 3003373 - RNA, 22 nt, Human
uuaaggaugcuuguacauaaug

SEQ ID NO: 3003374 - RNA, 20 nt, Human
uuaaggaugcuuguacauaa

SEQ ID NO: 3003375 - RNA, 19 nt, Human
uuaaggaugcuuguacaua

SEQ ID NO: 3003376 - RNA, 18 nt, Human
uuaaggaugcuuguacau

SEQ ID NO: 3003377 - RNA, 17 nt, Human
uuaaggaugcuuguaca

SEQ ID NO: 3003378 - RNA, 21 nt, Human
uuaaggaagacaaugugaaaa

SEQ ID NO: 3003379 - RNA, 22 nt, Human
uuaaugucaauucuugccaaau

SEQ ID NO: 3003380 - RNA, 17 nt, Human
uuaaugucacaggcagg

SEQ ID NO: 3003381 - RNA, 18 nt, Human
uuaaugucacaggcaggu

SEQ ID NO: 3003382 - RNA, 21 nt, Human
uuaauagguuuggacaaaaug

SEQ ID NO: 3003383 - RNA, 22 nt, Human
uuacauuuuuaagugcugcauu

SEQ ID NO: 3003384 - RNA, 21 nt, Human
uuacauuuuuaagugcugcau

SEQ ID NO: 3003385 - RNA, 20 nt, Human
uuacauuuuuaagugcugca

SEQ ID NO: 3003386 - RNA, 21 nt, Human
uuaccacuuguguuuugcaag

SEQ ID NO: 3003387 - RNA, 14 nt, Human
uuaccagcagagca

SEQ ID NO: 3003388 - RNA, 20 nt, Human
uuaccuuuuuuauacauaaa

SEQ ID NO: 3003389 - RNA, 19 nt, Human
uuaccuuuuuuauacauaa

SEQ ID NO: 3003390 - RNA, 22 nt, Human
uuaccuuuuuuauacauaaaca

SEQ ID NO: 3003391 - RNA, 23 nt, Human
uuacgaaaaaaugguagcauuuu

SEQ ID NO: 3003392 - RNA, 20 nt, Human
uuacgguuuuccagguuuaa

SEQ ID NO: 3003393 - RNA, 16 nt, Human
uuacggaacucaaaua

SEQ ID NO: 3003394 - RNA, 22 nt, Human
uuacauggcuggagcuagaauu

SEQ ID NO: 3003395 - RNA, 23 nt, Human
uuacauggcuggagcuagaauuu

SEQ ID NO: 3003396 - RNA, 15 nt, Human
uuacauuuguauaaa

SEQ ID NO: 3003397 - RNA, 14 nt, Human
uuacauuuguauaa

SEQ ID NO: 3003398 - RNA, 20 nt, Human
uuacagagacagaaagcaga

SEQ ID NO: 3003399 - RNA, 22 nt, Human
ugccuaauaugaugacuguuuu

SEQ ID NO: 3003400 - RNA, 17 nt, Human
ugccuaauaugaugacu

SEQ ID NO: 3003401 - RNA, 17 nt, Human
ugccuaccaauauuuaa

SEQ ID NO: 3003402 - RNA, 23 nt, Human
ugccuaccaauauuuaaucuuuu

SEQ ID NO: 3003403 - RNA, 23 nt, Human
ugccuccccuccucugcuugcca

SEQ ID NO: 3003404 - RNA, 22 nt, Human
ugccuccccuccucugcuugcc

SEQ ID NO: 3003405 - RNA, 19 nt, Human
ugccuccccuccucugcuu

SEQ ID NO: 3003406 - RNA, 18 nt, Human
ugccuccccuccucugcu

SEQ ID NO: 3003407 - RNA, 11 nt, Human
ugcccagcccc

SEQ ID NO: 3003408 - RNA, 23 nt, Human
ugcccaggcuggcgugcaguggu

SEQ ID NO: 3003409 - RNA, 17 nt, Human
ugccugaagucacacag

SEQ ID NO: 3003410 - RNA, 18 nt, Human
ugccugaagucacacagu

SEQ ID NO: 3003411 - RNA, 22 nt, Human
ugccugaagucacacagugagu

SEQ ID NO: 3003412 - RNA, 17 nt, Human
ugccuccuuugugagga

SEQ ID NO: 3003413 - RNA, 18 nt, Human
ugccuccuuugugaggaa

SEQ ID NO: 3003414 - RNA, 16 nt, Human
ugccuccuuugugagg

SEQ ID NO: 3003415 - RNA, 16 nt, Human
ugccuccccuccucug

SEQ ID NO: 3003416 - RNA, 14 nt, Human
ugccucugggacug

SEQ ID NO: 3003417 - RNA, 22 nt, Human
ugccuucucaacuccaaacuga

SEQ ID NO: 3003418 - RNA, 17 nt, Human
ugccuucucaacuccaa

SEQ ID NO: 3003419 - RNA, 23 nt, Human
ugcggugcuaucucccccagccc

SEQ ID NO: 3003420 - RNA, 18 nt, Human
ugccuuauggaacacucu

SEQ ID NO: 3003421 - RNA, 20 nt, Human
ugccuuauggaacacucuga

SEQ ID NO: 3003422 - RNA, 21 nt, Human
ugccuuauggaacacucugag

SEQ ID NO: 3003423 - RNA, 22 nt, Human
ugccuuauggaacacucugaga

SEQ ID NO: 3003424 - RNA, 18 nt, Human
ugcuagaacucccuuuca

SEQ ID NO: 3003425 - RNA, 19 nt, Human
ugcuagaacucccuuucaa

SEQ ID NO: 3003426 - RNA, 15 nt, Human
ugcgugcauaccacu

SEQ ID NO: 3003427 - RNA, 21 nt, Human
ugcuagaacucccuuucaaca

SEQ ID NO: 3003428 - RNA, 20 nt, Human
ugcuagaacucccuuucaac

SEQ ID NO: 3003429 - RNA, 17 nt, Human
ugcuaggaacacuccuu

SEQ ID NO: 3003430 - RNA, 19 nt, Human
ugcuaggaacacuccuuca

SEQ ID NO: 3003431 - RNA, 16 nt, Human
ugcuaggaacacuccu

SEQ ID NO: 3003432 - RNA, 19 nt, Human
ugcuccucuccccagcaag

SEQ ID NO: 3003433 - RNA, 18 nt, Human
ugcuccucuccccagcaa

SEQ ID NO: 3003434 - RNA, 23 nt, Human
ugcugaguguacagaguggaaua

SEQ ID NO: 3003435 - RNA, 16 nt, Human
ugcugacagacacagg

SEQ ID NO: 3003436 - RNA, 15 nt, Human
ugcugacagacacag

SEQ ID NO: 3003437 - RNA, 20 nt, Human
ugcugauggugcaaugaccu

SEQ ID NO: 3003438 - RNA, 23 nt, Human
ugcugauggugcaaugaccuuuc

SEQ ID NO: 3003439 - RNA, 15 nt, Human
ugcugcaguugccag

SEQ ID NO: 3003440 - RNA, 16 nt, Human
ugcugcaguugccagu

SEQ ID NO: 3003441 - RNA, 19 nt, Human
ugcuccuggcccacugcau

SEQ ID NO: 3003442 - RNA, 20 nt, Human
ugcuccugggcuacaaggac

SEQ ID NO: 3003443 - RNA, 22 nt, Human
ugcugaaugguuuucaaaauaa

SEQ ID NO: 3003444 - RNA, 18 nt, Human
ugcugaaugguuuucaaa

SEQ ID NO: 3003445 - RNA, 17 nt, Human
ugcugaaugguuuucaa

SEQ ID NO: 3003446 - RNA, 18 nt, Human
ugcugaauacagaggcaa

SEQ ID NO: 3003447 - RNA, 23 nt, Human
ugcugaauacagaggcaacugca

SEQ ID NO: 3003448 - RNA, 21 nt, Human
ugcugaaggcucgagcaugcc

SEQ ID NO: 3003449 - RNA, 21 nt, Human
ugcacacuguccuauuauauu

SEQ ID NO: 3003450 - RNA, 22 nt, Human
ugaagucuuuguacagacaaca

SEQ ID NO: 3003451 - RNA, 13 nt, Human
ugcacacuuuggc

SEQ ID NO: 3003452 - RNA, 16 nt, Human
ugcacacuuuggccca

SEQ ID NO: 3003453 - RNA, 20 nt, Human
ugcacacuuuggcccagggu

SEQ ID NO: 3003454 - RNA, 19 nt, Human
ugcacacuuuggcccaggg

SEQ ID NO: 3003455 - RNA, 18 nt, Human
ugcacacuuuggcccagg

SEQ ID NO: 3003456 - RNA, 17 nt, Human
ugcacacuuuggcccag

SEQ ID NO: 3003457 - RNA, 17 nt, Human
ugaagucuuuguacaga

SEQ ID NO: 3003458 - RNA, 20 nt, Human
ugaagucuuuguacagacaa

SEQ ID NO: 3003459 - RNA, 22 nt, Human
ugcacagaguuguuacauuuuu

SEQ ID NO: 3003460 - RNA, 21 nt, Human
ugcacagaguuguuacauuuu

SEQ ID NO: 3003461 - RNA, 20 nt, Human
ugcacagaguuguuacauuu

SEQ ID NO: 3003462 - RNA, 21 nt, Human
ugcacacuuuggcccagggug

SEQ ID NO: 3003463 - RNA, 23 nt, Human
ugcacagaguuguuacauuuuua

SEQ ID NO: 3003464 - RNA, 18 nt, Human
ugcacagcaggcugccag

SEQ ID NO: 3003465 - RNA, 17 nt, Human
ugcacagcuaacaugga

SEQ ID NO: 3003466 - RNA, 23 nt, Human
ugcacagcaggcugccagugccu

SEQ ID NO: 3003467 - RNA, 22 nt, Human
ugcacagcaggcugccagugcc

SEQ ID NO: 3003468 - RNA, 21 nt, Human
ugcacagcaggcugccagugc

SEQ ID NO: 3003469 - RNA, 13 nt, Human
ugcacaucuguuu

SEQ ID NO: 3003470 - RNA, 15 nt, Human
ugcacaucaaaauau

SEQ ID NO: 3003471 - RNA, 18 nt, Human
ugcacagcuaacauggaa

SEQ ID NO: 3003472 - RNA, 20 nt, Human
ugcacagcuaacauggaagu

SEQ ID NO: 3003473 - RNA, 23 nt, Human
ugcacagcuaacauggaaguacu

SEQ ID NO: 3003474 - RNA, 15 nt, Human
ugcacuuuguucugg

SEQ ID NO: 3003475 - RNA, 18 nt, Human
ugcacuuuguucuggcuc

SEQ ID NO: 3003476 - RNA, 19 nt, Human
ugcacuuuguucuggcucu

SEQ ID NO: 3003477 - RNA, 20 nt, Human
ugcacuuuguucuggcucuu

SEQ ID NO: 3003478 - RNA, 16 nt, Human
ugcagauaaacaguag

SEQ ID NO: 3003479 - RNA, 16 nt, Human
ugcacguacacacaca

SEQ ID NO: 3003480 - RNA, 16 nt, Human
ugcacuugcagacucu

SEQ ID NO: 3003481 - RNA, 21 nt, Human
ugcacuugcagacucuacaga

SEQ ID NO: 3003482 - RNA, 16 nt, Human
ugcagcaauaaagcag

SEQ ID NO: 3003483 - RNA, 15 nt, Human
ugcagcaauaaagca

SEQ ID NO: 3003484 - RNA, 14 nt, Human
ugcagcaauaaagc

SEQ ID NO: 3003485 - RNA, 14 nt, Human
ugcaggaccucagg

SEQ ID NO: 3003486 - RNA, 15 nt, Human
ugcaggaccucaggu

SEQ ID NO: 3003487 - RNA, 16 nt, Human
ugcaggaccucaggug

SEQ ID NO: 3003488 - RNA, 18 nt, Human
ugcaggaccucaggugag

SEQ ID NO: 3003489 - RNA, 20 nt, Human
ugccaucccucccuccaccu

SEQ ID NO: 3003490 - RNA, 19 nt, Human
ugccaucccucccuccacc

SEQ ID NO: 3003491 - RNA, 14 nt, Human
ugccaucccucccu

SEQ ID NO: 3003492 - RNA, 15 nt, Human
ugccaucccucccuc

SEQ ID NO: 3003493 - RNA, 22 nt, Human
ugccaucccucccuccaccucc

SEQ ID NO: 3003494 - RNA, 21 nt, Human
ugccaucccucccuccaccuc

SEQ ID NO: 3003495 - RNA, 13 nt, Human
ugccauccuggcc

SEQ ID NO: 3003496 - RNA, 14 nt, Human
ugccagucaccccg

SEQ ID NO: 3003497 - RNA, 24 nt, Human
ugccagguuuuuggucugacccac

SEQ ID NO: 3003498 - RNA, 11 nt, Human
ugccagggaca

SEQ ID NO: 3003499 - RNA, 22 nt, Human
ugccagggacagaggggguggc

SEQ ID NO: 3003500 - RNA, 15 nt, Human
ugcccaccuggccuc

SEQ ID NO: 3003501 - RNA, 17 nt, Human
ugcccaccuggccucug

SEQ ID NO: 3003502 - RNA, 18 nt, Human
ugcccaccuggccucugc

SEQ ID NO: 3003503 - RNA, 14 nt, Human
ugcccaccuggccu

SEQ ID NO: 3003504 - RNA, 10 nt, Human
ugcccagccc

SEQ ID NO: 3003505 - RNA, 21 nt, Human
ugccauccuggcccagggcau

SEQ ID NO: 3003506 - RNA, 18 nt, Human
ugccauccuggcccaggg

SEQ ID NO: 3003507 - RNA, 16 nt, Human
ugccauccuggcccag

SEQ ID NO: 3003508 - RNA, 15 nt, Human
ugccauccuggccca

SEQ ID NO: 3003509 - RNA, 17 nt, Human
ugcaggcagccaggcca

SEQ ID NO: 3003510 - RNA, 18 nt, Human
ugcaggcagccaggccac

SEQ ID NO: 3003511 - RNA, 19 nt, Human
ugcaggcagccaggccaca

SEQ ID NO: 3003512 - RNA, 19 nt, Human
ugcaucagcugcugaaaca

SEQ ID NO: 3003513 - RNA, 22 nt, Human
ugcaucagcugcugaaacaaca

SEQ ID NO: 3003514 - RNA, 16 nt, Human
ugcaggcagccaggcc

SEQ ID NO: 3003515 - RNA, 15 nt, Human
ugcaucguuucaucu

SEQ ID NO: 3003516 - RNA, 20 nt, Human
ugcauuauauuuauuacugu

SEQ ID NO: 3003517 - RNA, 14 nt, Human
ugcauuauauuuau

SEQ ID NO: 3003518 - RNA, 15 nt, Human
ugcauuauauuuauu

SEQ ID NO: 3003519 - RNA, 19 nt, Human
ugcauguuacauaagauaa

SEQ ID NO: 3003520 - RNA, 23 nt, Human
uggggcagugcuuggcccaggag

SEQ ID NO: 3003521 - RNA, 20 nt, Human
uggggcagugcuuggcccag

SEQ ID NO: 3003522 - RNA, 22 nt, Human
uggggcagugcuuggcccagga

SEQ ID NO: 3003523 - RNA, 17 nt, Human
ugggguggggaccucag

SEQ ID NO: 3003524 - RNA, 18 nt, Human
uggggcagugcuuggccc

SEQ ID NO: 3003525 - RNA, 16 nt, Human
uggguagacacacaug

SEQ ID NO: 3003526 - RNA, 17 nt, Human
uggguagacacacauga

SEQ ID NO: 3003527 - RNA, 13 nt, Human
uggguuuauuugg

SEQ ID NO: 3003528 - RNA, 23 nt, Human
ugggugucaagagggucugagga

SEQ ID NO: 3003529 - RNA, 21 nt, Human
ugggugucaagagggucugag

SEQ ID NO: 3003530 - RNA, 16 nt, Human
uggguucacugcaacc

SEQ ID NO: 3003531 - RNA, 23 nt, Human
uggguucaagcgauucuucugcu

SEQ ID NO: 3003532 - RNA, 24 nt, Human
ugggagcugccuguucagcuccag

SEQ ID NO: 3003533 - RNA, 16 nt, Human
ugggagcugucaagca

SEQ ID NO: 3003534 - RNA, 16 nt, Human
ugggagcuuuuguaga

SEQ ID NO: 3003535 - RNA, 22 nt, Human
ugggccuccugugugugcgccu

SEQ ID NO: 3003536 - RNA, 16 nt, Human
ugggccuccugugugu

SEQ ID NO: 3003537 - RNA, 14 nt, Human
ugggccuccugugu

SEQ ID NO: 3003538 - RNA, 19 nt, Human
ugggcuucaguggcagcug

SEQ ID NO: 3003539 - RNA, 18 nt, Human
ugggcuucaguggcagcu

SEQ ID NO: 3003540 - RNA, 13 nt, Human
uggggcagcuuga

SEQ ID NO: 3003541 - RNA, 21 nt, Human
ugggcuuggggaccagagcug

SEQ ID NO: 3003542 - RNA, 16 nt, Human
uggggcagcuugaggg

SEQ ID NO: 3003543 - RNA, 19 nt, Human
ugggcuuggggaccagagc

SEQ ID NO: 3003544 - RNA, 20 nt, Human
ugggcuucaguggcagcugc

SEQ ID NO: 3003545 - RNA, 14 nt, Human
uggccuucggccuc

SEQ ID NO: 3003546 - RNA, 18 nt, Human
uggccuucggccuccauc

SEQ ID NO: 3003547 - RNA, 17 nt, Human
uggccuucggccuccau

SEQ ID NO: 3003548 - RNA, 15 nt, Human
uggccagaugcacca

SEQ ID NO: 3003549 - RNA, 19 nt, Human
uggcgagccauuuguccca

SEQ ID NO: 3003550 - RNA, 14 nt, Human
uggcgagccauuug

SEQ ID NO: 3003551 - RNA, 14 nt, Human
uggcgcugccccug

SEQ ID NO: 3003552 - RNA, 14 nt, Human
uggcgugaacccag

SEQ ID NO: 3003553 - RNA, 22 nt, Human
uggcgugcaguggugcgaucug

SEQ ID NO: 3003554 - RNA, 13 nt, Human
uggcucuuccagg

SEQ ID NO: 3003555 - RNA, 15 nt, Human
uggcucuuccaggcu

SEQ ID NO: 3003556 - RNA, 12 nt, Human
uggcugggggcc

SEQ ID NO: 3003557 - RNA, 16 nt, Human
uggcucuuccaggcug

SEQ ID NO: 3003558 - RNA, 20 nt, Human
uggcucagguggggucacuc

SEQ ID NO: 3003559 - RNA, 22 nt, Human
uggcucagguggggucacucug

SEQ ID NO: 3003560 - RNA, 20 nt, Human
ugggacauuugcucauggaa

SEQ ID NO: 3003561 - RNA, 19 nt, Human
ugggacauuugcucaugga

SEQ ID NO: 3003562 - RNA, 16 nt, Human
ugggacaugggaaagg

SEQ ID NO: 3003563 - RNA, 23 nt, Human
ugggagcugccuguucagcucca

SEQ ID NO: 3003564 - RNA, 21 nt, Human
ugggacagucaccucauggaa

SEQ ID NO: 3003565 - RNA, 20 nt, Human
ugggacagucaccucaugga

SEQ ID NO: 3003566 - RNA, 18 nt, Human
ugggacagucaccucaug

SEQ ID NO: 3003567 - RNA, 22 nt, Human
ugggaaugaaugucagugugac

SEQ ID NO: 3003568 - RNA, 22 nt, Human
uggcugguuagagguucccuuu

SEQ ID NO: 3003569 - RNA, 14 nt, Human
uggcugggggccuc

SEQ ID NO: 3003570 - RNA, 17 nt, Human
uggccagaagucaaggc

SEQ ID NO: 3003571 - RNA, 20 nt, Human
uggcagugggagcugccugu

SEQ ID NO: 3003572 - RNA, 19 nt, Human
uggcagugggagcugccug

SEQ ID NO: 3003573 - RNA, 16 nt, Human
uggcagugggagcugc

SEQ ID NO: 3003574 - RNA, 15 nt, Human
uggcagugggagcug

SEQ ID NO: 3003575 - RNA, 14 nt, Human
uggcagugggagcu

SEQ ID NO: 3003576 - RNA, 13 nt, Human
uggcagugggagc

SEQ ID NO: 3003577 - RNA, 22 nt, Human
uggcagcugcgguccacccagg

SEQ ID NO: 3003578 - RNA, 21 nt, Human
uggcagcugcgguccacccag

SEQ ID NO: 3003579 - RNA, 23 nt, Human
uggcagcugcgguccacccagga

SEQ ID NO: 3003580 - RNA, 14 nt, Human
uggcaggcaccugu

SEQ ID NO: 3003581 - RNA, 19 nt, Human
uggcagcugcgguccaccc

SEQ ID NO: 3003582 - RNA, 14 nt, Human
uggaugccuggugg

SEQ ID NO: 3003583 - RNA, 14 nt, Human
uggcacugcuucca

SEQ ID NO: 3003584 - RNA, 16 nt, Human
uggcacugcuuccagu

SEQ ID NO: 3003585 - RNA, 18 nt, Human
uggcacugcuuccaguga

SEQ ID NO: 3003586 - RNA, 16 nt, Human
uggacaggcauguucu

SEQ ID NO: 3003587 - RNA, 12 nt, Human
uggacaggcaug

SEQ ID NO: 3003588 - RNA, 22 nt, Human
uggaggcaugugaugagaggaa

SEQ ID NO: 3003589 - RNA, 21 nt, Human
uggauauagcuaggugacaua

SEQ ID NO: 3003590 - RNA, 23 nt, Human
uggauauagcuaggugacauaua

SEQ ID NO: 3003591 - RNA, 15 nt, Human
ugcuuuuuuuggccu

SEQ ID NO: 3003592 - RNA, 16 nt, Human
ugcuucuucagagacu

SEQ ID NO: 3003593 - RNA, 14 nt, Human
ugcuucuguuuuau

SEQ ID NO: 3003594 - RNA, 19 nt, Human
ugcuuccagugaggcucug

SEQ ID NO: 3003595 - RNA, 20 nt, Human
ugcuuccagugaggcucugc

SEQ ID NO: 3003596 - RNA, 18 nt, Human
ugcuuccagugaggcucu

SEQ ID NO: 3003597 - RNA, 14 nt, Human
uggaacucucgagc

SEQ ID NO: 3003598 - RNA, 11 nt, Human
uggaagacagc

SEQ ID NO: 3003599 - RNA, 12 nt, Human
uggaagacagcu

SEQ ID NO: 3003600 - RNA, 22 nt, Human
uggaaaaguauguuagugcaaa

SEQ ID NO: 3003601 - RNA, 16 nt, Human
uggaaaauaaauuauu

SEQ ID NO: 3003602 - RNA, 15 nt, Human
uggaaaauaaauuau

SEQ ID NO: 3003603 - RNA, 14 nt, Human
uggaagacagcucu

SEQ ID NO: 3003604 - RNA, 16 nt, Human
uggaauacucuuauau

SEQ ID NO: 3003605 - RNA, 16 nt, Human
uggaauaucuccguca

SEQ ID NO: 3003606 - RNA, 13 nt, Human
ucuucuauauaau

SEQ ID NO: 3003607 - RNA, 12 nt, Human
ucuucuauuuau

SEQ ID NO: 3003608 - RNA, 22 nt, Human
ucuucuauauaauuccuguuuu

SEQ ID NO: 3003609 - RNA, 22 nt, Human
ucuucuauuuauuuauuuauuc

SEQ ID NO: 3003610 - RNA, 19 nt, Human
ucuucuccacuuucuagcc

SEQ ID NO: 3003611 - RNA, 21 nt, Human
ucuucuccacuuucuagccag

SEQ ID NO: 3003612 - RNA, 21 nt, Human
ucuuccacaagagcccaggcc

SEQ ID NO: 3003613 - RNA, 16 nt, Human
ucuucaguaagccgug

SEQ ID NO: 3003614 - RNA, 14 nt, Human
ucuuccaggcuggg

SEQ ID NO: 3003615 - RNA, 14 nt, Human
ucuuauacauuuga

SEQ ID NO: 3003616 - RNA, 15 nt, Human
ucuuauacauuugau

SEQ ID NO: 3003617 - RNA, 16 nt, Human
ucuuaguggauguucu

SEQ ID NO: 3003618 - RNA, 14 nt, Human
ucuuagugugugca

SEQ ID NO: 3003619 - RNA, 13 nt, Human
ucuuaaaaagugg

SEQ ID NO: 3003620 - RNA, 15 nt, Human
ucuucaguaagccgu

SEQ ID NO: 3003621 - RNA, 13 nt, Human
ucuuaugggcugg

SEQ ID NO: 3003622 - RNA, 12 nt, Human
ucuucuccaggc

SEQ ID NO: 3003623 - RNA, 14 nt, Human
ucuucuccaggcug

SEQ ID NO: 3003624 - RNA, 13 nt, Human
ucuucuccaggcu

SEQ ID NO: 3003625 - RNA, 18 nt, Human
ucuugaacuccuggccuc

SEQ ID NO: 3003626 - RNA, 17 nt, Human
ucuugaacuccuggccu

SEQ ID NO: 3003627 - RNA, 16 nt, Human
ucuugaacuccuggcc

SEQ ID NO: 3003628 - RNA, 21 nt, Human
ucuugaauuguaaggaaugau

SEQ ID NO: 3003629 - RNA, 11 nt, Human
ucuugcucugc

SEQ ID NO: 3003630 - RNA, 13 nt, Human
ucuugcucugcug

SEQ ID NO: 3003631 - RNA, 12 nt, Human
ucuugcucugcu

SEQ ID NO: 3003632 - RNA, 20 nt, Human
ucuguuacacaaagaaccac

SEQ ID NO: 3003633 - RNA, 18 nt, Human
ucuuaaaaaguggaaaaa

SEQ ID NO: 3003634 - RNA, 22 nt, Human
ucuguuuuauaauuuugugaag

SEQ ID NO: 3003635 - RNA, 20 nt, Human
ucuguuuuauaauuuuguga

SEQ ID NO: 3003636 - RNA, 17 nt, Human
ucuguacgucugacagg

SEQ ID NO: 3003637 - RNA, 22 nt, Human
ucuguggguuucuaaagcugcc

SEQ ID NO: 3003638 - RNA, 19 nt, Human
ucuguccgagcuuugaaaa

SEQ ID NO: 3003639 - RNA, 23 nt, Human
ucuguggguuucuaaagcugcca

SEQ ID NO: 3003640 - RNA, 22 nt, Human
ucugugucagguggggcagcuu

SEQ ID NO: 3003641 - RNA, 19 nt, Human
ucuguaauaaacucauuuc

SEQ ID NO: 3003642 - RNA, 23 nt, Human
ucuguaauaaacucauuucuagc

SEQ ID NO: 3003643 - RNA, 24 nt, Human
ucuguaauaaacucauuucuagca

SEQ ID NO: 3003644 - RNA, 23 nt, Human
ucuguacagagcccacgccccca

SEQ ID NO: 3003645 - RNA, 12 nt, Human
ucugggacacag

SEQ ID NO: 3003646 - RNA, 15 nt, Human
ucuggcucuuccagg

SEQ ID NO: 3003647 - RNA, 16 nt, Human
ucuggcucuuccaggc

SEQ ID NO: 3003648 - RNA, 17 nt, Human
ucuggcucuuccaggcu

SEQ ID NO: 3003649 - RNA, 23 nt, Human
ucuggccuucggccuccauccug

SEQ ID NO: 3003650 - RNA, 14 nt, Human
ucuggcuaugcauu

SEQ ID NO: 3003651 - RNA, 14 nt, Human
ucuuuuugaaaugu

SEQ ID NO: 3003652 - RNA, 16 nt, Human
ucuuuuugcuuugcuu

SEQ ID NO: 3003653 - RNA, 15 nt, Human
ugaaaagacuccaaa

SEQ ID NO: 3003654 - RNA, 16 nt, Human
ugaaaagacuccaaag

SEQ ID NO: 3003655 - RNA, 17 nt, Human
ugaaaagacuccaaaga

SEQ ID NO: 3003656 - RNA, 19 nt, Human
ugaaaagacuccaaagaaa

SEQ ID NO: 3003657 - RNA, 19 nt, Human
ugaaaacuuuaugcuaagu

SEQ ID NO: 3003658 - RNA, 19 nt, Human
ucuuuugccguuauuaaaa

SEQ ID NO: 3003659 - RNA, 17 nt, Human
ucuuuugccguuauuaa

SEQ ID NO: 3003660 - RNA, 19 nt, Human
ugaaagcagggacuugaac

SEQ ID NO: 3003661 - RNA, 18 nt, Human
ugaaagcagggacuugaa

SEQ ID NO: 3003662 - RNA, 17 nt, Human
ugaaaggaaagaggcuc

SEQ ID NO: 3003663 - RNA, 12 nt, Human
ugaaaggaaaga

SEQ ID NO: 3003664 - RNA, 13 nt, Human
ugaaagauucaau

SEQ ID NO: 3003665 - RNA, 22 nt, Human
ugaaaagacuccaaagaaaugu

SEQ ID NO: 3003666 - RNA, 18 nt, Human
ugaaacccugucucuacu

SEQ ID NO: 3003667 - RNA, 22 nt, Human
ugaaaugaggucagagccugca

SEQ ID NO: 3003668 - RNA, 21 nt, Human
ugaaaugaggucagagccugc

SEQ ID NO: 3003669 - RNA, 23 nt, Human
ugaaaugaggucagagccugcag

SEQ ID NO: 3003670 - RNA, 20 nt, Human
ugaaaugaggucagagccug

SEQ ID NO: 3003671 - RNA, 19 nt, Human
ugaaaugaggucagagccu

SEQ ID NO: 3003672 - RNA, 17 nt, Human
ugaaagggcccagagag

SEQ ID NO: 3003673 - RNA, 16 nt, Human
ugaaagggcccagaga

SEQ ID NO: 3003674 - RNA, 15 nt, Human
ugaaagggcccagag

SEQ ID NO: 3003675 - RNA, 17 nt, Human
ugaaaucuuuuugcuuu

SEQ ID NO: 3003676 - RNA, 19 nt, Human
ugaaaucuaggaaaauuau

SEQ ID NO: 3003677 - RNA, 18 nt, Human
ugaaaucuaggaaaauua

SEQ ID NO: 3003678 - RNA, 17 nt, Human
ugaaaucuaggaaaauu

SEQ ID NO: 3003679 - RNA, 15 nt, Human
ugaaaucuaggaaaa

SEQ ID NO: 3003680 - RNA, 14 nt, Human
ugaagacagagcua

SEQ ID NO: 3003681 - RNA, 16 nt, Human
ugaagacagagcuaca

SEQ ID NO: 3003682 - RNA, 14 nt, Human
ugaacuuggcgcug

SEQ ID NO: 3003683 - RNA, 12 nt, Human
ugaacuugguuc

SEQ ID NO: 3003684 - RNA, 19 nt, Human
ugaacuggguacuugugga

SEQ ID NO: 3003685 - RNA, 17 nt, Human
ugaagacuuuucuuuca

SEQ ID NO: 3003686 - RNA, 22 nt, Human
ugaagacuuuucuuucagccaa

SEQ ID NO: 3003687 - RNA, 14 nt, Human
ugaagacuuuucuu

SEQ ID NO: 3003688 - RNA, 21 nt, Human
ugaaggcucgagcaugccugg

SEQ ID NO: 3003689 - RNA, 22 nt, Human
ugaaguccaagcauuuagaugu

SEQ ID NO: 3003690 - RNA, 21 nt, Human
ugaaguccaagcauuuagaug

SEQ ID NO: 3003691 - RNA, 20 nt, Human
ugaaggcucgagcaugccug

SEQ ID NO: 3003692 - RNA, 14 nt, Human
ugaacacaucagcu

SEQ ID NO: 3003693 - RNA, 19 nt, Human
ugaaccacaucuugcucug

SEQ ID NO: 3003694 - RNA, 15 nt, Human
ugaacucuucaaucu

SEQ ID NO: 3003695 - RNA, 22 nt, Human
ugaaccacaucuugcucugcug

SEQ ID NO: 3003696 - RNA, 21 nt, Human
ugaaccacaucuugcucugcu

SEQ ID NO: 3003697 - RNA, 20 nt, Human
ugaaccacaucuugcucugc

SEQ ID NO: 3003698 - RNA, 18 nt, Human
ugaacucuucaaucucuu

SEQ ID NO: 3003699 - RNA, 13 nt, Human
ugaacugauaaag

SEQ ID NO: 3003700 - RNA, 15 nt, Human
ugaacugauaaagau

SEQ ID NO: 3003701 - RNA, 20 nt, Human
ugaacugaucauguuuauga

SEQ ID NO: 3003702 - RNA, 17 nt, Human
ucucaaacuaacaggcu

SEQ ID NO: 3003703 - RNA, 15 nt, Human
ucucaaacuaacagg

SEQ ID NO: 3003704 - RNA, 19 nt, Human
ucuaguaguuguucugaaa

SEQ ID NO: 3003705 - RNA, 21 nt, Human
ucucaaacucuugaccucagg

SEQ ID NO: 3003706 - RNA, 13 nt, Human
ucucaaacucuug

SEQ ID NO: 3003707 - RNA, 22 nt, Human
ucucaaacucuugaccucaggu

SEQ ID NO: 3003708 - RNA, 17 nt, Human
ucucacucugucgccca

SEQ ID NO: 3003709 - RNA, 16 nt, Human
ucucacucugucgccc

SEQ ID NO: 3003710 - RNA, 22 nt, Human
ucucacucugucgcccagucug

SEQ ID NO: 3003711 - RNA, 18 nt, Human
ucucacucugucgcccag

SEQ ID NO: 3003712 - RNA, 21 nt, Human
ucucacuguugcccaggcugg

SEQ ID NO: 3003713 - RNA, 20 nt, Human
ucucacuguugcccaggcug

SEQ ID NO: 3003714 - RNA, 19 nt, Human
ucucacuguugcccaggcu

SEQ ID NO: 3003715 - RNA, 18 nt, Human
ucucacuguugcccaggc

SEQ ID NO: 3003716 - RNA, 21 nt, Human
ucucagaaucucaaauaacua

SEQ ID NO: 3003717 - RNA, 17 nt, Human
ucucagaaucucaaaua

SEQ ID NO: 3003718 - RNA, 17 nt, Human
ucucacuguugcccagg

SEQ ID NO: 3003719 - RNA, 12 nt, Human
ucuacacugugc

SEQ ID NO: 3003720 - RNA, 14 nt, Human
ucuacacugugcug

SEQ ID NO: 3003721 - RNA, 17 nt, Human
ucuacacuccagugaga

SEQ ID NO: 3003722 - RNA, 17 nt, Human
ucuacacuaagagagaa

SEQ ID NO: 3003723 - RNA, 19 nt, Human
ucuacugaggugcuauguu

SEQ ID NO: 3003724 - RNA, 18 nt, Human
ucuacugaggugcuaugu

SEQ ID NO: 3003725 - RNA, 15 nt, Human
ucuacacugugcuga

SEQ ID NO: 3003726 - RNA, 22 nt, Human
ucuacugaggugcuauguucuu

SEQ ID NO: 3003727 - RNA, 22 nt, Human
ucuagggaaaaaccagcgugug

SEQ ID NO: 3003728 - RNA, 19 nt, Human
ucuagggaaaaaccagcgu

SEQ ID NO: 3003729 - RNA, 22 nt, Human
ucuaaaucuccaaaauaaaacu

SEQ ID NO: 3003730 - RNA, 16 nt, Human
ucuaaauucuuucauu

SEQ ID NO: 3003731 - RNA, 16 nt, Human
ucuaacuucaccauau

SEQ ID NO: 3003732 - RNA, 15 nt, Human
ucuaacuucaccaua

SEQ ID NO: 3003733 - RNA, 22 nt, Human
ucuaacuucaccauauuaccac

SEQ ID NO: 3003734 - RNA, 21 nt, Human
ucuacacuaagagagaaugag

SEQ ID NO: 3003735 - RNA, 15 nt, Human
uccuugcaucaauuu

SEQ ID NO: 3003736 - RNA, 19 nt, Human
uccuucuguccuacucugu

SEQ ID NO: 3003737 - RNA, 12 nt, Human
uccuucuguccu

SEQ ID NO: 3003738 - RNA, 23 nt, Human
uccugguccccucagcucugccu

SEQ ID NO: 3003739 - RNA, 10 nt, Human
ucccucccuu

SEQ ID NO: 3003740 - RNA, 22 nt, Human
uccuggcaugggaaugaauguc

SEQ ID NO: 3003741 - RNA, 17 nt, Human
uccuggcccacugcauc

SEQ ID NO: 3003742 - RNA, 15 nt, Human
uccugguguggaaga

SEQ ID NO: 3003743 - RNA, 15 nt, Human
ucgaguuacagacaa

SEQ ID NO: 3003744 - RNA, 17 nt, Human
ucgaguuacagacaaag

SEQ ID NO: 3003745 - RNA, 18 nt, Human
ucucuucacagucacauu

SEQ ID NO: 3003746 - RNA, 13 nt, Human
ucugaaagggacg

SEQ ID NO: 3003747 - RNA, 23 nt, Human
ucugaaaauguauguguaaguau

SEQ ID NO: 3003748 - RNA, 14 nt, Human
ucugaaaauguaug

SEQ ID NO: 3003749 - RNA, 14 nt, Human
ucugaaauuuccug

SEQ ID NO: 3003750 - RNA, 21 nt, Human
ucugaaaugucaguucugaua

SEQ ID NO: 3003751 - RNA, 16 nt, Human
ucucuuuucaaaacau

SEQ ID NO: 3003752 - RNA, 15 nt, Human
ucucuuuucaaaaca

SEQ ID NO: 3003753 - RNA, 16 nt, Human
ucugaaaauguaugug

SEQ ID NO: 3003754 - RNA, 23 nt, Human
ucugaggacacuaaccacgcugg

SEQ ID NO: 3003755 - RNA, 20 nt, Human
ucugaggacacuaaccacgc

SEQ ID NO: 3003756 - RNA, 17 nt, Human
ucugaggaauccagacc

SEQ ID NO: 3003757 - RNA, 16 nt, Human
ucugaggaauccagac

SEQ ID NO: 3003758 - RNA, 19 nt, Human
ucugauucccugauuuaau

SEQ ID NO: 3003759 - RNA, 23 nt, Human
ucugauucccaagcucugcuccu

SEQ ID NO: 3003760 - RNA, 14 nt, Human
ucugcacaagcugc

SEQ ID NO: 3003761 - RNA, 19 nt, Human
ucugcacaagcugcacccu

SEQ ID NO: 3003762 - RNA, 15 nt, Human
ucugacccaugcugc

SEQ ID NO: 3003763 - RNA, 16 nt, Human
ucugacccaugcugcc

SEQ ID NO: 3003764 - RNA, 17 nt, Human
ucugacccaugcugccc

SEQ ID NO: 3003765 - RNA, 18 nt, Human
ucugacccaugcugcccu

SEQ ID NO: 3003766 - RNA, 24 nt, Human
ucugagaucaaaacgguuuuacug

SEQ ID NO: 3003767 - RNA, 20 nt, Human
ucugaacuuggcgcugcccc

SEQ ID NO: 3003768 - RNA, 21 nt, Human
ucugaacuuggcgcugccccu

SEQ ID NO: 3003769 - RNA, 14 nt, Human
ucugacccaugcug

SEQ ID NO: 3003770 - RNA, 19 nt, Human
ucucuaguuugauuaaauu

SEQ ID NO: 3003771 - RNA, 18 nt, Human
ucucuaguuugauuaaau

SEQ ID NO: 3003772 - RNA, 16 nt, Human
ucucuaguuugauuaa

SEQ ID NO: 3003773 - RNA, 13 nt, Human
ucucuaggaaaua

SEQ ID NO: 3003774 - RNA, 20 nt, Human
ucuccugggcagcugccucc

SEQ ID NO: 3003775 - RNA, 19 nt, Human
ucuccugggcagcugccuc

SEQ ID NO: 3003776 - RNA, 21 nt, Human
ucuccugggcagcugccuccc

SEQ ID NO: 3003777 - RNA, 15 nt, Human
ucucuacaaaaagca

SEQ ID NO: 3003778 - RNA, 14 nt, Human
ucucuacuaaaaau

SEQ ID NO: 3003779 - RNA, 23 nt, Human
ucucuacccaucuuaaaaacaac

SEQ ID NO: 3003780 - RNA, 20 nt, Human
ucucuacccaucuuaaaaac

SEQ ID NO: 3003781 - RNA, 19 nt, Human
ucucuacccaucuuaaaaa

SEQ ID NO: 3003782 - RNA, 18 nt, Human
ucucuacccaucuuaaaa

SEQ ID NO: 3003783 - RNA, 13 nt, Human
ucucugaggacac

SEQ ID NO: 3003784 - RNA, 21 nt, Human
ucucagugucaaugcagcccc

SEQ ID NO: 3003785 - RNA, 15 nt, Human
ucucccccagcccca

SEQ ID NO: 3003786 - RNA, 17 nt, Human
ucucccccagccccauc

SEQ ID NO: 3003787 - RNA, 14 nt, Human
ucucccccagcccc

SEQ ID NO: 3003788 - RNA, 22 nt, Human
ucucccccagccccauccucug

SEQ ID NO: 3003789 - RNA, 13 nt, Human
ucucccccagccc

SEQ ID NO: 3003790 - RNA, 18 nt, Human
ucucccccagccccaucc

SEQ ID NO: 3003791 - RNA, 20 nt, Human
ucucccccagccccauccuc

SEQ ID NO: 3003792 - RNA, 18 nt, Human
ucuccugggcagcugccu

SEQ ID NO: 3003793 - RNA, 17 nt, Human
ucuccugggcagcugcc

SEQ ID NO: 3003794 - RNA, 16 nt, Human
ucuccugggcagcugc

SEQ ID NO: 3003795 - RNA, 15 nt, Human
ucuccugggcagcug

SEQ ID NO: 3003796 - RNA, 13 nt, Human
ucuccugggcagc

SEQ ID NO: 3003797 - RNA, 14 nt, Human
ucuccugggcagcu

SEQ ID NO: 3003798 - RNA, 19 nt, Human
ucuccugccucagccuccc

SEQ ID NO: 3003799 - RNA, 22 nt, Human
ucuccugccucagccucccaaa

SEQ ID NO: 3003800 - RNA, 16 nt, Human
ucccauucuuggccca

SEQ ID NO: 3003801 - RNA, 22 nt, Human
uccccacuugagaauuacccuu

SEQ ID NO: 3003802 - RNA, 15 nt, Human
ucccauucuuggccc

SEQ ID NO: 3003803 - RNA, 20 nt, Human
ucccaucucacacaugagca

SEQ ID NO: 3003804 - RNA, 23 nt, Human
ucccaucucacacaugagcauca

SEQ ID NO: 3003805 - RNA, 22 nt, Human
ucccaggcauuccccaggaggc

SEQ ID NO: 3003806 - RNA, 19 nt, Human
ucccaggcauuccccagga

SEQ ID NO: 3003807 - RNA, 20 nt, Human
ucccaggcauuccccaggag

SEQ ID NO: 3003808 - RNA, 21 nt, Human
ucccaggcauuccccaggagg

SEQ ID NO: 3003809 - RNA, 15 nt, Human
ucccaccucagccuc

SEQ ID NO: 3003810 - RNA, 14 nt, Human
ucccaccucagccu

SEQ ID NO: 3003811 - RNA, 13 nt, Human
ucccaccucagcc

SEQ ID NO: 3003812 - RNA, 16 nt, Human
ucccaaauuucauacc

SEQ ID NO: 3003813 - RNA, 13 nt, Human
ucccaacucaccc

SEQ ID NO: 3003814 - RNA, 14 nt, Human
ucccaacucacccc

SEQ ID NO: 3003815 - RNA, 15 nt, Human
ucccaacucacccca

SEQ ID NO: 3003816 - RNA, 16 nt, Human
ucccaacucaccccag

SEQ ID NO: 3003817 - RNA, 15 nt, Human
ucccaagcucugcuc

SEQ ID NO: 3003818 - RNA, 14 nt, Human
ucccaagcucugcu

SEQ ID NO: 3003819 - RNA, 13 nt, Human
ucccaagcucugc

SEQ ID NO: 3003820 - RNA, 12 nt, Human
ucccaagcucug

SEQ ID NO: 3003821 - RNA, 17 nt, Human
ucccaagcucugcuccu

SEQ ID NO: 3003822 - RNA, 13 nt, Human
uccauggacuuug

SEQ ID NO: 3003823 - RNA, 14 nt, Human
uccauggacuuugu

SEQ ID NO: 3003824 - RNA, 15 nt, Human
uccauggacuuuguu

SEQ ID NO: 3003825 - RNA, 21 nt, Human
ucccaaagugcugggauuaca

SEQ ID NO: 3003826 - RNA, 23 nt, Human
uccagcucaccagccccagugcc

SEQ ID NO: 3003827 - RNA, 17 nt, Human
ucccccuggcacugguu

SEQ ID NO: 3003828 - RNA, 21 nt, Human
ucccccuuccauggacuuugu

SEQ ID NO: 3003829 - RNA, 20 nt, Human
uccccgcacugggcuugggg

SEQ ID NO: 3003830 - RNA, 17 nt, Human
ucccucccucuuucccu

SEQ ID NO: 3003831 - RNA, 17 nt, Human
ucccucccuccaccucc

SEQ ID NO: 3003832 - RNA, 15 nt, Human
ucccucccucuuucc

SEQ ID NO: 3003833 - RNA, 15 nt, Human
ucccuacuguaauuu

SEQ ID NO: 3003834 - RNA, 14 nt, Human
uccccugcugggug

SEQ ID NO: 3003835 - RNA, 15 nt, Human
uccccugcugggugu

SEQ ID NO: 3003836 - RNA, 20 nt, Human
uccccugcuggguguggcgc

SEQ ID NO: 3003837 - RNA, 21 nt, Human
uccccugcuggguguggcgca

SEQ ID NO: 3003838 - RNA, 22 nt, Human
uccccuguagagugggagcuga

SEQ ID NO: 3003839 - RNA, 23 nt, Human
uccccuguccccgcacugggcuu

SEQ ID NO: 3003840 - RNA, 24 nt, Human
uccccugcuggguguggcgcagca

SEQ ID NO: 3003841 - RNA, 19 nt, Human
uccccuguagagugggagc

SEQ ID NO: 3003842 - RNA, 15 nt, Human
uccccuggcacuggc

SEQ ID NO: 3003843 - RNA, 15 nt, Human
ucaucuguuacacaa

SEQ ID NO: 3003844 - RNA, 20 nt, Human
ucauacccacccccacccaa

SEQ ID NO: 3003845 - RNA, 14 nt, Human
ucauacccaccccc

SEQ ID NO: 3003846 - RNA, 15 nt, Human
ucauacccaccccca

SEQ ID NO: 3003847 - RNA, 21 nt, Human
ucauuaggugugacugaauuu

SEQ ID NO: 3003848 - RNA, 18 nt, Human
ucauuaggugugacugaa

SEQ ID NO: 3003849 - RNA, 22 nt, Human
ucauuaggugugacugaauuuc

SEQ ID NO: 3003850 - RNA, 16 nt, Human
ucauuaggugugacug

SEQ ID NO: 3003851 - RNA, 12 nt, Human
ucagcagagugc

SEQ ID NO: 3003852 - RNA, 11 nt, Human
ucagcagagug

SEQ ID NO: 3003853 - RNA, 22 nt, Human
ucagcagagugcuuuaccaauu

SEQ ID NO: 3003854 - RNA, 16 nt, Human
ucagcagagugcuuua

SEQ ID NO: 3003855 - RNA, 24 nt, Human
ucagucugauucccaagcucugcu

SEQ ID NO: 3003856 - RNA, 15 nt, Human
ucagucuggcccuuc

SEQ ID NO: 3003857 - RNA, 16 nt, Human
ucagucugcuuagaaa

SEQ ID NO: 3003858 - RNA, 19 nt, Human
ucagucugcuuagaaauaa

SEQ ID NO: 3003859 - RNA, 21 nt, Human
ucagucugcuuagaaauaaca

SEQ ID NO: 3003860 - RNA, 17 nt, Human
ucagugugacugaucuc

SEQ ID NO: 3003861 - RNA, 13 nt, Human
ucagugugacuga

SEQ ID NO: 3003862 - RNA, 11 nt, Human
ucaguguacau

SEQ ID NO: 3003863 - RNA, 23 nt, Human
ucagugguuggcaauuguuucaa

SEQ ID NO: 3003864 - RNA, 22 nt, Human
ucauacaaggcccaggaggcuu

SEQ ID NO: 3003865 - RNA, 13 nt, Human
ucauacccacccc

SEQ ID NO: 3003866 - RNA, 13 nt, Human
ucauaaugacuua

SEQ ID NO: 3003867 - RNA, 13 nt, Human
ucaguucugauau

SEQ ID NO: 3003868 - RNA, 23 nt, Human
uccaagcauaccaacacgagcag

SEQ ID NO: 3003869 - RNA, 17 nt, Human
uccaagcauuuagaugu

SEQ ID NO: 3003870 - RNA, 14 nt, Human
uccaagaauuucua

SEQ ID NO: 3003871 - RNA, 22 nt, Human
uccaagaagcccaggaaaggcu

SEQ ID NO: 3003872 - RNA, 19 nt, Human
uccaagaagcccaggaaag

SEQ ID NO: 3003873 - RNA, 20 nt, Human
uccaagaagcccaggaaagg

SEQ ID NO: 3003874 - RNA, 16 nt, Human
ucauuucugcaucagc

SEQ ID NO: 3003875 - RNA, 22 nt, Human
ucauuucugcaucagcugcuga

SEQ ID NO: 3003876 - RNA, 14 nt, Human
ucauuucuuugagu

SEQ ID NO: 3003877 - RNA, 22 nt, Human
ucauucagauaugauucaaaug

SEQ ID NO: 3003878 - RNA, 23 nt, Human
uccaaacugacucuuaagaagac

SEQ ID NO: 3003879 - RNA, 12 nt, Human
uccaaagaaaug

SEQ ID NO: 3003880 - RNA, 16 nt, Human
uccaaaauaaaacuuu

SEQ ID NO: 3003881 - RNA, 17 nt, Human
uccaaaauaaaacuuuu

SEQ ID NO: 3003882 - RNA, 14 nt, Human
uccaccuacaugag

SEQ ID NO: 3003883 - RNA, 12 nt, Human
uccaccugccag

SEQ ID NO: 3003884 - RNA, 23 nt, Human
uccaccucccugcaauaaaaugg

SEQ ID NO: 3003885 - RNA, 22 nt, Human
uccaagcaggacauggacaagg

SEQ ID NO: 3003886 - RNA, 14 nt, Human
uccacaagagccca

SEQ ID NO: 3003887 - RNA, 17 nt, Human
uccagauccuggaaauc

SEQ ID NO: 3003888 - RNA, 16 nt, Human
uccagauccuggaaau

SEQ ID NO: 3003889 - RNA, 14 nt, Human
uccagauccuggaa

SEQ ID NO: 3003890 - RNA, 13 nt, Human
uccacuuggucug

SEQ ID NO: 3003891 - RNA, 12 nt, Human
uccacuuggucu

SEQ ID NO: 3003892 - RNA, 13 nt, Human
uccaccugccagg

SEQ ID NO: 3003893 - RNA, 18 nt, Human
ucaagcugaccuugcuga

SEQ ID NO: 3003894 - RNA, 18 nt, Human
ucaaggauccugagccag

SEQ ID NO: 3003895 - RNA, 19 nt, Human
ucaaggauccugagccaga

SEQ ID NO: 3003896 - RNA, 20 nt, Human
ucaaggauccugagccagau

SEQ ID NO: 3003897 - RNA, 22 nt, Human
ucaagugauucuccugccucag

SEQ ID NO: 3003898 - RNA, 16 nt, Human
ucaagcgauucuucug

SEQ ID NO: 3003899 - RNA, 15 nt, Human
ucaagcauguauuuu

SEQ ID NO: 3003900 - RNA, 14 nt, Human
ucaaccuccugggc

SEQ ID NO: 3003901 - RNA, 13 nt, Human
ucaaccuccuggg

SEQ ID NO: 3003902 - RNA, 16 nt, Human
ucaaacuuuacuaugg

SEQ ID NO: 3003903 - RNA, 13 nt, Human
ucaaacuuuacua

SEQ ID NO: 3003904 - RNA, 15 nt, Human
ucaaacuuuacuaug

SEQ ID NO: 3003905 - RNA, 22 nt, Human
ucaaacucuugaccucagguga

SEQ ID NO: 3003906 - RNA, 13 nt, Human
ucaauuacaggaa

SEQ ID NO: 3003907 - RNA, 18 nt, Human
ucaauuacaggaaguacu

SEQ ID NO: 3003908 - RNA, 22 nt, Human
ucaaugccccugaauuuaaaua

SEQ ID NO: 3003909 - RNA, 18 nt, Human
ucaaugcacugacauugu

SEQ ID NO: 3003910 - RNA, 14 nt, Human
ucaauaggaaaaac

SEQ ID NO: 3003911 - RNA, 14 nt, Human
ucaaugcacugaca

SEQ ID NO: 3003912 - RNA, 13 nt, Human
ucaauaggaaaaa

SEQ ID NO: 3003913 - RNA, 19 nt, Human
ucacaggaaguagaggagg

SEQ ID NO: 3003914 - RNA, 14 nt, Human
ucacaggaaguaga

SEQ ID NO: 3003915 - RNA, 23 nt, Human
ucacaggacagcccuucuuucca

SEQ ID NO: 3003916 - RNA, 11 nt, Human
ucacaggcagg

SEQ ID NO: 3003917 - RNA, 23 nt, Human
ucacacagugagucgaggacagg

SEQ ID NO: 3003918 - RNA, 22 nt, Human
ucacacagugagucgaggacag

SEQ ID NO: 3003919 - RNA, 21 nt, Human
ucacacaugagcaucaggcca

SEQ ID NO: 3003920 - RNA, 13 nt, Human
ucacacagugagu

SEQ ID NO: 3003921 - RNA, 22 nt, Human
ucacacaguauuacuucugcua

SEQ ID NO: 3003922 - RNA, 21 nt, Human
ucacacaguauuacuucugcu

SEQ ID NO: 3003923 - RNA, 19 nt, Human
ucaauuacaggaaguacug

SEQ ID NO: 3003924 - RNA, 20 nt, Human
uauuuuuguuuuuauuaaaa

SEQ ID NO: 3003925 - RNA, 18 nt, Human
uauuuuuguuuuuauuaa

SEQ ID NO: 3003926 - RNA, 20 nt, Human
uauuuuuuacauuuuacaca

SEQ ID NO: 3003927 - RNA, 12 nt, Human
uauuuugaaauu

SEQ ID NO: 3003928 - RNA, 13 nt, Human
ucaaacuaacagg

SEQ ID NO: 3003929 - RNA, 12 nt, Human
ucaaacuaacag

SEQ ID NO: 3003930 - RNA, 14 nt, Human
ucaaacucuuaaaa

SEQ ID NO: 3003931 - RNA, 22 nt, Human
ucaaaacgguuuuacugcagcu

SEQ ID NO: 3003932 - RNA, 13 nt, Human
ucaaaacugcacu

SEQ ID NO: 3003933 - RNA, 17 nt, Human
uauuuuuuucugaaauu

SEQ ID NO: 3003934 - RNA, 16 nt, Human
uauuuuuuucugaaau

SEQ ID NO: 3003935 - RNA, 15 nt, Human
uauuuuuuuacuaau

SEQ ID NO: 3003936 - RNA, 16 nt, Human
uauuuauugaaaugau

SEQ ID NO: 3003937 - RNA, 20 nt, Human
uauuuauugaaaugauuuca

SEQ ID NO: 3003938 - RNA, 12 nt, Human
uauuuauugaaa

SEQ ID NO: 3003939 - RNA, 21 nt, Human
uauuucuaugaaauauuaugu

SEQ ID NO: 3003940 - RNA, 22 nt, Human
uauuucuaugaaauauuauguu

SEQ ID NO: 3003941 - RNA, 23 nt, Human
uauuuauuaaaugcccagccccu

SEQ ID NO: 3003942 - RNA, 15 nt, Human
uaucugaaaauguau

SEQ ID NO: 3003943 - RNA, 14 nt, Human
uaucugaaaaugua

SEQ ID NO: 3003944 - RNA, 20 nt, Human
uaucugaaaauguaugugua

SEQ ID NO: 3003945 - RNA, 23 nt, Human
uauuugaguggaguuacugaaca

SEQ ID NO: 3003946 - RNA, 23 nt, Human
uauuucugaggagccugcaacau

SEQ ID NO: 3003947 - RNA, 12 nt, Human
uauuuuacuuuu

SEQ ID NO: 3003948 - RNA, 13 nt, Human
uauuuuacuuuuu

SEQ ID NO: 3003949 - RNA, 14 nt, Human
uauuuuacuuuuug

SEQ ID NO: 3003950 - RNA, 15 nt, Human
uauuuuacuuuuugg

SEQ ID NO: 3003951 - RNA, 22 nt, Human
uauuuuagguguaaaauaauua

SEQ ID NO: 3003952 - RNA, 23 nt, Human
ucagagcugcccucuccugggca

SEQ ID NO: 3003953 - RNA, 22 nt, Human
ucagacauagaauuaacacaug

SEQ ID NO: 3003954 - RNA, 15 nt, Human
ucagacagcugccug

SEQ ID NO: 3003955 - RNA, 16 nt, Human
ucagacagcugccugg

SEQ ID NO: 3003956 - RNA, 17 nt, Human
ucagacagcugccuggg

SEQ ID NO: 3003957 - RNA, 18 nt, Human
ucagacagcugccuggga

SEQ ID NO: 3003958 - RNA, 19 nt, Human
ucagacagcugccugggau

SEQ ID NO: 3003959 - RNA, 20 nt, Human
ucagacagcugccugggauc

SEQ ID NO: 3003960 - RNA, 19 nt, Human
ucagacauagaauuaacac

SEQ ID NO: 3003961 - RNA, 14 nt, Human
ucagacagcugccu

SEQ ID NO: 3003962 - RNA, 19 nt, Human
ucagcacgauuucuguuua

SEQ ID NO: 3003963 - RNA, 18 nt, Human
ucagcacgauuucuguuu

SEQ ID NO: 3003964 - RNA, 17 nt, Human
ucacuugucaauaaaau

SEQ ID NO: 3003965 - RNA, 20 nt, Human
ucacugcuuaacuucacaua

SEQ ID NO: 3003966 - RNA, 18 nt, Human
ucacugcuuaacuucaca

SEQ ID NO: 3003967 - RNA, 17 nt, Human
ucacugcuuaacuucac

SEQ ID NO: 3003968 - RNA, 15 nt, Human
ucacugcuuaacuuc

SEQ ID NO: 3003969 - RNA, 16 nt, Human
ucacucugucgcccag

SEQ ID NO: 3003970 - RNA, 12 nt, Human
ucacucugucgc

SEQ ID NO: 3003971 - RNA, 19 nt, Human
ucacucugucgcccagucu

SEQ ID NO: 3003972 - RNA, 14 nt, Human
ucacucuggcagcu

SEQ ID NO: 3003973 - RNA, 15 nt, Human
ucacucuggcagcuc

SEQ ID NO: 3003974 - RNA, 16 nt, Human
ucacucuggcagcuca

SEQ ID NO: 3003975 - RNA, 17 nt, Human
ucacucuggcagcucag

SEQ ID NO: 3003976 - RNA, 18 nt, Human
ucacucuggcagcucaga

SEQ ID NO: 3003977 - RNA, 19 nt, Human
ucacucuggcagcucagag

SEQ ID NO: 3003978 - RNA, 20 nt, Human
ucacucuggcagcucagaga

SEQ ID NO: 3003979 - RNA, 22 nt, Human
ucacucuggcagcucagagagg

SEQ ID NO: 3003980 - RNA, 12 nt, Human
ucacucuccuug

SEQ ID NO: 3003981 - RNA, 14 nt, Human
ucacucuccuuggu

SEQ ID NO: 3003982 - RNA, 12 nt, Human
ucacucuggcag

SEQ ID NO: 3003983 - RNA, 13 nt, Human
ucacucuggcagc

SEQ ID NO: 3003984 - RNA, 23 nt, Human
ucacucuccuuggugucgggcau

SEQ ID NO: 3003985 - RNA, 13 nt, Human
ucacuccuugaaa

SEQ ID NO: 3003986 - RNA, 20 nt, Human
ucacggcucacugcagccuc

SEQ ID NO: 3003987 - RNA, 15 nt, Human
ucacggcucacugca

SEQ ID NO: 3003988 - RNA, 13 nt, Human
ucacggcucacug

SEQ ID NO: 3003989 - RNA, 16 nt, Human
ucacggaagagccuug

SEQ ID NO: 3003990 - RNA, 17 nt, Human
ucacggaagagccuugc

SEQ ID NO: 3003991 - RNA, 14 nt, Human
ucacggaagagccu

SEQ ID NO: 3003992 - RNA, 15 nt, Human
ucacaggcaggucca

SEQ ID NO: 3003993 - RNA, 12 nt, Human
ucacaggcaggu

SEQ ID NO: 3003994 - RNA, 19 nt, Human
ucacaggcagguccagggu

SEQ ID NO: 3003995 - RNA, 14 nt, Human
ucaccuuucccauc

SEQ ID NO: 3003996 - RNA, 12 nt, Human
ucaccuuugucc

SEQ ID NO: 3003997 - RNA, 14 nt, Human
ucaccuuugucccc

SEQ ID NO: 3003998 - RNA, 15 nt, Human
ucaccuuugucccca

SEQ ID NO: 3003999 - RNA, 17 nt, Human
ucaccuuuguccccacc

SEQ ID NO: 3004000 - RNA, 18 nt, Human
ucaccuuuguccccaccg

SEQ ID NO: 3004001 - RNA, 22 nt, Human
ucaccuuuguccccaccgcaga

SEQ ID NO: 3004002 - RNA, 14 nt, Human
ucacgccacugcac

SEQ ID NO: 3004003 - RNA, 13 nt, Human
ucacgccacugca

SEQ ID NO: 3004004 - RNA, 16 nt, Human
ucacgccacugcacua

SEQ ID NO: 3004005 - RNA, 20 nt, Human
ucacgccuguaauccuagca

SEQ ID NO: 3004006 - RNA, 19 nt, Human
ucacgccuguaauccuagc

SEQ ID NO: 3004007 - RNA, 12 nt, Human
uaaacacauuaa

SEQ ID NO: 3004008 - RNA, 23 nt, Human
uaaacaagaccacguuucuaaag

SEQ ID NO: 3004009 - RNA, 17 nt, Human
uaaaauggguuuuacug

SEQ ID NO: 3004010 - RNA, 18 nt, Human
uaaacaagaccacguuuc

SEQ ID NO: 3004011 - RNA, 19 nt, Human
uaaacuuaaucuaaaugga

SEQ ID NO: 3004012 - RNA, 18 nt, Human
uaaacuuaaucuaaaugg

SEQ ID NO: 3004013 - RNA, 13 nt, Human
uaaacuuaaucua

SEQ ID NO: 3004014 - RNA, 14 nt, Human
uaaacuuaaucuaa

SEQ ID NO: 3004015 - RNA, 22 nt, Human
uaaacuuuaccuuuuuuauaca

SEQ ID NO: 3004016 - RNA, 16 nt, Human
uaaacuuuaccuuuuu

SEQ ID NO: 3004017 - RNA, 19 nt, Human
uaaacauauccaaguuuga

SEQ ID NO: 3004018 - RNA, 20 nt, Human
uaaacauauccaaguuugaa

SEQ ID NO: 3004019 - RNA, 14 nt, Human
uaaaagaugaaaau

SEQ ID NO: 3004020 - RNA, 14 nt, Human
uaaaagcauuuuuu

SEQ ID NO: 3004021 - RNA, 18 nt, Human
uaaaauccauacauuugu

SEQ ID NO: 3004022 - RNA, 19 nt, Human
uaaaauccauacauuugug

SEQ ID NO: 3004023 - RNA, 22 nt, Human
uaaauaucccuuggacauuuua

SEQ ID NO: 3004024 - RNA, 18 nt, Human
uaaauauaugcuaagucu

SEQ ID NO: 3004025 - RNA, 22 nt, Human
uaaauauugguugggaugacuu

SEQ ID NO: 3004026 - RNA, 23 nt, Human
uaaauauugguugggaugacuug

SEQ ID NO: 3004027 - RNA, 17 nt, Human
uaaauauguuucacaca

SEQ ID NO: 3004028 - RNA, 18 nt, Human
uaaauauuuugacuuguu

SEQ ID NO: 3004029 - RNA, 15 nt, Human
uaaauauuuugacuu

SEQ ID NO: 3004030 - RNA, 19 nt, Human
uaaauauuuugacuuguug

SEQ ID NO: 3004031 - RNA, 19 nt, Human
uaaaucagccguguaacca

SEQ ID NO: 3004032 - RNA, 17 nt, Human
uaaauaaaaauaauccu

SEQ ID NO: 3004033 - RNA, 13 nt, Human
uaaaguuucuguu

SEQ ID NO: 3004034 - RNA, 20 nt, Human
uaaaguguauuuuuuuacua

SEQ ID NO: 3004035 - RNA, 23 nt, Human
uaaaguguauuuuuuuacuaaua

SEQ ID NO: 3004036 - RNA, 22 nt, Human
uaaaguguauuuuuuuacuaau

SEQ ID NO: 3004037 - RNA, 21 nt, Human
uaaaguguauuuuuuuacuaa

SEQ ID NO: 3004038 - RNA, 14 nt, Human
uaaaggaauuuaaa

SEQ ID NO: 3004039 - RNA, 16 nt, Human
guuuuguguacuuuua

SEQ ID NO: 3004040 - RNA, 15 nt, Human
guuuuguguacuuuu

SEQ ID NO: 3004041 - RNA, 17 nt, Human
guuuuguguacuuuuaa

SEQ ID NO: 3004042 - RNA, 12 nt, Human
guuuucucuuga

SEQ ID NO: 3004043 - RNA, 19 nt, Human
guuuucucuugagagggug

SEQ ID NO: 3004044 - RNA, 23 nt, Human
guuuuuauggcuuuugugcauua

SEQ ID NO: 3004045 - RNA, 22 nt, Human
guuuuuauggcuuuugugcauu

SEQ ID NO: 3004046 - RNA, 19 nt, Human
guuuuuauggcuuuugugc

SEQ ID NO: 3004047 - RNA, 13 nt, Human
guuuguucccugu

SEQ ID NO: 3004048 - RNA, 16 nt, Human
guuuucaguguacaug

SEQ ID NO: 3004049 - RNA, 18 nt, Human
guuuucaggcuagaugua

SEQ ID NO: 3004050 - RNA, 17 nt, Human
guuuucaguguacaugg

SEQ ID NO: 3004051 - RNA, 16 nt, Human
guuuucauuaucucaa

SEQ ID NO: 3004052 - RNA, 13 nt, Human
guuuuuauuaaaa

SEQ ID NO: 3004053 - RNA, 17 nt, Human
guuuuuauuaaaaggaa

SEQ ID NO: 3004054 - RNA, 14 nt, Human
guuuuuauuaaaag

SEQ ID NO: 3004055 - RNA, 15 nt, Human
guuuuuauuauuaac

SEQ ID NO: 3004056 - RNA, 18 nt, Human
guuuuuauuauuaacaaa

SEQ ID NO: 3004057 - RNA, 20 nt, Human
uaaaaaugcaaaaaaaauua

SEQ ID NO: 3004058 - RNA, 16 nt, Human
uaaaaaagaaacauuu

SEQ ID NO: 3004059 - RNA, 20 nt, Human
uaaaaaacugcugacuguuu

SEQ ID NO: 3004060 - RNA, 23 nt, Human
uaaaaaacugcugacuguuuucu

SEQ ID NO: 3004061 - RNA, 17 nt, Human
guuuagaugaaugucag

SEQ ID NO: 3004062 - RNA, 18 nt, Human
guuuagaugaaugucagu

SEQ ID NO: 3004063 - RNA, 20 nt, Human
guuuaggauguugaaaaagu

SEQ ID NO: 3004064 - RNA, 13 nt, Human
guuuagaaagcuu

SEQ ID NO: 3004065 - RNA, 21 nt, Human
gguuggccccugcccggcugc

SEQ ID NO: 3004066 - RNA, 18 nt, Human
gguuggcaaaaaggcagg

SEQ ID NO: 3004067 - RNA, 18 nt, Human
guuucagaaauguguuau

SEQ ID NO: 3004068 - RNA, 14 nt, Human
guuucagaaaugug

SEQ ID NO: 3004069 - RNA, 21 nt, Human
guuuccuggcacugcuuccag

SEQ ID NO: 3004070 - RNA, 22 nt, Human
guuuccuggcacugcuuccagu

SEQ ID NO: 3004071 - RNA, 16 nt, Human
guuuccuggcacugcu

SEQ ID NO: 3004072 - RNA, 20 nt, Human
guuuccuggcacugcuucca

SEQ ID NO: 3004073 - RNA, 19 nt, Human
guuuguaaauuaacuuuua

SEQ ID NO: 3004074 - RNA, 17 nt, Human
guuuguaaauuaacuuu

SEQ ID NO: 3004075 - RNA, 19 nt, Human
guuugauuaaauucuugca

SEQ ID NO: 3004076 - RNA, 17 nt, Human
guuugauuaaauucuug

SEQ ID NO: 3004077 - RNA, 22 nt, Human
guuugauuaaauucuugcaaag

SEQ ID NO: 3004078 - RNA, 16 nt, Human
guuugaaccaagaacu

SEQ ID NO: 3004079 - RNA, 18 nt, Human
guuugagaucagccuggg

SEQ ID NO: 3004080 - RNA, 14 nt, Human
guuucuaaagcugc

SEQ ID NO: 3004081 - RNA, 15 nt, Human
guuucuaaagcugcc

SEQ ID NO: 3004082 - RNA, 16 nt, Human
guuucuaaagcugcca

SEQ ID NO: 3004083 - RNA, 16 nt, Human
uaagaacuaaaauguu

SEQ ID NO: 3004084 - RNA, 23 nt, Human
uaagagagaaugagagacacacu

SEQ ID NO: 3004085 - RNA, 17 nt, Human
uaagagagucuauuuac

SEQ ID NO: 3004086 - RNA, 22 nt, Human
uaagaggcagggucucacucug

SEQ ID NO: 3004087 - RNA, 24 nt, Human
uaagaaagacuaucuaaauguuga

SEQ ID NO: 3004088 - RNA, 19 nt, Human
uaacuuuuauaaacuuuac

SEQ ID NO: 3004089 - RNA, 22 nt, Human
uaacuuuuauaaacuuuaccuu

SEQ ID NO: 3004090 - RNA, 21 nt, Human
uaacuuuuauaaacuuuaccu

SEQ ID NO: 3004091 - RNA, 22 nt, Human
uaagaaccuuuugagugccuua

SEQ ID NO: 3004092 - RNA, 12 nt, Human
uaagagggaggg

SEQ ID NO: 3004093 - RNA, 22 nt, Human
uaagagggagggagggcuccag

SEQ ID NO: 3004094 - RNA, 23 nt, Human
uaagagggagggagggcuccaga

SEQ ID NO: 3004095 - RNA, 23 nt, Human
uaagagggauuagggagagaaga

SEQ ID NO: 3004096 - RNA, 14 nt, Human
uaagauaaaugugc

SEQ ID NO: 3004097 - RNA, 19 nt, Human
uaagagguaagacuuagua

SEQ ID NO: 3004098 - RNA, 17 nt, Human
uaagauaaaugugcuga

SEQ ID NO: 3004099 - RNA, 16 nt, Human
uaagauaaaugugcug

SEQ ID NO: 3004100 - RNA, 13 nt, Human
uaagccagacauc

SEQ ID NO: 3004101 - RNA, 15 nt, Human
uaagccaaaacugag

SEQ ID NO: 3004102 - RNA, 18 nt, Human
uaagccaaaacugagcau

SEQ ID NO: 3004103 - RNA, 18 nt, Human
uaagcauuccaacuaucu

SEQ ID NO: 3004104 - RNA, 16 nt, Human
uaagcauuccaacuau

SEQ ID NO: 3004105 - RNA, 20 nt, Human
uaagcauuccaacuaucuca

SEQ ID NO: 3004106 - RNA, 23 nt, Human
uaaggaugcuuguacauaaugcg

SEQ ID NO: 3004107 - RNA, 22 nt, Human
uaaggaugcuuguacauaaugc

SEQ ID NO: 3004108 - RNA, 21 nt, Human
uaaggaugcuuguacauaaug

SEQ ID NO: 3004109 - RNA, 20 nt, Human
uaaggaugcuuguacauaau

SEQ ID NO: 3004110 - RNA, 18 nt, Human
uaaggaugcuuguacaua

SEQ ID NO: 3004111 - RNA, 19 nt, Human
uaaggaugcuuguacauaa

SEQ ID NO: 3004112 - RNA, 21 nt, Human
uaagccagacaucaacagaua

SEQ ID NO: 3004113 - RNA, 20 nt, Human
uaagccagacaucaacagau

SEQ ID NO: 3004114 - RNA, 20 nt, Human
uaacagcaacacaaagcuuu

SEQ ID NO: 3004115 - RNA, 18 nt, Human
uaacagcaacacaaagcu

SEQ ID NO: 3004116 - RNA, 19 nt, Human
uaacagaagaaaauagaau

SEQ ID NO: 3004117 - RNA, 15 nt, Human
uaacagaagaaaaua

SEQ ID NO: 3004118 - RNA, 14 nt, Human
uaacagaagaaaau

SEQ ID NO: 3004119 - RNA, 16 nt, Human
uaacaggacgagauga

SEQ ID NO: 3004120 - RNA, 13 nt, Human
uaacagaaaugua

SEQ ID NO: 3004121 - RNA, 15 nt, Human
uaacagaaauguaca

SEQ ID NO: 3004122 - RNA, 14 nt, Human
uaacagaaauguac

SEQ ID NO: 3004123 - RNA, 12 nt, Human
uaacagaaaugu

SEQ ID NO: 3004124 - RNA, 19 nt, Human
uaacaaugcuguauuuuaa

SEQ ID NO: 3004125 - RNA, 14 nt, Human
uaaauuuaguauuu

SEQ ID NO: 3004126 - RNA, 23 nt, Human
uaaauugacacuuaaaaaugguu

SEQ ID NO: 3004127 - RNA, 21 nt, Human
uaacaggcuuagugauguaau

SEQ ID NO: 3004128 - RNA, 14 nt, Human
uaacaggcuuagug

SEQ ID NO: 3004129 - RNA, 19 nt, Human
uaacaggcagauacaggaa

SEQ ID NO: 3004130 - RNA, 14 nt, Human
uaaccagcagaaau

SEQ ID NO: 3004131 - RNA, 19 nt, Human
uaaccagcagaaaugccuu

SEQ ID NO: 3004132 - RNA, 16 nt, Human
uaaccagcagaaaugc

SEQ ID NO: 3004133 - RNA, 20 nt, Human
uaacuuuuauaaacuuuacc

SEQ ID NO: 3004134 - RNA, 17 nt, Human
uaauuaaaacacaacau

SEQ ID NO: 3004135 - RNA, 20 nt, Human
uaauuaaaagaauauuuuaa

SEQ ID NO: 3004136 - RNA, 15 nt, Human
uaauguuucaaacau

SEQ ID NO: 3004137 - RNA, 14 nt, Human
uaauguuucaaaca

SEQ ID NO: 3004138 - RNA, 14 nt, Human
uaaugcgugcauac

SEQ ID NO: 3004139 - RNA, 20 nt, Human
uaauugacaggauuauugga

SEQ ID NO: 3004140 - RNA, 22 nt, Human
uaauugacaggauuauuggaaa

SEQ ID NO: 3004141 - RNA, 18 nt, Human
uaauucuuagcucauucu

SEQ ID NO: 3004142 - RNA, 18 nt, Human
uaauuugugauacaaugc

SEQ ID NO: 3004143 - RNA, 15 nt, Human
uaauuugugauacaa

SEQ ID NO: 3004144 - RNA, 14 nt, Human
uaauuugugauaca

SEQ ID NO: 3004145 - RNA, 23 nt, Human
uaauuuguaguguuggagaagaa

SEQ ID NO: 3004146 - RNA, 20 nt, Human
uaauuuguaguguuggagaa

SEQ ID NO: 3004147 - RNA, 18 nt, Human
uaauuugguuuucacauu

SEQ ID NO: 3004148 - RNA, 17 nt, Human
uaauuugguuuucacau

SEQ ID NO: 3004149 - RNA, 15 nt, Human
uaauuugguuuucac

SEQ ID NO: 3004150 - RNA, 22 nt, Human
uaauuugugauacaaugcugug

SEQ ID NO: 3004151 - RNA, 19 nt, Human
uaauuugugauacaaugcu

SEQ ID NO: 3004152 - RNA, 20 nt, Human
uaauugggcacuauuuauuu

SEQ ID NO: 3004153 - RNA, 17 nt, Human
uaauugggcacuauuua

SEQ ID NO: 3004154 - RNA, 22 nt, Human
uaauuggaaaggcagcucuaaa

SEQ ID NO: 3004155 - RNA, 19 nt, Human
uaaugccacuaaauugaca

SEQ ID NO: 3004156 - RNA, 23 nt, Human
uaaugauaacuggaaacuucagc

SEQ ID NO: 3004157 - RNA, 11 nt, Human
uaaucuaaaug

SEQ ID NO: 3004158 - RNA, 23 nt, Human
uaaucucugauucccugauuuaa

SEQ ID NO: 3004159 - RNA, 14 nt, Human
uaauaauguuucaa

SEQ ID NO: 3004160 - RNA, 15 nt, Human
uaauaauguuucaaa

SEQ ID NO: 3004161 - RNA, 21 nt, Human
uaauaguucagguaacaggca

SEQ ID NO: 3004162 - RNA, 20 nt, Human
uaagugguacuaacuuuccu

SEQ ID NO: 3004163 - RNA, 19 nt, Human
uaauaaaugaaugucacuu

SEQ ID NO: 3004164 - RNA, 13 nt, Human
uacacuugugaau

SEQ ID NO: 3004165 - RNA, 19 nt, Human
uacacuguuucaaacuuua

SEQ ID NO: 3004166 - RNA, 18 nt, Human
uacacuguuucaaacuuu

SEQ ID NO: 3004167 - RNA, 17 nt, Human
uacacuguuucaaacuu

SEQ ID NO: 3004168 - RNA, 22 nt, Human
uacagaaaaguugaauuuuaca

SEQ ID NO: 3004169 - RNA, 18 nt, Human
uacagaaaaguugaauuu

SEQ ID NO: 3004170 - RNA, 13 nt, Human
uacacuuuaugca

SEQ ID NO: 3004171 - RNA, 24 nt, Human
uacagcaaggagauuuacaacugg

SEQ ID NO: 3004172 - RNA, 14 nt, Human
uacaggauuugaaa

SEQ ID NO: 3004173 - RNA, 16 nt, Human
uacaggcacccaccau

SEQ ID NO: 3004174 - RNA, 19 nt, Human
uacaggaaaagcugcugac

SEQ ID NO: 3004175 - RNA, 22 nt, Human
uacagcuugaccgugaggccag

SEQ ID NO: 3004176 - RNA, 21 nt, Human
uacagcuugaccgugaggcca

SEQ ID NO: 3004177 - RNA, 18 nt, Human
uacaggaaaagcugcuga

SEQ ID NO: 3004178 - RNA, 17 nt, Human
uacaggaaaagcugcug

SEQ ID NO: 3004179 - RNA, 23 nt, Human
uacagcuugaccgugaggccaga

SEQ ID NO: 3004180 - RNA, 21 nt, Human
uacacaaugguuuucuugugu

SEQ ID NO: 3004181 - RNA, 23 nt, Human
uacacaaugguuuucuugugugu

SEQ ID NO: 3004182 - RNA, 17 nt, Human
uacacaaugguuuucuu

SEQ ID NO: 3004183 - RNA, 15 nt, Human
uacacacacauacac

SEQ ID NO: 3004184 - RNA, 21 nt, Human
uacacacacacgcgugcacac

SEQ ID NO: 3004185 - RNA, 17 nt, Human
uacacacugcauguuug

SEQ ID NO: 3004186 - RNA, 14 nt, Human
uacacuguuucaaa

SEQ ID NO: 3004187 - RNA, 16 nt, Human
uacacugugcugaguc

SEQ ID NO: 3004188 - RNA, 22 nt, Human
uacacacugcauguuugugauu

SEQ ID NO: 3004189 - RNA, 18 nt, Human
uacacacuguacacauaa

SEQ ID NO: 3004190 - RNA, 17 nt, Human
uacacacuguacacaua

SEQ ID NO: 3004191 - RNA, 23 nt, Human
uaccaauauuuaaucuuuuauga

SEQ ID NO: 3004192 - RNA, 21 nt, Human
uaccaauauuuaaucuuuuau

SEQ ID NO: 3004193 - RNA, 16 nt, Human
uaccaauauuuaaucu

SEQ ID NO: 3004194 - RNA, 13 nt, Human
uaccaauauuuaa

SEQ ID NO: 3004195 - RNA, 13 nt, Human
uaccacagacaua

SEQ ID NO: 3004196 - RNA, 23 nt, Human
uaccacaggaaccacaagacugc

SEQ ID NO: 3004197 - RNA, 23 nt, Human
uaccauuuugggguacccacugc

SEQ ID NO: 3004198 - RNA, 22 nt, Human
uacccaggugcuaggaacacuc

SEQ ID NO: 3004199 - RNA, 18 nt, Human
uacccagcgagcccuggu

SEQ ID NO: 3004200 - RNA, 16 nt, Human
uacccagcgagcccug

SEQ ID NO: 3004201 - RNA, 14 nt, Human
uacccacugcucug

SEQ ID NO: 3004202 - RNA, 13 nt, Human
uacccacugcucu

SEQ ID NO: 3004203 - RNA, 12 nt, Human
uacccacugcuc

SEQ ID NO: 3004204 - RNA, 11 nt, Human
uacccacugcu

SEQ ID NO: 3004205 - RNA, 17 nt, Human
uacccacccccacccaa

SEQ ID NO: 3004206 - RNA, 19 nt, Human
uacccacccccacccaagg

SEQ ID NO: 3004207 - RNA, 23 nt, Human
uacccacccccacccaagggccu

SEQ ID NO: 3004208 - RNA, 12 nt, Human
uacccaccccca

SEQ ID NO: 3004209 - RNA, 15 nt, Human
uacccacccccaccc

SEQ ID NO: 3004210 - RNA, 15 nt, Human
uacccaaauuaagag

SEQ ID NO: 3004211 - RNA, 22 nt, Human
uacaugagguacugagagugaa

SEQ ID NO: 3004212 - RNA, 21 nt, Human
uacaugagguacugagaguga

SEQ ID NO: 3004213 - RNA, 11 nt, Human
uacauuugugu

SEQ ID NO: 3004214 - RNA, 17 nt, Human
uacauuuguauaaaaua

SEQ ID NO: 3004215 - RNA, 16 nt, Human
uacauuuguauaaaau

SEQ ID NO: 3004216 - RNA, 21 nt, Human
uacauuugcuccauccuccug

SEQ ID NO: 3004217 - RNA, 16 nt, Human
uaccaacacgagcagg

SEQ ID NO: 3004218 - RNA, 22 nt, Human
uacauuuuacacacuguacaca

SEQ ID NO: 3004219 - RNA, 18 nt, Human
uacauuuuacacacugua

SEQ ID NO: 3004220 - RNA, 15 nt, Human
uacauuuuacacacu

SEQ ID NO: 3004221 - RNA, 13 nt, Human
uacauuuuacaca

SEQ ID NO: 3004222 - RNA, 19 nt, Human
uacaguuacucagaauucu

SEQ ID NO: 3004223 - RNA, 23 nt, Human
uacaguuacucagaauucucuag

SEQ ID NO: 3004224 - RNA, 19 nt, Human
uacauaagauaaaugugcu

SEQ ID NO: 3004225 - RNA, 18 nt, Human
uacauaagauaaaugugc

SEQ ID NO: 3004226 - RNA, 22 nt, Human
uacauaagauaaaugugcugaa

SEQ ID NO: 3004227 - RNA, 15 nt, Human
uacugaggugcuaug

SEQ ID NO: 3004228 - RNA, 19 nt, Human
uacugagagugaacaaauu

SEQ ID NO: 3004229 - RNA, 23 nt, Human
uacugauguuccuagugaaagag

SEQ ID NO: 3004230 - RNA, 12 nt, Human
uacucccaucug

SEQ ID NO: 3004231 - RNA, 14 nt, Human
uacucccaucugug

SEQ ID NO: 3004232 - RNA, 16 nt, Human
uacucccaucugugaa

SEQ ID NO: 3004233 - RNA, 17 nt, Human
uacucccaucugugaaa

SEQ ID NO: 3004234 - RNA, 14 nt, Human
uacucaccucaccc

SEQ ID NO: 3004235 - RNA, 12 nt, Human
uacucaccucac

SEQ ID NO: 3004236 - RNA, 20 nt, Human
uacuacaguccucccaucuc

SEQ ID NO: 3004237 - RNA, 20 nt, Human
uacuacaguuuguuaguaug

SEQ ID NO: 3004238 - RNA, 22 nt, Human
uacucagaauucucuaguuuga

SEQ ID NO: 3004239 - RNA, 16 nt, Human
uacucagaauucucua

SEQ ID NO: 3004240 - RNA, 22 nt, Human
uacuaauaaaauuuaaaagucu

SEQ ID NO: 3004241 - RNA, 17 nt, Human
uacuaauagacaauuua

SEQ ID NO: 3004242 - RNA, 15 nt, Human
uacuaauagacaauu

SEQ ID NO: 3004243 - RNA, 12 nt, Human
uacuacaguccu

SEQ ID NO: 3004244 - RNA, 17 nt, Human
uacuacaguccucccau

SEQ ID NO: 3004245 - RNA, 17 nt, Human
uacuaaccagcagaaau

SEQ ID NO: 3004246 - RNA, 18 nt, Human
uacuaaccagcagaaaug

SEQ ID NO: 3004247 - RNA, 19 nt, Human
uacuaaccagcagaaaugc

SEQ ID NO: 3004248 - RNA, 18 nt, Human
uacccaucuuaaaaacaa

SEQ ID NO: 3004249 - RNA, 19 nt, Human
uacccaucuuaaaaacaac

SEQ ID NO: 3004250 - RNA, 22 nt, Human
uacccaucccauaugccugggc

SEQ ID NO: 3004251 - RNA, 15 nt, Human
uacccaucuuaaaaa

SEQ ID NO: 3004252 - RNA, 20 nt, Human
uaccuuuguauucucuccug

SEQ ID NO: 3004253 - RNA, 20 nt, Human
uaccuuuuuuauacauaaac

SEQ ID NO: 3004254 - RNA, 19 nt, Human
uaccuuuuuuauacauaaa

SEQ ID NO: 3004255 - RNA, 18 nt, Human
uaccuuuuuuauacauaa

SEQ ID NO: 3004256 - RNA, 16 nt, Human
uagaaauaacagaaga

SEQ ID NO: 3004257 - RNA, 13 nt, Human
uagaaauaacaga

SEQ ID NO: 3004258 - RNA, 23 nt, Human
uagaaauaucugaaaauguaugu

SEQ ID NO: 3004259 - RNA, 21 nt, Human
uagaaauaucugaaaauguau

SEQ ID NO: 3004260 - RNA, 20 nt, Human
uagaaauaucugaaaaugua

SEQ ID NO: 3004261 - RNA, 15 nt, Human
uagaaauauaauuga

SEQ ID NO: 3004262 - RNA, 18 nt, Human
uacuuguggacacagcuc

SEQ ID NO: 3004263 - RNA, 15 nt, Human
uacuuguggacacag

SEQ ID NO: 3004264 - RNA, 19 nt, Human
uacuuguggacacagcucu

SEQ ID NO: 3004265 - RNA, 14 nt, Human
uacuuguggacaca

SEQ ID NO: 3004266 - RNA, 17 nt, Human
uacugcauaugaaagga

SEQ ID NO: 3004267 - RNA, 21 nt, Human
uacuguaucaugacaaagacu

SEQ ID NO: 3004268 - RNA, 23 nt, Human
uagcaguaaaaaaugguguuuua

SEQ ID NO: 3004269 - RNA, 20 nt, Human
uagcagggcauggcugggaa

SEQ ID NO: 3004270 - RNA, 20 nt, Human
uagcagcccucaauugugaa

SEQ ID NO: 3004271 - RNA, 23 nt, Human
uagcagagaaugaaagggcccag

SEQ ID NO: 3004272 - RNA, 19 nt, Human
uagcagagaaugaaagggc

SEQ ID NO: 3004273 - RNA, 11 nt, Human
uagauguugcu

SEQ ID NO: 3004274 - RNA, 13 nt, Human
uagauguugcuaa

SEQ ID NO: 3004275 - RNA, 16 nt, Human
uagcacuuugggaggc

SEQ ID NO: 3004276 - RNA, 18 nt, Human
uagauaauacaccacuac

SEQ ID NO: 3004277 - RNA, 12 nt, Human
uagauguauaua

SEQ ID NO: 3004278 - RNA, 20 nt, Human
uagauguauguacuucaugc

SEQ ID NO: 3004279 - RNA, 20 nt, Human
uagauguaugcacacacaua

SEQ ID NO: 3004280 - RNA, 19 nt, Human
uagauguaugcacacacau

SEQ ID NO: 3004281 - RNA, 22 nt, Human
uagauguaugcacacacauaua

SEQ ID NO: 3004282 - RNA, 16 nt, Human
uagauguauguacuuc

SEQ ID NO: 3004283 - RNA, 16 nt, Human
uagauguaugcacaca

SEQ ID NO: 3004284 - RNA, 11 nt, Human
uagagacaggg

SEQ ID NO: 3004285 - RNA, 23 nt, Human
uagacccucaugcugccaauauc

SEQ ID NO: 3004286 - RNA, 16 nt, Human
uagagagagaccacuu

SEQ ID NO: 3004287 - RNA, 16 nt, Human
uagagguucaaagaua

SEQ ID NO: 3004288 - RNA, 19 nt, Human
uagagguucaaagauauuu

SEQ ID NO: 3004289 - RNA, 21 nt, Human
uagagguucaaagauauuuug

SEQ ID NO: 3004290 - RNA, 18 nt, Human
uagaguuuagcuggaaaa

SEQ ID NO: 3004291 - RNA, 17 nt, Human
uagaguuuagcuggaaa

SEQ ID NO: 3004292 - RNA, 21 nt, Human
uagaguuuagcccugaacauu

SEQ ID NO: 3004293 - RNA, 16 nt, Human
uagccuaggugacaga

SEQ ID NO: 3004294 - RNA, 14 nt, Human
uagcccugaacauu

SEQ ID NO: 3004295 - RNA, 14 nt, Human
uagcccaaaaccaa

SEQ ID NO: 3004296 - RNA, 21 nt, Human
uagcucuaggagggcuggcaa

SEQ ID NO: 3004297 - RNA, 17 nt, Human
uagccugccucuucucu

SEQ ID NO: 3004298 - RNA, 22 nt, Human
uagcucauucuccuuguguuac

SEQ ID NO: 3004299 - RNA, 20 nt, Human
uagcugggacuacaggcacc

SEQ ID NO: 3004300 - RNA, 18 nt, Human
uagcugggacuacaggug

SEQ ID NO: 3004301 - RNA, 11 nt, Human
uagcugggacu

SEQ ID NO: 3004302 - RNA, 20 nt, Human
uaggaauugacccacaagaa

SEQ ID NO: 3004303 - RNA, 23 nt, Human
uaggaauugacccacaagaaaug

SEQ ID NO: 3004304 - RNA, 15 nt, Human
uaggaagguuaaugu

SEQ ID NO: 3004305 - RNA, 13 nt, Human
uaggccaugggac

SEQ ID NO: 3004306 - RNA, 14 nt, Human
uaggccuggccaga

SEQ ID NO: 3004307 - RNA, 13 nt, Human
uaggccuggccag

SEQ ID NO: 3004308 - RNA, 16 nt, Human
uaggaagacuuuggaa

SEQ ID NO: 3004309 - RNA, 17 nt, Human
uaggaagacuuuggaaa

SEQ ID NO: 3004310 - RNA, 14 nt, Human
uaggaagacuuugg

SEQ ID NO: 3004311 - RNA, 15 nt, Human
uaggaagacuuugga

SEQ ID NO: 3004312 - RNA, 13 nt, Human
uaggaagacuuug

SEQ ID NO: 3004313 - RNA, 13 nt, Human
uaggaacacuccu

SEQ ID NO: 3004314 - RNA, 14 nt, Human
uaggaacacuccuu

SEQ ID NO: 3004315 - RNA, 21 nt, Human
uaggaacuuaaauaaugugaa

SEQ ID NO: 3004316 - RNA, 17 nt, Human
uaggaacacuccuucac

SEQ ID NO: 3004317 - RNA, 23 nt, Human
uauaauuccuguuuuuauuauua

SEQ ID NO: 3004318 - RNA, 17 nt, Human
uauaauucuacuuugag

SEQ ID NO: 3004319 - RNA, 20 nt, Human
uauaauguaagcucuacuga

SEQ ID NO: 3004320 - RNA, 19 nt, Human
uauaauguaagcucuacug

SEQ ID NO: 3004321 - RNA, 14 nt, Human
uauaauguaagcuc

SEQ ID NO: 3004322 - RNA, 22 nt, Human
uauaacaaaggauacuuauuua

SEQ ID NO: 3004323 - RNA, 18 nt, Human
uauaaugaaugaaacauu

SEQ ID NO: 3004324 - RNA, 20 nt, Human
uauaaugaaugaaacauuuu

SEQ ID NO: 3004325 - RNA, 20 nt, Human
uauaacaaaggauacuuauu

SEQ ID NO: 3004326 - RNA, 21 nt, Human
uaguuugauuaaauucuugca

SEQ ID NO: 3004327 - RNA, 14 nt, Human
uagucaaauugugu

SEQ ID NO: 3004328 - RNA, 18 nt, Human
uagucaaauugugugaaa

SEQ ID NO: 3004329 - RNA, 15 nt, Human
uaguggauguucuga

SEQ ID NO: 3004330 - RNA, 21 nt, Human
uaguuguaccgcaaugugacu

SEQ ID NO: 3004331 - RNA, 12 nt, Human
uaguuugcaguu

SEQ ID NO: 3004332 - RNA, 23 nt, Human
uaguuugauuaaauucuugcaaa

SEQ ID NO: 3004333 - RNA, 13 nt, Human
uaguuucuccaag

SEQ ID NO: 3004334 - RNA, 23 nt, Human
uauauuuauuacuguaagaaaau

SEQ ID NO: 3004335 - RNA, 20 nt, Human
uauauuuauuacuguaagaa

SEQ ID NO: 3004336 - RNA, 20 nt, Human
uauauguagauguaugcaca

SEQ ID NO: 3004337 - RNA, 18 nt, Human
uauauguagauguaugca

SEQ ID NO: 3004338 - RNA, 15 nt, Human
uauauguagauguau

SEQ ID NO: 3004339 - RNA, 13 nt, Human
uauauuugaaaua

SEQ ID NO: 3004340 - RNA, 14 nt, Human
uauauuugaaauau

SEQ ID NO: 3004341 - RNA, 18 nt, Human
uauauuuuuuaaaauaag

SEQ ID NO: 3004342 - RNA, 19 nt, Human
uauauuuuuuaaaauaagu

SEQ ID NO: 3004343 - RNA, 19 nt, Human
uauauuuuuuguuaaauga

SEQ ID NO: 3004344 - RNA, 17 nt, Human
uaucaggugcugccauc

SEQ ID NO: 3004345 - RNA, 16 nt, Human
uaucaugacaaagacu

SEQ ID NO: 3004346 - RNA, 15 nt, Human
uaucuaaauguugaa

SEQ ID NO: 3004347 - RNA, 16 nt, Human
uaucgucacugcuuaa

SEQ ID NO: 3004348 - RNA, 19 nt, Human
uaucgucacugcuuaacuu

SEQ ID NO: 3004349 - RNA, 21 nt, Human
ggggcagugcuuggcccagga

SEQ ID NO: 3004350 - RNA, 23 nt, Human
ggggcagugcuuggcccaggagu

SEQ ID NO: 3004351 - RNA, 20 nt, Human
ggggcagugcucacccacac

SEQ ID NO: 3004352 - RNA, 17 nt, Human
ggggcagugcucaccca

SEQ ID NO: 3004353 - RNA, 13 nt, Human
ggggcagugcuca

SEQ ID NO: 3004354 - RNA, 16 nt, Human
ggggcaacccugguga

SEQ ID NO: 3004355 - RNA, 17 nt, Human
ggggcugaggugggagg

SEQ ID NO: 3004356 - RNA, 12 nt, Human
ggggcucccagc

SEQ ID NO: 3004357 - RNA, 16 nt, Human
ggggcucccagccagg

SEQ ID NO: 3004358 - RNA, 13 nt, Human
ggggcucccagcc

SEQ ID NO: 3004359 - RNA, 20 nt, Human
ggggcucccagccaggcccu

SEQ ID NO: 3004360 - RNA, 21 nt, Human
ggggaaaaucagccugcucca

SEQ ID NO: 3004361 - RNA, 17 nt, Human
ggggaaaaucagccugc

SEQ ID NO: 3004362 - RNA, 19 nt, Human
ggggaaaaucagccugcuc

SEQ ID NO: 3004363 - RNA, 16 nt, Human
ggggaaaaucagccug

SEQ ID NO: 3004364 - RNA, 22 nt, Human
gggcuuggggaccagagcugcc

SEQ ID NO: 3004365 - RNA, 17 nt, Human
ggguaagugagagaggg

SEQ ID NO: 3004366 - RNA, 14 nt, Human
gggucucacucugu

SEQ ID NO: 3004367 - RNA, 12 nt, Human
gggucucacucu

SEQ ID NO: 3004368 - RNA, 21 nt, Human
gggucugaggaauccagaccc

SEQ ID NO: 3004369 - RNA, 12 nt, Human
gggucugaggaa

SEQ ID NO: 3004370 - RNA, 19 nt, Human
ggggcugaggugggaggau

SEQ ID NO: 3004371 - RNA, 12 nt, Human
ggggcugcaccg

SEQ ID NO: 3004372 - RNA, 21 nt, Human
ggggcugcaccggcuggccug

SEQ ID NO: 3004373 - RNA, 22 nt, Human
ggggcugcaccggcuggccugg

SEQ ID NO: 3004374 - RNA, 22 nt, Human
gggggaggugggauccuccagg

SEQ ID NO: 3004375 - RNA, 23 nt, Human
ggggcugcaccggcuggccuggc

SEQ ID NO: 3004376 - RNA, 17 nt, Human
gggguggggaccucagg

SEQ ID NO: 3004377 - RNA, 12 nt, Human
gggguggccucc

SEQ ID NO: 3004378 - RNA, 23 nt, Human
ggguucaagcgauucuucugcuu

SEQ ID NO: 3004379 - RNA, 22 nt, Human
ggguucaagcgauucuucugcu

SEQ ID NO: 3004380 - RNA, 12 nt, Human
ggguucuaccca

SEQ ID NO: 3004381 - RNA, 17 nt, Human
gggugaagugaagacaa

SEQ ID NO: 3004382 - RNA, 19 nt, Human
gggugacagagcaagugag

SEQ ID NO: 3004383 - RNA, 11 nt, Human
ggucagagccu

SEQ ID NO: 3004384 - RNA, 15 nt, Human
ggucccaccccacac

SEQ ID NO: 3004385 - RNA, 16 nt, Human
ggucccaccccacaca

SEQ ID NO: 3004386 - RNA, 13 nt, Human
gguacccacugcu

SEQ ID NO: 3004387 - RNA, 11 nt, Human
gguacccacug

SEQ ID NO: 3004388 - RNA, 22 nt, Human
gguagaaauaucugaaaaugua

SEQ ID NO: 3004389 - RNA, 17 nt, Human
gguacuuguggacacag

SEQ ID NO: 3004390 - RNA, 16 nt, Human
gguacuuguggacaca

SEQ ID NO: 3004391 - RNA, 23 nt, Human
gguagaaauaucugaaaauguau

SEQ ID NO: 3004392 - RNA, 22 nt, Human
gguagaagcccuucuaccuucc

SEQ ID NO: 3004393 - RNA, 14 nt, Human
gguagcauuuuaaa

SEQ ID NO: 3004394 - RNA, 18 nt, Human
gguagcauuuguguugaa

SEQ ID NO: 3004395 - RNA, 16 nt, Human
gguuauuuuacuuuuu

SEQ ID NO: 3004396 - RNA, 13 nt, Human
gguucaaagauau

SEQ ID NO: 3004397 - RNA, 21 nt, Human
gguucaaagauauuuugcuuu

SEQ ID NO: 3004398 - RNA, 13 nt, Human
gguugagguuuca

SEQ ID NO: 3004399 - RNA, 21 nt, Human
gguuacccaguuagcucucaa

SEQ ID NO: 3004400 - RNA, 17 nt, Human
gguuaggcauuguggga

SEQ ID NO: 3004401 - RNA, 13 nt, Human
gguuauggagagg

SEQ ID NO: 3004402 - RNA, 23 nt, Human
gguuauaacuuaaugaaaacaau

SEQ ID NO: 3004403 - RNA, 17 nt, Human
ggugucaagagggucug

SEQ ID NO: 3004404 - RNA, 19 nt, Human
ggugucaagagggucugag

SEQ ID NO: 3004405 - RNA, 19 nt, Human
ggugucaccugaagacuca

SEQ ID NO: 3004406 - RNA, 21 nt, Human
ggugguuauggagaggguguc

SEQ ID NO: 3004407 - RNA, 18 nt, Human
ggugguuucagaaaugug

SEQ ID NO: 3004408 - RNA, 17 nt, Human
ggugguuucagaaaugu

SEQ ID NO: 3004409 - RNA, 18 nt, Human
ggugguuuucuguucuuu

SEQ ID NO: 3004410 - RNA, 15 nt, Human
ggugguuuucuguuc

SEQ ID NO: 3004411 - RNA, 14 nt, Human
gguguaaacacauc

SEQ ID NO: 3004412 - RNA, 13 nt, Human
gguguaaacacau

SEQ ID NO: 3004413 - RNA, 15 nt, Human
gguggugaccucugc

SEQ ID NO: 3004414 - RNA, 14 nt, Human
gguggugaccucug

SEQ ID NO: 3004415 - RNA, 16 nt, Human
gguggugaccucugcc

SEQ ID NO: 3004416 - RNA, 16 nt, Human
ggugcuaucuccccca

SEQ ID NO: 3004417 - RNA, 17 nt, Human
ggugcuaucucccccag

SEQ ID NO: 3004418 - RNA, 19 nt, Human
ggugcuaucucccccagcc

SEQ ID NO: 3004419 - RNA, 20 nt, Human
ggugcuaucucccccagccc

SEQ ID NO: 3004420 - RNA, 21 nt, Human
ggugcuacaaaaacacagcaa

SEQ ID NO: 3004421 - RNA, 23 nt, Human
ggugcuacaaaaacacagcaagg

SEQ ID NO: 3004422 - RNA, 16 nt, Human
ggugagaggggaacag

SEQ ID NO: 3004423 - RNA, 15 nt, Human
ggugagaagcagagg

SEQ ID NO: 3004424 - RNA, 23 nt, Human
gguggccucccaacucaccccag

SEQ ID NO: 3004425 - RNA, 22 nt, Human
gguggccucccaacucacccca

SEQ ID NO: 3004426 - RNA, 16 nt, Human
gguggcagugggagcu

SEQ ID NO: 3004427 - RNA, 22 nt, Human
gguggcagugggagcugccugu

SEQ ID NO: 3004428 - RNA, 19 nt, Human
gguggcagugggagcugcc

SEQ ID NO: 3004429 - RNA, 15 nt, Human
ggugcugccauccag

SEQ ID NO: 3004430 - RNA, 18 nt, Human
ggugcugaguguacagag

SEQ ID NO: 3004431 - RNA, 22 nt, Human
ggugaccagcaccaucucuccu

SEQ ID NO: 3004432 - RNA, 21 nt, Human
ggugaccucugccugaaguca

SEQ ID NO: 3004433 - RNA, 14 nt, Human
ggucugacccacug

SEQ ID NO: 3004434 - RNA, 21 nt, Human
ggugacagagugagacucugu

SEQ ID NO: 3004435 - RNA, 16 nt, Human
ggugacauauacauac

SEQ ID NO: 3004436 - RNA, 17 nt, Human
ggucccaccccacacac

SEQ ID NO: 3004437 - RNA, 14 nt, Human
ggucccaccccaca

SEQ ID NO: 3004438 - RNA, 23 nt, Human
ggucucacucugucgcccagucu

SEQ ID NO: 3004439 - RNA, 22 nt, Human
ggucucacucugucgcccaguc

SEQ ID NO: 3004440 - RNA, 16 nt, Human
ggucucacucugucgc

SEQ ID NO: 3004441 - RNA, 16 nt, Human
gggcacaucauuucaa

SEQ ID NO: 3004442 - RNA, 13 nt, Human
gggcacagggucu

SEQ ID NO: 3004443 - RNA, 16 nt, Human
gggcacagggucucua

SEQ ID NO: 3004444 - RNA, 19 nt, Human
gggcacucagaagacacug

SEQ ID NO: 3004445 - RNA, 16 nt, Human
gggcacucagaagaca

SEQ ID NO: 3004446 - RNA, 23 nt, Human
gggcacaccgggcacucagaaga

SEQ ID NO: 3004447 - RNA, 18 nt, Human
gggcacagaaaauggaag

SEQ ID NO: 3004448 - RNA, 20 nt, Human
gggcacagaaaauggaagac

SEQ ID NO: 3004449 - RNA, 21 nt, Human
gggcacagaaaauggaagaca

SEQ ID NO: 3004450 - RNA, 18 nt, Human
gggcagaaggaagacuuc

SEQ ID NO: 3004451 - RNA, 14 nt, Human
gggcagaaggaaga

SEQ ID NO: 3004452 - RNA, 20 nt, Human
gggcacucagaagacacuga

SEQ ID NO: 3004453 - RNA, 11 nt, Human
gggcagagcag

SEQ ID NO: 3004454 - RNA, 17 nt, Human
gggcagguugguggggg

SEQ ID NO: 3004455 - RNA, 18 nt, Human
gggauaucacuuccauga

SEQ ID NO: 3004456 - RNA, 15 nt, Human
gggauccuccaggug

SEQ ID NO: 3004457 - RNA, 16 nt, Human
gggauccuccaggugc

SEQ ID NO: 3004458 - RNA, 21 nt, Human
gggauaugauuuaaaucagcc

SEQ ID NO: 3004459 - RNA, 13 nt, Human
gggauagagagag

SEQ ID NO: 3004460 - RNA, 18 nt, Human
gggcaacccuggugacca

SEQ ID NO: 3004461 - RNA, 20 nt, Human
gggcaacccccagccugcua

SEQ ID NO: 3004462 - RNA, 23 nt, Human
gggauccuggaguucugguuccu

SEQ ID NO: 3004463 - RNA, 14 nt, Human
gggagugagcuggu

SEQ ID NO: 3004464 - RNA, 11 nt, Human
gggagugagcu

SEQ ID NO: 3004465 - RNA, 18 nt, Human
gggagugacagaggcagc

SEQ ID NO: 3004466 - RNA, 17 nt, Human
gggagugacagaggcag

SEQ ID NO: 3004467 - RNA, 17 nt, Human
gggaggugggauccucc

SEQ ID NO: 3004468 - RNA, 16 nt, Human
gggaggugaccccagg

SEQ ID NO: 3004469 - RNA, 18 nt, Human
gggcagugcuuggcccag

SEQ ID NO: 3004470 - RNA, 19 nt, Human
gggcagugcuuggcccagg

SEQ ID NO: 3004471 - RNA, 20 nt, Human
gggcagugcuuggcccagga

SEQ ID NO: 3004472 - RNA, 22 nt, Human
gggcagugcuuggcccaggagu

SEQ ID NO: 3004473 - RNA, 20 nt, Human
gggcagugcucacccacacc

SEQ ID NO: 3004474 - RNA, 23 nt, Human
gggcagugcuuggcccaggaguu

SEQ ID NO: 3004475 - RNA, 12 nt, Human
gggcaugacacg

SEQ ID NO: 3004476 - RNA, 16 nt, Human
gggccacagagaaagu

SEQ ID NO: 3004477 - RNA, 23 nt, Human
gggccacagagaaaguacuucuc

SEQ ID NO: 3004478 - RNA, 19 nt, Human
gggccaccgccuugcccag

SEQ ID NO: 3004479 - RNA, 17 nt, Human
gggcccagagagggugg

SEQ ID NO: 3004480 - RNA, 14 nt, Human
gggccuggccugag

SEQ ID NO: 3004481 - RNA, 18 nt, Human
gggccuggccugagcugg

SEQ ID NO: 3004482 - RNA, 17 nt, Human
gggccuggcucaggugg

SEQ ID NO: 3004483 - RNA, 13 nt, Human
gggccuggcuccc

SEQ ID NO: 3004484 - RNA, 13 nt, Human
gggcccugccucc

SEQ ID NO: 3004485 - RNA, 13 nt, Human
gggccuggccuga

SEQ ID NO: 3004486 - RNA, 12 nt, Human
gggccuggccug

SEQ ID NO: 3004487 - RNA, 17 nt, Human
ggcuuagugauguaauu

SEQ ID NO: 3004488 - RNA, 21 nt, Human
ggcuuagucacugagacagcc

SEQ ID NO: 3004489 - RNA, 16 nt, Human
ggcuuagacccucaug

SEQ ID NO: 3004490 - RNA, 21 nt, Human
ggcuuaauuauugauguuuuc

SEQ ID NO: 3004491 - RNA, 17 nt, Human
ggcugggcuucaguggc

SEQ ID NO: 3004492 - RNA, 13 nt, Human
ggcugggcuucag

SEQ ID NO: 3004493 - RNA, 15 nt, Human
ggcuuaaaacaacac

SEQ ID NO: 3004494 - RNA, 12 nt, Human
ggcugggcuuca

SEQ ID NO: 3004495 - RNA, 17 nt, Human
ggcugggcucccuuccc

SEQ ID NO: 3004496 - RNA, 19 nt, Human
ggcuuggggaccagagcug

SEQ ID NO: 3004497 - RNA, 21 nt, Human
ggcuuggggaccagagcugcc

SEQ ID NO: 3004498 - RNA, 22 nt, Human
ggcuugaguuuaaauuguaaua

SEQ ID NO: 3004499 - RNA, 10 nt, Human
ggcuuuugug

SEQ ID NO: 3004500 - RNA, 14 nt, Human
gggaauugaggaca

SEQ ID NO: 3004501 - RNA, 12 nt, Human
gggaccucaggc

SEQ ID NO: 3004502 - RNA, 13 nt, Human
gggaccucaggcc

SEQ ID NO: 3004503 - RNA, 15 nt, Human
gggaccucaggccug

SEQ ID NO: 3004504 - RNA, 16 nt, Human
gggacucaaugcacug

SEQ ID NO: 3004505 - RNA, 17 nt, Human
gggacuacaggcaccca

SEQ ID NO: 3004506 - RNA, 23 nt, Human
gggaaggauacaaaagcauguga

SEQ ID NO: 3004507 - RNA, 21 nt, Human
gggaaggauacaaaagcaugu

SEQ ID NO: 3004508 - RNA, 14 nt, Human
ggcuuuugugcauu

SEQ ID NO: 3004509 - RNA, 16 nt, Human
gggaaggauacaaaag

SEQ ID NO: 3004510 - RNA, 14 nt, Human
gggaagggggcugg

SEQ ID NO: 3004511 - RNA, 16 nt, Human
gggaagggggcuggga

SEQ ID NO: 3004512 - RNA, 17 nt, Human
gggaagggggcugggac

SEQ ID NO: 3004513 - RNA, 13 nt, Human
gggaaugaagaua

SEQ ID NO: 3004514 - RNA, 23 nt, Human
ggcugcaaaggguaucaggugcu

SEQ ID NO: 3004515 - RNA, 22 nt, Human
ggcugcaaaggguaucaggugc

SEQ ID NO: 3004516 - RNA, 18 nt, Human
ggcugcaaaggguaucag

SEQ ID NO: 3004517 - RNA, 18 nt, Human
ggcugcaccggcuggccu

SEQ ID NO: 3004518 - RNA, 19 nt, Human
ggcugcaccggcuggccug

SEQ ID NO: 3004519 - RNA, 17 nt, Human
ggcugcaccggcuggcc

SEQ ID NO: 3004520 - RNA, 24 nt, Human
ggcugcaaaggguaucaggugcug

SEQ ID NO: 3004521 - RNA, 17 nt, Human
ggccccugcccggcugc

SEQ ID NO: 3004522 - RNA, 16 nt, Human
ggccccugcccggcug

SEQ ID NO: 3004523 - RNA, 17 nt, Human
ggcucugccucccauca

SEQ ID NO: 3004524 - RNA, 20 nt, Human
ggccccugcccggcugcgga

SEQ ID NO: 3004525 - RNA, 13 nt, Human
ggcugagguggga

SEQ ID NO: 3004526 - RNA, 15 nt, Human
ggcugaggugggagg

SEQ ID NO: 3004527 - RNA, 13 nt, Human
ggcugggcagagg

SEQ ID NO: 3004528 - RNA, 14 nt, Human
ggcugggcagagga

SEQ ID NO: 3004529 - RNA, 20 nt, Human
ggcugggagagccuuccagg

SEQ ID NO: 3004530 - RNA, 23 nt, Human
ggcugggagagccuuccaggggu

SEQ ID NO: 3004531 - RNA, 15 nt, Human
ggcugggcagaggaa

SEQ ID NO: 3004532 - RNA, 19 nt, Human
ggcugggcagaggaaagca

SEQ ID NO: 3004533 - RNA, 18 nt, Human
ggcugggagagccuucca

SEQ ID NO: 3004534 - RNA, 19 nt, Human
ggcugggagagccuuccag

SEQ ID NO: 3004535 - RNA, 23 nt, Human
ggcugcuucaaggauccugagcc

SEQ ID NO: 3004536 - RNA, 21 nt, Human
ggcugcuucaaggauccugag

SEQ ID NO: 3004537 - RNA, 13 nt, Human
ggcugcugaaggc

SEQ ID NO: 3004538 - RNA, 18 nt, Human
ggcugcugaaggcucgag

SEQ ID NO: 3004539 - RNA, 15 nt, Human
ggcugcugaaggcuc

SEQ ID NO: 3004540 - RNA, 17 nt, Human
ggcugcugaaggcucga

SEQ ID NO: 3004541 - RNA, 14 nt, Human
ggcugcugaaggcu

SEQ ID NO: 3004542 - RNA, 13 nt, Human
ggcugcagggagu

SEQ ID NO: 3004543 - RNA, 12 nt, Human
ggcugcagggag

SEQ ID NO: 3004544 - RNA, 11 nt, Human
ggcugcuucaa

SEQ ID NO: 3004545 - RNA, 12 nt, Human
ggcugcuucaag

SEQ ID NO: 3004546 - RNA, 14 nt, Human
ggcugcuucaagga

SEQ ID NO: 3004547 - RNA, 22 nt, Human
ggcugcuucaaggauccugagc

SEQ ID NO: 3004548 - RNA, 23 nt, Human
ggagcccugucuccucucucugu

SEQ ID NO: 3004549 - RNA, 20 nt, Human
ggagcaaaaucgaugcagug

SEQ ID NO: 3004550 - RNA, 15 nt, Human
ggagaggggcacagg

SEQ ID NO: 3004551 - RNA, 20 nt, Human
ggagauuuacaacuggggga

SEQ ID NO: 3004552 - RNA, 17 nt, Human
ggagagcuagcagcagg

SEQ ID NO: 3004553 - RNA, 21 nt, Human
ggagagcuagcagcagggagg

SEQ ID NO: 3004554 - RNA, 21 nt, Human
ggagaccccuuggggagcagg

SEQ ID NO: 3004555 - RNA, 23 nt, Human
ggaccccacuccggcccuccaga

SEQ ID NO: 3004556 - RNA, 20 nt, Human
ggaagccagcaggcucucag

SEQ ID NO: 3004557 - RNA, 19 nt, Human
ggaggacgcucucuggccu

SEQ ID NO: 3004558 - RNA, 21 nt, Human
ggaggacgcucucuggccuuc

SEQ ID NO: 3004559 - RNA, 20 nt, Human
ggaggacgcucucuggccuu

SEQ ID NO: 3004560 - RNA, 19 nt, Human
ggaggacuccaggcagcag

SEQ ID NO: 3004561 - RNA, 15 nt, Human
ggaggauguucuggg

SEQ ID NO: 3004562 - RNA, 23 nt, Human
ggaggaucacuugaguccagaag

SEQ ID NO: 3004563 - RNA, 17 nt, Human
ggaggaucucuugagcc

SEQ ID NO: 3004564 - RNA, 21 nt, Human
ggaggaucucuugagccuggg

SEQ ID NO: 3004565 - RNA, 12 nt, Human
ggagggcuccag

SEQ ID NO: 3004566 - RNA, 13 nt, Human
ggagggcuccaga

SEQ ID NO: 3004567 - RNA, 12 nt, Human
ggagggagggcu

SEQ ID NO: 3004568 - RNA, 21 nt, Human
ggagugacagaggcagcccca

SEQ ID NO: 3004569 - RNA, 19 nt, Human
ggagugacagaggcagccc

SEQ ID NO: 3004570 - RNA, 18 nt, Human
ggagugacagaggcagcc

SEQ ID NO: 3004571 - RNA, 17 nt, Human
ggagugacagaggcagc

SEQ ID NO: 3004572 - RNA, 21 nt, Human
ggagugaguugauagcacaga

SEQ ID NO: 3004573 - RNA, 14 nt, Human
ggagugagcugguu

SEQ ID NO: 3004574 - RNA, 12 nt, Human
ggagugagcugg

SEQ ID NO: 3004575 - RNA, 16 nt, Human
ggaucacagccucuga

SEQ ID NO: 3004576 - RNA, 16 nt, Human
ggagugacagaggcag

SEQ ID NO: 3004577 - RNA, 11 nt, Human
ggagugacaga

SEQ ID NO: 3004578 - RNA, 20 nt, Human
ggagucccaccuuggcugca

SEQ ID NO: 3004579 - RNA, 17 nt, Human
ggagggcuccagacaca

SEQ ID NO: 3004580 - RNA, 14 nt, Human
ggagggcuccagac

SEQ ID NO: 3004581 - RNA, 15 nt, Human
ggagggcuccagaca

SEQ ID NO: 3004582 - RNA, 18 nt, Human
ggcagcucaccucucccu

SEQ ID NO: 3004583 - RNA, 21 nt, Human
ggcagcucaccucucccuugg

SEQ ID NO: 3004584 - RNA, 22 nt, Human
ggcagcucaccucucccuugga

SEQ ID NO: 3004585 - RNA, 16 nt, Human
ggcagcucaccucucc

SEQ ID NO: 3004586 - RNA, 16 nt, Human
ggcagcugccuccccu

SEQ ID NO: 3004587 - RNA, 16 nt, Human
ggcagcagacacaugc

SEQ ID NO: 3004588 - RNA, 22 nt, Human
ggcagcugccuccccuccucug

SEQ ID NO: 3004589 - RNA, 21 nt, Human
ggcagcuugaggguugggcug

SEQ ID NO: 3004590 - RNA, 21 nt, Human
ggcagcugccuccccuccucu

SEQ ID NO: 3004591 - RNA, 18 nt, Human
ggcagcugccuccccucc

SEQ ID NO: 3004592 - RNA, 19 nt, Human
ggcagcugcgguccaccca

SEQ ID NO: 3004593 - RNA, 13 nt, Human
ggcagguccaggg

SEQ ID NO: 3004594 - RNA, 23 nt, Human
ggcaggucuugaacuccuggccu

SEQ ID NO: 3004595 - RNA, 23 nt, Human
ggcagaguugaagacagagcuac

SEQ ID NO: 3004596 - RNA, 23 nt, Human
ggcagauacaggaaaagcugcug

SEQ ID NO: 3004597 - RNA, 17 nt, Human
ggcagaggaaagcaaag

SEQ ID NO: 3004598 - RNA, 14 nt, Human
ggcagcagacacau

SEQ ID NO: 3004599 - RNA, 18 nt, Human
ggcaacugcauuggcuuu

SEQ ID NO: 3004600 - RNA, 19 nt, Human
ggcaacugcauuggcuuug

SEQ ID NO: 3004601 - RNA, 15 nt, Human
ggcaaggcugucaau

SEQ ID NO: 3004602 - RNA, 19 nt, Human
ggcaacccccagccugcua

SEQ ID NO: 3004603 - RNA, 21 nt, Human
ggaucagucugauucccaagc

SEQ ID NO: 3004604 - RNA, 20 nt, Human
ggcagagcagagaccauccc

SEQ ID NO: 3004605 - RNA, 15 nt, Human
ggcagagcagagacc

SEQ ID NO: 3004606 - RNA, 16 nt, Human
ggcagagcagagacca

SEQ ID NO: 3004607 - RNA, 12 nt, Human
ggcagagcagag

SEQ ID NO: 3004608 - RNA, 16 nt, Human
ggcacccggccccugc

SEQ ID NO: 3004609 - RNA, 15 nt, Human
ggcacccggccccug

SEQ ID NO: 3004610 - RNA, 16 nt, Human
ggcaaggcugucaauu

SEQ ID NO: 3004611 - RNA, 22 nt, Human
ggccaugggacagggaggacgc

SEQ ID NO: 3004612 - RNA, 13 nt, Human
ggccaugggccuc

SEQ ID NO: 3004613 - RNA, 12 nt, Human
ggccccugccac

SEQ ID NO: 3004614 - RNA, 16 nt, Human
ggccccugccacccug

SEQ ID NO: 3004615 - RNA, 13 nt, Human
ggccccugccacc

SEQ ID NO: 3004616 - RNA, 13 nt, Human
ggccccugcccgg

SEQ ID NO: 3004617 - RNA, 18 nt, Human
ggccccugccacccuggg

SEQ ID NO: 3004618 - RNA, 17 nt, Human
ggccccugccacccugg

SEQ ID NO: 3004619 - RNA, 16 nt, Human
ggccccucaggguccc

SEQ ID NO: 3004620 - RNA, 19 nt, Human
ggccccucagggucccugg

SEQ ID NO: 3004621 - RNA, 20 nt, Human
ggccccucagggucccuggu

SEQ ID NO: 3004622 - RNA, 21 nt, Human
ggccccucagggucccuggug

SEQ ID NO: 3004623 - RNA, 15 nt, Human
ggcauuccccaggag

SEQ ID NO: 3004624 - RNA, 16 nt, Human
ggccacaagacccuug

SEQ ID NO: 3004625 - RNA, 17 nt, Human
ggccacaagacccuugu

SEQ ID NO: 3004626 - RNA, 16 nt, Human
ggccaccugcggugcu

SEQ ID NO: 3004627 - RNA, 22 nt, Human
ggccaccugcggugcuaucucc

SEQ ID NO: 3004628 - RNA, 23 nt, Human
ggcauguucucugaggacacuaa

SEQ ID NO: 3004629 - RNA, 19 nt, Human
ggcagugcucacccacacc

SEQ ID NO: 3004630 - RNA, 15 nt, Human
ggcagguuggugggg

SEQ ID NO: 3004631 - RNA, 16 nt, Human
ggccaggccagaggga

SEQ ID NO: 3004632 - RNA, 14 nt, Human
ggccaggccagagg

SEQ ID NO: 3004633 - RNA, 11 nt, Human
ggccaggcugg

SEQ ID NO: 3004634 - RNA, 16 nt, Human
ggccacugugaagaga

SEQ ID NO: 3004635 - RNA, 14 nt, Human
ggccaggagccucc

SEQ ID NO: 3004636 - RNA, 16 nt, Human
ggccaggagccuccug

SEQ ID NO: 3004637 - RNA, 11 nt, Human
ggccacuguga

SEQ ID NO: 3004638 - RNA, 14 nt, Human
gcuuggcccaggag

SEQ ID NO: 3004639 - RNA, 15 nt, Human
gcuuggcccaggagu

SEQ ID NO: 3004640 - RNA, 16 nt, Human
gcuuggcccaggaguu

SEQ ID NO: 3004641 - RNA, 22 nt, Human
gcuuggcccaggaguuuggcca

SEQ ID NO: 3004642 - RNA, 13 nt, Human
gcuuggcccagga

SEQ ID NO: 3004643 - RNA, 23 nt, Human
gcuuggcccaggaguuuggccag

SEQ ID NO: 3004644 - RNA, 22 nt, Human
gcuuuaccaauugaaguaaaau

SEQ ID NO: 3004645 - RNA, 14 nt, Human
gcuuuuacuuaaac

SEQ ID NO: 3004646 - RNA, 20 nt, Human
ggaaaaaauaacaaugaaag

SEQ ID NO: 3004647 - RNA, 17 nt, Human
gcuuuuaaaaaaaaaua

SEQ ID NO: 3004648 - RNA, 15 nt, Human
ggaaaaauagccugc

SEQ ID NO: 3004649 - RNA, 14 nt, Human
ggaaaaacugauuu

SEQ ID NO: 3004650 - RNA, 13 nt, Human
ggaaaaauagccu

SEQ ID NO: 3004651 - RNA, 15 nt, Human
gcuguucacagccag

SEQ ID NO: 3004652 - RNA, 16 nt, Human
gcuguucacagccaga

SEQ ID NO: 3004653 - RNA, 18 nt, Human
gcuuccagugaggcucug

SEQ ID NO: 3004654 - RNA, 23 nt, Human
gcuguucacagccagacuggcac

SEQ ID NO: 3004655 - RNA, 19 nt, Human
gcuuccagugaggcucugc

SEQ ID NO: 3004656 - RNA, 20 nt, Human
gcuuccagugaggcucugcc

SEQ ID NO: 3004657 - RNA, 21 nt, Human
gcuuccagugaggcucugccc

SEQ ID NO: 3004658 - RNA, 13 nt, Human
gcuuggaggaagg

SEQ ID NO: 3004659 - RNA, 14 nt, Human
gcuuggaggaagga

SEQ ID NO: 3004660 - RNA, 15 nt, Human
gcuuggaggaaggaa

SEQ ID NO: 3004661 - RNA, 19 nt, Human
gcuugcccuggugccucac

SEQ ID NO: 3004662 - RNA, 17 nt, Human
gcuugcccuggugccuc

SEQ ID NO: 3004663 - RNA, 21 nt, Human
gcuugccaucccucccuccac

SEQ ID NO: 3004664 - RNA, 18 nt, Human
gcuugccaucccucccuc

SEQ ID NO: 3004665 - RNA, 16 nt, Human
gcuugccaucccuccc

SEQ ID NO: 3004666 - RNA, 22 nt, Human
gcuugaggguugggcugguguc

SEQ ID NO: 3004667 - RNA, 10 nt, Human
ggaaaagaau

SEQ ID NO: 3004668 - RNA, 14 nt, Human
ggaaaauaaauuau

SEQ ID NO: 3004669 - RNA, 15 nt, Human
ggaaaaucagccugc

SEQ ID NO: 3004670 - RNA, 18 nt, Human
ggaaauauuuauuuuaau

SEQ ID NO: 3004671 - RNA, 17 nt, Human
ggaaauauuuauuuuaa

SEQ ID NO: 3004672 - RNA, 17 nt, Human
ggaacagacuggaagca

SEQ ID NO: 3004673 - RNA, 15 nt, Human
ggaaauauuuauuuu

SEQ ID NO: 3004674 - RNA, 13 nt, Human
ggaaauauuuauu

SEQ ID NO: 3004675 - RNA, 12 nt, Human
ggaaauauuuau

SEQ ID NO: 3004676 - RNA, 20 nt, Human
ggaacagacuggaagcacag

SEQ ID NO: 3004677 - RNA, 19 nt, Human
ggaacagacuggaagcaca

SEQ ID NO: 3004678 - RNA, 23 nt, Human
ggaaccgagggggcugcucccac

SEQ ID NO: 3004679 - RNA, 13 nt, Human
ggaagcacaugcc

SEQ ID NO: 3004680 - RNA, 14 nt, Human
ggaagcacaugccu

SEQ ID NO: 3004681 - RNA, 15 nt, Human
ggaagcacaugccuc

SEQ ID NO: 3004682 - RNA, 17 nt, Human
ggaagcacaugccucuc

SEQ ID NO: 3004683 - RNA, 17 nt, Human
ggaagcacagcuucauu

SEQ ID NO: 3004684 - RNA, 13 nt, Human
ggaagagccuugc

SEQ ID NO: 3004685 - RNA, 21 nt, Human
ggaagcacaugccucucucag

SEQ ID NO: 3004686 - RNA, 22 nt, Human
ggaagcacaugccucucucagg

SEQ ID NO: 3004687 - RNA, 23 nt, Human
ggaagcacaugccucucucaggc

SEQ ID NO: 3004688 - RNA, 15 nt, Human
ggaagccagcaggcu

SEQ ID NO: 3004689 - RNA, 16 nt, Human
ggaagccagcaggcuc

SEQ ID NO: 3004690 - RNA, 17 nt, Human
ggaagccagcaggcucu

SEQ ID NO: 3004691 - RNA, 18 nt, Human
ggaagccagcaggcucuc

SEQ ID NO: 3004692 - RNA, 13 nt, Human
ggaagccagcagg

SEQ ID NO: 3004693 - RNA, 14 nt, Human
ggaagccagcaggc

SEQ ID NO: 3004694 - RNA, 18 nt, Human
gcuagauguauguacuuc

SEQ ID NO: 3004695 - RNA, 16 nt, Human
gcuagauguauguacu

SEQ ID NO: 3004696 - RNA, 11 nt, Human
gcugcccugug

SEQ ID NO: 3004697 - RNA, 12 nt, Human
gcugcccuguga

SEQ ID NO: 3004698 - RNA, 14 nt, Human
gcugcccugugagu

SEQ ID NO: 3004699 - RNA, 16 nt, Human
gcugcgguccacccag

SEQ ID NO: 3004700 - RNA, 13 nt, Human
gcugcuucaagga

SEQ ID NO: 3004701 - RNA, 10 nt, Human
gcugcuccca

SEQ ID NO: 3004702 - RNA, 18 nt, Human
gcugcgguccacccagga

SEQ ID NO: 3004703 - RNA, 17 nt, Human
gcugcgguccacccagg

SEQ ID NO: 3004704 - RNA, 16 nt, Human
gcugcuugggcuucau

SEQ ID NO: 3004705 - RNA, 21 nt, Human
gcugcuucaaggauccugagc

SEQ ID NO: 3004706 - RNA, 22 nt, Human
gcugcuucaaggauccugagcc

SEQ ID NO: 3004707 - RNA, 23 nt, Human
gcugcuucaaggauccugagcca

SEQ ID NO: 3004708 - RNA, 22 nt, Human
gcuggaccuugaacuggguacu

SEQ ID NO: 3004709 - RNA, 21 nt, Human
gcuggaccuugaacuggguac

SEQ ID NO: 3004710 - RNA, 17 nt, Human
gcugcuugggcuucauc

SEQ ID NO: 3004711 - RNA, 22 nt, Human
gcugcuugggcuucauccuccu

SEQ ID NO: 3004712 - RNA, 18 nt, Human
gcuggaccuugaacuggg

SEQ ID NO: 3004713 - RNA, 16 nt, Human
gcuggaccuugaacug

SEQ ID NO: 3004714 - RNA, 20 nt, Human
gcugggacaugggaaagggg

SEQ ID NO: 3004715 - RNA, 20 nt, Human
gcugggacuacaggcaccca

SEQ ID NO: 3004716 - RNA, 19 nt, Human
gcugggacuacaggcaccc

SEQ ID NO: 3004717 - RNA, 18 nt, Human
gcugggacuacaggcacc

SEQ ID NO: 3004718 - RNA, 13 nt, Human
gcugggacuacag

SEQ ID NO: 3004719 - RNA, 19 nt, Human
gcugggacuacagguguga

SEQ ID NO: 3004720 - RNA, 19 nt, Human
gcugggcuucaguggcagc

SEQ ID NO: 3004721 - RNA, 18 nt, Human
gcugggcuucaguggcag

SEQ ID NO: 3004722 - RNA, 23 nt, Human
gcugggggaagaagcucucuccu

SEQ ID NO: 3004723 - RNA, 12 nt, Human
gcuggggccagu

SEQ ID NO: 3004724 - RNA, 19 nt, Human
gcuggucccacucagucca

SEQ ID NO: 3004725 - RNA, 15 nt, Human
gcuggucccacucag

SEQ ID NO: 3004726 - RNA, 20 nt, Human
gcugggggccucagugccac

SEQ ID NO: 3004727 - RNA, 19 nt, Human
gcugggggccucagugcca

SEQ ID NO: 3004728 - RNA, 12 nt, Human
gcugggagagcc

SEQ ID NO: 3004729 - RNA, 13 nt, Human
gcugggagagccu

SEQ ID NO: 3004730 - RNA, 17 nt, Human
gcugggagagccuucca

SEQ ID NO: 3004731 - RNA, 18 nt, Human
gcugggagagccuuccag

SEQ ID NO: 3004732 - RNA, 19 nt, Human
gcugggagagccuuccagg

SEQ ID NO: 3004733 - RNA, 22 nt, Human
gcugggagagccuuccaggggu

SEQ ID NO: 3004734 - RNA, 21 nt, Human
gcugggaugauuggagggggg

SEQ ID NO: 3004735 - RNA, 17 nt, Human
gcugggcuucaguggca

SEQ ID NO: 3004736 - RNA, 22 nt, Human
gcuguauuuuaaaagaaugauu

SEQ ID NO: 3004737 - RNA, 22 nt, Human
gcugguucaggguuggccccug

SEQ ID NO: 3004738 - RNA, 16 nt, Human
gcugucaauuacagga

SEQ ID NO: 3004739 - RNA, 21 nt, Human
gcugguuagagguucccuuug

SEQ ID NO: 3004740 - RNA, 15 nt, Human
gcugguucaggguug

SEQ ID NO: 3004741 - RNA, 14 nt, Human
gcuggucccacuca

SEQ ID NO: 3004742 - RNA, 20 nt, Human
gcuggucccacucaguccau

SEQ ID NO: 3004743 - RNA, 18 nt, Human
gcuggugucaccugaaga

SEQ ID NO: 3004744 - RNA, 16 nt, Human
gcuggugucaccugaa

SEQ ID NO: 3004745 - RNA, 17 nt, Human
gcugucaauuacaggaa

SEQ ID NO: 3004746 - RNA, 19 nt, Human
gcugucaauuacaggaagu

SEQ ID NO: 3004747 - RNA, 22 nt, Human
gcugucaauuacaggaaguacu

SEQ ID NO: 3004748 - RNA, 23 nt, Human
gcugucaauuacaggaaguacug

SEQ ID NO: 3004749 - RNA, 21 nt, Human
gcugucccuuacgugaguccu

SEQ ID NO: 3004750 - RNA, 19 nt, Human
gcugucccuuacgugaguc

SEQ ID NO: 3004751 - RNA, 17 nt, Human
gcugucuccauguuuga

SEQ ID NO: 3004752 - RNA, 19 nt, Human
gccuuuuuauaacuuuuua

SEQ ID NO: 3004753 - RNA, 22 nt, Human
gcgacagugagacucugucuca

SEQ ID NO: 3004754 - RNA, 19 nt, Human
gccuucggccuccauccug

SEQ ID NO: 3004755 - RNA, 20 nt, Human
gccuuccccuggcacuggca

SEQ ID NO: 3004756 - RNA, 18 nt, Human
gccuucggccuccauccu

SEQ ID NO: 3004757 - RNA, 19 nt, Human
gccuuccccuggcacuggc

SEQ ID NO: 3004758 - RNA, 21 nt, Human
gccuuccaggggugggacacc

SEQ ID NO: 3004759 - RNA, 18 nt, Human
gccuguaaucacagcuac

SEQ ID NO: 3004760 - RNA, 17 nt, Human
gccugguggcagcugcg

SEQ ID NO: 3004761 - RNA, 16 nt, Human
gccugguggcagcugc

SEQ ID NO: 3004762 - RNA, 17 nt, Human
gccugucagcuaaagaa

SEQ ID NO: 3004763 - RNA, 15 nt, Human
gccugguggcagcug

SEQ ID NO: 3004764 - RNA, 14 nt, Human
gccugguggcagcu

SEQ ID NO: 3004765 - RNA, 20 nt, Human
gccuuagaagucacacagua

SEQ ID NO: 3004766 - RNA, 19 nt, Human
gccuuacccucauguucuu

SEQ ID NO: 3004767 - RNA, 21 nt, Human
gccuuauggaacacucugaga

SEQ ID NO: 3004768 - RNA, 22 nt, Human
gccuuauggaacacucugagac

SEQ ID NO: 3004769 - RNA, 23 nt, Human
gccuuauggaacacucugagacu

SEQ ID NO: 3004770 - RNA, 22 nt, Human
gcguccugucggagcccugucu

SEQ ID NO: 3004771 - RNA, 14 nt, Human
gcgugagccacugc

SEQ ID NO: 3004772 - RNA, 15 nt, Human
gcgugagccacugca

SEQ ID NO: 3004773 - RNA, 17 nt, Human
gcuaacauggaaguacu

SEQ ID NO: 3004774 - RNA, 18 nt, Human
gcuaacauggaaguacua

SEQ ID NO: 3004775 - RNA, 14 nt, Human
gcuaacauggaagu

SEQ ID NO: 3004776 - RNA, 14 nt, Human
gcuaacuuggguua

SEQ ID NO: 3004777 - RNA, 22 nt, Human
gcuacacaggggaaaagaggag

SEQ ID NO: 3004778 - RNA, 21 nt, Human
gcuagacgagcaggcuucuuc

SEQ ID NO: 3004779 - RNA, 22 nt, Human
gcuagacgagcaggcuucuucc

SEQ ID NO: 3004780 - RNA, 19 nt, Human
gcguccugucggagcccug

SEQ ID NO: 3004781 - RNA, 23 nt, Human
gcgguccacccaggagccccgag

SEQ ID NO: 3004782 - RNA, 20 nt, Human
gcgguccacccaggagcccc

SEQ ID NO: 3004783 - RNA, 23 nt, Human
gcggggacagcuccuucuguccu

SEQ ID NO: 3004784 - RNA, 23 nt, Human
gcggacagccacggccaggccag

SEQ ID NO: 3004785 - RNA, 19 nt, Human
gcggggacagcuccuucug

SEQ ID NO: 3004786 - RNA, 18 nt, Human
gcggggacagcuccuucu

SEQ ID NO: 3004787 - RNA, 19 nt, Human
gcggacagccacggccagg

SEQ ID NO: 3004788 - RNA, 16 nt, Human
gcggacagccacggcc

SEQ ID NO: 3004789 - RNA, 19 nt, Human
gcggaaugaaccacaucuu

SEQ ID NO: 3004790 - RNA, 18 nt, Human
gcgccuacaggagugagc

SEQ ID NO: 3004791 - RNA, 23 nt, Human
gcgccacugugcuccagccuggg

SEQ ID NO: 3004792 - RNA, 22 nt, Human
gcgccacugugcuccagccugg

SEQ ID NO: 3004793 - RNA, 21 nt, Human
gcgccuacaggagugagcacu

SEQ ID NO: 3004794 - RNA, 20 nt, Human
gcgccuacaggagugagcac

SEQ ID NO: 3004795 - RNA, 14 nt, Human
gcgcugccccuggc

SEQ ID NO: 3004796 - RNA, 17 nt, Human
gcgcugccccuggcagc

SEQ ID NO: 3004797 - RNA, 14 nt, Human
gccuccccuccucu

SEQ ID NO: 3004798 - RNA, 13 nt, Human
gccuccccuccuc

SEQ ID NO: 3004799 - RNA, 12 nt, Human
gccuccccuccu

SEQ ID NO: 3004800 - RNA, 11 nt, Human
gccuccccucc

SEQ ID NO: 3004801 - RNA, 19 nt, Human
gccucccgaauagcuggga

SEQ ID NO: 3004802 - RNA, 18 nt, Human
gccucccgaauagcuggg

SEQ ID NO: 3004803 - RNA, 23 nt, Human
gccucccgaguagcugggacuac

SEQ ID NO: 3004804 - RNA, 21 nt, Human
gccucccgaguagcugggacu

SEQ ID NO: 3004805 - RNA, 20 nt, Human
gccucccgaauagcugggac

SEQ ID NO: 3004806 - RNA, 14 nt, Human
gccucagccuccca

SEQ ID NO: 3004807 - RNA, 12 nt, Human
gccucagccucc

SEQ ID NO: 3004808 - RNA, 17 nt, Human
gccucccaucacccgcu

SEQ ID NO: 3004809 - RNA, 22 nt, Human
gccucagccucccaaagugcug

SEQ ID NO: 3004810 - RNA, 15 nt, Human
gccucucccaucacu

SEQ ID NO: 3004811 - RNA, 21 nt, Human
gccucugcacuccccugcugg

SEQ ID NO: 3004812 - RNA, 15 nt, Human
gccucugcacucccc

SEQ ID NO: 3004813 - RNA, 13 nt, Human
gccugagaugguc

SEQ ID NO: 3004814 - RNA, 17 nt, Human
gccucugcacuccccug

SEQ ID NO: 3004815 - RNA, 18 nt, Human
gccucugcacuccccugc

SEQ ID NO: 3004816 - RNA, 19 nt, Human
gccucugcacuccccugcu

SEQ ID NO: 3004817 - RNA, 20 nt, Human
gccucugcacuccccugcug

SEQ ID NO: 3004818 - RNA, 16 nt, Human
gccucugcacuccccu

SEQ ID NO: 3004819 - RNA, 15 nt, Human
gccucugacacacag

SEQ ID NO: 3004820 - RNA, 14 nt, Human
gccuggacccugug

SEQ ID NO: 3004821 - RNA, 12 nt, Human
gccugcccaggc

SEQ ID NO: 3004822 - RNA, 11 nt, Human
gccugcccagg

SEQ ID NO: 3004823 - RNA, 13 nt, Human
gcccuucucucca

SEQ ID NO: 3004824 - RNA, 23 nt, Human
gcccuucucuccagccccuggau

SEQ ID NO: 3004825 - RNA, 19 nt, Human
gcccuucuuuccacagaag

SEQ ID NO: 3004826 - RNA, 16 nt, Human
gccgagauagccaagg

SEQ ID NO: 3004827 - RNA, 16 nt, Human
gccgcagcccugcaga

SEQ ID NO: 3004828 - RNA, 17 nt, Human
gccgcagcccugcagag

SEQ ID NO: 3004829 - RNA, 15 nt, Human
gccgcagcccugcag

SEQ ID NO: 3004830 - RNA, 17 nt, Human
gccgagauagccaaggc

SEQ ID NO: 3004831 - RNA, 13 nt, Human
gccgcagcccugc

SEQ ID NO: 3004832 - RNA, 18 nt, Human
gccgucuaccugaggggc

SEQ ID NO: 3004833 - RNA, 20 nt, Human
gccgucuaccugaggggccu

SEQ ID NO: 3004834 - RNA, 22 nt, Human
gccgucuaccugaggggccucu

SEQ ID NO: 3004835 - RNA, 23 nt, Human
gccgucuaccugaggggccucuu

SEQ ID NO: 3004836 - RNA, 21 nt, Human
gccucagcauccuggcacccg

SEQ ID NO: 3004837 - RNA, 17 nt, Human
gccucagcauccuggca

SEQ ID NO: 3004838 - RNA, 18 nt, Human
gccucagcauccuggcac

SEQ ID NO: 3004839 - RNA, 24 nt, Human
gccucaagugauucuccugccuca

SEQ ID NO: 3004840 - RNA, 22 nt, Human
gccucaagugauucuccugccu

SEQ ID NO: 3004841 - RNA, 21 nt, Human
gcccucuccugggcagcugcc

SEQ ID NO: 3004842 - RNA, 19 nt, Human
gcccucuccugggcagcug

SEQ ID NO: 3004843 - RNA, 18 nt, Human
gcccucuccugggcagcu

SEQ ID NO: 3004844 - RNA, 22 nt, Human
gcccucugcccacucccugcaa

SEQ ID NO: 3004845 - RNA, 16 nt, Human
gcccucuccugggcag

SEQ ID NO: 3004846 - RNA, 15 nt, Human
gcccucuccugggca

SEQ ID NO: 3004847 - RNA, 14 nt, Human
gcccucuccugggc

SEQ ID NO: 3004848 - RNA, 19 nt, Human
gcccgggcucugccuccca

SEQ ID NO: 3004849 - RNA, 20 nt, Human
gcccgggcucugccucccau

SEQ ID NO: 3004850 - RNA, 21 nt, Human
gcccgggcucugccucccauc

SEQ ID NO: 3004851 - RNA, 13 nt, Human
gcccgggcucugc

SEQ ID NO: 3004852 - RNA, 14 nt, Human
gcccgggcucugcc

SEQ ID NO: 3004853 - RNA, 15 nt, Human
gcccgggcucugccu

SEQ ID NO: 3004854 - RNA, 18 nt, Human
gcccgggcucugccuccc

SEQ ID NO: 3004855 - RNA, 12 nt, Human
gcccgggcucug

SEQ ID NO: 3004856 - RNA, 15 nt, Human
gcccggcuccaggcu

SEQ ID NO: 3004857 - RNA, 14 nt, Human
gcccggcuccaggc

SEQ ID NO: 3004858 - RNA, 13 nt, Human
gcccggcuccagg

SEQ ID NO: 3004859 - RNA, 12 nt, Human
gcccggcuccag

SEQ ID NO: 3004860 - RNA, 19 nt, Human
gccccuucugacccaugcu

SEQ ID NO: 3004861 - RNA, 23 nt, Human
gccccuggcagccccuguucugg

SEQ ID NO: 3004862 - RNA, 19 nt, Human
gccccugcacuccagccug

SEQ ID NO: 3004863 - RNA, 22 nt, Human
gccccugcacagcaggcugcca

SEQ ID NO: 3004864 - RNA, 17 nt, Human
gccccugcacagcaggc

SEQ ID NO: 3004865 - RNA, 14 nt, Human
gccccugcacagca

SEQ ID NO: 3004866 - RNA, 23 nt, Human
gccccugcacagcaggcugccag

SEQ ID NO: 3004867 - RNA, 19 nt, Human
gccccucagggucccuggu

SEQ ID NO: 3004868 - RNA, 21 nt, Human
gccccucagggucccuggugg

SEQ ID NO: 3004869 - RNA, 17 nt, Human
gccccgugggguuccuc

SEQ ID NO: 3004870 - RNA, 23 nt, Human
gccccauucugccugcccaggcc

SEQ ID NO: 3004871 - RNA, 22 nt, Human
gccccauucugccugcccaggc

SEQ ID NO: 3004872 - RNA, 23 nt, Human
gccccgaggccuucucugaagga

SEQ ID NO: 3004873 - RNA, 15 nt, Human
gccccauucugccug

SEQ ID NO: 3004874 - RNA, 14 nt, Human
gccccgcccaggcu

SEQ ID NO: 3004875 - RNA, 22 nt, Human
gccccgaggccuucucugaagg

SEQ ID NO: 3004876 - RNA, 15 nt, Human
gcccaggcuggcgug

SEQ ID NO: 3004877 - RNA, 14 nt, Human
gcccaggcuggcgu

SEQ ID NO: 3004878 - RNA, 16 nt, Human
gcccaggcuggcgugc

SEQ ID NO: 3004879 - RNA, 20 nt, Human
gcccagucuggaaugcagug

SEQ ID NO: 3004880 - RNA, 22 nt, Human
gcccagucuggaaugcaguggu

SEQ ID NO: 3004881 - RNA, 12 nt, Human
gcccaggaaagg

SEQ ID NO: 3004882 - RNA, 15 nt, Human
gcccaggaaaggcuc

SEQ ID NO: 3004883 - RNA, 16 nt, Human
gcccaggaaaggcucc

SEQ ID NO: 3004884 - RNA, 18 nt, Human
gcccaggccuccuacagc

SEQ ID NO: 3004885 - RNA, 11 nt, Human
gcccaggcugg

SEQ ID NO: 3004886 - RNA, 17 nt, Human
gccccagugcccacagg

SEQ ID NO: 3004887 - RNA, 16 nt, Human
gccccagugcccacag

SEQ ID NO: 3004888 - RNA, 15 nt, Human
gccccagugcccaca

SEQ ID NO: 3004889 - RNA, 21 nt, Human
gccccauucugccugcccagg

SEQ ID NO: 3004890 - RNA, 20 nt, Human
gccccauucugccugcccag

SEQ ID NO: 3004891 - RNA, 18 nt, Human
gccccauucugccugccc

SEQ ID NO: 3004892 - RNA, 17 nt, Human
gccccauucugccugcc

SEQ ID NO: 3004893 - RNA, 23 nt, Human
gccccauccucuguacagagccc

SEQ ID NO: 3004894 - RNA, 15 nt, Human
gccccaucugcgggg

SEQ ID NO: 3004895 - RNA, 14 nt, Human
gccagcugcuuggg

SEQ ID NO: 3004896 - RNA, 15 nt, Human
gccagcugcuugggc

SEQ ID NO: 3004897 - RNA, 14 nt, Human
gccagccuugacca

SEQ ID NO: 3004898 - RNA, 20 nt, Human
gccagccuugaccauucucc

SEQ ID NO: 3004899 - RNA, 21 nt, Human
gccagccuugaccauucucca

SEQ ID NO: 3004900 - RNA, 22 nt, Human
gccagccuugaccauucuccac

SEQ ID NO: 3004901 - RNA, 21 nt, Human
gccagccgagauagccaaggc

SEQ ID NO: 3004902 - RNA, 20 nt, Human
gccagccgagauagccaagg

SEQ ID NO: 3004903 - RNA, 12 nt, Human
gccagccuugac

SEQ ID NO: 3004904 - RNA, 16 nt, Human
gccagauucuuuccug

SEQ ID NO: 3004905 - RNA, 20 nt, Human
gccagagggagugacagagg

SEQ ID NO: 3004906 - RNA, 19 nt, Human
gccagagggagugacagag

SEQ ID NO: 3004907 - RNA, 17 nt, Human
gccagauucuuuccuga

SEQ ID NO: 3004908 - RNA, 22 nt, Human
gccacguucuuacuaguuuccc

SEQ ID NO: 3004909 - RNA, 16 nt, Human
gccacggccaggccag

SEQ ID NO: 3004910 - RNA, 21 nt, Human
gccacuauuguuagucucuug

SEQ ID NO: 3004911 - RNA, 20 nt, Human
gccacuauuguuagucucuu

SEQ ID NO: 3004912 - RNA, 15 nt, Human
gccacggccaggcca

SEQ ID NO: 3004913 - RNA, 14 nt, Human
gccacggccaggcc

SEQ ID NO: 3004914 - RNA, 12 nt, Human
gccaaaggaagc

SEQ ID NO: 3004915 - RNA, 18 nt, Human
gccacugcaccgggccac

SEQ ID NO: 3004916 - RNA, 17 nt, Human
gccacugcaccgggcca

SEQ ID NO: 3004917 - RNA, 18 nt, Human
gccagagggagugacaga

SEQ ID NO: 3004918 - RNA, 17 nt, Human
gccagagggagugacag

SEQ ID NO: 3004919 - RNA, 12 nt, Human
gccagagacaca

SEQ ID NO: 3004920 - RNA, 15 nt, Human
gccagagacacaagc

SEQ ID NO: 3004921 - RNA, 13 nt, Human
gccaucccagccc

SEQ ID NO: 3004922 - RNA, 14 nt, Human
gccaucccagcccc

SEQ ID NO: 3004923 - RNA, 15 nt, Human
gccaucccagcccca

SEQ ID NO: 3004924 - RNA, 16 nt, Human
gccaucccagccccaa

SEQ ID NO: 3004925 - RNA, 14 nt, Human
gccaucccucccuc

SEQ ID NO: 3004926 - RNA, 13 nt, Human
gccaucccucccu

SEQ ID NO: 3004927 - RNA, 11 nt, Human
gccaucccucc

SEQ ID NO: 3004928 - RNA, 17 nt, Human
gccaucccagccccaau

SEQ ID NO: 3004929 - RNA, 14 nt, Human
gccauccagguuca

SEQ ID NO: 3004930 - RNA, 20 nt, Human
gccauccagguucagcuugu

SEQ ID NO: 3004931 - RNA, 19 nt, Human
gccauccagguucagcuug

SEQ ID NO: 3004932 - RNA, 17 nt, Human
gccaggaagccagcagg

SEQ ID NO: 3004933 - RNA, 18 nt, Human
gccaggaagccagcaggc

SEQ ID NO: 3004934 - RNA, 11 nt, Human
gccaggaagcc

SEQ ID NO: 3004935 - RNA, 19 nt, Human
gccaggaagccagcaggcu

SEQ ID NO: 3004936 - RNA, 21 nt, Human
gccaggggaaaaucagccugc

SEQ ID NO: 3004937 - RNA, 22 nt, Human
gccaggggaaaaucagccugcu

SEQ ID NO: 3004938 - RNA, 17 nt, Human
gccaggggaaaaucagc

SEQ ID NO: 3004939 - RNA, 23 nt, Human
gccaggggaaaaucagccugcuc

SEQ ID NO: 3004940 - RNA, 16 nt, Human
gcccacagcuguauga

SEQ ID NO: 3004941 - RNA, 15 nt, Human
gcccaaagaugcagc

SEQ ID NO: 3004942 - RNA, 16 nt, Human
gcccaaagaugcagcc

SEQ ID NO: 3004943 - RNA, 18 nt, Human
gcccacaggaucagucug

SEQ ID NO: 3004944 - RNA, 13 nt, Human
gcccacaggauca

SEQ ID NO: 3004945 - RNA, 19 nt, Human
gcccacaggaucagucuga

SEQ ID NO: 3004946 - RNA, 15 nt, Human
gcccaccccucaaca

SEQ ID NO: 3004947 - RNA, 19 nt, Human
gccaugggacagggaggac

SEQ ID NO: 3004948 - RNA, 14 nt, Human
gccaugggacaggg

SEQ ID NO: 3004949 - RNA, 15 nt, Human
gccaucccucccucc

SEQ ID NO: 3004950 - RNA, 20 nt, Human
gccauuucuuccacaagagc

SEQ ID NO: 3004951 - RNA, 22 nt, Human
gccauuucuuccacaagagccc

SEQ ID NO: 3004952 - RNA, 20 nt, Human
gccauuugucccaagugcca

SEQ ID NO: 3004953 - RNA, 18 nt, Human
gccauuugucccaagugc

SEQ ID NO: 3004954 - RNA, 16 nt, Human
gccauuugucccaagu

SEQ ID NO: 3004955 - RNA, 14 nt, Human
gccauuugucccaa

SEQ ID NO: 3004956 - RNA, 13 nt, Human
gccauuuguccca

SEQ ID NO: 3004957 - RNA, 17 nt, Human
gccauuucuuccacaag

SEQ ID NO: 3004958 - RNA, 22 nt, Human
gccauuuaaagcuuauuaaaac

SEQ ID NO: 3004959 - RNA, 16 nt, Human
gcagugcuuggcccag

SEQ ID NO: 3004960 - RNA, 17 nt, Human
gcagugcuuggcccagg

SEQ ID NO: 3004961 - RNA, 16 nt, Human
gcagugggagcugccu

SEQ ID NO: 3004962 - RNA, 23 nt, Human
gcagugcuuccaaggauggacca

SEQ ID NO: 3004963 - RNA, 14 nt, Human
gcagugcucaccca

SEQ ID NO: 3004964 - RNA, 15 nt, Human
gcaggcuacugucag

SEQ ID NO: 3004965 - RNA, 20 nt, Human
gcaggauucuuccucccucc

SEQ ID NO: 3004966 - RNA, 12 nt, Human
gcagggcucagc

SEQ ID NO: 3004967 - RNA, 16 nt, Human
gcagggagggcuucug

SEQ ID NO: 3004968 - RNA, 22 nt, Human
gcauauugcauacuauuaaaca

SEQ ID NO: 3004969 - RNA, 21 nt, Human
gcaucaagaugugacauguuu

SEQ ID NO: 3004970 - RNA, 17 nt, Human
gcauauucaggaagcuc

SEQ ID NO: 3004971 - RNA, 18 nt, Human
gcauauucaggaagcuca

SEQ ID NO: 3004972 - RNA, 20 nt, Human
gcauauucaggaagcucagg

SEQ ID NO: 3004973 - RNA, 15 nt, Human
gcauauucaggaagc

SEQ ID NO: 3004974 - RNA, 13 nt, Human
gcaguucugaaga

SEQ ID NO: 3004975 - RNA, 18 nt, Human
gcauagauucccugagca

SEQ ID NO: 3004976 - RNA, 18 nt, Human
gcagugggagcugccugu

SEQ ID NO: 3004977 - RNA, 17 nt, Human
gcagugggagcugccug

SEQ ID NO: 3004978 - RNA, 13 nt, Human
gcaucaggccagg

SEQ ID NO: 3004979 - RNA, 15 nt, Human
gcaucaggccaggcc

SEQ ID NO: 3004980 - RNA, 16 nt, Human
gcaucaggccaggccc

SEQ ID NO: 3004981 - RNA, 17 nt, Human
gcaucaggccaggcccu

SEQ ID NO: 3004982 - RNA, 23 nt, Human
gcaugaaguaauaugcacacauu

SEQ ID NO: 3004983 - RNA, 17 nt, Human
gcaugccuggauggggc

SEQ ID NO: 3004984 - RNA, 22 nt, Human
gcaugccuggauggggcugcac

SEQ ID NO: 3004985 - RNA, 15 nt, Human
gcaugcugucccuua

SEQ ID NO: 3004986 - RNA, 15 nt, Human
gcaugccuggauggg

SEQ ID NO: 3004987 - RNA, 17 nt, Human
gcauguuugugauugac

SEQ ID NO: 3004988 - RNA, 17 nt, Human
gcauuugcugaauacag

SEQ ID NO: 3004989 - RNA, 21 nt, Human
gcauuuggugguuucagaaau

SEQ ID NO: 3004990 - RNA, 23 nt, Human
gcauuugcugaauacagaggcaa

SEQ ID NO: 3004991 - RNA, 23 nt, Human
gcauuuuaaacaaaauagaaagu

SEQ ID NO: 3004992 - RNA, 12 nt, Human
gcauuccccacu

SEQ ID NO: 3004993 - RNA, 22 nt, Human
gcauuuugcuaaaugugaauga

SEQ ID NO: 3004994 - RNA, 16 nt, Human
gccaaaggaagcacau

SEQ ID NO: 3004995 - RNA, 20 nt, Human
gccaaaggaagcacaugccu

SEQ ID NO: 3004996 - RNA, 14 nt, Human
gccaaaggaagcac

SEQ ID NO: 3004997 - RNA, 16 nt, Human
gccaaagaagcagacc

SEQ ID NO: 3004998 - RNA, 21 nt, Human
gccaaacucaccugccccuca

SEQ ID NO: 3004999 - RNA, 19 nt, Human
gccaaacucaccugccccu

SEQ ID NO: 3005000 - RNA, 22 nt, Human
gcagaguggcagucuucaguuu

SEQ ID NO: 3005001 - RNA, 13 nt, Human
gcagaguggcagu

SEQ ID NO: 3005002 - RNA, 15 nt, Human
gcagaguugaagaca

SEQ ID NO: 3005003 - RNA, 14 nt, Human
gcagagaccauccc

SEQ ID NO: 3005004 - RNA, 15 nt, Human
gcagagaccaucccu

SEQ ID NO: 3005005 - RNA, 17 nt, Human
gcagagaccaucccuga

SEQ ID NO: 3005006 - RNA, 23 nt, Human
gcagagaaugaaagggcccagag

SEQ ID NO: 3005007 - RNA, 22 nt, Human
gcagagaaugaaagggcccaga

SEQ ID NO: 3005008 - RNA, 21 nt, Human
gcagagaauucucuuauccaa

SEQ ID NO: 3005009 - RNA, 21 nt, Human
gcagagaaugaaagggcccag

SEQ ID NO: 3005010 - RNA, 20 nt, Human
gcagagaaugaaagggccca

SEQ ID NO: 3005011 - RNA, 19 nt, Human
gcagagaaugaaagggccc

SEQ ID NO: 3005012 - RNA, 16 nt, Human
gcagaguugaagacag

SEQ ID NO: 3005013 - RNA, 17 nt, Human
gcagaguugaagacaga

SEQ ID NO: 3005014 - RNA, 19 nt, Human
gcagaguugaagacagagc

SEQ ID NO: 3005015 - RNA, 12 nt, Human
gcagcaauaaag

SEQ ID NO: 3005016 - RNA, 14 nt, Human
gcagccuggacccu

SEQ ID NO: 3005017 - RNA, 22 nt, Human
gcagccucaaccuccugggcua

SEQ ID NO: 3005018 - RNA, 21 nt, Human
gcagccucaaccuccugggcu

SEQ ID NO: 3005019 - RNA, 20 nt, Human
gcagccucaaccuccugggc

SEQ ID NO: 3005020 - RNA, 19 nt, Human
gcagccucaaccuccuggg

SEQ ID NO: 3005021 - RNA, 20 nt, Human
gcagcagggagggcuucugc

SEQ ID NO: 3005022 - RNA, 14 nt, Human
gcagaagacaguau

SEQ ID NO: 3005023 - RNA, 13 nt, Human
gcagaaggaagac

SEQ ID NO: 3005024 - RNA, 14 nt, Human
gcagaaggaagacu

SEQ ID NO: 3005025 - RNA, 12 nt, Human
gcagaaggaaga

SEQ ID NO: 3005026 - RNA, 15 nt, Human
gcacugucaagauga

SEQ ID NO: 3005027 - RNA, 22 nt, Human
gcacugggcuuggggaccagag

SEQ ID NO: 3005028 - RNA, 23 nt, Human
gcacugggcuuggggaccagagc

SEQ ID NO: 3005029 - RNA, 14 nt, Human
gcacugggcuuggg

SEQ ID NO: 3005030 - RNA, 18 nt, Human
gcacuaaggugugcucug

SEQ ID NO: 3005031 - RNA, 17 nt, Human
gcacuaaggugugcucu

SEQ ID NO: 3005032 - RNA, 13 nt, Human
gcaaugaccuuuc

SEQ ID NO: 3005033 - RNA, 14 nt, Human
gcaaugaccuuuca

SEQ ID NO: 3005034 - RNA, 20 nt, Human
gcacagccucuuagaugcag

SEQ ID NO: 3005035 - RNA, 18 nt, Human
gcacagccucuuagaugc

SEQ ID NO: 3005036 - RNA, 19 nt, Human
gcacagcuaacauggaagu

SEQ ID NO: 3005037 - RNA, 22 nt, Human
gcacaugccucucucaggccaa

SEQ ID NO: 3005038 - RNA, 16 nt, Human
gcacagcuucauuucc

SEQ ID NO: 3005039 - RNA, 19 nt, Human
gcaccacugcacuccagcc

SEQ ID NO: 3005040 - RNA, 15 nt, Human
gcaccuccugccucg

SEQ ID NO: 3005041 - RNA, 14 nt, Human
gcaccuccugccuc

SEQ ID NO: 3005042 - RNA, 17 nt, Human
gcacccggccccugcug

SEQ ID NO: 3005043 - RNA, 15 nt, Human
gcacccggccccugc

SEQ ID NO: 3005044 - RNA, 23 nt, Human
gcacccauuaugcgcuguggcca

SEQ ID NO: 3005045 - RNA, 14 nt, Human
gcacccggccccug

SEQ ID NO: 3005046 - RNA, 15 nt, Human
gcaaacuucagaguu

SEQ ID NO: 3005047 - RNA, 17 nt, Human
gcaaaccaucauugaaa

SEQ ID NO: 3005048 - RNA, 19 nt, Human
gcaaaccaucauugaaauc

SEQ ID NO: 3005049 - RNA, 20 nt, Human
gcaaaccaucauugaaaucu

SEQ ID NO: 3005050 - RNA, 21 nt, Human
gcaaaccaucauugaaaucuu

SEQ ID NO: 3005051 - RNA, 16 nt, Human
gcaaaccaucauugaa

SEQ ID NO: 3005052 - RNA, 18 nt, Human
gcaacugcauuggcuuug

SEQ ID NO: 3005053 - RNA, 21 nt, Human
gcaaauaaguguauuuugaaa

SEQ ID NO: 3005054 - RNA, 23 nt, Human
gcaaauaaguguauuuugaaauu

SEQ ID NO: 3005055 - RNA, 17 nt, Human
gcaaauaaguguauuuu

SEQ ID NO: 3005056 - RNA, 12 nt, Human
gcaagauguggg

SEQ ID NO: 3005057 - RNA, 16 nt, Human
gcaagaugugggcagu

SEQ ID NO: 3005058 - RNA, 16 nt, Human
gcaagcaccuccugcc

SEQ ID NO: 3005059 - RNA, 15 nt, Human
gcaagcaccuccugc

SEQ ID NO: 3005060 - RNA, 20 nt, Human
gcaagcaccuccugccucga

SEQ ID NO: 3005061 - RNA, 18 nt, Human
gcaagcaccuccugccuc

SEQ ID NO: 3005062 - RNA, 14 nt, Human
gcaaggcugucaau

SEQ ID NO: 3005063 - RNA, 18 nt, Human
gcaaggcugucaauuaca

SEQ ID NO: 3005064 - RNA, 14 nt, Human
gcaaggucauuuuu

SEQ ID NO: 3005065 - RNA, 13 nt, Human
gcaaggcugucaa

SEQ ID NO: 3005066 - RNA, 17 nt, Human
gcaauccugcaagaaca

SEQ ID NO: 3005067 - RNA, 19 nt, Human
gcaagguuuaaguuauuaa

SEQ ID NO: 3005068 - RNA, 17 nt, Human
gcaagguuuaaguuauu

SEQ ID NO: 3005069 - RNA, 14 nt, Human
gcaagguuuaaguu

SEQ ID NO: 3005070 - RNA, 22 nt, Human
gcaagguuuaaguuauuaagag

SEQ ID NO: 3005071 - RNA, 20 nt, Human
gauugggcacaucauuucaa

SEQ ID NO: 3005072 - RNA, 20 nt, Human
gauuuaaacacauuaaaggu

SEQ ID NO: 3005073 - RNA, 21 nt, Human
gauuucuguuuagauaauaca

SEQ ID NO: 3005074 - RNA, 22 nt, Human
gauuucuguuuagauaauacac

SEQ ID NO: 3005075 - RNA, 19 nt, Human
gauuuguuaaugauagcua

SEQ ID NO: 3005076 - RNA, 19 nt, Human
gauucuuuccugaggcugg

SEQ ID NO: 3005077 - RNA, 17 nt, Human
gauucccaagcucugcu

SEQ ID NO: 3005078 - RNA, 16 nt, Human
gauucccaagcucugc

SEQ ID NO: 3005079 - RNA, 20 nt, Human
gauucuuuccugaggcuggg

SEQ ID NO: 3005080 - RNA, 22 nt, Human
gauucuuuccugaggcugggcu

SEQ ID NO: 3005081 - RNA, 16 nt, Human
gauugcaacaggcugg

SEQ ID NO: 3005082 - RNA, 18 nt, Human
gauugcaacaggcugggc

SEQ ID NO: 3005083 - RNA, 17 nt, Human
gauugcaacaggcuggg

SEQ ID NO: 3005084 - RNA, 15 nt, Human
gauugcaacaggcug

SEQ ID NO: 3005085 - RNA, 16 nt, Human
gaugcuagaacucccu

SEQ ID NO: 3005086 - RNA, 18 nt, Human
gauguucuagcauggcug

SEQ ID NO: 3005087 - RNA, 22 nt, Human
gauuaaguaaugauaacuggaa

SEQ ID NO: 3005088 - RNA, 14 nt, Human
gauuaaguaaugau

SEQ ID NO: 3005089 - RNA, 13 nt, Human
gauucagacagcu

SEQ ID NO: 3005090 - RNA, 14 nt, Human
gauucagacagcug

SEQ ID NO: 3005091 - RNA, 17 nt, Human
gauucagacagcugccu

SEQ ID NO: 3005092 - RNA, 18 nt, Human
gauucagacagcugccug

SEQ ID NO: 3005093 - RNA, 21 nt, Human
gauuacaagcgugagccacug

SEQ ID NO: 3005094 - RNA, 13 nt, Human
gauuacaagcgug

SEQ ID NO: 3005095 - RNA, 15 nt, Human
gauucccaagcucug

SEQ ID NO: 3005096 - RNA, 22 nt, Human
gaugaaugucaguuguuauuua

SEQ ID NO: 3005097 - RNA, 21 nt, Human
gaugaaaugaggucagagccu

SEQ ID NO: 3005098 - RNA, 15 nt, Human
gaugaaaugagguca

SEQ ID NO: 3005099 - RNA, 19 nt, Human
gaucuucuuuauaauucua

SEQ ID NO: 3005100 - RNA, 22 nt, Human
gaucuucuguggguuucuaaag

SEQ ID NO: 3005101 - RNA, 23 nt, Human
gaugcaccagcccuuagcaggga

SEQ ID NO: 3005102 - RNA, 15 nt, Human
gaugcaccagcccuu

SEQ ID NO: 3005103 - RNA, 14 nt, Human
gaugagaggaaauc

SEQ ID NO: 3005104 - RNA, 14 nt, Human
gaugcaccagcccu

SEQ ID NO: 3005105 - RNA, 23 nt, Human
gaugagaaauaaaguuucuguug

SEQ ID NO: 3005106 - RNA, 18 nt, Human
gaugaccuugaaugaugc

SEQ ID NO: 3005107 - RNA, 20 nt, Human
gaugaccuugaaugaugcca

SEQ ID NO: 3005108 - RNA, 16 nt, Human
gaugccugguggcagc

SEQ ID NO: 3005109 - RNA, 15 nt, Human
gaugccugguggcag

SEQ ID NO: 3005110 - RNA, 14 nt, Human
gaugcagugcuucc

SEQ ID NO: 3005111 - RNA, 14 nt, Human
gaugccugguggca

SEQ ID NO: 3005112 - RNA, 19 nt, Human
gaugcagccucacaguccu

SEQ ID NO: 3005113 - RNA, 12 nt, Human
gauccugagcca

SEQ ID NO: 3005114 - RNA, 13 nt, Human
gauccuggaaauc

SEQ ID NO: 3005115 - RNA, 14 nt, Human
gauccuggaaauca

SEQ ID NO: 3005116 - RNA, 20 nt, Human
gaucuaggaagacuuuggaa

SEQ ID NO: 3005117 - RNA, 14 nt, Human
gaucuaggaagacu

SEQ ID NO: 3005118 - RNA, 18 nt, Human
gaucuaggaagacuuugg

SEQ ID NO: 3005119 - RNA, 13 nt, Human
gaucuaggaagac

SEQ ID NO: 3005120 - RNA, 17 nt, Human
gauccucccaccucagc

SEQ ID NO: 3005121 - RNA, 21 nt, Human
gauccucccaccucagccucc

SEQ ID NO: 3005122 - RNA, 14 nt, Human
gauccuccaggugc

SEQ ID NO: 3005123 - RNA, 16 nt, Human
gauccucccaccucag

SEQ ID NO: 3005124 - RNA, 13 nt, Human
gaucauccacugu

SEQ ID NO: 3005125 - RNA, 20 nt, Human
gaguuauugaagcagagugg

SEQ ID NO: 3005126 - RNA, 19 nt, Human
gaguuauugaagcagagug

SEQ ID NO: 3005127 - RNA, 18 nt, Human
gaguuauugaagcagagu

SEQ ID NO: 3005128 - RNA, 24 nt, Human
gauaauacaccacuacauucuguu

SEQ ID NO: 3005129 - RNA, 23 nt, Human
gauaauacaccacuacauucugu

SEQ ID NO: 3005130 - RNA, 12 nt, Human
gauaauacacca

SEQ ID NO: 3005131 - RNA, 13 nt, Human
gauaaacaguagu

SEQ ID NO: 3005132 - RNA, 23 nt, Human
gaucagcuuauugucuagugaaa

SEQ ID NO: 3005133 - RNA, 20 nt, Human
gaucacggcucacugcagcc

SEQ ID NO: 3005134 - RNA, 23 nt, Human
gaucacggcucacugcagccuca

SEQ ID NO: 3005135 - RNA, 14 nt, Human
gaucacagccucug

SEQ ID NO: 3005136 - RNA, 21 nt, Human
gauauagcuaggugacauaua

SEQ ID NO: 3005137 - RNA, 18 nt, Human
gauauaugcucugcaugu

SEQ ID NO: 3005138 - RNA, 20 nt, Human
gauagugucccacggugccu

SEQ ID NO: 3005139 - RNA, 16 nt, Human
gauacaaaagcaugug

SEQ ID NO: 3005140 - RNA, 14 nt, Human
gaacaucacagcuu

SEQ ID NO: 3005141 - RNA, 15 nt, Human
gaacauaaaauacaa

SEQ ID NO: 3005142 - RNA, 20 nt, Human
gaacagugauuaccagggac

SEQ ID NO: 3005143 - RNA, 16 nt, Human
gaacagugauuaccag

SEQ ID NO: 3005144 - RNA, 15 nt, Human
gaacacucugagacu

SEQ ID NO: 3005145 - RNA, 16 nt, Human
gaaauuguauuacaaa

SEQ ID NO: 3005146 - RNA, 17 nt, Human
gaaaauagaauugacau

SEQ ID NO: 3005147 - RNA, 13 nt, Human
gaacacucugaga

SEQ ID NO: 3005148 - RNA, 14 nt, Human
gaacacucugagac

SEQ ID NO: 3005149 - RNA, 19 nt, Human
gaaccuuuugagugccuua

SEQ ID NO: 3005150 - RNA, 21 nt, Human
gaaccuuuugagugccuuaca

SEQ ID NO: 3005151 - RNA, 18 nt, Human
gaaccuuuugagugccuu

SEQ ID NO: 3005152 - RNA, 21 nt, Human
gaacauuuggguuacuauuuc

SEQ ID NO: 3005153 - RNA, 16 nt, Human
gaacauuucauggugu

SEQ ID NO: 3005154 - RNA, 22 nt, Human
gaaccuuuugagugccuuacac

SEQ ID NO: 3005155 - RNA, 20 nt, Human
gaagauucuauguuaauauu

SEQ ID NO: 3005156 - RNA, 23 nt, Human
gaagauucuauguuaauauuuua

SEQ ID NO: 3005157 - RNA, 17 nt, Human
gaagauucuauguuaau

SEQ ID NO: 3005158 - RNA, 17 nt, Human
gaagcauuuacuuugug

SEQ ID NO: 3005159 - RNA, 18 nt, Human
gaagauguagaggagaaa

SEQ ID NO: 3005160 - RNA, 17 nt, Human
gaagauguagaggagaa

SEQ ID NO: 3005161 - RNA, 15 nt, Human
gaagauacugaaaua

SEQ ID NO: 3005162 - RNA, 20 nt, Human
gaagauaauauuaaggaaga

SEQ ID NO: 3005163 - RNA, 20 nt, Human
gaagagguuuuaaagcuucc

SEQ ID NO: 3005164 - RNA, 20 nt, Human
gaagccagcaggcucucagg

SEQ ID NO: 3005165 - RNA, 19 nt, Human
gaagccagcaggcucucag

SEQ ID NO: 3005166 - RNA, 21 nt, Human
gaagccagcaggcucucaggc

SEQ ID NO: 3005167 - RNA, 22 nt, Human
gaagccagcaggcucucaggcc

SEQ ID NO: 3005168 - RNA, 13 nt, Human
gaagcccaggaaa

SEQ ID NO: 3005169 - RNA, 15 nt, Human
gaagcccaggaaagg

SEQ ID NO: 3005170 - RNA, 16 nt, Human
gaagcccaggaaaggc

SEQ ID NO: 3005171 - RNA, 19 nt, Human
gaagcccaggaaaggcucc

SEQ ID NO: 3005172 - RNA, 23 nt, Human
gaagcccuucuaccuuccugcaa

SEQ ID NO: 3005173 - RNA, 23 nt, Human
gaagcccaggaaaggcuccagga

SEQ ID NO: 3005174 - RNA, 14 nt, Human
gaagacuuuggaaa

SEQ ID NO: 3005175 - RNA, 17 nt, Human
gaagacuuuggaaagag

SEQ ID NO: 3005176 - RNA, 20 nt, Human
gaagacuuuucuuucagcca

SEQ ID NO: 3005177 - RNA, 19 nt, Human
gaagagaaugcacaaacag

SEQ ID NO: 3005178 - RNA, 19 nt, Human
gaagacugcauuauauuua

SEQ ID NO: 3005179 - RNA, 12 nt, Human
gaagaacugaaa

SEQ ID NO: 3005180 - RNA, 11 nt, Human
gaagacuuugg

SEQ ID NO: 3005181 - RNA, 13 nt, Human
gaagacuuuggaa

SEQ ID NO: 3005182 - RNA, 17 nt, Human
gaagacugcauuauauu

SEQ ID NO: 3005183 - RNA, 23 nt, Human
gaacuuugaccucugcagcaaua

SEQ ID NO: 3005184 - RNA, 23 nt, Human
gaaggugccucuggaugcuguga

SEQ ID NO: 3005185 - RNA, 16 nt, Human
gaagggggcugggaca

SEQ ID NO: 3005186 - RNA, 19 nt, Human
gaagggggcugggacaugg

SEQ ID NO: 3005187 - RNA, 14 nt, Human
gaagcggcuggcag

SEQ ID NO: 3005188 - RNA, 15 nt, Human
gaagggggcugggac

SEQ ID NO: 3005189 - RNA, 22 nt, Human
gaaguaauaugcacacauuuuu

SEQ ID NO: 3005190 - RNA, 21 nt, Human
gaaguaauaugcacacauuuu

SEQ ID NO: 3005191 - RNA, 15 nt, Human
gaaguacuggagaaa

SEQ ID NO: 3005192 - RNA, 18 nt, Human
gaaguacuauaauuuacc

SEQ ID NO: 3005193 - RNA, 16 nt, Human
gaaguauccuucagcc

SEQ ID NO: 3005194 - RNA, 14 nt, Human
gaaguauccuucag

SEQ ID NO: 3005195 - RNA, 21 nt, Human
gaaguuucugccgcagcccug

SEQ ID NO: 3005196 - RNA, 15 nt, Human
gaagucuuagaugua

SEQ ID NO: 3005197 - RNA, 20 nt, Human
gaaguuucugccgcagcccu

SEQ ID NO: 3005198 - RNA, 22 nt, Human
gaaguccaagcauuuagaugua

SEQ ID NO: 3005199 - RNA, 12 nt, Human
gaaguccaagca

SEQ ID NO: 3005200 - RNA, 16 nt, Human
gaauauuuuaacuucc

SEQ ID NO: 3005201 - RNA, 20 nt, Human
gaauacucuuauaucuauau

SEQ ID NO: 3005202 - RNA, 22 nt, Human
gaauagcugggacuacaggugu

SEQ ID NO: 3005203 - RNA, 16 nt, Human
gaauaggcacuuuaaa

SEQ ID NO: 3005204 - RNA, 23 nt, Human
gaauagcugggacuacaggugug

SEQ ID NO: 3005205 - RNA, 15 nt, Human
gaauaccuguccccc

SEQ ID NO: 3005206 - RNA, 13 nt, Human
gaauaccuguccc

SEQ ID NO: 3005207 - RNA, 21 nt, Human
gaauaccccaagacucccaug

SEQ ID NO: 3005208 - RNA, 17 nt, Human
gaauaauacaguaucuc

SEQ ID NO: 3005209 - RNA, 21 nt, Human
gaauacagaggcaacugcauu

SEQ ID NO: 3005210 - RNA, 19 nt, Human
gaauaacauguaauuaagu

SEQ ID NO: 3005211 - RNA, 18 nt, Human
gaauaacauguaauuaag

SEQ ID NO: 3005212 - RNA, 20 nt, Human
gaaguuugagaucagccugg

SEQ ID NO: 3005213 - RNA, 13 nt, Human
gaaguuugaacau

SEQ ID NO: 3005214 - RNA, 17 nt, Human
gaaugucaguuguuauu

SEQ ID NO: 3005215 - RNA, 21 nt, Human
gaaugucaguuguuauuuauu

SEQ ID NO: 3005216 - RNA, 22 nt, Human
gaauucacaaaguaauuuggaa

SEQ ID NO: 3005217 - RNA, 20 nt, Human
gaaugucagugugacugauc

SEQ ID NO: 3005218 - RNA, 21 nt, Human
gaaugucagugugacugaucu

SEQ ID NO: 3005219 - RNA, 17 nt, Human
gaauucucagaaucuca

SEQ ID NO: 3005220 - RNA, 17 nt, Human
gaauucucuaguuugau

SEQ ID NO: 3005221 - RNA, 20 nt, Human
gaauuccuaaaauuauggaa

SEQ ID NO: 3005222 - RNA, 16 nt, Human
gaauuccuaaaauuau

SEQ ID NO: 3005223 - RNA, 14 nt, Human
gaauugaaaaacca

SEQ ID NO: 3005224 - RNA, 19 nt, Human
gaauucucuaguuugauua

SEQ ID NO: 3005225 - RNA, 22 nt, Human
gaauugauugggcacaucauuu

SEQ ID NO: 3005226 - RNA, 22 nt, Human
gaauuguaaggaaugauuaauu

SEQ ID NO: 3005227 - RNA, 22 nt, Human
gaauuuaaauagcuuuuuucuc

SEQ ID NO: 3005228 - RNA, 15 nt, Human
gaauuucccaaagca

SEQ ID NO: 3005229 - RNA, 18 nt, Human
gaaugaaccacaucuugc

SEQ ID NO: 3005230 - RNA, 22 nt, Human
gaaugaaccacaucuugcucug

SEQ ID NO: 3005231 - RNA, 23 nt, Human
gaaugaaccacaucuugcucugc

SEQ ID NO: 3005232 - RNA, 21 nt, Human
gaaugaagauacugaaauaaa

SEQ ID NO: 3005233 - RNA, 18 nt, Human
gaaugaagauacugaaau

SEQ ID NO: 3005234 - RNA, 17 nt, Human
gaaugaagauacugaaa

SEQ ID NO: 3005235 - RNA, 11 nt, Human
gaaugcagugg

SEQ ID NO: 3005236 - RNA, 19 nt, Human
gaaugaagauacugaaaua

SEQ ID NO: 3005237 - RNA, 22 nt, Human
gaaugguuuucaaaauaaaaau

SEQ ID NO: 3005238 - RNA, 14 nt, Human
gaaugucaguguga

SEQ ID NO: 3005239 - RNA, 17 nt, Human
gacuggauaguccgucu

SEQ ID NO: 3005240 - RNA, 16 nt, Human
gacuggauaguccguc

SEQ ID NO: 3005241 - RNA, 14 nt, Human
gacuggcacaguuu

SEQ ID NO: 3005242 - RNA, 18 nt, Human
gacuggcacaguuuucug

SEQ ID NO: 3005243 - RNA, 22 nt, Human
gacuggcacaguuuucugagaa

SEQ ID NO: 3005244 - RNA, 22 nt, Human
gacuggauaguccgucucugcu

SEQ ID NO: 3005245 - RNA, 23 nt, Human
gacuggccaagguuuggggaaga

SEQ ID NO: 3005246 - RNA, 23 nt, Human
gacuuaaugagacuuuaaaagca

SEQ ID NO: 3005247 - RNA, 12 nt, Human
gacuucaucccu

SEQ ID NO: 3005248 - RNA, 20 nt, Human
gacuucaucccucuggggcu

SEQ ID NO: 3005249 - RNA, 12 nt, Human
gacuuacuguac

SEQ ID NO: 3005250 - RNA, 16 nt, Human
gacuuacuguacauga

SEQ ID NO: 3005251 - RNA, 15 nt, Human
gacuuacuguacaug

SEQ ID NO: 3005252 - RNA, 23 nt, Human
gacuuacuguacaugaaaacaca

SEQ ID NO: 3005253 - RNA, 18 nt, Human
gacuuacuguacaugaaa

SEQ ID NO: 3005254 - RNA, 24 nt, Human
gacugcauuauauuuauuacugua

SEQ ID NO: 3005255 - RNA, 16 nt, Human
gacugaggggagggga

SEQ ID NO: 3005256 - RNA, 16 nt, Human
gacugagggggccugg

SEQ ID NO: 3005257 - RNA, 15 nt, Human
gacugagggggccug

SEQ ID NO: 3005258 - RNA, 18 nt, Human
gacugaguacguugugca

SEQ ID NO: 3005259 - RNA, 18 nt, Human
gacugagggggccuggau

SEQ ID NO: 3005260 - RNA, 17 nt, Human
gacugagggggccugga

SEQ ID NO: 3005261 - RNA, 19 nt, Human
gacugagggggccuggaug

SEQ ID NO: 3005262 - RNA, 18 nt, Human
gacuccugcaggcagcca

SEQ ID NO: 3005263 - RNA, 19 nt, Human
gacuccugcaggcagccag

SEQ ID NO: 3005264 - RNA, 20 nt, Human
gacuccugcaggcagccagg

SEQ ID NO: 3005265 - RNA, 21 nt, Human
gacuccugcaggcagccaggc

SEQ ID NO: 3005266 - RNA, 15 nt, Human
gacuacaggcaccca

SEQ ID NO: 3005267 - RNA, 13 nt, Human
gacuacaggcacc

SEQ ID NO: 3005268 - RNA, 18 nt, Human
gacuacaggcacccacca

SEQ ID NO: 3005269 - RNA, 16 nt, Human
gacugaauuucuuuug

SEQ ID NO: 3005270 - RNA, 21 nt, Human
gacucuacagaggccaugggc

SEQ ID NO: 3005271 - RNA, 15 nt, Human
gacucuacagaggcc

SEQ ID NO: 3005272 - RNA, 16 nt, Human
gacuaacuugucuuug

SEQ ID NO: 3005273 - RNA, 23 nt, Human
gacuaacuugucuuuggacccug

SEQ ID NO: 3005274 - RNA, 11 nt, Human
gacguguuaug

SEQ ID NO: 3005275 - RNA, 14 nt, Human
gacguguuaugacu

SEQ ID NO: 3005276 - RNA, 15 nt, Human
gacguguuaugacuc

SEQ ID NO: 3005277 - RNA, 22 nt, Human
gaccuuuaagagaaaugagcug

SEQ ID NO: 3005278 - RNA, 11 nt, Human
gaccuuucaau

SEQ ID NO: 3005279 - RNA, 19 nt, Human
gaccuuucaauaggaaaaa

SEQ ID NO: 3005280 - RNA, 20 nt, Human
gaccuuucaauaggaaaaac

SEQ ID NO: 3005281 - RNA, 22 nt, Human
gacgcugugcugcccugcccac

SEQ ID NO: 3005282 - RNA, 21 nt, Human
gacgcugugcugcccugccca

SEQ ID NO: 3005283 - RNA, 13 nt, Human
gacggagucccac

SEQ ID NO: 3005284 - RNA, 23 nt, Human
gacggagucccaccuuggcugca

SEQ ID NO: 3005285 - RNA, 20 nt, Human
gaccuucuccuucaccuuug

SEQ ID NO: 3005286 - RNA, 21 nt, Human
gaccuucuccuucaccuuugu

SEQ ID NO: 3005287 - RNA, 14 nt, Human
gaccuugaacuggg

SEQ ID NO: 3005288 - RNA, 15 nt, Human
gaccuucuccuucac

SEQ ID NO: 3005289 - RNA, 16 nt, Human
gaccuucuccuucacc

SEQ ID NO: 3005290 - RNA, 14 nt, Human
gaccuucuccuuca

SEQ ID NO: 3005291 - RNA, 20 nt, Human
gacccuugccgucuaccuga

SEQ ID NO: 3005292 - RNA, 23 nt, Human
gacccuugccgucuaccugaggg

SEQ ID NO: 3005293 - RNA, 19 nt, Human
gacccuugccgucuaccug

SEQ ID NO: 3005294 - RNA, 21 nt, Human
gacagagccccacccucagau

SEQ ID NO: 3005295 - RNA, 20 nt, Human
gacagagcuacacaggggaa

SEQ ID NO: 3005296 - RNA, 16 nt, Human
gacagagugagacucu

SEQ ID NO: 3005297 - RNA, 21 nt, Human
gacagagucucacuguugccc

SEQ ID NO: 3005298 - RNA, 19 nt, Human
gacagagugagacucuguc

SEQ ID NO: 3005299 - RNA, 23 nt, Human
gacagaggcagccccauucugcc

SEQ ID NO: 3005300 - RNA, 14 nt, Human
gacagagucucacu

SEQ ID NO: 3005301 - RNA, 22 nt, Human
gaauuucccaaagcagugcaug

SEQ ID NO: 3005302 - RNA, 16 nt, Human
gaauuucccaaagcag

SEQ ID NO: 3005303 - RNA, 18 nt, Human
gaauuucccaaagcagug

SEQ ID NO: 3005304 - RNA, 22 nt, Human
gacacgaauauugcugauggug

SEQ ID NO: 3005305 - RNA, 22 nt, Human
gacagacacaggcccggcucca

SEQ ID NO: 3005306 - RNA, 20 nt, Human
gacagacacaggcccggcuc

SEQ ID NO: 3005307 - RNA, 16 nt, Human
gacacuagaagauuuu

SEQ ID NO: 3005308 - RNA, 17 nt, Human
gacagacacaggcccgg

SEQ ID NO: 3005309 - RNA, 13 nt, Human
gacaguuggguuu

SEQ ID NO: 3005310 - RNA, 17 nt, Human
gacaguuggguuuuuua

SEQ ID NO: 3005311 - RNA, 22 nt, Human
gacaggcauguucucugaggac

SEQ ID NO: 3005312 - RNA, 16 nt, Human
gacaucaacugcauca

SEQ ID NO: 3005313 - RNA, 14 nt, Human
gacaucaacagaua

SEQ ID NO: 3005314 - RNA, 23 nt, Human
gacaucaacugcaucaagaugug

SEQ ID NO: 3005315 - RNA, 23 nt, Human
gacaggaugguucccuugaugaa

SEQ ID NO: 3005316 - RNA, 18 nt, Human
gacaggcaagcaccuccu

SEQ ID NO: 3005317 - RNA, 17 nt, Human
gacaggcaagcaccucc

SEQ ID NO: 3005318 - RNA, 13 nt, Human
gacaggcaagcac

SEQ ID NO: 3005319 - RNA, 19 nt, Human
gacaggcaaugcuggcugu

SEQ ID NO: 3005320 - RNA, 18 nt, Human
gacaggcaaugcuggcug

SEQ ID NO: 3005321 - RNA, 21 nt, Human
gacaggcaagcaccuccugcc

SEQ ID NO: 3005322 - RNA, 20 nt, Human
gacaggcaagcaccuccugc

SEQ ID NO: 3005323 - RNA, 21 nt, Human
gacaggcauguucucugagga

SEQ ID NO: 3005324 - RNA, 20 nt, Human
gacaggcauguucucugagg

SEQ ID NO: 3005325 - RNA, 23 nt, Human
gacaggcaaugcuggcuguuggc

SEQ ID NO: 3005326 - RNA, 18 nt, Human
gaccacugcagaagacag

SEQ ID NO: 3005327 - RNA, 16 nt, Human
gaccacugcagaagac

SEQ ID NO: 3005328 - RNA, 21 nt, Human
gaccagacaccuugacagggc

SEQ ID NO: 3005329 - RNA, 22 nt, Human
gaccagacaccuugacagggca

SEQ ID NO: 3005330 - RNA, 16 nt, Human
gaccacguuucuaaag

SEQ ID NO: 3005331 - RNA, 20 nt, Human
gaccagcaccaucucuccuc

SEQ ID NO: 3005332 - RNA, 21 nt, Human
gaccagcaccaucucuccucc

SEQ ID NO: 3005333 - RNA, 23 nt, Human
gaccagacaccuugacagggcac

SEQ ID NO: 3005334 - RNA, 21 nt, Human
gaccagagcugccaccugccu

SEQ ID NO: 3005335 - RNA, 18 nt, Human
gaccacaaaacuuuucua

SEQ ID NO: 3005336 - RNA, 19 nt, Human
gacccaaaaggcagaagca

SEQ ID NO: 3005337 - RNA, 18 nt, Human
gacccaaaaggcagaagc

SEQ ID NO: 3005338 - RNA, 12 nt, Human
gacccacugcuu

SEQ ID NO: 3005339 - RNA, 19 nt, Human
gacccaugcugcccuguga

SEQ ID NO: 3005340 - RNA, 20 nt, Human
gacccaugcugcccugugag

SEQ ID NO: 3005341 - RNA, 18 nt, Human
gacccaugcugcccugug

SEQ ID NO: 3005342 - RNA, 16 nt, Human
gacccugaggcccaga

SEQ ID NO: 3005343 - RNA, 17 nt, Human
gacccugcccugugggc

SEQ ID NO: 3005344 - RNA, 20 nt, Human
gacccugcccugugggcccc

SEQ ID NO: 3005345 - RNA, 22 nt, Human
gacccugcccugugggccccca

SEQ ID NO: 3005346 - RNA, 11 nt, Human
gacccugaggc

SEQ ID NO: 3005347 - RNA, 12 nt, Human
gacccugaggcc

SEQ ID NO: 3005348 - RNA, 10 nt, Human
gacccugagg

SEQ ID NO: 3005349 - RNA, 17 nt, Human
gacccaugcugcccugu

SEQ ID NO: 3005350 - RNA, 15 nt, Human
gaccccacuccggcc

SEQ ID NO: 3005351 - RNA, 22 nt, Human
gaccccacuccggcccuccaga

SEQ ID NO: 3005352 - RNA, 17 nt, Human
gaccccacuccggcccu

SEQ ID NO: 3005353 - RNA, 14 nt, Human
cuuuuugaaauguc

SEQ ID NO: 3005354 - RNA, 15 nt, Human
cuuuuucaauaacug

SEQ ID NO: 3005355 - RNA, 20 nt, Human
cuuuuguucuugguuuguaa

SEQ ID NO: 3005356 - RNA, 22 nt, Human
cuuuuguucuugguuuguaaau

SEQ ID NO: 3005357 - RNA, 21 nt, Human
cuuuguuuguugucagcugaa

SEQ ID NO: 3005358 - RNA, 15 nt, Human
cuuuucuguuugcua

SEQ ID NO: 3005359 - RNA, 19 nt, Human
gaaaauaacaauaaaagac

SEQ ID NO: 3005360 - RNA, 14 nt, Human
gaaaaguauguuag

SEQ ID NO: 3005361 - RNA, 20 nt, Human
gaaaaguauguuagugcaaa

SEQ ID NO: 3005362 - RNA, 19 nt, Human
gaaaacaugcuacacacug

SEQ ID NO: 3005363 - RNA, 20 nt, Human
gaaaagggacugcugggagg

SEQ ID NO: 3005364 - RNA, 18 nt, Human
gaaaacaugcuacacacu

SEQ ID NO: 3005365 - RNA, 16 nt, Human
gaaaacaugcuacaca

SEQ ID NO: 3005366 - RNA, 20 nt, Human
gaaaacacuguucucugccc

SEQ ID NO: 3005367 - RNA, 21 nt, Human
gaaaacacuguucucugcccu

SEQ ID NO: 3005368 - RNA, 18 nt, Human
gaaaacacuguucucugc

SEQ ID NO: 3005369 - RNA, 19 nt, Human
gaaaacacuguucucugcc

SEQ ID NO: 3005370 - RNA, 16 nt, Human
cuuuuuuagaguugau

SEQ ID NO: 3005371 - RNA, 19 nt, Human
cuuuccucaaaacuucaga

SEQ ID NO: 3005372 - RNA, 13 nt, Human
cuuucugaaauaa

SEQ ID NO: 3005373 - RNA, 14 nt, Human
cuuugcuugaaaga

SEQ ID NO: 3005374 - RNA, 23 nt, Human
cuuuggaaagacuuuuccaaccc

SEQ ID NO: 3005375 - RNA, 12 nt, Human
cuuuggaaagac

SEQ ID NO: 3005376 - RNA, 16 nt, Human
cuuuguucuggcucuu

SEQ ID NO: 3005377 - RNA, 21 nt, Human
cuuuguucuggcucuuccagg

SEQ ID NO: 3005378 - RNA, 12 nt, Human
cuuugugauuuu

SEQ ID NO: 3005379 - RNA, 19 nt, Human
cuuugugaggaagccgcug

SEQ ID NO: 3005380 - RNA, 13 nt, Human
cuuuguggcuucc

SEQ ID NO: 3005381 - RNA, 23 nt, Human
cuuugugaggaagccgcuggggc

SEQ ID NO: 3005382 - RNA, 23 nt, Human
cuuugggaggccaaggugggagg

SEQ ID NO: 3005383 - RNA, 16 nt, Human
cuuguacacucauuca

SEQ ID NO: 3005384 - RNA, 17 nt, Human
cuuguacuuuauuuucu

SEQ ID NO: 3005385 - RNA, 15 nt, Human
cuugguuuguaaauu

SEQ ID NO: 3005386 - RNA, 14 nt, Human
cuugguuuguaaau

SEQ ID NO: 3005387 - RNA, 16 nt, Human
cuuggggcugaugcag

SEQ ID NO: 3005388 - RNA, 18 nt, Human
cuuggggcugaugcaguu

SEQ ID NO: 3005389 - RNA, 16 nt, Human
cuuggacucauuuuaa

SEQ ID NO: 3005390 - RNA, 18 nt, Human
cuugggccacugugaaga

SEQ ID NO: 3005391 - RNA, 20 nt, Human
cuugggccacugugaagaga

SEQ ID NO: 3005392 - RNA, 16 nt, Human
cuuguugaggguaugu

SEQ ID NO: 3005393 - RNA, 22 nt, Human
cuuguugaggguauguuuuaua

SEQ ID NO: 3005394 - RNA, 21 nt, Human
cuuguugaggguauguuuuau

SEQ ID NO: 3005395 - RNA, 20 nt, Human
cuuguugaggguauguuuua

SEQ ID NO: 3005396 - RNA, 20 nt, Human
cuuuaccuuuuuuauacaua

SEQ ID NO: 3005397 - RNA, 19 nt, Human
cuuuaccuuuuuuauacau

SEQ ID NO: 3005398 - RNA, 17 nt, Human
cuuuaccuuuuuuauac

SEQ ID NO: 3005399 - RNA, 22 nt, Human
cuugugguuauaacuuaaugaa

SEQ ID NO: 3005400 - RNA, 16 nt, Human
cuuguuaagauaguua

SEQ ID NO: 3005401 - RNA, 16 nt, Human
cuuguggucccacccc

SEQ ID NO: 3005402 - RNA, 19 nt, Human
cuuguggucccaccccaca

SEQ ID NO: 3005403 - RNA, 22 nt, Human
cuugucggccccaccagugccu

SEQ ID NO: 3005404 - RNA, 21 nt, Human
cuugucggccccaccagugcc

SEQ ID NO: 3005405 - RNA, 23 nt, Human
cuugucggccccaccagugccuc

SEQ ID NO: 3005406 - RNA, 20 nt, Human
cuugucggccccaccagugc

SEQ ID NO: 3005407 - RNA, 15 nt, Human
cuugucggccccacc

SEQ ID NO: 3005408 - RNA, 15 nt, Human
cuuguggucccaccc

SEQ ID NO: 3005409 - RNA, 22 nt, Human
cuugcagcucuccccuucucug

SEQ ID NO: 3005410 - RNA, 23 nt, Human
cuugcaucaauuuuucuuauuuc

SEQ ID NO: 3005411 - RNA, 21 nt, Human
cuugcagacucuacagaggcc

SEQ ID NO: 3005412 - RNA, 20 nt, Human
cuugcagacucuacagaggc

SEQ ID NO: 3005413 - RNA, 20 nt, Human
cuugaguugauucagcucug

SEQ ID NO: 3005414 - RNA, 18 nt, Human
cuugaguugauucagcuc

SEQ ID NO: 3005415 - RNA, 19 nt, Human
cuugaguugauucagcucu

SEQ ID NO: 3005416 - RNA, 18 nt, Human
cuugcaauggcagccuug

SEQ ID NO: 3005417 - RNA, 17 nt, Human
cuugcaauggcagccuu

SEQ ID NO: 3005418 - RNA, 16 nt, Human
cuugcaauggcagccu

SEQ ID NO: 3005419 - RNA, 15 nt, Human
cuugcaauggcagcc

SEQ ID NO: 3005420 - RNA, 12 nt, Human
cuugagccuggg

SEQ ID NO: 3005421 - RNA, 15 nt, Human
cuugagccugggagg

SEQ ID NO: 3005422 - RNA, 17 nt, Human
cuugaggguugggcugg

SEQ ID NO: 3005423 - RNA, 15 nt, Human
cuugaggguugggcu

SEQ ID NO: 3005424 - RNA, 15 nt, Human
cuucuggauauagcu

SEQ ID NO: 3005425 - RNA, 22 nt, Human
cuugcccuguuaaaagaugaaa

SEQ ID NO: 3005426 - RNA, 22 nt, Human
cuugcucugcugacagacacag

SEQ ID NO: 3005427 - RNA, 20 nt, Human
cuugcuugauuguauggugg

SEQ ID NO: 3005428 - RNA, 14 nt, Human
cuuggaagcuccgc

SEQ ID NO: 3005429 - RNA, 20 nt, Human
cuuggaagcuccgcuuucua

SEQ ID NO: 3005430 - RNA, 14 nt, Human
cuugcccuguuaaa

SEQ ID NO: 3005431 - RNA, 18 nt, Human
cuugcccuggugccucac

SEQ ID NO: 3005432 - RNA, 18 nt, Human
cuugcccagccuggaugc

SEQ ID NO: 3005433 - RNA, 16 nt, Human
cuugccaucccucccu

SEQ ID NO: 3005434 - RNA, 15 nt, Human
cuugccaucccuccc

SEQ ID NO: 3005435 - RNA, 17 nt, Human
cuugccaucccucccuc

SEQ ID NO: 3005436 - RNA, 14 nt, Human
cuugccaucccucc

SEQ ID NO: 3005437 - RNA, 13 nt, Human
cuugcaugaggcu

SEQ ID NO: 3005438 - RNA, 14 nt, Human
cuugcaugaggcua

SEQ ID NO: 3005439 - RNA, 14 nt, Human
cuuauuuaaauaga

SEQ ID NO: 3005440 - RNA, 13 nt, Human
cuuauuuaaauag

SEQ ID NO: 3005441 - RNA, 15 nt, Human
cuuauuuaaugaaag

SEQ ID NO: 3005442 - RNA, 19 nt, Human
cuuauuuaaauagaugaca

SEQ ID NO: 3005443 - RNA, 18 nt, Human
cuuauuuaaauagaugac

SEQ ID NO: 3005444 - RNA, 17 nt, Human
cuuaucuuacgaaaaaa

SEQ ID NO: 3005445 - RNA, 13 nt, Human
cuuauaauuuaaa

SEQ ID NO: 3005446 - RNA, 17 nt, Human
cuuagguuggcaaaaag

SEQ ID NO: 3005447 - RNA, 21 nt, Human
cuuaggguuaugauuaaguaa

SEQ ID NO: 3005448 - RNA, 14 nt, Human
cuuauaauuuaaaa

SEQ ID NO: 3005449 - RNA, 19 nt, Human
cuuauaggaauugacccac

SEQ ID NO: 3005450 - RNA, 14 nt, Human
cuuagacccucaug

SEQ ID NO: 3005451 - RNA, 19 nt, Human
cuuagaugcaguucugaag

SEQ ID NO: 3005452 - RNA, 17 nt, Human
cuuagacagucccugcc

SEQ ID NO: 3005453 - RNA, 18 nt, Human
cuuagacagucccugcca

SEQ ID NO: 3005454 - RNA, 19 nt, Human
cuuagacagucccugccaa

SEQ ID NO: 3005455 - RNA, 11 nt, Human
cuuagacaguc

SEQ ID NO: 3005456 - RNA, 15 nt, Human
cuuagacagucccug

SEQ ID NO: 3005457 - RNA, 16 nt, Human
cuuagacagucccugc

SEQ ID NO: 3005458 - RNA, 14 nt, Human
cuuagacagucccu

SEQ ID NO: 3005459 - RNA, 15 nt, Human
cuuagaagucacaca

SEQ ID NO: 3005460 - RNA, 19 nt, Human
cuuacuaguuucccuugca

SEQ ID NO: 3005461 - RNA, 15 nt, Human
cuuacgugaguccug

SEQ ID NO: 3005462 - RNA, 22 nt, Human
cuuacgaaaaaaugguagcauu

SEQ ID NO: 3005463 - RNA, 16 nt, Human
cuuacuguacaugaaa

SEQ ID NO: 3005464 - RNA, 13 nt, Human
cuuacuguacaug

SEQ ID NO: 3005465 - RNA, 19 nt, Human
cuuaauaaacuguggugcu

SEQ ID NO: 3005466 - RNA, 23 nt, Human
cuuaaugagacuuuaaaagcauu

SEQ ID NO: 3005467 - RNA, 14 nt, Human
cuuaaucuaaaugg

SEQ ID NO: 3005468 - RNA, 18 nt, Human
cuuaaugccacuaaauug

SEQ ID NO: 3005469 - RNA, 18 nt, Human
cuuaagaaauuuguggaa

SEQ ID NO: 3005470 - RNA, 22 nt, Human
cuuaacuucacauauugauuuc

SEQ ID NO: 3005471 - RNA, 17 nt, Human
cuuaacuucacauauug

SEQ ID NO: 3005472 - RNA, 16 nt, Human
cuuaacuucacauauu

SEQ ID NO: 3005473 - RNA, 15 nt, Human
cuuaacuucacauau

SEQ ID NO: 3005474 - RNA, 14 nt, Human
cuuaacuucacaua

SEQ ID NO: 3005475 - RNA, 12 nt, Human
cuuaacuucaca

SEQ ID NO: 3005476 - RNA, 13 nt, Human
cuguuuucucuug

SEQ ID NO: 3005477 - RNA, 14 nt, Human
cuguuuucucuuga

SEQ ID NO: 3005478 - RNA, 21 nt, Human
cuguuuuauuuuaauucaguu

SEQ ID NO: 3005479 - RNA, 21 nt, Human
cuguuuguuucugaaagggac

SEQ ID NO: 3005480 - RNA, 23 nt, Human
cuguuuguuucugaaagggacgc

SEQ ID NO: 3005481 - RNA, 19 nt, Human
cuguuuuauaauuuuguga

SEQ ID NO: 3005482 - RNA, 17 nt, Human
cuguuuucucuugagag

SEQ ID NO: 3005483 - RNA, 12 nt, Human
cuguuuagauaa

SEQ ID NO: 3005484 - RNA, 18 nt, Human
cuguuuguuucugaaagg

SEQ ID NO: 3005485 - RNA, 18 nt, Human
cuucggccuccauccuga

SEQ ID NO: 3005486 - RNA, 17 nt, Human
cuucggccuccauccug

SEQ ID NO: 3005487 - RNA, 20 nt, Human
cuucgggaggucgaggcagg

SEQ ID NO: 3005488 - RNA, 21 nt, Human
cuucgggaggucgaggcagga

SEQ ID NO: 3005489 - RNA, 19 nt, Human
cuuccuuggacucauuuua

SEQ ID NO: 3005490 - RNA, 15 nt, Human
cuucgcuccuguguc

SEQ ID NO: 3005491 - RNA, 14 nt, Human
cuucgcuccugugu

SEQ ID NO: 3005492 - RNA, 13 nt, Human
cuucgcuccugug

SEQ ID NO: 3005493 - RNA, 22 nt, Human
cuucuccuucaccuuugucccc

SEQ ID NO: 3005494 - RNA, 21 nt, Human
cuucucccccacccccuaggg

SEQ ID NO: 3005495 - RNA, 19 nt, Human
cuucuccuucaccuuuguc

SEQ ID NO: 3005496 - RNA, 15 nt, Human
cuucuccacccugcu

SEQ ID NO: 3005497 - RNA, 14 nt, Human
cuucuccacccugc

SEQ ID NO: 3005498 - RNA, 14 nt, Human
cuucuccaggcugu

SEQ ID NO: 3005499 - RNA, 17 nt, Human
cuucuccaggcuguauc

SEQ ID NO: 3005500 - RNA, 21 nt, Human
cuucugccauauucuguuggc

SEQ ID NO: 3005501 - RNA, 20 nt, Human
cuucucuacccaucuuaaaa

SEQ ID NO: 3005502 - RNA, 17 nt, Human
cuucugccauauucugu

SEQ ID NO: 3005503 - RNA, 15 nt, Human
cuucugccauauucu

SEQ ID NO: 3005504 - RNA, 17 nt, Human
cuucugcuucagccucc

SEQ ID NO: 3005505 - RNA, 16 nt, Human
cuucugcuucagccuc

SEQ ID NO: 3005506 - RNA, 18 nt, Human
cuucugcuucagccuccc

SEQ ID NO: 3005507 - RNA, 19 nt, Human
cuuccagauccuggaaauc

SEQ ID NO: 3005508 - RNA, 22 nt, Human
cuuccaggggugggacacccug

SEQ ID NO: 3005509 - RNA, 24 nt, Human
cuuccaggggugggacacccugug

SEQ ID NO: 3005510 - RNA, 15 nt, Human
cuuccagugaggcuc

SEQ ID NO: 3005511 - RNA, 14 nt, Human
cuuccagugaggcu

SEQ ID NO: 3005512 - RNA, 18 nt, Human
cuucagcgguuuauauaa

SEQ ID NO: 3005513 - RNA, 16 nt, Human
cuucagcgguuuauau

SEQ ID NO: 3005514 - RNA, 11 nt, Human
cuucagcugac

SEQ ID NO: 3005515 - RNA, 22 nt, Human
cuuccacaagagcccaggccuc

SEQ ID NO: 3005516 - RNA, 23 nt, Human
cuuccacaagagcccaggccucc

SEQ ID NO: 3005517 - RNA, 13 nt, Human
cuucagugccuua

SEQ ID NO: 3005518 - RNA, 14 nt, Human
cuucagugccuuau

SEQ ID NO: 3005519 - RNA, 18 nt, Human
cuucauuuccugugucuu

SEQ ID NO: 3005520 - RNA, 11 nt, Human
cuucagugccu

SEQ ID NO: 3005521 - RNA, 12 nt, Human
cuucagugccuu

SEQ ID NO: 3005522 - RNA, 22 nt, Human
cucccuuccuaugcuguucacu

SEQ ID NO: 3005523 - RNA, 13 nt, Human
cucccuuccucuu

SEQ ID NO: 3005524 - RNA, 14 nt, Human
cucccuuccucuuu

SEQ ID NO: 3005525 - RNA, 16 nt, Human
cucccuucucuucaca

SEQ ID NO: 3005526 - RNA, 17 nt, Human
cucccuuggauuguccc

SEQ ID NO: 3005527 - RNA, 12 nt, Human
cucccuuucaac

SEQ ID NO: 3005528 - RNA, 13 nt, Human
cucccuuucaaca

SEQ ID NO: 3005529 - RNA, 22 nt, Human
cuccuaggacccgucuccagcu

SEQ ID NO: 3005530 - RNA, 21 nt, Human
cuccuaggacccgucuccagc

SEQ ID NO: 3005531 - RNA, 20 nt, Human
cuccuaggacccgucuccag

SEQ ID NO: 3005532 - RNA, 14 nt, Human
cucccaucucacac

SEQ ID NO: 3005533 - RNA, 15 nt, Human
cucccaucucacaca

SEQ ID NO: 3005534 - RNA, 18 nt, Human
cucccaucucacacauga

SEQ ID NO: 3005535 - RNA, 10 nt, Human
cucccuuccu

SEQ ID NO: 3005536 - RNA, 23 nt, Human
cucccuucccaccucucucacuc

SEQ ID NO: 3005537 - RNA, 12 nt, Human
cuccucagaucu

SEQ ID NO: 3005538 - RNA, 14 nt, Human
cuccucagaucuuc

SEQ ID NO: 3005539 - RNA, 13 nt, Human
cuccugcaggcag

SEQ ID NO: 3005540 - RNA, 14 nt, Human
cuccugcaggcagc

SEQ ID NO: 3005541 - RNA, 12 nt, Human
cuccugcaggca

SEQ ID NO: 3005542 - RNA, 13 nt, Human
cucggagaagagc

SEQ ID NO: 3005543 - RNA, 20 nt, Human
cucggagaagagcuguucac

SEQ ID NO: 3005544 - RNA, 12 nt, Human
cucggagaagag

SEQ ID NO: 3005545 - RNA, 19 nt, Human
cucggaccccacuccggcc

SEQ ID NO: 3005546 - RNA, 21 nt, Human
cucggaccccacuccggcccu

SEQ ID NO: 3005547 - RNA, 17 nt, Human
cucuaaauucuuucauu

SEQ ID NO: 3005548 - RNA, 13 nt, Human
cucuaaauucuuu

SEQ ID NO: 3005549 - RNA, 13 nt, Human
cucgcgacaaugc

SEQ ID NO: 3005550 - RNA, 15 nt, Human
cucgcgacaaugcaa

SEQ ID NO: 3005551 - RNA, 16 nt, Human
cucgaguuacagacaa

SEQ ID NO: 3005552 - RNA, 20 nt, Human
cucgaguuacagacaaagcg

SEQ ID NO: 3005553 - RNA, 20 nt, Human
cuccuucuguccuacucugu

SEQ ID NO: 3005554 - RNA, 15 nt, Human
cuccuucuguccuac

SEQ ID NO: 3005555 - RNA, 14 nt, Human
cuccuucuguccua

SEQ ID NO: 3005556 - RNA, 13 nt, Human
cuccuucaccuuu

SEQ ID NO: 3005557 - RNA, 16 nt, Human
cucgaacuggcugcaa

SEQ ID NO: 3005558 - RNA, 11 nt, Human
cuccuucuucc

SEQ ID NO: 3005559 - RNA, 21 nt, Human
cuccuugaaaacacuguucuc

SEQ ID NO: 3005560 - RNA, 14 nt, Human
cuccuucaccuuug

SEQ ID NO: 3005561 - RNA, 16 nt, Human
cuccuucaccuuuguc

SEQ ID NO: 3005562 - RNA, 19 nt, Human
cuccuucaccuuugucccc

SEQ ID NO: 3005563 - RNA, 21 nt, Human
cuccuucaccuuuguccccac

SEQ ID NO: 3005564 - RNA, 15 nt, Human
cuccugcaggcagcc

SEQ ID NO: 3005565 - RNA, 21 nt, Human
cuccugcaggcagccaggcca

SEQ ID NO: 3005566 - RNA, 22 nt, Human
cuccugcaggcagccaggccac

SEQ ID NO: 3005567 - RNA, 11 nt, Human
cuccugugugu

SEQ ID NO: 3005568 - RNA, 23 nt, Human
cuccugugucuugcaauggcagc

SEQ ID NO: 3005569 - RNA, 15 nt, Human
cuccugugucuugca

SEQ ID NO: 3005570 - RNA, 13 nt, Human
cucauucauuacu

SEQ ID NO: 3005571 - RNA, 17 nt, Human
cucauucauuacuaaaa

SEQ ID NO: 3005572 - RNA, 12 nt, Human
cucauucuucug

SEQ ID NO: 3005573 - RNA, 14 nt, Human
cucauucuucugua

SEQ ID NO: 3005574 - RNA, 13 nt, Human
cucauucuucugu

SEQ ID NO: 3005575 - RNA, 13 nt, Human
cucauugaccuga

SEQ ID NO: 3005576 - RNA, 15 nt, Human
cucauugaccugagg

SEQ ID NO: 3005577 - RNA, 23 nt, Human
cucauucuucuguacgucugaca

SEQ ID NO: 3005578 - RNA, 16 nt, Human
cucauugaccugaggc

SEQ ID NO: 3005579 - RNA, 14 nt, Human
cucauauuuucaug

SEQ ID NO: 3005580 - RNA, 21 nt, Human
cucauuagcauuuugcuaaau

SEQ ID NO: 3005581 - RNA, 18 nt, Human
cucauuaggauggcuagu

SEQ ID NO: 3005582 - RNA, 17 nt, Human
cucauuaggauggcuag

SEQ ID NO: 3005583 - RNA, 22 nt, Human
cucagguggggucacucuggca

SEQ ID NO: 3005584 - RNA, 23 nt, Human
cucagguggggucacucuggcag

SEQ ID NO: 3005585 - RNA, 16 nt, Human
cucaggugucccugca

SEQ ID NO: 3005586 - RNA, 15 nt, Human
cucaggugucccugc

SEQ ID NO: 3005587 - RNA, 14 nt, Human
cucagggucccugg

SEQ ID NO: 3005588 - RNA, 12 nt, Human
cucagggucccu

SEQ ID NO: 3005589 - RNA, 23 nt, Human
cuaaaagguaugcaaucaaaucu

SEQ ID NO: 3005590 - RNA, 19 nt, Human
cucauaguaugguggcugg

SEQ ID NO: 3005591 - RNA, 18 nt, Human
cucauaguaugguggcug

SEQ ID NO: 3005592 - RNA, 18 nt, Human
cucaggugucccugcacu

SEQ ID NO: 3005593 - RNA, 17 nt, Human
cucaggugucccugcac

SEQ ID NO: 3005594 - RNA, 19 nt, Human
cucaggugucccugcacuu

SEQ ID NO: 3005595 - RNA, 17 nt, Human
cucccaggcauucccca

SEQ ID NO: 3005596 - RNA, 19 nt, Human
cucccaggcauuccccagg

SEQ ID NO: 3005597 - RNA, 20 nt, Human
cucccaggcauuccccagga

SEQ ID NO: 3005598 - RNA, 21 nt, Human
cucccaggcauuccccaggag

SEQ ID NO: 3005599 - RNA, 17 nt, Human
cucccagucauuuaaua

SEQ ID NO: 3005600 - RNA, 22 nt, Human
cucccaggcauuccccaggagg

SEQ ID NO: 3005601 - RNA, 22 nt, Human
cucccaaggggcccaaauucuu

SEQ ID NO: 3005602 - RNA, 21 nt, Human
cucccaaggggcccaaauucu

SEQ ID NO: 3005603 - RNA, 15 nt, Human
cucccaggcauuccc

SEQ ID NO: 3005604 - RNA, 14 nt, Human
cuccaugugggcua

SEQ ID NO: 3005605 - RNA, 23 nt, Human
cuccauccugaggcuccacuugg

SEQ ID NO: 3005606 - RNA, 20 nt, Human
cuccauccugaggcuccacu

SEQ ID NO: 3005607 - RNA, 21 nt, Human
cuccauccugaggcuccacuu

SEQ ID NO: 3005608 - RNA, 11 nt, Human
cuccaggcucc

SEQ ID NO: 3005609 - RNA, 13 nt, Human
cuccagcuguuca

SEQ ID NO: 3005610 - RNA, 18 nt, Human
cuccagcuguucagcugg

SEQ ID NO: 3005611 - RNA, 19 nt, Human
cuccagcuguucagcuggu

SEQ ID NO: 3005612 - RNA, 20 nt, Human
cuccagcucaccagccccag

SEQ ID NO: 3005613 - RNA, 19 nt, Human
cuccagcucaccagcccca

SEQ ID NO: 3005614 - RNA, 15 nt, Human
cuccaccugccaggg

SEQ ID NO: 3005615 - RNA, 17 nt, Human
cuccaccugccagggac

SEQ ID NO: 3005616 - RNA, 18 nt, Human
cuccaccugccagggaca

SEQ ID NO: 3005617 - RNA, 21 nt, Human
cuccaccugccagggacagag

SEQ ID NO: 3005618 - RNA, 17 nt, Human
cuccaccucccugcaau

SEQ ID NO: 3005619 - RNA, 16 nt, Human
cuccaccucccugcaa

SEQ ID NO: 3005620 - RNA, 15 nt, Human
cuccaccucccugca

SEQ ID NO: 3005621 - RNA, 14 nt, Human
cuccaccucccugc

SEQ ID NO: 3005622 - RNA, 12 nt, Human
cuccacccugcu

SEQ ID NO: 3005623 - RNA, 11 nt, Human
cuccacccugc

SEQ ID NO: 3005624 - RNA, 16 nt, Human
cugaacuucagagcau

SEQ ID NO: 3005625 - RNA, 15 nt, Human
cugaacuuggcgcug

SEQ ID NO: 3005626 - RNA, 16 nt, Human
cugaacuuggcgcugc

SEQ ID NO: 3005627 - RNA, 21 nt, Human
cugaacuuggcgcugccccug

SEQ ID NO: 3005628 - RNA, 21 nt, Human
cugaagacucauucuucugua

SEQ ID NO: 3005629 - RNA, 19 nt, Human
cugaagacucauucuucug

SEQ ID NO: 3005630 - RNA, 19 nt, Human
cucuuuggucuacacugug

SEQ ID NO: 3005631 - RNA, 21 nt, Human
cucuuuggucuacacugugcu

SEQ ID NO: 3005632 - RNA, 18 nt, Human
cucuuugggccuggcucc

SEQ ID NO: 3005633 - RNA, 21 nt, Human
cugaaccuggguaacuaggga

SEQ ID NO: 3005634 - RNA, 16 nt, Human
cugaauacagaggcaa

SEQ ID NO: 3005635 - RNA, 24 nt, Human
cugaagucuuuguacagacaacaa

SEQ ID NO: 3005636 - RNA, 15 nt, Human
cugaagucacacagu

SEQ ID NO: 3005637 - RNA, 14 nt, Human
cugaagucacacag

SEQ ID NO: 3005638 - RNA, 18 nt, Human
cugaauuuaaauagcuuu

SEQ ID NO: 3005639 - RNA, 14 nt, Human
cugaauuuaaauag

SEQ ID NO: 3005640 - RNA, 23 nt, Human
cugaauuuaaauagcuuuuuucu

SEQ ID NO: 3005641 - RNA, 19 nt, Human
cugacagacacaggcccgg

SEQ ID NO: 3005642 - RNA, 21 nt, Human
cugacagacacaggcccggcu

SEQ ID NO: 3005643 - RNA, 11 nt, Human
cugacaggcaa

SEQ ID NO: 3005644 - RNA, 19 nt, Human
cugacaggcaaugcuggcu

SEQ ID NO: 3005645 - RNA, 18 nt, Human
cugacaggcaaugcuggc

SEQ ID NO: 3005646 - RNA, 17 nt, Human
cugacaggcaaugcugg

SEQ ID NO: 3005647 - RNA, 16 nt, Human
cugacaggcaaugcug

SEQ ID NO: 3005648 - RNA, 20 nt, Human
cugacaggcaaugcuggcug

SEQ ID NO: 3005649 - RNA, 17 nt, Human
cugacauuguuggccaa

SEQ ID NO: 3005650 - RNA, 11 nt, Human
cugacccacug

SEQ ID NO: 3005651 - RNA, 17 nt, Human
cucuuuccaucuacccu

SEQ ID NO: 3005652 - RNA, 15 nt, Human
cucuuuggacacuca

SEQ ID NO: 3005653 - RNA, 18 nt, Human
cucuuuggacacucacac

SEQ ID NO: 3005654 - RNA, 17 nt, Human
cucuuucuauuguuucu

SEQ ID NO: 3005655 - RNA, 15 nt, Human
cucuugaccucaggu

SEQ ID NO: 3005656 - RNA, 13 nt, Human
cucuugaccucag

SEQ ID NO: 3005657 - RNA, 16 nt, Human
cucuugaccucaggug

SEQ ID NO: 3005658 - RNA, 18 nt, Human
cucuugguccugcugcag

SEQ ID NO: 3005659 - RNA, 19 nt, Human
cucuugguccugcugcagu

SEQ ID NO: 3005660 - RNA, 22 nt, Human
cucuuccaggcugggagagccu

SEQ ID NO: 3005661 - RNA, 21 nt, Human
cucuuccaggcugggagagcc

SEQ ID NO: 3005662 - RNA, 23 nt, Human
cucuuccaggcugggagagccuu

SEQ ID NO: 3005663 - RNA, 12 nt, Human
cucuucuccagg

SEQ ID NO: 3005664 - RNA, 24 nt, Human
cucuuaaaacccaagugccuuagc

SEQ ID NO: 3005665 - RNA, 13 nt, Human
cucuuaaaaccca

SEQ ID NO: 3005666 - RNA, 17 nt, Human
cucuggcagcucagaga

SEQ ID NO: 3005667 - RNA, 18 nt, Human
cucuggcagcucagagag

SEQ ID NO: 3005668 - RNA, 19 nt, Human
cucuggcagcucagagagg

SEQ ID NO: 3005669 - RNA, 23 nt, Human
cucugcauacucauuaggauggc

SEQ ID NO: 3005670 - RNA, 22 nt, Human
cucugcaagaauugaagcagga

SEQ ID NO: 3005671 - RNA, 14 nt, Human
cucugcccuccaag

SEQ ID NO: 3005672 - RNA, 15 nt, Human
cucugcccuccaaga

SEQ ID NO: 3005673 - RNA, 16 nt, Human
cucugcccuccaagac

SEQ ID NO: 3005674 - RNA, 23 nt, Human
cucugcccuccaagaccuucucc

SEQ ID NO: 3005675 - RNA, 14 nt, Human
cucugccucugaca

SEQ ID NO: 3005676 - RNA, 23 nt, Human
cucugcggagcacacuggcucac

SEQ ID NO: 3005677 - RNA, 21 nt, Human
cucugcggagcacacuggcuc

SEQ ID NO: 3005678 - RNA, 19 nt, Human
cucugcggagcacacuggc

SEQ ID NO: 3005679 - RNA, 18 nt, Human
cucugcggagcacacugg

SEQ ID NO: 3005680 - RNA, 17 nt, Human
cucugcggagcacacug

SEQ ID NO: 3005681 - RNA, 13 nt, Human
cucuccagccccu

SEQ ID NO: 3005682 - RNA, 12 nt, Human
cucuccagcccc

SEQ ID NO: 3005683 - RNA, 18 nt, Human
cucucccaucacuucccu

SEQ ID NO: 3005684 - RNA, 14 nt, Human
cucucccaucacuu

SEQ ID NO: 3005685 - RNA, 20 nt, Human
cucucccaucacuucccuac

SEQ ID NO: 3005686 - RNA, 13 nt, Human
cucucccaucacu

SEQ ID NO: 3005687 - RNA, 23 nt, Human
cucucaggccagcugcuugggcu

SEQ ID NO: 3005688 - RNA, 22 nt, Human
cucucaggccagcugcuugggc

SEQ ID NO: 3005689 - RNA, 15 nt, Human
cucucucacuccuug

SEQ ID NO: 3005690 - RNA, 16 nt, Human
cucucucacuccuuga

SEQ ID NO: 3005691 - RNA, 12 nt, Human
cucucucaggcc

SEQ ID NO: 3005692 - RNA, 14 nt, Human
cucucucacuccuu

SEQ ID NO: 3005693 - RNA, 15 nt, Human
cucuccuguaccucu

SEQ ID NO: 3005694 - RNA, 14 nt, Human
cucuccuguaccuc

SEQ ID NO: 3005695 - RNA, 13 nt, Human
cucuccuguaccu

SEQ ID NO: 3005696 - RNA, 21 nt, Human
cucuccugggcagcugccucc

SEQ ID NO: 3005697 - RNA, 18 nt, Human
cucuccuguaccucuuga

SEQ ID NO: 3005698 - RNA, 17 nt, Human
cucuccuguaccucuug

SEQ ID NO: 3005699 - RNA, 22 nt, Human
cucuccuguaccucuugagccu

SEQ ID NO: 3005700 - RNA, 20 nt, Human
cuggacacuucacgcccuug

SEQ ID NO: 3005701 - RNA, 22 nt, Human
cuggacacuucacgcccuuggc

SEQ ID NO: 3005702 - RNA, 15 nt, Human
cuggaaugcaguggu

SEQ ID NO: 3005703 - RNA, 14 nt, Human
cuggaaugcagugg

SEQ ID NO: 3005704 - RNA, 23 nt, Human
cuggaauaauccuaaacauauga

SEQ ID NO: 3005705 - RNA, 15 nt, Human
cuggaagcacagcuu

SEQ ID NO: 3005706 - RNA, 18 nt, Human
cuggaagcacagcuucau

SEQ ID NO: 3005707 - RNA, 14 nt, Human
cuggaagcacagcu

SEQ ID NO: 3005708 - RNA, 13 nt, Human
cugcugaaacaac

SEQ ID NO: 3005709 - RNA, 16 nt, Human
cuggagcuagaauuug

SEQ ID NO: 3005710 - RNA, 22 nt, Human
cuggagcuagaauuugauaugu

SEQ ID NO: 3005711 - RNA, 17 nt, Human
cuggagcuagaauuuga

SEQ ID NO: 3005712 - RNA, 22 nt, Human
cuggcacuauaauguaagcucu

SEQ ID NO: 3005713 - RNA, 23 nt, Human
cuggcacuauaauguaagcucua

SEQ ID NO: 3005714 - RNA, 13 nt, Human
cuggcacugcuuc

SEQ ID NO: 3005715 - RNA, 14 nt, Human
cuggcacugcuucc

SEQ ID NO: 3005716 - RNA, 18 nt, Human
cuggcacaguuuucugag

SEQ ID NO: 3005717 - RNA, 19 nt, Human
cuggcacaguuuucugaga

SEQ ID NO: 3005718 - RNA, 19 nt, Human
cuggcaaacagggccucug

SEQ ID NO: 3005719 - RNA, 17 nt, Human
cuggcaaacagggccuc

SEQ ID NO: 3005720 - RNA, 16 nt, Human
cuggcaaacagggccu

SEQ ID NO: 3005721 - RNA, 21 nt, Human
cuggcaaacagggccucugcg

SEQ ID NO: 3005722 - RNA, 20 nt, Human
cuggcaaacagggccucugc

SEQ ID NO: 3005723 - RNA, 23 nt, Human
cuggcaaacagggccucugcgga

SEQ ID NO: 3005724 - RNA, 19 nt, Human
cuggcaaagcagaauguga

SEQ ID NO: 3005725 - RNA, 16 nt, Human
cuggcaaagcagaaug

SEQ ID NO: 3005726 - RNA, 12 nt, Human
cuggcaaagcag

SEQ ID NO: 3005727 - RNA, 16 nt, Human
cuggauggggcugcac

SEQ ID NO: 3005728 - RNA, 23 nt, Human
cuggauuaaacuuaaucuaaaug

SEQ ID NO: 3005729 - RNA, 13 nt, Human
cuggauuaaacuu

SEQ ID NO: 3005730 - RNA, 15 nt, Human
cuggauggggcugca

SEQ ID NO: 3005731 - RNA, 16 nt, Human
cuggccaacgggguga

SEQ ID NO: 3005732 - RNA, 16 nt, Human
cuggccagaugcacca

SEQ ID NO: 3005733 - RNA, 15 nt, Human
cuggcacugcuucca

SEQ ID NO: 3005734 - RNA, 16 nt, Human
cuggcacugcuuccag

SEQ ID NO: 3005735 - RNA, 17 nt, Human
cuggcacugcuuccagu

SEQ ID NO: 3005736 - RNA, 20 nt, Human
cuggccagaugcaccagccc

SEQ ID NO: 3005737 - RNA, 19 nt, Human
cuggccagaugcaccagcc

SEQ ID NO: 3005738 - RNA, 18 nt, Human
cuggccagaugcaccagc

SEQ ID NO: 3005739 - RNA, 17 nt, Human
cuggccagaugcaccag

SEQ ID NO: 3005740 - RNA, 21 nt, Human
cuggccagaugcaccagcccu

SEQ ID NO: 3005741 - RNA, 13 nt, Human
cuggcccagggca

SEQ ID NO: 3005742 - RNA, 14 nt, Human
cuggcccagggcau

SEQ ID NO: 3005743 - RNA, 18 nt, Human
cuggcccagggcaucugg

SEQ ID NO: 3005744 - RNA, 17 nt, Human
cuggcccagggcaucug

SEQ ID NO: 3005745 - RNA, 17 nt, Human
cuggccuagcauacgua

SEQ ID NO: 3005746 - RNA, 12 nt, Human
cuggcccacugc

SEQ ID NO: 3005747 - RNA, 13 nt, Human
cuggcccacugca

SEQ ID NO: 3005748 - RNA, 20 nt, Human
cuggcccagggcaucuggga

SEQ ID NO: 3005749 - RNA, 23 nt, Human
cuggccuagcauacguacacauu

SEQ ID NO: 3005750 - RNA, 21 nt, Human
cuggucccagccagcaguuca

SEQ ID NO: 3005751 - RNA, 18 nt, Human
cugguccauagagagcaa

SEQ ID NO: 3005752 - RNA, 14 nt, Human
cuggucccacucag

SEQ ID NO: 3005753 - RNA, 18 nt, Human
cuggucccacucagucca

SEQ ID NO: 3005754 - RNA, 15 nt, Human
cuggucccacucagu

SEQ ID NO: 3005755 - RNA, 15 nt, Human
cugguccauagagag

SEQ ID NO: 3005756 - RNA, 17 nt, Human
cugguccauagagagca

SEQ ID NO: 3005757 - RNA, 13 nt, Human
cuggguuggaggg

SEQ ID NO: 3005758 - RNA, 19 nt, Human
cuggguucuacccaggugc

SEQ ID NO: 3005759 - RNA, 23 nt, Human
cugguggcagugggagcugccug

SEQ ID NO: 3005760 - RNA, 19 nt, Human
cugguggcagugggagcug

SEQ ID NO: 3005761 - RNA, 18 nt, Human
cugggguggggaccucag

SEQ ID NO: 3005762 - RNA, 19 nt, Human
cugggguggggaccucagg

SEQ ID NO: 3005763 - RNA, 17 nt, Human
cugggguggggaccuca

SEQ ID NO: 3005764 - RNA, 18 nt, Human
cugggggccucagugcca

SEQ ID NO: 3005765 - RNA, 17 nt, Human
cugggggccucagugcc

SEQ ID NO: 3005766 - RNA, 13 nt, Human
cugggggccucag

SEQ ID NO: 3005767 - RNA, 21 nt, Human
cugggguggggaccucaggcc

SEQ ID NO: 3005768 - RNA, 22 nt, Human
cugggguggggaccucaggccu

SEQ ID NO: 3005769 - RNA, 23 nt, Human
cugggguggggaccucaggccug

SEQ ID NO: 3005770 - RNA, 20 nt, Human
cuggguacuuguggacacag

SEQ ID NO: 3005771 - RNA, 23 nt, Human
cuggguacuuguggacacagcuc

SEQ ID NO: 3005772 - RNA, 21 nt, Human
cuggguacuuguggacacagc

SEQ ID NO: 3005773 - RNA, 19 nt, Human
cuggguacuuguggacaca

SEQ ID NO: 3005774 - RNA, 20 nt, Human
cugggcuucaguggcagcug

SEQ ID NO: 3005775 - RNA, 19 nt, Human
cugggcuucaguggcagcu

SEQ ID NO: 3005776 - RNA, 17 nt, Human
cugggcuucaguggcag

SEQ ID NO: 3005777 - RNA, 18 nt, Human
cugggcuucaguggcagc

SEQ ID NO: 3005778 - RNA, 21 nt, Human
cugggcuuggggaccagagcu

SEQ ID NO: 3005779 - RNA, 17 nt, Human
cugggcuuggggaccag

SEQ ID NO: 3005780 - RNA, 20 nt, Human
cugggcuuggggaccagagc

SEQ ID NO: 3005781 - RNA, 13 nt, Human
cugggcuugggga

SEQ ID NO: 3005782 - RNA, 23 nt, Human
cugggcuucaguggcagcugcuu

SEQ ID NO: 3005783 - RNA, 22 nt, Human
cugggcuucaguggcagcugcu

SEQ ID NO: 3005784 - RNA, 21 nt, Human
cugggcuucaguggcagcugc

SEQ ID NO: 3005785 - RNA, 22 nt, Human
cugggaacccaaguccaagcau

SEQ ID NO: 3005786 - RNA, 12 nt, Human
cugggaggaacc

SEQ ID NO: 3005787 - RNA, 16 nt, Human
cugggagcuuuuguag

SEQ ID NO: 3005788 - RNA, 18 nt, Human
cugggaggucaaggcugc

SEQ ID NO: 3005789 - RNA, 18 nt, Human
cugggaggaaccgagggg

SEQ ID NO: 3005790 - RNA, 12 nt, Human
cugggagugagc

SEQ ID NO: 3005791 - RNA, 13 nt, Human
cugggagugagcu

SEQ ID NO: 3005792 - RNA, 16 nt, Human
cugggagugagcuggu

SEQ ID NO: 3005793 - RNA, 20 nt, Human
cugggcaaugugauaaaacc

SEQ ID NO: 3005794 - RNA, 20 nt, Human
cuggcuguuggcugggggcc

SEQ ID NO: 3005795 - RNA, 18 nt, Human
cuggcuguuggcuggggg

SEQ ID NO: 3005796 - RNA, 21 nt, Human
cuggcuggguggcaccagcag

SEQ ID NO: 3005797 - RNA, 22 nt, Human
cuggcuggguggcaccagcagc

SEQ ID NO: 3005798 - RNA, 19 nt, Human
cuggcuguuggcugggggc

SEQ ID NO: 3005799 - RNA, 18 nt, Human
cuggcucuuccaggcugg

SEQ ID NO: 3005800 - RNA, 19 nt, Human
cuggcucuuccaggcuggg

SEQ ID NO: 3005801 - RNA, 20 nt, Human
cuggcucuuccaggcuggga

SEQ ID NO: 3005802 - RNA, 17 nt, Human
cuggcucuuccaggcug

SEQ ID NO: 3005803 - RNA, 13 nt, Human
cuggccugagcug

SEQ ID NO: 3005804 - RNA, 17 nt, Human
cugcagggacagagcau

SEQ ID NO: 3005805 - RNA, 22 nt, Human
cugcagggaguccgaaagggac

SEQ ID NO: 3005806 - RNA, 20 nt, Human
cugcagccucaaccuccugg

SEQ ID NO: 3005807 - RNA, 19 nt, Human
cugcagccucaaccuccug

SEQ ID NO: 3005808 - RNA, 22 nt, Human
cugcagccucaaccuccugggc

SEQ ID NO: 3005809 - RNA, 11 nt, Human
cugcagccuca

SEQ ID NO: 3005810 - RNA, 13 nt, Human
cugcagaagacag

SEQ ID NO: 3005811 - RNA, 23 nt, Human
cugcagaagacaguauggcagcu

SEQ ID NO: 3005812 - RNA, 17 nt, Human
cugcaccggcuggccug

SEQ ID NO: 3005813 - RNA, 18 nt, Human
cugcaccggcuggccugg

SEQ ID NO: 3005814 - RNA, 19 nt, Human
cugcaccggcuggccuggc

SEQ ID NO: 3005815 - RNA, 17 nt, Human
cugcacuugcagacucu

SEQ ID NO: 3005816 - RNA, 16 nt, Human
cugcacuugcagacuc

SEQ ID NO: 3005817 - RNA, 14 nt, Human
cugcacuugcagac

SEQ ID NO: 3005818 - RNA, 17 nt, Human
cugcacccucaggcagg

SEQ ID NO: 3005819 - RNA, 16 nt, Human
cugcacccucaggcag

SEQ ID NO: 3005820 - RNA, 18 nt, Human
cugcacccucaggcaggu

SEQ ID NO: 3005821 - RNA, 13 nt, Human
cugcacaagcugc

SEQ ID NO: 3005822 - RNA, 14 nt, Human
cugcacaagcugca

SEQ ID NO: 3005823 - RNA, 15 nt, Human
cugcacaagcugcac

SEQ ID NO: 3005824 - RNA, 16 nt, Human
cugcacaagcugcacc

SEQ ID NO: 3005825 - RNA, 20 nt, Human
cugcacagcaggcugccagu

SEQ ID NO: 3005826 - RNA, 21 nt, Human
cugcacagcaggcugccagug

SEQ ID NO: 3005827 - RNA, 22 nt, Human
cugcacagcaggcugccagugc

SEQ ID NO: 3005828 - RNA, 13 nt, Human
cugagucugaagg

SEQ ID NO: 3005829 - RNA, 14 nt, Human
cugagucugaaggc

SEQ ID NO: 3005830 - RNA, 15 nt, Human
cugagucugaaggcu

SEQ ID NO: 3005831 - RNA, 16 nt, Human
cugagucugaaggcug

SEQ ID NO: 3005832 - RNA, 13 nt, Human
cugauaaagauga

SEQ ID NO: 3005833 - RNA, 22 nt, Human
cugagugggggaucacagccuc

SEQ ID NO: 3005834 - RNA, 13 nt, Human
cugauguuccuag

SEQ ID NO: 3005835 - RNA, 18 nt, Human
cugauguuccuagugaaa

SEQ ID NO: 3005836 - RNA, 20 nt, Human
cugauguuccuagugaaaga

SEQ ID NO: 3005837 - RNA, 21 nt, Human
cugauguuccuagugaaagag

SEQ ID NO: 3005838 - RNA, 15 nt, Human
cugauucccaagcuc

SEQ ID NO: 3005839 - RNA, 18 nt, Human
cugauucccaagcucugc

SEQ ID NO: 3005840 - RNA, 17 nt, Human
cugauucccaagcucug

SEQ ID NO: 3005841 - RNA, 20 nt, Human
cugauucccaagcucugcuc

SEQ ID NO: 3005842 - RNA, 19 nt, Human
cugauucccaagcucugcu

SEQ ID NO: 3005843 - RNA, 22 nt, Human
cugauucccaagcucugcuccu

SEQ ID NO: 3005844 - RNA, 16 nt, Human
cugauucccugauuua

SEQ ID NO: 3005845 - RNA, 14 nt, Human
cugaucgcuucucc

SEQ ID NO: 3005846 - RNA, 23 nt, Human
cugaucauguuuaugagaaacug

SEQ ID NO: 3005847 - RNA, 15 nt, Human
cugccuaagugcagc

SEQ ID NO: 3005848 - RNA, 13 nt, Human
cugccucagccuc

SEQ ID NO: 3005849 - RNA, 14 nt, Human
cugccucagccucc

SEQ ID NO: 3005850 - RNA, 14 nt, Human
cugccugcccaggc

SEQ ID NO: 3005851 - RNA, 13 nt, Human
cugccugcccagg

SEQ ID NO: 3005852 - RNA, 13 nt, Human
cugccucuucucu

SEQ ID NO: 3005853 - RNA, 23 nt, Human
cugccugaagucacacagugagu

SEQ ID NO: 3005854 - RNA, 18 nt, Human
cugcuccucuccccagca

SEQ ID NO: 3005855 - RNA, 15 nt, Human
cugcuccagcuguuc

SEQ ID NO: 3005856 - RNA, 17 nt, Human
cugcuccucuccccagc

SEQ ID NO: 3005857 - RNA, 16 nt, Human
cugcuccucuccccag

SEQ ID NO: 3005858 - RNA, 20 nt, Human
cugcggaaugaaccacaucu

SEQ ID NO: 3005859 - RNA, 15 nt, Human
cugcgguccacccag

SEQ ID NO: 3005860 - RNA, 21 nt, Human
cugcggaaugaaccacaucuu

SEQ ID NO: 3005861 - RNA, 16 nt, Human
cugcgguccacccagg

SEQ ID NO: 3005862 - RNA, 14 nt, Human
cugcuccagcuguu

SEQ ID NO: 3005863 - RNA, 15 nt, Human
cugccaggaagccag

SEQ ID NO: 3005864 - RNA, 16 nt, Human
cugccaggaagccagc

SEQ ID NO: 3005865 - RNA, 18 nt, Human
cugccaggaagccagcag

SEQ ID NO: 3005866 - RNA, 19 nt, Human
cugccaggaagccagcagg

SEQ ID NO: 3005867 - RNA, 19 nt, Human
cugccagccgagauagcca

SEQ ID NO: 3005868 - RNA, 15 nt, Human
cugccaugccagcuu

SEQ ID NO: 3005869 - RNA, 17 nt, Human
cugccaugccagcuuau

SEQ ID NO: 3005870 - RNA, 19 nt, Human
cugccaugccagcuuaucu

SEQ ID NO: 3005871 - RNA, 14 nt, Human
cugccacccugggg

SEQ ID NO: 3005872 - RNA, 20 nt, Human
cugccacccuggggagaaag

SEQ ID NO: 3005873 - RNA, 16 nt, Human
cugccacccuggggag

SEQ ID NO: 3005874 - RNA, 15 nt, Human
cugccacccugggga

SEQ ID NO: 3005875 - RNA, 19 nt, Human
cugcccuccaagaccuucu

SEQ ID NO: 3005876 - RNA, 15 nt, Human
cugcccggcugcgga

SEQ ID NO: 3005877 - RNA, 11 nt, Human
cugcccggcug

SEQ ID NO: 3005878 - RNA, 13 nt, Human
cugcccugcccac

SEQ ID NO: 3005879 - RNA, 14 nt, Human
cugcccugcccacc

SEQ ID NO: 3005880 - RNA, 15 nt, Human
cugcccugcccaccu

SEQ ID NO: 3005881 - RNA, 16 nt, Human
cugcccugcccaccug

SEQ ID NO: 3005882 - RNA, 14 nt, Human
cugccccuggcagc

SEQ ID NO: 3005883 - RNA, 15 nt, Human
cugccccuggcagcc

SEQ ID NO: 3005884 - RNA, 16 nt, Human
cugccccuggcagccc

SEQ ID NO: 3005885 - RNA, 20 nt, Human
cugcccggcaggguccuaga

SEQ ID NO: 3005886 - RNA, 13 nt, Human
cugcccaggcccc

SEQ ID NO: 3005887 - RNA, 16 nt, Human
cugccauuucugagau

SEQ ID NO: 3005888 - RNA, 14 nt, Human
ccucaauugugaaa

SEQ ID NO: 3005889 - RNA, 17 nt, Human
ccucacaguccuuacca

SEQ ID NO: 3005890 - RNA, 18 nt, Human
ccucaauaaacauuucau

SEQ ID NO: 3005891 - RNA, 20 nt, Human
ccucacaguccuuaccagca

SEQ ID NO: 3005892 - RNA, 22 nt, Human
ccucacaguccuuaccagcaga

SEQ ID NO: 3005893 - RNA, 12 nt, Human
ccucaccccacu

SEQ ID NO: 3005894 - RNA, 15 nt, Human
ccucaccccacugug

SEQ ID NO: 3005895 - RNA, 17 nt, Human
ccucaccuuucccaucu

SEQ ID NO: 3005896 - RNA, 13 nt, Human
ccggcuggccugg

SEQ ID NO: 3005897 - RNA, 22 nt, Human
ccgggaggcagagguugcagug

SEQ ID NO: 3005898 - RNA, 15 nt, Human
ccgggcacucagaag

SEQ ID NO: 3005899 - RNA, 12 nt, Human
ccggcuggccug

SEQ ID NO: 3005900 - RNA, 23 nt, Human
ccgcuuucuacccagcgagcccu

SEQ ID NO: 3005901 - RNA, 22 nt, Human
cccuuuuucaauaacuggaaca

SEQ ID NO: 3005902 - RNA, 17 nt, Human
cccuuuuucaauaacug

SEQ ID NO: 3005903 - RNA, 17 nt, Human
cccuuuuuuggcugcug

SEQ ID NO: 3005904 - RNA, 18 nt, Human
cccuuuuuuggcugcuga

SEQ ID NO: 3005905 - RNA, 11 nt, Human
cccuuuuccuu

SEQ ID NO: 3005906 - RNA, 13 nt, Human
cccuuuucuguuu

SEQ ID NO: 3005907 - RNA, 17 nt, Human
ccgagaaggaagccucc

SEQ ID NO: 3005908 - RNA, 18 nt, Human
ccgagauagccaaggcca

SEQ ID NO: 3005909 - RNA, 19 nt, Human
ccgagauagccaaggccaa

SEQ ID NO: 3005910 - RNA, 22 nt, Human
ccgagauagccaaggccaaagg

SEQ ID NO: 3005911 - RNA, 19 nt, Human
cccuuuuuuggcugcugaa

SEQ ID NO: 3005912 - RNA, 17 nt, Human
ccgaggccuucucugaa

SEQ ID NO: 3005913 - RNA, 18 nt, Human
ccgagaucacgccacugc

SEQ ID NO: 3005914 - RNA, 19 nt, Human
ccgagggggcugcucccac

SEQ ID NO: 3005915 - RNA, 18 nt, Human
ccgagggggcugcuccca

SEQ ID NO: 3005916 - RNA, 16 nt, Human
ccgagggggcugcucc

SEQ ID NO: 3005917 - RNA, 15 nt, Human
cccuugaugaagaag

SEQ ID NO: 3005918 - RNA, 16 nt, Human
cccuugaugaagaagu

SEQ ID NO: 3005919 - RNA, 17 nt, Human
cccuugccgucuaccug

SEQ ID NO: 3005920 - RNA, 18 nt, Human
cccuugccgucuaccuga

SEQ ID NO: 3005921 - RNA, 22 nt, Human
cccuugccgucuaccugagggg

SEQ ID NO: 3005922 - RNA, 18 nt, Human
cccuuggggagcaggcuc

SEQ ID NO: 3005923 - RNA, 14 nt, Human
cccuugugguccca

SEQ ID NO: 3005924 - RNA, 16 nt, Human
cccuuguggucccacc

SEQ ID NO: 3005925 - RNA, 18 nt, Human
cccuuguggucccacccc

SEQ ID NO: 3005926 - RNA, 20 nt, Human
cccuuugacgccaucccagc

SEQ ID NO: 3005927 - RNA, 16 nt, Human
cccugugucauuucaa

SEQ ID NO: 3005928 - RNA, 18 nt, Human
cccugugggcccccaaau

SEQ ID NO: 3005929 - RNA, 15 nt, Human
cccuguuuguuucug

SEQ ID NO: 3005930 - RNA, 16 nt, Human
cccugugggcccccaa

SEQ ID NO: 3005931 - RNA, 15 nt, Human
cccugugggccccca

SEQ ID NO: 3005932 - RNA, 19 nt, Human
cccugguggcagugggagc

SEQ ID NO: 3005933 - RNA, 16 nt, Human
cccugguggcaguggg

SEQ ID NO: 3005934 - RNA, 15 nt, Human
cccugguggcagugg

SEQ ID NO: 3005935 - RNA, 21 nt, Human
cccugguggcagugggagcug

SEQ ID NO: 3005936 - RNA, 18 nt, Human
ccccucagggucccuggu

SEQ ID NO: 3005937 - RNA, 20 nt, Human
ccccucagggucccuggugg

SEQ ID NO: 3005938 - RNA, 17 nt, Human
ccccucagggucccugg

SEQ ID NO: 3005939 - RNA, 12 nt, Human
ccccacugguga

SEQ ID NO: 3005940 - RNA, 13 nt, Human
ccccacuggugac

SEQ ID NO: 3005941 - RNA, 13 nt, Human
ccccaggaggcca

SEQ ID NO: 3005942 - RNA, 14 nt, Human
ccccaggaggccag

SEQ ID NO: 3005943 - RNA, 15 nt, Human
ccccaggaggccagc

SEQ ID NO: 3005944 - RNA, 21 nt, Human
ccccaggaggccagccuugac

SEQ ID NO: 3005945 - RNA, 22 nt, Human
ccccaggaggccagccuugacc

SEQ ID NO: 3005946 - RNA, 12 nt, Human
cccccagcccca

SEQ ID NO: 3005947 - RNA, 21 nt, Human
cccccgcugucagccauuccu

SEQ ID NO: 3005948 - RNA, 18 nt, Human
ccuccccuccucugcuug

SEQ ID NO: 3005949 - RNA, 17 nt, Human
ccuccccuccucugcuu

SEQ ID NO: 3005950 - RNA, 15 nt, Human
ccucccucccucuuu

SEQ ID NO: 3005951 - RNA, 13 nt, Human
ccucccucccucu

SEQ ID NO: 3005952 - RNA, 16 nt, Human
ccucccucccucuuuc

SEQ ID NO: 3005953 - RNA, 16 nt, Human
ccucccugcaauaaaa

SEQ ID NO: 3005954 - RNA, 12 nt, Human
ccucccugcaau

SEQ ID NO: 3005955 - RNA, 11 nt, Human
ccuccucugcu

SEQ ID NO: 3005956 - RNA, 22 nt, Human
ccuccugugugugcgccuacag

SEQ ID NO: 3005957 - RNA, 15 nt, Human
ccuccugugugugcg

SEQ ID NO: 3005958 - RNA, 13 nt, Human
ccuccugugugug

SEQ ID NO: 3005959 - RNA, 20 nt, Human
ccuccugggauuggcuguga

SEQ ID NO: 3005960 - RNA, 13 nt, Human
ccuccugggcuaa

SEQ ID NO: 3005961 - RNA, 14 nt, Human
ccuccccuccucug

SEQ ID NO: 3005962 - RNA, 15 nt, Human
ccuccccuccucugc

SEQ ID NO: 3005963 - RNA, 15 nt, Human
ccucagucuggcccu

SEQ ID NO: 3005964 - RNA, 19 nt, Human
ccucaggugauccacccac

SEQ ID NO: 3005965 - RNA, 17 nt, Human
ccucaggugauccaccc

SEQ ID NO: 3005966 - RNA, 22 nt, Human
ccucaggugagaagcagaggaa

SEQ ID NO: 3005967 - RNA, 22 nt, Human
ccucaggugauccacccaccuc

SEQ ID NO: 3005968 - RNA, 15 nt, Human
ccucagggucccugg

SEQ ID NO: 3005969 - RNA, 22 nt, Human
ccucagggucccugguggcagc

SEQ ID NO: 3005970 - RNA, 16 nt, Human
ccucaggugagaagca

SEQ ID NO: 3005971 - RNA, 20 nt, Human
ccucagaaaacaaggaugaa

SEQ ID NO: 3005972 - RNA, 14 nt, Human
ccucagcauccugg

SEQ ID NO: 3005973 - RNA, 17 nt, Human
ccucagcauccuggcac

SEQ ID NO: 3005974 - RNA, 16 nt, Human
ccucagcauccuggca

SEQ ID NO: 3005975 - RNA, 14 nt, Human
ccucaggccugggg

SEQ ID NO: 3005976 - RNA, 21 nt, Human
ccucaggccugggggcugggc

SEQ ID NO: 3005977 - RNA, 11 nt, Human
ccucaggccug

SEQ ID NO: 3005978 - RNA, 14 nt, Human
ccucagggucccug

SEQ ID NO: 3005979 - RNA, 20 nt, Human
ccucugcuugccaucccucc

SEQ ID NO: 3005980 - RNA, 17 nt, Human
ccucugcuugccauccc

SEQ ID NO: 3005981 - RNA, 21 nt, Human
ccucugcuugccaucccuccc

SEQ ID NO: 3005982 - RNA, 12 nt, Human
ccucugggacug

SEQ ID NO: 3005983 - RNA, 14 nt, Human
ccucugcacucccc

SEQ ID NO: 3005984 - RNA, 19 nt, Human
ccucugcacuccccugcug

SEQ ID NO: 3005985 - RNA, 20 nt, Human
ccucugcacuccccugcugg

SEQ ID NO: 3005986 - RNA, 21 nt, Human
ccucugcacuccccugcuggg

SEQ ID NO: 3005987 - RNA, 22 nt, Human
ccucugcacuccccugcugggu

SEQ ID NO: 3005988 - RNA, 20 nt, Human
ccucugcacaagcugcaccc

SEQ ID NO: 3005989 - RNA, 17 nt, Human
ccucugcacaagcugca

SEQ ID NO: 3005990 - RNA, 19 nt, Human
ccucugcacaagcugcacc

SEQ ID NO: 3005991 - RNA, 11 nt, Human
ccucugcacaa

SEQ ID NO: 3005992 - RNA, 15 nt, Human
ccucugcacaagcug

SEQ ID NO: 3005993 - RNA, 18 nt, Human
ccucugacacacagcucu

SEQ ID NO: 3005994 - RNA, 17 nt, Human
ccucugacacacagcuc

SEQ ID NO: 3005995 - RNA, 13 nt, Human
ccucuccugggca

SEQ ID NO: 3005996 - RNA, 12 nt, Human
ccucuccugggc

SEQ ID NO: 3005997 - RNA, 11 nt, Human
ccucuccuggg

SEQ ID NO: 3005998 - RNA, 23 nt, Human
ccucugaaaaccaauguucucuc

SEQ ID NO: 3005999 - RNA, 15 nt, Human
ccucugacacacagc

SEQ ID NO: 3006000 - RNA, 16 nt, Human
ccucugacacacagcu

SEQ ID NO: 3006001 - RNA, 12 nt, Human
ccucucccauca

SEQ ID NO: 3006002 - RNA, 23 nt, Human
ccuccugugugugcgccuacagg

SEQ ID NO: 3006003 - RNA, 16 nt, Human
ccugaggcccuucucu

SEQ ID NO: 3006004 - RNA, 17 nt, Human
ccugaggcccuucucuc

SEQ ID NO: 3006005 - RNA, 19 nt, Human
ccugaggcccuucucucca

SEQ ID NO: 3006006 - RNA, 20 nt, Human
ccugaggcccuucucuccag

SEQ ID NO: 3006007 - RNA, 21 nt, Human
ccugaggcccuucucuccagc

SEQ ID NO: 3006008 - RNA, 22 nt, Human
ccugaggcccuucucuccagcc

SEQ ID NO: 3006009 - RNA, 23 nt, Human
ccugaggcccuucucuccagccc

SEQ ID NO: 3006010 - RNA, 17 nt, Human
ccugaggcuccacuugg

SEQ ID NO: 3006011 - RNA, 12 nt, Human
ccugacaacacu

SEQ ID NO: 3006012 - RNA, 14 nt, Human
ccugacaacacuca

SEQ ID NO: 3006013 - RNA, 15 nt, Human
ccugacaacacucau

SEQ ID NO: 3006014 - RNA, 16 nt, Human
ccugacaacacucauu

SEQ ID NO: 3006015 - RNA, 13 nt, Human
ccugaggcccaga

SEQ ID NO: 3006016 - RNA, 14 nt, Human
ccugaggcccagag

SEQ ID NO: 3006017 - RNA, 12 nt, Human
ccugaggcccag

SEQ ID NO: 3006018 - RNA, 20 nt, Human
ccugaggcuccacuuggucu

SEQ ID NO: 3006019 - RNA, 18 nt, Human
ccugaggcuccacuuggu

SEQ ID NO: 3006020 - RNA, 14 nt, Human
ccugaggcccuucu

SEQ ID NO: 3006021 - RNA, 14 nt, Human
ccugaugcuucuuc

SEQ ID NO: 3006022 - RNA, 23 nt, Human
ccugauugugucucuugguccug

SEQ ID NO: 3006023 - RNA, 22 nt, Human
ccugauuuaauaugcaaagucu

SEQ ID NO: 3006024 - RNA, 17 nt, Human
ccugaugcuucuucaga

SEQ ID NO: 3006025 - RNA, 18 nt, Human
ccugaugcuucuucagag

SEQ ID NO: 3006026 - RNA, 23 nt, Human
ccugaaagaggaaugaaguacuc

SEQ ID NO: 3006027 - RNA, 13 nt, Human
ccugaaagaggaa

SEQ ID NO: 3006028 - RNA, 18 nt, Human
ccugaaagaggaaugaag

SEQ ID NO: 3006029 - RNA, 22 nt, Human
ccucuuuggucuacacugugcu

SEQ ID NO: 3006030 - RNA, 17 nt, Human
ccucuuaugggcugggu

SEQ ID NO: 3006031 - RNA, 17 nt, Human
ccugaagucacacagug

SEQ ID NO: 3006032 - RNA, 16 nt, Human
ccugaagucacacagu

SEQ ID NO: 3006033 - RNA, 13 nt, Human
ccugaaggccccg

SEQ ID NO: 3006034 - RNA, 15 nt, Human
ccugaagucacacag

SEQ ID NO: 3006035 - RNA, 20 nt, Human
ccugaacaggauauucucac

SEQ ID NO: 3006036 - RNA, 15 nt, Human
ccucuuaugggcugg

SEQ ID NO: 3006037 - RNA, 16 nt, Human
ccucuuaugggcuggg

SEQ ID NO: 3006038 - RNA, 14 nt, Human
ccucuuaugggcug

SEQ ID NO: 3006039 - RNA, 23 nt, Human
ccucuuagaugcaguucugaaga

SEQ ID NO: 3006040 - RNA, 14 nt, Human
ccucuuagaaaaac

SEQ ID NO: 3006041 - RNA, 14 nt, Human
ccucuguacagagc

SEQ ID NO: 3006042 - RNA, 15 nt, Human
ccucuguacagagcc

SEQ ID NO: 3006043 - RNA, 16 nt, Human
ccucuguacagagccc

SEQ ID NO: 3006044 - RNA, 17 nt, Human
ccucuguacagagccca

SEQ ID NO: 3006045 - RNA, 18 nt, Human
ccucuguacagagcccac

SEQ ID NO: 3006046 - RNA, 23 nt, Human
ccucuguacagagcccacgcccc

SEQ ID NO: 3006047 - RNA, 11 nt, Human
ccuuuggcuuc

SEQ ID NO: 3006048 - RNA, 17 nt, Human
ccuugaaugaugccaug

SEQ ID NO: 3006049 - RNA, 17 nt, Human
ccuugaacuuugaccuc

SEQ ID NO: 3006050 - RNA, 16 nt, Human
ccuugaacuggguacu

SEQ ID NO: 3006051 - RNA, 19 nt, Human
ccuugaaaacacuguucuc

SEQ ID NO: 3006052 - RNA, 21 nt, Human
ccuugaaaacacuguucucug

SEQ ID NO: 3006053 - RNA, 22 nt, Human
ccuugaaaacacuguucucugc

SEQ ID NO: 3006054 - RNA, 14 nt, Human
ccuugaacugggua

SEQ ID NO: 3006055 - RNA, 18 nt, Human
ccuucgcuccugugucuu

SEQ ID NO: 3006056 - RNA, 15 nt, Human
ccuucgcuccugugu

SEQ ID NO: 3006057 - RNA, 14 nt, Human
ccuucgcuccugug

SEQ ID NO: 3006058 - RNA, 13 nt, Human
ccuucgcuccugu

SEQ ID NO: 3006059 - RNA, 15 nt, Human
ccuugaaaacacugu

SEQ ID NO: 3006060 - RNA, 19 nt, Human
ccuugaccauucuccaccu

SEQ ID NO: 3006061 - RNA, 20 nt, Human
ccuugaccauucuccaccug

SEQ ID NO: 3006062 - RNA, 17 nt, Human
ccuugacagggcacacc

SEQ ID NO: 3006063 - RNA, 15 nt, Human
ccuugacagggcaca

SEQ ID NO: 3006064 - RNA, 13 nt, Human
ccuugacagggca

SEQ ID NO: 3006065 - RNA, 14 nt, Human
ccuugacagggcac

SEQ ID NO: 3006066 - RNA, 19 nt, Human
ccuuggauuguccccgacc

SEQ ID NO: 3006067 - RNA, 22 nt, Human
ccuugaguugauucagcucugc

SEQ ID NO: 3006068 - RNA, 23 nt, Human
ccuugaguugauucagcucugca

SEQ ID NO: 3006069 - RNA, 21 nt, Human
ccuugaccauucuccaccugc

SEQ ID NO: 3006070 - RNA, 20 nt, Human
ccuugaguugauucagcucu

SEQ ID NO: 3006071 - RNA, 14 nt, Human
ccuuaccagcagag

SEQ ID NO: 3006072 - RNA, 15 nt, Human
ccuuaccagcagagc

SEQ ID NO: 3006073 - RNA, 16 nt, Human
ccuuaccagcagagca

SEQ ID NO: 3006074 - RNA, 17 nt, Human
ccuuaccagcagagcac

SEQ ID NO: 3006075 - RNA, 19 nt, Human
ccuuacccucauguucuua

SEQ ID NO: 3006076 - RNA, 20 nt, Human
ccuuaccucggugccuuccu

SEQ ID NO: 3006077 - RNA, 14 nt, Human
ccuuaccugccagg

SEQ ID NO: 3006078 - RNA, 21 nt, Human
ccuuagacagucccugccaau

SEQ ID NO: 3006079 - RNA, 18 nt, Human
ccuuagacagucccugcc

SEQ ID NO: 3006080 - RNA, 19 nt, Human
ccuuagacagucccugcca

SEQ ID NO: 3006081 - RNA, 16 nt, Human
ccuuagacagucccug

SEQ ID NO: 3006082 - RNA, 17 nt, Human
ccuuagacagucccugc

SEQ ID NO: 3006083 - RNA, 15 nt, Human
ccuuccagggguggg

SEQ ID NO: 3006084 - RNA, 16 nt, Human
ccuuccagggguggga

SEQ ID NO: 3006085 - RNA, 18 nt, Human
ccuuccaggggugggaca

SEQ ID NO: 3006086 - RNA, 22 nt, Human
ccuuccaggggugggacacccu

SEQ ID NO: 3006087 - RNA, 14 nt, Human
ccuuccucuuucca

SEQ ID NO: 3006088 - RNA, 11 nt, Human
ccuuccugcug

SEQ ID NO: 3006089 - RNA, 20 nt, Human
ccuucagugccuuauggaac

SEQ ID NO: 3006090 - RNA, 15 nt, Human
ccuucagugccuuau

SEQ ID NO: 3006091 - RNA, 19 nt, Human
ccuucagugccuuauggaa

SEQ ID NO: 3006092 - RNA, 13 nt, Human
ccuucagugccuu

SEQ ID NO: 3006093 - RNA, 14 nt, Human
ccuucagugccuua

SEQ ID NO: 3006094 - RNA, 12 nt, Human
ccuucagugccu

SEQ ID NO: 3006095 - RNA, 12 nt, Human
ccuucagccuga

SEQ ID NO: 3006096 - RNA, 20 nt, Human
ccugggcagcugccuccccu

SEQ ID NO: 3006097 - RNA, 13 nt, Human
ccugguggcagcu

SEQ ID NO: 3006098 - RNA, 12 nt, Human
ccugguggcagc

SEQ ID NO: 3006099 - RNA, 14 nt, Human
ccugguggcagcuc

SEQ ID NO: 3006100 - RNA, 16 nt, Human
ccugguggcagcucac

SEQ ID NO: 3006101 - RNA, 17 nt, Human
ccugguggcagcucacc

SEQ ID NO: 3006102 - RNA, 18 nt, Human
ccugguggcagcucaccu

SEQ ID NO: 3006103 - RNA, 12 nt, Human
ccuguaccucuu

SEQ ID NO: 3006104 - RNA, 20 nt, Human
ccuguaauccuagcacuuug

SEQ ID NO: 3006105 - RNA, 20 nt, Human
ccuguaaucccagcacuuug

SEQ ID NO: 3006106 - RNA, 21 nt, Human
ccuguagagugggagcugagu

SEQ ID NO: 3006107 - RNA, 19 nt, Human
ccuguagagugggagcuga

SEQ ID NO: 3006108 - RNA, 23 nt, Human
ccuguagagugggagcugagugg

SEQ ID NO: 3006109 - RNA, 17 nt, Human
ccugugccucugggacu

SEQ ID NO: 3006110 - RNA, 15 nt, Human
ccugugccucuggga

SEQ ID NO: 3006111 - RNA, 19 nt, Human
ccugugccucugggacugg

SEQ ID NO: 3006112 - RNA, 20 nt, Human
ccugugauggggcccugccu

SEQ ID NO: 3006113 - RNA, 21 nt, Human
ccugugauggggcccugccuc

SEQ ID NO: 3006114 - RNA, 22 nt, Human
ccugugauggggcccugccucc

SEQ ID NO: 3006115 - RNA, 18 nt, Human
ccugugauggggcccugc

SEQ ID NO: 3006116 - RNA, 19 nt, Human
ccugugauggggcccugcc

SEQ ID NO: 3006117 - RNA, 17 nt, Human
ccugugauggggcccug

SEQ ID NO: 3006118 - RNA, 20 nt, Human
ccugugaguacuacaguccu

SEQ ID NO: 3006119 - RNA, 17 nt, Human
ccugucccccugacaac

SEQ ID NO: 3006120 - RNA, 16 nt, Human
ccugucccccugacaa

SEQ ID NO: 3006121 - RNA, 18 nt, Human
ccuguccccgcacugggc

SEQ ID NO: 3006122 - RNA, 17 nt, Human
ccugggcaacagagcaa

SEQ ID NO: 3006123 - RNA, 12 nt, Human
ccugggcagaag

SEQ ID NO: 3006124 - RNA, 14 nt, Human
ccugggcagaagga

SEQ ID NO: 3006125 - RNA, 18 nt, Human
ccugggcagcugccuccc

SEQ ID NO: 3006126 - RNA, 17 nt, Human
ccugggcagcugccucc

SEQ ID NO: 3006127 - RNA, 16 nt, Human
ccugggcagcugccuc

SEQ ID NO: 3006128 - RNA, 15 nt, Human
ccugggcagcugccu

SEQ ID NO: 3006129 - RNA, 16 nt, Human
ccugggaucccucauc

SEQ ID NO: 3006130 - RNA, 20 nt, Human
ccugggaucccucauccuca

SEQ ID NO: 3006131 - RNA, 20 nt, Human
ccugggaggucaaggcugca

SEQ ID NO: 3006132 - RNA, 14 nt, Human
ccuggccccucagg

SEQ ID NO: 3006133 - RNA, 17 nt, Human
ccuggcuaacacgguga

SEQ ID NO: 3006134 - RNA, 18 nt, Human
ccuggcucuguggcgagc

SEQ ID NO: 3006135 - RNA, 12 nt, Human
ccuggcucugug

SEQ ID NO: 3006136 - RNA, 18 nt, Human
ccuggcaugggaaugaau

SEQ ID NO: 3006137 - RNA, 20 nt, Human
ccuggcacugcuuccaguga

SEQ ID NO: 3006138 - RNA, 17 nt, Human
ccuggcacugcuuccag

SEQ ID NO: 3006139 - RNA, 23 nt, Human
ccuggacugagggggccuggaug

SEQ ID NO: 3006140 - RNA, 13 nt, Human
ccuggcacuggca

SEQ ID NO: 3006141 - RNA, 21 nt, Human
ccuggcacugcuuccagugag

SEQ ID NO: 3006142 - RNA, 23 nt, Human
ccuggcacuggcaaacagggccu

SEQ ID NO: 3006143 - RNA, 22 nt, Human
ccuggcacuggcaaacagggcc

SEQ ID NO: 3006144 - RNA, 14 nt, Human
ccuggcagccccug

SEQ ID NO: 3006145 - RNA, 16 nt, Human
ccuggcagccccuguu

SEQ ID NO: 3006146 - RNA, 16 nt, Human
ccuggcaugggaauga

SEQ ID NO: 3006147 - RNA, 17 nt, Human
ccuggcaugggaaugaa

SEQ ID NO: 3006148 - RNA, 14 nt, Human
ccuggcaugggaau

SEQ ID NO: 3006149 - RNA, 13 nt, Human
ccuggacccugug

SEQ ID NO: 3006150 - RNA, 14 nt, Human
ccuggacccugugg

SEQ ID NO: 3006151 - RNA, 22 nt, Human
ccuggacugagggggccuggau

SEQ ID NO: 3006152 - RNA, 21 nt, Human
ccuggacugagggggccugga

SEQ ID NO: 3006153 - RNA, 14 nt, Human
ccuggacugagggg

SEQ ID NO: 3006154 - RNA, 13 nt, Human
ccuggacugaggg

SEQ ID NO: 3006155 - RNA, 23 nt, Human
ccugcgucucauacucaccucac

SEQ ID NO: 3006156 - RNA, 19 nt, Human
ccugcaacaccuuguuucc

SEQ ID NO: 3006157 - RNA, 16 nt, Human
ccugcaaccugauugu

SEQ ID NO: 3006158 - RNA, 23 nt, Human
ccugauuuaauaugcaaagucua

SEQ ID NO: 3006159 - RNA, 18 nt, Human
ccugcaacaccuuguuuc

SEQ ID NO: 3006160 - RNA, 13 nt, Human
ccugcuccagcug

SEQ ID NO: 3006161 - RNA, 14 nt, Human
ccugcuccagcugu

SEQ ID NO: 3006162 - RNA, 22 nt, Human
ccugcuccagcuguucagcugg

SEQ ID NO: 3006163 - RNA, 12 nt, Human
ccugcuccagcu

SEQ ID NO: 3006164 - RNA, 21 nt, Human
ccugcuggguguggcgcagca

SEQ ID NO: 3006165 - RNA, 13 nt, Human
ccugcugguucag

SEQ ID NO: 3006166 - RNA, 19 nt, Human
ccugcugguucaggguugg

SEQ ID NO: 3006167 - RNA, 21 nt, Human
cguuucuaaaggcuaccuuug

SEQ ID NO: 3006168 - RNA, 19 nt, Human
cguuucuaaaggcuaccuu

SEQ ID NO: 3006169 - RNA, 20 nt, Human
cguuucuaugacacaugcaa

SEQ ID NO: 3006170 - RNA, 12 nt, Human
cguggcugcuuc

SEQ ID NO: 3006171 - RNA, 14 nt, Human
cguggcugcuucaa

SEQ ID NO: 3006172 - RNA, 15 nt, Human
cguggcugcuucaag

SEQ ID NO: 3006173 - RNA, 17 nt, Human
cguggcugcuucaagga

SEQ ID NO: 3006174 - RNA, 20 nt, Human
cgucaacucauauuuucaug

SEQ ID NO: 3006175 - RNA, 16 nt, Human
cgucaacucauauuuu

SEQ ID NO: 3006176 - RNA, 23 nt, Human
cggugcuaucucccccagcccca

SEQ ID NO: 3006177 - RNA, 16 nt, Human
cgucucuacuaaaaau

SEQ ID NO: 3006178 - RNA, 14 nt, Human
cgucuaccugaggg

SEQ ID NO: 3006179 - RNA, 14 nt, Human
cgucugacaggcaa

SEQ ID NO: 3006180 - RNA, 13 nt, Human
cgucugacaggca

SEQ ID NO: 3006181 - RNA, 11 nt, Human
cguccccuguc

SEQ ID NO: 3006182 - RNA, 14 nt, Human
cguccccugucccc

SEQ ID NO: 3006183 - RNA, 21 nt, Human
cgugcacacaccagagcccac

SEQ ID NO: 3006184 - RNA, 20 nt, Human
cgugcacacaccagagccca

SEQ ID NO: 3006185 - RNA, 19 nt, Human
cgugaacccaggaggcgga

SEQ ID NO: 3006186 - RNA, 17 nt, Human
cgugaacccaggaggcg

SEQ ID NO: 3006187 - RNA, 19 nt, Human
cgugcauaccacuuuuguu

SEQ ID NO: 3006188 - RNA, 18 nt, Human
cgugcauaccacuuuugu

SEQ ID NO: 3006189 - RNA, 14 nt, Human
cgugcauaccacuu

SEQ ID NO: 3006190 - RNA, 22 nt, Human
cgugcacacaccagagcccacc

SEQ ID NO: 3006191 - RNA, 22 nt, Human
cgugcaguggugcgaucugggu

SEQ ID NO: 3006192 - RNA, 20 nt, Human
cgcgugcacacaccagagcc

SEQ ID NO: 3006193 - RNA, 19 nt, Human
cgcgugcacacaccagagc

SEQ ID NO: 3006194 - RNA, 16 nt, Human
cgcgugcacacaccag

SEQ ID NO: 3006195 - RNA, 15 nt, Human
cgcuaagagggaggg

SEQ ID NO: 3006196 - RNA, 16 nt, Human
cgcuaagagggaggga

SEQ ID NO: 3006197 - RNA, 14 nt, Human
cgcuaagagggagg

SEQ ID NO: 3006198 - RNA, 21 nt, Human
cgcuaagagggagggagggcu

SEQ ID NO: 3006199 - RNA, 16 nt, Human
cgcgacaaugcaaacc

SEQ ID NO: 3006200 - RNA, 17 nt, Human
cgcgacaaugcaaacca

SEQ ID NO: 3006201 - RNA, 15 nt, Human
cgcgacaaugcaaac

SEQ ID NO: 3006202 - RNA, 15 nt, Human
cgcccccacugguga

SEQ ID NO: 3006203 - RNA, 13 nt, Human
cgcagacaggacc

SEQ ID NO: 3006204 - RNA, 14 nt, Human
cgcagacaggacca

SEQ ID NO: 3006205 - RNA, 13 nt, Human
ccuuuaagagaaa

SEQ ID NO: 3006206 - RNA, 16 nt, Human
ccuuguggucccaccc

SEQ ID NO: 3006207 - RNA, 19 nt, Human
ccuuguggucccaccccac

SEQ ID NO: 3006208 - RNA, 20 nt, Human
ccuuguggucccaccccaca

SEQ ID NO: 3006209 - RNA, 13 nt, Human
ccuuggcugcagg

SEQ ID NO: 3006210 - RNA, 12 nt, Human
ccuuggcugcag

SEQ ID NO: 3006211 - RNA, 23 nt, Human
ccuuugacgccaucccagcccca

SEQ ID NO: 3006212 - RNA, 16 nt, Human
ccuuugcuugaaagaa

SEQ ID NO: 3006213 - RNA, 12 nt, Human
cgaggacaggga

SEQ ID NO: 3006214 - RNA, 13 nt, Human
cgaggacagggag

SEQ ID NO: 3006215 - RNA, 19 nt, Human
cgaggccuucucugaagga

SEQ ID NO: 3006216 - RNA, 18 nt, Human
cgaggccuucucugaagg

SEQ ID NO: 3006217 - RNA, 20 nt, Human
ccuuuguauucucuccugua

SEQ ID NO: 3006218 - RNA, 18 nt, Human
ccuuuguauucucuccug

SEQ ID NO: 3006219 - RNA, 15 nt, Human
ccuuuguauucucuc

SEQ ID NO: 3006220 - RNA, 19 nt, Human
cgauucuucugcuucagcc

SEQ ID NO: 3006221 - RNA, 13 nt, Human
cgauucuucugcu

SEQ ID NO: 3006222 - RNA, 21 nt, Human
cgauucuucugcuucagccuc

SEQ ID NO: 3006223 - RNA, 19 nt, Human
cgaucuggguucacugcaa

SEQ ID NO: 3006224 - RNA, 11 nt, Human
cgcaaugugac

SEQ ID NO: 3006225 - RNA, 23 nt, Human
cgcacuucgggaggucgaggcag

SEQ ID NO: 3006226 - RNA, 12 nt, Human
cgauuucuguuu

SEQ ID NO: 3006227 - RNA, 17 nt, Human
cggccuccauccugagg

SEQ ID NO: 3006228 - RNA, 16 nt, Human
cggccuccauccugag

SEQ ID NO: 3006229 - RNA, 14 nt, Human
cggccuccauccug

SEQ ID NO: 3006230 - RNA, 13 nt, Human
cggccccaccagu

SEQ ID NO: 3006231 - RNA, 17 nt, Human
cggccccaccagugccu

SEQ ID NO: 3006232 - RNA, 16 nt, Human
cggccccaccagugcc

SEQ ID NO: 3006233 - RNA, 15 nt, Human
cggccccaccagugc

SEQ ID NO: 3006234 - RNA, 20 nt, Human
cggccccaccagugccucuc

SEQ ID NO: 3006235 - RNA, 18 nt, Human
cggccccaccagugccuc

SEQ ID NO: 3006236 - RNA, 21 nt, Human
cggccccaccagugccucucc

SEQ ID NO: 3006237 - RNA, 15 nt, Human
cggcuggccuggccc

SEQ ID NO: 3006238 - RNA, 16 nt, Human
cggcuggccuggcccc

SEQ ID NO: 3006239 - RNA, 14 nt, Human
cggcuggccuggcc

SEQ ID NO: 3006240 - RNA, 18 nt, Human
cggcuggccuggccccuc

SEQ ID NO: 3006241 - RNA, 12 nt, Human
cgggcaugacac

SEQ ID NO: 3006242 - RNA, 15 nt, Human
cgggcaugacacgaa

SEQ ID NO: 3006243 - RNA, 17 nt, Human
cgggaggucgaggcagg

SEQ ID NO: 3006244 - RNA, 16 nt, Human
cgggaggucgaggcag

SEQ ID NO: 3006245 - RNA, 17 nt, Human
cgggaggcugaggcagg

SEQ ID NO: 3006246 - RNA, 16 nt, Human
cgggaggcugaggcag

SEQ ID NO: 3006247 - RNA, 18 nt, Human
cgggaggcugaggcagga

SEQ ID NO: 3006248 - RNA, 20 nt, Human
cgggaggauguucugggaca

SEQ ID NO: 3006249 - RNA, 21 nt, Human
cggaccccacuccggcccucc

SEQ ID NO: 3006250 - RNA, 17 nt, Human
cggaccccacuccggcc

SEQ ID NO: 3006251 - RNA, 21 nt, Human
cggaccuuguagugagccgag

SEQ ID NO: 3006252 - RNA, 18 nt, Human
cggacagccacggccagg

SEQ ID NO: 3006253 - RNA, 16 nt, Human
cggacagccacggcca

SEQ ID NO: 3006254 - RNA, 15 nt, Human
cggacagccacggcc

SEQ ID NO: 3006255 - RNA, 20 nt, Human
cggaaugaaccacaucuugc

SEQ ID NO: 3006256 - RNA, 13 nt, Human
cgcuccugugucu

SEQ ID NO: 3006257 - RNA, 18 nt, Human
ccagaagucaaggcuuag

SEQ ID NO: 3006258 - RNA, 22 nt, Human
ccagaaguuugagaucagccug

SEQ ID NO: 3006259 - RNA, 23 nt, Human
ccagaaguuugagaucagccugg

SEQ ID NO: 3006260 - RNA, 18 nt, Human
ccacugcagaagacagua

SEQ ID NO: 3006261 - RNA, 13 nt, Human
ccacugcagaaga

SEQ ID NO: 3006262 - RNA, 23 nt, Human
ccacugcacuccagccuggguga

SEQ ID NO: 3006263 - RNA, 13 nt, Human
ccacuucagcuga

SEQ ID NO: 3006264 - RNA, 14 nt, Human
ccacuucagcugac

SEQ ID NO: 3006265 - RNA, 20 nt, Human
ccagacaccuugacagggca

SEQ ID NO: 3006266 - RNA, 21 nt, Human
ccagacaccuugacagggcac

SEQ ID NO: 3006267 - RNA, 21 nt, Human
ccagaauuucccaaagcagug

SEQ ID NO: 3006268 - RNA, 18 nt, Human
ccagaauuucccaaagca

SEQ ID NO: 3006269 - RNA, 12 nt, Human
ccagaauuuccc

SEQ ID NO: 3006270 - RNA, 19 nt, Human
ccagaauuucccaaagcag

SEQ ID NO: 3006271 - RNA, 14 nt, Human
ccacuacauucugu

SEQ ID NO: 3006272 - RNA, 15 nt, Human
ccacuacauucuguu

SEQ ID NO: 3006273 - RNA, 11 nt, Human
ccacuacauuc

SEQ ID NO: 3006274 - RNA, 17 nt, Human
ccacuacauucuguuaa

SEQ ID NO: 3006275 - RNA, 16 nt, Human
ccacuacauucuguua

SEQ ID NO: 3006276 - RNA, 13 nt, Human
ccacgcuggagug

SEQ ID NO: 3006277 - RNA, 16 nt, Human
ccacgcuggagugcag

SEQ ID NO: 3006278 - RNA, 15 nt, Human
ccacccccacccaag

SEQ ID NO: 3006279 - RNA, 18 nt, Human
ccacggccaggccagagg

SEQ ID NO: 3006280 - RNA, 16 nt, Human
ccacggccaggccaga

SEQ ID NO: 3006281 - RNA, 19 nt, Human
ccacgcuggagugcaguga

SEQ ID NO: 3006282 - RNA, 18 nt, Human
ccacgcuggagugcagug

SEQ ID NO: 3006283 - RNA, 23 nt, Human
ccacggccaggccagagggagug

SEQ ID NO: 3006284 - RNA, 15 nt, Human
ccaccccacacacgc

SEQ ID NO: 3006285 - RNA, 12 nt, Human
ccaauauccuaa

SEQ ID NO: 3006286 - RNA, 13 nt, Human
ccaauauccuaau

SEQ ID NO: 3006287 - RNA, 14 nt, Human
ccaauauccuaaua

SEQ ID NO: 3006288 - RNA, 15 nt, Human
ccaauauccuaauaa

SEQ ID NO: 3006289 - RNA, 16 nt, Human
ccaauauccuaauaaa

SEQ ID NO: 3006290 - RNA, 17 nt, Human
ccaauauccuaauaaaa

SEQ ID NO: 3006291 - RNA, 18 nt, Human
ccaauauccuaauaaaaa

SEQ ID NO: 3006292 - RNA, 19 nt, Human
ccaauauccuaauaaaaag

SEQ ID NO: 3006293 - RNA, 16 nt, Human
ccaauauucauagcag

SEQ ID NO: 3006294 - RNA, 20 nt, Human
ccacaggaaccacaagacug

SEQ ID NO: 3006295 - RNA, 16 nt, Human
ccacaggaucagucug

SEQ ID NO: 3006296 - RNA, 22 nt, Human
ccacaccauaagcuacugccau

SEQ ID NO: 3006297 - RNA, 21 nt, Human
ccacaccauaagcuacugcca

SEQ ID NO: 3006298 - RNA, 20 nt, Human
ccacaccauaagcuacugcc

SEQ ID NO: 3006299 - RNA, 15 nt, Human
ccacacccagcccac

SEQ ID NO: 3006300 - RNA, 20 nt, Human
ccacacccagcccacuucug

SEQ ID NO: 3006301 - RNA, 22 nt, Human
ccacacccagcccacuucugcc

SEQ ID NO: 3006302 - RNA, 21 nt, Human
ccacacccagcccacuucugc

SEQ ID NO: 3006303 - RNA, 21 nt, Human
ccaccaacauacucccaucug

SEQ ID NO: 3006304 - RNA, 17 nt, Human
ccacaucuugcucugcu

SEQ ID NO: 3006305 - RNA, 18 nt, Human
ccacaucuugcucugcug

SEQ ID NO: 3006306 - RNA, 19 nt, Human
ccacaucuugcucugcuga

SEQ ID NO: 3006307 - RNA, 16 nt, Human
ccacauuccugaugcu

SEQ ID NO: 3006308 - RNA, 16 nt, Human
ccacaugugcacaugc

SEQ ID NO: 3006309 - RNA, 17 nt, Human
ccacccccacccaaggg

SEQ ID NO: 3006310 - RNA, 23 nt, Human
ccacccaggagccccgaggccuu

SEQ ID NO: 3006311 - RNA, 21 nt, Human
ccacccaggagccccgaggcc

SEQ ID NO: 3006312 - RNA, 19 nt, Human
cauuuuagggguagcauuu

SEQ ID NO: 3006313 - RNA, 17 nt, Human
ccaaacucaccugcccc

SEQ ID NO: 3006314 - RNA, 20 nt, Human
cauuugaaaauuuugauguu

SEQ ID NO: 3006315 - RNA, 22 nt, Human
cauuugaaaauuuugauguuuu

SEQ ID NO: 3006316 - RNA, 13 nt, Human
cauuugcuccuuu

SEQ ID NO: 3006317 - RNA, 14 nt, Human
cauuugcuccuuuc

SEQ ID NO: 3006318 - RNA, 18 nt, Human
cauuugcucauggaauug

SEQ ID NO: 3006319 - RNA, 13 nt, Human
cauuugcucaugg

SEQ ID NO: 3006320 - RNA, 22 nt, Human
cauuuguuugaacugauaaaga

SEQ ID NO: 3006321 - RNA, 20 nt, Human
cauuuguuugaacugauaaa

SEQ ID NO: 3006322 - RNA, 17 nt, Human
cauuuguuugaacugau

SEQ ID NO: 3006323 - RNA, 18 nt, Human
cauuugagcagggcucag

SEQ ID NO: 3006324 - RNA, 17 nt, Human
cauuugagcagggcuca

SEQ ID NO: 3006325 - RNA, 20 nt, Human
cauuugagcagggcucagcg

SEQ ID NO: 3006326 - RNA, 16 nt, Human
cauuugagcagggcuc

SEQ ID NO: 3006327 - RNA, 14 nt, Human
cacccaagggccug

SEQ ID NO: 3006328 - RNA, 15 nt, Human
cacccaagggccugg

SEQ ID NO: 3006329 - RNA, 18 nt, Human
cauuguuggccaaagcca

SEQ ID NO: 3006330 - RNA, 17 nt, Human
cauuguuggccaaagcc

SEQ ID NO: 3006331 - RNA, 13 nt, Human
cauuuccuguguc

SEQ ID NO: 3006332 - RNA, 12 nt, Human
cauuuccugugu

SEQ ID NO: 3006333 - RNA, 16 nt, Human
cauuuaaaagauacag

SEQ ID NO: 3006334 - RNA, 15 nt, Human
cauuuaaaagauaca

SEQ ID NO: 3006335 - RNA, 12 nt, Human
cauuuaaaagau

SEQ ID NO: 3006336 - RNA, 17 nt, Human
cauuuaggccaugggac

SEQ ID NO: 3006337 - RNA, 17 nt, Human
ccaagcauuuagaugua

SEQ ID NO: 3006338 - RNA, 22 nt, Human
ccaagcauaccaacacgagcag

SEQ ID NO: 3006339 - RNA, 15 nt, Human
ccaagcucccaggca

SEQ ID NO: 3006340 - RNA, 16 nt, Human
ccaagcucccaggcau

SEQ ID NO: 3006341 - RNA, 22 nt, Human
ccaagcucccaggcauucccca

SEQ ID NO: 3006342 - RNA, 17 nt, Human
ccaaggccaaaggaagc

SEQ ID NO: 3006343 - RNA, 14 nt, Human
ccaagcucccaggc

SEQ ID NO: 3006344 - RNA, 23 nt, Human
ccaagguuuggggaagaacgaag

SEQ ID NO: 3006345 - RNA, 13 nt, Human
ccaaggugggagg

SEQ ID NO: 3006346 - RNA, 20 nt, Human
ccaagucaagugaaaaagga

SEQ ID NO: 3006347 - RNA, 19 nt, Human
ccaagggccuggccugagc

SEQ ID NO: 3006348 - RNA, 16 nt, Human
ccaagggccuggccug

SEQ ID NO: 3006349 - RNA, 18 nt, Human
ccaagggccuggccugag

SEQ ID NO: 3006350 - RNA, 22 nt, Human
ccaaggggaauguuugccucug

SEQ ID NO: 3006351 - RNA, 18 nt, Human
ccaaggccaaaggaagca

SEQ ID NO: 3006352 - RNA, 21 nt, Human
ccaaggccaaaggaagcacau

SEQ ID NO: 3006353 - RNA, 15 nt, Human
ccaagggccuggccu

SEQ ID NO: 3006354 - RNA, 16 nt, Human
ccaagggaauauugcc

SEQ ID NO: 3006355 - RNA, 14 nt, Human
ccaagcaaguauua

SEQ ID NO: 3006356 - RNA, 15 nt, Human
ccaagaagcccagga

SEQ ID NO: 3006357 - RNA, 12 nt, Human
ccaacccucauc

SEQ ID NO: 3006358 - RNA, 19 nt, Human
ccaagaagcccaggaaagg

SEQ ID NO: 3006359 - RNA, 20 nt, Human
ccaagaagcccaggaaaggc

SEQ ID NO: 3006360 - RNA, 17 nt, Human
ccaacauacucccaucu

SEQ ID NO: 3006361 - RNA, 18 nt, Human
ccaacauacucccaucug

SEQ ID NO: 3006362 - RNA, 19 nt, Human
ccaacauacucccaucugu

SEQ ID NO: 3006363 - RNA, 20 nt, Human
ccaacauacucccaucugug

SEQ ID NO: 3006364 - RNA, 16 nt, Human
ccaacauacucccauc

SEQ ID NO: 3006365 - RNA, 21 nt, Human
ccaacauacucccaucuguga

SEQ ID NO: 3006366 - RNA, 22 nt, Human
ccaacauacucccaucugugaa

SEQ ID NO: 3006367 - RNA, 20 nt, Human
ccaaaguacacuguuucaaa

SEQ ID NO: 3006368 - RNA, 23 nt, Human
ccaaauuucauaccuaucaucuu

SEQ ID NO: 3006369 - RNA, 18 nt, Human
ccaaaguacacuguuuca

SEQ ID NO: 3006370 - RNA, 15 nt, Human
ccaaaguacacuguu

SEQ ID NO: 3006371 - RNA, 15 nt, Human
ccaaaggaagcacau

SEQ ID NO: 3006372 - RNA, 23 nt, Human
ccaaaggaagcacaugccucucu

SEQ ID NO: 3006373 - RNA, 15 nt, Human
ccaaagcuaggccug

SEQ ID NO: 3006374 - RNA, 17 nt, Human
ccaaagcuaggccuggc

SEQ ID NO: 3006375 - RNA, 16 nt, Human
ccaaagcuaggccugg

SEQ ID NO: 3006376 - RNA, 21 nt, Human
ccaaagcuaggccuggccaga

SEQ ID NO: 3006377 - RNA, 20 nt, Human
ccaaacucaccugccccuca

SEQ ID NO: 3006378 - RNA, 19 nt, Human
ccaaagcagugcaugcugu

SEQ ID NO: 3006379 - RNA, 22 nt, Human
ccaaacugacucuuaagaagac

SEQ ID NO: 3006380 - RNA, 23 nt, Human
ccaaagcagugcaugcugucccu

SEQ ID NO: 3006381 - RNA, 19 nt, Human
ccaaagccaaagcuaggcc

SEQ ID NO: 3006382 - RNA, 17 nt, Human
ccaaagccuccuccagc

SEQ ID NO: 3006383 - RNA, 22 nt, Human
ccaaagccuccuccagccgcca

SEQ ID NO: 3006384 - RNA, 17 nt, Human
cccaggaguuuggccag

SEQ ID NO: 3006385 - RNA, 18 nt, Human
cccaggaguuuggccaga

SEQ ID NO: 3006386 - RNA, 19 nt, Human
cccaggaguuuggccagaa

SEQ ID NO: 3006387 - RNA, 20 nt, Human
cccaggaguuuggccagaag

SEQ ID NO: 3006388 - RNA, 15 nt, Human
cccaggaguuuggcc

SEQ ID NO: 3006389 - RNA, 16 nt, Human
cccaggaguuuggcca

SEQ ID NO: 3006390 - RNA, 13 nt, Human
cccaggcaggucu

SEQ ID NO: 3006391 - RNA, 11 nt, Human
cccaggcaggu

SEQ ID NO: 3006392 - RNA, 13 nt, Human
cccaggaggccag

SEQ ID NO: 3006393 - RNA, 22 nt, Human
cccaggaggccagccuugacca

SEQ ID NO: 3006394 - RNA, 18 nt, Human
cccaggagccccgaggcc

SEQ ID NO: 3006395 - RNA, 21 nt, Human
cccaggagccccgaggccuuc

SEQ ID NO: 3006396 - RNA, 22 nt, Human
cccaggccccugccacccuggg

SEQ ID NO: 3006397 - RNA, 21 nt, Human
cccaggccccugccacccugg

SEQ ID NO: 3006398 - RNA, 18 nt, Human
cccaggccccugccaccc

SEQ ID NO: 3006399 - RNA, 16 nt, Human
cccaggccccugccac

SEQ ID NO: 3006400 - RNA, 11 nt, Human
cccaggccccu

SEQ ID NO: 3006401 - RNA, 22 nt, Human
cccaggcauuccccaggaggcc

SEQ ID NO: 3006402 - RNA, 23 nt, Human
cccaggcauuccccaggaggcca

SEQ ID NO: 3006403 - RNA, 20 nt, Human
cccaggcauuccccaggagg

SEQ ID NO: 3006404 - RNA, 21 nt, Human
cccaggcauuccccaggaggc

SEQ ID NO: 3006405 - RNA, 18 nt, Human
cccaggcauuccccagga

SEQ ID NO: 3006406 - RNA, 17 nt, Human
cccaggcaggucuugaa

SEQ ID NO: 3006407 - RNA, 22 nt, Human
cccaggugcuaggaacacuccu

SEQ ID NO: 3006408 - RNA, 13 nt, Human
cccaggugccagu

SEQ ID NO: 3006409 - RNA, 23 nt, Human
cccaggugcuaggaacacuccuu

SEQ ID NO: 3006410 - RNA, 13 nt, Human
cccagugcccaca

SEQ ID NO: 3006411 - RNA, 20 nt, Human
cccagucuggaaugcagugg

SEQ ID NO: 3006412 - RNA, 17 nt, Human
cccaggccuccuacagc

SEQ ID NO: 3006413 - RNA, 18 nt, Human
cccaggccuccuacagcu

SEQ ID NO: 3006414 - RNA, 23 nt, Human
cccaaugcacuuuguucuggcuc

SEQ ID NO: 3006415 - RNA, 21 nt, Human
cccacaccauaagcuacugcc

SEQ ID NO: 3006416 - RNA, 17 nt, Human
cccacaccauaagcuac

SEQ ID NO: 3006417 - RNA, 23 nt, Human
cccaaauggaaaugggcagagca

SEQ ID NO: 3006418 - RNA, 17 nt, Human
cccaagggccuggccug

SEQ ID NO: 3006419 - RNA, 18 nt, Human
cccaagggccuggccuga

SEQ ID NO: 3006420 - RNA, 19 nt, Human
cccaagggccuggccugag

SEQ ID NO: 3006421 - RNA, 23 nt, Human
cccaagggccuggccugagcugg

SEQ ID NO: 3006422 - RNA, 18 nt, Human
cccagcaagugagagcug

SEQ ID NO: 3006423 - RNA, 16 nt, Human
cccagcaagugagagc

SEQ ID NO: 3006424 - RNA, 22 nt, Human
cccagauugcaacaggcugggc

SEQ ID NO: 3006425 - RNA, 21 nt, Human
cccagauugcaacaggcuggg

SEQ ID NO: 3006426 - RNA, 20 nt, Human
cccagauugcaacaggcugg

SEQ ID NO: 3006427 - RNA, 20 nt, Human
cccagagggccugcaaggga

SEQ ID NO: 3006428 - RNA, 18 nt, Human
cccagagggccugcaagg

SEQ ID NO: 3006429 - RNA, 19 nt, Human
cccagccuggaugccaucc

SEQ ID NO: 3006430 - RNA, 15 nt, Human
cccagcgagcccugg

SEQ ID NO: 3006431 - RNA, 18 nt, Human
cccagcgagcccuggugg

SEQ ID NO: 3006432 - RNA, 17 nt, Human
cccagcgagcccuggug

SEQ ID NO: 3006433 - RNA, 23 nt, Human
cccagcgagcccugguggcagug

SEQ ID NO: 3006434 - RNA, 19 nt, Human
cccagcgagcccugguggc

SEQ ID NO: 3006435 - RNA, 14 nt, Human
cccagccuggaugc

SEQ ID NO: 3006436 - RNA, 18 nt, Human
cccagccuggaugccauc

SEQ ID NO: 3006437 - RNA, 12 nt, Human
cccagccugcua

SEQ ID NO: 3006438 - RNA, 22 nt, Human
cccagcaagugagagcugggug

SEQ ID NO: 3006439 - RNA, 21 nt, Human
cccagcaagugagagcugggu

SEQ ID NO: 3006440 - RNA, 20 nt, Human
cccagcaagugagagcuggg

SEQ ID NO: 3006441 - RNA, 19 nt, Human
cccagcaagugagagcugg

SEQ ID NO: 3006442 - RNA, 11 nt, Human
cccagccccuu

SEQ ID NO: 3006443 - RNA, 17 nt, Human
ccccaggaggccagccu

SEQ ID NO: 3006444 - RNA, 17 nt, Human
cccaugcugcccuguga

SEQ ID NO: 3006445 - RNA, 18 nt, Human
cccaugcugcccugugag

SEQ ID NO: 3006446 - RNA, 15 nt, Human
cccaugcugcccugu

SEQ ID NO: 3006447 - RNA, 16 nt, Human
cccaugcugcccugug

SEQ ID NO: 3006448 - RNA, 18 nt, Human
cccagugccgagaaggaa

SEQ ID NO: 3006449 - RNA, 17 nt, Human
cccagugccgagaagga

SEQ ID NO: 3006450 - RNA, 20 nt, Human
cccagugcccacaggaucag

SEQ ID NO: 3006451 - RNA, 15 nt, Human
cccagugcccacagg

SEQ ID NO: 3006452 - RNA, 14 nt, Human
ccccacccaagggc

SEQ ID NO: 3006453 - RNA, 20 nt, Human
ccccacccaagggccuggcc

SEQ ID NO: 3006454 - RNA, 18 nt, Human
ccccaccagugccucucc

SEQ ID NO: 3006455 - RNA, 17 nt, Human
ccccaccagugccucuc

SEQ ID NO: 3006456 - RNA, 22 nt, Human
ccccaccagugccucucccugc

SEQ ID NO: 3006457 - RNA, 15 nt, Human
ccccaccagugccuc

SEQ ID NO: 3006458 - RNA, 16 nt, Human
ccccaccagugccucu

SEQ ID NO: 3006459 - RNA, 22 nt, Human
ccccaaauggaaaugggcagag

SEQ ID NO: 3006460 - RNA, 13 nt, Human
cccauucugccug

SEQ ID NO: 3006461 - RNA, 17 nt, Human
ccccaagacucccauga

SEQ ID NO: 3006462 - RNA, 13 nt, Human
ccaggugccaguu

SEQ ID NO: 3006463 - RNA, 17 nt, Human
ccaggugccaguuaugg

SEQ ID NO: 3006464 - RNA, 19 nt, Human
ccaggugcuaggaacacuc

SEQ ID NO: 3006465 - RNA, 14 nt, Human
ccagguucagcuug

SEQ ID NO: 3006466 - RNA, 23 nt, Human
ccaguaaaugggggugcauuuga

SEQ ID NO: 3006467 - RNA, 13 nt, Human
ccaggccccugcc

SEQ ID NO: 3006468 - RNA, 19 nt, Human
ccaggcuggucucaaacuc

SEQ ID NO: 3006469 - RNA, 14 nt, Human
ccaggcuggucuca

SEQ ID NO: 3006470 - RNA, 20 nt, Human
ccaggcuguaucccaugagc

SEQ ID NO: 3006471 - RNA, 16 nt, Human
ccagggcaucugggag

SEQ ID NO: 3006472 - RNA, 15 nt, Human
ccagggcaucuggga

SEQ ID NO: 3006473 - RNA, 15 nt, Human
ccaggagcagccaca

SEQ ID NO: 3006474 - RNA, 16 nt, Human
ccaggagcagccacau

SEQ ID NO: 3006475 - RNA, 15 nt, Human
ccaggagccccgagg

SEQ ID NO: 3006476 - RNA, 13 nt, Human
ccaggcauggugg

SEQ ID NO: 3006477 - RNA, 14 nt, Human
ccaggcauucccca

SEQ ID NO: 3006478 - RNA, 24 nt, Human
ccaggcauuccccaggaggccagc

SEQ ID NO: 3006479 - RNA, 23 nt, Human
ccaggcauuccccaggaggccag

SEQ ID NO: 3006480 - RNA, 22 nt, Human
ccaggcauuccccaggaggcca

SEQ ID NO: 3006481 - RNA, 13 nt, Human
ccaggagccuccu

SEQ ID NO: 3006482 - RNA, 14 nt, Human
ccaggagccuccug

SEQ ID NO: 3006483 - RNA, 18 nt, Human
ccaggagccuccugcccu

SEQ ID NO: 3006484 - RNA, 12 nt, Human
ccaggagccucc

SEQ ID NO: 3006485 - RNA, 12 nt, Human
ccaggaggccag

SEQ ID NO: 3006486 - RNA, 13 nt, Human
ccaggaggccagc

SEQ ID NO: 3006487 - RNA, 20 nt, Human
ccaggaagccagcaggcucu

SEQ ID NO: 3006488 - RNA, 22 nt, Human
ccaggaagccagcaggcucuca

SEQ ID NO: 3006489 - RNA, 14 nt, Human
ccagcucuggucca

SEQ ID NO: 3006490 - RNA, 17 nt, Human
ccagcucugguccauag

SEQ ID NO: 3006491 - RNA, 21 nt, Human
ccagcucugguccauagagag

SEQ ID NO: 3006492 - RNA, 22 nt, Human
ccagcucugguccauagagagc

SEQ ID NO: 3006493 - RNA, 20 nt, Human
ccagcugcugagauccugga

SEQ ID NO: 3006494 - RNA, 21 nt, Human
ccagcugcugagauccuggac

SEQ ID NO: 3006495 - RNA, 23 nt, Human
ccagcugcugagauccuggacug

SEQ ID NO: 3006496 - RNA, 22 nt, Human
ccagcugcugagauccuggacu

SEQ ID NO: 3006497 - RNA, 20 nt, Human
ccagcugcuugggcuucauc

SEQ ID NO: 3006498 - RNA, 23 nt, Human
ccagcugcuugggcuucauccuc

SEQ ID NO: 3006499 - RNA, 19 nt, Human
ccagccuugaccauucucc

SEQ ID NO: 3006500 - RNA, 20 nt, Human
ccagccuugaccauucucca

SEQ ID NO: 3006501 - RNA, 16 nt, Human
ccagagcccaccuugg

SEQ ID NO: 3006502 - RNA, 22 nt, Human
ccagagcccaccuuggcucaag

SEQ ID NO: 3006503 - RNA, 16 nt, Human
ccagcgagcccuggug

SEQ ID NO: 3006504 - RNA, 15 nt, Human
ccagcgagcccuggu

SEQ ID NO: 3006505 - RNA, 22 nt, Human
ccagccuugaccauucuccacc

SEQ ID NO: 3006506 - RNA, 14 nt, Human
ccagcgagcccugg

SEQ ID NO: 3006507 - RNA, 12 nt, Human
ccagcucugguc

SEQ ID NO: 3006508 - RNA, 13 nt, Human
ccagcucuggucc

SEQ ID NO: 3006509 - RNA, 11 nt, Human
ccagcucuggu

SEQ ID NO: 3006510 - RNA, 20 nt, Human
ccauccucuguacagagccc

SEQ ID NO: 3006511 - RNA, 18 nt, Human
ccaucaaggguacacugc

SEQ ID NO: 3006512 - RNA, 13 nt, Human
ccaucaccagaca

SEQ ID NO: 3006513 - RNA, 17 nt, Human
ccagugaggcucugccc

SEQ ID NO: 3006514 - RNA, 20 nt, Human
ccagugaggcucugcccuug

SEQ ID NO: 3006515 - RNA, 18 nt, Human
ccagugaggcucugcccu

SEQ ID NO: 3006516 - RNA, 19 nt, Human
ccagugaggcucugcccuu

SEQ ID NO: 3006517 - RNA, 12 nt, Human
ccauccucugua

SEQ ID NO: 3006518 - RNA, 19 nt, Human
ccauccucuguacagagcc

SEQ ID NO: 3006519 - RNA, 14 nt, Human
ccauccuccuggga

SEQ ID NO: 3006520 - RNA, 22 nt, Human
ccaucauugaaaucuuuuugcu

SEQ ID NO: 3006521 - RNA, 23 nt, Human
ccauccacuggguguaaacacau

SEQ ID NO: 3006522 - RNA, 14 nt, Human
ccaugaagauguag

SEQ ID NO: 3006523 - RNA, 19 nt, Human
ccaugauuaaccacuucag

SEQ ID NO: 3006524 - RNA, 21 nt, Human
ccaugauuaaccacuucagcu

SEQ ID NO: 3006525 - RNA, 18 nt, Human
ccaugauguuuuccauga

SEQ ID NO: 3006526 - RNA, 16 nt, Human
ccaugauguuuagaaa

SEQ ID NO: 3006527 - RNA, 14 nt, Human
ccaugcugcccugu

SEQ ID NO: 3006528 - RNA, 11 nt, Human
ccaugcugccc

SEQ ID NO: 3006529 - RNA, 13 nt, Human
ccaugcugcccug

SEQ ID NO: 3006530 - RNA, 20 nt, Human
cccaaaacucuccucugcug

SEQ ID NO: 3006531 - RNA, 13 nt, Human
cccaaaaggcaga

SEQ ID NO: 3006532 - RNA, 18 nt, Human
cccaaaaggcagaagcaa

SEQ ID NO: 3006533 - RNA, 23 nt, Human
ccauuuuggauucuuauggacaa

SEQ ID NO: 3006534 - RNA, 20 nt, Human
ccauuuugggguacccacug

SEQ ID NO: 3006535 - RNA, 22 nt, Human
ccauuuugggguacccacugcu

SEQ ID NO: 3006536 - RNA, 12 nt, Human
cccaaagaugca

SEQ ID NO: 3006537 - RNA, 15 nt, Human
cccaaagaugcagcc

SEQ ID NO: 3006538 - RNA, 16 nt, Human
cccaaagcagugcaug

SEQ ID NO: 3006539 - RNA, 18 nt, Human
ccauucugccugcccagg

SEQ ID NO: 3006540 - RNA, 17 nt, Human
ccauucugccugcccag

SEQ ID NO: 3006541 - RNA, 17 nt, Human
ccauucuccaccugcca

SEQ ID NO: 3006542 - RNA, 16 nt, Human
ccauucugccugccca

SEQ ID NO: 3006543 - RNA, 20 nt, Human
ccauucugccugcccaggcc

SEQ ID NO: 3006544 - RNA, 19 nt, Human
ccauucugccugcccaggc

SEQ ID NO: 3006545 - RNA, 14 nt, Human
ccauucuccaccug

SEQ ID NO: 3006546 - RNA, 21 nt, Human
ccauucugccugcccaggccc

SEQ ID NO: 3006547 - RNA, 13 nt, Human
ccauggacuuugu

SEQ ID NO: 3006548 - RNA, 14 nt, Human
ccauggacuuuguu

SEQ ID NO: 3006549 - RNA, 15 nt, Human
ccauucuccaccugc

SEQ ID NO: 3006550 - RNA, 16 nt, Human
ccauucuccaccugcc

SEQ ID NO: 3006551 - RNA, 17 nt, Human
ucacgugguccuaaucu

SEQ ID NO: 3006552 - RNA, 22 nt, Human
augacccagugguuccuaaucc

SEQ ID NO: 3006553 - RNA, 13 nt, Human
aaaaauuuacuuu

SEQ ID NO: 3006554 - RNA, 18 nt, Human
aaaaauuuacuuuaaacu

SEQ ID NO: 3006555 - RNA, 19 nt, Human
aaaaauuuacuuuaaacua

SEQ ID NO: 3006556 - RNA, 13 nt, Human
aagaaauuugugg

SEQ ID NO: 3006557 - RNA, 21 nt, Human
aaguccccucuccuccacauu

SEQ ID NO: 3006558 - RNA, 20 nt, Human
aaguccccucuccuccacau

SEQ ID NO: 3006559 - RNA, 14 nt, Human
aaugguaguuuuac

SEQ ID NO: 3006560 - RNA, 20 nt, Human
aaugucaguuguuauuuauu

SEQ ID NO: 3006561 - RNA, 19 nt, Human
aaugucaguuguuauuuau

SEQ ID NO: 3006562 - RNA, 19 nt, Human
aaucacacugucuucugau

SEQ ID NO: 3006563 - RNA, 15 nt, Human
aacugaacuucagag

SEQ ID NO: 3006564 - RNA, 20 nt, Human
aacucaccuggcaucuuaca

SEQ ID NO: 3006565 - RNA, 19 nt, Human
aacuuauggggccaaaaua

SEQ ID NO: 3006566 - RNA, 23 nt, Human
aacugacacaugcugaacaucac

SEQ ID NO: 3006567 - RNA, 16 nt, Human
aacuuuuuauauucuc

SEQ ID NO: 3006568 - RNA, 19 nt, Human
aacaaaggauacuuauuua

SEQ ID NO: 3006569 - RNA, 15 nt, Human
aacaaaggauacuua

SEQ ID NO: 3006570 - RNA, 18 nt, Human
aaagaugaaggucuguuu

SEQ ID NO: 3006571 - RNA, 13 nt, Human
acacaaagcuuuu

SEQ ID NO: 3006572 - RNA, 18 nt, Human
acacuguccuauuauauu

SEQ ID NO: 3006573 - RNA, 13 nt, Human
acauuaaagguac

SEQ ID NO: 3006574 - RNA, 12 nt, Human
acauuaaaugac

SEQ ID NO: 3006575 - RNA, 11 nt, Human
acauuaaauga

SEQ ID NO: 3006576 - RNA, 14 nt, Human
acuguuuagaugaa

SEQ ID NO: 3006577 - RNA, 18 nt, Human
acuuauuuaaauagauga

SEQ ID NO: 3006578 - RNA, 13 nt, Human
acuuauuuaaaua

SEQ ID NO: 3006579 - RNA, 22 nt, Human
acucuauaacaaaggauacuua

SEQ ID NO: 3006580 - RNA, 16 nt, Human
acucuaccugcacacu

SEQ ID NO: 3006581 - RNA, 16 nt, Human
acgugcacgcacacug

SEQ ID NO: 3006582 - RNA, 13 nt, Human
auacuuauuuaaa

SEQ ID NO: 3006583 - RNA, 23 nt, Human
auauccuaauaaaaaggugacca

SEQ ID NO: 3006584 - RNA, 19 nt, Human
auaucccuuggacauuuua

SEQ ID NO: 3006585 - RNA, 20 nt, Human
auauccuaauaaaaagguga

SEQ ID NO: 3006586 - RNA, 11 nt, Human
auaucacuucc

SEQ ID NO: 3006587 - RNA, 17 nt, Human
auauagcaagacauuau

SEQ ID NO: 3006588 - RNA, 22 nt, Human
auacuuauuuaaauagaugaca

SEQ ID NO: 3006589 - RNA, 15 nt, Human
auacuuauuuaaaua

SEQ ID NO: 3006590 - RNA, 21 nt, Human
auacuuauuuaaauagaugac

SEQ ID NO: 3006591 - RNA, 22 nt, Human
auauaauuccuguuuuuauuau

SEQ ID NO: 3006592 - RNA, 16 nt, Human
auauaauuccuguuuu

SEQ ID NO: 3006593 - RNA, 12 nt, Human
agucauuauguu

SEQ ID NO: 3006594 - RNA, 18 nt, Human
agucauuauguuaauauu

SEQ ID NO: 3006595 - RNA, 13 nt, Human
agucauucuuuaa

SEQ ID NO: 3006596 - RNA, 14 nt, Human
agucauucuucccu

SEQ ID NO: 3006597 - RNA, 16 nt, Human
agucaaggcuuagacc

SEQ ID NO: 3006598 - RNA, 14 nt, Human
agucaaggcuuaga

SEQ ID NO: 3006599 - RNA, 23 nt, Human
aucuucuauauaauuccuguuuu

SEQ ID NO: 3006600 - RNA, 18 nt, Human
augacuauucaguggcua

SEQ ID NO: 3006601 - RNA, 18 nt, Human
augacucuucccucaaau

SEQ ID NO: 3006602 - RNA, 17 nt, Human
auuaaaugacucuuccc

SEQ ID NO: 3006603 - RNA, 14 nt, Human
auuaaaugacucuu

SEQ ID NO: 3006604 - RNA, 21 nt, Human
auuaaaugacucuucccucaa

SEQ ID NO: 3006605 - RNA, 16 nt, Human
augcuugcugcugauu

SEQ ID NO: 3006606 - RNA, 22 nt, Human
augcuugcugcugauuuaaaca

SEQ ID NO: 3006607 - RNA, 17 nt, Human
agguacacuugugaaua

SEQ ID NO: 3006608 - RNA, 16 nt, Human
agguacacuugugaau

SEQ ID NO: 3006609 - RNA, 14 nt, Human
agguacacuuguga

SEQ ID NO: 3006610 - RNA, 17 nt, Human
agagguacacuugugaa

SEQ ID NO: 3006611 - RNA, 16 nt, Human
agagguacacuuguga

SEQ ID NO: 3006612 - RNA, 12 nt, Human
agcaugaagaca

SEQ ID NO: 3006613 - RNA, 20 nt, Human
agcagcccucaauugugaaa

SEQ ID NO: 3006614 - RNA, 20 nt, Human
agauguagacaguuggguuu

SEQ ID NO: 3006615 - RNA, 19 nt, Human
agccccacccucagaugca

SEQ ID NO: 3006616 - RNA, 16 nt, Human
cucuccccuucucugu

SEQ ID NO: 3006617 - RNA, 15 nt, Human
cguggugauuuagca

SEQ ID NO: 3006618 - RNA, 22 nt, Human
cguggugauuuagcaggaagcu

SEQ ID NO: 3006619 - RNA, 12 nt, Human
ccuuuuuauaac

SEQ ID NO: 3006620 - RNA, 15 nt, Human
ccuuuuuauaacuuu

SEQ ID NO: 3006621 - RNA, 21 nt, Human
ccuuuuuauaacuuuuuauau

SEQ ID NO: 3006622 - RNA, 16 nt, Human
ccuuuuucaauaacug

SEQ ID NO: 3006623 - RNA, 11 nt, Human
cuaauaaaaag

SEQ ID NO: 3006624 - RNA, 13 nt, Human
cuaauaaaaaggu

SEQ ID NO: 3006625 - RNA, 14 nt, Human
cuaauaaaaaggug

SEQ ID NO: 3006626 - RNA, 15 nt, Human
cuaauaaaaagguga

SEQ ID NO: 3006627 - RNA, 20 nt, Human
cgugugugugcguccugucg

SEQ ID NO: 3006628 - RNA, 12 nt, Human
cucaauugugaa

SEQ ID NO: 3006629 - RNA, 13 nt, Human
cucaauugugaaa

SEQ ID NO: 3006630 - RNA, 17 nt, Human
cucaauaaacauuucau

SEQ ID NO: 3006631 - RNA, 21 nt, Human
cucaauaaacauuucauuucc

SEQ ID NO: 3006632 - RNA, 21 nt, Human
cucaaacuaacaggcuuagug

SEQ ID NO: 3006633 - RNA, 15 nt, Human
cuauuuuuguuuuua

SEQ ID NO: 3006634 - RNA, 21 nt, Human
cuauuuuuguuuuuauuaaaa

SEQ ID NO: 3006635 - RNA, 21 nt, Human
cuauuaaacaugcuguacaua

SEQ ID NO: 3006636 - RNA, 22 nt, Human
ccugucggagcccugucuccuc

SEQ ID NO: 3006637 - RNA, 16 nt, Human
ccugucggagcccugu

SEQ ID NO: 3006638 - RNA, 21 nt, Human
ccugucggagcccugucuccu

SEQ ID NO: 3006639 - RNA, 17 nt, Human
ccugucggagcccuguc

SEQ ID NO: 3006640 - RNA, 19 nt, Human
cccugucuccucucucugu

SEQ ID NO: 3006641 - RNA, 21 nt, Human
ccucauuuuuauaaugucccu

SEQ ID NO: 3006642 - RNA, 21 nt, Human
ccucaugcugccaauauccua

SEQ ID NO: 3006643 - RNA, 20 nt, Human
ccucaugcugccaauauccu

SEQ ID NO: 3006644 - RNA, 20 nt, Human
ccaggauuauugucaaagaa

SEQ ID NO: 3006645 - RNA, 21 nt, Human
ccaauauuuaaucuuuuauga

SEQ ID NO: 3006646 - RNA, 14 nt, Human
cauauggauaaaua

SEQ ID NO: 3006647 - RNA, 18 nt, Human
caucuguuacacaaagaa

SEQ ID NO: 3006648 - RNA, 15 nt, Human
cauuaguuuugaaga

SEQ ID NO: 3006649 - RNA, 14 nt, Human
cauuaguuuugaag

SEQ ID NO: 3006650 - RNA, 13 nt, Human
cauuaguuuugaa

SEQ ID NO: 3006651 - RNA, 17 nt, Human
cauuauauagcaguaaa

SEQ ID NO: 3006652 - RNA, 16 nt, Human
cauuaguuuugaagau

SEQ ID NO: 3006653 - RNA, 20 nt, Human
cauuauauagcaguaaaaaa

SEQ ID NO: 3006654 - RNA, 17 nt, Human
auuuaaucuuuuaugau

SEQ ID NO: 3006655 - RNA, 14 nt, Human
auuuaaucuuuuau

SEQ ID NO: 3006656 - RNA, 23 nt, Human
auuucaagaaguccccucuccuc

SEQ ID NO: 3006657 - RNA, 12 nt, Human
auuucaagaagu

SEQ ID NO: 3006658 - RNA, 15 nt, Human
auuucucauguugaa

SEQ ID NO: 3006659 - RNA, 19 nt, Human
auucugagaugacuauuca

SEQ ID NO: 3006660 - RNA, 20 nt, Human
caagaaguccccucuccucc

SEQ ID NO: 3006661 - RNA, 11 nt, Human
cacuugugaau

SEQ ID NO: 3006662 - RNA, 12 nt, Human
cacuugugaaua

SEQ ID NO: 3006663 - RNA, 22 nt, Human
caccuugcagcucuccccuucu

SEQ ID NO: 3006664 - RNA, 15 nt, Human
caccuugcagcucuc

SEQ ID NO: 3006665 - RNA, 13 nt, Human
caccuugcagcuc

SEQ ID NO: 3006666 - RNA, 19 nt, Human
caauaaacauuucauuucc

SEQ ID NO: 3006667 - RNA, 15 nt, Human
ggcuaacuuggguua

SEQ ID NO: 3006668 - RNA, 19 nt, Human
ggaguuauugaagcagagu

SEQ ID NO: 3006669 - RNA, 23 nt, Human
ggauugugccuaauguguuugag

SEQ ID NO: 3006670 - RNA, 14 nt, Human
ggcacaucauuuca

SEQ ID NO: 3006671 - RNA, 15 nt, Human
ggcacaucauuucaa

SEQ ID NO: 3006672 - RNA, 21 nt, Human
aaagggguaggguuuaaagau

SEQ ID NO: 3006673 - RNA, 13 nt, Human
guaauaaacucau

SEQ ID NO: 3006674 - RNA, 17 nt, Human
aaauaauuagguauuuu

SEQ ID NO: 3006675 - RNA, 17 nt, Human
guaacauagcugugauu

SEQ ID NO: 3006676 - RNA, 21 nt, Human
aaauauugguugggaugacuu

SEQ ID NO: 3006677 - RNA, 23 nt, Human
aaauaucccuuggacauuuuaug

SEQ ID NO: 3006678 - RNA, 22 nt, Human
aaauaucccuuggacauuuuau

SEQ ID NO: 3006679 - RNA, 16 nt, Human
gguauagauguugcua

SEQ ID NO: 3006680 - RNA, 15 nt, Human
aaacauuucauuucc

SEQ ID NO: 3006681 - RNA, 16 nt, Human
gggguaaggugcaucu

SEQ ID NO: 3006682 - RNA, 20 nt, Human
aaaaugguguuuuaucuucu

SEQ ID NO: 3006683 - RNA, 21 nt, Human
aaaaggaagcuuacaugccua

SEQ ID NO: 3006684 - RNA, 19 nt, Human
aaaauaauuagguauuuuc

SEQ ID NO: 3006685 - RNA, 18 nt, Human
gcccaggaguuuggccag

SEQ ID NO: 3006686 - RNA, 20 nt, Human
gcccaggaguuuggccagaa

SEQ ID NO: 3006687 - RNA, 19 nt, Human
gcccaggaguuuggccaga

SEQ ID NO: 3006688 - RNA, 13 nt, Human
gcuuuugcauauu

SEQ ID NO: 3006689 - RNA, 17 nt, Human
ggaaaggaaugcaaaga

SEQ ID NO: 3006690 - RNA, 13 nt, Human
ggaaaggaaugca

SEQ ID NO: 3006691 - RNA, 20 nt, Human
ggaaugauauaagguuuuuu

SEQ ID NO: 3006692 - RNA, 14 nt, Human
gcagucuucaguuu

SEQ ID NO: 3006693 - RNA, 15 nt, Human
gcagcucuccccuuc

SEQ ID NO: 3006694 - RNA, 17 nt, Human
gagccccacccucagau

SEQ ID NO: 3006695 - RNA, 16 nt, Human
gagccccacccucaga

SEQ ID NO: 3006696 - RNA, 17 nt, Human
gaauguuuucaaauguu

SEQ ID NO: 3006697 - RNA, 17 nt, Human
gacccucaugcugccaa

SEQ ID NO: 3006698 - RNA, 16 nt, Human
gacccucaugcugcca

SEQ ID NO: 3006699 - RNA, 14 nt, Human
gacccucaugcugc

SEQ ID NO: 3006700 - RNA, 12 nt, Human
gacccucaugcu

SEQ ID NO: 3006701 - RNA, 23 nt, Human
gacccucaugcugccaauauccu

SEQ ID NO: 3006702 - RNA, 22 nt, Human
gacccucaugcugccaauaucc

SEQ ID NO: 3006703 - RNA, 21 nt, Human
gacccucaugcugccaauauc

SEQ ID NO: 3006704 - RNA, 18 nt, Human
gacccucaugcugccaau

SEQ ID NO: 3006705 - RNA, 20 nt, Human
gacauuuuaugucuuucuug

SEQ ID NO: 3006706 - RNA, 16 nt, Human
gacauuuuaugucuuu

SEQ ID NO: 3006707 - RNA, 19 nt, Human
gacacuucacgcccuuggc

SEQ ID NO: 3006708 - RNA, 23 nt, Human
cugucggagcccugucuccucuc

SEQ ID NO: 3006709 - RNA, 22 nt, Human
cuggaguuauugaagcagagug

SEQ ID NO: 3006710 - RNA, 21 nt, Human
cuggaguuauugaagcagagu

SEQ ID NO: 3006711 - RNA, 23 nt, Human
cuggaguuauugaagcagagugg

SEQ ID NO: 3006712 - RNA, 24 nt, Human
cuggaguuauugaagcagaguggc

SEQ ID NO: 3006713 - RNA, 15 nt, Human
cuuggcccaggaguu

SEQ ID NO: 3006714 - RNA, 14 nt, Human
cuuggcccaggagu

SEQ ID NO: 3006715 - RNA, 23 nt, Human
cuuggcccaggaguuuggccaga

SEQ ID NO: 3006716 - RNA, 22 nt, Human
cuuggcccaggaguuuggccag

SEQ ID NO: 3006717 - RNA, 20 nt, Human
cuuggcccaggaguuuggcc

SEQ ID NO: 3006718 - RNA, 16 nt, Human
cuuggcccaggaguuu

SEQ ID NO: 3006719 - RNA, 15 nt, Human
cuuuaagaacuaaaa

SEQ ID NO: 3006720 - RNA, 14 nt, Human
cuucuauauaauuc

SEQ ID NO: 3006721 - RNA, 16 nt, Human
cuucuauuuauuuauu

SEQ ID NO: 3006722 - RNA, 22 nt, Human
cuucucuguauuccuagaaacu

SEQ ID NO: 3006723 - RNA, 13 nt, Human
aagguagaauguu

SEQ ID NO: 3006724 - RNA, 14 nt, Human
aagguagaauguuu

SEQ ID NO: 3006725 - RNA, 15 nt, Human
uaaaaaggugaccau

SEQ ID NO: 3006726 - RNA, 13 nt, Human
uaaaaaggugacc

SEQ ID NO: 3006727 - RNA, 17 nt, Human
aagagggugggugggua

SEQ ID NO: 3006728 - RNA, 16 nt, Human
guuauuuuacuuuuug

SEQ ID NO: 3006729 - RNA, 15 nt, Human
guuauuuuacuuuuu

SEQ ID NO: 3006730 - RNA, 13 nt, Human
aagcuuuugcaua

SEQ ID NO: 3006731 - RNA, 22 nt, Human
aagcuuuugcauauugcauacu

SEQ ID NO: 3006732 - RNA, 15 nt, Human
aagcuuuugcauauu

SEQ ID NO: 3006733 - RNA, 19 nt, Human
aagcuuuugcauauugcau

SEQ ID NO: 3006734 - RNA, 15 nt, Human
aacauagcugugauu

SEQ ID NO: 3006735 - RNA, 16 nt, Human
aacacugguuuuaaau

SEQ ID NO: 3006736 - RNA, 12 nt, Human
aacacaaagcuu

SEQ ID NO: 3006737 - RNA, 18 nt, Human
aacacaaagcuuuugcau

SEQ ID NO: 3006738 - RNA, 19 nt, Human
aacacaaagcuuuugcaua

SEQ ID NO: 3006739 - RNA, 20 nt, Human
aacacaaagcuuuugcauau

SEQ ID NO: 3006740 - RNA, 15 nt, Human
aacuaaaauguucua

SEQ ID NO: 3006741 - RNA, 17 nt, Human
gugcacaucuguuuugu

SEQ ID NO: 3006742 - RNA, 14 nt, Human
aacuucagaguucu

SEQ ID NO: 3006743 - RNA, 17 nt, Human
acaaaggggcuuaauua

SEQ ID NO: 3006744 - RNA, 24 nt, Human
acaaaggauacuuauuuaaauaga

SEQ ID NO: 3006745 - RNA, 18 nt, Human
uagaugacauugacuauu

SEQ ID NO: 3006746 - RNA, 19 nt, Human
uagaugacauugacuauuu

SEQ ID NO: 3006747 - RNA, 18 nt, Human
uagcauguccuaaugcuu

SEQ ID NO: 3006748 - RNA, 20 nt, Human
uaggagaagucuucuauuua

SEQ ID NO: 3006749 - RNA, 12 nt, Human
uaggagcaugag

SEQ ID NO: 3006750 - RNA, 20 nt, Human
uauaacuuuuuauauucuca

SEQ ID NO: 3006751 - RNA, 12 nt, Human
uauaacuuuuua

SEQ ID NO: 3006752 - RNA, 17 nt, Human
uauaacuuuuuauauuc

SEQ ID NO: 3006753 - RNA, 17 nt, Human
uaucccuuggacauuuu

SEQ ID NO: 3006754 - RNA, 19 nt, Human
uaucccuuggacauuuuau

SEQ ID NO: 3006755 - RNA, 18 nt, Human
uaucccuuggacauuuua

SEQ ID NO: 3006756 - RNA, 12 nt, Human
uauccuaauaaa

SEQ ID NO: 3006757 - RNA, 18 nt, Human
uauccuaauaaaaaggug

SEQ ID NO: 3006758 - RNA, 15 nt, Human
uauccuaauaaaaag

SEQ ID NO: 3006759 - RNA, 19 nt, Human
uauccuaauaaaaagguga

SEQ ID NO: 3006760 - RNA, 22 nt, Human
uauccuaauaaaaaggugacca

SEQ ID NO: 3006761 - RNA, 18 nt, Human
acagauugaauuugccua

SEQ ID NO: 3006762 - RNA, 12 nt, Human
acagauugaauu

SEQ ID NO: 3006763 - RNA, 19 nt, Human
acaggcuuagugauguaau

SEQ ID NO: 3006764 - RNA, 20 nt, Human
acaggcuuagugauguaauu

SEQ ID NO: 3006765 - RNA, 14 nt, Human
acaggcuuagugau

SEQ ID NO: 3006766 - RNA, 18 nt, Human
uauucaguggcuaacuug

SEQ ID NO: 3006767 - RNA, 23 nt, Human
uauguuuuuguucaguuuaucug

SEQ ID NO: 3006768 - RNA, 20 nt, Human
uacucugccacuuuauuucu

SEQ ID NO: 3006769 - RNA, 17 nt, Human
aauuauugauguuuuca

SEQ ID NO: 3006770 - RNA, 21 nt, Human
aauuaaugucaguauuucaac

SEQ ID NO: 3006771 - RNA, 13 nt, Human
aauauuuaaucuu

SEQ ID NO: 3006772 - RNA, 17 nt, Human
uaaugucaguauuucaa

SEQ ID NO: 3006773 - RNA, 11 nt, Human
uaaucuuuuau

SEQ ID NO: 3006774 - RNA, 12 nt, Human
uaauaaacucau

SEQ ID NO: 3006775 - RNA, 23 nt, Human
aaucgcuccaccuugcagcucuc

SEQ ID NO: 3006776 - RNA, 19 nt, Human
aaucuggauucauauuuaa

SEQ ID NO: 3006777 - RNA, 18 nt, Human
aaucuggauucauauuua

SEQ ID NO: 3006778 - RNA, 17 nt, Human
aaucuggauucauauuu

SEQ ID NO: 3006779 - RNA, 16 nt, Human
aaucuggauucauauu

SEQ ID NO: 3006780 - RNA, 12 nt, Human
ucaauugugaaa

SEQ ID NO: 3006781 - RNA, 16 nt, Human
ucacacugucuucuga

SEQ ID NO: 3006782 - RNA, 20 nt, Human
acaugcuguacauacuuuuu

SEQ ID NO: 3006783 - RNA, 21 nt, Human
acaugcuguacauacuuuuug

SEQ ID NO: 3006784 - RNA, 19 nt, Human
acaugcuguacauacuuuu

SEQ ID NO: 3006785 - RNA, 17 nt, Human
ucaacauuucucauguu

SEQ ID NO: 3006786 - RNA, 11 nt, Human
acauucccugc

SEQ ID NO: 3006787 - RNA, 17 nt, Human
acauugacuauuuuugu

SEQ ID NO: 3006788 - RNA, 14 nt, Human
acauugacuauuuu

SEQ ID NO: 3006789 - RNA, 19 nt, Human
ucaaucuggauucauauuu

SEQ ID NO: 3006790 - RNA, 15 nt, Human
ucauauggauaaaua

SEQ ID NO: 3006791 - RNA, 14 nt, Human
acccucucaaacua

SEQ ID NO: 3006792 - RNA, 15 nt, Human
accccaucaucccuu

SEQ ID NO: 3006793 - RNA, 14 nt, Human
ucagcccucagaau

SEQ ID NO: 3006794 - RNA, 16 nt, Human
acucugccacuuuauu

SEQ ID NO: 3006795 - RNA, 17 nt, Human
acucugccacuuuauuu

SEQ ID NO: 3006796 - RNA, 22 nt, Human
acucugagugcaaacuucagag

SEQ ID NO: 3006797 - RNA, 21 nt, Human
acugaacaguaacauagcugu

SEQ ID NO: 3006798 - RNA, 15 nt, Human
acugaacaguaacau

SEQ ID NO: 3006799 - RNA, 23 nt, Human
uccagucauuauguuaauauuuc

SEQ ID NO: 3006800 - RNA, 21 nt, Human
uccagucauuauguuaauauu

SEQ ID NO: 3006801 - RNA, 15 nt, Human
uccagucauuauguu

SEQ ID NO: 3006802 - RNA, 14 nt, Human
uccagucauuaugu

SEQ ID NO: 3006803 - RNA, 22 nt, Human
acuuuuuauauucucagcagag

SEQ ID NO: 3006804 - RNA, 12 nt, Human
acuuuuuauauu

SEQ ID NO: 3006805 - RNA, 15 nt, Human
acuuuuuauauucuc

SEQ ID NO: 3006806 - RNA, 16 nt, Human
acuuuuuauauucuca

SEQ ID NO: 3006807 - RNA, 22 nt, Human
acuuugguuauuuuacuuuuug

SEQ ID NO: 3006808 - RNA, 23 nt, Human
acuuugguuauuuuacuuuuugg

SEQ ID NO: 3006809 - RNA, 10 nt, Human
acuuugguua

SEQ ID NO: 3006810 - RNA, 13 nt, Human
acuuugguuauuu

SEQ ID NO: 3006811 - RNA, 21 nt, Human
acuuugguuauuuuacuuuuu

SEQ ID NO: 3006812 - RNA, 15 nt, Human
acuugugaauaaaga

SEQ ID NO: 3006813 - RNA, 12 nt, Human
ucucagcagagu

SEQ ID NO: 3006814 - RNA, 13 nt, Human
ucucagcagagug

SEQ ID NO: 3006815 - RNA, 14 nt, Human
ucucagcagagugc

SEQ ID NO: 3006816 - RNA, 14 nt, Human
ucuauuuauuuauu

SEQ ID NO: 3006817 - RNA, 13 nt, Human
ucuauuuauuuau

SEQ ID NO: 3006818 - RNA, 16 nt, Human
ucuauguuaauauuuu

SEQ ID NO: 3006819 - RNA, 14 nt, Human
ucuauguuaauauu

SEQ ID NO: 3006820 - RNA, 22 nt, Human
ucuauaacaaaggauacuuauu

SEQ ID NO: 3006821 - RNA, 23 nt, Human
ucuauaacaaaggauacuuauuu

SEQ ID NO: 3006822 - RNA, 21 nt, Human
agaauguuuucaaauguucuc

SEQ ID NO: 3006823 - RNA, 15 nt, Human
agaauguuuucaaau

SEQ ID NO: 3006824 - RNA, 24 nt, Human
agacagagccccacccucagaugc

SEQ ID NO: 3006825 - RNA, 22 nt, Human
agacagagccccacccucagau

SEQ ID NO: 3006826 - RNA, 16 nt, Human
agaauugauugggcac

SEQ ID NO: 3006827 - RNA, 22 nt, Human
agaauugauugggcacaucauu

SEQ ID NO: 3006828 - RNA, 23 nt, Human
agaauugauugggcacaucauuu

SEQ ID NO: 3006829 - RNA, 24 nt, Human
agaauugauugggcacaucauuuc

SEQ ID NO: 3006830 - RNA, 22 nt, Human
ucugagugcaaacuucagaguu

SEQ ID NO: 3006831 - RNA, 23 nt, Human
ucugagugcaaacuucagaguuc

SEQ ID NO: 3006832 - RNA, 14 nt, Human
ucugagugcaaacu

SEQ ID NO: 3006833 - RNA, 18 nt, Human
ugacuauuuuuguuuuua

SEQ ID NO: 3006834 - RNA, 22 nt, Human
ugacuauuuuuguuuuuauuaa

SEQ ID NO: 3006835 - RNA, 11 nt, Human
ugacuguuuuu

SEQ ID NO: 3006836 - RNA, 16 nt, Human
ugacuauaaccuuguu

SEQ ID NO: 3006837 - RNA, 19 nt, Human
ugacuauucugagaugacu

SEQ ID NO: 3006838 - RNA, 21 nt, Human
ugacuauucugagaugacuau

SEQ ID NO: 3006839 - RNA, 22 nt, Human
ugacuauucugagaugacuauu

SEQ ID NO: 3006840 - RNA, 13 nt, Human
ugacauucccugc

SEQ ID NO: 3006841 - RNA, 20 nt, Human
ugaaugcccagugagacugu

SEQ ID NO: 3006842 - RNA, 14 nt, Human
ugacagauugaauu

SEQ ID NO: 3006843 - RNA, 13 nt, Human
agaugcacaugag

SEQ ID NO: 3006844 - RNA, 16 nt, Human
agaugcacaugagcug

SEQ ID NO: 3006845 - RNA, 23 nt, Human
ugagagcaguuugguuucuagca

SEQ ID NO: 3006846 - RNA, 21 nt, Human
ugagagcaguuugguuucuag

SEQ ID NO: 3006847 - RNA, 17 nt, Human
agacuuugguuauuuua

SEQ ID NO: 3006848 - RNA, 23 nt, Human
agacuuugguuauuuuacuuuuu

SEQ ID NO: 3006849 - RNA, 19 nt, Human
ugaaguaaaauguggcagg

SEQ ID NO: 3006850 - RNA, 18 nt, Human
ugaaguaaaauguggcag

SEQ ID NO: 3006851 - RNA, 17 nt, Human
uguagacaguuggguuu

SEQ ID NO: 3006852 - RNA, 12 nt, Human
agguugugaaug

SEQ ID NO: 3006853 - RNA, 15 nt, Human
ugguuuguucccugu

SEQ ID NO: 3006854 - RNA, 15 nt, Human
ugguuucuagcauga

SEQ ID NO: 3006855 - RNA, 16 nt, Human
ugguuauuuuacuuuu

SEQ ID NO: 3006856 - RNA, 15 nt, Human
ugguuauuuuacuuu

SEQ ID NO: 3006857 - RNA, 18 nt, Human
ugguuauuuuacuuuuug

SEQ ID NO: 3006858 - RNA, 21 nt, Human
aggggcuuaauuauugauguu

SEQ ID NO: 3006859 - RNA, 14 nt, Human
aggguuuaaagaug

SEQ ID NO: 3006860 - RNA, 14 nt, Human
agucuucuauuuau

SEQ ID NO: 3006861 - RNA, 19 nt, Human
ugugauuuuugguauuuga

SEQ ID NO: 3006862 - RNA, 21 nt, Human
ugugauuuuugguauuugaaa

SEQ ID NO: 3006863 - RNA, 20 nt, Human
ugugauuuuugguauuugaa

SEQ ID NO: 3006864 - RNA, 15 nt, Human
ugucuccucucucug

SEQ ID NO: 3006865 - RNA, 22 nt, Human
aguccccucuccuccacauuug

SEQ ID NO: 3006866 - RNA, 20 nt, Human
ugucaaccccaaguuaguuc

SEQ ID NO: 3006867 - RNA, 21 nt, Human
aguccccucuccuccacauuu

SEQ ID NO: 3006868 - RNA, 16 nt, Human
aguccccucuccucca

SEQ ID NO: 3006869 - RNA, 18 nt, Human
uuagcaggaagcugugag

SEQ ID NO: 3006870 - RNA, 16 nt, Human
auaacuggaacacucu

SEQ ID NO: 3006871 - RNA, 18 nt, Human
auaacuggaacacucuau

SEQ ID NO: 3006872 - RNA, 21 nt, Human
auaacuggaacacucuauaac

SEQ ID NO: 3006873 - RNA, 23 nt, Human
auaacuggaacacucuauaacaa

SEQ ID NO: 3006874 - RNA, 15 nt, Human
auaaacucauuucua

SEQ ID NO: 3006875 - RNA, 21 nt, Human
uuagccguggugauuuagcag

SEQ ID NO: 3006876 - RNA, 14 nt, Human
uuauaacuuuuuau

SEQ ID NO: 3006877 - RNA, 16 nt, Human
uuauaacuuuuuauau

SEQ ID NO: 3006878 - RNA, 19 nt, Human
uuauauagcaagacauuau

SEQ ID NO: 3006879 - RNA, 13 nt, Human
uuauauagcaaga

SEQ ID NO: 3006880 - RNA, 15 nt, Human
uuaucagaacuaugu

SEQ ID NO: 3006881 - RNA, 20 nt, Human
auacuauuaaacaugcugua

SEQ ID NO: 3006882 - RNA, 19 nt, Human
aguuauugaagcagagugg

SEQ ID NO: 3006883 - RNA, 23 nt, Human
aguuauugaagcagaguggcagu

SEQ ID NO: 3006884 - RNA, 16 nt, Human
aguuauugaagcagag

SEQ ID NO: 3006885 - RNA, 17 nt, Human
aguuauugaagcagagu

SEQ ID NO: 3006886 - RNA, 18 nt, Human
aguuauugaagcagagug

SEQ ID NO: 3006887 - RNA, 14 nt, Human
aguuauugaagcag

SEQ ID NO: 3006888 - RNA, 23 nt, Human
aguggcagucuucaguuugcaga

SEQ ID NO: 3006889 - RNA, 22 nt, Human
aguucuugccuuggcugcaguu

SEQ ID NO: 3006890 - RNA, 14 nt, Human
uguuuuaggagcau

SEQ ID NO: 3006891 - RNA, 17 nt, Human
uguuuuauauagcaaga

SEQ ID NO: 3006892 - RNA, 14 nt, Human
uguuuucaaauguu

SEQ ID NO: 3006893 - RNA, 13 nt, Human
uguuuucaaaugu

SEQ ID NO: 3006894 - RNA, 12 nt, Human
aguuuggccaga

SEQ ID NO: 3006895 - RNA, 16 nt, Human
aguuugguuucuagca

SEQ ID NO: 3006896 - RNA, 14 nt, Human
aguuuggccagaag

SEQ ID NO: 3006897 - RNA, 13 nt, Human
aguuuggccagaa

SEQ ID NO: 3006898 - RNA, 17 nt, Human
ugccagccacugugaua

SEQ ID NO: 3006899 - RNA, 20 nt, Human
ugcagcucuccccuucucug

SEQ ID NO: 3006900 - RNA, 22 nt, Human
ugcagcucuccccuucucugua

SEQ ID NO: 3006901 - RNA, 18 nt, Human
agcccugucuccucucuc

SEQ ID NO: 3006902 - RNA, 11 nt, Human
agcccugucuc

SEQ ID NO: 3006903 - RNA, 17 nt, Human
ugauuuagcaggaagcu

SEQ ID NO: 3006904 - RNA, 20 nt, Human
ugauuuagcaggaagcugug

SEQ ID NO: 3006905 - RNA, 18 nt, Human
ugaugacauucccugcua

SEQ ID NO: 3006906 - RNA, 15 nt, Human
ugaugacauucccug

SEQ ID NO: 3006907 - RNA, 13 nt, Human
ugaugacuguuuu

SEQ ID NO: 3006908 - RNA, 14 nt, Human
aggaguuuggccag

SEQ ID NO: 3006909 - RNA, 13 nt, Human
aggaguuuggcca

SEQ ID NO: 3006910 - RNA, 18 nt, Human
aggaguuuggccagaagu

SEQ ID NO: 3006911 - RNA, 17 nt, Human
aggaguuuggccagaag

SEQ ID NO: 3006912 - RNA, 16 nt, Human
aggaguuuggccagaa

SEQ ID NO: 3006913 - RNA, 15 nt, Human
aggaguuuggccaga

SEQ ID NO: 3006914 - RNA, 12 nt, Human
uggaaaggaaug

SEQ ID NO: 3006915 - RNA, 15 nt, Human
uggaaaggaaugcaa

SEQ ID NO: 3006916 - RNA, 21 nt, Human
uggaaaggaaugcaaagauga

SEQ ID NO: 3006917 - RNA, 22 nt, Human
uggaaaggaaugcaaagaugaa

SEQ ID NO: 3006918 - RNA, 12 nt, Human
ugcuuggcccag

SEQ ID NO: 3006919 - RNA, 16 nt, Human
ugcuuggcccaggagu

SEQ ID NO: 3006920 - RNA, 15 nt, Human
ugcuuggcccaggag

SEQ ID NO: 3006921 - RNA, 23 nt, Human
ugcuuggcccaggaguuuggcca

SEQ ID NO: 3006922 - RNA, 18 nt, Human
ugcuuggcccaggaguuu

SEQ ID NO: 3006923 - RNA, 15 nt, Human
ugcuguacauacuuu

SEQ ID NO: 3006924 - RNA, 17 nt, Human
ugcuguacauacuuuuu

SEQ ID NO: 3006925 - RNA, 22 nt, Human
ugcuguacauacuuuuuggguu

SEQ ID NO: 3006926 - RNA, 11 nt, Human
ugcuguacaua

SEQ ID NO: 3006927 - RNA, 18 nt, Human
aggaagcugugagagcag

SEQ ID NO: 3006928 - RNA, 17 nt, Human
aggaagcuuacaugccu

SEQ ID NO: 3006929 - RNA, 20 nt, Human
ugggaaagggauuuucagcc

SEQ ID NO: 3006930 - RNA, 22 nt, Human
uggaguuauugaagcagagugg

SEQ ID NO: 3006931 - RNA, 15 nt, Human
uugaagguagaaugu

SEQ ID NO: 3006932 - RNA, 19 nt, Human
uugaagguagaauguuuuc

SEQ ID NO: 3006933 - RNA, 16 nt, Human
uugaagguagaauguu

SEQ ID NO: 3006934 - RNA, 14 nt, Human
uugaaguaaaaugu

SEQ ID NO: 3006935 - RNA, 16 nt, Human
uugaaggaugcugucu

SEQ ID NO: 3006936 - RNA, 14 nt, Human
uugaaggaugcugu

SEQ ID NO: 3006937 - RNA, 16 nt, Human
auccaauugcugcuug

SEQ ID NO: 3006938 - RNA, 14 nt, Human
aucacuuccaugac

SEQ ID NO: 3006939 - RNA, 13 nt, Human
auauuuaaucuuu

SEQ ID NO: 3006940 - RNA, 20 nt, Human
auauugguugggaugacuug

SEQ ID NO: 3006941 - RNA, 19 nt, Human
auauugguugggaugacuu

SEQ ID NO: 3006942 - RNA, 22 nt, Human
uuccuguuuuuauuauuaacaa

SEQ ID NO: 3006943 - RNA, 16 nt, Human
uuccaguaaugagcuu

SEQ ID NO: 3006944 - RNA, 19 nt, Human
uucauucuuuuugaaaugu

SEQ ID NO: 3006945 - RNA, 14 nt, Human
uucauuaguuuuga

SEQ ID NO: 3006946 - RNA, 19 nt, Human
uucauuaguuuugaagauu

SEQ ID NO: 3006947 - RNA, 20 nt, Human
uuuccuucaagaaugcagua

SEQ ID NO: 3006948 - RNA, 18 nt, Human
uuucucacagaagaugaa

SEQ ID NO: 3006949 - RNA, 22 nt, Human
uuucucacagaagaugaagcac

SEQ ID NO: 3006950 - RNA, 15 nt, Human
uuucucauguugaaa

SEQ ID NO: 3006951 - RNA, 13 nt, Human
uuucucauguuga

SEQ ID NO: 3006952 - RNA, 23 nt, Human
uuugaaacacugguuuuaaauau

SEQ ID NO: 3006953 - RNA, 23 nt, Human
augccuaccaauauuuaaucuuu

SEQ ID NO: 3006954 - RNA, 17 nt, Human
augccuaccaauauuua

SEQ ID NO: 3006955 - RNA, 16 nt, Human
augccuaccaauauuu

SEQ ID NO: 3006956 - RNA, 18 nt, Human
uuuauauagcaagacauu

SEQ ID NO: 3006957 - RNA, 22 nt, Human
uuuauauagcaagacauuauau

SEQ ID NO: 3006958 - RNA, 22 nt, Human
uugugaaggcaggggaauguau

SEQ ID NO: 3006959 - RNA, 14 nt, Human
uugugaauaaagag

SEQ ID NO: 3006960 - RNA, 19 nt, Human
uuguugaggguauguuuua

SEQ ID NO: 3006961 - RNA, 22 nt, Human
uuguucccugugucauuucaaa

SEQ ID NO: 3006962 - RNA, 16 nt, Human
uuguuuuuauuaaaag

SEQ ID NO: 3006963 - RNA, 21 nt, Human
uuguaacuguuuagaugaaug

SEQ ID NO: 3006964 - RNA, 22 nt, Human
uuguaacuguuuagaugaaugu

SEQ ID NO: 3006965 - RNA, 23 nt, Human
uuggccugucuuuggauuguuaa

SEQ ID NO: 3006966 - RNA, 13 nt, Human
aucuuuuaugauu

SEQ ID NO: 3006967 - RNA, 23 nt, Human
auuucaaacagucucccuuccua

SEQ ID NO: 3006968 - RNA, 14 nt, Human
auuuauucauuagu

SEQ ID NO: 3006969 - RNA, 14 nt, Human
auuuauuuauucau

SEQ ID NO: 3006970 - RNA, 17 nt, Human
auugggcacaucauuuc

SEQ ID NO: 3006971 - RNA, 18 nt, Human
auugggcacaucauuuca

SEQ ID NO: 3006972 - RNA, 19 nt, Human
auugggcacaucauuucaa

SEQ ID NO: 3006973 - RNA, 21 nt, Human
auugggcacaucauuucaaga

SEQ ID NO: 3006974 - RNA, 23 nt, Human
auugggcacaucauuucaagaag

SEQ ID NO: 3006975 - RNA, 12 nt, Human
auuugugagacu

SEQ ID NO: 3006976 - RNA, 14 nt, Human
auuugugagacugu

SEQ ID NO: 3006977 - RNA, 21 nt, Human
auuuguuuugccaauuugcac

SEQ ID NO: 3006978 - RNA, 23 nt, Human
auuuguuuugccaauuugcacau

SEQ ID NO: 3006979 - RNA, 23 nt, Human
auuugaagguagaauguuuucaa

SEQ ID NO: 3006980 - RNA, 18 nt, Human
auuugaagguagaauguu

SEQ ID NO: 3006981 - RNA, 17 nt, Human
auuuuacuuuuuggaaa

SEQ ID NO: 3006982 - RNA, 14 nt, Human
auuuuacuuuuugg

SEQ ID NO: 3006983 - RNA, 16 nt, Human
auuaaacaugcuguac

SEQ ID NO: 3006984 - RNA, 22 nt, Human
auguuaauauuuuagguguaaa

SEQ ID NO: 3006985 - RNA, 13 nt, Human
auguuaauauuuu

SEQ ID NO: 3006986 - RNA, 13 nt, Human
auguuaauauuuc

SEQ ID NO: 3006987 - RNA, 14 nt, Human
auguguucuauuca

SEQ ID NO: 3006988 - RNA, 18 nt, Human
uuuugcauauugcauacu

SEQ ID NO: 3006989 - RNA, 15 nt, Human
uuuugcauauugcau

SEQ ID NO: 3006990 - RNA, 18 nt, Human
uuuugccaauuugcacau

SEQ ID NO: 3006991 - RNA, 19 nt, Human
uuuugccaauuugcacauu

SEQ ID NO: 3006992 - RNA, 16 nt, Human
uuuugccaauuugcac

SEQ ID NO: 3006993 - RNA, 17 nt, Human
auuauauagcaguaaaa

SEQ ID NO: 3006994 - RNA, 18 nt, Human
auucuauguuaauauuuu

SEQ ID NO: 3006995 - RNA, 15 nt, Human
auucuauguuaauau

SEQ ID NO: 3006996 - RNA, 17 nt, Human
auucucagcagagugcu

SEQ ID NO: 3006997 - RNA, 16 nt, Human
caaucuggauucauau

SEQ ID NO: 3006998 - RNA, 20 nt, Human
caaucuggauucauauuuaa

SEQ ID NO: 3006999 - RNA, 23 nt, Human
caaucugugaugacauucccugc

SEQ ID NO: 3007000 - RNA, 16 nt, Human
caaguuaguucaaucu

SEQ ID NO: 3007001 - RNA, 14 nt, Human
caauuugcacauua

SEQ ID NO: 3007002 - RNA, 15 nt, Human
caauuugcacauuaa

SEQ ID NO: 3007003 - RNA, 22 nt, Human
caauuugcacauuaaaugacuc

SEQ ID NO: 3007004 - RNA, 19 nt, Human
caaugagaucauugugaag

SEQ ID NO: 3007005 - RNA, 14 nt, Human
caaggcuuagaccc

SEQ ID NO: 3007006 - RNA, 15 nt, Human
caaggcuuagacccu

SEQ ID NO: 3007007 - RNA, 15 nt, Human
caaggcugugcaucu

SEQ ID NO: 3007008 - RNA, 18 nt, Human
caaggcuuagacccucau

SEQ ID NO: 3007009 - RNA, 14 nt, Human
caaacuaacaggcu

SEQ ID NO: 3007010 - RNA, 16 nt, Human
caaacuaacaggcuua

SEQ ID NO: 3007011 - RNA, 20 nt, Human
caaacuaacaggcuuaguga

SEQ ID NO: 3007012 - RNA, 21 nt, Human
cacaguguguggucaacauuu

SEQ ID NO: 3007013 - RNA, 16 nt, Human
cacuguccuauuauau

SEQ ID NO: 3007014 - RNA, 12 nt, Human
cacugguuuuaa

SEQ ID NO: 3007015 - RNA, 13 nt, Human
cacugguuuuaaa

SEQ ID NO: 3007016 - RNA, 15 nt, Human
cacugguuuuaaaua

SEQ ID NO: 3007017 - RNA, 16 nt, Human
cacugguuuuaaauau

SEQ ID NO: 3007018 - RNA, 18 nt, Human
cacugguuuguucccugu

SEQ ID NO: 3007019 - RNA, 20 nt, Human
cacuucacgcccuuggccau

SEQ ID NO: 3007020 - RNA, 21 nt, Human
cacuucacgcccuuggccaug

SEQ ID NO: 3007021 - RNA, 17 nt, Human
cacuucacgcccuuggc

SEQ ID NO: 3007022 - RNA, 19 nt, Human
cacuucacgcccuuggcca

SEQ ID NO: 3007023 - RNA, 13 nt, Human
cacucuauaacaa

SEQ ID NO: 3007024 - RNA, 15 nt, Human
cacgcacacugucug

SEQ ID NO: 3007025 - RNA, 20 nt, Human
cacccucagaugcacaugag

SEQ ID NO: 3007026 - RNA, 21 nt, Human
cagaaucgcuccaccuugcag

SEQ ID NO: 3007027 - RNA, 23 nt, Human
cagaaucgcuccaccuugcagcu

SEQ ID NO: 3007028 - RNA, 17 nt, Human
cagaagucaaggcuuag

SEQ ID NO: 3007029 - RNA, 16 nt, Human
cagaagucaaggcuua

SEQ ID NO: 3007030 - RNA, 18 nt, Human
cagaagucaaggcuuaga

SEQ ID NO: 3007031 - RNA, 17 nt, Human
cagaacuauguuuuugu

SEQ ID NO: 3007032 - RNA, 17 nt, Human
cagaugcacaugagcug

SEQ ID NO: 3007033 - RNA, 12 nt, Human
cagaguggcagu

SEQ ID NO: 3007034 - RNA, 21 nt, Human
cagagugcuuuaccaauugaa

SEQ ID NO: 3007035 - RNA, 21 nt, Human
cagagaagauucuuguauuua

SEQ ID NO: 3007036 - RNA, 20 nt, Human
cagagccccacccucagaug

SEQ ID NO: 3007037 - RNA, 14 nt, Human
caggaagcugugag

SEQ ID NO: 3007038 - RNA, 13 nt, Human
caggaagcuguga

SEQ ID NO: 3007039 - RNA, 22 nt, Human
caggaagcugugagagcaguuu

SEQ ID NO: 3007040 - RNA, 16 nt, Human
cagcucuccccuucuc

SEQ ID NO: 3007041 - RNA, 18 nt, Human
cagcccucaauugugaaa

SEQ ID NO: 3007042 - RNA, 13 nt, Human
cagcccucagaau

SEQ ID NO: 3007043 - RNA, 23 nt, Human
cagcaacacaaagcuuuugcaua

SEQ ID NO: 3007044 - RNA, 15 nt, Human
cagcaacacaaagcu

SEQ ID NO: 3007045 - RNA, 11 nt, Human
cagcagagugc

SEQ ID NO: 3007046 - RNA, 15 nt, Human
cagcagagugcuuua

SEQ ID NO: 3007047 - RNA, 9 nt, Human
cagcagagu

SEQ ID NO: 3007048 - RNA, 10 nt, Human
cagcagagug

SEQ ID NO: 3007049 - RNA, 19 nt, Human
cagcacaaggaaauaaaau

SEQ ID NO: 3007050 - RNA, 16 nt, Human
caggcuggaguuauug

SEQ ID NO: 3007051 - RNA, 13 nt, Human
caggcuggaguua

SEQ ID NO: 3007052 - RNA, 14 nt, Human
caggaguuuggcca

SEQ ID NO: 3007053 - RNA, 13 nt, Human
caggaguuuggcc

SEQ ID NO: 3007054 - RNA, 17 nt, Human
caggaguuuggccagaa

SEQ ID NO: 3007055 - RNA, 16 nt, Human
caggaguuuggccaga

SEQ ID NO: 3007056 - RNA, 15 nt, Human
caggaguuuggccag

SEQ ID NO: 3007057 - RNA, 19 nt, Human
cagucauuauguuaauauu

SEQ ID NO: 3007058 - RNA, 23 nt, Human
cagucagggaaggugccucugga

SEQ ID NO: 3007059 - RNA, 13 nt, Human
caguaacauagcu

SEQ ID NO: 3007060 - RNA, 21 nt, Human
caguaaugagcuuaagaaauu

SEQ ID NO: 3007061 - RNA, 18 nt, Human
caguacuaacauuuauuu

SEQ ID NO: 3007062 - RNA, 16 nt, Human
cauucuuggcccagga

SEQ ID NO: 3007063 - RNA, 13 nt, Human
cauucuuggccca

SEQ ID NO: 3007064 - RNA, 13 nt, Human
cauucuuuuugaa

SEQ ID NO: 3007065 - RNA, 16 nt, Human
cauucuuuuugaaaug

SEQ ID NO: 3007066 - RNA, 14 nt, Human
cauucuuuuugaaa

SEQ ID NO: 3007067 - RNA, 16 nt, Human
caugcuguacauacuu

SEQ ID NO: 3007068 - RNA, 19 nt, Human
caugcuguacauacuuuuu

SEQ ID NO: 3007069 - RNA, 21 nt, Human
caugcuguacauacuuuuugg

SEQ ID NO: 3007070 - RNA, 13 nt, Human
caugcuguacaua

SEQ ID NO: 3007071 - RNA, 11 nt, Human
caucaucccuu

SEQ ID NO: 3007072 - RNA, 17 nt, Human
caucccuuucccuuggu

SEQ ID NO: 3007073 - RNA, 14 nt, Human
caucccuuucccuu

SEQ ID NO: 3007074 - RNA, 17 nt, Human
cauauuuaauuugaagg

SEQ ID NO: 3007075 - RNA, 22 nt, Human
cauauugcauacuauuaaacau

SEQ ID NO: 3007076 - RNA, 19 nt, Human
cauauugcauacuauuaaa

SEQ ID NO: 3007077 - RNA, 21 nt, Human
cauauugcauacuauuaaaca

SEQ ID NO: 3007078 - RNA, 19 nt, Human
ccaguguuuuaggagcaug

SEQ ID NO: 3007079 - RNA, 23 nt, Human
ccuucuucccaauagcaaggcug

SEQ ID NO: 3007080 - RNA, 13 nt, Human
ccuuguuuaaugg

SEQ ID NO: 3007081 - RNA, 14 nt, Human
ccuguuuuuauuau

SEQ ID NO: 3007082 - RNA, 15 nt, Human
ccuguuuuuauuauu

SEQ ID NO: 3007083 - RNA, 15 nt, Human
ccuccacauuuguuu

SEQ ID NO: 3007084 - RNA, 12 nt, Human
cccuaaucuucc

SEQ ID NO: 3007085 - RNA, 16 nt, Human
cuuccacuugaguguc

SEQ ID NO: 3007086 - RNA, 14 nt, Human
cuucaagaaugcag

SEQ ID NO: 3007087 - RNA, 18 nt, Human
cuguuuuuauuauuaaca

SEQ ID NO: 3007088 - RNA, 20 nt, Human
cuguuuuuauuauuaacaaa

SEQ ID NO: 3007089 - RNA, 16 nt, Human
cuuaauuauugauguu

SEQ ID NO: 3007090 - RNA, 10 nt, Human
cuuaauuauu

SEQ ID NO: 3007091 - RNA, 18 nt, Human
cuuagacccucaugcugc

SEQ ID NO: 3007092 - RNA, 22 nt, Human
cuuagacccucaugcugccaau

SEQ ID NO: 3007093 - RNA, 21 nt, Human
cuuagacccucaugcugccaa

SEQ ID NO: 3007094 - RNA, 20 nt, Human
cuuagacccucaugcugcca

SEQ ID NO: 3007095 - RNA, 19 nt, Human
cuuagacccucaugcugcc

SEQ ID NO: 3007096 - RNA, 23 nt, Human
cuuagacccucaugcugccaaua

SEQ ID NO: 3007097 - RNA, 15 nt, Human
cuguguuguacagcu

SEQ ID NO: 3007098 - RNA, 19 nt, Human
cugugaugacauucccugc

SEQ ID NO: 3007099 - RNA, 22 nt, Human
cugugauuuuugguauuugaaa

SEQ ID NO: 3007100 - RNA, 14 nt, Human
cugucuuuuaaacu

SEQ ID NO: 3007101 - RNA, 15 nt, Human
cugucuuuuaaacuc

SEQ ID NO: 3007102 - RNA, 23 nt, Human
cugggguggguggggcagugcuu

SEQ ID NO: 3007103 - RNA, 14 nt, Human
gaagaaaauaauua

SEQ ID NO: 3007104 - RNA, 15 nt, Human
gaagguagaauguuu

SEQ ID NO: 3007105 - RNA, 17 nt, Human
gaagguagaauguuuuc

SEQ ID NO: 3007106 - RNA, 16 nt, Human
gaagguagaauguuuu

SEQ ID NO: 3007107 - RNA, 17 nt, Human
gaaguaaaauguggcag

SEQ ID NO: 3007108 - RNA, 18 nt, Human
gaaguaaaauguggcagg

SEQ ID NO: 3007109 - RNA, 22 nt, Human
gaaacacugguuuuaaauauuu

SEQ ID NO: 3007110 - RNA, 13 nt, Human
gaaacacugguuu

SEQ ID NO: 3007111 - RNA, 19 nt, Human
cuuuaaacuacauuagguu

SEQ ID NO: 3007112 - RNA, 16 nt, Human
cuuguuuaaugguagu

SEQ ID NO: 3007113 - RNA, 17 nt, Human
cucauguugaaacuuua

SEQ ID NO: 3007114 - RNA, 14 nt, Human
cucauuucuagcag

SEQ ID NO: 3007115 - RNA, 15 nt, Human
cuccacauuuguuuu

SEQ ID NO: 3007116 - RNA, 13 nt, Human
cuccacauuuguu

SEQ ID NO: 3007117 - RNA, 17 nt, Human
cuccaccuugcagcucu

SEQ ID NO: 3007118 - RNA, 22 nt, Human
cuaugggguaaaagggguaggg

SEQ ID NO: 3007119 - RNA, 22 nt, Human
cuaugcuguucacuggacacuu

SEQ ID NO: 3007120 - RNA, 15 nt, Human
cucaagucuggcaga

SEQ ID NO: 3007121 - RNA, 16 nt, Human
cucagcagagugcuuu

SEQ ID NO: 3007122 - RNA, 11 nt, Human
cucagcagagu

SEQ ID NO: 3007123 - RNA, 12 nt, Human
cucagcagagug

SEQ ID NO: 3007124 - RNA, 13 nt, Human
cucagcagagugc

SEQ ID NO: 3007125 - RNA, 22 nt, Human
cugauuuaaacacauuaaaggu

SEQ ID NO: 3007126 - RNA, 17 nt, Human
cugaacaucacagcuua

SEQ ID NO: 3007127 - RNA, 23 nt, Human
cugacgacuugagugcucaguag

SEQ ID NO: 3007128 - RNA, 15 nt, Human
gaugacuguuuuuaa

SEQ ID NO: 3007129 - RNA, 17 nt, Human
gauucuauguuaauauu

SEQ ID NO: 3007130 - RNA, 20 nt, Human
gauucuauguuaauauuuua

SEQ ID NO: 3007131 - RNA, 18 nt, Human
gauugugccuaauguguu

SEQ ID NO: 3007132 - RNA, 17 nt, Human
gaguuauugaagcagag

SEQ ID NO: 3007133 - RNA, 23 nt, Human
gccaauauccuaauaaaaaggug

SEQ ID NO: 3007134 - RNA, 22 nt, Human
gccaauauccuaauaaaaaggu

SEQ ID NO: 3007135 - RNA, 20 nt, Human
gccaauauccuaauaaaaag

SEQ ID NO: 3007136 - RNA, 19 nt, Human
gccaauauccuaauaaaaa

SEQ ID NO: 3007137 - RNA, 18 nt, Human
gccaauauccuaauaaaa

SEQ ID NO: 3007138 - RNA, 13 nt, Human
gccaauauccuaa

SEQ ID NO: 3007139 - RNA, 17 nt, Human
gccaauauccuaauaaa

SEQ ID NO: 3007140 - RNA, 16 nt, Human
gccaauauccuaauaa

SEQ ID NO: 3007141 - RNA, 15 nt, Human
gccaauauccuaaua

SEQ ID NO: 3007142 - RNA, 14 nt, Human
gccaauauccuaau

SEQ ID NO: 3007143 - RNA, 12 nt, Human
gccaauuugcac

SEQ ID NO: 3007144 - RNA, 22 nt, Human
gcauacugccuuguuuaauggu

SEQ ID NO: 3007145 - RNA, 13 nt, Human
gcauacuauuaaa

SEQ ID NO: 3007146 - RNA, 14 nt, Human
gcauacuauuaaac

SEQ ID NO: 3007147 - RNA, 17 nt, Human
gcauacuauuaaacaug

SEQ ID NO: 3007148 - RNA, 21 nt, Human
gcauacuauuaaacaugcugu

SEQ ID NO: 3007149 - RNA, 16 nt, Human
gcacgcacacugucug

SEQ ID NO: 3007150 - RNA, 15 nt, Human
gcacgcacacugucu

SEQ ID NO: 3007151 - RNA, 16 nt, Human
gcaggaagcugugaga

SEQ ID NO: 3007152 - RNA, 22 nt, Human
gcagaguaggggucugucuuuu

SEQ ID NO: 3007153 - RNA, 21 nt, Human
gcuuagacccucaugcugcca

SEQ ID NO: 3007154 - RNA, 16 nt, Human
gcuuagacccucaugc

SEQ ID NO: 3007155 - RNA, 22 nt, Human
gcuuacaugccuaccaauauuu

SEQ ID NO: 3007156 - RNA, 19 nt, Human
gcugauuuaaacacauuaa

SEQ ID NO: 3007157 - RNA, 14 nt, Human
gcugaccuugcuga

SEQ ID NO: 3007158 - RNA, 15 nt, Human
gccuuguuuaauggu

SEQ ID NO: 3007159 - RNA, 23 nt, Human
gccuuguuuaaugguaguuuuac

SEQ ID NO: 3007160 - RNA, 18 nt, Human
ggagcccugucuccucuc

SEQ ID NO: 3007161 - RNA, 20 nt, Human
ggagaagucuucuauuuauu

SEQ ID NO: 3007162 - RNA, 19 nt, Human
ggagaagucuucuauuuau

SEQ ID NO: 3007163 - RNA, 15 nt, Human
ggacauuuuaugucu

SEQ ID NO: 3007164 - RNA, 16 nt, Human
ggcagugcuuggccca

SEQ ID NO: 3007165 - RNA, 23 nt, Human
ggcagugcuuggcccaggaguuu

SEQ ID NO: 3007166 - RNA, 22 nt, Human
ggcagugcuuggcccaggaguu

SEQ ID NO: 3007167 - RNA, 21 nt, Human
ggcagugcuuggcccaggagu

SEQ ID NO: 3007168 - RNA, 20 nt, Human
ggcagugcuuggcccaggag

SEQ ID NO: 3007169 - RNA, 19 nt, Human
ggcagugcuuggcccagga

SEQ ID NO: 3007170 - RNA, 18 nt, Human
ggcagugcuuggcccagg

SEQ ID NO: 3007171 - RNA, 17 nt, Human
ggcagugcuuggcccag

SEQ ID NO: 3007172 - RNA, 19 nt, Human
ggauugaaggaugcugucu

SEQ ID NO: 3007173 - RNA, 23 nt, Human
ggcuggaguuauugaagcagagu

SEQ ID NO: 3007174 - RNA, 15 nt, Human
ggcuggaguuauuga

SEQ ID NO: 3007175 - RNA, 18 nt, Human
ggcuuagacccucaugcu

SEQ ID NO: 3007176 - RNA, 20 nt, Human
ggcuuagacccucaugcugc

SEQ ID NO: 3007177 - RNA, 23 nt, Human
ggcuuagacccucaugcugccaa

SEQ ID NO: 3007178 - RNA, 22 nt, Human
ggcuuagacccucaugcugcca

SEQ ID NO: 3007179 - RNA, 17 nt, Human
ucacugguacucugcca

SEQ ID NO: 3007180 - RNA, 20 nt, Human
ucaugcugccaauauccuaa

SEQ ID NO: 3007181 - RNA, 19 nt, Human
ucaugcugccaauauccua

SEQ ID NO: 3007182 - RNA, 17 nt, Human
ucaugcugccaauaucc

SEQ ID NO: 3007183 - RNA, 13 nt, Human
ucaugcugccaau

SEQ ID NO: 3007184 - RNA, 17 nt, Human
ucauuauguuaauauuu

SEQ ID NO: 3007185 - RNA, 16 nt, Human
ucauuauguuaauauu

SEQ ID NO: 3007186 - RNA, 23 nt, Human
ucaugcugccaauauccuaauaa

SEQ ID NO: 3007187 - RNA, 21 nt, Human
ucaugcugccaauauccuaau

SEQ ID NO: 3007188 - RNA, 23 nt, Human
ucauuaguuuugaagauucuaug

SEQ ID NO: 3007189 - RNA, 14 nt, Human
ucauuaguuuugaa

SEQ ID NO: 3007190 - RNA, 13 nt, Human
uauuaacaaaaca

SEQ ID NO: 3007191 - RNA, 14 nt, Human
uauugauguuuuca

SEQ ID NO: 3007192 - RNA, 13 nt, Human
uauugauguuuuc

SEQ ID NO: 3007193 - RNA, 17 nt, Human
uauucucagcagagugc

SEQ ID NO: 3007194 - RNA, 21 nt, Human
uauucucagcagagugcuuua

SEQ ID NO: 3007195 - RNA, 15 nt, Human
uauucucagcagagu

SEQ ID NO: 3007196 - RNA, 17 nt, Human
uauuuucuccaaauguu

SEQ ID NO: 3007197 - RNA, 19 nt, Human
uccugucggagcccugucu

SEQ ID NO: 3007198 - RNA, 22 nt, Human
ucuaaauaucccuuggacauuu

SEQ ID NO: 3007199 - RNA, 12 nt, Human
uccuauuauauu

SEQ ID NO: 3007200 - RNA, 15 nt, Human
uccuaauaaaaaggu

SEQ ID NO: 3007201 - RNA, 14 nt, Human
uccuaauaaaaagg

SEQ ID NO: 3007202 - RNA, 13 nt, Human
uccuaauaaaaag

SEQ ID NO: 3007203 - RNA, 12 nt, Human
uccuaauaaaaa

SEQ ID NO: 3007204 - RNA, 17 nt, Human
uccuaauaaaaagguga

SEQ ID NO: 3007205 - RNA, 16 nt, Human
uccuaauaaaaaggug

SEQ ID NO: 3007206 - RNA, 18 nt, Human
uccuaauaaaaaggugac

SEQ ID NO: 3007207 - RNA, 18 nt, Human
ucucuguaauaaacucau

SEQ ID NO: 3007208 - RNA, 22 nt, Human
ucucuguaauaaacucauuucu

SEQ ID NO: 3007209 - RNA, 13 nt, Human
ucuguuuugugua

SEQ ID NO: 3007210 - RNA, 19 nt, Human
ucuguuuuguguacuuuua

SEQ ID NO: 3007211 - RNA, 15 nt, Human
uguccuauuauauuc

SEQ ID NO: 3007212 - RNA, 14 nt, Human
ugucuuuuaaacuc

SEQ ID NO: 3007213 - RNA, 14 nt, Human
uggaaaagaauaaa

SEQ ID NO: 3007214 - RNA, 19 nt, Human
uggauugugccuaaugugu

SEQ ID NO: 3007215 - RNA, 23 nt, Human
uggauugugccuaauguguuuga

SEQ ID NO: 3007216 - RNA, 20 nt, Human
uggauugugccuaauguguu

SEQ ID NO: 3007217 - RNA, 13 nt, Human
uggacauuuuaug

SEQ ID NO: 3007218 - RNA, 11 nt, Human
uggacauuuua

SEQ ID NO: 3007219 - RNA, 17 nt, Human
uggacauuuuaugucuu

SEQ ID NO: 3007220 - RNA, 16 nt, Human
uggacauuuuaugucu

SEQ ID NO: 3007221 - RNA, 16 nt, Human
ugauguaauuaugguu

SEQ ID NO: 3007222 - RNA, 22 nt, Human
ugcagaguaggggucugucuuu

SEQ ID NO: 3007223 - RNA, 16 nt, Human
ugcacgcacacugucu

SEQ ID NO: 3007224 - RNA, 13 nt, Human
uuuuaucuucuau

SEQ ID NO: 3007225 - RNA, 15 nt, Human
uuuucaaauguucuc

SEQ ID NO: 3007226 - RNA, 13 nt, Human
uuuugaaauguca

SEQ ID NO: 3007227 - RNA, 22 nt, Human
uuugaguggaguuacugaacag

SEQ ID NO: 3007228 - RNA, 15 nt, Human
uuugcaggaaauccu

SEQ ID NO: 3007229 - RNA, 19 nt, Human
uuuggaaaggaaugcaaag

SEQ ID NO: 3007230 - RNA, 16 nt, Human
uuuggaaaggaaugca

SEQ ID NO: 3007231 - RNA, 17 nt, Human
uuuggaaaggaaugcaa

SEQ ID NO: 3007232 - RNA, 18 nt, Human
uuuggaaaggaaugcaaa

SEQ ID NO: 3007233 - RNA, 13 nt, Human
uuugguauuugaa

SEQ ID NO: 3007234 - RNA, 21 nt, Human
uuuugaagauucuauguuaau

SEQ ID NO: 3007235 - RNA, 16 nt, Human
uuuaagacccucucaa

SEQ ID NO: 3007236 - RNA, 17 nt, Human
uuuaagaacuaaaaugu

SEQ ID NO: 3007237 - RNA, 14 nt, Human
uuuacuuuaaacua

SEQ ID NO: 3007238 - RNA, 16 nt, Human
uuuauaacuuuuuaua

SEQ ID NO: 3007239 - RNA, 13 nt, Human
uuuauaacuuuuu

SEQ ID NO: 3007240 - RNA, 18 nt, Human
uugugccuaauguguuug

SEQ ID NO: 3007241 - RNA, 15 nt, Human
uugugccuaaugugu

SEQ ID NO: 3007242 - RNA, 15 nt, Human
uugguauuugaaaca

SEQ ID NO: 3007243 - RNA, 20 nt, Human
uugugaaaaaauuuacuuua

SEQ ID NO: 3007244 - RNA, 16 nt, Human
uuauuaacaaaacagu

SEQ ID NO: 3007245 - RNA, 21 nt, Human
uuaugauugccuuuuuauaac

SEQ ID NO: 3007246 - RNA, 15 nt, Human
uuaugauugccuuuu

SEQ ID NO: 3007247 - RNA, 16 nt, Human
uuauauucucagcaga

SEQ ID NO: 3007248 - RNA, 18 nt, Human
uuauauucucagcagagu

SEQ ID NO: 3007249 - RNA, 19 nt, Human
uuauauucucagcagagug

SEQ ID NO: 3007250 - RNA, 20 nt, Human
uuauauucucagcagagugc

SEQ ID NO: 3007251 - RNA, 21 nt, Human
uuauauucucagcagagugcu

SEQ ID NO: 3007252 - RNA, 17 nt, Human
uuauaacuuuuuauauu

SEQ ID NO: 3007253 - RNA, 14 nt, Human
uuagugauguaauu

SEQ ID NO: 3007254 - RNA, 12 nt, Human
uucaauaacugg

SEQ ID NO: 3007255 - RNA, 16 nt, Human
uucaauaacuggaaca

SEQ ID NO: 3007256 - RNA, 22 nt, Human
uucaauaacuggaacacucuau

SEQ ID NO: 3007257 - RNA, 20 nt, Human
uuauuuggaaaggaaugcaa

SEQ ID NO: 3007258 - RNA, 22 nt, Human
uuauuugaguggaguuacugaa

SEQ ID NO: 3007259 - RNA, 16 nt, Human
uuauuuggaaaggaau

SEQ ID NO: 3007260 - RNA, 14 nt, Human
uucacgcccuuggc

SEQ ID NO: 3007261 - RNA, 21 nt, Human
uucuauauaauuccuguuuuu

SEQ ID NO: 3007262 - RNA, 14 nt, Human
uucucucaucuguu

SEQ ID NO: 3007263 - RNA, 22 nt, Human
uucucauguugaaacuuuaaga

SEQ ID NO: 3007264 - RNA, 21 nt, Human
uugacuauuuuuguuuuuauu

SEQ ID NO: 3007265 - RNA, 19 nt, Human
uugacuauuuuuguuuuua

SEQ ID NO: 3007266 - RNA, 18 nt, Human
uugaggguauguuuuaua

SEQ ID NO: 3007267 - RNA, 16 nt, Human
uugauugggcacauca

SEQ ID NO: 3007268 - RNA, 17 nt, Human
uugauugggcacaucau

SEQ ID NO: 3007269 - RNA, 15 nt, Human
uucuggacuaaaacu

SEQ ID NO: 3007270 - RNA, 20 nt, Human
uucuucccaauagcaaggcu

SEQ ID NO: 3007271 - RNA, 21 nt, Human
caaaggauacuuauuuaaaua

SEQ ID NO: 3007272 - RNA, 16 nt, Human
caaaggauacuuauuu

SEQ ID NO: 3007273 - RNA, 17 nt, Human
caaagcuuuugcauauu

SEQ ID NO: 3007274 - RNA, 23 nt, Human
caacaugccagccacugugauag

SEQ ID NO: 3007275 - RNA, 22 nt, Human
caacauuucucauguugaaacu

SEQ ID NO: 3007276 - RNA, 17 nt, Human
cacauuaaagguacuuu

SEQ ID NO: 3007277 - RNA, 13 nt, Human
cacauuaaaugac

SEQ ID NO: 3007278 - RNA, 15 nt, Human
cacauuaaaugacuc

SEQ ID NO: 3007279 - RNA, 23 nt, Human
cacaaagaaccaccaggaaagca

SEQ ID NO: 3007280 - RNA, 15 nt, Human
cacaaagcagauccu

SEQ ID NO: 3007281 - RNA, 20 nt, Human
acuauuuuuguuuuuauuaa

SEQ ID NO: 3007282 - RNA, 19 nt, Human
acuauucugagaugacuau

SEQ ID NO: 3007283 - RNA, 18 nt, Human
acuauucugagaugacua

SEQ ID NO: 3007284 - RNA, 21 nt, Human
acuauuuuuguuuuuauuaaa

SEQ ID NO: 3007285 - RNA, 22 nt, Human
acuauuuuuguuuuuauuaaaa

SEQ ID NO: 3007286 - RNA, 17 nt, Human
acugguuuguucccugu

SEQ ID NO: 3007287 - RNA, 14 nt, Human
acugguuuuaaaua

SEQ ID NO: 3007288 - RNA, 16 nt, Human
acuucacgcccuuggc

SEQ ID NO: 3007289 - RNA, 12 nt, Human
acuuuuaagacu

SEQ ID NO: 3007290 - RNA, 13 nt, Human
acuuuuaagacuu

SEQ ID NO: 3007291 - RNA, 16 nt, Human
acuuuauuucucucau

SEQ ID NO: 3007292 - RNA, 19 nt, Human
acccaguguuuuaggagca

SEQ ID NO: 3007293 - RNA, 22 nt, Human
acccaguguuuuaggagcauga

SEQ ID NO: 3007294 - RNA, 15 nt, Human
aaacucugagugcaa

SEQ ID NO: 3007295 - RNA, 13 nt, Human
aaacucugagugc

SEQ ID NO: 3007296 - RNA, 19 nt, Human
aaacacugguuuuaaauau

SEQ ID NO: 3007297 - RNA, 20 nt, Human
aacacauuaaagguacuuug

SEQ ID NO: 3007298 - RNA, 15 nt, Human
aacacauuaaaggua

SEQ ID NO: 3007299 - RNA, 22 nt, Human
aacagcaacacaaagcuuuugc

SEQ ID NO: 3007300 - RNA, 22 nt, Human
aaugucaguuguuauuuauuga

SEQ ID NO: 3007301 - RNA, 12 nt, Human
aaggugcaucug

SEQ ID NO: 3007302 - RNA, 11 nt, Human
aagauucuaug

SEQ ID NO: 3007303 - RNA, 15 nt, Human
agcaugaagacagag

SEQ ID NO: 3007304 - RNA, 17 nt, Human
agcccucaauugugaaa

SEQ ID NO: 3007305 - RNA, 16 nt, Human
agcccucaauugugaa

SEQ ID NO: 3007306 - RNA, 22 nt, Human
agacgugcacgcacacugucug

SEQ ID NO: 3007307 - RNA, 21 nt, Human
agacgugcacgcacacugucu

SEQ ID NO: 3007308 - RNA, 12 nt, Human
agcuuuugcaua

SEQ ID NO: 3007309 - RNA, 22 nt, Human
aggagaagucuucuauuuauuu

SEQ ID NO: 3007310 - RNA, 23 nt, Human
aggagaagucuucuauuuauuua

SEQ ID NO: 3007311 - RNA, 22 nt, Human
aggucuguuuuguguacuuuua

SEQ ID NO: 3007312 - RNA, 20 nt, Human
auaucccuuggacauuuuau

SEQ ID NO: 3007313 - RNA, 14 nt, Human
auauccuaauaaaa

SEQ ID NO: 3007314 - RNA, 13 nt, Human
auauccuaauaaa

SEQ ID NO: 3007315 - RNA, 12 nt, Human
auauccuaauaa

SEQ ID NO: 3007316 - RNA, 23 nt, Human
auaucccuuggacauuuuauguc

SEQ ID NO: 3007317 - RNA, 22 nt, Human
auaucccuuggacauuuuaugu

SEQ ID NO: 3007318 - RNA, 18 nt, Human
auauccuaauaaaaaggu

SEQ ID NO: 3007319 - RNA, 16 nt, Human
auauccuaauaaaaag

SEQ ID NO: 3007320 - RNA, 21 nt, Human
auagcaguaaaaaaugguguu

SEQ ID NO: 3007321 - RNA, 15 nt, Human
auagcaguaaaaaau

SEQ ID NO: 3007322 - RNA, 15 nt, Human
auaaugucccuucac

SEQ ID NO: 3007323 - RNA, 21 nt, Human
auaacaaaggauacuuauuua

SEQ ID NO: 3007324 - RNA, 20 nt, Human
auaacaaaggauacuuauuu

SEQ ID NO: 3007325 - RNA, 18 nt, Human
auguuuucaaauguucuc

SEQ ID NO: 3007326 - RNA, 17 nt, Human
auguuuuauauagcaag

SEQ ID NO: 3007327 - RNA, 15 nt, Human
auguuuucaaauguu

SEQ ID NO: 3007328 - RNA, 12 nt, Human
auguuuucaaau

SEQ ID NO: 3007329 - RNA, 20 nt, Human
auguucuccagucauuaugu

SEQ ID NO: 3007330 - RNA, 23 nt, Human
augcuugcugcugauuuaaacac

SEQ ID NO: 3007331 - RNA, 23 nt, Human
augcugccaauauccuaauaaaa

SEQ ID NO: 3007332 - RNA, 22 nt, Human
augcugccaauauccuaauaaa

SEQ ID NO: 3007333 - RNA, 21 nt, Human
augcugccaauauccuaauaa

SEQ ID NO: 3007334 - RNA, 20 nt, Human
augcugccaauauccuaaua

SEQ ID NO: 3007335 - RNA, 13 nt, Human
augcugccaauau

SEQ ID NO: 3007336 - RNA, 19 nt, Human
augcugccaauauccuaau

SEQ ID NO: 3007337 - RNA, 18 nt, Human
augcugccaauauccuaa

SEQ ID NO: 3007338 - RNA, 17 nt, Human
augcugccaauauccua

SEQ ID NO: 3007339 - RNA, 14 nt, Human
augcugccaauauc

SEQ ID NO: 3007340 - RNA, 16 nt, Human
uaaaugacucuucccu

SEQ ID NO: 3007341 - RNA, 13 nt, Human
aaguuuugagaaa

SEQ ID NO: 3007342 - RNA, 22 nt, Human
uaaacuacauuagguugugaau

SEQ ID NO: 3007343 - RNA, 17 nt, Human
uaaacucauuucuagca

SEQ ID NO: 3007344 - RNA, 12 nt, Human
uaaacucauuuc

SEQ ID NO: 3007345 - RNA, 20 nt, Human
uaaacucugagugcaaacuu

SEQ ID NO: 3007346 - RNA, 20 nt, Human
guucuccagucauuauguua

SEQ ID NO: 3007347 - RNA, 18 nt, Human
guucuccagucauuaugu

SEQ ID NO: 3007348 - RNA, 23 nt, Human
guugcuaacagcaacacaaagcu

SEQ ID NO: 3007349 - RNA, 23 nt, Human
guuuuuuaagggcccuuuuucaa

SEQ ID NO: 3007350 - RNA, 22 nt, Human
aagucaaggcuuagacccucau

SEQ ID NO: 3007351 - RNA, 13 nt, Human
aagucaaggcuua

SEQ ID NO: 3007352 - RNA, 21 nt, Human
guuucuagcaugaagacagag

SEQ ID NO: 3007353 - RNA, 22 nt, Human
aagggcccuuuuucaauaacug

SEQ ID NO: 3007354 - RNA, 16 nt, Human
aagggcccuuuuucaa

SEQ ID NO: 3007355 - RNA, 11 nt, Human
guuuggccaga

SEQ ID NO: 3007356 - RNA, 23 nt, Human
guuuggccagaagucaaggcuua

SEQ ID NO: 3007357 - RNA, 18 nt, Human
guuuggccagaagucaag

SEQ ID NO: 3007358 - RNA, 12 nt, Human
guuuggccagaa

SEQ ID NO: 3007359 - RNA, 18 nt, Human
gugcacgcacacugucug

SEQ ID NO: 3007360 - RNA, 23 nt, Human
guguguggucaacauuucucaug

SEQ ID NO: 3007361 - RNA, 22 nt, Human
aacuaacaggcuuagugaugua

SEQ ID NO: 3007362 - RNA, 18 nt, Human
aacuaacaggcuuaguga

SEQ ID NO: 3007363 - RNA, 13 nt, Human
aacucuguaauuc

SEQ ID NO: 3007364 - RNA, 19 nt, Human
aaucuuuuaugauugccuu

SEQ ID NO: 3007365 - RNA, 20 nt, Human
uaauuugaagguagaauguu

SEQ ID NO: 3007366 - RNA, 21 nt, Human
aaugcaaagaugaaggucugu

SEQ ID NO: 3007367 - RNA, 14 nt, Human
aaugcaaagaugaa

SEQ ID NO: 3007368 - RNA, 18 nt, Human
aaugcaaagaugaagguc

SEQ ID NO: 3007369 - RNA, 12 nt, Human
aaugcaaagaug

SEQ ID NO: 3007370 - RNA, 21 nt, Human
uaauuaugguuaguagaggua

SEQ ID NO: 3007371 - RNA, 14 nt, Human
uacauacuuuuugg

SEQ ID NO: 3007372 - RNA, 15 nt, Human
uacauacuuuuuggg

SEQ ID NO: 3007373 - RNA, 12 nt, Human
uacauacuuuuu

SEQ ID NO: 3007374 - RNA, 18 nt, Human
uacuauuaaacaugcugu

SEQ ID NO: 3007375 - RNA, 14 nt, Human
uacuauuaaacaug

SEQ ID NO: 3007376 - RNA, 15 nt, Human
uacuauuaaacaugc

SEQ ID NO: 3007377 - RNA, 16 nt, Human
uacuauuaaacaugcu

SEQ ID NO: 3007378 - RNA, 13 nt, Human
uacuauuaaacau

SEQ ID NO: 3007379 - RNA, 14 nt, Human
uauuuauuuauuua

SEQ ID NO: 3007380 - RNA, 13 nt, Human
uauuuauuuguga

SEQ ID NO: 3007381 - RNA, 13 nt, Human
uauuuaauuugaa

SEQ ID NO: 3007382 - RNA, 23 nt, Human
uauuuaauuugaagguagaaugu

SEQ ID NO: 3007383 - RNA, 16 nt, Human
uauuuaauuugaaggu

SEQ ID NO: 3007384 - RNA, 13 nt, Human
uauuuaaucuuuu

SEQ ID NO: 3007385 - RNA, 15 nt, Human
uauuuaaucuuuuau

SEQ ID NO: 3007386 - RNA, 16 nt, Human
uauugaaaugauuuca

SEQ ID NO: 3007387 - RNA, 14 nt, Human
uauugaagcagagu

SEQ ID NO: 3007388 - RNA, 16 nt, Human
uauugaagcagagugg

SEQ ID NO: 3007389 - RNA, 20 nt, Human
uauugaagcagaguggcagu

SEQ ID NO: 3007390 - RNA, 15 nt, Human
uauucugagaugacu

SEQ ID NO: 3007391 - RNA, 17 nt, Human
uauuaaacaugcuguac

SEQ ID NO: 3007392 - RNA, 15 nt, Human
uauuaaacaugcugu

SEQ ID NO: 3007393 - RNA, 19 nt, Human
uauuaaacaugcuguacau

SEQ ID NO: 3007394 - RNA, 15 nt, Human
uauguuuuauauagc

SEQ ID NO: 3007395 - RNA, 22 nt, Human
acaguguguggucaacauuucu

SEQ ID NO: 3007396 - RNA, 21 nt, Human
acaguaacauagcugugauuu

SEQ ID NO: 3007397 - RNA, 20 nt, Human
uaucacuuccaugacauaag

SEQ ID NO: 3007398 - RNA, 19 nt, Human
uauauucucagcagagugc

SEQ ID NO: 3007399 - RNA, 17 nt, Human
uauauucucagcagagu

SEQ ID NO: 3007400 - RNA, 14 nt, Human
uaucagaacuaugu

SEQ ID NO: 3007401 - RNA, 20 nt, Human
uaucagaacuauguuuuugu

SEQ ID NO: 3007402 - RNA, 14 nt, Human
uaugaugacuguuu

SEQ ID NO: 3007403 - RNA, 15 nt, Human
uaugaugacuguuuu

SEQ ID NO: 3007404 - RNA, 13 nt, Human
uauagcaagacau

SEQ ID NO: 3007405 - RNA, 15 nt, Human
uagucauucuucccu

SEQ ID NO: 3007406 - RNA, 14 nt, Human
uagucauucuuccc

SEQ ID NO: 3007407 - RNA, 17 nt, Human
acuaucacugguuuggu

SEQ ID NO: 3007408 - RNA, 21 nt, Human
acuauuaaacaugcuguacau

SEQ ID NO: 3007409 - RNA, 20 nt, Human
acuauguuuuuguucaguuu

SEQ ID NO: 3007410 - RNA, 18 nt, Human
acuacauuagguugugaa

SEQ ID NO: 3007411 - RNA, 19 nt, Human
acuacauuagguugugaau

SEQ ID NO: 3007412 - RNA, 20 nt, Human
acuacauuagguugugaaug

SEQ ID NO: 3007413 - RNA, 14 nt, Human
acuaaaauguucua

SEQ ID NO: 3007414 - RNA, 15 nt, Human
uccuguuuuuauuau

SEQ ID NO: 3007415 - RNA, 21 nt, Human
uccuguuuuuauuauuaacaa

SEQ ID NO: 3007416 - RNA, 16 nt, Human
uccuguuuuuauuauu

SEQ ID NO: 3007417 - RNA, 20 nt, Human
uccuguuuuuauuauuaaca

SEQ ID NO: 3007418 - RNA, 21 nt, Human
uccacauuuguuuugccaauu

SEQ ID NO: 3007419 - RNA, 19 nt, Human
ucagaacuauguuuuuguu

SEQ ID NO: 3007420 - RNA, 16 nt, Human
ucagaacuauguuuuu

SEQ ID NO: 3007421 - RNA, 18 nt, Human
ucagaugcacaugagcug

SEQ ID NO: 3007422 - RNA, 23 nt, Human
ugagcaucgcuuaggagaagucu

SEQ ID NO: 3007423 - RNA, 10 nt, Human
agcagagugc

SEQ ID NO: 3007424 - RNA, 13 nt, Human
agcagagugcuuu

SEQ ID NO: 3007425 - RNA, 17 nt, Human
ugaagcagaguggcagu

SEQ ID NO: 3007426 - RNA, 21 nt, Human
ugaagauucuauguuaauauu

SEQ ID NO: 3007427 - RNA, 14 nt, Human
ugacauugcaccug

SEQ ID NO: 3007428 - RNA, 17 nt, Human
ugacauugcaccuggau

SEQ ID NO: 3007429 - RNA, 14 nt, Human
ugacauugacuauu

SEQ ID NO: 3007430 - RNA, 16 nt, Human
ugacauugacuauuuu

SEQ ID NO: 3007431 - RNA, 15 nt, Human
agcaacacaaagcuu

SEQ ID NO: 3007432 - RNA, 21 nt, Human
agcaacacaaagcuuuugcau

SEQ ID NO: 3007433 - RNA, 16 nt, Human
agcaacacaaagcuuu

SEQ ID NO: 3007434 - RNA, 18 nt, Human
agcaacacaaagcuuuug

SEQ ID NO: 3007435 - RNA, 20 nt, Human
acuuguugaggguauguuuu

SEQ ID NO: 3007436 - RNA, 15 nt, Human
ucuccucucucugua

SEQ ID NO: 3007437 - RNA, 20 nt, Human
agaacaaaggggcuuaauua

SEQ ID NO: 3007438 - RNA, 17 nt, Human
agaacuaaaauguucua

SEQ ID NO: 3007439 - RNA, 15 nt, Human
ucuggauucauauuu

SEQ ID NO: 3007440 - RNA, 17 nt, Human
agacccucaugcugcca

SEQ ID NO: 3007441 - RNA, 19 nt, Human
agacccucaugcugccaau

SEQ ID NO: 3007442 - RNA, 18 nt, Human
agacccucaugcugccaa

SEQ ID NO: 3007443 - RNA, 21 nt, Human
agacccucaugcugccaauau

SEQ ID NO: 3007444 - RNA, 20 nt, Human
agacccucaugcugccaaua

SEQ ID NO: 3007445 - RNA, 24 nt, Human
agacccucaugcugccaauauccu

SEQ ID NO: 3007446 - RNA, 16 nt, Human
agacccucucaaacua

SEQ ID NO: 3007447 - RNA, 21 nt, Human
agacuggauaguccgucucug

SEQ ID NO: 3007448 - RNA, 20 nt, Human
agacuggauaguccgucucu

SEQ ID NO: 3007449 - RNA, 16 nt, Human
ucuucccucaaaugug

SEQ ID NO: 3007450 - RNA, 18 nt, Human
ucugucuuuuaaacucug

SEQ ID NO: 3007451 - RNA, 12 nt, Human
ucugucuuuuaa

SEQ ID NO: 3007452 - RNA, 16 nt, Human
ucugucuuuuaaacuc

SEQ ID NO: 3007453 - RNA, 17 nt, Human
ugcauacuauuaaacau

SEQ ID NO: 3007454 - RNA, 18 nt, Human
ugcauacuauuaaacaug

SEQ ID NO: 3007455 - RNA, 20 nt, Human
ugcauacuauuaaacaugcu

SEQ ID NO: 3007456 - RNA, 12 nt, Human
ugcauacuauua

SEQ ID NO: 3007457 - RNA, 15 nt, Human
ugcauacuauuaaac

SEQ ID NO: 3007458 - RNA, 16 nt, Human
ugcauacuauuaaaca

SEQ ID NO: 3007459 - RNA, 17 nt, Human
ugcacaucuguuuugua

SEQ ID NO: 3007460 - RNA, 23 nt, Human
ugccaauauccuaauaaaaaggu

SEQ ID NO: 3007461 - RNA, 21 nt, Human
ugccaauauccuaauaaaaag

SEQ ID NO: 3007462 - RNA, 19 nt, Human
ugccaauauccuaauaaaa

SEQ ID NO: 3007463 - RNA, 18 nt, Human
ugccaauauccuaauaaa

SEQ ID NO: 3007464 - RNA, 17 nt, Human
ugccaauauccuaauaa

SEQ ID NO: 3007465 - RNA, 16 nt, Human
ugccaauauccuaaua

SEQ ID NO: 3007466 - RNA, 15 nt, Human
ugccaauauccuaau

SEQ ID NO: 3007467 - RNA, 23 nt, Human
aggaaagcaaaucaguuugguug

SEQ ID NO: 3007468 - RNA, 23 nt, Human
ugcugccaauauccuaauaaaaa

SEQ ID NO: 3007469 - RNA, 22 nt, Human
ugcugccaauauccuaauaaaa

SEQ ID NO: 3007470 - RNA, 20 nt, Human
ugccuuuuuauaacuuuuua

SEQ ID NO: 3007471 - RNA, 19 nt, Human
uggaacacucuauaacaaa

SEQ ID NO: 3007472 - RNA, 12 nt, Human
aggaguuuggcc

SEQ ID NO: 3007473 - RNA, 11 nt, Human
uggcccaggag

SEQ ID NO: 3007474 - RNA, 19 nt, Human
aggcuuagugauguaauua

SEQ ID NO: 3007475 - RNA, 17 nt, Human
aggcuuagugauguaau

SEQ ID NO: 3007476 - RNA, 18 nt, Human
aggcuuagugauguaauu

SEQ ID NO: 3007477 - RNA, 16 nt, Human
uggcuaacuuggguua

SEQ ID NO: 3007478 - RNA, 20 nt, Human
uguccagccccguagacgug

SEQ ID NO: 3007479 - RNA, 22 nt, Human
aggugggauaucacuuccauga

SEQ ID NO: 3007480 - RNA, 20 nt, Human
uguacauacuuuuuggguuu

SEQ ID NO: 3007481 - RNA, 15 nt, Human
uguacauacuuuuug

SEQ ID NO: 3007482 - RNA, 17 nt, Human
aguaaugagcuuaagaa

SEQ ID NO: 3007483 - RNA, 16 nt, Human
agguuuuuuuuucuca

SEQ ID NO: 3007484 - RNA, 20 nt, Human
aguaaaaaaugguguuuuau

SEQ ID NO: 3007485 - RNA, 19 nt, Human
aguguguggucaacauuuc

SEQ ID NO: 3007486 - RNA, 22 nt, Human
uguucuaaauaucccuuggaca

SEQ ID NO: 3007487 - RNA, 13 nt, Human
ugugucauuucaa

SEQ ID NO: 3007488 - RNA, 14 nt, Human
ugugucauuucaaa

SEQ ID NO: 3007489 - RNA, 22 nt, Human
uguggucaacauuucucauguu

SEQ ID NO: 3007490 - RNA, 15 nt, Human
ugugccuaauguguu

SEQ ID NO: 3007491 - RNA, 14 nt, Human
ugugccuaaugugu

SEQ ID NO: 3007492 - RNA, 18 nt, Human
ugugccuaauguguuuga

SEQ ID NO: 3007493 - RNA, 17 nt, Human
ugugccuaauguguuug

SEQ ID NO: 3007494 - RNA, 18 nt, Human
agugcaaacuucagaguu

SEQ ID NO: 3007495 - RNA, 15 nt, Human
agucucccuuccuau

SEQ ID NO: 3007496 - RNA, 18 nt, Human
auacuauuaaacaugcug

SEQ ID NO: 3007497 - RNA, 19 nt, Human
auacuauuaaacaugcugu

SEQ ID NO: 3007498 - RNA, 17 nt, Human
auacuauuaaacaugcu

SEQ ID NO: 3007499 - RNA, 20 nt, Human
auagauguugcuaacagcaa

SEQ ID NO: 3007500 - RNA, 14 nt, Human
auagauguugcuaa

SEQ ID NO: 3007501 - RNA, 20 nt, Human
auacugccuuguuuaauggu

SEQ ID NO: 3007502 - RNA, 18 nt, Human
auacugccuuguuuaaug

SEQ ID NO: 3007503 - RNA, 13 nt, Human
uuauuauuaacaa

SEQ ID NO: 3007504 - RNA, 14 nt, Human
uuauuauuaacaaa

SEQ ID NO: 3007505 - RNA, 21 nt, Human
uuauucauuaguuuugaagau

SEQ ID NO: 3007506 - RNA, 18 nt, Human
uuauucauuaguuuugaa

SEQ ID NO: 3007507 - RNA, 13 nt, Human
uuauguuaauauu

SEQ ID NO: 3007508 - RNA, 19 nt, Human
aguuuuuuuccuucaagaa

SEQ ID NO: 3007509 - RNA, 19 nt, Human
uuaagacuuugguuauuuu

SEQ ID NO: 3007510 - RNA, 15 nt, Human
aguuuaucuguucau

SEQ ID NO: 3007511 - RNA, 15 nt, Human
aguuuuacaguguuu

SEQ ID NO: 3007512 - RNA, 22 nt, Human
auaacuuuuuauauucucagca

SEQ ID NO: 3007513 - RNA, 18 nt, Human
auaacuuuuuauauucuc

SEQ ID NO: 3007514 - RNA, 21 nt, Human
uugaaggaugcugucuucgua

SEQ ID NO: 3007515 - RNA, 17 nt, Human
uugcauauugcauacua

SEQ ID NO: 3007516 - RNA, 17 nt, Human
aucugaaauaaggaaug

SEQ ID NO: 3007517 - RNA, 19 nt, Human
uucuagcaugaagacagag

SEQ ID NO: 3007518 - RNA, 15 nt, Human
uucccucaaaugugu

SEQ ID NO: 3007519 - RNA, 19 nt, Human
augugcacaucuguuuugu

SEQ ID NO: 3007520 - RNA, 13 nt, Human
augucaguauuuc

SEQ ID NO: 3007521 - RNA, 16 nt, Human
augucaguauuucaac

SEQ ID NO: 3007522 - RNA, 20 nt, Human
auguagacaguuggguuuuu

SEQ ID NO: 3007523 - RNA, 18 nt, Human
auguagacaguuggguuu

SEQ ID NO: 3007524 - RNA, 15 nt, Human
uuuaaauagaugaca

SEQ ID NO: 3007525 - RNA, 16 nt, Human
augauauaagguuuuu

SEQ ID NO: 3007526 - RNA, 18 nt, Human
uuguuuugccaauuugca

SEQ ID NO: 3007527 - RNA, 17 nt, Human
uuuaaagauguagacag

SEQ ID NO: 3007528 - RNA, 19 nt, Human
augauugccuuuuuauaac

SEQ ID NO: 3007529 - RNA, 14 nt, Human
uuucaaauguucuc

SEQ ID NO: 3007530 - RNA, 19 nt, Human
auugauugggcacaucauu

SEQ ID NO: 3007531 - RNA, 23 nt, Human
auugauugggcacaucauuucaa

SEQ ID NO: 3007532 - RNA, 16 nt, Human
auuuauuuauuuauuc

SEQ ID NO: 3007533 - RNA, 14 nt, Human
auuugaaacacugg

SEQ ID NO: 3007534 - RNA, 17 nt, Human
auuugaaacacugguuu

SEQ ID NO: 3007535 - RNA, 21 nt, Human
auuuuuguuuuuauuaaaagg

SEQ ID NO: 3007536 - RNA, 19 nt, Human
auuuuuguuuuuauuaaaa

SEQ ID NO: 3007537 - RNA, 19 nt, Human
auuuuugguauuugaaaca

SEQ ID NO: 3007538 - RNA, 16 nt, Human
auucuuuuugaaaugu

SEQ ID NO: 3007539 - RNA, 18 nt, Human
auugaagcagaguggcag

SEQ ID NO: 3007540 - RNA, 14 nt, Human
auugaagcagagug

SEQ ID NO: 3007541 - RNA, 15 nt, Human
auugaagcagagugg

SEQ ID NO: 3007542 - RNA, 13 nt, Human
auugaagcagagu

SEQ ID NO: 3007543 - RNA, 17 nt, Human
uuuguggaaaauaacuc

SEQ ID NO: 3007544 - RNA, 16 nt, Human
auuauauucauucuuu

SEQ ID NO: 3007545 - RNA, 17 nt, Human
auuauguuaauauuucu

SEQ ID NO: 3007546 - RNA, 13 nt, Human
auuauguuaauau

SEQ ID NO: 3007547 - RNA, 16 nt, Human
auuauguuaauauuuc

SEQ ID NO: 3007548 - RNA, 14 nt, Human
auuauguuaauauu

SEQ ID NO: 3007549 - RNA, 19 nt, Human
cuggauaguccgucucugc

SEQ ID NO: 3007550 - RNA, 18 nt, Human
cuggauaguccgucucug

SEQ ID NO: 3007551 - RNA, 17 nt, Human
cugucggagcccugucu

SEQ ID NO: 3007552 - RNA, 23 nt, Human
cuuugguuauuuuacuuuuugga

SEQ ID NO: 3007553 - RNA, 17 nt, Human
cuuugguuauuuuacuu

SEQ ID NO: 3007554 - RNA, 19 nt, Human
cuuugguuauuuuacuuuu

SEQ ID NO: 3007555 - RNA, 13 nt, Human
cuuugguuauuuu

SEQ ID NO: 3007556 - RNA, 18 nt, Human
cuuuaccaauugaaguaa

SEQ ID NO: 3007557 - RNA, 16 nt, Human
cuuuaccaauugaagu

SEQ ID NO: 3007558 - RNA, 19 nt, Human
cuuuaccaauugaaguaaa

SEQ ID NO: 3007559 - RNA, 20 nt, Human
cuuuaccaauugaaguaaaa

SEQ ID NO: 3007560 - RNA, 22 nt, Human
cuugugaauaaagagggugggu

SEQ ID NO: 3007561 - RNA, 20 nt, Human
gaaagggauuuucagcccuc

SEQ ID NO: 3007562 - RNA, 12 nt, Human
gaaagggauuuu

SEQ ID NO: 3007563 - RNA, 15 nt, Human
gauucuuguauuuau

SEQ ID NO: 3007564 - RNA, 21 nt, Human
gauucuuguauuuauuacaac

SEQ ID NO: 3007565 - RNA, 21 nt, Human
gaugcugucuucguacuggga

SEQ ID NO: 3007566 - RNA, 14 nt, Human
gcaggcuggaguua

SEQ ID NO: 3007567 - RNA, 22 nt, Human
gacuuugguuauuuuacuuuuu

SEQ ID NO: 3007568 - RNA, 21 nt, Human
gacccucucaaacuaacaggc

SEQ ID NO: 3007569 - RNA, 20 nt, Human
ggcacugguuuguucccugu

SEQ ID NO: 3007570 - RNA, 19 nt, Human
ggcccuuuuucaauaacug

SEQ ID NO: 3007571 - RNA, 18 nt, Human
ggcugaacuuuguggucg

SEQ ID NO: 3007572 - RNA, 20 nt, Human
aaaaggaagcuuacaugccu

SEQ ID NO: 3007573 - RNA, 14 nt, Human
guagaauguuuuca

SEQ ID NO: 3007574 - RNA, 16 nt, Human
guagacaguuggguuu

SEQ ID NO: 3007575 - RNA, 23 nt, Human
guagacgugcacgcacacugucu

SEQ ID NO: 3007576 - RNA, 20 nt, Human
guagacgugcacgcacacug

SEQ ID NO: 3007577 - RNA, 21 nt, Human
guacucugccacuuuauuucu

SEQ ID NO: 3007578 - RNA, 14 nt, Human
guaacucuguaauu

SEQ ID NO: 3007579 - RNA, 16 nt, Human
aaagguacuuugcagg

SEQ ID NO: 3007580 - RNA, 14 nt, Human
ggguggggcagugc

SEQ ID NO: 3007581 - RNA, 13 nt, Human
aaagcuuuugcau

SEQ ID NO: 3007582 - RNA, 14 nt, Human
aaagcuuuugcaua

SEQ ID NO: 3007583 - RNA, 21 nt, Human
aaacacauuaaagguacuuug

SEQ ID NO: 3007584 - RNA, 11 nt, Human
aaacacauuaa

SEQ ID NO: 3007585 - RNA, 15 nt, Human
aaacacauuaaaggu

SEQ ID NO: 3007586 - RNA, 23 nt, Human
aaacaugcuguacauacuuuuug

SEQ ID NO: 3007587 - RNA, 16 nt, Human
gcuuguacacucauuc

SEQ ID NO: 3007588 - RNA, 23 nt, Human
ggaacagaagaggaaagagagac

SEQ ID NO: 3007589 - RNA, 19 nt, Human
gcuccaccuugcagcucuc

SEQ ID NO: 3007590 - RNA, 16 nt, Human
gcccucaauugugaaa

SEQ ID NO: 3007591 - RNA, 22 nt, Human
cagaguaggggucugucuuuua

SEQ ID NO: 3007592 - RNA, 23 nt, Human
cagaguaggggucugucuuuuaa

SEQ ID NO: 3007593 - RNA, 20 nt, Human
cagaguaggggucugucuuu

SEQ ID NO: 3007594 - RNA, 13 nt, Human
cauagcugugauu

SEQ ID NO: 3007595 - RNA, 15 nt, Human
cauagcugugauuuu

SEQ ID NO: 3007596 - RNA, 18 nt, Human
cauagcugugauuuuugg

SEQ ID NO: 3007597 - RNA, 14 nt, Human
cauuagguugugaa

SEQ ID NO: 3007598 - RNA, 15 nt, Human
cauuagguugugaau

SEQ ID NO: 3007599 - RNA, 16 nt, Human
cauuagguugugaaug

SEQ ID NO: 3007600 - RNA, 12 nt, Human
auuaaaugacuc

SEQ ID NO: 3007601 - RNA, 13 nt, Human
auuaaaugacucu

SEQ ID NO: 3007602 - RNA, 24 nt, Human
caaacccaguguuuuaggagcaug

SEQ ID NO: 3007603 - RNA, 17 nt, Human
caaacagucucccuucc

SEQ ID NO: 3007604 - RNA, 13 nt, Human
auuuuaugucuuu

SEQ ID NO: 3007605 - RNA, 15 nt, Human
cacaucuguuuugua

SEQ ID NO: 3007606 - RNA, 18 nt, Human
cacccaggaacuccugac

SEQ ID NO: 3007607 - RNA, 13 nt, Human
cacagaagaugaa

SEQ ID NO: 3007608 - RNA, 23 nt, Human
caauugaaguaaaauguggcagg

SEQ ID NO: 3007609 - RNA, 12 nt, Human
ccuaauguguuu

SEQ ID NO: 3007610 - RNA, 14 nt, Human
ccuaauaaaaaggu

SEQ ID NO: 3007611 - RNA, 20 nt, Human
ccuaauaaaaaggugaccau

SEQ ID NO: 3007612 - RNA, 16 nt, Human
ccuaauaaaaagguga

SEQ ID NO: 3007613 - RNA, 15 nt, Human
ccuaauaaaaaggug

SEQ ID NO: 3007614 - RNA, 16 nt, Human
ccauucuuggcccagg

SEQ ID NO: 3007615 - RNA, 22 nt, Human
ccagucauuauguuaauauuuc

SEQ ID NO: 3007616 - RNA, 21 nt, Human
ccagucauuauguuaauauuu

SEQ ID NO: 3007617 - RNA, 20 nt, Human
cccagcacaaagcagauccu

SEQ ID NO: 3007618 - RNA, 17 nt, Human
cucacaauccuugccac

SEQ ID NO: 3007619 - RNA, 21 nt, Human
cugacacaugcugaacaucac

SEQ ID NO: 3007620 - RNA, 14 nt, Human
ccagcacaaagcag

SEQ ID NO: 3007621 - RNA, 13 nt, Human
ccagugagacugu

SEQ ID NO: 3007622 - RNA, 18 nt, Human
ccagugacagucagggaa

SEQ ID NO: 3007623 - RNA, 21 nt, Human
cucagaugcacaugagcuggc

SEQ ID NO: 3007624 - RNA, 23 nt, Human
cucauuuuuauaaugucccuuca

SEQ ID NO: 3007625 - RNA, 20 nt, Human
cuauauaauuccuguuuuua

SEQ ID NO: 3007626 - RNA, 18 nt, Human
cuauauaauuccuguuuu

SEQ ID NO: 3007627 - RNA, 23 nt, Human
cuauucagcacaaggaaauaaaa

SEQ ID NO: 3007628 - RNA, 18 nt, Human
cuauucugagaugacuau

SEQ ID NO: 3007629 - RNA, 15 nt, Human
cuauucugagaugac

SEQ ID NO: 3007630 - RNA, 16 nt, Human
cuauucugagaugacu

SEQ ID NO: 3007631 - RNA, 15 nt, Human
cucacagaagaugaa

SEQ ID NO: 3007632 - RNA, 19 nt, Human
cuauuuauuuauuuauuca

SEQ ID NO: 3007633 - RNA, 12 nt, Human
cuauuuauuuau

SEQ ID NO: 3007634 - RNA, 20 nt, Human
cuaacagcaacacaaagcuu

SEQ ID NO: 3007635 - RNA, 19 nt, Human
cuaauaugaugacuguuuu

SEQ ID NO: 3007636 - RNA, 21 nt, Human
cuaauaugaugacuguuuuua

SEQ ID NO: 3007637 - RNA, 17 nt, Human
cuacauugacagauuga

SEQ ID NO: 3007638 - RNA, 18 nt, Human
cuacauuagguugugaau

SEQ ID NO: 3007639 - RNA, 17 nt, Human
cuacauuagguugugaa

SEQ ID NO: 3007640 - RNA, 21 nt, Human
cuaccaauauuuaaucuuuua

SEQ ID NO: 3007641 - RNA, 15 nt, Human
cuaccaauauuuaau

SEQ ID NO: 3007642 - RNA, 13 nt, Human
cuaccaauauuua

SEQ ID NO: 3007643 - RNA, 21 nt, Human
cuuuuuggguuuauuuggaaa

SEQ ID NO: 3007644 - RNA, 17 nt, Human
gaaaaggccuucuuccc

SEQ ID NO: 3007645 - RNA, 14 nt, Human
cuuugcaggaaauc

SEQ ID NO: 3007646 - RNA, 15 nt, Human
cuuauuuccucauuu

SEQ ID NO: 3007647 - RNA, 15 nt, Human
cuuagugauguaauu

SEQ ID NO: 3007648 - RNA, 16 nt, Human
cuuagugauguaauua

SEQ ID NO: 3007649 - RNA, 22 nt, Human
cuggcacugguuuguucccugu

SEQ ID NO: 3007650 - RNA, 22 nt, Human
cuguaauaaacucauuucuagc

SEQ ID NO: 3007651 - RNA, 21 nt, Human
cugugcaucuagccucaagcu

SEQ ID NO: 3007652 - RNA, 22 nt, Human
gaaugucaguuguuauuuauug

SEQ ID NO: 3007653 - RNA, 21 nt, Human
gaaugucaguuguuauuuauu

SEQ ID NO: 3007654 - RNA, 19 nt, Human
gacagagccccacccucag

SEQ ID NO: 3007655 - RNA, 18 nt, Human
gagguacacuugugaaua

SEQ ID NO: 3007656 - RNA, 12 nt, Human
gagcccugucuc

SEQ ID NO: 3007657 - RNA, 16 nt, Human
gcacauuaaaugacuc

SEQ ID NO: 3007658 - RNA, 21 nt, Human
gcacauuaaaugacucuuccc

SEQ ID NO: 3007659 - RNA, 12 nt, Human
gcacauuaaaug

SEQ ID NO: 3007660 - RNA, 14 nt, Human
gcacauuaaaugac

SEQ ID NO: 3007661 - RNA, 13 nt, Human
gcacacugucugc

SEQ ID NO: 3007662 - RNA, 16 nt, Human
gauguugcuaacagca

SEQ ID NO: 3007663 - RNA, 18 nt, Human
gcaaagaugaaggucugu

SEQ ID NO: 3007664 - RNA, 14 nt, Human
gcaaagaugaaggu

SEQ ID NO: 3007665 - RNA, 15 nt, Human
gauugccuuuuuaua

SEQ ID NO: 3007666 - RNA, 21 nt, Human
gauugccuuuuuauaacuuuu

SEQ ID NO: 3007667 - RNA, 22 nt, Human
gauugccuuuuuauaacuuuuu

SEQ ID NO: 3007668 - RNA, 13 nt, Human
ggauacuuauuua

SEQ ID NO: 3007669 - RNA, 13 nt, Human
ggaaugcaaagau

SEQ ID NO: 3007670 - RNA, 23 nt, Human
ggaaagggauuuucagcccucag

SEQ ID NO: 3007671 - RNA, 21 nt, Human
gcuuaggagaagucuucuauu

SEQ ID NO: 3007672 - RNA, 23 nt, Human
gcugccaauauccuaauaaaaag

SEQ ID NO: 3007673 - RNA, 21 nt, Human
gcugccaauauccuaauaaaa

SEQ ID NO: 3007674 - RNA, 20 nt, Human
gcugccaauauccuaauaaa

SEQ ID NO: 3007675 - RNA, 14 nt, Human
gcccuuuuucaaua

SEQ ID NO: 3007676 - RNA, 18 nt, Human
gccuaauaugaugacugu

SEQ ID NO: 3007677 - RNA, 17 nt, Human
gcucaccccaucauccc

SEQ ID NO: 3007678 - RNA, 19 nt, Human
gcucaccccaucaucccuu

SEQ ID NO: 3007679 - RNA, 13 nt, Human
gcugcaguuuuuu

SEQ ID NO: 3007680 - RNA, 15 nt, Human
gcugccaauauccua

SEQ ID NO: 3007681 - RNA, 14 nt, Human
gcugccaauauccu

SEQ ID NO: 3007682 - RNA, 19 nt, Human
gcugccaauauccuaauaa

SEQ ID NO: 3007683 - RNA, 18 nt, Human
gcugccaauauccuaaua

SEQ ID NO: 3007684 - RNA, 17 nt, Human
gcugccaauauccuaau

SEQ ID NO: 3007685 - RNA, 16 nt, Human
gcugccaauauccuaa

SEQ ID NO: 3007686 - RNA, 22 nt, Human
guaacuguuuagaugaauguca

SEQ ID NO: 3007687 - RNA, 10 nt, Human
gguugugaau

SEQ ID NO: 3007688 - RNA, 18 nt, Human
guaaaaaaugguguuuua

SEQ ID NO: 3007689 - RNA, 16 nt, Human
guaaaaaaugguguuu

SEQ ID NO: 3007690 - RNA, 14 nt, Human
guacuuuuaagacu

SEQ ID NO: 3007691 - RNA, 15 nt, Human
guagagguacacuug

SEQ ID NO: 3007692 - RNA, 17 nt, Human
guagagguacacuugug

SEQ ID NO: 3007693 - RNA, 19 nt, Human
guagagguacacuugugaa

SEQ ID NO: 3007694 - RNA, 18 nt, Human
guacuaacauuuauuuga

SEQ ID NO: 3007695 - RNA, 19 nt, Human
guacauacuuuuuggguuu

SEQ ID NO: 3007696 - RNA, 13 nt, Human
guacauacuuuuu

SEQ ID NO: 3007697 - RNA, 14 nt, Human
guacauacuuuuug

SEQ ID NO: 3007698 - RNA, 15 nt, Human
guacacuugugaaua

SEQ ID NO: 3007699 - RNA, 14 nt, Human
guacacuugugaau

SEQ ID NO: 3007700 - RNA, 21 nt, Human
ggguagccacuggacugacga

SEQ ID NO: 3007701 - RNA, 23 nt, Human
gguagaauguuuucaaauguucu

SEQ ID NO: 3007702 - RNA, 13 nt, Human
gucaaggcuuaga

SEQ ID NO: 3007703 - RNA, 20 nt, Human
guagagguacacuugugaau

SEQ ID NO: 3007704 - RNA, 19 nt, Human
guccuauuauauucauucu

SEQ ID NO: 3007705 - RNA, 21 nt, Human
guccuauuauauucauucuuu

SEQ ID NO: 3007706 - RNA, 21 nt, Human
guccugucggagcccugucuc

SEQ ID NO: 3007707 - RNA, 20 nt, Human
guccugucggagcccugucu

SEQ ID NO: 3007708 - RNA, 18 nt, Human
guccugucggagcccugu

SEQ ID NO: 3007709 - RNA, 24 nt, Human
gugcuuggcccaggaguuuggcca

SEQ ID NO: 3007710 - RNA, 19 nt, Human
gugcuuggcccaggaguuu

SEQ ID NO: 3007711 - RNA, 17 nt, Human
gugcuuggcccaggagu

SEQ ID NO: 3007712 - RNA, 16 nt, Human
gugcuuggcccaggag

SEQ ID NO: 3007713 - RNA, 15 nt, Human
gugcuuggcccagga

SEQ ID NO: 3007714 - RNA, 14 nt, Human
gugcuuggcccagg

SEQ ID NO: 3007715 - RNA, 13 nt, Human
gugcuuggcccag

SEQ ID NO: 3007716 - RNA, 14 nt, Human
guggaaaauaacuc

SEQ ID NO: 3007717 - RNA, 12 nt, Human
ucaaauguguac

SEQ ID NO: 3007718 - RNA, 15 nt, Human
uauuuaaauagauga

SEQ ID NO: 3007719 - RNA, 17 nt, Human
uauuuaaauagaugaca

SEQ ID NO: 3007720 - RNA, 18 nt, Human
uauuugaaacacugguuu

SEQ ID NO: 3007721 - RNA, 23 nt, Human
uauugcauacuauuaaacaugcu

SEQ ID NO: 3007722 - RNA, 19 nt, Human
uauugcauacuauuaaaca

SEQ ID NO: 3007723 - RNA, 23 nt, Human
uauucauucuuuuugaaauguca

SEQ ID NO: 3007724 - RNA, 18 nt, Human
uauucauucuuuuugaaa

SEQ ID NO: 3007725 - RNA, 23 nt, Human
uauuauauucauucuuuuugaaa

SEQ ID NO: 3007726 - RNA, 17 nt, Human
uauuauauucauucuuu

SEQ ID NO: 3007727 - RNA, 13 nt, Human
uauuauauucauu

SEQ ID NO: 3007728 - RNA, 13 nt, Human
uauguguucuauu

SEQ ID NO: 3007729 - RNA, 14 nt, Human
uauguuaauauuuu

SEQ ID NO: 3007730 - RNA, 16 nt, Human
uauguuaauauuucug

SEQ ID NO: 3007731 - RNA, 13 nt, Human
uauguuaauauuu

SEQ ID NO: 3007732 - RNA, 18 nt, Human
uaucuguucauauggaua

SEQ ID NO: 3007733 - RNA, 23 nt, Human
uaugauugccuuuuuauaacuuu

SEQ ID NO: 3007734 - RNA, 20 nt, Human
uaugauugccuuuuuauaac

SEQ ID NO: 3007735 - RNA, 16 nt, Human
uccuccacauuuguuu

SEQ ID NO: 3007736 - RNA, 13 nt, Human
uccuccacauuug

SEQ ID NO: 3007737 - RNA, 22 nt, Human
uccucauuuuuauaaugucccu

SEQ ID NO: 3007738 - RNA, 17 nt, Human
uccuagucauucuuccc

SEQ ID NO: 3007739 - RNA, 15 nt, Human
ucccuuggacauuuu

SEQ ID NO: 3007740 - RNA, 21 nt, Human
ucccuuggacauuuuaugucu

SEQ ID NO: 3007741 - RNA, 19 nt, Human
ucccuuggacauuuuaugu

SEQ ID NO: 3007742 - RNA, 18 nt, Human
ucccuuggacauuuuaug

SEQ ID NO: 3007743 - RNA, 16 nt, Human
ucccuuggacauuuua

SEQ ID NO: 3007744 - RNA, 20 nt, Human
ucccuucacaaacccagugu

SEQ ID NO: 3007745 - RNA, 22 nt, Human
uccugucggagcccugucuccu

SEQ ID NO: 3007746 - RNA, 13 nt, Human
ugaaaugucaacc

SEQ ID NO: 3007747 - RNA, 17 nt, Human
ugaacaguaacauagcu

SEQ ID NO: 3007748 - RNA, 22 nt, Human
ugauugccuuuuuauaacuuuu

SEQ ID NO: 3007749 - RNA, 17 nt, Human
ugauugccuuuuuauaa

SEQ ID NO: 3007750 - RNA, 15 nt, Human
ugauuuaaacacauu

SEQ ID NO: 3007751 - RNA, 18 nt, Human
ugauuuaaacacauuaaa

SEQ ID NO: 3007752 - RNA, 16 nt, Human
ugauuuaaacacauua

SEQ ID NO: 3007753 - RNA, 17 nt, Human
ugauuuaaacacauuaa

SEQ ID NO: 3007754 - RNA, 23 nt, Human
ugauugggcacaucauuucaaga

SEQ ID NO: 3007755 - RNA, 18 nt, Human
ugauugggcacaucauuu

SEQ ID NO: 3007756 - RNA, 20 nt, Human
ugauugggcacaucauuuca

SEQ ID NO: 3007757 - RNA, 21 nt, Human
ugauugggcacaucauuucaa

SEQ ID NO: 3007758 - RNA, 17 nt, Human
ugauugggcacaucauu

SEQ ID NO: 3007759 - RNA, 21 nt, Human
ugcuguucacuggacacuuca

SEQ ID NO: 3007760 - RNA, 19 nt, Human
ugcugccaauauccuaaua

SEQ ID NO: 3007761 - RNA, 18 nt, Human
ugcugccaauauccuaau

SEQ ID NO: 3007762 - RNA, 17 nt, Human
ugcugccaauauccuaa

SEQ ID NO: 3007763 - RNA, 16 nt, Human
ugcugccaauauccua

SEQ ID NO: 3007764 - RNA, 15 nt, Human
ugcugccaauauccu

SEQ ID NO: 3007765 - RNA, 21 nt, Human
ugcugccaauauccuaauaaa

SEQ ID NO: 3007766 - RNA, 15 nt, Human
ugcauauugcauacu

SEQ ID NO: 3007767 - RNA, 23 nt, Human
ugcauauugcauacuauuaaaca

SEQ ID NO: 3007768 - RNA, 16 nt, Human
ugcagggacagagcau

SEQ ID NO: 3007769 - RNA, 19 nt, Human
uggaucuguauguguucua

SEQ ID NO: 3007770 - RNA, 18 nt, Human
uggguauagauguugcua

SEQ ID NO: 3007771 - RNA, 14 nt, Human
uggguauagauguu

SEQ ID NO: 3007772 - RNA, 22 nt, Human
uggugauuuagcaggaagcugu

SEQ ID NO: 3007773 - RNA, 16 nt, Human
uggugauuuagcagga

SEQ ID NO: 3007774 - RNA, 14 nt, Human
uggucaacauuucu

SEQ ID NO: 3007775 - RNA, 15 nt, Human
ugguauuugaaacac

SEQ ID NO: 3007776 - RNA, 21 nt, Human
uuaaacucugagugcaaacuu

SEQ ID NO: 3007777 - RNA, 19 nt, Human
uuaaugguaguuuuacagu

SEQ ID NO: 3007778 - RNA, 22 nt, Human
uuaguagagguacacuugugaa

SEQ ID NO: 3007779 - RNA, 23 nt, Human
uuaguagagguacacuugugaau

SEQ ID NO: 3007780 - RNA, 20 nt, Human
uuaggagaagucuucuauuu

SEQ ID NO: 3007781 - RNA, 20 nt, Human
uuagacccucaugcugccaa

SEQ ID NO: 3007782 - RNA, 19 nt, Human
uuagacccucaugcugcca

SEQ ID NO: 3007783 - RNA, 13 nt, Human
uuacuuuaaacua

SEQ ID NO: 3007784 - RNA, 15 nt, Human
uuauuuuacuuuuug

SEQ ID NO: 3007785 - RNA, 13 nt, Human
uuauuuuacuuuu

SEQ ID NO: 3007786 - RNA, 15 nt, Human
uuauugauguuuuca

SEQ ID NO: 3007787 - RNA, 13 nt, Human
uuauugaagcaga

SEQ ID NO: 3007788 - RNA, 15 nt, Human
uuauugaagcagagu

SEQ ID NO: 3007789 - RNA, 16 nt, Human
uuauugaagcagagug

SEQ ID NO: 3007790 - RNA, 17 nt, Human
uuauugaagcagagugg

SEQ ID NO: 3007791 - RNA, 12 nt, Human
uuauugaagcag

SEQ ID NO: 3007792 - RNA, 19 nt, Human
uuuacaguguuucuggcuu

SEQ ID NO: 3007793 - RNA, 17 nt, Human
uuuacaguguuucuggc

SEQ ID NO: 3007794 - RNA, 23 nt, Human
uuuauccuagucauucuucccua

SEQ ID NO: 3007795 - RNA, 15 nt, Human
uuuaucuguucauau

SEQ ID NO: 3007796 - RNA, 16 nt, Human
uuuaucuguucauaug

SEQ ID NO: 3007797 - RNA, 22 nt, Human
uuuauccuagucauucuucccu

SEQ ID NO: 3007798 - RNA, 23 nt, Human
uuguuuaaugguaguuuuacagu

SEQ ID NO: 3007799 - RNA, 12 nt, Human
uuguuuaauggu

SEQ ID NO: 3007800 - RNA, 15 nt, Human
uuguuauuuauugaa

SEQ ID NO: 3007801 - RNA, 20 nt, Human
uuguuauuuauugaaaugau

SEQ ID NO: 3007802 - RNA, 14 nt, Human
uuuaaacacauuaa

SEQ ID NO: 3007803 - RNA, 15 nt, Human
uuuaaacacauuaaa

SEQ ID NO: 3007804 - RNA, 15 nt, Human
uuuaaacuacauuag

SEQ ID NO: 3007805 - RNA, 21 nt, Human
uuugaagguagaauguuuuca

SEQ ID NO: 3007806 - RNA, 20 nt, Human
uuugccaauuugcacauuaa

SEQ ID NO: 3007807 - RNA, 15 nt, Human
uuugccaauuugcac

SEQ ID NO: 3007808 - RNA, 22 nt, Human
uuugguugguaacucuguaauu

SEQ ID NO: 3007809 - RNA, 13 nt, Human
uuugguuauuuua

SEQ ID NO: 3007810 - RNA, 14 nt, Human
uuugguuauuuuac

SEQ ID NO: 3007811 - RNA, 17 nt, Human
uuuggguuuauuuggaa

SEQ ID NO: 3007812 - RNA, 22 nt, Human
uuucacaguguguggucaacau

SEQ ID NO: 3007813 - RNA, 13 nt, Human
uucuuguauuuau

SEQ ID NO: 3007814 - RNA, 14 nt, Human
uugaagcagagugg

SEQ ID NO: 3007815 - RNA, 12 nt, Human
uugaagcagagu

SEQ ID NO: 3007816 - RNA, 13 nt, Human
uugaagauucuau

SEQ ID NO: 3007817 - RNA, 23 nt, Human
uugaagauucuauguuaauauuu

SEQ ID NO: 3007818 - RNA, 22 nt, Human
uugaagauucuauguuaauauu

SEQ ID NO: 3007819 - RNA, 15 nt, Human
uugaaacacugguuu

SEQ ID NO: 3007820 - RNA, 23 nt, Human
uugcagcucuccccuucucugua

SEQ ID NO: 3007821 - RNA, 18 nt, Human
uugguaacucuguaauuc

SEQ ID NO: 3007822 - RNA, 20 nt, Human
uugggcacaucauuucaaga

SEQ ID NO: 3007823 - RNA, 17 nt, Human
uugccuuuuuauaacuu

SEQ ID NO: 3007824 - RNA, 18 nt, Human
uugccuuggcugcaguuu

SEQ ID NO: 3007825 - RNA, 16 nt, Human
uugcugcuuguacacu

SEQ ID NO: 3007826 - RNA, 21 nt, Human
uugcugcugauuuaaacacau

SEQ ID NO: 3007827 - RNA, 17 nt, Human
uugcugcugauuuaaac

SEQ ID NO: 3007828 - RNA, 19 nt, Human
uugcugcugauuuaaacac

SEQ ID NO: 3007829 - RNA, 23 nt, Human
uugcuaacagcaacacaaagcuu

SEQ ID NO: 3007830 - RNA, 17 nt, Human
uuuguguacuuuuaaga

SEQ ID NO: 3007831 - RNA, 13 nt, Human
uuuguguacuuuu

SEQ ID NO: 3007832 - RNA, 14 nt, Human
uuuguguacuuuua

SEQ ID NO: 3007833 - RNA, 17 nt, Human
cugccaauauccuaaua

SEQ ID NO: 3007834 - RNA, 16 nt, Human
cugccaauauccuaau

SEQ ID NO: 3007835 - RNA, 14 nt, Human
cugccaauauccua

SEQ ID NO: 3007836 - RNA, 13 nt, Human
cugccaauauccu

SEQ ID NO: 3007837 - RNA, 22 nt, Human
cugccaauauccuaauaaaaag

SEQ ID NO: 3007838 - RNA, 20 nt, Human
cugccaauauccuaauaaaa

SEQ ID NO: 3007839 - RNA, 19 nt, Human
cugccaauauccuaauaaa

SEQ ID NO: 3007840 - RNA, 18 nt, Human
cugccaauauccuaauaa

SEQ ID NO: 3007841 - RNA, 16 nt, Human
cugguuuguucccugu

SEQ ID NO: 3007842 - RNA, 22 nt, Human
cugguuuuaaauauuuugacuu

SEQ ID NO: 3007843 - RNA, 22 nt, Human
cuuuuaugauugccuuuuuaua

SEQ ID NO: 3007844 - RNA, 23 nt, Human
cuuuugcauauugcauacuauua

SEQ ID NO: 3007845 - RNA, 20 nt, Human
gaaaaaauuuacuuuaaacu

SEQ ID NO: 3007846 - RNA, 22 nt, Human
cuucuauuuauuuauuuauuca

SEQ ID NO: 3007847 - RNA, 17 nt, Human
cuucaguuugcagagua

SEQ ID NO: 3007848 - RNA, 16 nt, Human
cuucaguuugcagagu

SEQ ID NO: 3007849 - RNA, 17 nt, Human
cuucacgcccuuggcca

SEQ ID NO: 3007850 - RNA, 15 nt, Human
cuucacgcccuuggc

SEQ ID NO: 3007851 - RNA, 13 nt, Human
gauacuuauuuaa

SEQ ID NO: 3007852 - RNA, 19 nt, Human
gauacuuauuuaaauagau

SEQ ID NO: 3007853 - RNA, 16 nt, Human
gauacuuauuuaaaua

SEQ ID NO: 3007854 - RNA, 14 nt, Human
gaguuuggccagaa

SEQ ID NO: 3007855 - RNA, 13 nt, Human
gaguuuggccaga

SEQ ID NO: 3007856 - RNA, 12 nt, Human
gaguuuggccag

SEQ ID NO: 3007857 - RNA, 21 nt, Human
gagugcucaguagucagacug

SEQ ID NO: 3007858 - RNA, 15 nt, Human
gcaguacuaacauuu

SEQ ID NO: 3007859 - RNA, 21 nt, Human
gcaguacuaacauuuauuuga

SEQ ID NO: 3007860 - RNA, 22 nt, Human
gcaguaaaaaaugguguuuuau

SEQ ID NO: 3007861 - RNA, 19 nt, Human
gcaguaaaaaaugguguuu

SEQ ID NO: 3007862 - RNA, 21 nt, Human
gcacaugagcuggcgggauug

SEQ ID NO: 3007863 - RNA, 15 nt, Human
gcacaucuguuuugu

SEQ ID NO: 3007864 - RNA, 13 nt, Human
gacuauuuuuguu

SEQ ID NO: 3007865 - RNA, 17 nt, Human
gacuauuuuuguuuuua

SEQ ID NO: 3007866 - RNA, 18 nt, Human
gacuauuuuuguuuuuau

SEQ ID NO: 3007867 - RNA, 21 nt, Human
gacuauuuuuguuuuuauuaa

SEQ ID NO: 3007868 - RNA, 22 nt, Human
gacuauuuuuguuuuuauuaaa

SEQ ID NO: 3007869 - RNA, 21 nt, Human
gagaagucuucuauuuauuua

SEQ ID NO: 3007870 - RNA, 20 nt, Human
gagaagucuucuauuuauuu

SEQ ID NO: 3007871 - RNA, 20 nt, Human
ggcccaggaguuuggccaga

SEQ ID NO: 3007872 - RNA, 19 nt, Human
ggcccaggaguuuggccag

SEQ ID NO: 3007873 - RNA, 18 nt, Human
ggcccaggaguuuggcca

SEQ ID NO: 3007874 - RNA, 13 nt, Human
ggcccaggaguuu

SEQ ID NO: 3007875 - RNA, 11 nt, Human
ggcccaggagu

SEQ ID NO: 3007876 - RNA, 18 nt, Human
ggaucuguauguguucua

SEQ ID NO: 3007877 - RNA, 19 nt, Human
ggaucuguauguguucuau

SEQ ID NO: 3007878 - RNA, 13 nt, Human
ggaguuuggccag

SEQ ID NO: 3007879 - RNA, 15 nt, Human
ggaguuuggccagaa

SEQ ID NO: 3007880 - RNA, 14 nt, Human
ggaguuuggccaga

SEQ ID NO: 3007881 - RNA, 22 nt, Human
aaaagggguaggguuuaaagau

SEQ ID NO: 3007882 - RNA, 19 nt, Human
gggcccuuuuucaauaacu

SEQ ID NO: 3007883 - RNA, 16 nt, Human
aaacagucucccuucc

SEQ ID NO: 3007884 - RNA, 22 nt, Human
aaauaaggaaugauauaagguu

SEQ ID NO: 3007885 - RNA, 18 nt, Human
gguggggcagugcuuggc

SEQ ID NO: 3007886 - RNA, 12 nt, Human
gguuucuagcau

SEQ ID NO: 3007887 - RNA, 11 nt, Human
gguuuauuugg

SEQ ID NO: 3007888 - RNA, 21 nt, Human
ggucuguuuuguguacuuuua

SEQ ID NO: 3007889 - RNA, 15 nt, Human
gguacacuugugaau

SEQ ID NO: 3007890 - RNA, 18 nt, Human
gccccacccucagaugca

SEQ ID NO: 3007891 - RNA, 15 nt, Human
gccccacccucagau

SEQ ID NO: 3007892 - RNA, 17 nt, Human
gcccaggaguuuggcca

SEQ ID NO: 3007893 - RNA, 13 nt, Human
gcccaggaguuug

SEQ ID NO: 3007894 - RNA, 16 nt, Human
gcccaggaguuuggcc

SEQ ID NO: 3007895 - RNA, 15 nt, Human
gcccaggaguuuggc

SEQ ID NO: 3007896 - RNA, 22 nt, Human
gcuggaguuauugaagcagagu

SEQ ID NO: 3007897 - RNA, 22 nt, Human
gcuguacauacuuuuuggguuu

SEQ ID NO: 3007898 - RNA, 17 nt, Human
gcuguacauacuuuuug

SEQ ID NO: 3007899 - RNA, 22 nt, Human
gcuuaauuauugauguuuucau

SEQ ID NO: 3007900 - RNA, 17 nt, Human
gcuuauuuccucauuuu

SEQ ID NO: 3007901 - RNA, 12 nt, Human
gcugaacaucac

SEQ ID NO: 3007902 - RNA, 22 nt, Human
cuccagucauuauguuaauauu

SEQ ID NO: 3007903 - RNA, 12 nt, Human
cucaugcugcca

SEQ ID NO: 3007904 - RNA, 22 nt, Human
cucaugcugccaauauccuaau

SEQ ID NO: 3007905 - RNA, 14 nt, Human
cucaugcugccaau

SEQ ID NO: 3007906 - RNA, 13 nt, Human
cucuauuucugga

SEQ ID NO: 3007907 - RNA, 21 nt, Human
ccuuggacauuuuaugucuuu

SEQ ID NO: 3007908 - RNA, 18 nt, Human
ccuuggacauuuuauguc

SEQ ID NO: 3007909 - RNA, 16 nt, Human
ccuuggacauuuuaug

SEQ ID NO: 3007910 - RNA, 22 nt, Human
cuauaacaaaggauacuuauuu

SEQ ID NO: 3007911 - RNA, 18 nt, Human
cuauaacaaaggauacuu

SEQ ID NO: 3007912 - RNA, 16 nt, Human
cuagcaugaagacaga

SEQ ID NO: 3007913 - RNA, 13 nt, Human
cccuucucuguau

SEQ ID NO: 3007914 - RNA, 24 nt, Human
ccguagacgugcacgcacacuguc

SEQ ID NO: 3007915 - RNA, 13 nt, Human
caaacccaguguu

SEQ ID NO: 3007916 - RNA, 21 nt, Human
auuugccuaauaugaugacug

SEQ ID NO: 3007917 - RNA, 18 nt, Human
auuuguggaaaauaacuc

SEQ ID NO: 3007918 - RNA, 18 nt, Human
auuuggaaaggaaugcaa

SEQ ID NO: 3007919 - RNA, 15 nt, Human
auuuggaaaggaaug

SEQ ID NO: 3007920 - RNA, 14 nt, Human
auuagguugugaau

SEQ ID NO: 3007921 - RNA, 15 nt, Human
auuagguugugaaug

SEQ ID NO: 3007922 - RNA, 13 nt, Human
auuagguugugaa

SEQ ID NO: 3007923 - RNA, 17 nt, Human
auuacaacucuauuuaa

SEQ ID NO: 3007924 - RNA, 20 nt, Human
auuaaugucaguauuucaac

SEQ ID NO: 3007925 - RNA, 17 nt, Human
auugcugcuuguacacu

SEQ ID NO: 3007926 - RNA, 14 nt, Human
cacugguuugguuc

SEQ ID NO: 3007927 - RNA, 22 nt, Human
caugcugccaauauccuaauaa

SEQ ID NO: 3007928 - RNA, 21 nt, Human
caugcugccaauauccuaaua

SEQ ID NO: 3007929 - RNA, 19 nt, Human
caugcugccaauauccuaa

SEQ ID NO: 3007930 - RNA, 17 nt, Human
caugcugccaauauccu

SEQ ID NO: 3007931 - RNA, 15 nt, Human
caugcugccaauauc

SEQ ID NO: 3007932 - RNA, 11 nt, Human
caguuugguug

SEQ ID NO: 3007933 - RNA, 21 nt, Human
caguuugguugguaacucugu

SEQ ID NO: 3007934 - RNA, 14 nt, Human
caguuugcagagua

SEQ ID NO: 3007935 - RNA, 14 nt, Human
cauuucaagaaguc

SEQ ID NO: 3007936 - RNA, 20 nt, Human
caguaaaaaaugguguuuua

SEQ ID NO: 3007937 - RNA, 21 nt, Human
caguaaaaaaugguguuuuau

SEQ ID NO: 3007938 - RNA, 20 nt, Human
aacuacauuagguugugaau

SEQ ID NO: 3007939 - RNA, 12 nt, Human
aacucauuucua

SEQ ID NO: 3007940 - RNA, 14 nt, Human
gucuucuauuuauu

SEQ ID NO: 3007941 - RNA, 12 nt, Human
gucuucuauuua

SEQ ID NO: 3007942 - RNA, 17 nt, Human
gucuucuauuuauuuau

SEQ ID NO: 3007943 - RNA, 20 nt, Human
aacugggaugaggugacuau

SEQ ID NO: 3007944 - RNA, 19 nt, Human
aacucugagugcaaacuuc

SEQ ID NO: 3007945 - RNA, 18 nt, Human
aacucugagugcaaacuu

SEQ ID NO: 3007946 - RNA, 20 nt, Human
aacucugagugcaaacuuca

SEQ ID NO: 3007947 - RNA, 22 nt, Human
aacucugagugcaaacuucaga

SEQ ID NO: 3007948 - RNA, 21 nt, Human
aacacaaagcuuuugcauauu

SEQ ID NO: 3007949 - RNA, 21 nt, Human
gucaguuguuauuuauugaaa

SEQ ID NO: 3007950 - RNA, 18 nt, Human
gucaguuguuauuuauug

SEQ ID NO: 3007951 - RNA, 17 nt, Human
gucaguuguuauuuauu

SEQ ID NO: 3007952 - RNA, 16 nt, Human
gucaguuguuauuuau

SEQ ID NO: 3007953 - RNA, 12 nt, Human
aaauuuguggaa

SEQ ID NO: 3007954 - RNA, 17 nt, Human
aaaugguguuuuaucuu

SEQ ID NO: 3007955 - RNA, 18 nt, Human
aaaugguguuuuaucuuc

SEQ ID NO: 3007956 - RNA, 22 nt, Human
guuuauuuggaaaggaaugcaa

SEQ ID NO: 3007957 - RNA, 17 nt, Human
guuuaaugguaguuuua

SEQ ID NO: 3007958 - RNA, 12 nt, Human
guuuaaugguag

SEQ ID NO: 3007959 - RNA, 16 nt, Human
aaggauacuuauuuaa

SEQ ID NO: 3007960 - RNA, 13 nt, Human
aaggauacuuauu

SEQ ID NO: 3007961 - RNA, 14 nt, Human
guugcuaacagcaa

SEQ ID NO: 3007962 - RNA, 17 nt, Human
aagucuucuauuuauuu

SEQ ID NO: 3007963 - RNA, 13 nt, Human
aagucuucuauuu

SEQ ID NO: 3007964 - RNA, 16 nt, Human
guuauugaagcagagu

SEQ ID NO: 3007965 - RNA, 17 nt, Human
guuauugaagcagagug

SEQ ID NO: 3007966 - RNA, 18 nt, Human
guuauugaagcagagugg

SEQ ID NO: 3007967 - RNA, 18 nt, Human
aagaugaaggucuguuuu

SEQ ID NO: 3007968 - RNA, 13 nt, Human
gugucauuucaaa

SEQ ID NO: 3007969 - RNA, 23 nt, Human
aauagcagcccucaauugugaaa

SEQ ID NO: 3007970 - RNA, 22 nt, Human
aauagcagcccucaauugugaa

SEQ ID NO: 3007971 - RNA, 21 nt, Human
aauagcaaggcugugcaucua

SEQ ID NO: 3007972 - RNA, 21 nt, Human
uaacaaaggauacuuauuuaa

SEQ ID NO: 3007973 - RNA, 19 nt, Human
uaacaaaggauacuuauuu

SEQ ID NO: 3007974 - RNA, 20 nt, Human
uaacaaaggauacuuauuua

SEQ ID NO: 3007975 - RNA, 15 nt, Human
uaacaaaggauacuu

SEQ ID NO: 3007976 - RNA, 16 nt, Human
uaacaaaggauacuua

SEQ ID NO: 3007977 - RNA, 17 nt, Human
uaacaaaggauacuuau

SEQ ID NO: 3007978 - RNA, 18 nt, Human
uaacaaaggauacuuauu

SEQ ID NO: 3007979 - RNA, 21 nt, Human
uaacuaucacugguuugguuc

SEQ ID NO: 3007980 - RNA, 16 nt, Human
uaacuaucacugguuu

SEQ ID NO: 3007981 - RNA, 12 nt, Human
uaauaaaaaggu

SEQ ID NO: 3007982 - RNA, 15 nt, Human
uaauaaaaaggugac

SEQ ID NO: 3007983 - RNA, 14 nt, Human
uaauaaaaagguga

SEQ ID NO: 3007984 - RNA, 23 nt, Human
aauauuuugacuuguugagggua

SEQ ID NO: 3007985 - RNA, 22 nt, Human
aaugcuugcugcugauuuaaac

SEQ ID NO: 3007986 - RNA, 23 nt, Human
aaugcuugcugcugauuuaaaca

SEQ ID NO: 3007987 - RNA, 18 nt, Human
aaugcuugcugcugauuu

SEQ ID NO: 3007988 - RNA, 20 nt, Human
aaugcuugcugcugauuuaa

SEQ ID NO: 3007989 - RNA, 22 nt, Human
aauguucacugguacucugcca

SEQ ID NO: 3007990 - RNA, 16 nt, Human
uacauuagguugugaa

SEQ ID NO: 3007991 - RNA, 17 nt, Human
uacauuagguugugaau

SEQ ID NO: 3007992 - RNA, 23 nt, Human
uauauagcaguaaaaaauggugu

SEQ ID NO: 3007993 - RNA, 10 nt, Human
uauagauguu

SEQ ID NO: 3007994 - RNA, 21 nt, Human
uauagauguugcuaacagcaa

SEQ ID NO: 3007995 - RNA, 15 nt, Human
uauagauguugcuaa

SEQ ID NO: 3007996 - RNA, 20 nt, Human
uauagauguugcuaacagca

SEQ ID NO: 3007997 - RNA, 18 nt, Human
uauagcaguaaaaaaugg

SEQ ID NO: 3007998 - RNA, 15 nt, Human
uauauagcaguaaaa

SEQ ID NO: 3007999 - RNA, 20 nt, Human
uauauagcaagacauuauau

SEQ ID NO: 3008000 - RNA, 16 nt, Human
uauauagcaguaaaaa

SEQ ID NO: 3008001 - RNA, 18 nt, Human
uauauagcaagacauuau

SEQ ID NO: 3008002 - RNA, 15 nt, Human
uauccaauugcugcu

SEQ ID NO: 3008003 - RNA, 23 nt, Human
uauccaauugcugcuuguacacu

SEQ ID NO: 3008004 - RNA, 14 nt, Human
uauccaaucuguga

SEQ ID NO: 3008005 - RNA, 16 nt, Human
acacucauucauuacu

SEQ ID NO: 3008006 - RNA, 20 nt, Human
uaugugcacaucuguuuugu

SEQ ID NO: 3008007 - RNA, 18 nt, Human
uagagguacacuugugaa

SEQ ID NO: 3008008 - RNA, 13 nt, Human
uagagguacacuu

SEQ ID NO: 3008009 - RNA, 22 nt, Human
uaggggucugucuuuuaaacuc

SEQ ID NO: 3008010 - RNA, 20 nt, Human
acacaaagcuuuugcauauu

SEQ ID NO: 3008011 - RNA, 18 nt, Human
acacaaagcuuuugcaua

SEQ ID NO: 3008012 - RNA, 19 nt, Human
acacaaagcuuuugcauau

SEQ ID NO: 3008013 - RNA, 15 nt, Human
acucuucccucaaau

SEQ ID NO: 3008014 - RNA, 20 nt, Human
accugcacacuguccuauua

SEQ ID NO: 3008015 - RNA, 17 nt, Human
acgcccuuggccauggg

SEQ ID NO: 3008016 - RNA, 14 nt, Human
uauuuugacuuguu

SEQ ID NO: 3008017 - RNA, 20 nt, Human
uauuuugacuuguugagggu

SEQ ID NO: 3008018 - RNA, 22 nt, Human
ucacagcuuauuuccucauuuu

SEQ ID NO: 3008019 - RNA, 16 nt, Human
ucaauugugaaaaaau

SEQ ID NO: 3008020 - RNA, 20 nt, Human
ucaauugugaaaaaauuuac

SEQ ID NO: 3008021 - RNA, 14 nt, Human
ucacagaagaugaa

SEQ ID NO: 3008022 - RNA, 15 nt, Human
acauuuuaugucuuu

SEQ ID NO: 3008023 - RNA, 13 nt, Human
acauuuuaugucu

SEQ ID NO: 3008024 - RNA, 13 nt, Human
ucagcccucagaa

SEQ ID NO: 3008025 - RNA, 12 nt, Human
ucagcccucaga

SEQ ID NO: 3008026 - RNA, 15 nt, Human
ucaguuugcagagua

SEQ ID NO: 3008027 - RNA, 16 nt, Human
ucaguuugcagaguag

SEQ ID NO: 3008028 - RNA, 12 nt, Human
ucaguuugguug

SEQ ID NO: 3008029 - RNA, 16 nt, Human
ucaguuuaucuguuca

SEQ ID NO: 3008030 - RNA, 14 nt, Human
ucaguuuaucuguu

SEQ ID NO: 3008031 - RNA, 20 nt, Human
ucaguuguuauuuauugaaa

SEQ ID NO: 3008032 - RNA, 15 nt, Human
ucaguuguuauuuau

SEQ ID NO: 3008033 - RNA, 13 nt, Human
ucaguagucagac

SEQ ID NO: 3008034 - RNA, 18 nt, Human
acuguccuauuauauuca

SEQ ID NO: 3008035 - RNA, 16 nt, Human
acuguccuauuauauu

SEQ ID NO: 3008036 - RNA, 15 nt, Human
acuguccuauuauau

SEQ ID NO: 3008037 - RNA, 12 nt, Human
ucuagcaugaag

SEQ ID NO: 3008038 - RNA, 17 nt, Human
agaacuauguuuuuguu

SEQ ID NO: 3008039 - RNA, 16 nt, Human
agaauaaaccaagaau

SEQ ID NO: 3008040 - RNA, 16 nt, Human
ucuggauucauauuua

SEQ ID NO: 3008041 - RNA, 19 nt, Human
ucuggauucauauuuaauu

SEQ ID NO: 3008042 - RNA, 19 nt, Human
ugaagguagaauguuuuca

SEQ ID NO: 3008043 - RNA, 18 nt, Human
ugaagguagaauguuuuc

SEQ ID NO: 3008044 - RNA, 14 nt, Human
ugaauuugccuaau

SEQ ID NO: 3008045 - RNA, 14 nt, Human
agcaagacauuaua

SEQ ID NO: 3008046 - RNA, 12 nt, Human
agauguugcuaa

SEQ ID NO: 3008047 - RNA, 23 nt, Human
ugacuauuuuuguuuuuauuaaa

SEQ ID NO: 3008048 - RNA, 23 nt, Human
agagcaguuugguuucuagcaug

SEQ ID NO: 3008049 - RNA, 21 nt, Human
agagcaguuugguuucuagca

SEQ ID NO: 3008050 - RNA, 11 nt, Human
ucuuuuaaacu

SEQ ID NO: 3008051 - RNA, 12 nt, Human
ucuuuuaaacuc

SEQ ID NO: 3008052 - RNA, 21 nt, Human
ugaaaaaauuuacuuuaaacu

SEQ ID NO: 3008053 - RNA, 23 nt, Human
agcauguccuaaugcuugcugcu

SEQ ID NO: 3008054 - RNA, 14 nt, Human
ugcacacuguccua

SEQ ID NO: 3008055 - RNA, 14 nt, Human
ugcaguacuaacau

SEQ ID NO: 3008056 - RNA, 17 nt, Human
ugccaauuugcacauua

SEQ ID NO: 3008057 - RNA, 21 nt, Human
ugccaauuugcacauuaaaug

SEQ ID NO: 3008058 - RNA, 15 nt, Human
ugccaauuugcacau

SEQ ID NO: 3008059 - RNA, 13 nt, Human
ugccaauuugcac

SEQ ID NO: 3008060 - RNA, 14 nt, Human
ugccaauauccuaa

SEQ ID NO: 3008061 - RNA, 19 nt, Human
ugcuuguacacucauucau

SEQ ID NO: 3008062 - RNA, 22 nt, Human
ugcuuguacacucauucauuac

SEQ ID NO: 3008063 - RNA, 16 nt, Human
ugcuuguacacucauu

SEQ ID NO: 3008064 - RNA, 18 nt, Human
ugcuugcugcugauuuaa

SEQ ID NO: 3008065 - RNA, 15 nt, Human
aggauacuuauuuaa

SEQ ID NO: 3008066 - RNA, 16 nt, Human
aggauacuuauuuaaa

SEQ ID NO: 3008067 - RNA, 13 nt, Human
aggauacuuauuu

SEQ ID NO: 3008068 - RNA, 16 nt, Human
uggcaucuuacaucug

SEQ ID NO: 3008069 - RNA, 15 nt, Human
aggaaugcaaagaug

SEQ ID NO: 3008070 - RNA, 17 nt, Human
aggaaugcaaagaugaa

SEQ ID NO: 3008071 - RNA, 18 nt, Human
uguacuuuuaagacuuug

SEQ ID NO: 3008072 - RNA, 15 nt, Human
uguacuuuuaagacu

SEQ ID NO: 3008073 - RNA, 14 nt, Human
aguagagguacacu

SEQ ID NO: 3008074 - RNA, 22 nt, Human
aguagagguacacuugugaaua

SEQ ID NO: 3008075 - RNA, 20 nt, Human
aguagagguacacuugugaa

SEQ ID NO: 3008076 - RNA, 21 nt, Human
aguagagguacacuugugaau

SEQ ID NO: 3008077 - RNA, 23 nt, Human
uguaauuaugguuaguagaggua

SEQ ID NO: 3008078 - RNA, 22 nt, Human
uguccuaaugcuugcugcugau

SEQ ID NO: 3008079 - RNA, 23 nt, Human
agucagacuggauaguccgucuc

SEQ ID NO: 3008080 - RNA, 13 nt, Human
aguagucagacug

SEQ ID NO: 3008081 - RNA, 15 nt, Human
ugucaguauuucaac

SEQ ID NO: 3008082 - RNA, 20 nt, Human
ugggcacaucauuucaagaa

SEQ ID NO: 3008083 - RNA, 15 nt, Human
ugggcacaucauuuc

SEQ ID NO: 3008084 - RNA, 17 nt, Human
agguagaauguuuucaa

SEQ ID NO: 3008085 - RNA, 22 nt, Human
agugcuuuaccaauugaaguaa

SEQ ID NO: 3008086 - RNA, 20 nt, Human
agugcuuggcccaggaguuu

SEQ ID NO: 3008087 - RNA, 13 nt, Human
uguuaauauuuua

SEQ ID NO: 3008088 - RNA, 19 nt, Human
agugcuuggcccaggaguu

SEQ ID NO: 3008089 - RNA, 18 nt, Human
agugcuuggcccaggagu

SEQ ID NO: 3008090 - RNA, 16 nt, Human
agugcuuggcccagga

SEQ ID NO: 3008091 - RNA, 15 nt, Human
agugcuuggcccagg

SEQ ID NO: 3008092 - RNA, 14 nt, Human
agugcuuggcccag

SEQ ID NO: 3008093 - RNA, 12 nt, Human
agugcuuggccc

SEQ ID NO: 3008094 - RNA, 16 nt, Human
aguuacugaacaguaa

SEQ ID NO: 3008095 - RNA, 15 nt, Human
aguggaguuacugaa

SEQ ID NO: 3008096 - RNA, 19 nt, Human
uguuauuuauugaaaugau

SEQ ID NO: 3008097 - RNA, 18 nt, Human
uguuauuuauugaaauga

SEQ ID NO: 3008098 - RNA, 17 nt, Human
uguuauuuauugaaaug

SEQ ID NO: 3008099 - RNA, 15 nt, Human
uguuauuuauugaaa

SEQ ID NO: 3008100 - RNA, 13 nt, Human
uguuauuuauuga

SEQ ID NO: 3008101 - RNA, 24 nt, Human
aguucaaucuggauucauauuuaa

SEQ ID NO: 3008102 - RNA, 23 nt, Human
aguucuauuuauuugugagacug

SEQ ID NO: 3008103 - RNA, 20 nt, Human
uguuuagaugaaugucaguu

SEQ ID NO: 3008104 - RNA, 15 nt, Human
uguuuagaugaaugu

SEQ ID NO: 3008105 - RNA, 12 nt, Human
uuagguugugaa

SEQ ID NO: 3008106 - RNA, 13 nt, Human
uuagguugugaau

SEQ ID NO: 3008107 - RNA, 17 nt, Human
uuagguugugaaugcag

SEQ ID NO: 3008108 - RNA, 23 nt, Human
uuacugaacaguaacauagcugu

SEQ ID NO: 3008109 - RNA, 15 nt, Human
uuacugaacaguaac

SEQ ID NO: 3008110 - RNA, 23 nt, Human
auaaauauugguugggaugacuu

SEQ ID NO: 3008111 - RNA, 16 nt, Human
uuaaauagaugacauu

SEQ ID NO: 3008112 - RNA, 14 nt, Human
uuaaauagaugaca

SEQ ID NO: 3008113 - RNA, 13 nt, Human
uuaaauagaugac

SEQ ID NO: 3008114 - RNA, 21 nt, Human
uuaaacaugcuguacauacuu

SEQ ID NO: 3008115 - RNA, 22 nt, Human
uuaaacaugcuguacauacuuu

SEQ ID NO: 3008116 - RNA, 23 nt, Human
uuaaacaugcuguacauacuuuu

SEQ ID NO: 3008117 - RNA, 19 nt, Human
uuaaacaugcuguacauac

SEQ ID NO: 3008118 - RNA, 14 nt, Human
uuaaacacauuaaa

SEQ ID NO: 3008119 - RNA, 13 nt, Human
uuaaggguaugau

SEQ ID NO: 3008120 - RNA, 19 nt, Human
uuaagaacuaaaauguucu

SEQ ID NO: 3008121 - RNA, 16 nt, Human
uuaagaacuaaaaugu

SEQ ID NO: 3008122 - RNA, 20 nt, Human
uuaagaacuaaaauguucua

SEQ ID NO: 3008123 - RNA, 18 nt, Human
aguuuugaagauucuaug

SEQ ID NO: 3008124 - RNA, 17 nt, Human
aguuuugaagauucuau

SEQ ID NO: 3008125 - RNA, 19 nt, Human
uuuucucacagaagaugaa

SEQ ID NO: 3008126 - RNA, 13 nt, Human
auuaaagugccca

SEQ ID NO: 3008127 - RNA, 23 nt, Human
uuuuccaguaaugagcuuaagaa

SEQ ID NO: 3008128 - RNA, 15 nt, Human
uuuuauuauuaacaa

SEQ ID NO: 3008129 - RNA, 22 nt, Human
uuuguaacuguuuagaugaaug

SEQ ID NO: 3008130 - RNA, 22 nt, Human
uuuuaagggcccuuuuucaaua

SEQ ID NO: 3008131 - RNA, 17 nt, Human
uuuuaagacuuugguua

SEQ ID NO: 3008132 - RNA, 17 nt, Human
augucaguuguuauuua

SEQ ID NO: 3008133 - RNA, 15 nt, Human
augucaguuguuauu

SEQ ID NO: 3008134 - RNA, 23 nt, Human
augucuagaccaggaccucccuc

SEQ ID NO: 3008135 - RNA, 14 nt, Human
uuuggccagaaguc

SEQ ID NO: 3008136 - RNA, 12 nt, Human
uuuggccagaag

SEQ ID NO: 3008137 - RNA, 10 nt, Human
uuuggccaga

SEQ ID NO: 3008138 - RNA, 13 nt, Human
uuugcacauuaaa

SEQ ID NO: 3008139 - RNA, 16 nt, Human
uuugcacauuaaauga

SEQ ID NO: 3008140 - RNA, 12 nt, Human
uuugcacauuaa

SEQ ID NO: 3008141 - RNA, 11 nt, Human
auuauuaacaa

SEQ ID NO: 3008142 - RNA, 17 nt, Human
auuuaaacacauuaaag

SEQ ID NO: 3008143 - RNA, 18 nt, Human
auuuaaacacauuaaagg

SEQ ID NO: 3008144 - RNA, 16 nt, Human
auucucagcagagugc

SEQ ID NO: 3008145 - RNA, 16 nt, Human
auugacagauugaauu

SEQ ID NO: 3008146 - RNA, 15 nt, Human
auucucagcagagug

SEQ ID NO: 3008147 - RNA, 14 nt, Human
auucucagcagagu

SEQ ID NO: 3008148 - RNA, 23 nt, Human
uucaagaaugcaguacuaacauu

SEQ ID NO: 3008149 - RNA, 23 nt, Human
uucaagaaguccccucuccucca

SEQ ID NO: 3008150 - RNA, 13 nt, Human
uucauauuuaauu

SEQ ID NO: 3008151 - RNA, 16 nt, Human
auaugaugacuguuuu

SEQ ID NO: 3008152 - RNA, 14 nt, Human
uuccuucaagaaug

SEQ ID NO: 3008153 - RNA, 21 nt, Human
uuccuucaagaaugcaguacu

SEQ ID NO: 3008154 - RNA, 22 nt, Human
uucuaaauaucccuuggacauu

SEQ ID NO: 3008155 - RNA, 13 nt, Human
uucucagcagagu

SEQ ID NO: 3008156 - RNA, 15 nt, Human
uucuuggcccaggau

SEQ ID NO: 3008157 - RNA, 12 nt, Human
auccuaauaaaa

SEQ ID NO: 3008158 - RNA, 17 nt, Human
auccuaauaaaaaggug

SEQ ID NO: 3008159 - RNA, 16 nt, Human
auccuaauaaaaaggu

SEQ ID NO: 3008160 - RNA, 15 nt, Human
auccuaauaaaaagg

SEQ ID NO: 3008161 - RNA, 14 nt, Human
auccuaauaaaaag

SEQ ID NO: 3008162 - RNA, 22 nt, Human
auccuaauaaaaaggugaccau

SEQ ID NO: 3008163 - RNA, 18 nt, Human
auccuaauaaaaagguga

SEQ ID NO: 3008164 - RNA, 20 nt, Human
auccuagucauucuucccua

SEQ ID NO: 3008165 - RNA, 15 nt, Human
uucuuuuugaaaugu

SEQ ID NO: 3008166 - RNA, 14 nt, Human
uucuuuuugaaaug

SEQ ID NO: 3008167 - RNA, 14 nt, Human
uugaaaugauuuca

SEQ ID NO: 3008168 - RNA, 13 nt, Human
aucauuucaagaa

SEQ ID NO: 3008169 - RNA, 13 nt, Human
augauuucacagu

SEQ ID NO: 3008170 - RNA, 22 nt, Human
uuuaauuugaagguagaauguu

SEQ ID NO: 3008171 - RNA, 13 nt, Human
augcagguuuuau

SEQ ID NO: 3008172 - RNA, 18 nt, Human
augcaguacuaacauuua

SEQ ID NO: 3008173 - RNA, 12 nt, Human
augcuguacaua

SEQ ID NO: 3008174 - RNA, 15 nt, Human
augcuguacauacuu

SEQ ID NO: 3008175 - RNA, 16 nt, Human
augcuguacauacuuu

SEQ ID NO: 3008176 - RNA, 18 nt, Human
augcuguacauacuuuuu

SEQ ID NO: 3008177 - RNA, 18 nt, Human
uuuagaugaaugucaguu

SEQ ID NO: 3008178 - RNA, 17 nt, Human
uuuagaugaaugucagu

SEQ ID NO: 3008179 - RNA, 22 nt, Human
uuuagaugaaugucaguuguua

SEQ ID NO: 3008180 - RNA, 12 nt, Human
aucuguuacaca

SEQ ID NO: 3008181 - RNA, 20 nt, Human
uugccuaauaugaugacugu

SEQ ID NO: 3008182 - RNA, 23 nt, Human
uugcacauuaaaugacucuuccc

SEQ ID NO: 3008183 - RNA, 11 nt, Human
uugcacauuaa

SEQ ID NO: 3008184 - RNA, 14 nt, Human
augacauucccugc

SEQ ID NO: 3008185 - RNA, 16 nt, Human
augacauugacuauuu

SEQ ID NO: 3008186 - RNA, 19 nt, Human
augacauugacuauuuuug

SEQ ID NO: 3008187 - RNA, 18 nt, Human
augacuuggugucuaaug

SEQ ID NO: 3008188 - RNA, 23 nt, Human
augacuuggugucuaauguguag

SEQ ID NO: 3008189 - RNA, 18 nt, Human
uugguucuggacuaaaac

SEQ ID NO: 3008190 - RNA, 20 nt, Human
uugguucuggacuaaaacua

SEQ ID NO: 3008191 - RNA, 17 nt, Human
uugguugggaugacuug

SEQ ID NO: 3008192 - RNA, 21 nt, Human
uugguugguaacucuguaauu

SEQ ID NO: 3008193 - RNA, 21 nt, Human
augaaugcccagugagacugu

SEQ ID NO: 3008194 - RNA, 13 nt, Human
augaaugcccagu

SEQ ID NO: 3008195 - RNA, 11 nt, Human
aguuuggccag

SEQ ID NO: 3008196 - RNA, 19 nt, Human
auagcauguccuaaugcuu

SEQ ID NO: 3008197 - RNA, 16 nt, Human
auagcauguccuaaug

SEQ ID NO: 3008198 - RNA, 22 nt, Human
auagcagcccucaauugugaaa

SEQ ID NO: 3008199 - RNA, 21 nt, Human
auagcagcccucaauugugaa

SEQ ID NO: 3008200 - RNA, 17 nt, Human
auauucauucuuuuuga

SEQ ID NO: 3008201 - RNA, 16 nt, Human
aguacuaacauuuauu

SEQ ID NO: 3008202 - RNA, 15 nt, Human
augguaguuuuacag

SEQ ID NO: 3008203 - RNA, 22 nt, Human
augguaguuuuacaguguuucu

SEQ ID NO: 3008204 - RNA, 21 nt, Human
augguaguuuuacaguguuuc

SEQ ID NO: 3008205 - RNA, 18 nt, Human
auggauaaauauugguug

SEQ ID NO: 3008206 - RNA, 21 nt, Human
aucgcuccaccuugcagcucu

SEQ ID NO: 3008207 - RNA, 17 nt, Human
aucgcuccaccuugcag

SEQ ID NO: 3008208 - RNA, 14 nt, Human
augacuguuuuuaa

SEQ ID NO: 3008209 - RNA, 20 nt, Human
agcuuauuuccucauuuuua

SEQ ID NO: 3008210 - RNA, 22 nt, Human
agggauuuucagcccucagaau

SEQ ID NO: 3008211 - RNA, 17 nt, Human
agggauuuucagcccuc

SEQ ID NO: 3008212 - RNA, 23 nt, Human
aggcuuagacccucaugcugcca

SEQ ID NO: 3008213 - RNA, 24 nt, Human
aggcuuagacccucaugcugccaa

SEQ ID NO: 3008214 - RNA, 21 nt, Human
agaagucuucuauuuauuuau

SEQ ID NO: 3008215 - RNA, 16 nt, Human
agacuggauaguccgu

SEQ ID NO: 3008216 - RNA, 21 nt, Human
agauucuauguuaauauuuua

SEQ ID NO: 3008217 - RNA, 22 nt, Human
agauucuuguauuuauuacaac

SEQ ID NO: 3008218 - RNA, 14 nt, Human
agaugaaggucugu

SEQ ID NO: 3008219 - RNA, 17 nt, Human
agaugaaggucuguuuu

SEQ ID NO: 3008220 - RNA, 15 nt, Human
aagggauuuucagcc

SEQ ID NO: 3008221 - RNA, 23 nt, Human
aagggauuuucagcccucagaau

SEQ ID NO: 3008222 - RNA, 21 nt, Human
aagggauuuucagcccucaga

SEQ ID NO: 3008223 - RNA, 19 nt, Human
aaggucuguuuuguguacu

SEQ ID NO: 3008224 - RNA, 20 nt, Human
aaggucuguuuuguguacuu

SEQ ID NO: 3008225 - RNA, 23 nt, Human
aaggucuguuuuguguacuuuua

SEQ ID NO: 3008226 - RNA, 15 nt, Human
aaggaaugcaaagau

SEQ ID NO: 3008227 - RNA, 16 nt, Human
aaggaaugcaaagaug

SEQ ID NO: 3008228 - RNA, 13 nt, Human
aacuguuuagaug

SEQ ID NO: 3008229 - RNA, 17 nt, Human
aagacuuugguuauuuu

SEQ ID NO: 3008230 - RNA, 23 nt, Human
aagacuuugguuauuuuacuuuu

SEQ ID NO: 3008231 - RNA, 13 nt, Human
aagacuuugguua

SEQ ID NO: 3008232 - RNA, 15 nt, Human
aagacuuugguuauu

SEQ ID NO: 3008233 - RNA, 22 nt, Human
aagauucuauguuaauauuuua

SEQ ID NO: 3008234 - RNA, 21 nt, Human
aagauucuauguuaauauuuu

SEQ ID NO: 3008235 - RNA, 19 nt, Human
aagauucuauguuaauauu

SEQ ID NO: 3008236 - RNA, 20 nt, Human
aagcagaguggcagucuuca

SEQ ID NO: 3008237 - RNA, 11 nt, Human
aagcagagugg

SEQ ID NO: 3008238 - RNA, 14 nt, Human
aagcagaguggcag

SEQ ID NO: 3008239 - RNA, 10 nt, Human
aagcagagug

SEQ ID NO: 3008240 - RNA, 17 nt, Human
aauaaaauuuuaguuga

SEQ ID NO: 3008241 - RNA, 13 nt, Human
aauauaaaaauaa

SEQ ID NO: 3008242 - RNA, 18 nt, Human
aacugaaguucuauuuau

SEQ ID NO: 3008243 - RNA, 21 nt, Human
aacaugcuguacauacuuuuu

SEQ ID NO: 3008244 - RNA, 18 nt, Human
aacaugcuguacauacuu

SEQ ID NO: 3008245 - RNA, 19 nt, Human
aacaugcuguacauacuuu

SEQ ID NO: 3008246 - RNA, 20 nt, Human
aacaugcuguacauacuuuu

SEQ ID NO: 3008247 - RNA, 17 nt, Human
aacagcaacacaaagcu

SEQ ID NO: 3008248 - RNA, 18 nt, Human
aacagcaacacaaagcuu

SEQ ID NO: 3008249 - RNA, 12 nt, Human
aaagugcccagc

SEQ ID NO: 3008250 - RNA, 14 nt, Human
acaugccuaccaau

SEQ ID NO: 3008251 - RNA, 18 nt, Human
acaugccuaccaauauuu

SEQ ID NO: 3008252 - RNA, 19 nt, Human
acaugccuaccaauauuua

SEQ ID NO: 3008253 - RNA, 17 nt, Human
acauuucucauguugaa

SEQ ID NO: 3008254 - RNA, 17 nt, Human
accaagaauugauuggg

SEQ ID NO: 3008255 - RNA, 22 nt, Human
caauauccuaauaaaaagguga

SEQ ID NO: 3008256 - RNA, 16 nt, Human
cacaaagcuuuugcau

SEQ ID NO: 3008257 - RNA, 13 nt, Human
cacaaagcuuuug

SEQ ID NO: 3008258 - RNA, 18 nt, Human
caauaacuggaacacucu

SEQ ID NO: 3008259 - RNA, 21 nt, Human
caauauccuaauaaaaaggug

SEQ ID NO: 3008260 - RNA, 22 nt, Human
caaggcuuagacccucaugcug

SEQ ID NO: 3008261 - RNA, 19 nt, Human
caaggcuuagacccucaug

SEQ ID NO: 3008262 - RNA, 23 nt, Human
cacaguguguggucaacauuucu

SEQ ID NO: 3008263 - RNA, 21 nt, Human
caguguguggucaacauuucu

SEQ ID NO: 3008264 - RNA, 17 nt, Human
caguguguggucaacau

SEQ ID NO: 3008265 - RNA, 20 nt, Human
cagugcuuggcccaggaguu

SEQ ID NO: 3008266 - RNA, 19 nt, Human
cagugcuuggcccaggagu

SEQ ID NO: 3008267 - RNA, 18 nt, Human
cagugcuuggcccaggag

SEQ ID NO: 3008268 - RNA, 17 nt, Human
cagugcuuggcccagga

SEQ ID NO: 3008269 - RNA, 12 nt, Human
cagugcuuggcc

SEQ ID NO: 3008270 - RNA, 16 nt, Human
cagugcuuggcccagg

SEQ ID NO: 3008271 - RNA, 15 nt, Human
cagugcuuggcccag

SEQ ID NO: 3008272 - RNA, 14 nt, Human
cagugcuuggccca

SEQ ID NO: 3008273 - RNA, 13 nt, Human
cagugcuuggccc

SEQ ID NO: 3008274 - RNA, 16 nt, Human
caguguuuuaggagca

SEQ ID NO: 3008275 - RNA, 20 nt, Human
caguguuuuaggagcaugag

SEQ ID NO: 3008276 - RNA, 18 nt, Human
cauaagugcuauugcaga

SEQ ID NO: 3008277 - RNA, 22 nt, Human
cauaagugcuauugcagagccg

SEQ ID NO: 3008278 - RNA, 19 nt, Human
caguuuuuuuccuucaaga

SEQ ID NO: 3008279 - RNA, 11 nt, Human
caguuggguuu

SEQ ID NO: 3008280 - RNA, 16 nt, Human
caguuggguuuuuuaa

SEQ ID NO: 3008281 - RNA, 18 nt, Human
caguuggguuuuuuaagg

SEQ ID NO: 3008282 - RNA, 14 nt, Human
cauacuauuaaaca

SEQ ID NO: 3008283 - RNA, 12 nt, Human
caucauuucaag

SEQ ID NO: 3008284 - RNA, 14 nt, Human
caucauuucaagaa

SEQ ID NO: 3008285 - RNA, 18 nt, Human
cauacuauuaaacaugcu

SEQ ID NO: 3008286 - RNA, 12 nt, Human
cauacuuuuugg

SEQ ID NO: 3008287 - RNA, 16 nt, Human
cauacuuuuuggguuu

SEQ ID NO: 3008288 - RNA, 18 nt, Human
cauacuuuuuggguuuau

SEQ ID NO: 3008289 - RNA, 17 nt, Human
caugccuaccaauauuu

SEQ ID NO: 3008290 - RNA, 13 nt, Human
cauuaaaugacuc

SEQ ID NO: 3008291 - RNA, 14 nt, Human
cauuaaaugacucu

SEQ ID NO: 3008292 - RNA, 18 nt, Human
cauuaaaugacucuuccc

SEQ ID NO: 3008293 - RNA, 17 nt, Human
cauuaaagguacuuugc

SEQ ID NO: 3008294 - RNA, 19 nt, Human
ccaauuugcacauuaaaug

SEQ ID NO: 3008295 - RNA, 20 nt, Human
ccaauuugcacauuaaauga

SEQ ID NO: 3008296 - RNA, 17 nt, Human
cauuucucauguugaaa

SEQ ID NO: 3008297 - RNA, 16 nt, Human
cauuucucauguugaa

SEQ ID NO: 3008298 - RNA, 14 nt, Human
cauugacagauuga

SEQ ID NO: 3008299 - RNA, 22 nt, Human
cauugacuauuuuuguuuuuau

SEQ ID NO: 3008300 - RNA, 17 nt, Human
cccaguguuuuaggagc

SEQ ID NO: 3008301 - RNA, 16 nt, Human
cccaguguuuuaggag

SEQ ID NO: 3008302 - RNA, 14 nt, Human
cccuuggacauuuu

SEQ ID NO: 3008303 - RNA, 15 nt, Human
cccuuggacauuuua

SEQ ID NO: 3008304 - RNA, 20 nt, Human
ccucagaugcacaugagcug

SEQ ID NO: 3008305 - RNA, 14 nt, Human
ccucuccuccacau

SEQ ID NO: 3008306 - RNA, 16 nt, Human
ccucccccuggcacug

SEQ ID NO: 3008307 - RNA, 17 nt, Human
cccucaugcugccaaua

SEQ ID NO: 3008308 - RNA, 14 nt, Human
cccucaugcugcca

SEQ ID NO: 3008309 - RNA, 18 nt, Human
cuacacaccuaacuuaug

SEQ ID NO: 3008310 - RNA, 13 nt, Human
cuaaaauguucua

SEQ ID NO: 3008311 - RNA, 18 nt, Human
cgugcacgcacacugucu

SEQ ID NO: 3008312 - RNA, 22 nt, Human
cgccagcucaccccaucauccc

SEQ ID NO: 3008313 - RNA, 13 nt, Human
cuccuccacauuu

SEQ ID NO: 3008314 - RNA, 16 nt, Human
cugaaauaaggaauga

SEQ ID NO: 3008315 - RNA, 23 nt, Human
cugcaguuuuuuuccuucaagaa

SEQ ID NO: 3008316 - RNA, 22 nt, Human
cugcaguuuuuuuccuucaaga

SEQ ID NO: 3008317 - RNA, 20 nt, Human
cugcaguuuuuuuccuucaa

SEQ ID NO: 3008318 - RNA, 20 nt, Human
cugggaaagggauuuucagc

SEQ ID NO: 3008319 - RNA, 21 nt, Human
cuguccuauuauauucauucu

SEQ ID NO: 3008320 - RNA, 15 nt, Human
cuguccuauuauauu

SEQ ID NO: 3008321 - RNA, 20 nt, Human
cugucuccucucucuguaau

SEQ ID NO: 3008322 - RNA, 17 nt, Human
cugucuccucucucugu

SEQ ID NO: 3008323 - RNA, 15 nt, Human
cuguacauacuuuuu

SEQ ID NO: 3008324 - RNA, 16 nt, Human
cuguacauacuuuuug

SEQ ID NO: 3008325 - RNA, 21 nt, Human
cuguaaguuacaugaaggcag

SEQ ID NO: 3008326 - RNA, 21 nt, Human
cugguacucugccacuuuauu

SEQ ID NO: 3008327 - RNA, 20 nt, Human
gaagauucuuguauuuauua

SEQ ID NO: 3008328 - RNA, 14 nt, Human
gaaggaugcugucu

SEQ ID NO: 3008329 - RNA, 20 nt, Human
gaagguagaauguuuucaaa

SEQ ID NO: 3008330 - RNA, 19 nt, Human
gaaggucuguuuuguguac

SEQ ID NO: 3008331 - RNA, 18 nt, Human
gaagucaaggcuuagacc

SEQ ID NO: 3008332 - RNA, 23 nt, Human
gaaguccccucuccuccacauuu

SEQ ID NO: 3008333 - RNA, 18 nt, Human
gaaguccccucuccucca

SEQ ID NO: 3008334 - RNA, 15 nt, Human
gaacacucuauaaca

SEQ ID NO: 3008335 - RNA, 21 nt, Human
gaacacucuauaacaaaggau

SEQ ID NO: 3008336 - RNA, 22 nt, Human
gaacaguaacauagcugugauu

SEQ ID NO: 3008337 - RNA, 16 nt, Human
gaaacugacacaugcu

SEQ ID NO: 3008338 - RNA, 20 nt, Human
gaaaggaaugcaaagaugaa

SEQ ID NO: 3008339 - RNA, 12 nt, Human
cuuuuuauaacu

SEQ ID NO: 3008340 - RNA, 18 nt, Human
cuuuuuauauucucagca

SEQ ID NO: 3008341 - RNA, 16 nt, Human
cuuuuuauaacuuuuu

SEQ ID NO: 3008342 - RNA, 22 nt, Human
cuuuuuauauucucagcagagu

SEQ ID NO: 3008343 - RNA, 15 nt, Human
cuuuugcauauugca

SEQ ID NO: 3008344 - RNA, 17 nt, Human
cuuuuaagacuuugguu

SEQ ID NO: 3008345 - RNA, 11 nt, Human
cuuuuaaacuc

SEQ ID NO: 3008346 - RNA, 12 nt, Human
cuuucccuuggu

SEQ ID NO: 3008347 - RNA, 17 nt, Human
cuuucccuuggugcccu

SEQ ID NO: 3008348 - RNA, 22 nt, Human
cuugagugucaagcugaccuug

SEQ ID NO: 3008349 - RNA, 16 nt, Human
cuugagugcucaguag

SEQ ID NO: 3008350 - RNA, 19 nt, Human
cuuggacauuuuaugucuu

SEQ ID NO: 3008351 - RNA, 16 nt, Human
cuuggacauuuuaugu

SEQ ID NO: 3008352 - RNA, 18 nt, Human
cuuggacauuuuaugucu

SEQ ID NO: 3008353 - RNA, 17 nt, Human
cuuggacauuuuauguc

SEQ ID NO: 3008354 - RNA, 19 nt, Human
cuugcugcugauuuaaaca

SEQ ID NO: 3008355 - RNA, 17 nt, Human
cuugcugcugauuuaaa

SEQ ID NO: 3008356 - RNA, 17 nt, Human
gaagucuucuauuuauu

SEQ ID NO: 3008357 - RNA, 13 nt, Human
gaagucuucuauu

SEQ ID NO: 3008358 - RNA, 18 nt, Human
gaugaaggucuguuuugu

SEQ ID NO: 3008359 - RNA, 15 nt, Human
gaugaaggucuguuu

SEQ ID NO: 3008360 - RNA, 17 nt, Human
gaugacauucccugcua

SEQ ID NO: 3008361 - RNA, 17 nt, Human
gaugacauugacuauuu

SEQ ID NO: 3008362 - RNA, 21 nt, Human
gaugacauugacuauuuuugu

SEQ ID NO: 3008363 - RNA, 23 nt, Human
gaugacauugacuauuuuuguuu

SEQ ID NO: 3008364 - RNA, 15 nt, Human
gaugacauucccugc

SEQ ID NO: 3008365 - RNA, 19 nt, Human
gauuuucagcccucagaau

SEQ ID NO: 3008366 - RNA, 15 nt, Human
gauuuucagcccuca

SEQ ID NO: 3008367 - RNA, 11 nt, Human
gauuuucagcc

SEQ ID NO: 3008368 - RNA, 12 nt, Human
gauucauauuua

SEQ ID NO: 3008369 - RNA, 20 nt, Human
gcagugcuuggcccaggagu

SEQ ID NO: 3008370 - RNA, 19 nt, Human
gcagugcuuggcccaggag

SEQ ID NO: 3008371 - RNA, 18 nt, Human
gcagugcuuggcccagga

SEQ ID NO: 3008372 - RNA, 17 nt, Human
gcagugcuuggcccagg

SEQ ID NO: 3008373 - RNA, 19 nt, Human
gcacugguuuguucccugu

SEQ ID NO: 3008374 - RNA, 17 nt, Human
gcacugguuuguucccu

SEQ ID NO: 3008375 - RNA, 19 nt, Human
gcagcccucaauugugaaa

SEQ ID NO: 3008376 - RNA, 13 nt, Human
gcuacacaccuaa

SEQ ID NO: 3008377 - RNA, 16 nt, Human
gcccuuggccaugggu

SEQ ID NO: 3008378 - RNA, 18 nt, Human
gcccuuuuucaauaacug

SEQ ID NO: 3008379 - RNA, 23 nt, Human
gccguggugauuuagcaggaagc

SEQ ID NO: 3008380 - RNA, 22 nt, Human
gccgugugugugcguccugucg

SEQ ID NO: 3008381 - RNA, 19 nt, Human
uuuuaauauggaucuguau

SEQ ID NO: 3008382 - RNA, 12 nt, Human
uuuguucccugu

SEQ ID NO: 3008383 - RNA, 13 nt, Human
uuugguuucuagc

SEQ ID NO: 3008384 - RNA, 15 nt, Human
uuugcauauugcaua

SEQ ID NO: 3008385 - RNA, 20 nt, Human
uuugcauauugcauacuauu

SEQ ID NO: 3008386 - RNA, 14 nt, Human
uuuggaaaagaaua

SEQ ID NO: 3008387 - RNA, 16 nt, Human
uuugaagauucuaugu

SEQ ID NO: 3008388 - RNA, 22 nt, Human
uuaccaauugaaguaaaaugug

SEQ ID NO: 3008389 - RNA, 18 nt, Human
uuuccucauuuuuauaau

SEQ ID NO: 3008390 - RNA, 23 nt, Human
uuaccaauugaaguaaaaugugg

SEQ ID NO: 3008391 - RNA, 21 nt, Human
uuuuuccuucaagaaugcagu

SEQ ID NO: 3008392 - RNA, 20 nt, Human
uuuuuaagggcccuuuuuca

SEQ ID NO: 3008393 - RNA, 17 nt, Human
uuuuggguuuauuugga

SEQ ID NO: 3008394 - RNA, 18 nt, Human
uuuuggguuuauuuggaa

SEQ ID NO: 3008395 - RNA, 14 nt, Human
uuuugguauuugaa

SEQ ID NO: 3008396 - RNA, 16 nt, Human
uuuugguauuugaaac

SEQ ID NO: 3008397 - RNA, 14 nt, Human
uuuuccuucaagaa

SEQ ID NO: 3008398 - RNA, 21 nt, Human
uuuuccuucaagaaugcagua

SEQ ID NO: 3008399 - RNA, 13 nt, Human
uuuuccuucaaga

SEQ ID NO: 3008400 - RNA, 19 nt, Human
gucauuauguuaauauuuc

SEQ ID NO: 3008401 - RNA, 17 nt, Human
gucauuauguuaauauu

SEQ ID NO: 3008402 - RNA, 14 nt, Human
gucauucuucccua

SEQ ID NO: 3008403 - RNA, 22 nt, Human
guauuuucuccaaauguucacu

SEQ ID NO: 3008404 - RNA, 14 nt, Human
gucaaggcuuagac

SEQ ID NO: 3008405 - RNA, 20 nt, Human
gucaaggcuuagacccucau

SEQ ID NO: 3008406 - RNA, 18 nt, Human
gucaaggcuuagacccuc

SEQ ID NO: 3008407 - RNA, 16 nt, Human
gucaaggcuuagaccc

SEQ ID NO: 3008408 - RNA, 20 nt, Human
guauguuuuauauagcaaga

SEQ ID NO: 3008409 - RNA, 16 nt, Human
guauagauguugcuaa

SEQ ID NO: 3008410 - RNA, 15 nt, Human
guauagauguugcua

SEQ ID NO: 3008411 - RNA, 13 nt, Human
gugcguccugucg

SEQ ID NO: 3008412 - RNA, 16 nt, Human
gucggagcccugucuc

SEQ ID NO: 3008413 - RNA, 12 nt, Human
gucggagcccug

SEQ ID NO: 3008414 - RNA, 20 nt, Human
gucuguuuuguguacuuuua

SEQ ID NO: 3008415 - RNA, 15 nt, Human
gucuguuuuguguac

SEQ ID NO: 3008416 - RNA, 14 nt, Human
gucuguuuugugua

SEQ ID NO: 3008417 - RNA, 17 nt, Human
gucugucuuuuaaacuc

SEQ ID NO: 3008418 - RNA, 24 nt, Human
guuaguucaaucuggauucauauu

SEQ ID NO: 3008419 - RNA, 23 nt, Human
guucaaucuggauucauauuuaa

SEQ ID NO: 3008420 - RNA, 24 nt, Human
guucacuggacacuucacgcccuu

SEQ ID NO: 3008421 - RNA, 16 nt, Human
gugugcguccugucgg

SEQ ID NO: 3008422 - RNA, 14 nt, Human
gugugcguccuguc

SEQ ID NO: 3008423 - RNA, 17 nt, Human
guggcuaacuuggguua

SEQ ID NO: 3008424 - RNA, 23 nt, Human
guggggcagugcuuggcccagga

SEQ ID NO: 3008425 - RNA, 14 nt, Human
guggggcagugcuu

SEQ ID NO: 3008426 - RNA, 15 nt, Human
guggguggggcagug

SEQ ID NO: 3008427 - RNA, 21 nt, Human
uaaaaggaagcuuacaugccu

SEQ ID NO: 3008428 - RNA, 18 nt, Human
uaaaaggaagcuuacaug

SEQ ID NO: 3008429 - RNA, 20 nt, Human
uaaacaugcuguacauacuu

SEQ ID NO: 3008430 - RNA, 19 nt, Human
uaaacaugcuguacauacu

SEQ ID NO: 3008431 - RNA, 22 nt, Human
uaaacacauuaaagguacuuug

SEQ ID NO: 3008432 - RNA, 23 nt, Human
uaaacaugcuguacauacuuuuu

SEQ ID NO: 3008433 - RNA, 21 nt, Human
uaaacaugcuguacauacuuu

SEQ ID NO: 3008434 - RNA, 22 nt, Human
uaaacaugcuguacauacuuuu

SEQ ID NO: 3008435 - RNA, 19 nt, Human
uaaugcuugcugcugauuu

SEQ ID NO: 3008436 - RNA, 15 nt, Human
uaauaugaugacugu

SEQ ID NO: 3008437 - RNA, 15 nt, Human
uaauauggaucugua

SEQ ID NO: 3008438 - RNA, 18 nt, Human
uaacucaccuggcaucuu

SEQ ID NO: 3008439 - RNA, 15 nt, Human
uaacuuuuuauauuc

SEQ ID NO: 3008440 - RNA, 16 nt, Human
uaacuuuuuauauucu

SEQ ID NO: 3008441 - RNA, 13 nt, Human
uaacuuuuuauau

SEQ ID NO: 3008442 - RNA, 14 nt, Human
uaacuuuuuauauu

SEQ ID NO: 3008443 - RNA, 10 nt, Human
uaacuggaac

SEQ ID NO: 3008444 - RNA, 22 nt, Human
uaguagagguacacuugugaau

SEQ ID NO: 3008445 - RNA, 20 nt, Human
uaguagagguacacuuguga

SEQ ID NO: 3008446 - RNA, 21 nt, Human
uaguagagguacacuugugaa

SEQ ID NO: 3008447 - RNA, 17 nt, Human
uaguagagguacacuug

SEQ ID NO: 3008448 - RNA, 21 nt, Human
uagcagcccucaauugugaaa

SEQ ID NO: 3008449 - RNA, 16 nt, Human
uagcaugaagacagag

SEQ ID NO: 3008450 - RNA, 19 nt, Human
uagagguacacuugugaau

SEQ ID NO: 3008451 - RNA, 18 nt, Human
uagacccucaugcugcca

SEQ ID NO: 3008452 - RNA, 17 nt, Human
uagacccucaugcugcc

SEQ ID NO: 3008453 - RNA, 19 nt, Human
uagacccucaugcugccaa

SEQ ID NO: 3008454 - RNA, 12 nt, Human
uacuuuaaacua

SEQ ID NO: 3008455 - RNA, 18 nt, Human
uagaauguuuucaaaugu

SEQ ID NO: 3008456 - RNA, 19 nt, Human
uagaauguuuucaaauguu

SEQ ID NO: 3008457 - RNA, 18 nt, Human
uaauuccuguuuuuauua

SEQ ID NO: 3008458 - RNA, 16 nt, Human
uacaugccuaccaaua

SEQ ID NO: 3008459 - RNA, 19 nt, Human
uacaugccuaccaauauuu

SEQ ID NO: 3008460 - RNA, 17 nt, Human
uacuaacauuuauuuga

SEQ ID NO: 3008461 - RNA, 18 nt, Human
uacuaacauuuauuugag

SEQ ID NO: 3008462 - RNA, 21 nt, Human
ugaaacacugguuuuaaauau

SEQ ID NO: 3008463 - RNA, 18 nt, Human
ugaaugcagguuuuauca

SEQ ID NO: 3008464 - RNA, 20 nt, Human
ugaaugcagguuuuaucaga

SEQ ID NO: 3008465 - RNA, 15 nt, Human
ugacucuucccucaa

SEQ ID NO: 3008466 - RNA, 17 nt, Human
ucuucaguuugcagagu

SEQ ID NO: 3008467 - RNA, 18 nt, Human
ucuucaguuugcagagua

SEQ ID NO: 3008468 - RNA, 15 nt, Human
ugaaacacugguuuu

SEQ ID NO: 3008469 - RNA, 20 nt, Human
ugaaacacugguuuuaaaua

SEQ ID NO: 3008470 - RNA, 14 nt, Human
ucuggacuaaaacu

SEQ ID NO: 3008471 - RNA, 15 nt, Human
ucggagcccugucuc

SEQ ID NO: 3008472 - RNA, 14 nt, Human
ucggagcccugucu

SEQ ID NO: 3008473 - RNA, 21 nt, Human
ugcuaacagcaacacaaagcu

SEQ ID NO: 3008474 - RNA, 22 nt, Human
ugcuaacagcaacacaaagcuu

SEQ ID NO: 3008475 - RNA, 23 nt, Human
ugcuaacagcaacacaaagcuuu

SEQ ID NO: 3008476 - RNA, 15 nt, Human
ugcugauuuaaacac

SEQ ID NO: 3008477 - RNA, 17 nt, Human
ugcugauuuaaacacau

SEQ ID NO: 3008478 - RNA, 14 nt, Human
ugcugauuuaaaca

SEQ ID NO: 3008479 - RNA, 16 nt, Human
ugcucaguagucagac

SEQ ID NO: 3008480 - RNA, 17 nt, Human
ugcacgcacacugucug

SEQ ID NO: 3008481 - RNA, 19 nt, Human
ugcacgcacacugucugcc

SEQ ID NO: 3008482 - RNA, 15 nt, Human
ugguaguuuuacagu

SEQ ID NO: 3008483 - RNA, 13 nt, Human
uggcccaggaguu

SEQ ID NO: 3008484 - RNA, 19 nt, Human
uggcccaggaguuuggcca

SEQ ID NO: 3008485 - RNA, 14 nt, Human
uggcccaggaguuu

SEQ ID NO: 3008486 - RNA, 21 nt, Human
uggcccaggaguuuggccaga

SEQ ID NO: 3008487 - RNA, 20 nt, Human
uggcccaggaguuuggccag

SEQ ID NO: 3008488 - RNA, 22 nt, Human
uggcccaggaguuuggccagaa

SEQ ID NO: 3008489 - RNA, 12 nt, Human
uggcccaggagu

SEQ ID NO: 3008490 - RNA, 21 nt, Human
ugcuuuaccaauugaaguaaa

SEQ ID NO: 3008491 - RNA, 15 nt, Human
ugugcacaucuguuu

SEQ ID NO: 3008492 - RNA, 17 nt, Human
ugugcacaucuguuuug

SEQ ID NO: 3008493 - RNA, 23 nt, Human
ugugaaggcaggggaauguaugu

SEQ ID NO: 3008494 - RNA, 20 nt, Human
uguaauaaacucauuucuag

SEQ ID NO: 3008495 - RNA, 18 nt, Human
uguuucuggcuuagaaca

SEQ ID NO: 3008496 - RNA, 18 nt, Human
uuaaaugacucuucccuc

SEQ ID NO: 3008497 - RNA, 11 nt, Human
uuaaaugacuc

SEQ ID NO: 3008498 - RNA, 20 nt, Human
uuaaauauuuugacuuguug

SEQ ID NO: 3008499 - RNA, 23 nt, Human
uuaaacuacauuagguugugaau

SEQ ID NO: 3008500 - RNA, 22 nt, Human
uuaaacuacauuagguugugaa

SEQ ID NO: 3008501 - RNA, 23 nt, Human
uguguggucaacauuucucaugu

SEQ ID NO: 3008502 - RNA, 14 nt, Human
uguguggucaacau

SEQ ID NO: 3008503 - RNA, 18 nt, Human
uguucacuggacacuuca

SEQ ID NO: 3008504 - RNA, 21 nt, Human
cucucuguaauaaacucauuu

SEQ ID NO: 3008505 - RNA, 16 nt, Human
cucucuguaauaaacu

SEQ ID NO: 3008506 - RNA, 18 nt, Human
cucaguagucagacugga

SEQ ID NO: 3008507 - RNA, 12 nt, Human
cuauguuuuugu

SEQ ID NO: 3008508 - RNA, 17 nt, Human
cuaucacugguuugguu

SEQ ID NO: 3008509 - RNA, 21 nt, Human
cuauguuaauauuuuaggugu

SEQ ID NO: 3008510 - RNA, 14 nt, Human
cuauguuaauauuu

SEQ ID NO: 3008511 - RNA, 17 nt, Human
cuauguuaauauuuuag

SEQ ID NO: 3008512 - RNA, 15 nt, Human
cuauguuaauauuuu

SEQ ID NO: 3008513 - RNA, 13 nt, Human
cuauguuaauauu

SEQ ID NO: 3008514 - RNA, 19 nt, Human
cuaauaaaaaggugaccau

SEQ ID NO: 3008515 - RNA, 13 nt, Human
cuaacuuggguua

SEQ ID NO: 3008516 - RNA, 13 nt, Human
ccuuucccuuggu

SEQ ID NO: 3008517 - RNA, 16 nt, Human
ccucaugcugccaaua

SEQ ID NO: 3008518 - RNA, 15 nt, Human
ccucaugcugccaau

SEQ ID NO: 3008519 - RNA, 13 nt, Human
ccucaugcugcca

SEQ ID NO: 3008520 - RNA, 14 nt, Human
cccauucuuggccc

SEQ ID NO: 3008521 - RNA, 18 nt, Human
ccacuugagugucaagcu

SEQ ID NO: 3008522 - RNA, 18 nt, Human
ccaggaguuuggccagaa

SEQ ID NO: 3008523 - RNA, 17 nt, Human
ccaggaguuuggccaga

SEQ ID NO: 3008524 - RNA, 16 nt, Human
ccaggaguuuggccag

SEQ ID NO: 3008525 - RNA, 15 nt, Human
ccaggaguuuggcca

SEQ ID NO: 3008526 - RNA, 14 nt, Human
ccaggaguuuggcc

SEQ ID NO: 3008527 - RNA, 16 nt, Human
cauuauguuaauauuu

SEQ ID NO: 3008528 - RNA, 15 nt, Human
cauuauguuaauauu

SEQ ID NO: 3008529 - RNA, 14 nt, Human
cauuauguuaauau

SEQ ID NO: 3008530 - RNA, 17 nt, Human
cauuauguuaauauuuc

SEQ ID NO: 3008531 - RNA, 21 nt, Human
caguuguuauuuauugaaaug

SEQ ID NO: 3008532 - RNA, 19 nt, Human
caguuguuauuuauugaaa

SEQ ID NO: 3008533 - RNA, 14 nt, Human
caguuguuauuuau

SEQ ID NO: 3008534 - RNA, 19 nt, Human
cagacuggauaguccgucu

SEQ ID NO: 3008535 - RNA, 18 nt, Human
caauauuuaaucuuuuau

SEQ ID NO: 3008536 - RNA, 22 nt, Human
caauugugaaaaaauuuacuuu

SEQ ID NO: 3008537 - RNA, 17 nt, Human
cacaaggaaauaaaauu

SEQ ID NO: 3008538 - RNA, 23 nt, Human
caauugugaaaaaauuuacuuua

SEQ ID NO: 3008539 - RNA, 17 nt, Human
auuuucuccaaauguuc

SEQ ID NO: 3008540 - RNA, 20 nt, Human
auuugcacauuaaaugacuc

SEQ ID NO: 3008541 - RNA, 21 nt, Human
auuugcacauuaaaugacucu

SEQ ID NO: 3008542 - RNA, 17 nt, Human
auuucacaguguguggu

SEQ ID NO: 3008543 - RNA, 22 nt, Human
auuuaauuugaagguagaaugu

SEQ ID NO: 3008544 - RNA, 15 nt, Human
auuuaauuugaaggu

SEQ ID NO: 3008545 - RNA, 13 nt, Human
auuuaauuugaag

SEQ ID NO: 3008546 - RNA, 14 nt, Human
auuugcacauuaaa

SEQ ID NO: 3008547 - RNA, 15 nt, Human
auuugcacauuaaau

SEQ ID NO: 3008548 - RNA, 17 nt, Human
auuugcacauuaaauga

SEQ ID NO: 3008549 - RNA, 19 nt, Human
auuugcacauuaaaugacu

SEQ ID NO: 3008550 - RNA, 17 nt, Human
auuucucucaucuguua

SEQ ID NO: 3008551 - RNA, 15 nt, Human
auucauuaguuuuga

SEQ ID NO: 3008552 - RNA, 14 nt, Human
auucauuaguuuug

SEQ ID NO: 3008553 - RNA, 15 nt, Human
auucauucuuuuuga

SEQ ID NO: 3008554 - RNA, 21 nt, Human
auucauucuuuuugaaauguc

SEQ ID NO: 3008555 - RNA, 16 nt, Human
auucauucuuuuugaa

SEQ ID NO: 3008556 - RNA, 21 nt, Human
gggauuuucagcccucagaau

SEQ ID NO: 3008557 - RNA, 17 nt, Human
gggauugaaggaugcug

SEQ ID NO: 3008558 - RNA, 18 nt, Human
aaacuacauugacagauu

SEQ ID NO: 3008559 - RNA, 16 nt, Human
aaacucauuucuagca

SEQ ID NO: 3008560 - RNA, 21 nt, Human
aaacuacauuagguugugaau

SEQ ID NO: 3008561 - RNA, 22 nt, Human
aaacuacauuagguugugaaug

SEQ ID NO: 3008562 - RNA, 20 nt, Human
aaacuacauuagguugugaa

SEQ ID NO: 3008563 - RNA, 22 nt, Human
aaacaugcuguacauacuuuuu

SEQ ID NO: 3008564 - RNA, 20 nt, Human
aaacaugcuguacauacuuu

SEQ ID NO: 3008565 - RNA, 21 nt, Human
aaacaugcuguacauacuuuu

SEQ ID NO: 3008566 - RNA, 15 nt, Human
aaacaugcuguacau

SEQ ID NO: 3008567 - RNA, 16 nt, Human
aaacaugcuguacaua

SEQ ID NO: 3008568 - RNA, 18 nt, Human
aaacaugcuguacauacu

SEQ ID NO: 3008569 - RNA, 20 nt, Human
ggugauuuagcaggaagcug

SEQ ID NO: 3008570 - RNA, 14 nt, Human
ggucugucuuuuaa

SEQ ID NO: 3008571 - RNA, 13 nt, Human
ggucugucuuuua

SEQ ID NO: 3008572 - RNA, 17 nt, Human
aaagcuuuugcauauug

SEQ ID NO: 3008573 - RNA, 19 nt, Human
aaaggaaugcaaagaugaa

SEQ ID NO: 3008574 - RNA, 22 nt, Human
aaaggaaugcaaagaugaaggu

SEQ ID NO: 3008575 - RNA, 19 nt, Human
aaagaugaaggucuguuuu

SEQ ID NO: 3008576 - RNA, 12 nt, Human
ggauuuucagcc

SEQ ID NO: 3008577 - RNA, 21 nt, Human
ggcccaggaguuuggccagaa

SEQ ID NO: 3008578 - RNA, 23 nt, Human
ggcccaggaguuuggccagaagu

SEQ ID NO: 3008579 - RNA, 22 nt, Human
ggcccaggaguuuggccagaag

SEQ ID NO: 3008580 - RNA, 15 nt, Human
gccuaccaauauuua

SEQ ID NO: 3008581 - RNA, 14 nt, Human
gccacuuuauuucu

SEQ ID NO: 3008582 - RNA, 22 nt, Human
gccagaagucaaggcuuagacc

SEQ ID NO: 3008583 - RNA, 20 nt, Human
gccagaagucaaggcuuaga

SEQ ID NO: 3008584 - RNA, 16 nt, Human
gccagaagucaaggcu

SEQ ID NO: 3008585 - RNA, 23 nt, Human
gccagaagucaaggcuuagaccc

SEQ ID NO: 3008586 - RNA, 16 nt, Human
gcugcugauuuaaaca

SEQ ID NO: 3008587 - RNA, 13 nt, Human
gcuguacauacuu

SEQ ID NO: 3008588 - RNA, 14 nt, Human
gcuguacauacuuu

SEQ ID NO: 3008589 - RNA, 15 nt, Human
gcuguacauacuuuu

SEQ ID NO: 3008590 - RNA, 16 nt, Human
gcuguacauacuuuuu

SEQ ID NO: 3008591 - RNA, 17 nt, Human
gaguggaguuacugaac

SEQ ID NO: 3008592 - RNA, 11 nt, Human
gaguggaguua

SEQ ID NO: 3008593 - RNA, 13 nt, Human
gcacaucauuuca

SEQ ID NO: 3008594 - RNA, 11 nt, Human
gaagcagagug

SEQ ID NO: 3008595 - RNA, 12 nt, Human
gaagcagagugg

SEQ ID NO: 3008596 - RNA, 16 nt, Human
gaaguucuauuuauuu

SEQ ID NO: 3008597 - RNA, 22 nt, Human
gacauugacuauuuuuguuuuu

SEQ ID NO: 3008598 - RNA, 14 nt, Human
gacauugacuauuu

SEQ ID NO: 3008599 - RNA, 12 nt, Human
gacauucccugc

SEQ ID NO: 3008600 - RNA, 13 nt, Human
gacucuucccuca

SEQ ID NO: 3008601 - RNA, 13 nt, Human
cuuggcccaggag

SEQ ID NO: 3008602 - RNA, 20 nt, Human
cugcuuauccguuagccgug

SEQ ID NO: 3008603 - RNA, 16 nt, Human
cugcugauuuaaacac

SEQ ID NO: 3008604 - RNA, 22 nt, Human
cugcugauuuaaacacauuaaa

SEQ ID NO: 3008605 - RNA, 17 nt, Human
aaauuuacuuuaaacua

SEQ ID NO: 3008606 - RNA, 20 nt, Human
aaauuuacuuuaaacuacau

SEQ ID NO: 3008607 - RNA, 17 nt, Human
gucaacauuucucaugu

SEQ ID NO: 3008608 - RNA, 13 nt, Human
gucaacauuucuc

SEQ ID NO: 3008609 - RNA, 17 nt, Human
aaaggauacuuauuuaa

SEQ ID NO: 3008610 - RNA, 15 nt, Human
aaaggauacuuauuu

SEQ ID NO: 3008611 - RNA, 15 nt, Human
aaaugauuucacagu

SEQ ID NO: 3008612 - RNA, 22 nt, Human
aacaguaacauagcugugauuu

SEQ ID NO: 3008613 - RNA, 18 nt, Human
aacaggcuuagugaugua

SEQ ID NO: 3008614 - RNA, 15 nt, Human
aacaguaacauagcu

SEQ ID NO: 3008615 - RNA, 22 nt, Human
aacauuuauuugaguggaguua

SEQ ID NO: 3008616 - RNA, 21 nt, Human
aacacucuauaacaaaggaua

SEQ ID NO: 3008617 - RNA, 22 nt, Human
aacacugguuuuaaauauuuug

SEQ ID NO: 3008618 - RNA, 18 nt, Human
aacacugguuuuaaauau

SEQ ID NO: 3008619 - RNA, 16 nt, Human
aaccccaaguuaguuc

SEQ ID NO: 3008620 - RNA, 14 nt, Human
guuuuacaguguuu

SEQ ID NO: 3008621 - RNA, 20 nt, Human
guuuaaugguaguuuuacag

SEQ ID NO: 3008622 - RNA, 14 nt, Human
guuacacaaagaac

SEQ ID NO: 3008623 - RNA, 17 nt, Human
aagacccucucaaacua

SEQ ID NO: 3008624 - RNA, 23 nt, Human
aagaauugauugggcacaucauu

SEQ ID NO: 3008625 - RNA, 24 nt, Human
aagaaugcaguacuaacauuuauu

SEQ ID NO: 3008626 - RNA, 15 nt, Human
gugccuaauguguuu

SEQ ID NO: 3008627 - RNA, 21 nt, Human
aacuuuaagaacuaaaauguu

SEQ ID NO: 3008628 - RNA, 18 nt, Human
uaaugagcuuaagaaauu

SEQ ID NO: 3008629 - RNA, 16 nt, Human
uaaugguaguuuuaca

SEQ ID NO: 3008630 - RNA, 18 nt, Human
uaaugguaguuuuacagu

SEQ ID NO: 3008631 - RNA, 13 nt, Human
aaugacucuuccc

SEQ ID NO: 3008632 - RNA, 18 nt, Human
uaauuauugauguuuuca

SEQ ID NO: 3008633 - RNA, 16 nt, Human
uaauuauugauguuuu

SEQ ID NO: 3008634 - RNA, 14 nt, Human
aaugagcuuaagaa

SEQ ID NO: 3008635 - RNA, 18 nt, Human
aaugcaguacuaacauuu

SEQ ID NO: 3008636 - RNA, 17 nt, Human
aauaacuggaacacucu

SEQ ID NO: 3008637 - RNA, 20 nt, Human
guuuugaagauucuauguua

SEQ ID NO: 3008638 - RNA, 17 nt, Human
guuuugaagauucuaug

SEQ ID NO: 3008639 - RNA, 16 nt, Human
guuuugaagauucuau

SEQ ID NO: 3008640 - RNA, 13 nt, Human
aauaaaaagguga

SEQ ID NO: 3008641 - RNA, 12 nt, Human
aauaaaaaggug

SEQ ID NO: 3008642 - RNA, 16 nt, Human
aauaaaaaggugacca

SEQ ID NO: 3008643 - RNA, 14 nt, Human
uaaauagaugacau

SEQ ID NO: 3008644 - RNA, 19 nt, Human
uaaauagaugacauugacu

SEQ ID NO: 3008645 - RNA, 21 nt, Human
uaaauagaugacauugacuau

SEQ ID NO: 3008646 - RNA, 15 nt, Human
aauauugguugggau

SEQ ID NO: 3008647 - RNA, 21 nt, Human
aauauugguugggaugacuug

SEQ ID NO: 3008648 - RNA, 21 nt, Human
aauauuuuagguguaaaauaa

SEQ ID NO: 3008649 - RNA, 16 nt, Human
aauaugaugacuguuu

SEQ ID NO: 3008650 - RNA, 17 nt, Human
aauaugaugacuguuuu

SEQ ID NO: 3008651 - RNA, 21 nt, Human
aauauccuaauaaaaagguga

SEQ ID NO: 3008652 - RNA, 20 nt, Human
aauagcauguccuaaugcuu

SEQ ID NO: 3008653 - RNA, 19 nt, Human
aauagaugacauugacuau

SEQ ID NO: 3008654 - RNA, 21 nt, Human
aauagaugacauugacuauuu

SEQ ID NO: 3008655 - RNA, 22 nt, Human
aauagaugacauugacuauuuu

SEQ ID NO: 3008656 - RNA, 19 nt, Human
aauauccuaauaaaaaggu

SEQ ID NO: 3008657 - RNA, 15 nt, Human
aauauccuaauaaaa

SEQ ID NO: 3008658 - RNA, 20 nt, Human
aauauccaauugcugcuugu

SEQ ID NO: 3008659 - RNA, 14 nt, Human
aauauccuaauaaa

SEQ ID NO: 3008660 - RNA, 13 nt, Human
aauauccuaauaa

SEQ ID NO: 3008661 - RNA, 12 nt, Human
aauauccuaaua

SEQ ID NO: 3008662 - RNA, 22 nt, Human
aauaucccuuggacauuuuaug

SEQ ID NO: 3008663 - RNA, 20 nt, Human
aauaucccuuggacauuuua

SEQ ID NO: 3008664 - RNA, 21 nt, Human
aauaucccuuggacauuuuau

SEQ ID NO: 3008665 - RNA, 15 nt, Human
acaaagcuuuugcau

SEQ ID NO: 3008666 - RNA, 22 nt, Human
acaaagcuuuugcauauugcau

SEQ ID NO: 3008667 - RNA, 23 nt, Human
acaaagcuuuugcauauugcaua

SEQ ID NO: 3008668 - RNA, 21 nt, Human
acaaaggauacuuauuuaaau

SEQ ID NO: 3008669 - RNA, 23 nt, Human
acaaaggauacuuauuuaaauag

SEQ ID NO: 3008670 - RNA, 20 nt, Human
uagaugaaugucaguuguua

SEQ ID NO: 3008671 - RNA, 23 nt, Human
aauuugccuaauaugaugacugu

SEQ ID NO: 3008672 - RNA, 16 nt, Human
aauuugcacauuaaau

SEQ ID NO: 3008673 - RNA, 10 nt, Human
uacuuuuugg

SEQ ID NO: 3008674 - RNA, 12 nt, Human
aauuugcacauu

SEQ ID NO: 3008675 - RNA, 12 nt, Human
uacuuauuuaaa

SEQ ID NO: 3008676 - RNA, 14 nt, Human
uacuuauuuaaaua

SEQ ID NO: 3008677 - RNA, 21 nt, Human
uacuuauuuaaauagaugaca

SEQ ID NO: 3008678 - RNA, 14 nt, Human
aauuugcacauuaa

SEQ ID NO: 3008679 - RNA, 16 nt, Human
aauuuacuuuaaacua

SEQ ID NO: 3008680 - RNA, 15 nt, Human
aauuuacuuuaaacu

SEQ ID NO: 3008681 - RNA, 18 nt, Human
aauuuacuuuaaacuaca

SEQ ID NO: 3008682 - RNA, 21 nt, Human
uacuaaaaguuuugagaaauu

SEQ ID NO: 3008683 - RNA, 23 nt, Human
uacugggaaagggauuuucagcc

SEQ ID NO: 3008684 - RNA, 14 nt, Human
uacugaacaguaac

SEQ ID NO: 3008685 - RNA, 20 nt, Human
aauugauugggcacaucauu

SEQ ID NO: 3008686 - RNA, 23 nt, Human
aauugauugggcacaucauuuca

SEQ ID NO: 3008687 - RNA, 19 nt, Human
aauugauugggcacaucau

SEQ ID NO: 3008688 - RNA, 12 nt, Human
uagguugugaau

SEQ ID NO: 3008689 - RNA, 14 nt, Human
acacaccuaacuua

SEQ ID NO: 3008690 - RNA, 23 nt, Human
uaguucaaucuggauucauauuu

SEQ ID NO: 3008691 - RNA, 18 nt, Human
acacaugcugaacaucac

SEQ ID NO: 3008692 - RNA, 19 nt, Human
uauauucauucuuuuugaa

SEQ ID NO: 3008693 - RNA, 20 nt, Human
uauauucauucuuuuugaaa

SEQ ID NO: 3008694 - RNA, 18 nt, Human
acacuugugaauaaagag

SEQ ID NO: 3008695 - RNA, 12 nt, Human
acacuugugaau

SEQ ID NO: 3008696 - RNA, 13 nt, Human
acacuugugaaua

SEQ ID NO: 3008697 - RNA, 15 nt, Human
acacucuauaacaaa

SEQ ID NO: 3008698 - RNA, 20 nt, Human
acagcaacacaaagcuuuug

SEQ ID NO: 3008699 - RNA, 17 nt, Human
acagcaacacaaagcuu

SEQ ID NO: 3008700 - RNA, 20 nt, Human
uauccuagucauucuucccu

SEQ ID NO: 3008701 - RNA, 15 nt, Human
uauuugugagacugu

SEQ ID NO: 3008702 - RNA, 15 nt, Human
acauuagguugugaa

SEQ ID NO: 3008703 - RNA, 16 nt, Human
acauuagguugugaau

SEQ ID NO: 3008704 - RNA, 17 nt, Human
acauuagguugugaaug

SEQ ID NO: 3008705 - RNA, 21 nt, Human
acaugcugaacaucacagcuu

SEQ ID NO: 3008706 - RNA, 14 nt, Human
acaugcugaacauc

SEQ ID NO: 3008707 - RNA, 17 nt, Human
acaugcuguacauacuu

SEQ ID NO: 3008708 - RNA, 15 nt, Human
acauuaaaugacucu

SEQ ID NO: 3008709 - RNA, 19 nt, Human
acauuaaaugacucuuccc

SEQ ID NO: 3008710 - RNA, 21 nt, Human
acauuaaaugacucuucccuc

SEQ ID NO: 3008711 - RNA, 16 nt, Human
ucaagaaugcaguacu

SEQ ID NO: 3008712 - RNA, 14 nt, Human
ucaaggcuuagacc

SEQ ID NO: 3008713 - RNA, 11 nt, Human
acauacuuuuu

SEQ ID NO: 3008714 - RNA, 13 nt, Human
acauacuuuuugg

SEQ ID NO: 3008715 - RNA, 17 nt, Human
acauacuuuuuggguuu

SEQ ID NO: 3008716 - RNA, 20 nt, Human
acauacuuuuuggguuuauu

SEQ ID NO: 3008717 - RNA, 18 nt, Human
acaguuggguuuuuuaag

SEQ ID NO: 3008718 - RNA, 16 nt, Human
acaguuggguuuuuua

SEQ ID NO: 3008719 - RNA, 13 nt, Human
acaucuguuuugu

SEQ ID NO: 3008720 - RNA, 14 nt, Human
acauagcugugauu

SEQ ID NO: 3008721 - RNA, 17 nt, Human
accaauauuuaaucuuu

SEQ ID NO: 3008722 - RNA, 16 nt, Human
accaauauuuaaucuu

SEQ ID NO: 3008723 - RNA, 20 nt, Human
accaauauuuaaucuuuuau

SEQ ID NO: 3008724 - RNA, 23 nt, Human
accaauauuuaaucuuuuaugau

SEQ ID NO: 3008725 - RNA, 14 nt, Human
uccccucuccucca

SEQ ID NO: 3008726 - RNA, 11 nt, Human
uccuaaauagc

SEQ ID NO: 3008727 - RNA, 15 nt, Human
ucccuuucccuuggu

SEQ ID NO: 3008728 - RNA, 17 nt, Human
ucccugugucauuucaa

SEQ ID NO: 3008729 - RNA, 16 nt, Human
ucccugugucauuuca

SEQ ID NO: 3008730 - RNA, 18 nt, Human
acuaacauuuauuugagu

SEQ ID NO: 3008731 - RNA, 12 nt, Human
acuaacaggcuu

SEQ ID NO: 3008732 - RNA, 17 nt, Human
acuaacaggcuuaguga

SEQ ID NO: 3008733 - RNA, 18 nt, Human
acuaacaggcuuagugau

SEQ ID NO: 3008734 - RNA, 12 nt, Human
ucauuacuaaaa

SEQ ID NO: 3008735 - RNA, 21 nt, Human
ucauucuuuuugaaaugucaa

SEQ ID NO: 3008736 - RNA, 22 nt, Human
accuggauugugccuaaugugu

SEQ ID NO: 3008737 - RNA, 22 nt, Human
uccaaucugugaugacauuccc

SEQ ID NO: 3008738 - RNA, 18 nt, Human
ucgcuccaccuugcagcu

SEQ ID NO: 3008739 - RNA, 12 nt, Human
ucugacuauaac

SEQ ID NO: 3008740 - RNA, 18 nt, Human
ucucucaucuguuacaca

SEQ ID NO: 3008741 - RNA, 11 nt, Human
acuuuaaacua

SEQ ID NO: 3008742 - RNA, 15 nt, Human
ucuauuuauuuguga

SEQ ID NO: 3008743 - RNA, 21 nt, Human
ucuauuucuggaugaaugccc

SEQ ID NO: 3008744 - RNA, 15 nt, Human
ucuuacaucugaaau

SEQ ID NO: 3008745 - RNA, 14 nt, Human
agacaguuggguuu

SEQ ID NO: 3008746 - RNA, 20 nt, Human
ucugugaugacauucccugc

SEQ ID NO: 3008747 - RNA, 17 nt, Human
ucugugaugacauuccc

SEQ ID NO: 3008748 - RNA, 12 nt, Human
ucuguauguguu

SEQ ID NO: 3008749 - RNA, 15 nt, Human
ucuguauguguucua

SEQ ID NO: 3008750 - RNA, 12 nt, Human
agaauguuuuca

SEQ ID NO: 3008751 - RNA, 12 nt, Human
ugaagcagagug

SEQ ID NO: 3008752 - RNA, 13 nt, Human
ugaagcagagugg

SEQ ID NO: 3008753 - RNA, 16 nt, Human
ugaagcagaguggcag

SEQ ID NO: 3008754 - RNA, 15 nt, Human
ugaaugucaguuguu

SEQ ID NO: 3008755 - RNA, 18 nt, Human
agagguacacuugugaau

SEQ ID NO: 3008756 - RNA, 14 nt, Human
ugaaauaaggaaug

SEQ ID NO: 3008757 - RNA, 18 nt, Human
ugaaauaaggaaugauau

SEQ ID NO: 3008758 - RNA, 20 nt, Human
agcaggaagcugugagagca

SEQ ID NO: 3008759 - RNA, 20 nt, Human
agcaguuugguuucuagcau

SEQ ID NO: 3008760 - RNA, 23 nt, Human
agcaguuugguuucuagcaugaa

SEQ ID NO: 3008761 - RNA, 22 nt, Human
agcaguuugguuucuagcauga

SEQ ID NO: 3008762 - RNA, 14 nt, Human
ugaguggaguuacu

SEQ ID NO: 3008763 - RNA, 18 nt, Human
ugagugcaaacuucagag

SEQ ID NO: 3008764 - RNA, 20 nt, Human
ugagugcaaacuucagaguu

SEQ ID NO: 3008765 - RNA, 22 nt, Human
ugagugcaaacuucagaguucu

SEQ ID NO: 3008766 - RNA, 18 nt, Human
ugcaucuagccucaagcu

SEQ ID NO: 3008767 - RNA, 16 nt, Human
ugauuucacagugugu

SEQ ID NO: 3008768 - RNA, 14 nt, Human
ugauuucacagugu

SEQ ID NO: 3008769 - RNA, 16 nt, Human
ugcaaacuucagaguu

SEQ ID NO: 3008770 - RNA, 23 nt, Human
ugcaaagaugaaggucuguuuug

SEQ ID NO: 3008771 - RNA, 12 nt, Human
ugcaaagaugaa

SEQ ID NO: 3008772 - RNA, 15 nt, Human
ugcacauuaaaugac

SEQ ID NO: 3008773 - RNA, 18 nt, Human
ugcacauuaaaugacucu

SEQ ID NO: 3008774 - RNA, 13 nt, Human
ugcacauuaaaug

SEQ ID NO: 3008775 - RNA, 17 nt, Human
uggauucauauuuaauu

SEQ ID NO: 3008776 - RNA, 14 nt, Human
uggauucauauuua

SEQ ID NO: 3008777 - RNA, 20 nt, Human
uggaguuauugaagcagagu

SEQ ID NO: 3008778 - RNA, 14 nt, Human
aggcaggggaaugu

SEQ ID NO: 3008779 - RNA, 19 nt, Human
aggcaggggaauguaugug

SEQ ID NO: 3008780 - RNA, 16 nt, Human
aggcaggggaauguau

SEQ ID NO: 3008781 - RNA, 20 nt, Human
agcuuaagaaauuuguggaa

SEQ ID NO: 3008782 - RNA, 21 nt, Human
ugguuaguagagguacacuug

SEQ ID NO: 3008783 - RNA, 16 nt, Human
aguaaaauguggcagg

SEQ ID NO: 3008784 - RNA, 18 nt, Human
aguaggggucugucuuuu

SEQ ID NO: 3008785 - RNA, 20 nt, Human
aguaggggucugucuuuuaa

SEQ ID NO: 3008786 - RNA, 19 nt, Human
ugucaagcugaccuugcug

SEQ ID NO: 3008787 - RNA, 17 nt, Human
agggcccuuuuucaaua

SEQ ID NO: 3008788 - RNA, 16 nt, Human
uguuuuaucuucuaua

SEQ ID NO: 3008789 - RNA, 21 nt, Human
uguuuuauauagcaagacauu

SEQ ID NO: 3008790 - RNA, 19 nt, Human
uguuuugccaauuugcaca

SEQ ID NO: 3008791 - RNA, 17 nt, Human
uguuuugccaauuugca

SEQ ID NO: 3008792 - RNA, 21 nt, Human
uguuuugccaauuugcacauu

SEQ ID NO: 3008793 - RNA, 22 nt, Human
uguuuugccaauuugcacauua

SEQ ID NO: 3008794 - RNA, 22 nt, Human
uguuugagcaucgcuuaggaga

SEQ ID NO: 3008795 - RNA, 14 nt, Human
uguugcuaacagca

SEQ ID NO: 3008796 - RNA, 15 nt, Human
aguuggguuuuuuaa

SEQ ID NO: 3008797 - RNA, 18 nt, Human
agucuucaguuugcagag

SEQ ID NO: 3008798 - RNA, 20 nt, Human
agucuucaguuugcagagua

SEQ ID NO: 3008799 - RNA, 21 nt, Human
agucuucaguuugcagaguag

SEQ ID NO: 3008800 - RNA, 18 nt, Human
ugugaugacauucccugc

SEQ ID NO: 3008801 - RNA, 16 nt, Human
auauucucagcagagu

SEQ ID NO: 3008802 - RNA, 15 nt, Human
auauucucagcagag

SEQ ID NO: 3008803 - RNA, 17 nt, Human
auauucucagcagagug

SEQ ID NO: 3008804 - RNA, 18 nt, Human
auauucucagcagagugc

SEQ ID NO: 3008805 - RNA, 22 nt, Human
auauugcauacuauuaaacaug

SEQ ID NO: 3008806 - RNA, 20 nt, Human
auauugcauacuauuaaaca

SEQ ID NO: 3008807 - RNA, 23 nt, Human
auauuucugaggagccugcaaca

SEQ ID NO: 3008808 - RNA, 13 nt, Human
uucucacagaaga

SEQ ID NO: 3008809 - RNA, 11 nt, Human
uuauuuauuga

SEQ ID NO: 3008810 - RNA, 13 nt, Human
uuauuuaaauaga

SEQ ID NO: 3008811 - RNA, 19 nt, Human
auagcugugauuuuuggua

SEQ ID NO: 3008812 - RNA, 12 nt, Human
auaacuuuuuau

SEQ ID NO: 3008813 - RNA, 22 nt, Human
auagcugugauuuuugguauuu

SEQ ID NO: 3008814 - RNA, 21 nt, Human
uuauuucucucaucuguuaca

SEQ ID NO: 3008815 - RNA, 20 nt, Human
uucauauuuaauuugaaggu

SEQ ID NO: 3008816 - RNA, 18 nt, Human
uucauagagaauauaaaa

SEQ ID NO: 3008817 - RNA, 11 nt, Human
uucauagagaa

SEQ ID NO: 3008818 - RNA, 18 nt, Human
uucacugguacucugcca

SEQ ID NO: 3008819 - RNA, 15 nt, Human
uucagcccucagaau

SEQ ID NO: 3008820 - RNA, 13 nt, Human
auauaagguuuuu

SEQ ID NO: 3008821 - RNA, 20 nt, Human
uuggcccaggauuauuguca

SEQ ID NO: 3008822 - RNA, 22 nt, Human
uuggcccaggaguuuggccaga

SEQ ID NO: 3008823 - RNA, 21 nt, Human
uuggcccaggaguuuggccag

SEQ ID NO: 3008824 - RNA, 20 nt, Human
uuggcccaggaguuuggcca

SEQ ID NO: 3008825 - RNA, 15 nt, Human
uuggcccaggaguuu

SEQ ID NO: 3008826 - RNA, 14 nt, Human
uuggcccaggaguu

SEQ ID NO: 3008827 - RNA, 13 nt, Human
uuggcccaggagu

SEQ ID NO: 3008828 - RNA, 21 nt, Human
aucugugaugacauucccugc

SEQ ID NO: 3008829 - RNA, 19 nt, Human
aucugugaugacauucccu

SEQ ID NO: 3008830 - RNA, 14 nt, Human
uugagugucaagcu

SEQ ID NO: 3008831 - RNA, 19 nt, Human
aucccuuggacauuuuaug

SEQ ID NO: 3008832 - RNA, 17 nt, Human
aucccuuggacauuuua

SEQ ID NO: 3008833 - RNA, 21 nt, Human
aucccuuggacauuuuauguc

SEQ ID NO: 3008834 - RNA, 20 nt, Human
aucccuuggacauuuuaugu

SEQ ID NO: 3008835 - RNA, 16 nt, Human
aucccuuucccuuggu

SEQ ID NO: 3008836 - RNA, 19 nt, Human
uugccaauuugcacauuaa

SEQ ID NO: 3008837 - RNA, 22 nt, Human
uugccaauuugcacauuaaaug

SEQ ID NO: 3008838 - RNA, 23 nt, Human
uugccaauuugcacauuaaauga

SEQ ID NO: 3008839 - RNA, 16 nt, Human
uuuaucagaacuaugu

SEQ ID NO: 3008840 - RNA, 17 nt, Human
uuuaucagaacuauguu

SEQ ID NO: 3008841 - RNA, 18 nt, Human
uuuaaucuuuuaugauug

SEQ ID NO: 3008842 - RNA, 16 nt, Human
augcccagugagacug

SEQ ID NO: 3008843 - RNA, 15 nt, Human
augcccagugagacu

SEQ ID NO: 3008844 - RNA, 18 nt, Human
uuuaucagaacuauguuu

SEQ ID NO: 3008845 - RNA, 22 nt, Human
uugugaaugcagguuuuaucag

SEQ ID NO: 3008846 - RNA, 16 nt, Human
uuguguacuuuuaaga

SEQ ID NO: 3008847 - RNA, 20 nt, Human
augcaaagaugaaggucugu

SEQ ID NO: 3008848 - RNA, 18 nt, Human
uuuaagggcccuuuuuca

SEQ ID NO: 3008849 - RNA, 20 nt, Human
uuuaagggcccuuuuucaau

SEQ ID NO: 3008850 - RNA, 21 nt, Human
uuuaagggcccuuuuucaaua

SEQ ID NO: 3008851 - RNA, 13 nt, Human
uuuaaucuuuuau

SEQ ID NO: 3008852 - RNA, 15 nt, Human
uuuaaucuuuuauga

SEQ ID NO: 3008853 - RNA, 16 nt, Human
uuuaagacuuugguua

SEQ ID NO: 3008854 - RNA, 20 nt, Human
uuuuguuuuuauuaaaagga

SEQ ID NO: 3008855 - RNA, 21 nt, Human
uuuuuauauucucagcagagu

SEQ ID NO: 3008856 - RNA, 22 nt, Human
uuuuuauauucucagcagagug

SEQ ID NO: 3008857 - RNA, 14 nt, Human
uuuuggaaaagaau

SEQ ID NO: 3008858 - RNA, 12 nt, Human
uuuuguguacuu

SEQ ID NO: 3008859 - RNA, 18 nt, Human
uuuuuggaaaagaauaaa

SEQ ID NO: 3008860 - RNA, 15 nt, Human
uuuuugguauuugaa

SEQ ID NO: 3008861 - RNA, 17 nt, Human
auuauugauguuuucau

SEQ ID NO: 3008862 - RNA, 21 nt, Human
auuaguuuugaagauucuaug

SEQ ID NO: 3008863 - RNA, 21 nt, Human
auuccuaacuaucacugguuu

SEQ ID NO: 3008864 - RNA, 23 nt, Human
uuuguaacuguuuagaugaaugu

SEQ ID NO: 3008865 - RNA, 23 nt, Human
uuugagaaauuuuuuuuuccagu

SEQ ID NO: 3008866 - RNA, 17 nt, Human
uuuguuuuuauuaaaag

SEQ ID NO: 3008867 - RNA, 14 nt, Human
auguugcuaacagc

SEQ ID NO: 3008868 - RNA, 22 nt, Human
auugcauacuauuaaacaugcu

SEQ ID NO: 3008869 - RNA, 19 nt, Human
auugcauacuauuaaacau

SEQ ID NO: 3008870 - RNA, 20 nt, Human
auugcauacuauuaaacaug

SEQ ID NO: 3008871 - RNA, 19 nt, Human
auugccuuuuuauaacuuu

SEQ ID NO: 3008872 - RNA, 20 nt, Human
auugccuuuuuauaacuuuu

SEQ ID NO: 3008873 - RNA, 21 nt, Human
auugccuuuuuauaacuuuuu

SEQ ID NO: 3008874 - RNA, 15 nt, Human
auugaaguaaaaugu

SEQ ID NO: 3008875 - RNA, 24 nt, Human
auuccuagaaacugacacaugcug

SEQ ID NO: 3008876 - RNA, 17 nt, Human
auugaaggaugcugucu

SEQ ID NO: 3008877 - RNA, 14 nt, Human
auugaaguaaaaug

SEQ ID NO: 3008878 - RNA, 17 nt, Human
auugauguuuucauaga

SEQ ID NO: 3008879 - RNA, 16 nt, Human
auugauguuuucauag

SEQ ID NO: 3008880 - RNA, 13 nt, Human
auugauguuuuca

SEQ ID NO: 3008881 - RNA, 18 nt, Human
auugcauacuauuaaaca

SEQ ID NO: 3008882 - RNA, 17 nt, Human
auugcauacuauuaaac

SEQ ID NO: 3008883 - RNA, 17 nt, Human
auugcaccuggauguac

SEQ ID NO: 3008884 - RNA, 22 nt, Human
auuuauugaaaugauuucacag

SEQ ID NO: 3008885 - RNA, 15 nt, Human
auuuauugaaaugau

SEQ ID NO: 3008886 - RNA, 13 nt, Human
auuuauugaaaug

SEQ ID NO: 3008887 - RNA, 12 nt, Human
auuuauuacaac

SEQ ID NO: 3008888 - RNA, 15 nt, Human
auuuacuuuaaacua

SEQ ID NO: 3008889 - RNA, 14 nt, Human
auuuaaauagauga

SEQ ID NO: 3008890 - RNA, 15 nt, Human
auuuaaauagaugac

SEQ ID NO: 3008891 - RNA, 22 nt, Human
aaauagcagcccucaauuguga

SEQ ID NO: 3008892 - RNA, 21 nt, Human
aaauagaugacauugacuauu

SEQ ID NO: 3008893 - RNA, 14 nt, Human
aaauagaugacauu

SEQ ID NO: 3008894 - RNA, 22 nt, Human
aagacagagccccacccucaga

SEQ ID NO: 3008895 - RNA, 20 nt, Human
aaggcaggggaauguaugug

SEQ ID NO: 3008896 - RNA, 18 nt, Human
aaggcaggggaauguaug

SEQ ID NO: 3008897 - RNA, 19 nt, Human
aauuccuguuuuuauuauu

SEQ ID NO: 3008898 - RNA, 21 nt, Human
aauuccuguuuuuauuauuaa

SEQ ID NO: 3008899 - RNA, 22 nt, Human
aauuccuguuuuuauuauuaac

SEQ ID NO: 3008900 - RNA, 13 nt, Human
aauuccuguuuuu

SEQ ID NO: 3008901 - RNA, 20 nt, Human
aauuaugguuaguagaggua

SEQ ID NO: 3008902 - RNA, 14 nt, Human
acaucauuucaaga

SEQ ID NO: 3008903 - RNA, 19 nt, Human
acuggaacacucuauaaca

SEQ ID NO: 3008904 - RNA, 13 nt, Human
acugacacaugcu

SEQ ID NO: 3008905 - RNA, 22 nt, Human
acccucaugcugccaauauccu

SEQ ID NO: 3008906 - RNA, 16 nt, Human
acccucaugcugccaa

SEQ ID NO: 3008907 - RNA, 14 nt, Human
acccucaugcugcc

SEQ ID NO: 3008908 - RNA, 20 nt, Human
acccucagaugcacaugagc

SEQ ID NO: 3008909 - RNA, 14 nt, Human
acgcacacugucug

SEQ ID NO: 3008910 - RNA, 13 nt, Human
aguuugcagagua

SEQ ID NO: 3008911 - RNA, 17 nt, Human
aguuguuauuuauugaa

SEQ ID NO: 3008912 - RNA, 14 nt, Human
agugcuauugcaga

SEQ ID NO: 3008913 - RNA, 21 nt, Human
auaagugcuauugcagagccg

SEQ ID NO: 3008914 - RNA, 22 nt, Human
agucuggcagacuuucuucucu

SEQ ID NO: 3008915 - RNA, 22 nt, Human
agugcuacacaccuaacuuaug

SEQ ID NO: 3008916 - RNA, 18 nt, Human
agugauguaauuaugguu

SEQ ID NO: 3008917 - RNA, 15 nt, Human
aucaucccuuucccu

SEQ ID NO: 3008918 - RNA, 19 nt, Human
aucaucccuuucccuuggu

SEQ ID NO: 3008919 - RNA, 16 nt, Human
auagcaagacauuaua

SEQ ID NO: 3008920 - RNA, 23 nt, Human
augagcuuaagaaauuuguggaa

SEQ ID NO: 3008921 - RNA, 14 nt, Human
augagcuuaagaaa

SEQ ID NO: 3008922 - RNA, 12 nt, Human
aggcuuagaccc

SEQ ID NO: 3008923 - RNA, 21 nt, Human
aggcuuagacccucaugcugc

SEQ ID NO: 3008924 - RNA, 14 nt, Human
aggcuuagacccuc

SEQ ID NO: 3008925 - RNA, 22 nt, Human
aggcuuagacccucaugcugcc

SEQ ID NO: 3008926 - RNA, 18 nt, Human
agaagucuucuauuuauu

SEQ ID NO: 3008927 - RNA, 19 nt, Human
agaagucaaggcuuagacc

SEQ ID NO: 3008928 - RNA, 18 nt, Human
agaagucaaggcuuagac

SEQ ID NO: 3008929 - RNA, 17 nt, Human
agaagucaaggcuuaga

SEQ ID NO: 3008930 - RNA, 16 nt, Human
agaagucaaggcuuag

SEQ ID NO: 3008931 - RNA, 23 nt, Human
agaaugcaguacuaacauuuauu

SEQ ID NO: 3008932 - RNA, 13 nt, Human
agcaaaucaguuu

SEQ ID NO: 3008933 - RNA, 23 nt, Human
agaugacauugacuauuuuuguu

SEQ ID NO: 3008934 - RNA, 18 nt, Human
agaugacauugacuauuu

SEQ ID NO: 3008935 - RNA, 15 nt, Human
agaugaaugucaguu

SEQ ID NO: 3008936 - RNA, 11 nt, Human
agaugaauguc

SEQ ID NO: 3008937 - RNA, 18 nt, Human
agauucuauguuaauauu

SEQ ID NO: 3008938 - RNA, 19 nt, Human
agcaucgcuuaggagaagu

SEQ ID NO: 3008939 - RNA, 17 nt, Human
caacauaacucaagucu

SEQ ID NO: 3008940 - RNA, 23 nt, Human
caacugggguggguggggcagug

SEQ ID NO: 3008941 - RNA, 20 nt, Human
caauauccuaauaaaaaggu

SEQ ID NO: 3008942 - RNA, 19 nt, Human
caauauccuaauaaaaagg

SEQ ID NO: 3008943 - RNA, 18 nt, Human
caauauccuaauaaaaag

SEQ ID NO: 3008944 - RNA, 16 nt, Human
caauauccuaauaaaa

SEQ ID NO: 3008945 - RNA, 15 nt, Human
caauauccuaauaaa

SEQ ID NO: 3008946 - RNA, 14 nt, Human
caauauccuaauaa

SEQ ID NO: 3008947 - RNA, 13 nt, Human
caauauccuaaua

SEQ ID NO: 3008948 - RNA, 12 nt, Human
caauauccuaau

SEQ ID NO: 3008949 - RNA, 16 nt, Human
caccaugggauuaaua

SEQ ID NO: 3008950 - RNA, 16 nt, Human
cccaggaguuuggcca

SEQ ID NO: 3008951 - RNA, 15 nt, Human
cccaggaguuuggcc

SEQ ID NO: 3008952 - RNA, 20 nt, Human
cccaggaguuuggccagaag

SEQ ID NO: 3008953 - RNA, 19 nt, Human
cccaggaguuuggccagaa

SEQ ID NO: 3008954 - RNA, 18 nt, Human
cccaggaguuuggccaga

SEQ ID NO: 3008955 - RNA, 17 nt, Human
cccaggaguuuggccag

SEQ ID NO: 3008956 - RNA, 19 nt, Human
ccaauauccuaauaaaaag

SEQ ID NO: 3008957 - RNA, 18 nt, Human
ccaauauccuaauaaaaa

SEQ ID NO: 3008958 - RNA, 17 nt, Human
ccaauauccuaauaaaa

SEQ ID NO: 3008959 - RNA, 16 nt, Human
ccaauauccuaauaaa

SEQ ID NO: 3008960 - RNA, 15 nt, Human
ccaauauccuaauaa

SEQ ID NO: 3008961 - RNA, 14 nt, Human
ccaauauccuaaua

SEQ ID NO: 3008962 - RNA, 13 nt, Human
ccaauauccuaau

SEQ ID NO: 3008963 - RNA, 12 nt, Human
ccaauauccuaa

SEQ ID NO: 3008964 - RNA, 18 nt, Human
ccagaagucaaggcuuag

SEQ ID NO: 3008965 - RNA, 16 nt, Human
cccugugucauuucaa

SEQ ID NO: 3008966 - RNA, 17 nt, Human
cccuuuuucaauaacug

SEQ ID NO: 3008967 - RNA, 22 nt, Human
cccuuuuucaauaacuggaaca

SEQ ID NO: 3008968 - RNA, 18 nt, Human
ccucaauaaacauuucau

SEQ ID NO: 3008969 - RNA, 14 nt, Human
ccucaauugugaaa

SEQ ID NO: 3008970 - RNA, 17 nt, Human
cugcagggacagagcau

SEQ ID NO: 3008971 - RNA, 22 nt, Human
cuggacacuucacgcccuuggc

SEQ ID NO: 3008972 - RNA, 20 nt, Human
cuggacacuucacgcccuug

SEQ ID NO: 3008973 - RNA, 16 nt, Human
cugaacuucagagcau

SEQ ID NO: 3008974 - RNA, 17 nt, Human
cucauucauuacuaaaa

SEQ ID NO: 3008975 - RNA, 13 nt, Human
cucauucauuacu

SEQ ID NO: 3008976 - RNA, 22 nt, Human
cucccuuccuaugcuguucacu

SEQ ID NO: 3008977 - RNA, 18 nt, Human
cuuaagaaauuuguggaa

SEQ ID NO: 3008978 - RNA, 19 nt, Human
cuuaauaaacuguggugcu

SEQ ID NO: 3008979 - RNA, 14 nt, Human
cuuagacccucaug

SEQ ID NO: 3008980 - RNA, 18 nt, Human
cuuauuuaaauagaugac

SEQ ID NO: 3008981 - RNA, 19 nt, Human
cuuauuuaaauagaugaca

SEQ ID NO: 3008982 - RNA, 13 nt, Human
cuuauuuaaauag

SEQ ID NO: 3008983 - RNA, 14 nt, Human
cuuauuuaaauaga

SEQ ID NO: 3008984 - RNA, 22 nt, Human
cuugcagcucuccccuucucug

SEQ ID NO: 3008985 - RNA, 20 nt, Human
cuuguugaggguauguuuua

SEQ ID NO: 3008986 - RNA, 21 nt, Human
cuuguugaggguauguuuuau

SEQ ID NO: 3008987 - RNA, 22 nt, Human
cuuguugaggguauguuuuaua

SEQ ID NO: 3008988 - RNA, 16 nt, Human
cuuguugaggguaugu

SEQ ID NO: 3008989 - RNA, 16 nt, Human
cuuguacacucauuca

SEQ ID NO: 3008990 - RNA, 15 nt, Human
cuuuuucaauaacug

SEQ ID NO: 3008991 - RNA, 14 nt, Human
cuuuuugaaauguc

SEQ ID NO: 3008992 - RNA, 17 nt, Human
gacaguuggguuuuuua

SEQ ID NO: 3008993 - RNA, 13 nt, Human
gacaguuggguuu

SEQ ID NO: 3008994 - RNA, 21 nt, Human
gacagagccccacccucagau

SEQ ID NO: 3008995 - RNA, 22 nt, Human
gacuggauaguccgucucugcu

SEQ ID NO: 3008996 - RNA, 16 nt, Human
gacuggauaguccguc

SEQ ID NO: 3008997 - RNA, 17 nt, Human
gacuggauaguccgucu

SEQ ID NO: 3008998 - RNA, 22 nt, Human
gaauugauugggcacaucauuu

SEQ ID NO: 3008999 - RNA, 17 nt, Human
gaaugucaguuguuauu

SEQ ID NO: 3009000 - RNA, 23 nt, Human
gaaggugccucuggaugcuguga

SEQ ID NO: 3009001 - RNA, 17 nt, Human
gaagauucuauguuaau

SEQ ID NO: 3009002 - RNA, 23 nt, Human
gaagauucuauguuaauauuuua

SEQ ID NO: 3009003 - RNA, 20 nt, Human
gaagauucuauguuaauauu

SEQ ID NO: 3009004 - RNA, 14 nt, Human
gaacaucacagcuu

SEQ ID NO: 3009005 - RNA, 18 nt, Human
gaguuauugaagcagagu

SEQ ID NO: 3009006 - RNA, 19 nt, Human
gaguuauugaagcagagug

SEQ ID NO: 3009007 - RNA, 20 nt, Human
gaguuauugaagcagagugg

SEQ ID NO: 3009008 - RNA, 22 nt, Human
gaugaaugucaguuguuauuua

SEQ ID NO: 3009009 - RNA, 20 nt, Human
gauuuaaacacauuaaaggu

SEQ ID NO: 3009010 - RNA, 20 nt, Human
gauugggcacaucauuucaa

SEQ ID NO: 3009011 - RNA, 15 nt, Human
gcaaacuucagaguu

SEQ ID NO: 3009012 - RNA, 13 nt, Human
gcagaguggcagu

SEQ ID NO: 3009013 - RNA, 22 nt, Human
gcagaguggcagucuucaguuu

SEQ ID NO: 3009014 - RNA, 22 nt, Human
gcauauugcauacuauuaaaca

SEQ ID NO: 3009015 - RNA, 16 nt, Human
gcagugcuuggcccag

SEQ ID NO: 3009016 - RNA, 19 nt, Human
gcguccugucggagcccug

SEQ ID NO: 3009017 - RNA, 14 nt, Human
gcuaacuuggguua

SEQ ID NO: 3009018 - RNA, 22 nt, Human
gcguccugucggagcccugucu

SEQ ID NO: 3009019 - RNA, 19 nt, Human
gccuuuuuauaacuuuuua

SEQ ID NO: 3009020 - RNA, 10 nt, Human
ggaaaagaau

SEQ ID NO: 3009021 - RNA, 22 nt, Human
gcuuuaccaauugaaguaaaau

SEQ ID NO: 3009022 - RNA, 23 nt, Human
gcuuggcccaggaguuuggccag

SEQ ID NO: 3009023 - RNA, 13 nt, Human
gcuuggcccagga

SEQ ID NO: 3009024 - RNA, 22 nt, Human
gcuuggcccaggaguuuggcca

SEQ ID NO: 3009025 - RNA, 16 nt, Human
gcuuggcccaggaguu

SEQ ID NO: 3009026 - RNA, 15 nt, Human
gcuuggcccaggagu

SEQ ID NO: 3009027 - RNA, 14 nt, Human
gcuuggcccaggag

SEQ ID NO: 3009028 - RNA, 23 nt, Human
ggagcccugucuccucucucugu

SEQ ID NO: 3009029 - RNA, 21 nt, Human
ggcuuaauuauugauguuuuc

SEQ ID NO: 3009030 - RNA, 16 nt, Human
ggcuuagacccucaug

SEQ ID NO: 3009031 - RNA, 17 nt, Human
ggcuuagugauguaauu

SEQ ID NO: 3009032 - RNA, 23 nt, Human
gggcagugcuuggcccaggaguu

SEQ ID NO: 3009033 - RNA, 22 nt, Human
gggcagugcuuggcccaggagu

SEQ ID NO: 3009034 - RNA, 20 nt, Human
gggcagugcuuggcccagga

SEQ ID NO: 3009035 - RNA, 19 nt, Human
gggcagugcuuggcccagg

SEQ ID NO: 3009036 - RNA, 18 nt, Human
gggcagugcuuggcccag

SEQ ID NO: 3009037 - RNA, 18 nt, Human
gggauaucacuuccauga

SEQ ID NO: 3009038 - RNA, 16 nt, Human
gggcacaucauuucaa

SEQ ID NO: 3009039 - RNA, 16 nt, Human
gguuauuuuacuuuuu

SEQ ID NO: 3009040 - RNA, 23 nt, Human
ggggcagugcuuggcccaggagu

SEQ ID NO: 3009041 - RNA, 21 nt, Human
ggggcagugcuuggcccagga

SEQ ID NO: 3009042 - RNA, 20 nt, Human
uauaacaaaggauacuuauu

SEQ ID NO: 3009043 - RNA, 22 nt, Human
uauaacaaaggauacuuauuua

SEQ ID NO: 3009044 - RNA, 23 nt, Human
uauaauuccuguuuuuauuauua

SEQ ID NO: 3009045 - RNA, 23 nt, Human
uagacccucaugcugccaauauc

SEQ ID NO: 3009046 - RNA, 13 nt, Human
uagauguugcuaa

SEQ ID NO: 3009047 - RNA, 11 nt, Human
uagauguugcu

SEQ ID NO: 3009048 - RNA, 20 nt, Human
uagcagcccucaauugugaa

SEQ ID NO: 3009049 - RNA, 23 nt, Human
uagcaguaaaaaaugguguuuua

SEQ ID NO: 3009050 - RNA, 13 nt, Human
uaccaauauuuaa

SEQ ID NO: 3009051 - RNA, 16 nt, Human
uaccaauauuuaaucu

SEQ ID NO: 3009052 - RNA, 21 nt, Human
uaccaauauuuaaucuuuuau

SEQ ID NO: 3009053 - RNA, 23 nt, Human
uaccaauauuuaaucuuuuauga

SEQ ID NO: 3009054 - RNA, 13 nt, Human
uacacuugugaau

SEQ ID NO: 3009055 - RNA, 14 nt, Human
uaacaggcuuagug

SEQ ID NO: 3009056 - RNA, 21 nt, Human
uaacaggcuuagugauguaau

SEQ ID NO: 3009057 - RNA, 18 nt, Human
uaacagcaacacaaagcu

SEQ ID NO: 3009058 - RNA, 20 nt, Human
uaacagcaacacaaagcuuu

SEQ ID NO: 3009059 - RNA, 16 nt, Human
uaagaacuaaaauguu

SEQ ID NO: 3009060 - RNA, 18 nt, Human
guuuagaugaaugucagu

SEQ ID NO: 3009061 - RNA, 17 nt, Human
guuuagaugaaugucag

SEQ ID NO: 3009062 - RNA, 18 nt, Human
guuuuuauuauuaacaaa

SEQ ID NO: 3009063 - RNA, 15 nt, Human
guuuuuauuauuaac

SEQ ID NO: 3009064 - RNA, 14 nt, Human
guuuuuauuaaaag

SEQ ID NO: 3009065 - RNA, 17 nt, Human
guuuuuauuaaaaggaa

SEQ ID NO: 3009066 - RNA, 13 nt, Human
guuuuuauuaaaa

SEQ ID NO: 3009067 - RNA, 13 nt, Human
guuuguucccugu

SEQ ID NO: 3009068 - RNA, 17 nt, Human
guuuuguguacuuuuaa

SEQ ID NO: 3009069 - RNA, 15 nt, Human
guuuuguguacuuuu

SEQ ID NO: 3009070 - RNA, 16 nt, Human
guuuuguguacuuuua

SEQ ID NO: 3009071 - RNA, 19 nt, Human
uaaauauuuugacuuguug

SEQ ID NO: 3009072 - RNA, 15 nt, Human
uaaauauuuugacuu

SEQ ID NO: 3009073 - RNA, 18 nt, Human
uaaauauuuugacuuguu

SEQ ID NO: 3009074 - RNA, 23 nt, Human
uaaauauugguugggaugacuug

SEQ ID NO: 3009075 - RNA, 22 nt, Human
uaaauauugguugggaugacuu

SEQ ID NO: 3009076 - RNA, 22 nt, Human
uaaauaucccuuggacauuuua

SEQ ID NO: 3009077 - RNA, 12 nt, Human
uaaacacauuaa

SEQ ID NO: 3009078 - RNA, 22 nt, Human
uauuuuagguguaaaauaauua

SEQ ID NO: 3009079 - RNA, 15 nt, Human
uauuuuacuuuuugg

SEQ ID NO: 3009080 - RNA, 14 nt, Human
uauuuuacuuuuug

SEQ ID NO: 3009081 - RNA, 13 nt, Human
uauuuuacuuuuu

SEQ ID NO: 3009082 - RNA, 12 nt, Human
uauuuuacuuuu

SEQ ID NO: 3009083 - RNA, 23 nt, Human
uauuucugaggagccugcaacau

SEQ ID NO: 3009084 - RNA, 23 nt, Human
uauuugaguggaguuacugaaca

SEQ ID NO: 3009085 - RNA, 12 nt, Human
uauuuauugaaa

SEQ ID NO: 3009086 - RNA, 20 nt, Human
uauuuauugaaaugauuuca

SEQ ID NO: 3009087 - RNA, 16 nt, Human
uauuuauugaaaugau

SEQ ID NO: 3009088 - RNA, 12 nt, Human
ucaaacuaacag

SEQ ID NO: 3009089 - RNA, 13 nt, Human
ucaaacuaacagg

SEQ ID NO: 3009090 - RNA, 18 nt, Human
uauuuuuguuuuuauuaa

SEQ ID NO: 3009091 - RNA, 20 nt, Human
uauuuuuguuuuuauuaaaa

SEQ ID NO: 3009092 - RNA, 18 nt, Human
ucaagcugaccuugcuga

SEQ ID NO: 3009093 - RNA, 16 nt, Human
ucagcagagugcuuua

SEQ ID NO: 3009094 - RNA, 22 nt, Human
ucagcagagugcuuuaccaauu

SEQ ID NO: 3009095 - RNA, 11 nt, Human
ucagcagagug

SEQ ID NO: 3009096 - RNA, 12 nt, Human
ucagcagagugc

SEQ ID NO: 3009097 - RNA, 15 nt, Human
ucaucuguuacacaa

SEQ ID NO: 3009098 - RNA, 17 nt, Human
ucccccuggcacugguu

SEQ ID NO: 3009099 - RNA, 15 nt, Human
ucccauucuuggccc

SEQ ID NO: 3009100 - RNA, 16 nt, Human
ucccauucuuggccca

SEQ ID NO: 3009101 - RNA, 15 nt, Human
ucucaaacuaacagg

SEQ ID NO: 3009102 - RNA, 17 nt, Human
ucucaaacuaacaggcu

SEQ ID NO: 3009103 - RNA, 14 nt, Human
ucuuuuugaaaugu

SEQ ID NO: 3009104 - RNA, 24 nt, Human
ucuguaauaaacucauuucuagca

SEQ ID NO: 3009105 - RNA, 23 nt, Human
ucuguaauaaacucauuucuagc

SEQ ID NO: 3009106 - RNA, 19 nt, Human
ucuguaauaaacucauuuc

SEQ ID NO: 3009107 - RNA, 20 nt, Human
ucuguuacacaaagaaccac

SEQ ID NO: 3009108 - RNA, 22 nt, Human
ucuucuauuuauuuauuuauuc

SEQ ID NO: 3009109 - RNA, 22 nt, Human
ucuucuauauaauuccuguuuu

SEQ ID NO: 3009110 - RNA, 12 nt, Human
ucuucuauuuau

SEQ ID NO: 3009111 - RNA, 13 nt, Human
ucuucuauauaau

SEQ ID NO: 3009112 - RNA, 15 nt, Human
ugcuuuuuuuggccu

SEQ ID NO: 3009113 - RNA, 17 nt, Human
uggccagaagucaaggc

SEQ ID NO: 3009114 - RNA, 13 nt, Human
uggguuuauuugg

SEQ ID NO: 3009115 - RNA, 18 nt, Human
uggggcagugcuuggccc

SEQ ID NO: 3009116 - RNA, 22 nt, Human
uggggcagugcuuggcccagga

SEQ ID NO: 3009117 - RNA, 20 nt, Human
uggggcagugcuuggcccag

SEQ ID NO: 3009118 - RNA, 23 nt, Human
uggggcagugcuuggcccaggag

SEQ ID NO: 3009119 - RNA, 13 nt, Human
ugcacaucuguuu

SEQ ID NO: 3009120 - RNA, 21 nt, Human
ugcacacuguccuauuauauu

SEQ ID NO: 3009121 - RNA, 23 nt, Human
ugccuaccaauauuuaaucuuuu

SEQ ID NO: 3009122 - RNA, 17 nt, Human
ugccuaccaauauuuaa

SEQ ID NO: 3009123 - RNA, 17 nt, Human
ugccuaauaugaugacu

SEQ ID NO: 3009124 - RNA, 22 nt, Human
ugccuaauaugaugacuguuuu

SEQ ID NO: 3009125 - RNA, 23 nt, Human
uguuuugccaauuugcacauuaa

SEQ ID NO: 3009126 - RNA, 18 nt, Human
uguuuuuauuauuaacaa

SEQ ID NO: 3009127 - RNA, 15 nt, Human
uguuuuuauuauuaa

SEQ ID NO: 3009128 - RNA, 19 nt, Human
ugugugcguccugucggag

SEQ ID NO: 3009129 - RNA, 15 nt, Human
uguuuaaugguaguu

SEQ ID NO: 3009130 - RNA, 21 nt, Human
uguucuccagucauuauguua

SEQ ID NO: 3009131 - RNA, 16 nt, Human
uguugaaacuuuaaga

SEQ ID NO: 3009132 - RNA, 18 nt, Human
ugucaguuguuauuuauu

SEQ ID NO: 3009133 - RNA, 17 nt, Human
ugucaguuguuauuuau

SEQ ID NO: 3009134 - RNA, 22 nt, Human
ugucaguuguuauuuauugaaa

SEQ ID NO: 3009135 - RNA, 21 nt, Human
uguaacuguuuagaugaaugu

SEQ ID NO: 3009136 - RNA, 12 nt, Human
uguguacuuuua

SEQ ID NO: 3009137 - RNA, 15 nt, Human
uguguacuuuuaaga

SEQ ID NO: 3009138 - RNA, 14 nt, Human
ugugcguccugucg

SEQ ID NO: 3009139 - RNA, 12 nt, Human
ugugaaaaaauu

SEQ ID NO: 3009140 - RNA, 17 nt, Human
ugugaaaaaauuuacuu

SEQ ID NO: 3009141 - RNA, 23 nt, Human
ugugaaaaaauuuacuuuaaacu

SEQ ID NO: 3009142 - RNA, 21 nt, Human
ugugaauaaagagggugggug

SEQ ID NO: 3009143 - RNA, 14 nt, Human
ugugaaugcagguu

SEQ ID NO: 3009144 - RNA, 20 nt, Human
ugugaaugcagguuuuauca

SEQ ID NO: 3009145 - RNA, 17 nt, Human
uuggguuuauuuggaaa

SEQ ID NO: 3009146 - RNA, 12 nt, Human
uuggguuuauuu

SEQ ID NO: 3009147 - RNA, 20 nt, Human
uuggccagaagucaaggcuu

SEQ ID NO: 3009148 - RNA, 20 nt, Human
uuguacacucauucauuacu

SEQ ID NO: 3009149 - RNA, 20 nt, Human
uugcuaacagcaacacaaag

SEQ ID NO: 3009150 - RNA, 13 nt, Human
uugcuaacagcaa

SEQ ID NO: 3009151 - RNA, 20 nt, Human
uuggacauuuuaugucuuuc

SEQ ID NO: 3009152 - RNA, 18 nt, Human
uuggacauuuuaugucuu

SEQ ID NO: 3009153 - RNA, 17 nt, Human
uuggacauuuuaugucu

SEQ ID NO: 3009154 - RNA, 16 nt, Human
uuggacauuuuauguc

SEQ ID NO: 3009155 - RNA, 15 nt, Human
uuggacauuuuaugu

SEQ ID NO: 3009156 - RNA, 21 nt, Human
uuggaaaggaaugcaaagaug

SEQ ID NO: 3009157 - RNA, 14 nt, Human
uugaaacuuuaaga

SEQ ID NO: 3009158 - RNA, 22 nt, Human
uugauugggcacaucauuucaa

SEQ ID NO: 3009159 - RNA, 19 nt, Human
uugcauacuauuaaacaug

SEQ ID NO: 3009160 - RNA, 18 nt, Human
uugcauacuauuaaacau

SEQ ID NO: 3009161 - RNA, 16 nt, Human
uugcauacuauuaaac

SEQ ID NO: 3009162 - RNA, 12 nt, Human
uugacuauuuuu

SEQ ID NO: 3009163 - RNA, 19 nt, Human
uuacuaaaaguuuugagaa

SEQ ID NO: 3009164 - RNA, 20 nt, Human
uuacuaaaaguuuugagaaa

SEQ ID NO: 3009165 - RNA, 19 nt, Human
uucaaucuggauucauauu

SEQ ID NO: 3009166 - RNA, 23 nt, Human
uucaaucuggauucauauuuaau

SEQ ID NO: 3009167 - RNA, 20 nt, Human
uucaaucuggauucauauuu

SEQ ID NO: 3009168 - RNA, 17 nt, Human
uuccacuugagugucaa

SEQ ID NO: 3009169 - RNA, 21 nt, Human
uuccacuugagugucaagcug

SEQ ID NO: 3009170 - RNA, 15 nt, Human
uucaguuuaucuguu

SEQ ID NO: 3009171 - RNA, 18 nt, Human
uucaguuuaucuguucau

SEQ ID NO: 3009172 - RNA, 21 nt, Human
uucuauuuauuuauuuauuca

SEQ ID NO: 3009173 - RNA, 14 nt, Human
uucuauuuauuugu

SEQ ID NO: 3009174 - RNA, 17 nt, Human
uucuccagucauuaugu

SEQ ID NO: 3009175 - RNA, 19 nt, Human
uucuccagucauuauguua

SEQ ID NO: 3009176 - RNA, 15 nt, Human
uuuacuuuuuggaaa

SEQ ID NO: 3009177 - RNA, 23 nt, Human
uuuacuuuuuggaaaagaauaaa

SEQ ID NO: 3009178 - RNA, 16 nt, Human
uuuauuuauuuauuca

SEQ ID NO: 3009179 - RNA, 22 nt, Human
uuuauuuggaaaggaaugcaaa

SEQ ID NO: 3009180 - RNA, 22 nt, Human
uuuuaucagaacuauguuuuug

SEQ ID NO: 3009181 - RNA, 15 nt, Human
uuuuauauucucagc

SEQ ID NO: 3009182 - RNA, 13 nt, Human
uuuuauauagcaa

SEQ ID NO: 3009183 - RNA, 23 nt, Human
uuuucaauaacuggaacacucua

SEQ ID NO: 3009184 - RNA, 13 nt, Human
uuuucaauaacug

SEQ ID NO: 3009185 - RNA, 16 nt, Human
uuuucaauaacuggaa

SEQ ID NO: 3009186 - RNA, 19 nt, Human
uuuucaauaacuggaacac

SEQ ID NO: 3009187 - RNA, 11 nt, Human
uuugcagagua

SEQ ID NO: 3009188 - RNA, 16 nt, Human
caccaugggauuaaua

SEQ ID NO: 3009189 - RNA, 18 nt, Human
caccaucaugucuggcua

SEQ ID NO: 3009190 - RNA, 15 nt, Human
caccaucaugucugg

SEQ ID NO: 3009191 - RNA, 17 nt, Human
caccaucaugucuggcu

SEQ ID NO: 3009192 - RNA, 24 nt, Human
caccaucaagccaccaacauacuc

SEQ ID NO: 3009193 - RNA, 19 nt, Human
caccaucaagccaccaaca

SEQ ID NO: 3009194 - RNA, 17 nt, Human
caccaucaagccaccaa

SEQ ID NO: 3009195 - RNA, 16 nt, Human
caccaucaagccacca

SEQ ID NO: 3009196 - RNA, 13 nt, Human
caccaucaagcca

SEQ ID NO: 3009197 - RNA, 15 nt, Human
caccaucaagccacc

SEQ ID NO: 3009198 - RNA, 14 nt, Human
caccaucaagccac

SEQ ID NO: 3009199 - RNA, 21 nt, Human
caccauauuaccacagacaua

SEQ ID NO: 3009200 - RNA, 19 nt, Human
caccacacccagcccacuu

SEQ ID NO: 3009201 - RNA, 17 nt, Human
caccagagcccaccuug

SEQ ID NO: 3009202 - RNA, 18 nt, Human
caccagagcccaccuugg

SEQ ID NO: 3009203 - RNA, 20 nt, Human
caccagagcccaccuuggcu

SEQ ID NO: 3009204 - RNA, 22 nt, Human
caccagagcccaccuuggcuca

SEQ ID NO: 3009205 - RNA, 15 nt, Human
caccagagcccaccu

SEQ ID NO: 3009206 - RNA, 12 nt, Human
caccaagcccag

SEQ ID NO: 3009207 - RNA, 13 nt, Human
caccaagcccagu

SEQ ID NO: 3009208 - RNA, 17 nt, Human
caccaacgucugugcca

SEQ ID NO: 3009209 - RNA, 16 nt, Human
caccaacgucugugcc

SEQ ID NO: 3009210 - RNA, 22 nt, Human
cacauguccaagaagcccagga

SEQ ID NO: 3009211 - RNA, 21 nt, Human
cacauguccaagaagcccagg

SEQ ID NO: 3009212 - RNA, 19 nt, Human
cacauguccaagaagccca

SEQ ID NO: 3009213 - RNA, 18 nt, Human
cacauguccaagaagccc

SEQ ID NO: 3009214 - RNA, 22 nt, Human
cacacggacacucaaaagcugg

SEQ ID NO: 3009215 - RNA, 18 nt, Human
cacagcucuucuccaggc

SEQ ID NO: 3009216 - RNA, 17 nt, Human
cacaggaucagucugau

SEQ ID NO: 3009217 - RNA, 19 nt, Human
cacagcucuucuccaggcu

SEQ ID NO: 3009218 - RNA, 20 nt, Human
cacagcucuucuccaggcug

SEQ ID NO: 3009219 - RNA, 14 nt, Human
cacaggcccggcuc

SEQ ID NO: 3009220 - RNA, 23 nt, Human
cacaguccuuaccagcagagcac

SEQ ID NO: 3009221 - RNA, 19 nt, Human
cacaggcagguccaggguu

SEQ ID NO: 3009222 - RNA, 21 nt, Human
cacaugccucucucaggccaa

SEQ ID NO: 3009223 - RNA, 20 nt, Human
cacaugccucucucaggcca

SEQ ID NO: 3009224 - RNA, 17 nt, Human
cacauguccaagaagcc

SEQ ID NO: 3009225 - RNA, 16 nt, Human
cacauguccaagaagc

SEQ ID NO: 3009226 - RNA, 18 nt, Human
cacaugcacgugugugca

SEQ ID NO: 3009227 - RNA, 20 nt, Human
cacaugcaaggucauuuuuu

SEQ ID NO: 3009228 - RNA, 17 nt, Human
cacaugcaaggucauuu

SEQ ID NO: 3009229 - RNA, 19 nt, Human
cacaugcaaggucauuuuu

SEQ ID NO: 3009230 - RNA, 17 nt, Human
cacaugagcaucaggcc

SEQ ID NO: 3009231 - RNA, 13 nt, Human
cacaugagcauca

SEQ ID NO: 3009232 - RNA, 21 nt, Human
cacaugagcaucaggccaggc

SEQ ID NO: 3009233 - RNA, 20 nt, Human
cacaugagcaucaggccagg

SEQ ID NO: 3009234 - RNA, 19 nt, Human
cacaugagcaucaggccag

SEQ ID NO: 3009235 - RNA, 18 nt, Human
cacaugagcaucaggcca

SEQ ID NO: 3009236 - RNA, 13 nt, Human
cacccaagggccu

SEQ ID NO: 3009237 - RNA, 12 nt, Human
caauauccuaau

SEQ ID NO: 3009238 - RNA, 13 nt, Human
caauauccuaaua

SEQ ID NO: 3009239 - RNA, 14 nt, Human
caauauccuaauaa

SEQ ID NO: 3009240 - RNA, 15 nt, Human
caauauccuaauaaa

SEQ ID NO: 3009241 - RNA, 16 nt, Human
caauauccuaauaaaa

SEQ ID NO: 3009242 - RNA, 18 nt, Human
caauauccuaauaaaaag

SEQ ID NO: 3009243 - RNA, 19 nt, Human
caauauccuaauaaaaagg

SEQ ID NO: 3009244 - RNA, 20 nt, Human
caauauccuaauaaaaaggu

SEQ ID NO: 3009245 - RNA, 20 nt, Human
caaugcaaaccaucauugaa

SEQ ID NO: 3009246 - RNA, 23 nt, Human
caaugcaaaccaucauugaaauc

SEQ ID NO: 3009247 - RNA, 14 nt, Human
caaugcacugacau

SEQ ID NO: 3009248 - RNA, 13 nt, Human
caaugcacuuugu

SEQ ID NO: 3009249 - RNA, 14 nt, Human
caaugauggucacc

SEQ ID NO: 3009250 - RNA, 22 nt, Human
caaugcaaaccaucauugaaau

SEQ ID NO: 3009251 - RNA, 21 nt, Human
caaugcaaaccaucauugaaa

SEQ ID NO: 3009252 - RNA, 13 nt, Human
caaugaccuuuca

SEQ ID NO: 3009253 - RNA, 14 nt, Human
caaugaccuuucaa

SEQ ID NO: 3009254 - RNA, 13 nt, Human
caaugauggucac

SEQ ID NO: 3009255 - RNA, 16 nt, Human
caaugaccuuucaaua

SEQ ID NO: 3009256 - RNA, 15 nt, Human
caaugaccuuucaau

SEQ ID NO: 3009257 - RNA, 17 nt, Human
cacaaagguagcuuuuc

SEQ ID NO: 3009258 - RNA, 17 nt, Human
cacaaacgggcucagca

SEQ ID NO: 3009259 - RNA, 15 nt, Human
cacaaacagaggccg

SEQ ID NO: 3009260 - RNA, 14 nt, Human
caaugcacuuuguu

SEQ ID NO: 3009261 - RNA, 18 nt, Human
caaugguuuucuugugug

SEQ ID NO: 3009262 - RNA, 15 nt, Human
cacacaccagagccc

SEQ ID NO: 3009263 - RNA, 16 nt, Human
cacacaccagagccca

SEQ ID NO: 3009264 - RNA, 20 nt, Human
cacacaccagagcccaccuu

SEQ ID NO: 3009265 - RNA, 14 nt, Human
cacacacuuuggcu

SEQ ID NO: 3009266 - RNA, 21 nt, Human
cacacagaggcugccucuccc

SEQ ID NO: 3009267 - RNA, 17 nt, Human
cacaccgggcacucaga

SEQ ID NO: 3009268 - RNA, 14 nt, Human
cacacccagcccac

SEQ ID NO: 3009269 - RNA, 20 nt, Human
cacacccagcccacuucugc

SEQ ID NO: 3009270 - RNA, 13 nt, Human
cacacagcucugu

SEQ ID NO: 3009271 - RNA, 14 nt, Human
cacacagcucuguc

SEQ ID NO: 3009272 - RNA, 15 nt, Human
cacacagcucugucc

SEQ ID NO: 3009273 - RNA, 21 nt, Human
cacaccagagcccaccuuggc

SEQ ID NO: 3009274 - RNA, 22 nt, Human
cacaccagagcccaccuuggcu

SEQ ID NO: 3009275 - RNA, 13 nt, Human
cacacccagccca

SEQ ID NO: 3009276 - RNA, 23 nt, Human
caacugggguggguggggcagug

SEQ ID NO: 3009277 - RNA, 17 nt, Human
caacugcaucaagaugu

SEQ ID NO: 3009278 - RNA, 23 nt, Human
caacugcaucaagaugugacaug

SEQ ID NO: 3009279 - RNA, 20 nt, Human
caacugcaucaagaugugac

SEQ ID NO: 3009280 - RNA, 17 nt, Human
caaccugauugugucuc

SEQ ID NO: 3009281 - RNA, 21 nt, Human
caaccugauugugucucuugg

SEQ ID NO: 3009282 - RNA, 19 nt, Human
caaccugauugugucucuu

SEQ ID NO: 3009283 - RNA, 17 nt, Human
caacauaacucaagucu

SEQ ID NO: 3009284 - RNA, 15 nt, Human
caacauacucccauc

SEQ ID NO: 3009285 - RNA, 14 nt, Human
caacauacucccau

SEQ ID NO: 3009286 - RNA, 16 nt, Human
caacauacucccaucu

SEQ ID NO: 3009287 - RNA, 13 nt, Human
caacaggcugggc

SEQ ID NO: 3009288 - RNA, 17 nt, Human
caacaggcugggcuuca

SEQ ID NO: 3009289 - RNA, 14 nt, Human
caacaggcugggcu

SEQ ID NO: 3009290 - RNA, 14 nt, Human
caagugagacccug

SEQ ID NO: 3009291 - RNA, 23 nt, Human
caagugaaaaaggaggaagagaa

SEQ ID NO: 3009292 - RNA, 22 nt, Human
caagugaaaaaggaggaagaga

SEQ ID NO: 3009293 - RNA, 19 nt, Human
caagugauucuccugccuc

SEQ ID NO: 3009294 - RNA, 18 nt, Human
caagugauucuccugccu

SEQ ID NO: 3009295 - RNA, 19 nt, Human
caagugagacccugucuca

SEQ ID NO: 3009296 - RNA, 15 nt, Human
caagugagacccugu

SEQ ID NO: 3009297 - RNA, 20 nt, Human
caagugauucuccugccuca

SEQ ID NO: 3009298 - RNA, 21 nt, Human
caaggggaauguuugccucug

SEQ ID NO: 3009299 - RNA, 15 nt, Human
caagggccuggccug

SEQ ID NO: 3009300 - RNA, 14 nt, Human
caagggccuggccu

SEQ ID NO: 3009301 - RNA, 13 nt, Human
caagggccuggcc

SEQ ID NO: 3009302 - RNA, 23 nt, Human
caaggggaauguuugccucugcc

SEQ ID NO: 3009303 - RNA, 14 nt, Human
caaggcugucaauu

SEQ ID NO: 3009304 - RNA, 13 nt, Human
caaggcugucaau

SEQ ID NO: 3009305 - RNA, 21 nt, Human
caaggcugggggaagaagcuc

SEQ ID NO: 3009306 - RNA, 18 nt, Human
caaggcugggggaagaag

SEQ ID NO: 3009307 - RNA, 17 nt, Human
caaggauccugagccag

SEQ ID NO: 3009308 - RNA, 16 nt, Human
caaggauccugagcca

SEQ ID NO: 3009309 - RNA, 15 nt, Human
caaggauccugagcc

SEQ ID NO: 3009310 - RNA, 14 nt, Human
caaggauccugagc

SEQ ID NO: 3009311 - RNA, 17 nt, Human
caagagcccaggccucc

SEQ ID NO: 3009312 - RNA, 12 nt, Human
caagagggucug

SEQ ID NO: 3009313 - RNA, 16 nt, Human
caagagggucugagga

SEQ ID NO: 3009314 - RNA, 17 nt, Human
caagagggucugaggaa

SEQ ID NO: 3009315 - RNA, 23 nt, Human
caagacccuuguggucccacccc

SEQ ID NO: 3009316 - RNA, 22 nt, Human
caagacgcugugcugcccugcc

SEQ ID NO: 3009317 - RNA, 21 nt, Human
caagacgcugugcugcccugc

SEQ ID NO: 3009318 - RNA, 20 nt, Human
caagacgcugugcugcccug

SEQ ID NO: 3009319 - RNA, 19 nt, Human
caagacgcugugcugcccu

SEQ ID NO: 3009320 - RNA, 13 nt, Human
caagaccuucucc

SEQ ID NO: 3009321 - RNA, 21 nt, Human
caaagagguuuuaaaaaaauc

SEQ ID NO: 3009322 - RNA, 14 nt, Human
caaagagguuuuaa

SEQ ID NO: 3009323 - RNA, 20 nt, Human
caaaggguaucaggugcugc

SEQ ID NO: 3009324 - RNA, 21 nt, Human
caaaggguaucaggugcugcc

SEQ ID NO: 3009325 - RNA, 23 nt, Human
caaaggguaucaggugcugccau

SEQ ID NO: 3009326 - RNA, 17 nt, Human
caaaguggugagaggca

SEQ ID NO: 3009327 - RNA, 16 nt, Human
caaaguggugagaggc

SEQ ID NO: 3009328 - RNA, 20 nt, Human
caaaggagauuggaaggaac

SEQ ID NO: 3009329 - RNA, 14 nt, Human
caaaggagauugga

SEQ ID NO: 3009330 - RNA, 20 nt, Human
caacaggcugggcuucagug

SEQ ID NO: 3009331 - RNA, 19 nt, Human
agcaucgcuuaggagaagu

SEQ ID NO: 3009332 - RNA, 16 nt, Human
agcaucuaugugagac

SEQ ID NO: 3009333 - RNA, 22 nt, Human
agccagauuucacucuccuugg

SEQ ID NO: 3009334 - RNA, 20 nt, Human
agccagauuucacucuccuu

SEQ ID NO: 3009335 - RNA, 17 nt, Human
agccagauuucacucuc

SEQ ID NO: 3009336 - RNA, 14 nt, Human
agccagauuucacu

SEQ ID NO: 3009337 - RNA, 13 nt, Human
agcccaccuuggc

SEQ ID NO: 3009338 - RNA, 23 nt, Human
agcccaccccucaacaccucugc

SEQ ID NO: 3009339 - RNA, 19 nt, Human
agcccacgcccccacuggu

SEQ ID NO: 3009340 - RNA, 15 nt, Human
agcccacgcccccac

SEQ ID NO: 3009341 - RNA, 18 nt, Human
agcccacgcccccacugg

SEQ ID NO: 3009342 - RNA, 17 nt, Human
agcccacgcccccacug

SEQ ID NO: 3009343 - RNA, 23 nt, Human
agccagcaggcucucaggccagc

SEQ ID NO: 3009344 - RNA, 21 nt, Human
agccagcaggcucucaggcca

SEQ ID NO: 3009345 - RNA, 22 nt, Human
agccagcaggcucucaggccag

SEQ ID NO: 3009346 - RNA, 20 nt, Human
agcacuaaggugugcucuga

SEQ ID NO: 3009347 - RNA, 21 nt, Human
agcacagacccugcccugugg

SEQ ID NO: 3009348 - RNA, 17 nt, Human
agcagugcaugcugucc

SEQ ID NO: 3009349 - RNA, 20 nt, Human
agcagccuggacccugugga

SEQ ID NO: 3009350 - RNA, 18 nt, Human
agcagcguuucuaugaca

SEQ ID NO: 3009351 - RNA, 19 nt, Human
agcagcguuucuaugacac

SEQ ID NO: 3009352 - RNA, 16 nt, Human
agcagugcaugcuguc

SEQ ID NO: 3009353 - RNA, 13 nt, Human
agcagugcaugcu

SEQ ID NO: 3009354 - RNA, 16 nt, Human
agcagccuggacccug

SEQ ID NO: 3009355 - RNA, 18 nt, Human
agauucuauguuaauauu

SEQ ID NO: 3009356 - RNA, 14 nt, Human
agauucuuuccuga

SEQ ID NO: 3009357 - RNA, 22 nt, Human
agaugggugcuuggaggaagga

SEQ ID NO: 3009358 - RNA, 20 nt, Human
agaugggugcuuggaggaag

SEQ ID NO: 3009359 - RNA, 11 nt, Human
agaugaauguc

SEQ ID NO: 3009360 - RNA, 18 nt, Human
agaugacaucugucuagg

SEQ ID NO: 3009361 - RNA, 15 nt, Human
agaugaaugucaguu

SEQ ID NO: 3009362 - RNA, 18 nt, Human
agaugacauugacuauuu

SEQ ID NO: 3009363 - RNA, 23 nt, Human
agaugacauugacuauuuuuguu

SEQ ID NO: 3009364 - RNA, 18 nt, Human
agaucucuaacuucacca

SEQ ID NO: 3009365 - RNA, 13 nt, Human
agcaaaucaguuu

SEQ ID NO: 3009366 - RNA, 19 nt, Human
agcaaauucuguuuuucua

SEQ ID NO: 3009367 - RNA, 17 nt, Human
agauugcaacaggcugg

SEQ ID NO: 3009368 - RNA, 16 nt, Human
agauugcaccacugca

SEQ ID NO: 3009369 - RNA, 16 nt, Human
agauucuuuccugagg

SEQ ID NO: 3009370 - RNA, 15 nt, Human
agauucuuuccugag

SEQ ID NO: 3009371 - RNA, 16 nt, Human
agauugcaacaggcug

SEQ ID NO: 3009372 - RNA, 20 nt, Human
agagggucugaggaauccag

SEQ ID NO: 3009373 - RNA, 23 nt, Human
agaggggguggccucccaacuca

SEQ ID NO: 3009374 - RNA, 15 nt, Human
agaguugaagacaga

SEQ ID NO: 3009375 - RNA, 14 nt, Human
agaguugaagacag

SEQ ID NO: 3009376 - RNA, 13 nt, Human
agaguugaagaca

SEQ ID NO: 3009377 - RNA, 20 nt, Human
agauagccaaggccaaagga

SEQ ID NO: 3009378 - RNA, 23 nt, Human
agaaugcaguacuaacauuuauu

SEQ ID NO: 3009379 - RNA, 18 nt, Human
agaaugcucuuuacuuca

SEQ ID NO: 3009380 - RNA, 23 nt, Human
agaaugcacaaacagaggccgcc

SEQ ID NO: 3009381 - RNA, 17 nt, Human
agaaucucaaauaacua

SEQ ID NO: 3009382 - RNA, 16 nt, Human
agaagucaaggcuuag

SEQ ID NO: 3009383 - RNA, 17 nt, Human
agaagucaaggcuuaga

SEQ ID NO: 3009384 - RNA, 18 nt, Human
agaagucaaggcuuagac

SEQ ID NO: 3009385 - RNA, 19 nt, Human
agaagucaaggcuuagacc

SEQ ID NO: 3009386 - RNA, 14 nt, Human
agaagucacacagu

SEQ ID NO: 3009387 - RNA, 17 nt, Human
agaagucuuagauguau

SEQ ID NO: 3009388 - RNA, 19 nt, Human
agaagucuuagauguauau

SEQ ID NO: 3009389 - RNA, 23 nt, Human
agaagagaaugcacaaacagagg

SEQ ID NO: 3009390 - RNA, 15 nt, Human
agaagagaaugcaca

SEQ ID NO: 3009391 - RNA, 21 nt, Human
agaaccaaaaagaggcuaugu

SEQ ID NO: 3009392 - RNA, 18 nt, Human
agaaccaaaaagaggcua

SEQ ID NO: 3009393 - RNA, 17 nt, Human
agaaccaaaaagaggcu

SEQ ID NO: 3009394 - RNA, 18 nt, Human
agagaaaguacuucucca

SEQ ID NO: 3009395 - RNA, 17 nt, Human
agagcccacgcccccac

SEQ ID NO: 3009396 - RNA, 18 nt, Human
agagcccacgcccccacu

SEQ ID NO: 3009397 - RNA, 23 nt, Human
agagagcaagacgcugugcugcc

SEQ ID NO: 3009398 - RNA, 19 nt, Human
agagagcaagacgcugugc

SEQ ID NO: 3009399 - RNA, 11 nt, Human
agagagcaaga

SEQ ID NO: 3009400 - RNA, 16 nt, Human
agacucuuuggacacu

SEQ ID NO: 3009401 - RNA, 23 nt, Human
agacagcccgggcucugccuccc

SEQ ID NO: 3009402 - RNA, 22 nt, Human
agacagcccgggcucugccucc

SEQ ID NO: 3009403 - RNA, 14 nt, Human
agacaauuuauuau

SEQ ID NO: 3009404 - RNA, 21 nt, Human
agacagcccgggcucugccuc

SEQ ID NO: 3009405 - RNA, 23 nt, Human
agaccaucccugaaggccccgcc

SEQ ID NO: 3009406 - RNA, 14 nt, Human
agaccacguuucua

SEQ ID NO: 3009407 - RNA, 17 nt, Human
agacgcugugcugcccu

SEQ ID NO: 3009408 - RNA, 19 nt, Human
agacgcugugcugcccugc

SEQ ID NO: 3009409 - RNA, 18 nt, Human
agacgcugugcugcccug

SEQ ID NO: 3009410 - RNA, 20 nt, Human
agacaaugugaaaagaaaaa

SEQ ID NO: 3009411 - RNA, 23 nt, Human
agacaaugacuuacuguacauga

SEQ ID NO: 3009412 - RNA, 22 nt, Human
aggcuuagacccucaugcugcc

SEQ ID NO: 3009413 - RNA, 14 nt, Human
aggcuuagacccuc

SEQ ID NO: 3009414 - RNA, 21 nt, Human
aggcuuagacccucaugcugc

SEQ ID NO: 3009415 - RNA, 12 nt, Human
aggcuuagaccc

SEQ ID NO: 3009416 - RNA, 23 nt, Human
aggcuguaucccaugagccucag

SEQ ID NO: 3009417 - RNA, 19 nt, Human
aggcugcagugagccgaga

SEQ ID NO: 3009418 - RNA, 17 nt, Human
aggcugcagugagccga

SEQ ID NO: 3009419 - RNA, 12 nt, Human
aggcugucaauu

SEQ ID NO: 3009420 - RNA, 24 nt, Human
aggcuguaucccaugagccucagc

SEQ ID NO: 3009421 - RNA, 20 nt, Human
aggcccucugcccacucccu

SEQ ID NO: 3009422 - RNA, 19 nt, Human
aggcccucugcccacuccc

SEQ ID NO: 3009423 - RNA, 18 nt, Human
agggccuggccugagcug

SEQ ID NO: 3009424 - RNA, 14 nt, Human
agggccuggcucag

SEQ ID NO: 3009425 - RNA, 13 nt, Human
agggccuggcuca

SEQ ID NO: 3009426 - RNA, 18 nt, Human
agggccuggcucaggugg

SEQ ID NO: 3009427 - RNA, 12 nt, Human
aggccagcugcu

SEQ ID NO: 3009428 - RNA, 23 nt, Human
aggcauuccccaggaggccagcc

SEQ ID NO: 3009429 - RNA, 22 nt, Human
aggcauuccccaggaggccagc

SEQ ID NO: 3009430 - RNA, 21 nt, Human
aggcauuccccaggaggccag

SEQ ID NO: 3009431 - RNA, 20 nt, Human
aggcauguucucugaggaca

SEQ ID NO: 3009432 - RNA, 22 nt, Human
aggcauguucucugaggacacu

SEQ ID NO: 3009433 - RNA, 24 nt, Human
aggcaugugaugagaggaaaucac

SEQ ID NO: 3009434 - RNA, 23 nt, Human
aggcaugugaugagaggaaauca

SEQ ID NO: 3009435 - RNA, 14 nt, Human
aggccaugggccuc

SEQ ID NO: 3009436 - RNA, 16 nt, Human
aggccaugggccuccu

SEQ ID NO: 3009437 - RNA, 15 nt, Human
aggcccucugcccac

SEQ ID NO: 3009438 - RNA, 17 nt, Human
aggcccucugcccacuc

SEQ ID NO: 3009439 - RNA, 23 nt, Human
aggccaggcccucugcccacucc

SEQ ID NO: 3009440 - RNA, 19 nt, Human
aggccaggcccucugccca

SEQ ID NO: 3009441 - RNA, 18 nt, Human
aggccaggcccucugccc

SEQ ID NO: 3009442 - RNA, 17 nt, Human
aggccaggcccucugcc

SEQ ID NO: 3009443 - RNA, 16 nt, Human
aggccaggcccucugc

SEQ ID NO: 3009444 - RNA, 16 nt, Human
aggccagcugcuuggg

SEQ ID NO: 3009445 - RNA, 14 nt, Human
aggccagcugcuug

SEQ ID NO: 3009446 - RNA, 13 nt, Human
aggccagcugcuu

SEQ ID NO: 3009447 - RNA, 14 nt, Human
aggcagccaggcca

SEQ ID NO: 3009448 - RNA, 16 nt, Human
aggcagccaggccaca

SEQ ID NO: 3009449 - RNA, 15 nt, Human
aggcagccaggccac

SEQ ID NO: 3009450 - RNA, 13 nt, Human
aggcagauacagg

SEQ ID NO: 3009451 - RNA, 19 nt, Human
aggaaguacuggagaaaau

SEQ ID NO: 3009452 - RNA, 14 nt, Human
aggaggucucuaag

SEQ ID NO: 3009453 - RNA, 15 nt, Human
aggaggucucuaaga

SEQ ID NO: 3009454 - RNA, 12 nt, Human
aggagugagcac

SEQ ID NO: 3009455 - RNA, 14 nt, Human
aggagugagcacua

SEQ ID NO: 3009456 - RNA, 15 nt, Human
aggaaguacuggaga

SEQ ID NO: 3009457 - RNA, 11 nt, Human
aggaaguacug

SEQ ID NO: 3009458 - RNA, 14 nt, Human
aggaagguagaaau

SEQ ID NO: 3009459 - RNA, 23 nt, Human
aggaacaaggcaaggcugucaau

SEQ ID NO: 3009460 - RNA, 12 nt, Human
aggaacacuccu

SEQ ID NO: 3009461 - RNA, 23 nt, Human
aggaacuuaaauaaugugaaacu

SEQ ID NO: 3009462 - RNA, 15 nt, Human
aggaacacuccuuca

SEQ ID NO: 3009463 - RNA, 21 nt, Human
agcuuuguuuguugucagcug

SEQ ID NO: 3009464 - RNA, 22 nt, Human
agcucaccagccccagugccca

SEQ ID NO: 3009465 - RNA, 23 nt, Human
agcucaccagccccagugcccac

SEQ ID NO: 3009466 - RNA, 21 nt, Human
agcugacuuuucuguccgagc

SEQ ID NO: 3009467 - RNA, 15 nt, Human
agcugacuuuucugu

SEQ ID NO: 3009468 - RNA, 15 nt, Human
agcuggucccacuca

SEQ ID NO: 3009469 - RNA, 22 nt, Human
agcugccuguucagcuccagcu

SEQ ID NO: 3009470 - RNA, 14 nt, Human
agccuggacccugu

SEQ ID NO: 3009471 - RNA, 20 nt, Human
agccugggaggucaaggcug

SEQ ID NO: 3009472 - RNA, 18 nt, Human
agccugggcaaugugaua

SEQ ID NO: 3009473 - RNA, 20 nt, Human
agcuaacauggaaguacuau

SEQ ID NO: 3009474 - RNA, 19 nt, Human
agcuaacauggaaguacua

SEQ ID NO: 3009475 - RNA, 17 nt, Human
agcgauucuucugcuuc

SEQ ID NO: 3009476 - RNA, 19 nt, Human
agcgauucuucugcuucag

SEQ ID NO: 3009477 - RNA, 15 nt, Human
agcgauucuucugcu

SEQ ID NO: 3009478 - RNA, 13 nt, Human
agcuaaugggaca

SEQ ID NO: 3009479 - RNA, 14 nt, Human
agcuaaugggacac

SEQ ID NO: 3009480 - RNA, 15 nt, Human
agcuaaugggacacu

SEQ ID NO: 3009481 - RNA, 13 nt, Human
agcucaccagccc

SEQ ID NO: 3009482 - RNA, 14 nt, Human
agcucaccagcccc

SEQ ID NO: 3009483 - RNA, 21 nt, Human
agcucaccagccccagugccc

SEQ ID NO: 3009484 - RNA, 14 nt, Human
augagcuuaagaaa

SEQ ID NO: 3009485 - RNA, 23 nt, Human
augagcuuaagaaauuuguggaa

SEQ ID NO: 3009486 - RNA, 21 nt, Human
augagccucagcauccuggca

SEQ ID NO: 3009487 - RNA, 19 nt, Human
augagccucagcauccugg

SEQ ID NO: 3009488 - RNA, 11 nt, Human
augagccuggc

SEQ ID NO: 3009489 - RNA, 13 nt, Human
augaccuuucaau

SEQ ID NO: 3009490 - RNA, 15 nt, Human
augaccuuucaauag

SEQ ID NO: 3009491 - RNA, 23 nt, Human
augaagcauuuacuuuguguuca

SEQ ID NO: 3009492 - RNA, 12 nt, Human
augaaagacugu

SEQ ID NO: 3009493 - RNA, 23 nt, Human
augaaguaauaugcacacauuuu

SEQ ID NO: 3009494 - RNA, 14 nt, Human
augaaguaauaugc

SEQ ID NO: 3009495 - RNA, 21 nt, Human
augaaguaauaugcacacauu

SEQ ID NO: 3009496 - RNA, 23 nt, Human
aucuaggaagacuuuggaaagag

SEQ ID NO: 3009497 - RNA, 21 nt, Human
augccugguggcagcugcggu

SEQ ID NO: 3009498 - RNA, 11 nt, Human
augccuggugg

SEQ ID NO: 3009499 - RNA, 12 nt, Human
augccugguggc

SEQ ID NO: 3009500 - RNA, 13 nt, Human
augccugguggca

SEQ ID NO: 3009501 - RNA, 19 nt, Human
augccugguggcagcugcg

SEQ ID NO: 3009502 - RNA, 18 nt, Human
augccugguggcagcugc

SEQ ID NO: 3009503 - RNA, 16 nt, Human
augcuuugaucccuuc

SEQ ID NO: 3009504 - RNA, 15 nt, Human
augcucugcauguua

SEQ ID NO: 3009505 - RNA, 18 nt, Human
augcucugcauguuacau

SEQ ID NO: 3009506 - RNA, 19 nt, Human
augcucugcauguuacaua

SEQ ID NO: 3009507 - RNA, 20 nt, Human
augcuucuucagagacuccu

SEQ ID NO: 3009508 - RNA, 17 nt, Human
augcuucuucagagacu

SEQ ID NO: 3009509 - RNA, 14 nt, Human
augcuucuucagag

SEQ ID NO: 3009510 - RNA, 21 nt, Human
augggaaugaaugucagugug

SEQ ID NO: 3009511 - RNA, 16 nt, Human
auagcaagacauuaua

SEQ ID NO: 3009512 - RNA, 14 nt, Human
auagcacagacccu

SEQ ID NO: 3009513 - RNA, 20 nt, Human
aucaaaagguuaauaaagua

SEQ ID NO: 3009514 - RNA, 19 nt, Human
aucaaagagguuuuaaaaa

SEQ ID NO: 3009515 - RNA, 18 nt, Human
auauuuuuuucuuuucuu

SEQ ID NO: 3009516 - RNA, 19 nt, Human
aucaucccuuucccuuggu

SEQ ID NO: 3009517 - RNA, 15 nt, Human
aucaucccuuucccu

SEQ ID NO: 3009518 - RNA, 20 nt, Human
aucaugacaaagacugagua

SEQ ID NO: 3009519 - RNA, 15 nt, Human
aucauccuaagcuau

SEQ ID NO: 3009520 - RNA, 21 nt, Human
auccacugugccaugugccag

SEQ ID NO: 3009521 - RNA, 22 nt, Human
aucuaggaagacuuuggaaaga

SEQ ID NO: 3009522 - RNA, 18 nt, Human
agugauguaauuaugguu

SEQ ID NO: 3009523 - RNA, 19 nt, Human
agugauccucccaccucag

SEQ ID NO: 3009524 - RNA, 20 nt, Human
agugauccucccaccucagc

SEQ ID NO: 3009525 - RNA, 22 nt, Human
agugauccucccaccucagccu

SEQ ID NO: 3009526 - RNA, 22 nt, Human
agugcuacacaccuaacuuaug

SEQ ID NO: 3009527 - RNA, 19 nt, Human
agugauucuccugccucag

SEQ ID NO: 3009528 - RNA, 18 nt, Human
agugauucuccugccuca

SEQ ID NO: 3009529 - RNA, 20 nt, Human
agugauucuccugccucagc

SEQ ID NO: 3009530 - RNA, 18 nt, Human
agugccuuauggaacacu

SEQ ID NO: 3009531 - RNA, 22 nt, Human
agugccuuauggaacacucuga

SEQ ID NO: 3009532 - RNA, 21 nt, Human
agugccuuauggaacacucug

SEQ ID NO: 3009533 - RNA, 20 nt, Human
agugccuuauggaacacucu

SEQ ID NO: 3009534 - RNA, 19 nt, Human
agugccuuauggaacacuc

SEQ ID NO: 3009535 - RNA, 16 nt, Human
agugacagaggcagcc

SEQ ID NO: 3009536 - RNA, 19 nt, Human
agugacagaggcagcccca

SEQ ID NO: 3009537 - RNA, 14 nt, Human
agugacagaggcag

SEQ ID NO: 3009538 - RNA, 22 nt, Human
agucuggcagacuuucuucucu

SEQ ID NO: 3009539 - RNA, 18 nt, Human
agucuggcccuuccuuuu

SEQ ID NO: 3009540 - RNA, 21 nt, Human
agucugauucccaagcucugc

SEQ ID NO: 3009541 - RNA, 22 nt, Human
agucugauucccaagcucugcu

SEQ ID NO: 3009542 - RNA, 20 nt, Human
agucugauucccaagcucug

SEQ ID NO: 3009543 - RNA, 18 nt, Human
agucuggaaugcaguggu

SEQ ID NO: 3009544 - RNA, 16 nt, Human
agucgaggacagggag

SEQ ID NO: 3009545 - RNA, 14 nt, Human
aguccucuuuucug

SEQ ID NO: 3009546 - RNA, 18 nt, Human
aguccuuaccagcagagc

SEQ ID NO: 3009547 - RNA, 16 nt, Human
aguccuuaccagcaga

SEQ ID NO: 3009548 - RNA, 17 nt, Human
aguaacuuacuuaggug

SEQ ID NO: 3009549 - RNA, 21 nt, Human
aguaaaugggggugcauuuga

SEQ ID NO: 3009550 - RNA, 19 nt, Human
aguaaaugggggugcauuu

SEQ ID NO: 3009551 - RNA, 20 nt, Human
aguaaaugggggugcauuug

SEQ ID NO: 3009552 - RNA, 18 nt, Human
aguaaaugggggugcauu

SEQ ID NO: 3009553 - RNA, 20 nt, Human
aguacuucuccacccugcuc

SEQ ID NO: 3009554 - RNA, 19 nt, Human
aguacuucuccacccugcu

SEQ ID NO: 3009555 - RNA, 21 nt, Human
aguacuucuccacccugcucu

SEQ ID NO: 3009556 - RNA, 15 nt, Human
aguacuggagaaaau

SEQ ID NO: 3009557 - RNA, 21 nt, Human
auaagugcuauugcagagccg

SEQ ID NO: 3009558 - RNA, 12 nt, Human
auaauguuaaca

SEQ ID NO: 3009559 - RNA, 23 nt, Human
auacaaugcugugcccuaaagug

SEQ ID NO: 3009560 - RNA, 15 nt, Human
auacaccacuacauu

SEQ ID NO: 3009561 - RNA, 21 nt, Human
auaaagaugagugagcaugcc

SEQ ID NO: 3009562 - RNA, 17 nt, Human
auacaccacuacauucu

SEQ ID NO: 3009563 - RNA, 14 nt, Human
agugcuauugcaga

SEQ ID NO: 3009564 - RNA, 17 nt, Human
aguugaaaaacagcuga

SEQ ID NO: 3009565 - RNA, 17 nt, Human
aguugaagacagagcua

SEQ ID NO: 3009566 - RNA, 16 nt, Human
aguugaagacagagcu

SEQ ID NO: 3009567 - RNA, 18 nt, Human
aguugaaaaacagcugag

SEQ ID NO: 3009568 - RNA, 21 nt, Human
aguuccaccaucaagccacca

SEQ ID NO: 3009569 - RNA, 18 nt, Human
aguuccaccaucaagcca

SEQ ID NO: 3009570 - RNA, 14 nt, Human
aguucauacccugu

SEQ ID NO: 3009571 - RNA, 17 nt, Human
aguuguuauuuauugaa

SEQ ID NO: 3009572 - RNA, 22 nt, Human
aguuguuagugugucuuagugu

SEQ ID NO: 3009573 - RNA, 17 nt, Human
aguuguuagugugucuu

SEQ ID NO: 3009574 - RNA, 13 nt, Human
aguuugcagagua

SEQ ID NO: 3009575 - RNA, 11 nt, Human
aguuugcaguu

SEQ ID NO: 3009576 - RNA, 14 nt, Human
aguuugauuaaauu

SEQ ID NO: 3009577 - RNA, 14 nt, Human
acgcacacugucug

SEQ ID NO: 3009578 - RNA, 20 nt, Human
acgauuucuguuuagauaau

SEQ ID NO: 3009579 - RNA, 23 nt, Human
acgauuucuguuuagauaauaca

SEQ ID NO: 3009580 - RNA, 19 nt, Human
acgauuucuguuuagauaa

SEQ ID NO: 3009581 - RNA, 17 nt, Human
acggacacucaaaagcu

SEQ ID NO: 3009582 - RNA, 19 nt, Human
acggaauaguuggcuagga

SEQ ID NO: 3009583 - RNA, 15 nt, Human
acggaauaguuggcu

SEQ ID NO: 3009584 - RNA, 13 nt, Human
acgucugugccau

SEQ ID NO: 3009585 - RNA, 12 nt, Human
acgucugugcca

SEQ ID NO: 3009586 - RNA, 19 nt, Human
acgcugugcugcccugccc

SEQ ID NO: 3009587 - RNA, 22 nt, Human
acgcugugcugcccugcccacc

SEQ ID NO: 3009588 - RNA, 18 nt, Human
acuaauggggcggugaga

SEQ ID NO: 3009589 - RNA, 15 nt, Human
accugccccucaacu

SEQ ID NO: 3009590 - RNA, 12 nt, Human
accugccccuca

SEQ ID NO: 3009591 - RNA, 22 nt, Human
accugccaggaagccagcaggc

SEQ ID NO: 3009592 - RNA, 21 nt, Human
accugccaggaagccagcagg

SEQ ID NO: 3009593 - RNA, 23 nt, Human
accugccaggaagccagcaggcu

SEQ ID NO: 3009594 - RNA, 19 nt, Human
accugccaggaagccagca

SEQ ID NO: 3009595 - RNA, 20 nt, Human
accucugccugaagucacac

SEQ ID NO: 3009596 - RNA, 12 nt, Human
accucugccuga

SEQ ID NO: 3009597 - RNA, 20 nt, Human
acccucagaugcacaugagc

SEQ ID NO: 3009598 - RNA, 14 nt, Human
acccucaggcaggu

SEQ ID NO: 3009599 - RNA, 13 nt, Human
acccucaggcagg

SEQ ID NO: 3009600 - RNA, 13 nt, Human
acccucaucacca

SEQ ID NO: 3009601 - RNA, 16 nt, Human
acccucaggcaggugg

SEQ ID NO: 3009602 - RNA, 15 nt, Human
acccucaggcaggug

SEQ ID NO: 3009603 - RNA, 14 nt, Human
acccucaugcugcc

SEQ ID NO: 3009604 - RNA, 16 nt, Human
acccucaugcugccaa

SEQ ID NO: 3009605 - RNA, 23 nt, Human
acccucaucaccaacgucugugc

SEQ ID NO: 3009606 - RNA, 22 nt, Human
acccucaugcugccaauauccu

SEQ ID NO: 3009607 - RNA, 23 nt, Human
acccuggcacuauaauguaagcu

SEQ ID NO: 3009608 - RNA, 16 nt, Human
acccuggggagaaagu

SEQ ID NO: 3009609 - RNA, 16 nt, Human
acccugugauggggcc

SEQ ID NO: 3009610 - RNA, 13 nt, Human
acccuauugcugc

SEQ ID NO: 3009611 - RNA, 19 nt, Human
acccuauugcugcuugagg

SEQ ID NO: 3009612 - RNA, 14 nt, Human
acccuauugcugcu

SEQ ID NO: 3009613 - RNA, 18 nt, Human
accgugaggccagagaca

SEQ ID NO: 3009614 - RNA, 23 nt, Human
accgugaggccagagacacaagc

SEQ ID NO: 3009615 - RNA, 12 nt, Human
accucagccucc

SEQ ID NO: 3009616 - RNA, 11 nt, Human
accucagccuc

SEQ ID NO: 3009617 - RNA, 12 nt, Human
accgggcacuca

SEQ ID NO: 3009618 - RNA, 14 nt, Human
accgggcacucaga

SEQ ID NO: 3009619 - RNA, 20 nt, Human
accgggccacagagaaagua

SEQ ID NO: 3009620 - RNA, 16 nt, Human
accgggcacucagaag

SEQ ID NO: 3009621 - RNA, 21 nt, Human
acccugugauggggcccugcc

SEQ ID NO: 3009622 - RNA, 20 nt, Human
acccugugauggggcccugc

SEQ ID NO: 3009623 - RNA, 19 nt, Human
acccugugauggggcccug

SEQ ID NO: 3009624 - RNA, 17 nt, Human
acccugugauggggccc

SEQ ID NO: 3009625 - RNA, 11 nt, Human
accucaggccu

SEQ ID NO: 3009626 - RNA, 20 nt, Human
accucaggugauccacccac

SEQ ID NO: 3009627 - RNA, 21 nt, Human
accucaggugauccacccacc

SEQ ID NO: 3009628 - RNA, 13 nt, Human
acugacacaugcu

SEQ ID NO: 3009629 - RNA, 23 nt, Human
acugaauuucuuuugccguuauu

SEQ ID NO: 3009630 - RNA, 17 nt, Human
acugacauuguuggcca

SEQ ID NO: 3009631 - RNA, 18 nt, Human
acugacauuguuggccaa

SEQ ID NO: 3009632 - RNA, 12 nt, Human
acugaauuucuu

SEQ ID NO: 3009633 - RNA, 16 nt, Human
acugauuuuuuuuucc

SEQ ID NO: 3009634 - RNA, 20 nt, Human
acugauuuuuuuuuccuuca

SEQ ID NO: 3009635 - RNA, 19 nt, Human
acugauuuuuuuuuccuuc

SEQ ID NO: 3009636 - RNA, 18 nt, Human
acugauuuuuuuuuccuu

SEQ ID NO: 3009637 - RNA, 17 nt, Human
acugauuuuuuuuuccu

SEQ ID NO: 3009638 - RNA, 23 nt, Human
acugaugggcaacccccagccug

SEQ ID NO: 3009639 - RNA, 15 nt, Human
acucuacagaggcca

SEQ ID NO: 3009640 - RNA, 22 nt, Human
acucccaucugugaaaggaaag

SEQ ID NO: 3009641 - RNA, 19 nt, Human
acuggaacacucuauaaca

SEQ ID NO: 3009642 - RNA, 14 nt, Human
acugccaugccagc

SEQ ID NO: 3009643 - RNA, 17 nt, Human
acugugccaugugccag

SEQ ID NO: 3009644 - RNA, 18 nt, Human
acugugccaugugccagg

SEQ ID NO: 3009645 - RNA, 16 nt, Human
acugugccaugugcca

SEQ ID NO: 3009646 - RNA, 19 nt, Human
acuguuucaaacuuuacua

SEQ ID NO: 3009647 - RNA, 13 nt, Human
acuguuucaaacu

SEQ ID NO: 3009648 - RNA, 15 nt, Human
acuguuucaaacuuu

SEQ ID NO: 3009649 - RNA, 18 nt, Human
acuguuucaaacuuuacu

SEQ ID NO: 3009650 - RNA, 23 nt, Human
acuuggggggcugaggugggagg

SEQ ID NO: 3009651 - RNA, 14 nt, Human
acaucauuucaaga

SEQ ID NO: 3009652 - RNA, 20 nt, Human
acauacaggaagguagaaau

SEQ ID NO: 3009653 - RNA, 16 nt, Human
acauacaauuccaaac

SEQ ID NO: 3009654 - RNA, 23 nt, Human
acaugcacagcuaacauggaagu

SEQ ID NO: 3009655 - RNA, 13 nt, Human
acaugcacgugug

SEQ ID NO: 3009656 - RNA, 20 nt, Human
acaugccucucucaggccaa

SEQ ID NO: 3009657 - RNA, 19 nt, Human
acauguuuuucuucucccu

SEQ ID NO: 3009658 - RNA, 12 nt, Human
accagagcugcc

SEQ ID NO: 3009659 - RNA, 13 nt, Human
accagagcugcca

SEQ ID NO: 3009660 - RNA, 16 nt, Human
accagagcugccaccu

SEQ ID NO: 3009661 - RNA, 14 nt, Human
accagagcugccac

SEQ ID NO: 3009662 - RNA, 13 nt, Human
accacguuucuaa

SEQ ID NO: 3009663 - RNA, 14 nt, Human
accacguuucuaaa

SEQ ID NO: 3009664 - RNA, 18 nt, Human
accacgcuggaccuugaa

SEQ ID NO: 3009665 - RNA, 14 nt, Human
accacgcuggaccu

SEQ ID NO: 3009666 - RNA, 16 nt, Human
accacgcuggaccuug

SEQ ID NO: 3009667 - RNA, 12 nt, Human
accaagcccagu

SEQ ID NO: 3009668 - RNA, 17 nt, Human
accaacgucugugccau

SEQ ID NO: 3009669 - RNA, 14 nt, Human
accaacgucugugc

SEQ ID NO: 3009670 - RNA, 23 nt, Human
acaggcacccaccaucaugucug

SEQ ID NO: 3009671 - RNA, 19 nt, Human
acagcucuucuccaggcug

SEQ ID NO: 3009672 - RNA, 20 nt, Human
acagcucuucuccaggcugu

SEQ ID NO: 3009673 - RNA, 18 nt, Human
acagcucuucuccaggcu

SEQ ID NO: 3009674 - RNA, 15 nt, Human
acaggcaaugcuggc

SEQ ID NO: 3009675 - RNA, 16 nt, Human
acaggcaaugcuggcu

SEQ ID NO: 3009676 - RNA, 14 nt, Human
acaggcacccacca

SEQ ID NO: 3009677 - RNA, 17 nt, Human
acaggcaaugcuggcug

SEQ ID NO: 3009678 - RNA, 20 nt, Human
aauuaugguuaguagaggua

SEQ ID NO: 3009679 - RNA, 13 nt, Human
aauuccuguuuuu

SEQ ID NO: 3009680 - RNA, 22 nt, Human
aauuccuguuuuuauuauuaac

SEQ ID NO: 3009681 - RNA, 21 nt, Human
aauuccuguuuuuauuauuaa

SEQ ID NO: 3009682 - RNA, 19 nt, Human
aauuccuguuuuuauuauu

SEQ ID NO: 3009683 - RNA, 19 nt, Human
aauuaugaguuauuuuuau

SEQ ID NO: 3009684 - RNA, 22 nt, Human
aauuguaaggaaugauuaauua

SEQ ID NO: 3009685 - RNA, 18 nt, Human
aauucuguuuuucuaggc

SEQ ID NO: 3009686 - RNA, 14 nt, Human
aauucuguuuuucu

SEQ ID NO: 3009687 - RNA, 21 nt, Human
aauucucauuugucacacacu

SEQ ID NO: 3009688 - RNA, 15 nt, Human
aauucucuuauccaa

SEQ ID NO: 3009689 - RNA, 15 nt, Human
aauucucuaguuuga

SEQ ID NO: 3009690 - RNA, 17 nt, Human
aauucucuaguuugauu

SEQ ID NO: 3009691 - RNA, 14 nt, Human
aauucuacuuugag

SEQ ID NO: 3009692 - RNA, 19 nt, Human
aauucucagaaucucaaau

SEQ ID NO: 3009693 - RNA, 17 nt, Human
aauuucccaaagcagug

SEQ ID NO: 3009694 - RNA, 15 nt, Human
aauuucccaaagcag

SEQ ID NO: 3009695 - RNA, 15 nt, Human
acaaguuaaauaaau

SEQ ID NO: 3009696 - RNA, 15 nt, Human
acaaggcaaggcugu

SEQ ID NO: 3009697 - RNA, 19 nt, Human
acaaggcaaggcugucaau

SEQ ID NO: 3009698 - RNA, 17 nt, Human
acaaggcaaggcuguca

SEQ ID NO: 3009699 - RNA, 16 nt, Human
acaaggcaaggcuguc

SEQ ID NO: 3009700 - RNA, 14 nt, Human
acacagcucuucuc

SEQ ID NO: 3009701 - RNA, 16 nt, Human
acacagcucuucucca

SEQ ID NO: 3009702 - RNA, 18 nt, Human
acacagcucuucuccagg

SEQ ID NO: 3009703 - RNA, 18 nt, Human
acaccagagcccaccuug

SEQ ID NO: 3009704 - RNA, 23 nt, Human
acaccagagcccaccuuggcuca

SEQ ID NO: 3009705 - RNA, 13 nt, Human
acaccagagccca

SEQ ID NO: 3009706 - RNA, 18 nt, Human
aaggcaggggaauguaug

SEQ ID NO: 3009707 - RNA, 20 nt, Human
aaggcaggggaauguaugug

SEQ ID NO: 3009708 - RNA, 15 nt, Human
aaggcaaggcuguca

SEQ ID NO: 3009709 - RNA, 13 nt, Human
aaggcaaggcugu

SEQ ID NO: 3009710 - RNA, 19 nt, Human
aagcugcacccucaggcag

SEQ ID NO: 3009711 - RNA, 13 nt, Human
aagcugcacccuc

SEQ ID NO: 3009712 - RNA, 14 nt, Human
aagauaaaugugcu

SEQ ID NO: 3009713 - RNA, 21 nt, Human
aagauaauauuaaggaagaca

SEQ ID NO: 3009714 - RNA, 19 nt, Human
aagauaauauuaaggaaga

SEQ ID NO: 3009715 - RNA, 17 nt, Human
aagauacaguuacucag

SEQ ID NO: 3009716 - RNA, 14 nt, Human
aagcggcuggcagc

SEQ ID NO: 3009717 - RNA, 15 nt, Human
aagcgugagccacug

SEQ ID NO: 3009718 - RNA, 22 nt, Human
aagacagagccccacccucaga

SEQ ID NO: 3009719 - RNA, 23 nt, Human
aagacagauacuccuccaagguu

SEQ ID NO: 3009720 - RNA, 15 nt, Human
aagaccacguuucua

SEQ ID NO: 3009721 - RNA, 17 nt, Human
aagaccacguuucuaaa

SEQ ID NO: 3009722 - RNA, 12 nt, Human
aagacuuuucuu

SEQ ID NO: 3009723 - RNA, 21 nt, Human
aagacuuuuccaacccucauc

SEQ ID NO: 3009724 - RNA, 19 nt, Human
aagacuuuucuuucagcca

SEQ ID NO: 3009725 - RNA, 13 nt, Human
aagagaaaaaaua

SEQ ID NO: 3009726 - RNA, 17 nt, Human
aagacuuuuccaacccu

SEQ ID NO: 3009727 - RNA, 22 nt, Human
aagacaaugacuuacuguacau

SEQ ID NO: 3009728 - RNA, 19 nt, Human
aagacaaugugaaaagaaa

SEQ ID NO: 3009729 - RNA, 20 nt, Human
aagacaaugugaaaagaaaa

SEQ ID NO: 3009730 - RNA, 20 nt, Human
aagaguaggaagacuuugga

SEQ ID NO: 3009731 - RNA, 21 nt, Human
aaugaaagacuguacaaagua

SEQ ID NO: 3009732 - RNA, 18 nt, Human
aaugaaagacuguacaaa

SEQ ID NO: 3009733 - RNA, 20 nt, Human
aaugaaagacuguacaaagu

SEQ ID NO: 3009734 - RNA, 20 nt, Human
aaugaugccaugaggaacaa

SEQ ID NO: 3009735 - RNA, 21 nt, Human
aaucaccgaaaacguggcugc

SEQ ID NO: 3009736 - RNA, 23 nt, Human
aaucaccgaaaacguggcugcuu

SEQ ID NO: 3009737 - RNA, 23 nt, Human
aauauguggaguucaucuugaau

SEQ ID NO: 3009738 - RNA, 13 nt, Human
aauauuaagaaag

SEQ ID NO: 3009739 - RNA, 12 nt, Human
aagugcugggau

SEQ ID NO: 3009740 - RNA, 14 nt, Human
aagugcugcauuua

SEQ ID NO: 3009741 - RNA, 22 nt, Human
aagugcugcauuuaaaagauac

SEQ ID NO: 3009742 - RNA, 17 nt, Human
aauaaugugaaacugga

SEQ ID NO: 3009743 - RNA, 22 nt, Human
aauaaugugaaacuggauuaaa

SEQ ID NO: 3009744 - RNA, 14 nt, Human
aauaaagcagcguu

SEQ ID NO: 3009745 - RNA, 19 nt, Human
aauaauguuaacauggaca

SEQ ID NO: 3009746 - RNA, 14 nt, Human
aaauagaugacauu

SEQ ID NO: 3009747 - RNA, 21 nt, Human
aaauagaugacauugacuauu

SEQ ID NO: 3009748 - RNA, 22 nt, Human
aaauagcagcccucaauuguga

SEQ ID NO: 3009749 - RNA, 19 nt, Human
aaaugcuguaacuuucuga

SEQ ID NO: 3009750 - RNA, 14 nt, Human
aaaucuuuuugcuu

SEQ ID NO: 3009751 - RNA, 13 nt, Human
aaaucuuuuugcu

SEQ ID NO: 3009752 - RNA, 19 nt, Human
aaaucucaaauuucuaaau

SEQ ID NO: 3009753 - RNA, 20 nt, Human
aaaggaugcccaaagaugca

SEQ ID NO: 3009754 - RNA, 14 nt, Human
aaaggaugcacaga

SEQ ID NO: 3009755 - RNA, 23 nt, Human
aacauggccuuugcuugaaagaa

SEQ ID NO: 3009756 - RNA, 23 nt, Human
aaccuuuugagugccuuacacaa

SEQ ID NO: 3009757 - RNA, 16 nt, Human
aaccuuuugagugccu

SEQ ID NO: 3009758 - RNA, 22 nt, Human
aacauggccuuugcuugaaaga

SEQ ID NO: 3009759 - RNA, 11 nt, Human
aacaggcagau

SEQ ID NO: 3009760 - RNA, 23 nt, Human
aaauucuucuccacuuucuagcc

SEQ ID NO: 3009761 - RNA, 15 nt, Human
aaauucuugcaaagu

SEQ ID NO: 3009762 - RNA, 17 nt, Human
aaaacacauuuuucuua

SEQ ID NO: 3009763 - RNA, 19 nt, Human
aaaacacuguucucugccc

SEQ ID NO: 3009764 - RNA, 11 nt, Human
aaaagaaaaag

SEQ ID NO: 3009765 - RNA, 14 nt, Human
aaaauaaaacuuuu

SEQ ID NO: 3009766 - RNA, 21 nt, Human
aaaaucagccugcuccagcug

SEQ ID NO: 3009767 - RNA, 17 nt, Human
aaaaucagccugcucca

SEQ ID NO: 3009768 - RNA, 16 nt, Human
aaaauaaaacuuuuua

SEQ ID NO: 3009769 - RNA, 13 nt, Human
aaaaucagccugc

SEQ ID NO: 3009770 - RNA, 16 nt, Human
aaagccuccuccagcc

SEQ ID NO: 3009771 - RNA, 20 nt, Human
aaagauauuuugcuuuguga

SEQ ID NO: 3009772 - RNA, 23 nt, Human
aaacugauuuuuuuuuccuucag

SEQ ID NO: 3009773 - RNA, 22 nt, Human
aaacugauuuuuuuuuccuuca

SEQ ID NO: 3009774 - RNA, 23 nt, Human
aaacucuuaaaacccaagugccu

SEQ ID NO: 3009775 - RNA, 12 nt, Human
aaacucuuaaaa

SEQ ID NO: 3009776 - RNA, 16 nt, Human
aaacccagcucugguc

SEQ ID NO: 3009777 - RNA, 12 nt, Human
aaacccagcucu

SEQ ID NO: 3009778 - RNA, 16 nt, Human
aaaccgccaaggcugg

SEQ ID NO: 3009779 - RNA, 15 nt, Human
aaaccgccaaggcug

SEQ ID NO: 3009780 - RNA, 15 nt, Human
aaaaucucaaauuuc

SEQ ID NO: 3009781 - RNA, 16 nt, Human
aaaaucucaaauuucu

SEQ ID NO: 3009782 - RNA, 18 nt, Human
aaaaucucaaauuucuaa

SEQ ID NO: 3009783 - RNA, 15 nt, Human
auuuaaauagaugac

SEQ ID NO: 3009784 - RNA, 14 nt, Human
auuuaaauagauga

SEQ ID NO: 3009785 - RNA, 22 nt, Human
auuuacaacugggggaggguga

SEQ ID NO: 3009786 - RNA, 17 nt, Human
auuguuuucaguguaca

SEQ ID NO: 3009787 - RNA, 14 nt, Human
auuuaaaaaaaauc

SEQ ID NO: 3009788 - RNA, 18 nt, Human
auuguuuucaguguacau

SEQ ID NO: 3009789 - RNA, 19 nt, Human
auuguuuucaguguacaug

SEQ ID NO: 3009790 - RNA, 15 nt, Human
auuuacuuuaaacua

SEQ ID NO: 3009791 - RNA, 19 nt, Human
auuuacuucuuauacauuu

SEQ ID NO: 3009792 - RNA, 20 nt, Human
auuuacuucuuauacauuug

SEQ ID NO: 3009793 - RNA, 12 nt, Human
auuuauuacaac

SEQ ID NO: 3009794 - RNA, 13 nt, Human
auuuauugaaaug

SEQ ID NO: 3009795 - RNA, 15 nt, Human
auuuauugaaaugau

SEQ ID NO: 3009796 - RNA, 22 nt, Human
auuuauugaaaugauuucacag

SEQ ID NO: 3009797 - RNA, 16 nt, Human
auuucccaaagcagug

SEQ ID NO: 3009798 - RNA, 14 nt, Human
auuucccaaagcag

SEQ ID NO: 3009799 - RNA, 17 nt, Human
auuuccguuaaaauacc

SEQ ID NO: 3009800 - RNA, 15 nt, Human
auuugagcagggcuc

SEQ ID NO: 3009801 - RNA, 15 nt, Human
auuugaggucuguuc

SEQ ID NO: 3009802 - RNA, 17 nt, Human
auuugaggucuguucuu

SEQ ID NO: 3009803 - RNA, 18 nt, Human
auuugaggucuguucuuu

SEQ ID NO: 3009804 - RNA, 21 nt, Human
auuuggugguuucagaaaugu

SEQ ID NO: 3009805 - RNA, 21 nt, Human
auuugaggucuguucuuucca

SEQ ID NO: 3009806 - RNA, 17 nt, Human
auugcaccuggauguac

SEQ ID NO: 3009807 - RNA, 16 nt, Human
auugcaacaggcuggg

SEQ ID NO: 3009808 - RNA, 17 nt, Human
auugcauacuauuaaac

SEQ ID NO: 3009809 - RNA, 18 nt, Human
auugcauacuauuaaaca

SEQ ID NO: 3009810 - RNA, 19 nt, Human
auugcaacaggcugggcuu

SEQ ID NO: 3009811 - RNA, 12 nt, Human
auugcaccacug

SEQ ID NO: 3009812 - RNA, 17 nt, Human
auugcaacaggcugggc

SEQ ID NO: 3009813 - RNA, 18 nt, Human
auugcaacaggcugggcu

SEQ ID NO: 3009814 - RNA, 13 nt, Human
auugauguuuuca

SEQ ID NO: 3009815 - RNA, 16 nt, Human
auugauguuuucauag

SEQ ID NO: 3009816 - RNA, 17 nt, Human
auugauguuuucauaga

SEQ ID NO: 3009817 - RNA, 14 nt, Human
auugaaguaaaaug

SEQ ID NO: 3009818 - RNA, 17 nt, Human
auugaaggaugcugucu

SEQ ID NO: 3009819 - RNA, 24 nt, Human
auuccuagaaacugacacaugcug

SEQ ID NO: 3009820 - RNA, 15 nt, Human
auugaaguaaaaugu

SEQ ID NO: 3009821 - RNA, 21 nt, Human
auugccuuuuuauaacuuuuu

SEQ ID NO: 3009822 - RNA, 20 nt, Human
auugccuuuuuauaacuuuu

SEQ ID NO: 3009823 - RNA, 19 nt, Human
auugccuuuuuauaacuuu

SEQ ID NO: 3009824 - RNA, 20 nt, Human
auugcauacuauuaaacaug

SEQ ID NO: 3009825 - RNA, 19 nt, Human
auugcauacuauuaaacau

SEQ ID NO: 3009826 - RNA, 22 nt, Human
auugcauacuauuaaacaugcu

SEQ ID NO: 3009827 - RNA, 23 nt, Human
auuggcuagagguucaaagauau

SEQ ID NO: 3009828 - RNA, 19 nt, Human
auuggcuagagguucaaag

SEQ ID NO: 3009829 - RNA, 20 nt, Human
auuggcuagagguucaaaga

SEQ ID NO: 3009830 - RNA, 22 nt, Human
auuggcuagagguucaaagaua

SEQ ID NO: 3009831 - RNA, 14 nt, Human
auguugcuaacagc

SEQ ID NO: 3009832 - RNA, 17 nt, Human
uuuuagaguugauacua

SEQ ID NO: 3009833 - RNA, 21 nt, Human
uuuuagacccuauugcugcuu

SEQ ID NO: 3009834 - RNA, 12 nt, Human
auguugaaagau

SEQ ID NO: 3009835 - RNA, 20 nt, Human
auguucuuucacccuuuucu

SEQ ID NO: 3009836 - RNA, 13 nt, Human
auguugcccaggc

SEQ ID NO: 3009837 - RNA, 18 nt, Human
auguugaaagaucaaaag

SEQ ID NO: 3009838 - RNA, 14 nt, Human
auguugcccaggca

SEQ ID NO: 3009839 - RNA, 15 nt, Human
auguugcccaggcag

SEQ ID NO: 3009840 - RNA, 20 nt, Human
auguuacauaagauaaaugu

SEQ ID NO: 3009841 - RNA, 19 nt, Human
auguuacauaagauaaaug

SEQ ID NO: 3009842 - RNA, 17 nt, Human
uuuguuuuuauuaaaag

SEQ ID NO: 3009843 - RNA, 18 nt, Human
uuuuaaaaaacugcugac

SEQ ID NO: 3009844 - RNA, 15 nt, Human
uuuuaguagagacag

SEQ ID NO: 3009845 - RNA, 18 nt, Human
uuuuauggcuuuugugca

SEQ ID NO: 3009846 - RNA, 19 nt, Human
uuuuauggcuuuugugcau

SEQ ID NO: 3009847 - RNA, 12 nt, Human
uuuuauuaaauu

SEQ ID NO: 3009848 - RNA, 21 nt, Human
uuuuauggcuuuugugcauua

SEQ ID NO: 3009849 - RNA, 23 nt, Human
uuuucuacucgaguuacagacaa

SEQ ID NO: 3009850 - RNA, 19 nt, Human
auuaaaacacaacaucuuu

SEQ ID NO: 3009851 - RNA, 23 nt, Human
auuaaaaaucucaaauuucuaaa

SEQ ID NO: 3009852 - RNA, 17 nt, Human
auguuggccaggcuggu

SEQ ID NO: 3009853 - RNA, 13 nt, Human
uuuucuguucuuu

SEQ ID NO: 3009854 - RNA, 23 nt, Human
uuugagaaauuuuuuuuuccagu

SEQ ID NO: 3009855 - RNA, 13 nt, Human
uuugagacagagu

SEQ ID NO: 3009856 - RNA, 18 nt, Human
uuugaccucugcagcaau

SEQ ID NO: 3009857 - RNA, 15 nt, Human
uuugauucagacagc

SEQ ID NO: 3009858 - RNA, 23 nt, Human
uuugauuaaauucuugcaaagua

SEQ ID NO: 3009859 - RNA, 14 nt, Human
uuugauccaagcug

SEQ ID NO: 3009860 - RNA, 15 nt, Human
uuugauccaagcugg

SEQ ID NO: 3009861 - RNA, 14 nt, Human
uuugacaaggggca

SEQ ID NO: 3009862 - RNA, 19 nt, Human
uuugaccucugcagcaaua

SEQ ID NO: 3009863 - RNA, 21 nt, Human
uuugaccucugcagcaauaaa

SEQ ID NO: 3009864 - RNA, 23 nt, Human
uuucccucccuuccucuuuccau

SEQ ID NO: 3009865 - RNA, 18 nt, Human
uuugauucagacagcugc

SEQ ID NO: 3009866 - RNA, 22 nt, Human
uuuggauuggaugaauuccaaa

SEQ ID NO: 3009867 - RNA, 22 nt, Human
uuugcuggggccgaaagaacag

SEQ ID NO: 3009868 - RNA, 19 nt, Human
uuugcuggggccgaaagaa

SEQ ID NO: 3009869 - RNA, 22 nt, Human
uuugggguacccacugcucugg

SEQ ID NO: 3009870 - RNA, 21 nt, Human
uuugggguacccacugcucug

SEQ ID NO: 3009871 - RNA, 13 nt, Human
uuuggcugcugaa

SEQ ID NO: 3009872 - RNA, 12 nt, Human
uuuggcugcuga

SEQ ID NO: 3009873 - RNA, 23 nt, Human
uuuguaacuguuuagaugaaugu

SEQ ID NO: 3009874 - RNA, 16 nt, Human
uuuguaauuuuuuuau

SEQ ID NO: 3009875 - RNA, 14 nt, Human
uuuguacagacaac

SEQ ID NO: 3009876 - RNA, 16 nt, Human
uuuguuucugaaaggg

SEQ ID NO: 3009877 - RNA, 14 nt, Human
uuuguuucugaaag

SEQ ID NO: 3009878 - RNA, 22 nt, Human
uuugugcauuaucuagauacug

SEQ ID NO: 3009879 - RNA, 15 nt, Human
uuugugauacaaugc

SEQ ID NO: 3009880 - RNA, 22 nt, Human
uuugugauacaaugcugugccc

SEQ ID NO: 3009881 - RNA, 19 nt, Human
uuugugcauuaucuagaua

SEQ ID NO: 3009882 - RNA, 14 nt, Human
uuugucuuaaaaag

SEQ ID NO: 3009883 - RNA, 13 nt, Human
uuugucuuaaaaa

SEQ ID NO: 3009884 - RNA, 16 nt, Human
uuugugauacaaugcu

SEQ ID NO: 3009885 - RNA, 23 nt, Human
uuugucuuaaaaaguggaaaaau

SEQ ID NO: 3009886 - RNA, 17 nt, Human
auguccaagaagcccag

SEQ ID NO: 3009887 - RNA, 16 nt, Human
auguccaagaagccca

SEQ ID NO: 3009888 - RNA, 12 nt, Human
auguaucaauga

SEQ ID NO: 3009889 - RNA, 14 nt, Human
augugagacugguu

SEQ ID NO: 3009890 - RNA, 13 nt, Human
augugagaccauu

SEQ ID NO: 3009891 - RNA, 21 nt, Human
auuccuaacuaucacugguuu

SEQ ID NO: 3009892 - RNA, 22 nt, Human
auuccccaggaggccagccuug

SEQ ID NO: 3009893 - RNA, 20 nt, Human
auuccccaggaggccagccu

SEQ ID NO: 3009894 - RNA, 19 nt, Human
auuccccaggaggccagcc

SEQ ID NO: 3009895 - RNA, 18 nt, Human
auucccaagcucugcucc

SEQ ID NO: 3009896 - RNA, 19 nt, Human
auucccaagcucugcuccu

SEQ ID NO: 3009897 - RNA, 17 nt, Human
auucccaagcucugcuc

SEQ ID NO: 3009898 - RNA, 21 nt, Human
auuaguuuugaagauucuaug

SEQ ID NO: 3009899 - RNA, 17 nt, Human
auuauugauguuuucau

SEQ ID NO: 3009900 - RNA, 15 nt, Human
uuuuugguauuugaa

SEQ ID NO: 3009901 - RNA, 18 nt, Human
auuaaguacuauguauca

SEQ ID NO: 3009902 - RNA, 16 nt, Human
auuaaguacuauguau

SEQ ID NO: 3009903 - RNA, 19 nt, Human
auuaaguacuauguaucaa

SEQ ID NO: 3009904 - RNA, 13 nt, Human
auuaaggaagaca

SEQ ID NO: 3009905 - RNA, 18 nt, Human
uuuuuggaaaagaauaaa

SEQ ID NO: 3009906 - RNA, 12 nt, Human
uuuuguguacuu

SEQ ID NO: 3009907 - RNA, 23 nt, Human
uuuugugcauuaucuagauacug

SEQ ID NO: 3009908 - RNA, 14 nt, Human
uuuuggaaaagaau

SEQ ID NO: 3009909 - RNA, 22 nt, Human
uuuuuauauucucagcagagug

SEQ ID NO: 3009910 - RNA, 21 nt, Human
uuuuuauauucucagcagagu

SEQ ID NO: 3009911 - RNA, 23 nt, Human
uuuuuauacauaaacaagaccac

SEQ ID NO: 3009912 - RNA, 20 nt, Human
uuuuguuuuuauuaaaagga

SEQ ID NO: 3009913 - RNA, 16 nt, Human
uuuuguuuuugucuua

SEQ ID NO: 3009914 - RNA, 14 nt, Human
auuacuucugcuac

SEQ ID NO: 3009915 - RNA, 12 nt, Human
auuacuucugcu

SEQ ID NO: 3009916 - RNA, 13 nt, Human
auuacuucugcua

SEQ ID NO: 3009917 - RNA, 13 nt, Human
auuagagaagaga

SEQ ID NO: 3009918 - RNA, 16 nt, Human
uuuaagacuuugguua

SEQ ID NO: 3009919 - RNA, 12 nt, Human
uuuaagagaaau

SEQ ID NO: 3009920 - RNA, 19 nt, Human
uuuaaggaugcuuguacau

SEQ ID NO: 3009921 - RNA, 21 nt, Human
uuuaagcuguuacugucuuca

SEQ ID NO: 3009922 - RNA, 15 nt, Human
uuuaaucuuuuauga

SEQ ID NO: 3009923 - RNA, 13 nt, Human
uuuaaucuuuuau

SEQ ID NO: 3009924 - RNA, 16 nt, Human
uuuaaugaaagacugu

SEQ ID NO: 3009925 - RNA, 21 nt, Human
uuuaagggcccuuuuucaaua

SEQ ID NO: 3009926 - RNA, 20 nt, Human
uuuaagggcccuuuuucaau

SEQ ID NO: 3009927 - RNA, 18 nt, Human
uuuaagggcccuuuuuca

SEQ ID NO: 3009928 - RNA, 22 nt, Human
uuuaaggaugcuuguacauaau

SEQ ID NO: 3009929 - RNA, 20 nt, Human
uuuaaggaugcuuguacaua

SEQ ID NO: 3009930 - RNA, 21 nt, Human
uuuaaggaugcuuguacauaa

SEQ ID NO: 3009931 - RNA, 11 nt, Human
uuuaaaugcac

SEQ ID NO: 3009932 - RNA, 20 nt, Human
augcaaagaugaaggucugu

SEQ ID NO: 3009933 - RNA, 21 nt, Human
augcacuuuguucuggcucuu

SEQ ID NO: 3009934 - RNA, 23 nt, Human
augcacuuuguucuggcucuucc

SEQ ID NO: 3009935 - RNA, 17 nt, Human
uuguucuugguuuguaa

SEQ ID NO: 3009936 - RNA, 19 nt, Human
uuguucuugguuuguaaau

SEQ ID NO: 3009937 - RNA, 16 nt, Human
uuguguacuuuuaaga

SEQ ID NO: 3009938 - RNA, 22 nt, Human
uugugaaugcagguuuuaucag

SEQ ID NO: 3009939 - RNA, 16 nt, Human
uuguccccgacccuug

SEQ ID NO: 3009940 - RNA, 15 nt, Human
uuguccccgacccuu

SEQ ID NO: 3009941 - RNA, 20 nt, Human
uuguccccaccgcagacagg

SEQ ID NO: 3009942 - RNA, 18 nt, Human
uuguccccaccgcagaca

SEQ ID NO: 3009943 - RNA, 13 nt, Human
uugugaggaagcc

SEQ ID NO: 3009944 - RNA, 19 nt, Human
uugugauacaaugcugugc

SEQ ID NO: 3009945 - RNA, 20 nt, Human
uugugauacaaugcugugcc

SEQ ID NO: 3009946 - RNA, 18 nt, Human
uugugaggaagccgcugg

SEQ ID NO: 3009947 - RNA, 17 nt, Human
uugugaggaagccgcug

SEQ ID NO: 3009948 - RNA, 21 nt, Human
uugucauauaagauucauauu

SEQ ID NO: 3009949 - RNA, 17 nt, Human
uugucacacacuuuggc

SEQ ID NO: 3009950 - RNA, 13 nt, Human
augaguccccugu

SEQ ID NO: 3009951 - RNA, 23 nt, Human
augaguccccuguuuguuucuga

SEQ ID NO: 3009952 - RNA, 19 nt, Human
augaggucagagccugcag

SEQ ID NO: 3009953 - RNA, 20 nt, Human
augaggucagagccugcagu

SEQ ID NO: 3009954 - RNA, 15 nt, Human
augaggucagagccu

SEQ ID NO: 3009955 - RNA, 16 nt, Human
augaggucagagccug

SEQ ID NO: 3009956 - RNA, 18 nt, Human
augaggucagagccugca

SEQ ID NO: 3009957 - RNA, 18 nt, Human
uuuaucagaacuauguuu

SEQ ID NO: 3009958 - RNA, 14 nt, Human
uuuaucagaauucu

SEQ ID NO: 3009959 - RNA, 14 nt, Human
augcuccuggccca

SEQ ID NO: 3009960 - RNA, 18 nt, Human
augcuggcuguuggcugg

SEQ ID NO: 3009961 - RNA, 19 nt, Human
augcuggcuguuggcuggg

SEQ ID NO: 3009962 - RNA, 20 nt, Human
augcuggcuguuggcugggg

SEQ ID NO: 3009963 - RNA, 18 nt, Human
auggaagacagcucuuau

SEQ ID NO: 3009964 - RNA, 17 nt, Human
auggaagacagcucuua

SEQ ID NO: 3009965 - RNA, 20 nt, Human
augcuucucacugccaugcc

SEQ ID NO: 3009966 - RNA, 16 nt, Human
augcuucucacugcca

SEQ ID NO: 3009967 - RNA, 12 nt, Human
uuucaaacuuua

SEQ ID NO: 3009968 - RNA, 16 nt, Human
uuucccuauuagagaa

SEQ ID NO: 3009969 - RNA, 11 nt, Human
uuucagaaaug

SEQ ID NO: 3009970 - RNA, 12 nt, Human
uuucagaaaugu

SEQ ID NO: 3009971 - RNA, 15 nt, Human
augcccagugagacu

SEQ ID NO: 3009972 - RNA, 16 nt, Human
augcccagugagacug

SEQ ID NO: 3009973 - RNA, 17 nt, Human
augcccagccccuucug

SEQ ID NO: 3009974 - RNA, 15 nt, Human
augcccagccccuuc

SEQ ID NO: 3009975 - RNA, 16 nt, Human
augcccagccccuucu

SEQ ID NO: 3009976 - RNA, 21 nt, Human
augccaugaggaacaaggcaa

SEQ ID NO: 3009977 - RNA, 18 nt, Human
uuuaaucuuuuaugauug

SEQ ID NO: 3009978 - RNA, 21 nt, Human
uuuaaugaaagacuguacaaa

SEQ ID NO: 3009979 - RNA, 23 nt, Human
uuuaaugaaagacuguacaaagu

SEQ ID NO: 3009980 - RNA, 20 nt, Human
augcgugcauaccacuuuug

SEQ ID NO: 3009981 - RNA, 22 nt, Human
augcgugcauaccacuuuuguu

SEQ ID NO: 3009982 - RNA, 14 nt, Human
augccucucucagg

SEQ ID NO: 3009983 - RNA, 13 nt, Human
augccucucucag

SEQ ID NO: 3009984 - RNA, 15 nt, Human
augccucucucaggc

SEQ ID NO: 3009985 - RNA, 17 nt, Human
uuuaucagaacuauguu

SEQ ID NO: 3009986 - RNA, 16 nt, Human
uuuaucagaacuaugu

SEQ ID NO: 3009987 - RNA, 14 nt, Human
uuuacuucuuauac

SEQ ID NO: 3009988 - RNA, 13 nt, Human
uuuacuucuuaua

SEQ ID NO: 3009989 - RNA, 11 nt, Human
uuuacuuaaac

SEQ ID NO: 3009990 - RNA, 16 nt, Human
uuuacugcagcuuugu

SEQ ID NO: 3009991 - RNA, 18 nt, Human
uuuaccugaagucuuugu

SEQ ID NO: 3009992 - RNA, 23 nt, Human
uugccaauuugcacauuaaauga

SEQ ID NO: 3009993 - RNA, 22 nt, Human
uugccaauuugcacauuaaaug

SEQ ID NO: 3009994 - RNA, 19 nt, Human
uugccaauuugcacauuaa

SEQ ID NO: 3009995 - RNA, 13 nt, Human
uugcccaggcagg

SEQ ID NO: 3009996 - RNA, 14 nt, Human
uugcccaggcaggu

SEQ ID NO: 3009997 - RNA, 16 nt, Human
uugcccaggcaggucu

SEQ ID NO: 3009998 - RNA, 18 nt, Human
uugcccaggcaggucuug

SEQ ID NO: 3009999 - RNA, 11 nt, Human
uugcccaggcu

SEQ ID NO: 3010000 - RNA, 12 nt, Human
uugcccaggcug

SEQ ID NO: 3010001 - RNA, 14 nt, Human
uugcccaggcuggc

SEQ ID NO: 3010002 - RNA, 23 nt, Human
uugcccaggcuggcgugcagugg

SEQ ID NO: 3010003 - RNA, 11 nt, Human
uugcccaggca

SEQ ID NO: 3010004 - RNA, 21 nt, Human
uugcaccacugcacuccagcc

SEQ ID NO: 3010005 - RNA, 14 nt, Human
uugcaauggcagcc

SEQ ID NO: 3010006 - RNA, 12 nt, Human
uugcaugaggcu

SEQ ID NO: 3010007 - RNA, 14 nt, Human
uugcaugaggcuag

SEQ ID NO: 3010008 - RNA, 15 nt, Human
uugauuaaauucuug

SEQ ID NO: 3010009 - RNA, 16 nt, Human
uugauuaaauucuugc

SEQ ID NO: 3010010 - RNA, 20 nt, Human
uugauuaaauucuugcaaag

SEQ ID NO: 3010011 - RNA, 21 nt, Human
uugauuaaauucuugcaaagu

SEQ ID NO: 3010012 - RNA, 23 nt, Human
uugauguucuuucacccuuuucu

SEQ ID NO: 3010013 - RNA, 18 nt, Human
aucucuugagccugggag

SEQ ID NO: 3010014 - RNA, 23 nt, Human
aucucacacaugagcaucaggcc

SEQ ID NO: 3010015 - RNA, 16 nt, Human
aucucaaauuucuaaa

SEQ ID NO: 3010016 - RNA, 17 nt, Human
aucucaaauuucuaaau

SEQ ID NO: 3010017 - RNA, 16 nt, Human
aucccuuucccuuggu

SEQ ID NO: 3010018 - RNA, 20 nt, Human
aucccuuggacauuuuaugu

SEQ ID NO: 3010019 - RNA, 21 nt, Human
aucccuuggacauuuuauguc

SEQ ID NO: 3010020 - RNA, 17 nt, Human
aucccuuggacauuuua

SEQ ID NO: 3010021 - RNA, 19 nt, Human
aucccuuggacauuuuaug

SEQ ID NO: 3010022 - RNA, 19 nt, Human
uugacaggauuauuggaaa

SEQ ID NO: 3010023 - RNA, 10 nt, Human
uugacagggc

SEQ ID NO: 3010024 - RNA, 12 nt, Human
uugacagggcac

SEQ ID NO: 3010025 - RNA, 16 nt, Human
uugacaucaacugcau

SEQ ID NO: 3010026 - RNA, 13 nt, Human
uugacaucaacug

SEQ ID NO: 3010027 - RNA, 11 nt, Human
uugagacagag

SEQ ID NO: 3010028 - RNA, 12 nt, Human
uugagcagggcu

SEQ ID NO: 3010029 - RNA, 16 nt, Human
uugagcagggcucagc

SEQ ID NO: 3010030 - RNA, 14 nt, Human
uugagugucaagcu

SEQ ID NO: 3010031 - RNA, 11 nt, Human
uugagugccuu

SEQ ID NO: 3010032 - RNA, 21 nt, Human
uugagugcugucuccauguuu

SEQ ID NO: 3010033 - RNA, 15 nt, Human
uugauacuacaguuu

SEQ ID NO: 3010034 - RNA, 17 nt, Human
uugauacuacaguuugu

SEQ ID NO: 3010035 - RNA, 20 nt, Human
aucuaauauguaacaagcca

SEQ ID NO: 3010036 - RNA, 23 nt, Human
aucuaauauguaacaagccaccc

SEQ ID NO: 3010037 - RNA, 18 nt, Human
aucuagauacuguaucau

SEQ ID NO: 3010038 - RNA, 19 nt, Human
aucuagauacuguaucaug

SEQ ID NO: 3010039 - RNA, 19 nt, Human
aucuaggaagacuuuggaa

SEQ ID NO: 3010040 - RNA, 18 nt, Human
aucuaggaagacuuugga

SEQ ID NO: 3010041 - RNA, 17 nt, Human
aucuaggaagacuuugg

SEQ ID NO: 3010042 - RNA, 14 nt, Human
aucucaaauuucua

SEQ ID NO: 3010043 - RNA, 23 nt, Human
aucucaaauaacuaaaagguaug

SEQ ID NO: 3010044 - RNA, 14 nt, Human
aucucaaauaacua

SEQ ID NO: 3010045 - RNA, 21 nt, Human
aucucaaauaacuaaaaggua

SEQ ID NO: 3010046 - RNA, 19 nt, Human
aucugugaugacauucccu

SEQ ID NO: 3010047 - RNA, 21 nt, Human
aucugugaugacauucccugc

SEQ ID NO: 3010048 - RNA, 12 nt, Human
aucugucauuug

SEQ ID NO: 3010049 - RNA, 17 nt, Human
aucugucauuugagcag

SEQ ID NO: 3010050 - RNA, 22 nt, Human
aucugucauuugagcagggcuc

SEQ ID NO: 3010051 - RNA, 15 nt, Human
aucuugcucugcuga

SEQ ID NO: 3010052 - RNA, 16 nt, Human
aucuugcucugcugac

SEQ ID NO: 3010053 - RNA, 14 nt, Human
aucuugcucugcug

SEQ ID NO: 3010054 - RNA, 15 nt, Human
uugcuuugugauuuu

SEQ ID NO: 3010055 - RNA, 20 nt, Human
uugcuuugugauuuuuguaa

SEQ ID NO: 3010056 - RNA, 17 nt, Human
uuggaaaauaaauuauu

SEQ ID NO: 3010057 - RNA, 13 nt, Human
uuggcccaggagu

SEQ ID NO: 3010058 - RNA, 14 nt, Human
uuggcccaggaguu

SEQ ID NO: 3010059 - RNA, 15 nt, Human
uuggcccaggaguuu

SEQ ID NO: 3010060 - RNA, 20 nt, Human
uuggcccaggaguuuggcca

SEQ ID NO: 3010061 - RNA, 21 nt, Human
uuggcccaggaguuuggccag

SEQ ID NO: 3010062 - RNA, 22 nt, Human
uuggcccaggaguuuggccaga

SEQ ID NO: 3010063 - RNA, 20 nt, Human
uuggcccaggauuauuguca

SEQ ID NO: 3010064 - RNA, 23 nt, Human
augaaccacaucuugcucugcug

SEQ ID NO: 3010065 - RNA, 22 nt, Human
augaaccacaucuugcucugcu

SEQ ID NO: 3010066 - RNA, 17 nt, Human
augaaugaaacauuuug

SEQ ID NO: 3010067 - RNA, 18 nt, Human
uuggugguuucagaaaug

SEQ ID NO: 3010068 - RNA, 19 nt, Human
uuggugguuucagaaaugu

SEQ ID NO: 3010069 - RNA, 18 nt, Human
augaaugucagugugacu

SEQ ID NO: 3010070 - RNA, 16 nt, Human
augaaugucaguguga

SEQ ID NO: 3010071 - RNA, 17 nt, Human
uuggugucgggcaugac

SEQ ID NO: 3010072 - RNA, 19 nt, Human
uuggugucgggcaugacac

SEQ ID NO: 3010073 - RNA, 18 nt, Human
uuggugucgggcaugaca

SEQ ID NO: 3010074 - RNA, 14 nt, Human
uugguuuguaaauu

SEQ ID NO: 3010075 - RNA, 13 nt, Human
auauaagguuuuu

SEQ ID NO: 3010076 - RNA, 15 nt, Human
uucagcccucagaau

SEQ ID NO: 3010077 - RNA, 19 nt, Human
uucagccaagaauucuuaa

SEQ ID NO: 3010078 - RNA, 14 nt, Human
uucagccaagaauu

SEQ ID NO: 3010079 - RNA, 17 nt, Human
uucagaucucuaacuuc

SEQ ID NO: 3010080 - RNA, 18 nt, Human
uucacugguacucugcca

SEQ ID NO: 3010081 - RNA, 11 nt, Human
uucauagagaa

SEQ ID NO: 3010082 - RNA, 18 nt, Human
uucauagagaauauaaaa

SEQ ID NO: 3010083 - RNA, 13 nt, Human
uucauauuuaauu

SEQ ID NO: 3010084 - RNA, 16 nt, Human
uucauauuuacuucuu

SEQ ID NO: 3010085 - RNA, 21 nt, Human
uucauauuuacuucuuauaca

SEQ ID NO: 3010086 - RNA, 14 nt, Human
uucaguaauaacuc

SEQ ID NO: 3010087 - RNA, 20 nt, Human
uucauauuuaauuugaaggu

SEQ ID NO: 3010088 - RNA, 18 nt, Human
uucaucauccuaagcuau

SEQ ID NO: 3010089 - RNA, 21 nt, Human
uucaucauccuaagcuauuca

SEQ ID NO: 3010090 - RNA, 14 nt, Human
auaugucaagccau

SEQ ID NO: 3010091 - RNA, 20 nt, Human
auaugauuuaaaucagccgu

SEQ ID NO: 3010092 - RNA, 22 nt, Human
auaucugaaaauguauguguaa

SEQ ID NO: 3010093 - RNA, 21 nt, Human
uuauuucucucaucuguuaca

SEQ ID NO: 3010094 - RNA, 17 nt, Human
uucaaaauaaaaaugag

SEQ ID NO: 3010095 - RNA, 15 nt, Human
uucaaggauccugag

SEQ ID NO: 3010096 - RNA, 21 nt, Human
uucaaggauccugagccagau

SEQ ID NO: 3010097 - RNA, 19 nt, Human
uucaaggauccugagccag

SEQ ID NO: 3010098 - RNA, 18 nt, Human
uucaaggauccugagcca

SEQ ID NO: 3010099 - RNA, 16 nt, Human
uucaaggauccugagc

SEQ ID NO: 3010100 - RNA, 22 nt, Human
auagcugugauuuuugguauuu

SEQ ID NO: 3010101 - RNA, 19 nt, Human
auaggaacuuaaauaaugu

SEQ ID NO: 3010102 - RNA, 17 nt, Human
uucacauauugauuucc

SEQ ID NO: 3010103 - RNA, 22 nt, Human
uucaccacaugugcacaugcac

SEQ ID NO: 3010104 - RNA, 12 nt, Human
auaacuuuuuau

SEQ ID NO: 3010105 - RNA, 13 nt, Human
auaagauaaaugu

SEQ ID NO: 3010106 - RNA, 17 nt, Human
auaagauaaaugugcug

SEQ ID NO: 3010107 - RNA, 18 nt, Human
auagccugccucuucucu

SEQ ID NO: 3010108 - RNA, 22 nt, Human
auagcucaggugucccugcacu

SEQ ID NO: 3010109 - RNA, 20 nt, Human
auagcucaggugucccugca

SEQ ID NO: 3010110 - RNA, 21 nt, Human
auagcucaggugucccugcac

SEQ ID NO: 3010111 - RNA, 12 nt, Human
auagcugggacu

SEQ ID NO: 3010112 - RNA, 19 nt, Human
auagcucaggugucccugc

SEQ ID NO: 3010113 - RNA, 19 nt, Human
auagcugugauuuuuggua

SEQ ID NO: 3010114 - RNA, 23 nt, Human
auagcuggucuuauuuguaaagc

SEQ ID NO: 3010115 - RNA, 17 nt, Human
auagcugggacuacagg

SEQ ID NO: 3010116 - RNA, 22 nt, Human
auagcuggucuuauuuguaaag

SEQ ID NO: 3010117 - RNA, 13 nt, Human
uuauuuaaauaga

SEQ ID NO: 3010118 - RNA, 14 nt, Human
uuauuuaaauuuua

SEQ ID NO: 3010119 - RNA, 18 nt, Human
uuauuuaaugaaagacug

SEQ ID NO: 3010120 - RNA, 22 nt, Human
uuauuuaaugaaagacuguaca

SEQ ID NO: 3010121 - RNA, 11 nt, Human
uuauuuauuga

SEQ ID NO: 3010122 - RNA, 16 nt, Human
uuauuuaguuccuuga

SEQ ID NO: 3010123 - RNA, 13 nt, Human
uucucacagaaga

SEQ ID NO: 3010124 - RNA, 23 nt, Human
uucucagaaucucaaauaacuaa

SEQ ID NO: 3010125 - RNA, 13 nt, Human
uucucagaaucuc

SEQ ID NO: 3010126 - RNA, 19 nt, Human
uucucagaaucucaaauaa

SEQ ID NO: 3010127 - RNA, 22 nt, Human
uucucagaaucucaaauaacua

SEQ ID NO: 3010128 - RNA, 13 nt, Human
uucuaggccuggg

SEQ ID NO: 3010129 - RNA, 15 nt, Human
aucagcacgauuucu

SEQ ID NO: 3010130 - RNA, 16 nt, Human
aucagcacgauuucug

SEQ ID NO: 3010131 - RNA, 17 nt, Human
aucagcacgauuucugu

SEQ ID NO: 3010132 - RNA, 18 nt, Human
aucagcacgauuucuguu

SEQ ID NO: 3010133 - RNA, 22 nt, Human
aucauuaaagccugaguuugcu

SEQ ID NO: 3010134 - RNA, 13 nt, Human
aucauugaaaucu

SEQ ID NO: 3010135 - RNA, 15 nt, Human
aucauugaaaucuuu

SEQ ID NO: 3010136 - RNA, 14 nt, Human
aucauugaaaucuu

SEQ ID NO: 3010137 - RNA, 15 nt, Human
uucugaaagggacgc

SEQ ID NO: 3010138 - RNA, 19 nt, Human
aucauugaaaucuuuuugc

SEQ ID NO: 3010139 - RNA, 23 nt, Human
uucugaacuuggcgcugccccug

SEQ ID NO: 3010140 - RNA, 16 nt, Human
uucugccgcagcccug

SEQ ID NO: 3010141 - RNA, 23 nt, Human
uucugccgcagcccugcagaggg

SEQ ID NO: 3010142 - RNA, 10 nt, Human
uucugggaca

SEQ ID NO: 3010143 - RNA, 11 nt, Human
uucugggacac

SEQ ID NO: 3010144 - RNA, 22 nt, Human
uucugggacacaguucaauucu

SEQ ID NO: 3010145 - RNA, 15 nt, Human
auccagguucagcuu

SEQ ID NO: 3010146 - RNA, 16 nt, Human
auccagguucagcuug

SEQ ID NO: 3010147 - RNA, 16 nt, Human
aucccauaugccuggg

SEQ ID NO: 3010148 - RNA, 17 nt, Human
aucccauaugccugggc

SEQ ID NO: 3010149 - RNA, 23 nt, Human
auauuucugaggagccugcaaca

SEQ ID NO: 3010150 - RNA, 17 nt, Human
auauuguuuucagugua

SEQ ID NO: 3010151 - RNA, 20 nt, Human
auauuguuuucaguguacau

SEQ ID NO: 3010152 - RNA, 20 nt, Human
auauugcauacuauuaaaca

SEQ ID NO: 3010153 - RNA, 22 nt, Human
auauugcauacuauuaaacaug

SEQ ID NO: 3010154 - RNA, 21 nt, Human
auauugcugauggugcaauga

SEQ ID NO: 3010155 - RNA, 17 nt, Human
auauugcugauggugca

SEQ ID NO: 3010156 - RNA, 18 nt, Human
auauucucagcagagugc

SEQ ID NO: 3010157 - RNA, 17 nt, Human
auauucucagcagagug

SEQ ID NO: 3010158 - RNA, 15 nt, Human
auauucucagcagag

SEQ ID NO: 3010159 - RNA, 16 nt, Human
auauucucagcagagu

SEQ ID NO: 3010160 - RNA, 16 nt, Human
auauucuguuggccag

SEQ ID NO: 3010161 - RNA, 19 nt, Human
auauugauuuccguuaaaa

SEQ ID NO: 3010162 - RNA, 21 nt, Human
auauugauuuccguuaaaaua

SEQ ID NO: 3010163 - RNA, 22 nt, Human
auauugauuuccguuaaaauac

SEQ ID NO: 3010164 - RNA, 20 nt, Human
auauguuuuaagaggcaggg

SEQ ID NO: 3010165 - RNA, 18 nt, Human
auauguuuuaagaggcag

SEQ ID NO: 3010166 - RNA, 24 nt, Human
auauuaagaaagacuaucuaaaug

SEQ ID NO: 3010167 - RNA, 22 nt, Human
auauuaaggaagacaaugugaa

SEQ ID NO: 3010168 - RNA, 14 nt, Human
uuccuucagugccu

SEQ ID NO: 3010169 - RNA, 11 nt, Human
uuccuucagug

SEQ ID NO: 3010170 - RNA, 17 nt, Human
uuccuguucccaugaga

SEQ ID NO: 3010171 - RNA, 11 nt, Human
uuccucuuucc

SEQ ID NO: 3010172 - RNA, 15 nt, Human
uuccuaauccucuag

SEQ ID NO: 3010173 - RNA, 13 nt, Human
uuccuaauccucu

SEQ ID NO: 3010174 - RNA, 13 nt, Human
aucaaguauuaua

SEQ ID NO: 3010175 - RNA, 14 nt, Human
aucaaguauuauac

SEQ ID NO: 3010176 - RNA, 18 nt, Human
aucaaguauuauaccuuu

SEQ ID NO: 3010177 - RNA, 22 nt, Human
aucacggcucacugcagccuca

SEQ ID NO: 3010178 - RNA, 18 nt, Human
ugugaugacauucccugc

SEQ ID NO: 3010179 - RNA, 18 nt, Human
ugugauggggcccugccu

SEQ ID NO: 3010180 - RNA, 20 nt, Human
ugugauggggcccugccucc

SEQ ID NO: 3010181 - RNA, 19 nt, Human
ugugauggggcccugccuc

SEQ ID NO: 3010182 - RNA, 23 nt, Human
ugugcauuuggugguuucagaaa

SEQ ID NO: 3010183 - RNA, 20 nt, Human
ugugccagguuuuuggucug

SEQ ID NO: 3010184 - RNA, 12 nt, Human
ugugccaugugc

SEQ ID NO: 3010185 - RNA, 16 nt, Human
ugugccaugugccagg

SEQ ID NO: 3010186 - RNA, 17 nt, Human
agugaggcucugcccuu

SEQ ID NO: 3010187 - RNA, 16 nt, Human
agugaggcucugcccu

SEQ ID NO: 3010188 - RNA, 14 nt, Human
agugaggcucugcc

SEQ ID NO: 3010189 - RNA, 15 nt, Human
agugaggcucugccc

SEQ ID NO: 3010190 - RNA, 15 nt, Human
agugagucgaggaca

SEQ ID NO: 3010191 - RNA, 21 nt, Human
agugaguugauagcacagacc

SEQ ID NO: 3010192 - RNA, 21 nt, Human
agugaggcucugcccuugguu

SEQ ID NO: 3010193 - RNA, 20 nt, Human
agugaggcucugcccuuggu

SEQ ID NO: 3010194 - RNA, 19 nt, Human
agugaggcucugcccuugg

SEQ ID NO: 3010195 - RNA, 21 nt, Human
ugugcccccauguaagcaccc

SEQ ID NO: 3010196 - RNA, 21 nt, Human
uguggaguucaucuugaauug

SEQ ID NO: 3010197 - RNA, 17 nt, Human
uguggaguucaucuuga

SEQ ID NO: 3010198 - RNA, 21 nt, Human
agucuucaguuugcagaguag

SEQ ID NO: 3010199 - RNA, 20 nt, Human
agucuucaguuugcagagua

SEQ ID NO: 3010200 - RNA, 18 nt, Human
agucuucaguuugcagag

SEQ ID NO: 3010201 - RNA, 23 nt, Human
agucuuagauguauauauuuccu

SEQ ID NO: 3010202 - RNA, 14 nt, Human
agucuuuguacaga

SEQ ID NO: 3010203 - RNA, 16 nt, Human
ugugacugaauuucuu

SEQ ID NO: 3010204 - RNA, 15 nt, Human
ugugacugaauuucu

SEQ ID NO: 3010205 - RNA, 19 nt, Human
ugugaaccaccacacccag

SEQ ID NO: 3010206 - RNA, 20 nt, Human
ugugaaccaccacacccagc

SEQ ID NO: 3010207 - RNA, 21 nt, Human
ugugaaccaccacacccagcc

SEQ ID NO: 3010208 - RNA, 17 nt, Human
ugugaaccaccacaccc

SEQ ID NO: 3010209 - RNA, 15 nt, Human
ugugaaaggaaagag

SEQ ID NO: 3010210 - RNA, 21 nt, Human
ugugaaaggaaagagggaggu

SEQ ID NO: 3010211 - RNA, 18 nt, Human
ugugaaaggaaagaggcu

SEQ ID NO: 3010212 - RNA, 20 nt, Human
uguuccacaaguuaaauaaa

SEQ ID NO: 3010213 - RNA, 20 nt, Human
agugugucuuagugugugca

SEQ ID NO: 3010214 - RNA, 16 nt, Human
uguucugggacacagu

SEQ ID NO: 3010215 - RNA, 13 nt, Human
uguugcccaggca

SEQ ID NO: 3010216 - RNA, 12 nt, Human
uguugcccaggc

SEQ ID NO: 3010217 - RNA, 15 nt, Human
uguugcccaggcagg

SEQ ID NO: 3010218 - RNA, 16 nt, Human
uguugcccaggcaggu

SEQ ID NO: 3010219 - RNA, 17 nt, Human
uguugcccaggcagguc

SEQ ID NO: 3010220 - RNA, 18 nt, Human
uguugcccaggcaggucu

SEQ ID NO: 3010221 - RNA, 16 nt, Human
aguggugcgaucuggg

SEQ ID NO: 3010222 - RNA, 17 nt, Human
aguggugcgaucugggu

SEQ ID NO: 3010223 - RNA, 21 nt, Human
agugguggugaacagaacaaa

SEQ ID NO: 3010224 - RNA, 17 nt, Human
aguggugguuuucuguu

SEQ ID NO: 3010225 - RNA, 18 nt, Human
aguggugguuuucuguuc

SEQ ID NO: 3010226 - RNA, 19 nt, Human
aguggugguuuucuguucu

SEQ ID NO: 3010227 - RNA, 20 nt, Human
aguggugguuuucuguucuu

SEQ ID NO: 3010228 - RNA, 21 nt, Human
aguggugguuuucuguucuuu

SEQ ID NO: 3010229 - RNA, 23 nt, Human
aguggugguuuucuguucuuucu

SEQ ID NO: 3010230 - RNA, 17 nt, Human
agugugguguuuccugg

SEQ ID NO: 3010231 - RNA, 19 nt, Human
agugugguguuuccuggca

SEQ ID NO: 3010232 - RNA, 16 nt, Human
agugugguguuuccug

SEQ ID NO: 3010233 - RNA, 23 nt, Human
uguguguuuauugucaaaguggu

SEQ ID NO: 3010234 - RNA, 19 nt, Human
uguguguuuauugucaaag

SEQ ID NO: 3010235 - RNA, 16 nt, Human
ugugucucuugguccu

SEQ ID NO: 3010236 - RNA, 21 nt, Human
ugugucuugcaauggcagccu

SEQ ID NO: 3010237 - RNA, 20 nt, Human
ugugucuugcaauggcagcc

SEQ ID NO: 3010238 - RNA, 21 nt, Human
ugugucucuugguccugcugc

SEQ ID NO: 3010239 - RNA, 20 nt, Human
ugugucucuugguccugcug

SEQ ID NO: 3010240 - RNA, 17 nt, Human
ugugucucuugguccug

SEQ ID NO: 3010241 - RNA, 20 nt, Human
agugcugggauuacaggugu

SEQ ID NO: 3010242 - RNA, 19 nt, Human
agugcugcauuuaaaagau

SEQ ID NO: 3010243 - RNA, 16 nt, Human
agugcugcauuuaaaa

SEQ ID NO: 3010244 - RNA, 17 nt, Human
agugcugcauuuaaaag

SEQ ID NO: 3010245 - RNA, 21 nt, Human
agugcugggauuacaggugug

SEQ ID NO: 3010246 - RNA, 12 nt, Human
agugcugcauuu

SEQ ID NO: 3010247 - RNA, 13 nt, Human
agugcugcauuua

SEQ ID NO: 3010248 - RNA, 23 nt, Human
agugaguugauagcacagacccu

SEQ ID NO: 3010249 - RNA, 22 nt, Human
agugaguugauagcacagaccc

SEQ ID NO: 3010250 - RNA, 15 nt, Human
uguggucccacccca

SEQ ID NO: 3010251 - RNA, 13 nt, Human
uguggucccaccc

SEQ ID NO: 3010252 - RNA, 16 nt, Human
ugugguguuuccuggc

SEQ ID NO: 3010253 - RNA, 14 nt, Human
ugugguguuuccug

SEQ ID NO: 3010254 - RNA, 21 nt, Human
uguggguuucuaaagcugcca

SEQ ID NO: 3010255 - RNA, 23 nt, Human
uguggguuucuaaagcugccagc

SEQ ID NO: 3010256 - RNA, 15 nt, Human
aguuggguuuuuuaa

SEQ ID NO: 3010257 - RNA, 18 nt, Human
aguuggucccccuuccau

SEQ ID NO: 3010258 - RNA, 23 nt, Human
aguuguuugauucagacagcugc

SEQ ID NO: 3010259 - RNA, 21 nt, Human
aguuguuugauucagacagcu

SEQ ID NO: 3010260 - RNA, 16 nt, Human
aguuggcuaggacccc

SEQ ID NO: 3010261 - RNA, 17 nt, Human
aguuggguggaugccug

SEQ ID NO: 3010262 - RNA, 21 nt, Human
aguuggguggaugccuggugg

SEQ ID NO: 3010263 - RNA, 20 nt, Human
uuaaauucuugcaaaguauc

SEQ ID NO: 3010264 - RNA, 14 nt, Human
uguugcuaacagca

SEQ ID NO: 3010265 - RNA, 19 nt, Human
uguugcccaggcaggucuu

SEQ ID NO: 3010266 - RNA, 19 nt, Human
uguuuauugucaaaguggu

SEQ ID NO: 3010267 - RNA, 17 nt, Human
uguuuauugucaaagug

SEQ ID NO: 3010268 - RNA, 22 nt, Human
uguuugagcaucgcuuaggaga

SEQ ID NO: 3010269 - RNA, 22 nt, Human
uguuugauucagacagcugccu

SEQ ID NO: 3010270 - RNA, 17 nt, Human
uguuugauucagacagc

SEQ ID NO: 3010271 - RNA, 22 nt, Human
uguuuugccaauuugcacauua

SEQ ID NO: 3010272 - RNA, 21 nt, Human
uguuuugccaauuugcacauu

SEQ ID NO: 3010273 - RNA, 17 nt, Human
uguuuugccaauuugca

SEQ ID NO: 3010274 - RNA, 19 nt, Human
uguuuugccaauuugcaca

SEQ ID NO: 3010275 - RNA, 14 nt, Human
aguucugguuccua

SEQ ID NO: 3010276 - RNA, 21 nt, Human
uguuuuauauagcaagacauu

SEQ ID NO: 3010277 - RNA, 16 nt, Human
uguuuuaucuucuaua

SEQ ID NO: 3010278 - RNA, 21 nt, Human
uguuuuauuuuaauucaguug

SEQ ID NO: 3010279 - RNA, 20 nt, Human
uguuuuccaugaguccccug

SEQ ID NO: 3010280 - RNA, 22 nt, Human
uuaagugcugcauuuaaaagau

SEQ ID NO: 3010281 - RNA, 17 nt, Human
uuaaguacuauguauca

SEQ ID NO: 3010282 - RNA, 15 nt, Human
uuaagaggcaggguc

SEQ ID NO: 3010283 - RNA, 16 nt, Human
uuaagaggcagggucu

SEQ ID NO: 3010284 - RNA, 13 nt, Human
uuaagaggcaggg

SEQ ID NO: 3010285 - RNA, 19 nt, Human
uuaauuuuuuugagacaga

SEQ ID NO: 3010286 - RNA, 23 nt, Human
auaaacaagaccacguuucuaaa

SEQ ID NO: 3010287 - RNA, 15 nt, Human
auaaacaagaccacg

SEQ ID NO: 3010288 - RNA, 22 nt, Human
auaaacaagaccacguuucuaa

SEQ ID NO: 3010289 - RNA, 15 nt, Human
uuaauucuuagcuca

SEQ ID NO: 3010290 - RNA, 23 nt, Human
uuaaugaaagacuguacaaagua

SEQ ID NO: 3010291 - RNA, 20 nt, Human
uuaaugaaagacuguacaaa

SEQ ID NO: 3010292 - RNA, 20 nt, Human
uuacauaagauaaaugugcu

SEQ ID NO: 3010293 - RNA, 19 nt, Human
uuacuauggcccuggccua

SEQ ID NO: 3010294 - RNA, 18 nt, Human
uuacucagaauucucuag

SEQ ID NO: 3010295 - RNA, 23 nt, Human
uuacucagaauucucuaguuuga

SEQ ID NO: 3010296 - RNA, 11 nt, Human
uuagacagagu

SEQ ID NO: 3010297 - RNA, 11 nt, Human
uuagaaauaua

SEQ ID NO: 3010298 - RNA, 12 nt, Human
uuagaaauauaa

SEQ ID NO: 3010299 - RNA, 14 nt, Human
uuagaaauauaauu

SEQ ID NO: 3010300 - RNA, 16 nt, Human
auaacuaaaagguaug

SEQ ID NO: 3010301 - RNA, 14 nt, Human
uuacaggaaguacu

SEQ ID NO: 3010302 - RNA, 17 nt, Human
agggcccuuuuucaaua

SEQ ID NO: 3010303 - RNA, 19 nt, Human
agggcucagcggggacagc

SEQ ID NO: 3010304 - RNA, 20 nt, Human
agggcucagcggggacagcu

SEQ ID NO: 3010305 - RNA, 22 nt, Human
agggcucagcggggacagcucc

SEQ ID NO: 3010306 - RNA, 23 nt, Human
agggcucagcggggacagcuccu

SEQ ID NO: 3010307 - RNA, 16 nt, Human
agggagggcuccagac

SEQ ID NO: 3010308 - RNA, 15 nt, Human
agggagggcuccaga

SEQ ID NO: 3010309 - RNA, 14 nt, Human
agggagggcuccag

SEQ ID NO: 3010310 - RNA, 13 nt, Human
agggagggcucca

SEQ ID NO: 3010311 - RNA, 15 nt, Human
agggagggagggcuc

SEQ ID NO: 3010312 - RNA, 16 nt, Human
ugggcccccaaaugga

SEQ ID NO: 3010313 - RNA, 21 nt, Human
ugggcccccaaauggaaaugg

SEQ ID NO: 3010314 - RNA, 20 nt, Human
ugggaggccaaggugggagg

SEQ ID NO: 3010315 - RNA, 19 nt, Human
ugggaggccaaggugggag

SEQ ID NO: 3010316 - RNA, 21 nt, Human
ugggaggaucucuugagccug

SEQ ID NO: 3010317 - RNA, 20 nt, Human
ugggaggaucucuugagccu

SEQ ID NO: 3010318 - RNA, 12 nt, Human
ugggcagaagga

SEQ ID NO: 3010319 - RNA, 18 nt, Human
ugggccaggagccuccug

SEQ ID NO: 3010320 - RNA, 12 nt, Human
ugggcagagcag

SEQ ID NO: 3010321 - RNA, 11 nt, Human
ugggcagagca

SEQ ID NO: 3010322 - RNA, 21 nt, Human
aggcccggcuccaggcuccuu

SEQ ID NO: 3010323 - RNA, 18 nt, Human
aggcccggcuccaggcuc

SEQ ID NO: 3010324 - RNA, 20 nt, Human
aggcccggcuccaggcuccu

SEQ ID NO: 3010325 - RNA, 22 nt, Human
agggaaggauacaaaagcaugu

SEQ ID NO: 3010326 - RNA, 22 nt, Human
ugggagaaccaaaaagaggcua

SEQ ID NO: 3010327 - RNA, 20 nt, Human
ugggacucaaugcacugaca

SEQ ID NO: 3010328 - RNA, 18 nt, Human
ugggacucaaugcacuga

SEQ ID NO: 3010329 - RNA, 16 nt, Human
ugggagagccuuccag

SEQ ID NO: 3010330 - RNA, 18 nt, Human
ugggaggaucucuugagc

SEQ ID NO: 3010331 - RNA, 21 nt, Human
ugggagagaagagaaugcaca

SEQ ID NO: 3010332 - RNA, 19 nt, Human
ugggagagaagagaaugca

SEQ ID NO: 3010333 - RNA, 14 nt, Human
ugggacuacaggca

SEQ ID NO: 3010334 - RNA, 15 nt, Human
ugggacuacaggcac

SEQ ID NO: 3010335 - RNA, 16 nt, Human
ugggacuacaggcacc

SEQ ID NO: 3010336 - RNA, 21 nt, Human
uggguggcaccagcagccugg

SEQ ID NO: 3010337 - RNA, 20 nt, Human
uggguggcaccagcagccug

SEQ ID NO: 3010338 - RNA, 17 nt, Human
uggguggcaccagcagc

SEQ ID NO: 3010339 - RNA, 20 nt, Human
ugguagagugugccugaagu

SEQ ID NO: 3010340 - RNA, 16 nt, Human
aggguggugaccucug

SEQ ID NO: 3010341 - RNA, 15 nt, Human
agggugggagugggc

SEQ ID NO: 3010342 - RNA, 20 nt, Human
aggggguggccucccaacuc

SEQ ID NO: 3010343 - RNA, 15 nt, Human
aggguaaggcugugg

SEQ ID NO: 3010344 - RNA, 14 nt, Human
agggucucacucug

SEQ ID NO: 3010345 - RNA, 15 nt, Human
agggucucacucugu

SEQ ID NO: 3010346 - RNA, 16 nt, Human
agggucucacucuguc

SEQ ID NO: 3010347 - RNA, 21 nt, Human
aggggaauguuugccucugcc

SEQ ID NO: 3010348 - RNA, 19 nt, Human
aggggaauguuugccucug

SEQ ID NO: 3010349 - RNA, 20 nt, Human
aggggaauguuugccucugc

SEQ ID NO: 3010350 - RNA, 13 nt, Human
aggggaaaagagg

SEQ ID NO: 3010351 - RNA, 14 nt, Human
aggggaacagacug

SEQ ID NO: 3010352 - RNA, 22 nt, Human
aggggaaaaucagccugcucca

SEQ ID NO: 3010353 - RNA, 18 nt, Human
aggggaaaaucagccugc

SEQ ID NO: 3010354 - RNA, 13 nt, Human
aggggaauguuug

SEQ ID NO: 3010355 - RNA, 17 nt, Human
ugggguacccacugcuc

SEQ ID NO: 3010356 - RNA, 18 nt, Human
ugggguacccacugcucu

SEQ ID NO: 3010357 - RNA, 19 nt, Human
ugggguacccacugcucug

SEQ ID NO: 3010358 - RNA, 15 nt, Human
ugggguaugggagag

SEQ ID NO: 3010359 - RNA, 14 nt, Human
uggggucacucugg

SEQ ID NO: 3010360 - RNA, 13 nt, Human
uggggucacucug

SEQ ID NO: 3010361 - RNA, 20 nt, Human
uggggucacucuggcagcuc

SEQ ID NO: 3010362 - RNA, 16 nt, Human
uggggucacucuggca

SEQ ID NO: 3010363 - RNA, 22 nt, Human
uggggucacucuggcagcucag

SEQ ID NO: 3010364 - RNA, 23 nt, Human
uggggcugcaccggcuggccugg

SEQ ID NO: 3010365 - RNA, 22 nt, Human
uggggcugcaccggcuggccug

SEQ ID NO: 3010366 - RNA, 12 nt, Human
uggggcccugcc

SEQ ID NO: 3010367 - RNA, 21 nt, Human
uggggccaguuggucccccuu

SEQ ID NO: 3010368 - RNA, 17 nt, Human
uggggaccucaggccug

SEQ ID NO: 3010369 - RNA, 16 nt, Human
uggggaccucaggccu

SEQ ID NO: 3010370 - RNA, 15 nt, Human
uggggaccucaggcc

SEQ ID NO: 3010371 - RNA, 14 nt, Human
uggggaccucaggc

SEQ ID NO: 3010372 - RNA, 12 nt, Human
agggcuccagac

SEQ ID NO: 3010373 - RNA, 19 nt, Human
ugucaagcugaccuugcug

SEQ ID NO: 3010374 - RNA, 16 nt, Human
uguauuuuuuuacuaa

SEQ ID NO: 3010375 - RNA, 19 nt, Human
uguauucucuccuguaccu

SEQ ID NO: 3010376 - RNA, 20 nt, Human
uguauucucuccuguaccuc

SEQ ID NO: 3010377 - RNA, 17 nt, Human
uguaucaaugaguaaca

SEQ ID NO: 3010378 - RNA, 20 nt, Human
aguaggggucugucuuuuaa

SEQ ID NO: 3010379 - RNA, 18 nt, Human
aguaggggucugucuuuu

SEQ ID NO: 3010380 - RNA, 17 nt, Human
ugucaauuacaggaagu

SEQ ID NO: 3010381 - RNA, 15 nt, Human
ugucaauuacaggaa

SEQ ID NO: 3010382 - RNA, 14 nt, Human
ugucaauuacagga

SEQ ID NO: 3010383 - RNA, 15 nt, Human
aguauuacuucugcu

SEQ ID NO: 3010384 - RNA, 17 nt, Human
aguaugguggcuggguu

SEQ ID NO: 3010385 - RNA, 18 nt, Human
aguauuacuucugcuaca

SEQ ID NO: 3010386 - RNA, 15 nt, Human
aguaugguggcuggg

SEQ ID NO: 3010387 - RNA, 16 nt, Human
aguaugguggcugggu

SEQ ID NO: 3010388 - RNA, 14 nt, Human
aguaugguggcugg

SEQ ID NO: 3010389 - RNA, 23 nt, Human
agucacacaguauuacuucugcu

SEQ ID NO: 3010390 - RNA, 19 nt, Human
agucaccccggccaccugc

SEQ ID NO: 3010391 - RNA, 15 nt, Human
agucacacagugagu

SEQ ID NO: 3010392 - RNA, 23 nt, Human
agucacacagugagucgaggaca

SEQ ID NO: 3010393 - RNA, 16 nt, Human
aguaaaauguggcagg

SEQ ID NO: 3010394 - RNA, 14 nt, Human
aguaauaugcacac

SEQ ID NO: 3010395 - RNA, 15 nt, Human
aguaauaugcacaca

SEQ ID NO: 3010396 - RNA, 16 nt, Human
uguagagccagggucu

SEQ ID NO: 3010397 - RNA, 18 nt, Human
uguagagccagggucuca

SEQ ID NO: 3010398 - RNA, 17 nt, Human
aguagaagucuuagaug

SEQ ID NO: 3010399 - RNA, 21 nt, Human
aguagaagucuuagauguaua

SEQ ID NO: 3010400 - RNA, 19 nt, Human
aguagaagucuuagaugua

SEQ ID NO: 3010401 - RNA, 20 nt, Human
aguagaagucuuagauguau

SEQ ID NO: 3010402 - RNA, 11 nt, Human
aguagagacag

SEQ ID NO: 3010403 - RNA, 20 nt, Human
uguaggcauaaagucagggg

SEQ ID NO: 3010404 - RNA, 17 nt, Human
uguaggcauaaagucag

SEQ ID NO: 3010405 - RNA, 21 nt, Human
ugguuaguagagguacacuug

SEQ ID NO: 3010406 - RNA, 14 nt, Human
ugguuauggagagg

SEQ ID NO: 3010407 - RNA, 15 nt, Human
ugguuuguaaauuaa

SEQ ID NO: 3010408 - RNA, 14 nt, Human
ugguuuucaaaaua

SEQ ID NO: 3010409 - RNA, 15 nt, Human
ugguuuucaaaauaa

SEQ ID NO: 3010410 - RNA, 17 nt, Human
ugguuuucaaaauaaaa

SEQ ID NO: 3010411 - RNA, 15 nt, Human
uguaaauagcucagg

SEQ ID NO: 3010412 - RNA, 16 nt, Human
uguaaauagcucaggu

SEQ ID NO: 3010413 - RNA, 12 nt, Human
aggugugcucug

SEQ ID NO: 3010414 - RNA, 14 nt, Human
agguuuaagcuguu

SEQ ID NO: 3010415 - RNA, 20 nt, Human
aggugucccugcacuugcag

SEQ ID NO: 3010416 - RNA, 19 nt, Human
agguggggucacucuggca

SEQ ID NO: 3010417 - RNA, 17 nt, Human
aggugugaaccaccaca

SEQ ID NO: 3010418 - RNA, 15 nt, Human
aggugugcucugauc

SEQ ID NO: 3010419 - RNA, 20 nt, Human
aggugugcucugaucaucca

SEQ ID NO: 3010420 - RNA, 14 nt, Human
aggugauccaccca

SEQ ID NO: 3010421 - RNA, 20 nt, Human
aggugauccacccaccucag

SEQ ID NO: 3010422 - RNA, 15 nt, Human
aggugggauccucca

SEQ ID NO: 3010423 - RNA, 18 nt, Human
aggugccucaagagaagg

SEQ ID NO: 3010424 - RNA, 16 nt, Human
agguggggcagcuuga

SEQ ID NO: 3010425 - RNA, 23 nt, Human
agguggggcagcuugaggguugg

SEQ ID NO: 3010426 - RNA, 17 nt, Human
aggugggauccuccagg

SEQ ID NO: 3010427 - RNA, 16 nt, Human
aggugggauccuccag

SEQ ID NO: 3010428 - RNA, 16 nt, Human
aggucuugaacuccug

SEQ ID NO: 3010429 - RNA, 13 nt, Human
aggucagagccug

SEQ ID NO: 3010430 - RNA, 16 nt, Human
uggucagauuugaacu

SEQ ID NO: 3010431 - RNA, 15 nt, Human
uggucagauuugaac

SEQ ID NO: 3010432 - RNA, 14 nt, Human
aggucagagccugc

SEQ ID NO: 3010433 - RNA, 15 nt, Human
aggucagagccugca

SEQ ID NO: 3010434 - RNA, 17 nt, Human
aggucagagccugcagu

SEQ ID NO: 3010435 - RNA, 18 nt, Human
aggucagagccugcaguu

SEQ ID NO: 3010436 - RNA, 22 nt, Human
aggugacagagugagacucugu

SEQ ID NO: 3010437 - RNA, 13 nt, Human
aggugaccccagg

SEQ ID NO: 3010438 - RNA, 17 nt, Human
aggucuugaacuccugg

SEQ ID NO: 3010439 - RNA, 13 nt, Human
aggugacagagug

SEQ ID NO: 3010440 - RNA, 15 nt, Human
aggugacagagugag

SEQ ID NO: 3010441 - RNA, 23 nt, Human
aggugagaagcagaggaaggaga

SEQ ID NO: 3010442 - RNA, 21 nt, Human
aggugagaagcagaggaagga

SEQ ID NO: 3010443 - RNA, 16 nt, Human
aggugagaagcagagg

SEQ ID NO: 3010444 - RNA, 20 nt, Human
ugguuaggcauugugggaag

SEQ ID NO: 3010445 - RNA, 18 nt, Human
ugguuaggcauuguggga

SEQ ID NO: 3010446 - RNA, 14 nt, Human
ugguggcagcugcg

SEQ ID NO: 3010447 - RNA, 13 nt, Human
ugguggcagcugc

SEQ ID NO: 3010448 - RNA, 15 nt, Human
ugguggcagcugcgg

SEQ ID NO: 3010449 - RNA, 19 nt, Human
uggugucgggcaugacacg

SEQ ID NO: 3010450 - RNA, 16 nt, Human
uggugcgaucuggguu

SEQ ID NO: 3010451 - RNA, 17 nt, Human
uggugcgaucuggguuc

SEQ ID NO: 3010452 - RNA, 20 nt, Human
agcuuaagaaauuuguggaa

SEQ ID NO: 3010453 - RNA, 20 nt, Human
agcuuaaaggggcuagagug

SEQ ID NO: 3010454 - RNA, 11 nt, Human
ugcuacacacu

SEQ ID NO: 3010455 - RNA, 14 nt, Human
ugcgguccacccag

SEQ ID NO: 3010456 - RNA, 15 nt, Human
ugcgguccacccagg

SEQ ID NO: 3010457 - RNA, 22 nt, Human
agcuugaccgugaggccagaga

SEQ ID NO: 3010458 - RNA, 20 nt, Human
agcuugaccgugaggccaga

SEQ ID NO: 3010459 - RNA, 22 nt, Human
agcuugaggguugggcuggugu

SEQ ID NO: 3010460 - RNA, 23 nt, Human
agcuugaccgugaggccagagac

SEQ ID NO: 3010461 - RNA, 14 nt, Human
aggaaaagcugcug

SEQ ID NO: 3010462 - RNA, 16 nt, Human
aggaaaagcugcugac

SEQ ID NO: 3010463 - RNA, 13 nt, Human
ugcuaucuccccc

SEQ ID NO: 3010464 - RNA, 17 nt, Human
ugcuaucucccccagcc

SEQ ID NO: 3010465 - RNA, 14 nt, Human
ugcuaucuccccca

SEQ ID NO: 3010466 - RNA, 14 nt, Human
ugcucugcugacag

SEQ ID NO: 3010467 - RNA, 15 nt, Human
ugcucugcugacaga

SEQ ID NO: 3010468 - RNA, 20 nt, Human
ugcuccagcuguucagcugg

SEQ ID NO: 3010469 - RNA, 21 nt, Human
ugcuccagcuguucagcuggu

SEQ ID NO: 3010470 - RNA, 15 nt, Human
aggaagcucagggcc

SEQ ID NO: 3010471 - RNA, 14 nt, Human
aggaagcucagggc

SEQ ID NO: 3010472 - RNA, 13 nt, Human
aggaagcucaggg

SEQ ID NO: 3010473 - RNA, 23 nt, Human
aggaaaggcuccaggagcagcca

SEQ ID NO: 3010474 - RNA, 16 nt, Human
agcugcuugggcuuca

SEQ ID NO: 3010475 - RNA, 18 nt, Human
agcugccuguucagcucc

SEQ ID NO: 3010476 - RNA, 14 nt, Human
agcugccuguucag

SEQ ID NO: 3010477 - RNA, 16 nt, Human
agcugccuguucagcu

SEQ ID NO: 3010478 - RNA, 21 nt, Human
ugccuggauggggcugcaccg

SEQ ID NO: 3010479 - RNA, 20 nt, Human
ugccuggauggggcugcacc

SEQ ID NO: 3010480 - RNA, 17 nt, Human
ugccuggauggggcugc

SEQ ID NO: 3010481 - RNA, 16 nt, Human
ugccuggauggggcug

SEQ ID NO: 3010482 - RNA, 20 nt, Human
ugccugcccaggccccugcc

SEQ ID NO: 3010483 - RNA, 22 nt, Human
ugccugcccaggccccugccac

SEQ ID NO: 3010484 - RNA, 23 nt, Human
ugccugcccaggccccugccacc

SEQ ID NO: 3010485 - RNA, 14 nt, Human
ugccucagccuccc

SEQ ID NO: 3010486 - RNA, 18 nt, Human
ugccucugccucugacac

SEQ ID NO: 3010487 - RNA, 20 nt, Human
ugccucugccucugacacac

SEQ ID NO: 3010488 - RNA, 17 nt, Human
ugccucugccucugaca

SEQ ID NO: 3010489 - RNA, 20 nt, Human
agcugggacuacaggcaccc

SEQ ID NO: 3010490 - RNA, 23 nt, Human
agcugggacuacaggcacccacc

SEQ ID NO: 3010491 - RNA, 16 nt, Human
agcugggacuacaggu

SEQ ID NO: 3010492 - RNA, 20 nt, Human
agcugggguggggaccucag

SEQ ID NO: 3010493 - RNA, 23 nt, Human
agcugggguggggaccucaggcc

SEQ ID NO: 3010494 - RNA, 22 nt, Human
agcugggguggggaccucaggc

SEQ ID NO: 3010495 - RNA, 17 nt, Human
agcugugcucuggacag

SEQ ID NO: 3010496 - RNA, 18 nt, Human
agcugugcucuggacagg

SEQ ID NO: 3010497 - RNA, 23 nt, Human
agcugugcucuggacaggcaugu

SEQ ID NO: 3010498 - RNA, 14 nt, Human
agcuguuacugucu

SEQ ID NO: 3010499 - RNA, 18 nt, Human
agcuguuacugucuucag

SEQ ID NO: 3010500 - RNA, 21 nt, Human
ugccuuacccucauguucuua

SEQ ID NO: 3010501 - RNA, 16 nt, Human
ugccuuggggacaaga

SEQ ID NO: 3010502 - RNA, 20 nt, Human
ugccuuacccucauguucuu

SEQ ID NO: 3010503 - RNA, 17 nt, Human
ugccuguugggccagga

SEQ ID NO: 3010504 - RNA, 16 nt, Human
ugccuguugggccagg

SEQ ID NO: 3010505 - RNA, 19 nt, Human
agcuguuacugucuucagu

SEQ ID NO: 3010506 - RNA, 16 nt, Human
agcuccuucuguccua

SEQ ID NO: 3010507 - RNA, 21 nt, Human
agcuccuucuguccuacucug

SEQ ID NO: 3010508 - RNA, 16 nt, Human
agcucucuccucccuu

SEQ ID NO: 3010509 - RNA, 14 nt, Human
agcucuguccuggg

SEQ ID NO: 3010510 - RNA, 17 nt, Human
agcucugguccauagag

SEQ ID NO: 3010511 - RNA, 12 nt, Human
agcucuggucca

SEQ ID NO: 3010512 - RNA, 13 nt, Human
agcucccaggcau

SEQ ID NO: 3010513 - RNA, 15 nt, Human
agcuccuucuguccu

SEQ ID NO: 3010514 - RNA, 23 nt, Human
agcucccaggcauuccccaggag

SEQ ID NO: 3010515 - RNA, 14 nt, Human
agcugccagccgag

SEQ ID NO: 3010516 - RNA, 20 nt, Human
agcugccagccgagauagcc

SEQ ID NO: 3010517 - RNA, 16 nt, Human
agcucuguccugggag

SEQ ID NO: 3010518 - RNA, 21 nt, Human
agcucuguccugggagugagc

SEQ ID NO: 3010519 - RNA, 12 nt, Human
ugccucagccuc

SEQ ID NO: 3010520 - RNA, 13 nt, Human
ugccucagccucc

SEQ ID NO: 3010521 - RNA, 12 nt, Human
ugccgcagcccu

SEQ ID NO: 3010522 - RNA, 18 nt, Human
ugcccuuaccugccagga

SEQ ID NO: 3010523 - RNA, 16 nt, Human
aggcaggggaauguau

SEQ ID NO: 3010524 - RNA, 19 nt, Human
aggcaggggaauguaugug

SEQ ID NO: 3010525 - RNA, 14 nt, Human
aggcaggggaaugu

SEQ ID NO: 3010526 - RNA, 22 nt, Human
aggcaggucuugaacuccuggc

SEQ ID NO: 3010527 - RNA, 12 nt, Human
aggcagggucuc

SEQ ID NO: 3010528 - RNA, 15 nt, Human
aggcauaaagucagg

SEQ ID NO: 3010529 - RNA, 17 nt, Human
aggcaggugggauggau

SEQ ID NO: 3010530 - RNA, 18 nt, Human
aggcauugugggaagggg

SEQ ID NO: 3010531 - RNA, 22 nt, Human
aggcauaaagucagggguuccc

SEQ ID NO: 3010532 - RNA, 18 nt, Human
aggauugcuacuguccua

SEQ ID NO: 3010533 - RNA, 15 nt, Human
aggauugcuacuguc

SEQ ID NO: 3010534 - RNA, 17 nt, Human
aggauugcuacuguccu

SEQ ID NO: 3010535 - RNA, 14 nt, Human
uggagaaaauggac

SEQ ID NO: 3010536 - RNA, 16 nt, Human
aggcaaggcugucaau

SEQ ID NO: 3010537 - RNA, 17 nt, Human
aggcaaggcugucaauu

SEQ ID NO: 3010538 - RNA, 18 nt, Human
aggcaagcaccuccugcc

SEQ ID NO: 3010539 - RNA, 19 nt, Human
aggcaagcaccuccugccu

SEQ ID NO: 3010540 - RNA, 20 nt, Human
aggcaagcaccuccugccuc

SEQ ID NO: 3010541 - RNA, 17 nt, Human
aggcaagcaccuccugc

SEQ ID NO: 3010542 - RNA, 20 nt, Human
uggagguacgaaaagagggg

SEQ ID NO: 3010543 - RNA, 20 nt, Human
aggcauuugcugaauacaga

SEQ ID NO: 3010544 - RNA, 16 nt, Human
aggcauuugcugaaua

SEQ ID NO: 3010545 - RNA, 14 nt, Human
uggagugcagugag

SEQ ID NO: 3010546 - RNA, 14 nt, Human
uggauucauauuua

SEQ ID NO: 3010547 - RNA, 17 nt, Human
uggauucauauuuaauu

SEQ ID NO: 3010548 - RNA, 20 nt, Human
uggaugccugguggcagcug

SEQ ID NO: 3010549 - RNA, 21 nt, Human
uggaugccugguggcagcugc

SEQ ID NO: 3010550 - RNA, 23 nt, Human
uggaugccugguggcagcugcgg

SEQ ID NO: 3010551 - RNA, 23 nt, Human
uggcacaucagcacgauuucugu

SEQ ID NO: 3010552 - RNA, 21 nt, Human
uggcacaucagcacgauuucu

SEQ ID NO: 3010553 - RNA, 16 nt, Human
uggcacccggccccug

SEQ ID NO: 3010554 - RNA, 18 nt, Human
uggcacccggccccugcu

SEQ ID NO: 3010555 - RNA, 19 nt, Human
uggcacccggccccugcug

SEQ ID NO: 3010556 - RNA, 20 nt, Human
uggcacccggccccugcugg

SEQ ID NO: 3010557 - RNA, 22 nt, Human
uggcagcucaccucucccuugg

SEQ ID NO: 3010558 - RNA, 21 nt, Human
uggcagcucaccucucccuug

SEQ ID NO: 3010559 - RNA, 23 nt, Human
uggcagcucaccucucccuugga

SEQ ID NO: 3010560 - RNA, 15 nt, Human
aggccagccuugacc

SEQ ID NO: 3010561 - RNA, 13 nt, Human
aggccagccuuga

SEQ ID NO: 3010562 - RNA, 13 nt, Human
aggcccagagggc

SEQ ID NO: 3010563 - RNA, 13 nt, Human
aggcccggcucca

SEQ ID NO: 3010564 - RNA, 17 nt, Human
aggcccggcuccaggcu

SEQ ID NO: 3010565 - RNA, 14 nt, Human
aggccccgcccagg

SEQ ID NO: 3010566 - RNA, 17 nt, Human
aggacuuuucuuugugg

SEQ ID NO: 3010567 - RNA, 19 nt, Human
aggacuuuucuuuguggcu

SEQ ID NO: 3010568 - RNA, 22 nt, Human
aggacuuuucuuuguggcuucc

SEQ ID NO: 3010569 - RNA, 13 nt, Human
aggagcagccaca

SEQ ID NO: 3010570 - RNA, 12 nt, Human
aggagcagccac

SEQ ID NO: 3010571 - RNA, 17 nt, Human
aggagccccgaggccuu

SEQ ID NO: 3010572 - RNA, 16 nt, Human
aggagccuccugcccu

SEQ ID NO: 3010573 - RNA, 15 nt, Human
uggaagacagcucuu

SEQ ID NO: 3010574 - RNA, 16 nt, Human
uggaagacagcucuua

SEQ ID NO: 3010575 - RNA, 21 nt, Human
uggaaauuuguuauaaugaau

SEQ ID NO: 3010576 - RNA, 23 nt, Human
uggaaauuuguuauaaugaauga

SEQ ID NO: 3010577 - RNA, 15 nt, Human
ugcuugagcucagga

SEQ ID NO: 3010578 - RNA, 17 nt, Human
aggagccuccugcccuu

SEQ ID NO: 3010579 - RNA, 17 nt, Human
ugcuuugugauuuuugu

SEQ ID NO: 3010580 - RNA, 22 nt, Human
ugcuuugugauuuuuguaauuu

SEQ ID NO: 3010581 - RNA, 20 nt, Human
ugcuuuugucuaugggacuc

SEQ ID NO: 3010582 - RNA, 23 nt, Human
ugcuuuuuaauauugauaugcuu

SEQ ID NO: 3010583 - RNA, 18 nt, Human
ugcuuuuggucuguguga

SEQ ID NO: 3010584 - RNA, 16 nt, Human
aggauucuuccucccu

SEQ ID NO: 3010585 - RNA, 22 nt, Human
aggaugcacagaguuguuacau

SEQ ID NO: 3010586 - RNA, 23 nt, Human
aggaugaucuaggaagacuuugg

SEQ ID NO: 3010587 - RNA, 22 nt, Human
aggaugaucuaggaagacuuug

SEQ ID NO: 3010588 - RNA, 17 nt, Human
aggauucuuccucccuc

SEQ ID NO: 3010589 - RNA, 19 nt, Human
aggauucuuccucccuccc

SEQ ID NO: 3010590 - RNA, 13 nt, Human
aggaucagucuga

SEQ ID NO: 3010591 - RNA, 13 nt, Human
ugcacauuaaaug

SEQ ID NO: 3010592 - RNA, 18 nt, Human
ugcacauuaaaugacucu

SEQ ID NO: 3010593 - RNA, 15 nt, Human
ugcacauuaaaugac

SEQ ID NO: 3010594 - RNA, 15 nt, Human
ugcaccacugcacuc

SEQ ID NO: 3010595 - RNA, 13 nt, Human
ugcaccagcccuu

SEQ ID NO: 3010596 - RNA, 21 nt, Human
ugcaccacugcacuccagccu

SEQ ID NO: 3010597 - RNA, 15 nt, Human
ugcaccggcuggccu

SEQ ID NO: 3010598 - RNA, 14 nt, Human
ugcaccggcuggcc

SEQ ID NO: 3010599 - RNA, 16 nt, Human
ugcaccggcuggccug

SEQ ID NO: 3010600 - RNA, 14 nt, Human
ugcacuccagccug

SEQ ID NO: 3010601 - RNA, 16 nt, Human
ugcacuccagccuggg

SEQ ID NO: 3010602 - RNA, 15 nt, Human
ugcacuccagccugg

SEQ ID NO: 3010603 - RNA, 22 nt, Human
agccccuggaugcagccucaca

SEQ ID NO: 3010604 - RNA, 14 nt, Human
agccccgaggccuu

SEQ ID NO: 3010605 - RNA, 19 nt, Human
agcccaggccuccuacagc

SEQ ID NO: 3010606 - RNA, 14 nt, Human
agcccaggccuccu

SEQ ID NO: 3010607 - RNA, 16 nt, Human
agcccgggcucugccu

SEQ ID NO: 3010608 - RNA, 19 nt, Human
agcccugcagagggcacag

SEQ ID NO: 3010609 - RNA, 16 nt, Human
agcccugcagagggca

SEQ ID NO: 3010610 - RNA, 15 nt, Human
agcccugcagagggc

SEQ ID NO: 3010611 - RNA, 14 nt, Human
agcccugcagaggg

SEQ ID NO: 3010612 - RNA, 14 nt, Human
agccccuucugacc

SEQ ID NO: 3010613 - RNA, 16 nt, Human
agccccuucugaccca

SEQ ID NO: 3010614 - RNA, 15 nt, Human
agccccuucugaccc

SEQ ID NO: 3010615 - RNA, 15 nt, Human
agcccgggcucugcc

SEQ ID NO: 3010616 - RNA, 14 nt, Human
agcccgggcucugc

SEQ ID NO: 3010617 - RNA, 13 nt, Human
agcccgggcucug

SEQ ID NO: 3010618 - RNA, 19 nt, Human
agccccuucugacccaugc

SEQ ID NO: 3010619 - RNA, 12 nt, Human
ugcaaagaugaa

SEQ ID NO: 3010620 - RNA, 23 nt, Human
ugcaaagaugaaggucuguuuug

SEQ ID NO: 3010621 - RNA, 16 nt, Human
ugcaaacuucagaguu

SEQ ID NO: 3010622 - RNA, 20 nt, Human
ugcaaaccaucauugaaauc

SEQ ID NO: 3010623 - RNA, 18 nt, Human
ugcaaaccaucauugaaa

SEQ ID NO: 3010624 - RNA, 21 nt, Human
ugcaaaggguaucaggugcug

SEQ ID NO: 3010625 - RNA, 20 nt, Human
ugcaaaguaucccuacugua

SEQ ID NO: 3010626 - RNA, 14 nt, Human
ugauuucacagugu

SEQ ID NO: 3010627 - RNA, 16 nt, Human
ugauuucacagugugu

SEQ ID NO: 3010628 - RNA, 17 nt, Human
agccacggccaggccag

SEQ ID NO: 3010629 - RNA, 18 nt, Human
agccacggccaggccaga

SEQ ID NO: 3010630 - RNA, 13 nt, Human
ugcaaaccaucau

SEQ ID NO: 3010631 - RNA, 12 nt, Human
ugcaaaccauca

SEQ ID NO: 3010632 - RNA, 12 nt, Human
agcccaggccuc

SEQ ID NO: 3010633 - RNA, 15 nt, Human
ugcaaggucauuuuu

SEQ ID NO: 3010634 - RNA, 13 nt, Human
ugcaacaggcugg

SEQ ID NO: 3010635 - RNA, 18 nt, Human
ugcaucuagccucaagcu

SEQ ID NO: 3010636 - RNA, 17 nt, Human
ugcaucguuucaucuuc

SEQ ID NO: 3010637 - RNA, 18 nt, Human
ugcaugcugucccuuacg

SEQ ID NO: 3010638 - RNA, 21 nt, Human
ugcaugcugucccuuacguga

SEQ ID NO: 3010639 - RNA, 19 nt, Human
ugcaugcugucccuuacgu

SEQ ID NO: 3010640 - RNA, 16 nt, Human
ugcauaccacuuuugu

SEQ ID NO: 3010641 - RNA, 18 nt, Human
ugcauaccacuuuuguuc

SEQ ID NO: 3010642 - RNA, 20 nt, Human
ugcauaccacuuuuguucuu

SEQ ID NO: 3010643 - RNA, 14 nt, Human
ugcauaccacuuuu

SEQ ID NO: 3010644 - RNA, 13 nt, Human
agccuccugcccu

SEQ ID NO: 3010645 - RNA, 18 nt, Human
agccuccugcccuuaccu

SEQ ID NO: 3010646 - RNA, 14 nt, Human
agccuccugcccuu

SEQ ID NO: 3010647 - RNA, 12 nt, Human
ugcagacaggca

SEQ ID NO: 3010648 - RNA, 13 nt, Human
ugcagacaggcaa

SEQ ID NO: 3010649 - RNA, 21 nt, Human
ugcagacaggcaagcaccucc

SEQ ID NO: 3010650 - RNA, 18 nt, Human
ugcagccucacaguccuu

SEQ ID NO: 3010651 - RNA, 21 nt, Human
ugcagccucacaguccuuacc

SEQ ID NO: 3010652 - RNA, 17 nt, Human
ugcagccucacaguccu

SEQ ID NO: 3010653 - RNA, 19 nt, Human
agccuugaccauucuccac

SEQ ID NO: 3010654 - RNA, 18 nt, Human
agccuugaccauucucca

SEQ ID NO: 3010655 - RNA, 21 nt, Human
agccuugaccauucuccaccu

SEQ ID NO: 3010656 - RNA, 19 nt, Human
agccuugcggaagguucua

SEQ ID NO: 3010657 - RNA, 20 nt, Human
agccuuagaagucacacagu

SEQ ID NO: 3010658 - RNA, 23 nt, Human
agccuugaacuuugaccucugca

SEQ ID NO: 3010659 - RNA, 17 nt, Human
agccugugccucuggga

SEQ ID NO: 3010660 - RNA, 18 nt, Human
agccugugccucugggac

SEQ ID NO: 3010661 - RNA, 14 nt, Human
ugccaaugggagcu

SEQ ID NO: 3010662 - RNA, 13 nt, Human
ugccaauggacua

SEQ ID NO: 3010663 - RNA, 16 nt, Human
ugcauuuaaaagauac

SEQ ID NO: 3010664 - RNA, 22 nt, Human
ugccagccgagauagccaaggc

SEQ ID NO: 3010665 - RNA, 17 nt, Human
ugccagccgagauagcc

SEQ ID NO: 3010666 - RNA, 22 nt, Human
ugagugcaaacuucagaguucu

SEQ ID NO: 3010667 - RNA, 20 nt, Human
ugagugcaaacuucagaguu

SEQ ID NO: 3010668 - RNA, 18 nt, Human
ugagugcaaacuucagag

SEQ ID NO: 3010669 - RNA, 18 nt, Human
ugagucaccaagcccagu

SEQ ID NO: 3010670 - RNA, 20 nt, Human
ugaguacguugugcauuugg

SEQ ID NO: 3010671 - RNA, 14 nt, Human
ugaguggaguuacu

SEQ ID NO: 3010672 - RNA, 14 nt, Human
ugagugccuuacac

SEQ ID NO: 3010673 - RNA, 13 nt, Human
ugagugccuuaca

SEQ ID NO: 3010674 - RNA, 17 nt, Human
ugagugcagcucuggag

SEQ ID NO: 3010675 - RNA, 14 nt, Human
ugauacaaugcugu

SEQ ID NO: 3010676 - RNA, 15 nt, Human
ugauacaaugcugug

SEQ ID NO: 3010677 - RNA, 18 nt, Human
ugaguucauacccuguua

SEQ ID NO: 3010678 - RNA, 21 nt, Human
ugagugggggaucacagccuc

SEQ ID NO: 3010679 - RNA, 22 nt, Human
agcaguuugguuucuagcauga

SEQ ID NO: 3010680 - RNA, 23 nt, Human
agcaguuugguuucuagcaugaa

SEQ ID NO: 3010681 - RNA, 19 nt, Human
agcauaaaaauuagccaag

SEQ ID NO: 3010682 - RNA, 20 nt, Human
agcaguuugguuucuagcau

SEQ ID NO: 3010683 - RNA, 16 nt, Human
ugaguacguugugcau

SEQ ID NO: 3010684 - RNA, 17 nt, Human
ugaguacguugugcauu

SEQ ID NO: 3010685 - RNA, 18 nt, Human
ugaguacguugugcauuu

SEQ ID NO: 3010686 - RNA, 19 nt, Human
ugaguacguugugcauuug

SEQ ID NO: 3010687 - RNA, 23 nt, Human
agcauaaaaauuagccaagugug

SEQ ID NO: 3010688 - RNA, 20 nt, Human
agcaggaagcugugagagca

SEQ ID NO: 3010689 - RNA, 13 nt, Human
agcaggacaugga

SEQ ID NO: 3010690 - RNA, 11 nt, Human
agcagccacau

SEQ ID NO: 3010691 - RNA, 16 nt, Human
agcagcagggagggcu

SEQ ID NO: 3010692 - RNA, 17 nt, Human
ugacccaugcugcccug

SEQ ID NO: 3010693 - RNA, 19 nt, Human
ugacccaugcugcccugug

SEQ ID NO: 3010694 - RNA, 18 nt, Human
ugacccaugcugcccugu

SEQ ID NO: 3010695 - RNA, 20 nt, Human
ugacccaugcugcccuguga

SEQ ID NO: 3010696 - RNA, 13 nt, Human
agcagggaaacag

SEQ ID NO: 3010697 - RNA, 14 nt, Human
agcagggaaacagc

SEQ ID NO: 3010698 - RNA, 15 nt, Human
agcagggaaacagcu

SEQ ID NO: 3010699 - RNA, 23 nt, Human
agcaggcucucaggccagcugcu

SEQ ID NO: 3010700 - RNA, 22 nt, Human
agcaggcucucaggccagcugc

SEQ ID NO: 3010701 - RNA, 21 nt, Human
agcaggcucucaggccagcug

SEQ ID NO: 3010702 - RNA, 19 nt, Human
agcaggcucucaggccagc

SEQ ID NO: 3010703 - RNA, 18 nt, Human
agcaggcucucaggccag

SEQ ID NO: 3010704 - RNA, 17 nt, Human
agcaggcucucaggcca

SEQ ID NO: 3010705 - RNA, 16 nt, Human
agcaggcucucaggcc

SEQ ID NO: 3010706 - RNA, 15 nt, Human
agcaggcucucaggc

SEQ ID NO: 3010707 - RNA, 14 nt, Human
agcaggcucucagg

SEQ ID NO: 3010708 - RNA, 13 nt, Human
agcaggcucucag

SEQ ID NO: 3010709 - RNA, 17 nt, Human
agcaggcucgggcuccc

SEQ ID NO: 3010710 - RNA, 22 nt, Human
agcagggcucagcggggacagc

SEQ ID NO: 3010711 - RNA, 13 nt, Human
agcagggcucagc

SEQ ID NO: 3010712 - RNA, 14 nt, Human
agcagggcucagcg

SEQ ID NO: 3010713 - RNA, 15 nt, Human
agcagggcucagcgg

SEQ ID NO: 3010714 - RNA, 20 nt, Human
agcagggagggcuucugcca

SEQ ID NO: 3010715 - RNA, 19 nt, Human
agcauggcugccaauggga

SEQ ID NO: 3010716 - RNA, 22 nt, Human
agcauuuugcuaaaugugaaug

SEQ ID NO: 3010717 - RNA, 15 nt, Human
agcauuuugcuaaau

SEQ ID NO: 3010718 - RNA, 23 nt, Human
agcaucaggccaggcccucugcc

SEQ ID NO: 3010719 - RNA, 21 nt, Human
agcaucaggccaggcccucug

SEQ ID NO: 3010720 - RNA, 22 nt, Human
agcaucaggccaggcccucugc

SEQ ID NO: 3010721 - RNA, 16 nt, Human
agcauauucaggaagc

SEQ ID NO: 3010722 - RNA, 13 nt, Human
agcauggcugcca

SEQ ID NO: 3010723 - RNA, 15 nt, Human
ugaucacggcucacu

SEQ ID NO: 3010724 - RNA, 13 nt, Human
ugaucacggcuca

SEQ ID NO: 3010725 - RNA, 14 nt, Human
ugaucacggcucac

SEQ ID NO: 3010726 - RNA, 21 nt, Human
agcauauucaggaagcucagg

SEQ ID NO: 3010727 - RNA, 19 nt, Human
agcauauucaggaagcuca

SEQ ID NO: 3010728 - RNA, 17 nt, Human
agcauauucaggaagcu

SEQ ID NO: 3010729 - RNA, 16 nt, Human
ugauccucccaccuca

SEQ ID NO: 3010730 - RNA, 13 nt, Human
ugaucuaggaaga

SEQ ID NO: 3010731 - RNA, 19 nt, Human
ugauccucccaccucagcc

SEQ ID NO: 3010732 - RNA, 20 nt, Human
ugauccucccaccucagccu

SEQ ID NO: 3010733 - RNA, 18 nt, Human
ugauccucccaccucagc

SEQ ID NO: 3010734 - RNA, 21 nt, Human
ugaugggcaacccccagccug

SEQ ID NO: 3010735 - RNA, 22 nt, Human
ugaugggcaacccccagccugc

SEQ ID NO: 3010736 - RNA, 13 nt, Human
ugauggggcccug

SEQ ID NO: 3010737 - RNA, 21 nt, Human
ugaugaucuuugcagacaggc

SEQ ID NO: 3010738 - RNA, 22 nt, Human
ugaugaaaugaggucagagccu

SEQ ID NO: 3010739 - RNA, 15 nt, Human
ugaucuaggaagacu

SEQ ID NO: 3010740 - RNA, 14 nt, Human
ugaucuaggaagac

SEQ ID NO: 3010741 - RNA, 23 nt, Human
ugaugaaaugaggucagagccug

SEQ ID NO: 3010742 - RNA, 19 nt, Human
ugaugaucuuugcagacag

SEQ ID NO: 3010743 - RNA, 20 nt, Human
ugaugaucuuugcagacagg

SEQ ID NO: 3010744 - RNA, 22 nt, Human
ugauggggcccugccuccuuug

SEQ ID NO: 3010745 - RNA, 19 nt, Human
ugauguuuuccaugagucc

SEQ ID NO: 3010746 - RNA, 17 nt, Human
ugauguuuuccaugagu

SEQ ID NO: 3010747 - RNA, 21 nt, Human
ugauguuuuaaggaugcuugu

SEQ ID NO: 3010748 - RNA, 20 nt, Human
ugauuaaccacuucagcuga

SEQ ID NO: 3010749 - RNA, 17 nt, Human
ugauuaaauucuugcaa

SEQ ID NO: 3010750 - RNA, 13 nt, Human
ugauuaaauucuu

SEQ ID NO: 3010751 - RNA, 16 nt, Human
ugauuaaauucuugca

SEQ ID NO: 3010752 - RNA, 16 nt, Human
agccacggccaggcca

SEQ ID NO: 3010753 - RNA, 18 nt, Human
ugaaauaaggaaugauau

SEQ ID NO: 3010754 - RNA, 14 nt, Human
ugaaauaaggaaug

SEQ ID NO: 3010755 - RNA, 18 nt, Human
agagcugccaccugccug

SEQ ID NO: 3010756 - RNA, 11 nt, Human
agagccuugcg

SEQ ID NO: 3010757 - RNA, 21 nt, Human
agagccuugcggaagguucua

SEQ ID NO: 3010758 - RNA, 20 nt, Human
agagcagagaccaucccuga

SEQ ID NO: 3010759 - RNA, 18 nt, Human
agagcagagaccaucccu

SEQ ID NO: 3010760 - RNA, 17 nt, Human
agagcagagaccauccc

SEQ ID NO: 3010761 - RNA, 12 nt, Human
agagcagagacc

SEQ ID NO: 3010762 - RNA, 16 nt, Human
agagauugugguuuca

SEQ ID NO: 3010763 - RNA, 21 nt, Human
ucuuuggacccugaggcccag

SEQ ID NO: 3010764 - RNA, 17 nt, Human
ucuuuggacccugaggc

SEQ ID NO: 3010765 - RNA, 18 nt, Human
agagguacacuugugaau

SEQ ID NO: 3010766 - RNA, 24 nt, Human
agaggcagccccauucugccugcc

SEQ ID NO: 3010767 - RNA, 13 nt, Human
agaggcagcccca

SEQ ID NO: 3010768 - RNA, 19 nt, Human
agaggcagccccauucugc

SEQ ID NO: 3010769 - RNA, 19 nt, Human
agaggccaugggccuccug

SEQ ID NO: 3010770 - RNA, 17 nt, Human
agaggcuaugugagcac

SEQ ID NO: 3010771 - RNA, 10 nt, Human
agaggcaggg

SEQ ID NO: 3010772 - RNA, 13 nt, Human
agaggcagggucu

SEQ ID NO: 3010773 - RNA, 22 nt, Human
ugaaccgaugagaaauaaaguu

SEQ ID NO: 3010774 - RNA, 15 nt, Human
ugaaauuuuuauuaa

SEQ ID NO: 3010775 - RNA, 14 nt, Human
ugaacuccuggccu

SEQ ID NO: 3010776 - RNA, 15 nt, Human
ugaacuccuggccuc

SEQ ID NO: 3010777 - RNA, 11 nt, Human
ugaacuccugg

SEQ ID NO: 3010778 - RNA, 12 nt, Human
ugaacuccuggc

SEQ ID NO: 3010779 - RNA, 19 nt, Human
ugaacuuugaccucugcag

SEQ ID NO: 3010780 - RNA, 20 nt, Human
ugaacuuugaccucugcagc

SEQ ID NO: 3010781 - RNA, 17 nt, Human
ugaacuuugaccucugc

SEQ ID NO: 3010782 - RNA, 22 nt, Human
ugaacuuugaccucugcagcaa

SEQ ID NO: 3010783 - RNA, 15 nt, Human
ugaaugucaguuguu

SEQ ID NO: 3010784 - RNA, 19 nt, Human
ugaaugucagugugacuga

SEQ ID NO: 3010785 - RNA, 16 nt, Human
ugaagcagaguggcag

SEQ ID NO: 3010786 - RNA, 13 nt, Human
ugaagcagagugg

SEQ ID NO: 3010787 - RNA, 12 nt, Human
ugaagcagagug

SEQ ID NO: 3010788 - RNA, 20 nt, Human
ugaaugguuuucaaaauaaa

SEQ ID NO: 3010789 - RNA, 22 nt, Human
agagucagaaguuucugccgca

SEQ ID NO: 3010790 - RNA, 17 nt, Human
agaguugauacuacagu

SEQ ID NO: 3010791 - RNA, 20 nt, Human
agaguugauacuacaguuug

SEQ ID NO: 3010792 - RNA, 22 nt, Human
agaguugauacuacaguuuguu

SEQ ID NO: 3010793 - RNA, 12 nt, Human
agaguuguuaca

SEQ ID NO: 3010794 - RNA, 21 nt, Human
agaguuguuacauuuuuaagu

SEQ ID NO: 3010795 - RNA, 20 nt, Human
ugacacacagcucuguccug

SEQ ID NO: 3010796 - RNA, 15 nt, Human
ugaauuucuuuugcc

SEQ ID NO: 3010797 - RNA, 17 nt, Human
agaucacgccacugcac

SEQ ID NO: 3010798 - RNA, 18 nt, Human
agaucacgccacugcacu

SEQ ID NO: 3010799 - RNA, 12 nt, Human
agauaaaugugc

SEQ ID NO: 3010800 - RNA, 14 nt, Human
agaucacgccacug

SEQ ID NO: 3010801 - RNA, 15 nt, Human
agaucacgccacugc

SEQ ID NO: 3010802 - RNA, 16 nt, Human
agaucacgccacugca

SEQ ID NO: 3010803 - RNA, 11 nt, Human
ugacagggcac

SEQ ID NO: 3010804 - RNA, 16 nt, Human
ugacagggcacaccgg

SEQ ID NO: 3010805 - RNA, 20 nt, Human
ugacagggcacaccgggcac

SEQ ID NO: 3010806 - RNA, 20 nt, Human
ugacaggcaaugcuggcugu

SEQ ID NO: 3010807 - RNA, 21 nt, Human
ugacacacagcucuguccugg

SEQ ID NO: 3010808 - RNA, 15 nt, Human
agaucagccugggca

SEQ ID NO: 3010809 - RNA, 13 nt, Human
agaucagccuggg

SEQ ID NO: 3010810 - RNA, 20 nt, Human
ugacauuguuggccaaagcc

SEQ ID NO: 3010811 - RNA, 21 nt, Human
ugacauuguuggccaaagcca

SEQ ID NO: 3010812 - RNA, 18 nt, Human
ugaccaaugauggucacc

SEQ ID NO: 3010813 - RNA, 15 nt, Human
agaugcuucucacug

SEQ ID NO: 3010814 - RNA, 12 nt, Human
ugacccacugcu

SEQ ID NO: 3010815 - RNA, 13 nt, Human
ugacccacugcuu

SEQ ID NO: 3010816 - RNA, 23 nt, Human
ugaccauucuccaccugccaggg

SEQ ID NO: 3010817 - RNA, 14 nt, Human
agaugcaccagccc

SEQ ID NO: 3010818 - RNA, 15 nt, Human
agaugcaccagcccu

SEQ ID NO: 3010819 - RNA, 19 nt, Human
agaauuaguggcacuugcu

SEQ ID NO: 3010820 - RNA, 21 nt, Human
agaauguguuuaaacuugguu

SEQ ID NO: 3010821 - RNA, 23 nt, Human
agaaccccaggguccuguagccc

SEQ ID NO: 3010822 - RNA, 20 nt, Human
agaauucucagaaucucaaa

SEQ ID NO: 3010823 - RNA, 20 nt, Human
agaauuauaauuaguuccuc

SEQ ID NO: 3010824 - RNA, 14 nt, Human
agaauucucuaguu

SEQ ID NO: 3010825 - RNA, 15 nt, Human
ucuguauguguucua

SEQ ID NO: 3010826 - RNA, 12 nt, Human
ucuguauguguu

SEQ ID NO: 3010827 - RNA, 18 nt, Human
ucuguacgucugacaggc

SEQ ID NO: 3010828 - RNA, 17 nt, Human
ucugugaugacauuccc

SEQ ID NO: 3010829 - RNA, 20 nt, Human
ucugugaugacauucccugc

SEQ ID NO: 3010830 - RNA, 13 nt, Human
ucuguuuagauaa

SEQ ID NO: 3010831 - RNA, 23 nt, Human
ucuguuuagauaauacaccacua

SEQ ID NO: 3010832 - RNA, 16 nt, Human
ucuguuuagauaauac

SEQ ID NO: 3010833 - RNA, 19 nt, Human
ucuguuuagauaauacacc

SEQ ID NO: 3010834 - RNA, 14 nt, Human
agacaguuggguuu

SEQ ID NO: 3010835 - RNA, 19 nt, Human
agacagucccugccaaugg

SEQ ID NO: 3010836 - RNA, 13 nt, Human
agacagucccugc

SEQ ID NO: 3010837 - RNA, 16 nt, Human
agacagcugccuggga

SEQ ID NO: 3010838 - RNA, 15 nt, Human
agacagcugccuggg

SEQ ID NO: 3010839 - RNA, 12 nt, Human
agacagucccug

SEQ ID NO: 3010840 - RNA, 15 nt, Human
ucuuacaucugaaau

SEQ ID NO: 3010841 - RNA, 18 nt, Human
ucuuaugggcuggguucu

SEQ ID NO: 3010842 - RNA, 12 nt, Human
ucuuagauguau

SEQ ID NO: 3010843 - RNA, 22 nt, Human
agacaccuugacagggcacacc

SEQ ID NO: 3010844 - RNA, 19 nt, Human
agacaccuugacagggcac

SEQ ID NO: 3010845 - RNA, 24 nt, Human
agacacauguccaagaagcccagg

SEQ ID NO: 3010846 - RNA, 23 nt, Human
agacacaggcccggcuccaggcu

SEQ ID NO: 3010847 - RNA, 16 nt, Human
agacacaggcccggcu

SEQ ID NO: 3010848 - RNA, 22 nt, Human
agacacauguccaagaagccca

SEQ ID NO: 3010849 - RNA, 21 nt, Human
agacacauguccaagaagccc

SEQ ID NO: 3010850 - RNA, 14 nt, Human
agacagcugccugg

SEQ ID NO: 3010851 - RNA, 13 nt, Human
agacagcugccug

SEQ ID NO: 3010852 - RNA, 17 nt, Human
agaauucucuuauccaa

SEQ ID NO: 3010853 - RNA, 18 nt, Human
agaauucucuaguuugau

SEQ ID NO: 3010854 - RNA, 19 nt, Human
agaauucucuaguuugauu

SEQ ID NO: 3010855 - RNA, 13 nt, Human
agacacaagccuu

SEQ ID NO: 3010856 - RNA, 14 nt, Human
agacacaagccuuc

SEQ ID NO: 3010857 - RNA, 19 nt, Human
agacacaggcccggcucca

SEQ ID NO: 3010858 - RNA, 20 nt, Human
agacacaggcccggcuccag

SEQ ID NO: 3010859 - RNA, 21 nt, Human
agacacaggcccggcuccagg

SEQ ID NO: 3010860 - RNA, 22 nt, Human
agacacaggcccggcuccaggc

SEQ ID NO: 3010861 - RNA, 17 nt, Human
agacacaggcccggcuc

SEQ ID NO: 3010862 - RNA, 14 nt, Human
ucuugguuuguaaa

SEQ ID NO: 3010863 - RNA, 22 nt, Human
ucuuuaaugucacaggcagguc

SEQ ID NO: 3010864 - RNA, 19 nt, Human
ucuuuaaugucacaggcag

SEQ ID NO: 3010865 - RNA, 16 nt, Human
ucuugguuuguaaauu

SEQ ID NO: 3010866 - RNA, 20 nt, Human
ucuuuaaugucacaggcagg

SEQ ID NO: 3010867 - RNA, 19 nt, Human
agacucgcgacaaugcaaa

SEQ ID NO: 3010868 - RNA, 18 nt, Human
agacucgcgacaaugcaa

SEQ ID NO: 3010869 - RNA, 17 nt, Human
agacucgcgacaaugca

SEQ ID NO: 3010870 - RNA, 15 nt, Human
agacucgcgacaaug

SEQ ID NO: 3010871 - RNA, 18 nt, Human
ucuuucuggcuaugcauu

SEQ ID NO: 3010872 - RNA, 13 nt, Human
ucuuucugcuuug

SEQ ID NO: 3010873 - RNA, 20 nt, Human
ucuuuauaauucuacuuuga

SEQ ID NO: 3010874 - RNA, 20 nt, Human
agacucgcgacaaugcaaac

SEQ ID NO: 3010875 - RNA, 14 nt, Human
agacuguacaaagu

SEQ ID NO: 3010876 - RNA, 15 nt, Human
agacuguacaaagua

SEQ ID NO: 3010877 - RNA, 16 nt, Human
agacuguacaaaguag

SEQ ID NO: 3010878 - RNA, 22 nt, Human
agagaaaaaauauuuuccugcc

SEQ ID NO: 3010879 - RNA, 19 nt, Human
agacuuuucuuucagccaa

SEQ ID NO: 3010880 - RNA, 20 nt, Human
ucuucuguacgucugacagg

SEQ ID NO: 3010881 - RNA, 23 nt, Human
agacauacuaaccagcagaaaug

SEQ ID NO: 3010882 - RNA, 22 nt, Human
ucuucugcuucagccucccgag

SEQ ID NO: 3010883 - RNA, 19 nt, Human
ucuucugcuucagccuccc

SEQ ID NO: 3010884 - RNA, 21 nt, Human
ucuucuguacgucugacaggc

SEQ ID NO: 3010885 - RNA, 22 nt, Human
ucuucuguacgucugacaggca

SEQ ID NO: 3010886 - RNA, 17 nt, Human
ucuuauuuaaugaaaga

SEQ ID NO: 3010887 - RNA, 18 nt, Human
ucuugagccuugaacuuu

SEQ ID NO: 3010888 - RNA, 19 nt, Human
ucuugagccuugaacuuug

SEQ ID NO: 3010889 - RNA, 17 nt, Human
ucuugagccuugaacuu

SEQ ID NO: 3010890 - RNA, 16 nt, Human
ucuugagccuugaacu

SEQ ID NO: 3010891 - RNA, 14 nt, Human
agacccggcugcgu

SEQ ID NO: 3010892 - RNA, 23 nt, Human
ucucacacaugagcaucaggcca

SEQ ID NO: 3010893 - RNA, 15 nt, Human
ucuauuuauuuguga

SEQ ID NO: 3010894 - RNA, 16 nt, Human
acuucagcugacuuuu

SEQ ID NO: 3010895 - RNA, 11 nt, Human
acuucagcuga

SEQ ID NO: 3010896 - RNA, 11 nt, Human
ucucacuccuu

SEQ ID NO: 3010897 - RNA, 22 nt, Human
acuucgggaggucgaggcagga

SEQ ID NO: 3010898 - RNA, 13 nt, Human
ucucacuccuuga

SEQ ID NO: 3010899 - RNA, 12 nt, Human
ucucacucuguc

SEQ ID NO: 3010900 - RNA, 14 nt, Human
acuucuccacccug

SEQ ID NO: 3010901 - RNA, 16 nt, Human
acuuguggacacagcu

SEQ ID NO: 3010902 - RNA, 17 nt, Human
acuuguggacacagcuc

SEQ ID NO: 3010903 - RNA, 18 nt, Human
acuuguggacacagcucu

SEQ ID NO: 3010904 - RNA, 19 nt, Human
acuugagcccagagugaac

SEQ ID NO: 3010905 - RNA, 15 nt, Human
acuucuccacccugc

SEQ ID NO: 3010906 - RNA, 16 nt, Human
acuucuccacccugcu

SEQ ID NO: 3010907 - RNA, 11 nt, Human
acuuuaaacua

SEQ ID NO: 3010908 - RNA, 21 nt, Human
ucuccuccuuuucacaguucu

SEQ ID NO: 3010909 - RNA, 14 nt, Human
acuuugaccucugc

SEQ ID NO: 3010910 - RNA, 17 nt, Human
acuuucuagccagagga

SEQ ID NO: 3010911 - RNA, 16 nt, Human
acuuucuagccagagg

SEQ ID NO: 3010912 - RNA, 16 nt, Human
ucuccauguuugaugu

SEQ ID NO: 3010913 - RNA, 13 nt, Human
ucucagggccugg

SEQ ID NO: 3010914 - RNA, 12 nt, Human
ucucagggccug

SEQ ID NO: 3010915 - RNA, 15 nt, Human
acuuguggacacagc

SEQ ID NO: 3010916 - RNA, 19 nt, Human
ucucagggccuggucguuu

SEQ ID NO: 3010917 - RNA, 15 nt, Human
ucucagggccugguc

SEQ ID NO: 3010918 - RNA, 14 nt, Human
ucucagggccuggu

SEQ ID NO: 3010919 - RNA, 11 nt, Human
ucuccaggcug

SEQ ID NO: 3010920 - RNA, 17 nt, Human
ucuccaaaauaaaacuu

SEQ ID NO: 3010921 - RNA, 19 nt, Human
ucuccaaaauaaaacuuuu

SEQ ID NO: 3010922 - RNA, 22 nt, Human
ucuccaaaauaaaacuuuuuaa

SEQ ID NO: 3010923 - RNA, 13 nt, Human
ucuccaaaauaaa

SEQ ID NO: 3010924 - RNA, 16 nt, Human
ucuccaggcuguaucc

SEQ ID NO: 3010925 - RNA, 18 nt, Human
ucucucaucuguuacaca

SEQ ID NO: 3010926 - RNA, 19 nt, Human
ucucuccagccccuggaug

SEQ ID NO: 3010927 - RNA, 18 nt, Human
ucucuccagccccuggau

SEQ ID NO: 3010928 - RNA, 16 nt, Human
ucucuccagccccugg

SEQ ID NO: 3010929 - RNA, 17 nt, Human
ucucuccagccccugga

SEQ ID NO: 3010930 - RNA, 21 nt, Human
ucucucaggccaaacucaccu

SEQ ID NO: 3010931 - RNA, 15 nt, Human
ucucucacuccuuga

SEQ ID NO: 3010932 - RNA, 13 nt, Human
ucucucacuccuu

SEQ ID NO: 3010933 - RNA, 18 nt, Human
acuuugaccucugcagca

SEQ ID NO: 3010934 - RNA, 15 nt, Human
acuuugaccucugca

SEQ ID NO: 3010935 - RNA, 16 nt, Human
acuuugaccucugcag

SEQ ID NO: 3010936 - RNA, 16 nt, Human
ucucuccuguaccucu

SEQ ID NO: 3010937 - RNA, 14 nt, Human
ucucuccuguaccu

SEQ ID NO: 3010938 - RNA, 17 nt, Human
ucucugcccuccaagac

SEQ ID NO: 3010939 - RNA, 16 nt, Human
ucucugcccuccaaga

SEQ ID NO: 3010940 - RNA, 15 nt, Human
ucucugcccuccaag

SEQ ID NO: 3010941 - RNA, 11 nt, Human
ucucugcccuc

SEQ ID NO: 3010942 - RNA, 13 nt, Human
agaaaaagaaaaa

SEQ ID NO: 3010943 - RNA, 20 nt, Human
ucucuuuaaugucacaggca

SEQ ID NO: 3010944 - RNA, 21 nt, Human
ucucuuuaaugucacaggcag

SEQ ID NO: 3010945 - RNA, 18 nt, Human
ucucuugagccugggagg

SEQ ID NO: 3010946 - RNA, 16 nt, Human
ucucuugauucauaau

SEQ ID NO: 3010947 - RNA, 14 nt, Human
ucucuugauucaua

SEQ ID NO: 3010948 - RNA, 17 nt, Human
ucucuugagccugggag

SEQ ID NO: 3010949 - RNA, 17 nt, Human
agaaaaaggaugcacag

SEQ ID NO: 3010950 - RNA, 12 nt, Human
ucugacuauaac

SEQ ID NO: 3010951 - RNA, 23 nt, Human
ucugagacucgcgacaaugcaaa

SEQ ID NO: 3010952 - RNA, 22 nt, Human
ucugagacucgcgacaaugcaa

SEQ ID NO: 3010953 - RNA, 17 nt, Human
ucugcacuccccugcug

SEQ ID NO: 3010954 - RNA, 19 nt, Human
ucugcacuccccugcuggg

SEQ ID NO: 3010955 - RNA, 18 nt, Human
ucugcacuccccugcugg

SEQ ID NO: 3010956 - RNA, 18 nt, Human
ucugcagcaauaaagcag

SEQ ID NO: 3010957 - RNA, 20 nt, Human
ucugcacuccccugcugggu

SEQ ID NO: 3010958 - RNA, 21 nt, Human
ucugaacuuggcgcugccccu

SEQ ID NO: 3010959 - RNA, 20 nt, Human
agaaauaucugaaaauguau

SEQ ID NO: 3010960 - RNA, 14 nt, Human
agaaauauaauuga

SEQ ID NO: 3010961 - RNA, 19 nt, Human
agaaauaucugaaaaugua

SEQ ID NO: 3010962 - RNA, 18 nt, Human
ucgcuccaccuugcagcu

SEQ ID NO: 3010963 - RNA, 15 nt, Human
ucgagcaugccugga

SEQ ID NO: 3010964 - RNA, 18 nt, Human
ucgagcaugccuggaugg

SEQ ID NO: 3010965 - RNA, 16 nt, Human
ucgagcaugccuggau

SEQ ID NO: 3010966 - RNA, 19 nt, Human
ucgcgacaaugcaaaccau

SEQ ID NO: 3010967 - RNA, 14 nt, Human
ucgcgacaaugcaa

SEQ ID NO: 3010968 - RNA, 16 nt, Human
ucgcgacaaugcaaac

SEQ ID NO: 3010969 - RNA, 22 nt, Human
uccuuuagcgcccaguugggug

SEQ ID NO: 3010970 - RNA, 15 nt, Human
uccuucagugccuua

SEQ ID NO: 3010971 - RNA, 14 nt, Human
uccuucagugccuu

SEQ ID NO: 3010972 - RNA, 17 nt, Human
uccuucagugccuuaug

SEQ ID NO: 3010973 - RNA, 16 nt, Human
uccuucagugccuuau

SEQ ID NO: 3010974 - RNA, 15 nt, Human
uccuuuagcgcccag

SEQ ID NO: 3010975 - RNA, 19 nt, Human
uccuuuagcgcccaguugg

SEQ ID NO: 3010976 - RNA, 14 nt, Human
uccuuguguuacua

SEQ ID NO: 3010977 - RNA, 23 nt, Human
uccuuguguuacuaaguuuuuau

SEQ ID NO: 3010978 - RNA, 20 nt, Human
acugcuuaacuucacauauu

SEQ ID NO: 3010979 - RNA, 17 nt, Human
acugcuuccagugaggc

SEQ ID NO: 3010980 - RNA, 21 nt, Human
acugcuugugaaaggaaagag

SEQ ID NO: 3010981 - RNA, 15 nt, Human
acuggauuaaacuua

SEQ ID NO: 3010982 - RNA, 18 nt, Human
acugcuuaacuucacaua

SEQ ID NO: 3010983 - RNA, 22 nt, Human
acugcaucaagaugugacaugu

SEQ ID NO: 3010984 - RNA, 20 nt, Human
acugcaucaagaugugacau

SEQ ID NO: 3010985 - RNA, 15 nt, Human
acugcauguuuguga

SEQ ID NO: 3010986 - RNA, 16 nt, Human
acugcauguuugugau

SEQ ID NO: 3010987 - RNA, 22 nt, Human
uccuagaaauuccccacccuga

SEQ ID NO: 3010988 - RNA, 21 nt, Human
uccuagaaauuccccacccug

SEQ ID NO: 3010989 - RNA, 16 nt, Human
acugcauaugaaagga

SEQ ID NO: 3010990 - RNA, 18 nt, Human
acuguccuacccacccuc

SEQ ID NO: 3010991 - RNA, 17 nt, Human
acuguccuacccacccu

SEQ ID NO: 3010992 - RNA, 17 nt, Human
ucgggaggucgaggcag

SEQ ID NO: 3010993 - RNA, 21 nt, Human
ucgggaggucgaggcaggagg

SEQ ID NO: 3010994 - RNA, 19 nt, Human
ucgggaggucgaggcagga

SEQ ID NO: 3010995 - RNA, 12 nt, Human
ucgggcaugaca

SEQ ID NO: 3010996 - RNA, 11 nt, Human
ucgggcaugac

SEQ ID NO: 3010997 - RNA, 13 nt, Human
acuuaaucuaaau

SEQ ID NO: 3010998 - RNA, 15 nt, Human
acuuaaucuaaaugg

SEQ ID NO: 3010999 - RNA, 16 nt, Human
acuuaaucuaaaugga

SEQ ID NO: 3011000 - RNA, 17 nt, Human
acuguugcccaggcugg

SEQ ID NO: 3011001 - RNA, 18 nt, Human
acuguugcccaggcuggc

SEQ ID NO: 3011002 - RNA, 12 nt, Human
acuguugcccag

SEQ ID NO: 3011003 - RNA, 13 nt, Human
acuguugcccagg

SEQ ID NO: 3011004 - RNA, 14 nt, Human
acuguugcccaggc

SEQ ID NO: 3011005 - RNA, 17 nt, Human
acuuaaauaaugugaaa

SEQ ID NO: 3011006 - RNA, 18 nt, Human
acuuaaauaaugugaaac

SEQ ID NO: 3011007 - RNA, 16 nt, Human
acuuaaauaaugugaa

SEQ ID NO: 3011008 - RNA, 15 nt, Human
acuuaaauaauguga

SEQ ID NO: 3011009 - RNA, 19 nt, Human
acuguucucugcccuccaa

SEQ ID NO: 3011010 - RNA, 21 nt, Human
acuguucucugcccuccaaga

SEQ ID NO: 3011011 - RNA, 20 nt, Human
acuguucucugcccuccaag

SEQ ID NO: 3011012 - RNA, 15 nt, Human
acuguucucugcccu

SEQ ID NO: 3011013 - RNA, 14 nt, Human
acuguucucugccc

SEQ ID NO: 3011014 - RNA, 15 nt, Human
ucuaaagcugccagc

SEQ ID NO: 3011015 - RNA, 14 nt, Human
ucuaaagcugccag

SEQ ID NO: 3011016 - RNA, 13 nt, Human
ucuaaagcugcca

SEQ ID NO: 3011017 - RNA, 22 nt, Human
uccaaucugugaugacauuccc

SEQ ID NO: 3011018 - RNA, 17 nt, Human
uccacccaccucagccu

SEQ ID NO: 3011019 - RNA, 18 nt, Human
uccacccaccucagccuc

SEQ ID NO: 3011020 - RNA, 19 nt, Human
uccacccaccucagccucc

SEQ ID NO: 3011021 - RNA, 12 nt, Human
uccacccaggag

SEQ ID NO: 3011022 - RNA, 14 nt, Human
uccacccaggagcc

SEQ ID NO: 3011023 - RNA, 15 nt, Human
uccacccaggagccc

SEQ ID NO: 3011024 - RNA, 22 nt, Human
accuggauugugccuaaugugu

SEQ ID NO: 3011025 - RNA, 14 nt, Human
accuggccucugca

SEQ ID NO: 3011026 - RNA, 17 nt, Human
accuggccucugcacuc

SEQ ID NO: 3011027 - RNA, 16 nt, Human
accuggccucugcacu

SEQ ID NO: 3011028 - RNA, 20 nt, Human
accuggccucugcacucccc

SEQ ID NO: 3011029 - RNA, 18 nt, Human
accuggccucugcacucc

SEQ ID NO: 3011030 - RNA, 23 nt, Human
accuggccucugcacuccccugc

SEQ ID NO: 3011031 - RNA, 19 nt, Human
accuguuucugcagccacu

SEQ ID NO: 3011032 - RNA, 18 nt, Human
accuuagacagucccugc

SEQ ID NO: 3011033 - RNA, 20 nt, Human
accuuagacagucccugcca

SEQ ID NO: 3011034 - RNA, 19 nt, Human
accuuagacagucccugcc

SEQ ID NO: 3011035 - RNA, 14 nt, Human
accugccaggaagc

SEQ ID NO: 3011036 - RNA, 12 nt, Human
accugccaggaa

SEQ ID NO: 3011037 - RNA, 14 nt, Human
uccaacccucauca

SEQ ID NO: 3011038 - RNA, 17 nt, Human
uccaacccucaucacca

SEQ ID NO: 3011039 - RNA, 16 nt, Human
uccaacccucaucacc

SEQ ID NO: 3011040 - RNA, 23 nt, Human
uccaacccucaucaccaacgucu

SEQ ID NO: 3011041 - RNA, 21 nt, Human
uccaagcuggucccacucagu

SEQ ID NO: 3011042 - RNA, 18 nt, Human
uccaaggguacuaaggaa

SEQ ID NO: 3011043 - RNA, 12 nt, Human
uccaagaagccc

SEQ ID NO: 3011044 - RNA, 16 nt, Human
uccaagcuggucccac

SEQ ID NO: 3011045 - RNA, 20 nt, Human
uccaagcuggucccacucag

SEQ ID NO: 3011046 - RNA, 19 nt, Human
uccagacccggcugcgugg

SEQ ID NO: 3011047 - RNA, 15 nt, Human
uccagacccggcugc

SEQ ID NO: 3011048 - RNA, 18 nt, Human
uccagacccggcugcgug

SEQ ID NO: 3011049 - RNA, 14 nt, Human
uccagacccggcug

SEQ ID NO: 3011050 - RNA, 22 nt, Human
uccagaauuucccaaagcagug

SEQ ID NO: 3011051 - RNA, 20 nt, Human
uccagaauuucccaaagcag

SEQ ID NO: 3011052 - RNA, 16 nt, Human
uccagaauuucccaaa

SEQ ID NO: 3011053 - RNA, 14 nt, Human
accuuuugagugcc

SEQ ID NO: 3011054 - RNA, 20 nt, Human
accuuuugagugccuuacac

SEQ ID NO: 3011055 - RNA, 17 nt, Human
accuuuugagugccuua

SEQ ID NO: 3011056 - RNA, 13 nt, Human
uccagccccugga

SEQ ID NO: 3011057 - RNA, 12 nt, Human
uccagccccugg

SEQ ID NO: 3011058 - RNA, 14 nt, Human
uccaggcuguaucc

SEQ ID NO: 3011059 - RNA, 16 nt, Human
acgagcaggcuucuuc

SEQ ID NO: 3011060 - RNA, 17 nt, Human
acgccagauucuuuccu

SEQ ID NO: 3011061 - RNA, 19 nt, Human
acgccagauucuuuccuga

SEQ ID NO: 3011062 - RNA, 21 nt, Human
uccaggcuguaucccaugagc

SEQ ID NO: 3011063 - RNA, 19 nt, Human
accuuuuuuauacauaaac

SEQ ID NO: 3011064 - RNA, 20 nt, Human
accuuuuuuauacauaaaca

SEQ ID NO: 3011065 - RNA, 21 nt, Human
accuuuuuuauacauaaacaa

SEQ ID NO: 3011066 - RNA, 21 nt, Human
ucauucuuuuugaaaugucaa

SEQ ID NO: 3011067 - RNA, 12 nt, Human
ucauucuucugu

SEQ ID NO: 3011068 - RNA, 13 nt, Human
ucauugaaaucuu

SEQ ID NO: 3011069 - RNA, 12 nt, Human
ucauugaaaucu

SEQ ID NO: 3011070 - RNA, 12 nt, Human
ucauuacuaaaa

SEQ ID NO: 3011071 - RNA, 15 nt, Human
ucauugaccugaggc

SEQ ID NO: 3011072 - RNA, 14 nt, Human
ucauugaccugagg

SEQ ID NO: 3011073 - RNA, 12 nt, Human
ucauugaccuga

SEQ ID NO: 3011074 - RNA, 22 nt, Human
ucauugaaaucuuuuugcuuug

SEQ ID NO: 3011075 - RNA, 13 nt, Human
accuccugggcua

SEQ ID NO: 3011076 - RNA, 19 nt, Human
accucggugccuuccucuu

SEQ ID NO: 3011077 - RNA, 14 nt, Human
accugauugugucu

SEQ ID NO: 3011078 - RNA, 18 nt, Human
accugauugugucucuug

SEQ ID NO: 3011079 - RNA, 17 nt, Human
accugauugugucucuu

SEQ ID NO: 3011080 - RNA, 15 nt, Human
accugauugugucuc

SEQ ID NO: 3011081 - RNA, 16 nt, Human
accugaggggccucuu

SEQ ID NO: 3011082 - RNA, 22 nt, Human
accugaggcccuucucuccagc

SEQ ID NO: 3011083 - RNA, 21 nt, Human
accugaggcccuucucuccag

SEQ ID NO: 3011084 - RNA, 20 nt, Human
accugaggcccuucucucca

SEQ ID NO: 3011085 - RNA, 16 nt, Human
accugaggcccuucuc

SEQ ID NO: 3011086 - RNA, 15 nt, Human
accugaggcccuucu

SEQ ID NO: 3011087 - RNA, 14 nt, Human
accugaggcccuuc

SEQ ID NO: 3011088 - RNA, 15 nt, Human
ucaggaagcucaggg

SEQ ID NO: 3011089 - RNA, 14 nt, Human
ucaggaagcucagg

SEQ ID NO: 3011090 - RNA, 13 nt, Human
ucaggaagcucag

SEQ ID NO: 3011091 - RNA, 12 nt, Human
ucaggaagcuca

SEQ ID NO: 3011092 - RNA, 23 nt, Human
accuccugccucgaacuggcugc

SEQ ID NO: 3011093 - RNA, 15 nt, Human
ucauccuaagcuauu

SEQ ID NO: 3011094 - RNA, 13 nt, Human
accuccugccucg

SEQ ID NO: 3011095 - RNA, 12 nt, Human
accuccugccuc

SEQ ID NO: 3011096 - RNA, 14 nt, Human
ucauccuucuggaa

SEQ ID NO: 3011097 - RNA, 18 nt, Human
ucauccucauacccaccc

SEQ ID NO: 3011098 - RNA, 19 nt, Human
ucauccuccucagaucuuc

SEQ ID NO: 3011099 - RNA, 13 nt, Human
ucauccuccucag

SEQ ID NO: 3011100 - RNA, 22 nt, Human
ucauccuucuggaauaaggaga

SEQ ID NO: 3011101 - RNA, 18 nt, Human
acuaacaggcuuagugau

SEQ ID NO: 3011102 - RNA, 17 nt, Human
acuaacaggcuuaguga

SEQ ID NO: 3011103 - RNA, 12 nt, Human
acuaacaggcuu

SEQ ID NO: 3011104 - RNA, 18 nt, Human
acuaacauuuauuugagu

SEQ ID NO: 3011105 - RNA, 11 nt, Human
acuacaggcac

SEQ ID NO: 3011106 - RNA, 15 nt, Human
acuacaggcacccac

SEQ ID NO: 3011107 - RNA, 17 nt, Human
acuacaguccucccauc

SEQ ID NO: 3011108 - RNA, 13 nt, Human
acuacaguuuguu

SEQ ID NO: 3011109 - RNA, 14 nt, Human
acuacaguuuguua

SEQ ID NO: 3011110 - RNA, 14 nt, Human
acuacauucuguua

SEQ ID NO: 3011111 - RNA, 15 nt, Human
acuacaguuuguuag

SEQ ID NO: 3011112 - RNA, 11 nt, Human
acuacauucug

SEQ ID NO: 3011113 - RNA, 12 nt, Human
acuacauucugu

SEQ ID NO: 3011114 - RNA, 13 nt, Human
acuacauucuguu

SEQ ID NO: 3011115 - RNA, 17 nt, Human
ucccagcugugcucugg

SEQ ID NO: 3011116 - RNA, 15 nt, Human
acuacauucuguuaa

SEQ ID NO: 3011117 - RNA, 17 nt, Human
uccccaccgcagacagg

SEQ ID NO: 3011118 - RNA, 21 nt, Human
uccccaccgcagacaggacca

SEQ ID NO: 3011119 - RNA, 18 nt, Human
uccccaccgcagacagga

SEQ ID NO: 3011120 - RNA, 22 nt, Human
ucccauaugccugggcagaagg

SEQ ID NO: 3011121 - RNA, 16 nt, Human
ucccauaugccugggc

SEQ ID NO: 3011122 - RNA, 15 nt, Human
ucccaucacccgcua

SEQ ID NO: 3011123 - RNA, 20 nt, Human
acgggaggguaaggcugugg

SEQ ID NO: 3011124 - RNA, 16 nt, Human
ucccacaaaggagagc

SEQ ID NO: 3011125 - RNA, 20 nt, Human
ucccaccccacacacgccag

SEQ ID NO: 3011126 - RNA, 15 nt, Human
ucccaccccacacac

SEQ ID NO: 3011127 - RNA, 23 nt, Human
acguggcugcuucaaggauccug

SEQ ID NO: 3011128 - RNA, 17 nt, Human
acgguuuuacugcagcu

SEQ ID NO: 3011129 - RNA, 15 nt, Human
acgguuuuacugcag

SEQ ID NO: 3011130 - RNA, 16 nt, Human
ucccaaagcagugcau

SEQ ID NO: 3011131 - RNA, 18 nt, Human
ucccaaacccuucagugc

SEQ ID NO: 3011132 - RNA, 13 nt, Human
ucccaaagugcug

SEQ ID NO: 3011133 - RNA, 14 nt, Human
ucccaaagugcugg

SEQ ID NO: 3011134 - RNA, 18 nt, Human
ucccaaagcagugcaugc

SEQ ID NO: 3011135 - RNA, 17 nt, Human
ucccaaagcagugcaug

SEQ ID NO: 3011136 - RNA, 21 nt, Human
ucccaaagcagugcaugcugu

SEQ ID NO: 3011137 - RNA, 23 nt, Human
acgccagauucuuuccugaggcu

SEQ ID NO: 3011138 - RNA, 22 nt, Human
acgccagauucuuuccugaggc

SEQ ID NO: 3011139 - RNA, 16 nt, Human
ucccugugucauuuca

SEQ ID NO: 3011140 - RNA, 17 nt, Human
ucccugugucauuucaa

SEQ ID NO: 3011141 - RNA, 15 nt, Human
ucccuuucccuuggu

SEQ ID NO: 3011142 - RNA, 17 nt, Human
ucccuuacgugaguccu

SEQ ID NO: 3011143 - RNA, 15 nt, Human
ucccugguggcagcu

SEQ ID NO: 3011144 - RNA, 12 nt, Human
ucccugucccag

SEQ ID NO: 3011145 - RNA, 21 nt, Human
acuccugcaggcagccaggcc

SEQ ID NO: 3011146 - RNA, 11 nt, Human
uccuaaauagc

SEQ ID NO: 3011147 - RNA, 17 nt, Human
uccggucccugucccag

SEQ ID NO: 3011148 - RNA, 16 nt, Human
uccuagaaauucccca

SEQ ID NO: 3011149 - RNA, 12 nt, Human
ucccuuuuccuu

SEQ ID NO: 3011150 - RNA, 15 nt, Human
acucauucuucugua

SEQ ID NO: 3011151 - RNA, 14 nt, Human
acucauugaccuga

SEQ ID NO: 3011152 - RNA, 17 nt, Human
acuccagaauuucccaa

SEQ ID NO: 3011153 - RNA, 15 nt, Human
acuccagaauuuccc

SEQ ID NO: 3011154 - RNA, 15 nt, Human
acucauugaccugag

SEQ ID NO: 3011155 - RNA, 17 nt, Human
acuccugcaggcagcca

SEQ ID NO: 3011156 - RNA, 19 nt, Human
acuccugcaggcagccagg

SEQ ID NO: 3011157 - RNA, 18 nt, Human
acuccugcaggcagccag

SEQ ID NO: 3011158 - RNA, 23 nt, Human
acuccagaauuucccaaagcagu

SEQ ID NO: 3011159 - RNA, 12 nt, Human
acuccagccugg

SEQ ID NO: 3011160 - RNA, 13 nt, Human
acuccagccuggg

SEQ ID NO: 3011161 - RNA, 14 nt, Human
uccccucuccucca

SEQ ID NO: 3011162 - RNA, 20 nt, Human
ucccgaauagcugggacuac

SEQ ID NO: 3011163 - RNA, 15 nt, Human
ucccgaguagcuggg

SEQ ID NO: 3011164 - RNA, 18 nt, Human
ucccgaguagcugggacu

SEQ ID NO: 3011165 - RNA, 16 nt, Human
ucccgaguagcuggga

SEQ ID NO: 3011166 - RNA, 17 nt, Human
ucccgaguagcugggac

SEQ ID NO: 3011167 - RNA, 17 nt, Human
acuacucccccaggugg

SEQ ID NO: 3011168 - RNA, 12 nt, Human
acucaccccagc

SEQ ID NO: 3011169 - RNA, 21 nt, Human
acucacauuuauucugcucac

SEQ ID NO: 3011170 - RNA, 16 nt, Human
ucccugaaggccccgc

SEQ ID NO: 3011171 - RNA, 14 nt, Human
ucccucuuucccuc

SEQ ID NO: 3011172 - RNA, 18 nt, Human
ucccucuuucccucccuu

SEQ ID NO: 3011173 - RNA, 20 nt, Human
ucccucuuucccucccuucc

SEQ ID NO: 3011174 - RNA, 15 nt, Human
ucccugaaggccccg

SEQ ID NO: 3011175 - RNA, 11 nt, Human
ucccugaaggc

SEQ ID NO: 3011176 - RNA, 21 nt, Human
ucccucuuucccucccuuccu

SEQ ID NO: 3011177 - RNA, 23 nt, Human
accaauauuuaaucuuuuaugau

SEQ ID NO: 3011178 - RNA, 20 nt, Human
accaauauuuaaucuuuuau

SEQ ID NO: 3011179 - RNA, 15 nt, Human
accaauguucucucu

SEQ ID NO: 3011180 - RNA, 16 nt, Human
accaauauuuaaucuu

SEQ ID NO: 3011181 - RNA, 17 nt, Human
accaauauuuaaucuuu

SEQ ID NO: 3011182 - RNA, 15 nt, Human
ucaagugaaaaagga

SEQ ID NO: 3011183 - RNA, 23 nt, Human
ucaagugaaaaaggaggaagaga

SEQ ID NO: 3011184 - RNA, 22 nt, Human
accaacauacucccaucuguga

SEQ ID NO: 3011185 - RNA, 21 nt, Human
accaacauacucccaucugug

SEQ ID NO: 3011186 - RNA, 19 nt, Human
accaacauacucccaucug

SEQ ID NO: 3011187 - RNA, 17 nt, Human
accaacauacucccauc

SEQ ID NO: 3011188 - RNA, 12 nt, Human
ucacauaucugu

SEQ ID NO: 3011189 - RNA, 15 nt, Human
ucacauaucugucau

SEQ ID NO: 3011190 - RNA, 15 nt, Human
ucacaguucucuccu

SEQ ID NO: 3011191 - RNA, 13 nt, Human
ucaccccagcccc

SEQ ID NO: 3011192 - RNA, 20 nt, Human
ucaccccagccccaaaacuc

SEQ ID NO: 3011193 - RNA, 14 nt, Human
ucaccccagcccca

SEQ ID NO: 3011194 - RNA, 15 nt, Human
ucaccccggccaccu

SEQ ID NO: 3011195 - RNA, 14 nt, Human
accagacaccuuga

SEQ ID NO: 3011196 - RNA, 11 nt, Human
accagacaggu

SEQ ID NO: 3011197 - RNA, 12 nt, Human
accagagcccac

SEQ ID NO: 3011198 - RNA, 14 nt, Human
accagagcccaccu

SEQ ID NO: 3011199 - RNA, 16 nt, Human
accagagcccaccuug

SEQ ID NO: 3011200 - RNA, 22 nt, Human
accacuuuuguucuugguuugu

SEQ ID NO: 3011201 - RNA, 21 nt, Human
accacugcacuccagccuggg

SEQ ID NO: 3011202 - RNA, 18 nt, Human
ucaccccggccaccugcg

SEQ ID NO: 3011203 - RNA, 17 nt, Human
ucaccccggccaccugc

SEQ ID NO: 3011204 - RNA, 20 nt, Human
accacugcacuccagccugg

SEQ ID NO: 3011205 - RNA, 17 nt, Human
accacugcacuccagcc

SEQ ID NO: 3011206 - RNA, 15 nt, Human
accacuuuuguucuu

SEQ ID NO: 3011207 - RNA, 16 nt, Human
accacuuuuguucuug

SEQ ID NO: 3011208 - RNA, 21 nt, Human
accacuuuuguucuugguuug

SEQ ID NO: 3011209 - RNA, 18 nt, Human
ucacuauguugcccaggc

SEQ ID NO: 3011210 - RNA, 17 nt, Human
ucacuauguugcccagg

SEQ ID NO: 3011211 - RNA, 19 nt, Human
ucacuauguugcccaggca

SEQ ID NO: 3011212 - RNA, 15 nt, Human
ucaccugccccucaa

SEQ ID NO: 3011213 - RNA, 13 nt, Human
ucaccugccccuc

SEQ ID NO: 3011214 - RNA, 15 nt, Human
ucaccucucccuugg

SEQ ID NO: 3011215 - RNA, 22 nt, Human
ucagccaagaauucuuaaauau

SEQ ID NO: 3011216 - RNA, 23 nt, Human
ucagccguguaaccauggaccca

SEQ ID NO: 3011217 - RNA, 19 nt, Human
acccagcgagcccuggugg

SEQ ID NO: 3011218 - RNA, 23 nt, Human
acccagcgagcccugguggcagu

SEQ ID NO: 3011219 - RNA, 24 nt, Human
acccagcgagcccugguggcagug

SEQ ID NO: 3011220 - RNA, 16 nt, Human
accccuucgcuccugu

SEQ ID NO: 3011221 - RNA, 14 nt, Human
accccuucgcuccu

SEQ ID NO: 3011222 - RNA, 15 nt, Human
accccuucgcuccug

SEQ ID NO: 3011223 - RNA, 12 nt, Human
acccccacccaa

SEQ ID NO: 3011224 - RNA, 14 nt, Human
ucagcggggacagc

SEQ ID NO: 3011225 - RNA, 20 nt, Human
ucagcuuguaaauagcucag

SEQ ID NO: 3011226 - RNA, 18 nt, Human
ucagaaucucaaauaacu

SEQ ID NO: 3011227 - RNA, 19 nt, Human
ucagaaucucaaauaacua

SEQ ID NO: 3011228 - RNA, 16 nt, Human
ucagagacuccugcag

SEQ ID NO: 3011229 - RNA, 21 nt, Human
ucagagacuccugcaggcagc

SEQ ID NO: 3011230 - RNA, 20 nt, Human
ucagagacuccugcaggcag

SEQ ID NO: 3011231 - RNA, 17 nt, Human
ucagagacuccugcagg

SEQ ID NO: 3011232 - RNA, 12 nt, Human
ucagagccugca

SEQ ID NO: 3011233 - RNA, 23 nt, Human
ucagagagggugggagugggccc

SEQ ID NO: 3011234 - RNA, 21 nt, Human
ucagagagggugggagugggc

SEQ ID NO: 3011235 - RNA, 16 nt, Human
ucagagagggugggag

SEQ ID NO: 3011236 - RNA, 13 nt, Human
ucagagccugcag

SEQ ID NO: 3011237 - RNA, 14 nt, Human
ucagagccugcagu

SEQ ID NO: 3011238 - RNA, 15 nt, Human
ucagagccugcaguu

SEQ ID NO: 3011239 - RNA, 18 nt, Human
ucagagccugcaguuauu

SEQ ID NO: 3011240 - RNA, 14 nt, Human
ucagaagacacuga

SEQ ID NO: 3011241 - RNA, 22 nt, Human
ucagaaguuucugccgcagccc

SEQ ID NO: 3011242 - RNA, 19 nt, Human
ucagaaguuucugccgcag

SEQ ID NO: 3011243 - RNA, 21 nt, Human
ucacucuuauugcccacgcug

SEQ ID NO: 3011244 - RNA, 23 nt, Human
ucacucuuauugcccacgcugga

SEQ ID NO: 3011245 - RNA, 22 nt, Human
accauggucggaaaacaugcua

SEQ ID NO: 3011246 - RNA, 13 nt, Human
acccacugcucug

SEQ ID NO: 3011247 - RNA, 14 nt, Human
acccacugcucugg

SEQ ID NO: 3011248 - RNA, 15 nt, Human
acccacugcucuggu

SEQ ID NO: 3011249 - RNA, 11 nt, Human
acccacugcuu

SEQ ID NO: 3011250 - RNA, 10 nt, Human
acccacugcu

SEQ ID NO: 3011251 - RNA, 11 nt, Human
acccacugcuc

SEQ ID NO: 3011252 - RNA, 14 nt, Human
acauagcugugauu

SEQ ID NO: 3011253 - RNA, 14 nt, Human
acauauugauuucc

SEQ ID NO: 3011254 - RNA, 16 nt, Human
acauauugauuuccgu

SEQ ID NO: 3011255 - RNA, 23 nt, Human
acauauugauuuccguuaaaaua

SEQ ID NO: 3011256 - RNA, 18 nt, Human
acauauugauuuccguua

SEQ ID NO: 3011257 - RNA, 22 nt, Human
acauauugauuuccguuaaaau

SEQ ID NO: 3011258 - RNA, 13 nt, Human
acaucuguuuugu

SEQ ID NO: 3011259 - RNA, 13 nt, Human
acaucuugcucug

SEQ ID NO: 3011260 - RNA, 16 nt, Human
acaugaaaacacauuu

SEQ ID NO: 3011261 - RNA, 18 nt, Human
acaugaaaacacauuuuu

SEQ ID NO: 3011262 - RNA, 19 nt, Human
acaugaaaacacauuuuuc

SEQ ID NO: 3011263 - RNA, 21 nt, Human
acaucuugcucugcugacaga

SEQ ID NO: 3011264 - RNA, 17 nt, Human
acaugaaaacacauuuu

SEQ ID NO: 3011265 - RNA, 18 nt, Human
acaucuugcucugcugac

SEQ ID NO: 3011266 - RNA, 19 nt, Human
acaucuugcucugcugaca

SEQ ID NO: 3011267 - RNA, 16 nt, Human
acaucaacaucuuggu

SEQ ID NO: 3011268 - RNA, 18 nt, Human
acaucaacaucuugguca

SEQ ID NO: 3011269 - RNA, 16 nt, Human
acaguuggguuuuuua

SEQ ID NO: 3011270 - RNA, 18 nt, Human
acaguuggguuuuuuaag

SEQ ID NO: 3011271 - RNA, 20 nt, Human
acaguugaaaaacagcugag

SEQ ID NO: 3011272 - RNA, 16 nt, Human
acaguugaaaaacagc

SEQ ID NO: 3011273 - RNA, 15 nt, Human
acaguugaaaaacag

SEQ ID NO: 3011274 - RNA, 23 nt, Human
uauuuccuauauuguuuucagug

SEQ ID NO: 3011275 - RNA, 22 nt, Human
uauuucccucaccuuucccauc

SEQ ID NO: 3011276 - RNA, 20 nt, Human
acauacuuuuuggguuuauu

SEQ ID NO: 3011277 - RNA, 17 nt, Human
acauacuuuuuggguuu

SEQ ID NO: 3011278 - RNA, 13 nt, Human
acauacuuuuugg

SEQ ID NO: 3011279 - RNA, 11 nt, Human
acauacuuuuu

SEQ ID NO: 3011280 - RNA, 17 nt, Human
acauacucccaucugug

SEQ ID NO: 3011281 - RNA, 14 nt, Human
acauacucugcuua

SEQ ID NO: 3011282 - RNA, 13 nt, Human
acauacuaaccag

SEQ ID NO: 3011283 - RNA, 21 nt, Human
acauacuaaccagcagaaaug

SEQ ID NO: 3011284 - RNA, 22 nt, Human
acauacuaaccagcagaaaugc

SEQ ID NO: 3011285 - RNA, 13 nt, Human
acauacucccauc

SEQ ID NO: 3011286 - RNA, 16 nt, Human
acaguuuguuaguaug

SEQ ID NO: 3011287 - RNA, 20 nt, Human
acaguuuguuaguaugaggc

SEQ ID NO: 3011288 - RNA, 14 nt, Human
ucaaggcuuagacc

SEQ ID NO: 3011289 - RNA, 11 nt, Human
ucaaguauuau

SEQ ID NO: 3011290 - RNA, 15 nt, Human
ucaaguauuauaccu

SEQ ID NO: 3011291 - RNA, 23 nt, Human
ucaaguauuauaccuuuuuuaga

SEQ ID NO: 3011292 - RNA, 16 nt, Human
ucaaguauuauaccuu

SEQ ID NO: 3011293 - RNA, 21 nt, Human
ucaaguauuauaccuuuuuua

SEQ ID NO: 3011294 - RNA, 16 nt, Human
ucaagaaugcaguacu

SEQ ID NO: 3011295 - RNA, 21 nt, Human
acauuaaaugacucuucccuc

SEQ ID NO: 3011296 - RNA, 19 nt, Human
acauuaaaugacucuuccc

SEQ ID NO: 3011297 - RNA, 15 nt, Human
acauuaaaugacucu

SEQ ID NO: 3011298 - RNA, 17 nt, Human
acaugcuguacauacuu

SEQ ID NO: 3011299 - RNA, 19 nt, Human
acauguccaagaagcccag

SEQ ID NO: 3011300 - RNA, 21 nt, Human
acauguccaagaagcccagga

SEQ ID NO: 3011301 - RNA, 14 nt, Human
acaugcugaacauc

SEQ ID NO: 3011302 - RNA, 21 nt, Human
acaugcugaacaucacagcuu

SEQ ID NO: 3011303 - RNA, 17 nt, Human
acauuagguugugaaug

SEQ ID NO: 3011304 - RNA, 16 nt, Human
acauuagguugugaau

SEQ ID NO: 3011305 - RNA, 15 nt, Human
acauuagguugugaa

SEQ ID NO: 3011306 - RNA, 12 nt, Human
acauucuguuaa

SEQ ID NO: 3011307 - RNA, 15 nt, Human
ucaaauuucuaaauc

SEQ ID NO: 3011308 - RNA, 16 nt, Human
ucaaauuucuaaaucu

SEQ ID NO: 3011309 - RNA, 15 nt, Human
acauucuguuaauca

SEQ ID NO: 3011310 - RNA, 14 nt, Human
ucaaauuucuaaau

SEQ ID NO: 3011311 - RNA, 17 nt, Human
ucaaauuucuaaaucuc

SEQ ID NO: 3011312 - RNA, 16 nt, Human
ucaacagguuuuccug

SEQ ID NO: 3011313 - RNA, 15 nt, Human
uauuugugagacugu

SEQ ID NO: 3011314 - RNA, 18 nt, Human
ucaaauaacuaaaaggua

SEQ ID NO: 3011315 - RNA, 22 nt, Human
acaugcuacacacugcauguuu

SEQ ID NO: 3011316 - RNA, 15 nt, Human
acaugaucuucuuua

SEQ ID NO: 3011317 - RNA, 17 nt, Human
acaugaucuucuuuaua

SEQ ID NO: 3011318 - RNA, 19 nt, Human
acaugagcaucaggccagg

SEQ ID NO: 3011319 - RNA, 18 nt, Human
acaugagcaucaggccag

SEQ ID NO: 3011320 - RNA, 17 nt, Human
acaugagcaucaggcca

SEQ ID NO: 3011321 - RNA, 20 nt, Human
uauccuagucauucuucccu

SEQ ID NO: 3011322 - RNA, 15 nt, Human
uaucucagggccugg

SEQ ID NO: 3011323 - RNA, 13 nt, Human
uaucucagggccu

SEQ ID NO: 3011324 - RNA, 19 nt, Human
uaucccuacuguaauuugu

SEQ ID NO: 3011325 - RNA, 20 nt, Human
uaucccuacuguaauuugug

SEQ ID NO: 3011326 - RNA, 22 nt, Human
uauccuaauaaaaaggugacca

SEQ ID NO: 3011327 - RNA, 18 nt, Human
acagagcuacacagggga

SEQ ID NO: 3011328 - RNA, 21 nt, Human
acagagcaagugagacccugu

SEQ ID NO: 3011329 - RNA, 16 nt, Human
acagaguuguuacauu

SEQ ID NO: 3011330 - RNA, 17 nt, Human
acagaguuguuacauuu

SEQ ID NO: 3011331 - RNA, 18 nt, Human
acagaguuguuacauuuu

SEQ ID NO: 3011332 - RNA, 19 nt, Human
acagaguuguuacauuuuu

SEQ ID NO: 3011333 - RNA, 20 nt, Human
acagaguuguuacauuuuua

SEQ ID NO: 3011334 - RNA, 17 nt, Human
acagcaacacaaagcuu

SEQ ID NO: 3011335 - RNA, 20 nt, Human
acagcccgggcucugccucc

SEQ ID NO: 3011336 - RNA, 22 nt, Human
acagcccgggcucugccuccca

SEQ ID NO: 3011337 - RNA, 21 nt, Human
acagcccgggcucugccuccc

SEQ ID NO: 3011338 - RNA, 20 nt, Human
acagcaacacaaagcuuuug

SEQ ID NO: 3011339 - RNA, 23 nt, Human
acagcccgggcucugccucccau

SEQ ID NO: 3011340 - RNA, 15 nt, Human
acagaguuguuacau

SEQ ID NO: 3011341 - RNA, 21 nt, Human
acagaguuguuacauuuuuaa

SEQ ID NO: 3011342 - RNA, 22 nt, Human
acagaguuguuacauuuuuaag

SEQ ID NO: 3011343 - RNA, 20 nt, Human
acagauagauauaugcucug

SEQ ID NO: 3011344 - RNA, 20 nt, Human
acagauacuccuccaagguu

SEQ ID NO: 3011345 - RNA, 23 nt, Human
acagaugggugcuuggaggaagg

SEQ ID NO: 3011346 - RNA, 15 nt, Human
acacucuauaacaaa

SEQ ID NO: 3011347 - RNA, 13 nt, Human
acacucugagacu

SEQ ID NO: 3011348 - RNA, 11 nt, Human
acacucugaga

SEQ ID NO: 3011349 - RNA, 13 nt, Human
acacuccuucaca

SEQ ID NO: 3011350 - RNA, 22 nt, Human
acacucacauuuauucugcuca

SEQ ID NO: 3011351 - RNA, 15 nt, Human
acacuguucucugcc

SEQ ID NO: 3011352 - RNA, 14 nt, Human
acacuguucucugc

SEQ ID NO: 3011353 - RNA, 20 nt, Human
acacuguucucugcccucca

SEQ ID NO: 3011354 - RNA, 18 nt, Human
acacuguucucugcccuc

SEQ ID NO: 3011355 - RNA, 17 nt, Human
acacuguucucugcccu

SEQ ID NO: 3011356 - RNA, 16 nt, Human
acacuguucucugccc

SEQ ID NO: 3011357 - RNA, 23 nt, Human
acacuguucucugcccuccaaga

SEQ ID NO: 3011358 - RNA, 22 nt, Human
acacuguucucugcccuccaag

SEQ ID NO: 3011359 - RNA, 13 nt, Human
acacuugugaaua

SEQ ID NO: 3011360 - RNA, 12 nt, Human
acacuugugaau

SEQ ID NO: 3011361 - RNA, 23 nt, Human
acacuguuucaaacuuuacuaug

SEQ ID NO: 3011362 - RNA, 18 nt, Human
acacuugugaauaaagag

SEQ ID NO: 3011363 - RNA, 15 nt, Human
acacuguuucaaacu

SEQ ID NO: 3011364 - RNA, 18 nt, Human
acagaaaauucuucucca

SEQ ID NO: 3011365 - RNA, 20 nt, Human
uauauucauucuuuuugaaa

SEQ ID NO: 3011366 - RNA, 19 nt, Human
uauauucauucuuuuugaa

SEQ ID NO: 3011367 - RNA, 21 nt, Human
acagacuggaagcacagcuuc

SEQ ID NO: 3011368 - RNA, 17 nt, Human
acagacuggaagcacag

SEQ ID NO: 3011369 - RNA, 19 nt, Human
acagacuggaagcacagcu

SEQ ID NO: 3011370 - RNA, 18 nt, Human
acagacacaggcccggcu

SEQ ID NO: 3011371 - RNA, 22 nt, Human
acagacacaggcccggcuccag

SEQ ID NO: 3011372 - RNA, 17 nt, Human
acagacacaggcccggc

SEQ ID NO: 3011373 - RNA, 15 nt, Human
acagacacaggcccg

SEQ ID NO: 3011374 - RNA, 18 nt, Human
acacaugcugaacaucac

SEQ ID NO: 3011375 - RNA, 13 nt, Human
acacauguccaag

SEQ ID NO: 3011376 - RNA, 19 nt, Human
acacauguccaagaagccc

SEQ ID NO: 3011377 - RNA, 18 nt, Human
acacauguccaagaagcc

SEQ ID NO: 3011378 - RNA, 12 nt, Human
acacccagccca

SEQ ID NO: 3011379 - RNA, 13 nt, Human
acacccagcccac

SEQ ID NO: 3011380 - RNA, 22 nt, Human
acacauguccaagaagcccagg

SEQ ID NO: 3011381 - RNA, 21 nt, Human
acacauguccaagaagcccag

SEQ ID NO: 3011382 - RNA, 23 nt, Human
uaguucaaucuggauucauauuu

SEQ ID NO: 3011383 - RNA, 22 nt, Human
uauaaccaguguuguggauuua

SEQ ID NO: 3011384 - RNA, 16 nt, Human
acacuaaccacgcugg

SEQ ID NO: 3011385 - RNA, 17 nt, Human
acacuaaccacgcugga

SEQ ID NO: 3011386 - RNA, 19 nt, Human
acacuaaccacgcuggacc

SEQ ID NO: 3011387 - RNA, 14 nt, Human
acaccuugacaggg

SEQ ID NO: 3011388 - RNA, 15 nt, Human
acaccuugacagggc

SEQ ID NO: 3011389 - RNA, 16 nt, Human
acaccuugacagggca

SEQ ID NO: 3011390 - RNA, 18 nt, Human
acaccucugcacaagcug

SEQ ID NO: 3011391 - RNA, 14 nt, Human
acacaccuaacuua

SEQ ID NO: 3011392 - RNA, 11 nt, Human
acacacagcuc

SEQ ID NO: 3011393 - RNA, 12 nt, Human
acacacagcucu

SEQ ID NO: 3011394 - RNA, 19 nt, Human
acacacagcucuguccugg

SEQ ID NO: 3011395 - RNA, 15 nt, Human
acaaugguuuucuug

SEQ ID NO: 3011396 - RNA, 21 nt, Human
acaaugguuuucuuguguguu

SEQ ID NO: 3011397 - RNA, 12 nt, Human
uagguugugaau

SEQ ID NO: 3011398 - RNA, 21 nt, Human
uagguuggcaaaaaggcagga

SEQ ID NO: 3011399 - RNA, 22 nt, Human
acacaguauuacuucugcuaca

SEQ ID NO: 3011400 - RNA, 11 nt, Human
acacagugagu

SEQ ID NO: 3011401 - RNA, 22 nt, Human
acacagcucuucuccaggcugu

SEQ ID NO: 3011402 - RNA, 13 nt, Human
uaguagagacagg

SEQ ID NO: 3011403 - RNA, 19 nt, Human
aauugauugggcacaucau

SEQ ID NO: 3011404 - RNA, 23 nt, Human
aauugauugggcacaucauuuca

SEQ ID NO: 3011405 - RNA, 20 nt, Human
aauugauugggcacaucauu

SEQ ID NO: 3011406 - RNA, 23 nt, Human
uacuguaauuugugauacaaugc

SEQ ID NO: 3011407 - RNA, 14 nt, Human
uacugaacaguaac

SEQ ID NO: 3011408 - RNA, 23 nt, Human
uacugggaaagggauuuucagcc

SEQ ID NO: 3011409 - RNA, 15 nt, Human
uacuguaauuuguga

SEQ ID NO: 3011410 - RNA, 16 nt, Human
uacuguaauuugugau

SEQ ID NO: 3011411 - RNA, 17 nt, Human
uacuguaauuugugaua

SEQ ID NO: 3011412 - RNA, 21 nt, Human
uacuaaaaguuuugagaaauu

SEQ ID NO: 3011413 - RNA, 16 nt, Human
uacgucugacaggcaa

SEQ ID NO: 3011414 - RNA, 13 nt, Human
uacgugaguccug

SEQ ID NO: 3011415 - RNA, 22 nt, Human
uacucuacccucuuagaaaaac

SEQ ID NO: 3011416 - RNA, 16 nt, Human
uacucuacccucuuag

SEQ ID NO: 3011417 - RNA, 15 nt, Human
uacgucugacaggca

SEQ ID NO: 3011418 - RNA, 18 nt, Human
aauuuacuuuaaacuaca

SEQ ID NO: 3011419 - RNA, 15 nt, Human
aauuuacuuuaaacu

SEQ ID NO: 3011420 - RNA, 16 nt, Human
aauuuacuuuaaacua

SEQ ID NO: 3011421 - RNA, 17 nt, Human
aauuuaccugaagucuu

SEQ ID NO: 3011422 - RNA, 15 nt, Human
aauuuaccugaaguc

SEQ ID NO: 3011423 - RNA, 13 nt, Human
aauuuauuauggc

SEQ ID NO: 3011424 - RNA, 14 nt, Human
aauuuauuauggca

SEQ ID NO: 3011425 - RNA, 14 nt, Human
aauuugcacauuaa

SEQ ID NO: 3011426 - RNA, 21 nt, Human
uacuuauuuaaauagaugaca

SEQ ID NO: 3011427 - RNA, 14 nt, Human
uacuuauuuaaaua

SEQ ID NO: 3011428 - RNA, 12 nt, Human
uacuuauuuaaa

SEQ ID NO: 3011429 - RNA, 12 nt, Human
aauuugcacauu

SEQ ID NO: 3011430 - RNA, 13 nt, Human
uacuucuccaccc

SEQ ID NO: 3011431 - RNA, 18 nt, Human
uacuucuccacccugcuc

SEQ ID NO: 3011432 - RNA, 20 nt, Human
uacuucuccacccugcucuc

SEQ ID NO: 3011433 - RNA, 15 nt, Human
uacuucugcuacaua

SEQ ID NO: 3011434 - RNA, 14 nt, Human
uacuucuuauacau

SEQ ID NO: 3011435 - RNA, 15 nt, Human
uacuucuuauacauu

SEQ ID NO: 3011436 - RNA, 16 nt, Human
uacuucuuauacauuu

SEQ ID NO: 3011437 - RNA, 10 nt, Human
uacuuuuugg

SEQ ID NO: 3011438 - RNA, 16 nt, Human
aauuugcacauuaaau

SEQ ID NO: 3011439 - RNA, 23 nt, Human
aauuugccuaauaugaugacugu

SEQ ID NO: 3011440 - RNA, 16 nt, Human
aauuuguuauaaugaa

SEQ ID NO: 3011441 - RNA, 20 nt, Human
aauuugugauacaaugcugu

SEQ ID NO: 3011442 - RNA, 23 nt, Human
acaaaggauacuuauuuaaauag

SEQ ID NO: 3011443 - RNA, 21 nt, Human
acaaaggauacuuauuuaaau

SEQ ID NO: 3011444 - RNA, 23 nt, Human
acaaagcuuuugcauauugcaua

SEQ ID NO: 3011445 - RNA, 22 nt, Human
acaaagcuuuugcauauugcau

SEQ ID NO: 3011446 - RNA, 15 nt, Human
acaaagcuuuugcau

SEQ ID NO: 3011447 - RNA, 21 nt, Human
acaaagcgugguggacaugca

SEQ ID NO: 3011448 - RNA, 14 nt, Human
acaaaacuuuucua

SEQ ID NO: 3011449 - RNA, 22 nt, Human
acaagcuccaagcucccaggca

SEQ ID NO: 3011450 - RNA, 19 nt, Human
acaagcuccaagcucccag

SEQ ID NO: 3011451 - RNA, 17 nt, Human
acaagcuccaagcuccc

SEQ ID NO: 3011452 - RNA, 16 nt, Human
acaagcuccaagcucc

SEQ ID NO: 3011453 - RNA, 15 nt, Human
acaagcuccaagcuc

SEQ ID NO: 3011454 - RNA, 16 nt, Human
uagcucaggugucccu

SEQ ID NO: 3011455 - RNA, 17 nt, Human
acaacaucuuuuucuac

SEQ ID NO: 3011456 - RNA, 16 nt, Human
acaagaccacguuucu

SEQ ID NO: 3011457 - RNA, 17 nt, Human
acaagaccacguuucua

SEQ ID NO: 3011458 - RNA, 18 nt, Human
acaagagcccaggccucc

SEQ ID NO: 3011459 - RNA, 22 nt, Human
acaagagcccaggccuccuaca

SEQ ID NO: 3011460 - RNA, 17 nt, Human
acaagcgugagccacug

SEQ ID NO: 3011461 - RNA, 13 nt, Human
acaagcuccaagc

SEQ ID NO: 3011462 - RNA, 21 nt, Human
aauaucccuuggacauuuuau

SEQ ID NO: 3011463 - RNA, 20 nt, Human
aauaucccuuggacauuuua

SEQ ID NO: 3011464 - RNA, 22 nt, Human
aauaucccuuggacauuuuaug

SEQ ID NO: 3011465 - RNA, 12 nt, Human
aauauccuaaua

SEQ ID NO: 3011466 - RNA, 13 nt, Human
aauauccuaauaa

SEQ ID NO: 3011467 - RNA, 14 nt, Human
aauauccuaauaaa

SEQ ID NO: 3011468 - RNA, 20 nt, Human
aauauccaauugcugcuugu

SEQ ID NO: 3011469 - RNA, 15 nt, Human
aauauccuaauaaaa

SEQ ID NO: 3011470 - RNA, 19 nt, Human
aauauccuaauaaaaaggu

SEQ ID NO: 3011471 - RNA, 14 nt, Human
uaacauggaaguac

SEQ ID NO: 3011472 - RNA, 15 nt, Human
uaacauggaaguacu

SEQ ID NO: 3011473 - RNA, 15 nt, Human
uaacuaaaagguaug

SEQ ID NO: 3011474 - RNA, 14 nt, Human
uaacuaaaagguau

SEQ ID NO: 3011475 - RNA, 22 nt, Human
aauagaugacauugacuauuuu

SEQ ID NO: 3011476 - RNA, 21 nt, Human
aauagaugacauugacuauuu

SEQ ID NO: 3011477 - RNA, 19 nt, Human
aauagaugacauugacuau

SEQ ID NO: 3011478 - RNA, 20 nt, Human
aauagcauguccuaaugcuu

SEQ ID NO: 3011479 - RNA, 13 nt, Human
aauagcugggacu

SEQ ID NO: 3011480 - RNA, 14 nt, Human
aauagcugggacua

SEQ ID NO: 3011481 - RNA, 18 nt, Human
aauagacaauuuauuaug

SEQ ID NO: 3011482 - RNA, 23 nt, Human
aauagacaauuuauuauggcaca

SEQ ID NO: 3011483 - RNA, 19 nt, Human
aauaggaaaaacugauuuu

SEQ ID NO: 3011484 - RNA, 18 nt, Human
aauaggaaaaacugauuu

SEQ ID NO: 3011485 - RNA, 17 nt, Human
aauaggaaaaacugauu

SEQ ID NO: 3011486 - RNA, 16 nt, Human
aauaggaaaaacugau

SEQ ID NO: 3011487 - RNA, 15 nt, Human
aauaggaaaaacuga

SEQ ID NO: 3011488 - RNA, 21 nt, Human
aauauccuaauaaaaagguga

SEQ ID NO: 3011489 - RNA, 16 nt, Human
aauaucugaaaaugua

SEQ ID NO: 3011490 - RNA, 17 nt, Human
aauaucugaaaauguau

SEQ ID NO: 3011491 - RNA, 18 nt, Human
aauaucugaaaauguaug

SEQ ID NO: 3011492 - RNA, 19 nt, Human
aauaucugaaaauguaugu

SEQ ID NO: 3011493 - RNA, 20 nt, Human
aauaucugaaaauguaugug

SEQ ID NO: 3011494 - RNA, 15 nt, Human
uaacuuuuauaaacu

SEQ ID NO: 3011495 - RNA, 17 nt, Human
uaacuuuuauaaacuuu

SEQ ID NO: 3011496 - RNA, 18 nt, Human
uaacuuuuauaaacuuua

SEQ ID NO: 3011497 - RNA, 17 nt, Human
aauaugaugacuguuuu

SEQ ID NO: 3011498 - RNA, 16 nt, Human
aauaugaugacuguuu

SEQ ID NO: 3011499 - RNA, 17 nt, Human
aauauugauaugcuuau

SEQ ID NO: 3011500 - RNA, 18 nt, Human
aauauugauaugcuuaua

SEQ ID NO: 3011501 - RNA, 15 nt, Human
aauaugcacacauuu

SEQ ID NO: 3011502 - RNA, 22 nt, Human
aauauugcugauggugcaauga

SEQ ID NO: 3011503 - RNA, 21 nt, Human
aauauugcugauggugcaaug

SEQ ID NO: 3011504 - RNA, 18 nt, Human
aauauugcugauggugca

SEQ ID NO: 3011505 - RNA, 15 nt, Human
aauauugcugauggu

SEQ ID NO: 3011506 - RNA, 13 nt, Human
aauauugcugaug

SEQ ID NO: 3011507 - RNA, 12 nt, Human
aauauugcugau

SEQ ID NO: 3011508 - RNA, 11 nt, Human
aauauugcuga

SEQ ID NO: 3011509 - RNA, 21 nt, Human
aauauuuuagguguaaaauaa

SEQ ID NO: 3011510 - RNA, 21 nt, Human
aauauugguugggaugacuug

SEQ ID NO: 3011511 - RNA, 15 nt, Human
aauauugguugggau

SEQ ID NO: 3011512 - RNA, 21 nt, Human
uaaauagaugacauugacuau

SEQ ID NO: 3011513 - RNA, 19 nt, Human
uaaauagaugacauugacu

SEQ ID NO: 3011514 - RNA, 14 nt, Human
uaaauagaugacau

SEQ ID NO: 3011515 - RNA, 14 nt, Human
uaaaucuccaaaau

SEQ ID NO: 3011516 - RNA, 15 nt, Human
uaaaucuccaaaaua

SEQ ID NO: 3011517 - RNA, 18 nt, Human
uaaaucuccaaaauaaaa

SEQ ID NO: 3011518 - RNA, 22 nt, Human
uaaaucuccaaaauaaaacuuu

SEQ ID NO: 3011519 - RNA, 12 nt, Human
uaaauuaacuuu

SEQ ID NO: 3011520 - RNA, 14 nt, Human
uaaauuaacuuuua

SEQ ID NO: 3011521 - RNA, 17 nt, Human
uaaauuaacuuuuauaa

SEQ ID NO: 3011522 - RNA, 15 nt, Human
uaaauuaacuuuuau

SEQ ID NO: 3011523 - RNA, 16 nt, Human
uaaauuaacuuuuaua

SEQ ID NO: 3011524 - RNA, 15 nt, Human
uaaauguugaaagau

SEQ ID NO: 3011525 - RNA, 20 nt, Human
uaaauguugaaagaucaaaa

SEQ ID NO: 3011526 - RNA, 23 nt, Human
uaaaugcaccuggaauauauaac

SEQ ID NO: 3011527 - RNA, 19 nt, Human
uaaauaaugugaaacugga

SEQ ID NO: 3011528 - RNA, 16 nt, Human
aauaaaaaggugacca

SEQ ID NO: 3011529 - RNA, 12 nt, Human
aauaaaaaggug

SEQ ID NO: 3011530 - RNA, 13 nt, Human
aauaaaaagguga

SEQ ID NO: 3011531 - RNA, 20 nt, Human
aaguuuuuauggcuuuugug

SEQ ID NO: 3011532 - RNA, 16 nt, Human
guuuugaagauucuau

SEQ ID NO: 3011533 - RNA, 17 nt, Human
guuuugaagauucuaug

SEQ ID NO: 3011534 - RNA, 20 nt, Human
guuuugaagauucuauguua

SEQ ID NO: 3011535 - RNA, 17 nt, Human
aauaacuggaacacucu

SEQ ID NO: 3011536 - RNA, 22 nt, Human
aauaacauguaauuaaguacua

SEQ ID NO: 3011537 - RNA, 18 nt, Human
aauaaaacuuuuuaaaau

SEQ ID NO: 3011538 - RNA, 12 nt, Human
aauaaaacuuuu

SEQ ID NO: 3011539 - RNA, 14 nt, Human
aauaaaacuuuuua

SEQ ID NO: 3011540 - RNA, 15 nt, Human
aauaaaacuuuuuaa

SEQ ID NO: 3011541 - RNA, 16 nt, Human
aauaaaucauaaaacu

SEQ ID NO: 3011542 - RNA, 18 nt, Human
aaugcaguacuaacauuu

SEQ ID NO: 3011543 - RNA, 13 nt, Human
aaugcccagcccc

SEQ ID NO: 3011544 - RNA, 15 nt, Human
aaugcccagccccuu

SEQ ID NO: 3011545 - RNA, 14 nt, Human
aaugcccagccccu

SEQ ID NO: 3011546 - RNA, 18 nt, Human
aauggaagacagcucuua

SEQ ID NO: 3011547 - RNA, 16 nt, Human
aauggacguguuauga

SEQ ID NO: 3011548 - RNA, 13 nt, Human
aaugcugugcccu

SEQ ID NO: 3011549 - RNA, 20 nt, Human
aaugcugugcccuaaagugu

SEQ ID NO: 3011550 - RNA, 21 nt, Human
aaugcugugcccuaaagugua

SEQ ID NO: 3011551 - RNA, 24 nt, Human
aaugcccagccccuucugacccau

SEQ ID NO: 3011552 - RNA, 23 nt, Human
aaugcccagccccuucugaccca

SEQ ID NO: 3011553 - RNA, 22 nt, Human
aaugcccagccccuucugaccc

SEQ ID NO: 3011554 - RNA, 20 nt, Human
aaugcccagccccuucugac

SEQ ID NO: 3011555 - RNA, 14 nt, Human
aaugagcuuaagaa

SEQ ID NO: 3011556 - RNA, 14 nt, Human
aaugagccuggcaa

SEQ ID NO: 3011557 - RNA, 16 nt, Human
uaauuauugauguuuu

SEQ ID NO: 3011558 - RNA, 18 nt, Human
uaauuauugauguuuuca

SEQ ID NO: 3011559 - RNA, 15 nt, Human
uacaaaagcauguga

SEQ ID NO: 3011560 - RNA, 20 nt, Human
uacaaaaagcauaaaaauua

SEQ ID NO: 3011561 - RNA, 15 nt, Human
uacaaaaagcauaaa

SEQ ID NO: 3011562 - RNA, 19 nt, Human
uacaccacuacauucuguu

SEQ ID NO: 3011563 - RNA, 20 nt, Human
uacaccacuacauucuguua

SEQ ID NO: 3011564 - RNA, 15 nt, Human
uacaccacuacauuc

SEQ ID NO: 3011565 - RNA, 16 nt, Human
uacaccacuacauucu

SEQ ID NO: 3011566 - RNA, 17 nt, Human
uacaccacuacauucug

SEQ ID NO: 3011567 - RNA, 18 nt, Human
uacaccacuacauucugu

SEQ ID NO: 3011568 - RNA, 23 nt, Human
uacagagcccacgcccccacugg

SEQ ID NO: 3011569 - RNA, 12 nt, Human
aauguacugcau

SEQ ID NO: 3011570 - RNA, 15 nt, Human
uacauaaugcgugca

SEQ ID NO: 3011571 - RNA, 19 nt, Human
uacauaaugcgugcauacc

SEQ ID NO: 3011572 - RNA, 20 nt, Human
uacauaaugcgugcauacca

SEQ ID NO: 3011573 - RNA, 17 nt, Human
uacauaaugcgugcaua

SEQ ID NO: 3011574 - RNA, 15 nt, Human
uacaguaucucaggg

SEQ ID NO: 3011575 - RNA, 12 nt, Human
aauguaugugua

SEQ ID NO: 3011576 - RNA, 14 nt, Human
aauguauguguaag

SEQ ID NO: 3011577 - RNA, 14 nt, Human
aauguacugcauau

SEQ ID NO: 3011578 - RNA, 18 nt, Human
aauguacugcauaugaaa

SEQ ID NO: 3011579 - RNA, 13 nt, Human
aaugacucuuccc

SEQ ID NO: 3011580 - RNA, 18 nt, Human
aaugacuuacuguacaug

SEQ ID NO: 3011581 - RNA, 14 nt, Human
aaugacuuacugua

SEQ ID NO: 3011582 - RNA, 17 nt, Human
aaugacuuacuguacau

SEQ ID NO: 3011583 - RNA, 15 nt, Human
aaugagccuggcaag

SEQ ID NO: 3011584 - RNA, 18 nt, Human
uaaugguaguuuuacagu

SEQ ID NO: 3011585 - RNA, 16 nt, Human
uaaugguaguuuuaca

SEQ ID NO: 3011586 - RNA, 13 nt, Human
uaaugaggaaacu

SEQ ID NO: 3011587 - RNA, 18 nt, Human
uaaugagcuuaagaaauu

SEQ ID NO: 3011588 - RNA, 21 nt, Human
uaaugacuuaagcacacuuga

SEQ ID NO: 3011589 - RNA, 15 nt, Human
uaaugacuuaagcac

SEQ ID NO: 3011590 - RNA, 22 nt, Human
uaaugaaagacuguacaaagua

SEQ ID NO: 3011591 - RNA, 23 nt, Human
uaaugaaagacuguacaaaguag

SEQ ID NO: 3011592 - RNA, 14 nt, Human
uaaugaaagacugu

SEQ ID NO: 3011593 - RNA, 17 nt, Human
uaaugaaagacuguaca

SEQ ID NO: 3011594 - RNA, 18 nt, Human
uaaugaaagacuguacaa

SEQ ID NO: 3011595 - RNA, 19 nt, Human
uaaugaaagacuguacaaa

SEQ ID NO: 3011596 - RNA, 20 nt, Human
aaucuucugaacuuggcgcu

SEQ ID NO: 3011597 - RNA, 13 nt, Human
aaucuucugaacu

SEQ ID NO: 3011598 - RNA, 19 nt, Human
uaaguacuauguaucaaug

SEQ ID NO: 3011599 - RNA, 20 nt, Human
uaaguuuuuauggcuuuugu

SEQ ID NO: 3011600 - RNA, 13 nt, Human
aaucucaaauaac

SEQ ID NO: 3011601 - RNA, 14 nt, Human
aaucucaaauuucu

SEQ ID NO: 3011602 - RNA, 12 nt, Human
aaucucaaauuu

SEQ ID NO: 3011603 - RNA, 15 nt, Human
aaucucaaauaacua

SEQ ID NO: 3011604 - RNA, 18 nt, Human
aaucuaaauggaaccacu

SEQ ID NO: 3011605 - RNA, 13 nt, Human
aaucuaaauggaa

SEQ ID NO: 3011606 - RNA, 15 nt, Human
aaucuaaauggaacc

SEQ ID NO: 3011607 - RNA, 12 nt, Human
aaucuaaaugga

SEQ ID NO: 3011608 - RNA, 21 nt, Human
aacuuuaagaacuaaaauguu

SEQ ID NO: 3011609 - RNA, 13 nt, Human
aacuuuaccuuuu

SEQ ID NO: 3011610 - RNA, 17 nt, Human
aacuuggcgcugccccu

SEQ ID NO: 3011611 - RNA, 11 nt, Human
gugccuuaugg

SEQ ID NO: 3011612 - RNA, 18 nt, Human
aacuugucuuuggacccu

SEQ ID NO: 3011613 - RNA, 15 nt, Human
gugccuaauguguuu

SEQ ID NO: 3011614 - RNA, 15 nt, Human
gugccucaagagaag

SEQ ID NO: 3011615 - RNA, 21 nt, Human
gugaaccaccacacccagccc

SEQ ID NO: 3011616 - RNA, 22 nt, Human
gugccgagaaggaagccuccca

SEQ ID NO: 3011617 - RNA, 12 nt, Human
gugccucuggga

SEQ ID NO: 3011618 - RNA, 13 nt, Human
gugccucugggac

SEQ ID NO: 3011619 - RNA, 14 nt, Human
gugccuuauggaac

SEQ ID NO: 3011620 - RNA, 23 nt, Human
gugccuuauggaacacucugaga

SEQ ID NO: 3011621 - RNA, 21 nt, Human
gugccuuauggaacacucuga

SEQ ID NO: 3011622 - RNA, 20 nt, Human
aagaaagacuaucuaaaugu

SEQ ID NO: 3011623 - RNA, 22 nt, Human
aagaaagacuaucuaaauguug

SEQ ID NO: 3011624 - RNA, 15 nt, Human
aagaaaaaggaugca

SEQ ID NO: 3011625 - RNA, 17 nt, Human
aagaaaaaggaugcaca

SEQ ID NO: 3011626 - RNA, 18 nt, Human
aagaaaaaggaugcacag

SEQ ID NO: 3011627 - RNA, 18 nt, Human
gugcuaggaacacuccuu

SEQ ID NO: 3011628 - RNA, 17 nt, Human
gugcuaggaacacuccu

SEQ ID NO: 3011629 - RNA, 22 nt, Human
gugcuaggaacacuccuucaca

SEQ ID NO: 3011630 - RNA, 21 nt, Human
gugcuaucucccccagcccca

SEQ ID NO: 3011631 - RNA, 24 nt, Human
aagaaugcaguacuaacauuuauu

SEQ ID NO: 3011632 - RNA, 16 nt, Human
aagaauugaagcagga

SEQ ID NO: 3011633 - RNA, 23 nt, Human
aagaauugauugggcacaucauu

SEQ ID NO: 3011634 - RNA, 17 nt, Human
aagacccucucaaacua

SEQ ID NO: 3011635 - RNA, 19 nt, Human
guggcaccagcagccugga

SEQ ID NO: 3011636 - RNA, 18 nt, Human
guggauuuaacagaaaug

SEQ ID NO: 3011637 - RNA, 19 nt, Human
guggauuuaacagaaaugu

SEQ ID NO: 3011638 - RNA, 18 nt, Human
guggcaccagcagccugg

SEQ ID NO: 3011639 - RNA, 20 nt, Human
guggcagcucaccucucccu

SEQ ID NO: 3011640 - RNA, 16 nt, Human
guggcagcucaccucu

SEQ ID NO: 3011641 - RNA, 14 nt, Human
guggcagcucaccu

SEQ ID NO: 3011642 - RNA, 22 nt, Human
gugcuaucucccccagccccau

SEQ ID NO: 3011643 - RNA, 19 nt, Human
gugcuaucucccccagccc

SEQ ID NO: 3011644 - RNA, 12 nt, Human
gugcuauguucu

SEQ ID NO: 3011645 - RNA, 21 nt, Human
gugcugggauuacaagcguga

SEQ ID NO: 3011646 - RNA, 22 nt, Human
gugcugggauuacaagcgugag

SEQ ID NO: 3011647 - RNA, 20 nt, Human
gugcugggauuacaggugug

SEQ ID NO: 3011648 - RNA, 17 nt, Human
guggacacagcucuucu

SEQ ID NO: 3011649 - RNA, 23 nt, Human
guggacacagcucuucuccaggc

SEQ ID NO: 3011650 - RNA, 18 nt, Human
guggacacagcucuucuc

SEQ ID NO: 3011651 - RNA, 22 nt, Human
guggacacagcucuucuccagg

SEQ ID NO: 3011652 - RNA, 21 nt, Human
guggaugccugguggcagcug

SEQ ID NO: 3011653 - RNA, 18 nt, Human
aagaugugacauguuuua

SEQ ID NO: 3011654 - RNA, 14 nt, Human
aagaugugacaugu

SEQ ID NO: 3011655 - RNA, 13 nt, Human
aagcaaaggagau

SEQ ID NO: 3011656 - RNA, 12 nt, Human
aagcaaaggaga

SEQ ID NO: 3011657 - RNA, 12 nt, Human
aagaugcagccg

SEQ ID NO: 3011658 - RNA, 18 nt, Human
aagagguuuuaaaaaaau

SEQ ID NO: 3011659 - RNA, 17 nt, Human
gugguuuucuguucuuu

SEQ ID NO: 3011660 - RNA, 23 nt, Human
guguuuccuggcacugcuuccag

SEQ ID NO: 3011661 - RNA, 17 nt, Human
gugucuugcaauggcag

SEQ ID NO: 3011662 - RNA, 18 nt, Human
gugucuugcaauggcagc

SEQ ID NO: 3011663 - RNA, 18 nt, Human
gugucuuuuuucacuaca

SEQ ID NO: 3011664 - RNA, 17 nt, Human
gugugacuacuccccca

SEQ ID NO: 3011665 - RNA, 22 nt, Human
aagacccuuguggucccacccc

SEQ ID NO: 3011666 - RNA, 21 nt, Human
aagacccuuguggucccaccc

SEQ ID NO: 3011667 - RNA, 18 nt, Human
aagacccuugugguccca

SEQ ID NO: 3011668 - RNA, 16 nt, Human
aagacuaucuaaaugu

SEQ ID NO: 3011669 - RNA, 17 nt, Human
aagacuaucuaaauguu

SEQ ID NO: 3011670 - RNA, 18 nt, Human
aagacuaucuaaauguug

SEQ ID NO: 3011671 - RNA, 17 nt, Human
aagacugaguacguugu

SEQ ID NO: 3011672 - RNA, 17 nt, Human
aagacuguacaaaguag

SEQ ID NO: 3011673 - RNA, 21 nt, Human
aagacugaguacguugugcau

SEQ ID NO: 3011674 - RNA, 16 nt, Human
aagacuguacaaagua

SEQ ID NO: 3011675 - RNA, 14 nt, Human
guggguacgggagg

SEQ ID NO: 3011676 - RNA, 20 nt, Human
gugggggaucacagccucug

SEQ ID NO: 3011677 - RNA, 16 nt, Human
gugguuucagaaaugu

SEQ ID NO: 3011678 - RNA, 14 nt, Human
guggugguuuucug

SEQ ID NO: 3011679 - RNA, 23 nt, Human
gugggaggaucucuugagccugg

SEQ ID NO: 3011680 - RNA, 13 nt, Human
gugggauccucca

SEQ ID NO: 3011681 - RNA, 14 nt, Human
gugggagugggccc

SEQ ID NO: 3011682 - RNA, 13 nt, Human
gugggagugggcc

SEQ ID NO: 3011683 - RNA, 23 nt, Human
guggcgcagcauauucaggaagc

SEQ ID NO: 3011684 - RNA, 22 nt, Human
guggcgcagcauauucaggaag

SEQ ID NO: 3011685 - RNA, 22 nt, Human
gugggacacccugugauggggc

SEQ ID NO: 3011686 - RNA, 14 nt, Human
guuacacaaagaac

SEQ ID NO: 3011687 - RNA, 20 nt, Human
guuaguaugaggcauuuguu

SEQ ID NO: 3011688 - RNA, 17 nt, Human
guuaguaugaggcauuu

SEQ ID NO: 3011689 - RNA, 18 nt, Human
guuaaugauagcuacugu

SEQ ID NO: 3011690 - RNA, 18 nt, Human
guuaaucauuagguguga

SEQ ID NO: 3011691 - RNA, 15 nt, Human
guucagcuccagcuc

SEQ ID NO: 3011692 - RNA, 18 nt, Human
guucagcuccagcucacc

SEQ ID NO: 3011693 - RNA, 16 nt, Human
guucagcuccagcuca

SEQ ID NO: 3011694 - RNA, 17 nt, Human
guucagcuccagcucac

SEQ ID NO: 3011695 - RNA, 17 nt, Human
guucaggguuggccccu

SEQ ID NO: 3011696 - RNA, 18 nt, Human
guucaggguuggccccug

SEQ ID NO: 3011697 - RNA, 19 nt, Human
guucaggguuggccccugc

SEQ ID NO: 3011698 - RNA, 19 nt, Human
aagccuccuccagccgcca

SEQ ID NO: 3011699 - RNA, 17 nt, Human
aagcuaggccuggccag

SEQ ID NO: 3011700 - RNA, 18 nt, Human
aagcuaggccuggccaga

SEQ ID NO: 3011701 - RNA, 16 nt, Human
aagcuaggccuggcca

SEQ ID NO: 3011702 - RNA, 22 nt, Human
aagcuauucaguaauaacucua

SEQ ID NO: 3011703 - RNA, 20 nt, Human
guuccauggccucuucagau

SEQ ID NO: 3011704 - RNA, 16 nt, Human
guucccauuugcuccu

SEQ ID NO: 3011705 - RNA, 20 nt, Human
guucccauuugcuccuuucu

SEQ ID NO: 3011706 - RNA, 16 nt, Human
guucuacccaggugcu

SEQ ID NO: 3011707 - RNA, 22 nt, Human
guucccuuugacgccaucccag

SEQ ID NO: 3011708 - RNA, 21 nt, Human
guucccuuugacgccauccca

SEQ ID NO: 3011709 - RNA, 20 nt, Human
guucccuuugacgccauccc

SEQ ID NO: 3011710 - RNA, 23 nt, Human
guucugggacacaguucaauucu

SEQ ID NO: 3011711 - RNA, 21 nt, Human
guucuugguuuguaaauuaac

SEQ ID NO: 3011712 - RNA, 17 nt, Human
guucuuaguuugcaguu

SEQ ID NO: 3011713 - RNA, 22 nt, Human
guugaugaucuuugcagacagg

SEQ ID NO: 3011714 - RNA, 20 nt, Human
guuuaaugguaguuuuacag

SEQ ID NO: 3011715 - RNA, 13 nt, Human
guuggguggaugc

SEQ ID NO: 3011716 - RNA, 18 nt, Human
guuggucccccuuccaug

SEQ ID NO: 3011717 - RNA, 17 nt, Human
aaggaugcuuguacaua

SEQ ID NO: 3011718 - RNA, 19 nt, Human
aaggaugcuuguacauaau

SEQ ID NO: 3011719 - RNA, 18 nt, Human
aaggaugcacagaguugu

SEQ ID NO: 3011720 - RNA, 19 nt, Human
aaggaugcccaaagaugca

SEQ ID NO: 3011721 - RNA, 15 nt, Human
aaggaugcuuguaca

SEQ ID NO: 3011722 - RNA, 16 nt, Human
aaggaugcuuguacau

SEQ ID NO: 3011723 - RNA, 23 nt, Human
guugaugaucuuugcagacaggc

SEQ ID NO: 3011724 - RNA, 13 nt, Human
aaggauccugagc

SEQ ID NO: 3011725 - RNA, 14 nt, Human
aaggauccugagcc

SEQ ID NO: 3011726 - RNA, 23 nt, Human
aaggaugaucuaggaagacuuug

SEQ ID NO: 3011727 - RNA, 18 nt, Human
aaggaugaucuaggaaga

SEQ ID NO: 3011728 - RNA, 17 nt, Human
aaggauccugagccaga

SEQ ID NO: 3011729 - RNA, 15 nt, Human
aaggauccugagcca

SEQ ID NO: 3011730 - RNA, 19 nt, Human
aaggcuaccuuuguauucu

SEQ ID NO: 3011731 - RNA, 18 nt, Human
aaggccaaaggaagcaca

SEQ ID NO: 3011732 - RNA, 16 nt, Human
aaggccaaaggaagca

SEQ ID NO: 3011733 - RNA, 17 nt, Human
guugcccaggcaggucu

SEQ ID NO: 3011734 - RNA, 14 nt, Human
aaggcuccaggagc

SEQ ID NO: 3011735 - RNA, 18 nt, Human
guugcccaggcaggucuu

SEQ ID NO: 3011736 - RNA, 21 nt, Human
guugcccaggcuggcgugcag

SEQ ID NO: 3011737 - RNA, 15 nt, Human
guugcccaggcaggu

SEQ ID NO: 3011738 - RNA, 17 nt, Human
guugcccaggcuggcgu

SEQ ID NO: 3011739 - RNA, 14 nt, Human
guuuuacaguguuu

SEQ ID NO: 3011740 - RNA, 19 nt, Human
guuuucuguucuuucuggc

SEQ ID NO: 3011741 - RNA, 11 nt, Human
guuuucuguuc

SEQ ID NO: 3011742 - RNA, 22 nt, Human
guuugauucagacagcugccug

SEQ ID NO: 3011743 - RNA, 22 nt, Human
guuucuaaaggcuaccuuugua

SEQ ID NO: 3011744 - RNA, 23 nt, Human
guuucuaaaggcuaccuuuguau

SEQ ID NO: 3011745 - RNA, 13 nt, Human
guuugccucugcc

SEQ ID NO: 3011746 - RNA, 16 nt, Human
guuugccucugccucu

SEQ ID NO: 3011747 - RNA, 16 nt, Human
aaggguaucaggugcu

SEQ ID NO: 3011748 - RNA, 15 nt, Human
aaguaauaugcacac

SEQ ID NO: 3011749 - RNA, 16 nt, Human
aaguaauaugcacaca

SEQ ID NO: 3011750 - RNA, 20 nt, Human
guuucuaaagcugccagccg

SEQ ID NO: 3011751 - RNA, 19 nt, Human
guuucuaaaggcuaccuuu

SEQ ID NO: 3011752 - RNA, 12 nt, Human
aaguaauaugca

SEQ ID NO: 3011753 - RNA, 22 nt, Human
aaggggaauguuugccucugcc

SEQ ID NO: 3011754 - RNA, 23 nt, Human
aaggggaauguuugccucugccu

SEQ ID NO: 3011755 - RNA, 17 nt, Human
aagggccuggccugagc

SEQ ID NO: 3011756 - RNA, 14 nt, Human
aagggccuggccug

SEQ ID NO: 3011757 - RNA, 19 nt, Human
aagggccuggccugagcug

SEQ ID NO: 3011758 - RNA, 13 nt, Human
aagggccuggccu

SEQ ID NO: 3011759 - RNA, 16 nt, Human
aaccccaaguuaguuc

SEQ ID NO: 3011760 - RNA, 17 nt, Human
aacccagcucuggucca

SEQ ID NO: 3011761 - RNA, 11 nt, Human
aacccagcucu

SEQ ID NO: 3011762 - RNA, 14 nt, Human
aacccagcucuggu

SEQ ID NO: 3011763 - RNA, 13 nt, Human
aacccagcucugg

SEQ ID NO: 3011764 - RNA, 23 nt, Human
aaccauuuugcugucccuuuucc

SEQ ID NO: 3011765 - RNA, 17 nt, Human
aaccuccgccucuuggg

SEQ ID NO: 3011766 - RNA, 14 nt, Human
aaccuccugggcua

SEQ ID NO: 3011767 - RNA, 13 nt, Human
aacccccagccug

SEQ ID NO: 3011768 - RNA, 14 nt, Human
aacccccagccugc

SEQ ID NO: 3011769 - RNA, 15 nt, Human
aacccccagccugcu

SEQ ID NO: 3011770 - RNA, 16 nt, Human
aacauuuugucauaua

SEQ ID NO: 3011771 - RNA, 13 nt, Human
gucuccauguuug

SEQ ID NO: 3011772 - RNA, 20 nt, Human
aaccacaucuugcucugcug

SEQ ID NO: 3011773 - RNA, 22 nt, Human
aaccacaucuugcucugcugac

SEQ ID NO: 3011774 - RNA, 20 nt, Human
aaccaucauugaaaucuuuu

SEQ ID NO: 3011775 - RNA, 19 nt, Human
aaccaucauugaaaucuuu

SEQ ID NO: 3011776 - RNA, 21 nt, Human
aaccaucauugaaaucuuuuu

SEQ ID NO: 3011777 - RNA, 18 nt, Human
aaccacaucuugcucugc

SEQ ID NO: 3011778 - RNA, 15 nt, Human
aacguggcugcuuca

SEQ ID NO: 3011779 - RNA, 19 nt, Human
aacguggcugcuucaagga

SEQ ID NO: 3011780 - RNA, 16 nt, Human
aacguggcugcuucaa

SEQ ID NO: 3011781 - RNA, 22 nt, Human
aacguggcugcuucaaggaucc

SEQ ID NO: 3011782 - RNA, 19 nt, Human
gugaaccaccacacccagc

SEQ ID NO: 3011783 - RNA, 15 nt, Human
gucuuagauguauau

SEQ ID NO: 3011784 - RNA, 24 nt, Human
gucuuuucuugcaugaggcuagug

SEQ ID NO: 3011785 - RNA, 19 nt, Human
gucuuuucuugcaugaggc

SEQ ID NO: 3011786 - RNA, 14 nt, Human
gucuuuucuugcau

SEQ ID NO: 3011787 - RNA, 17 nt, Human
gucuuuggacccugagg

SEQ ID NO: 3011788 - RNA, 15 nt, Human
gucuuuggacccuga

SEQ ID NO: 3011789 - RNA, 14 nt, Human
gucuuuggacccug

SEQ ID NO: 3011790 - RNA, 18 nt, Human
aacacugguuuuaaauau

SEQ ID NO: 3011791 - RNA, 22 nt, Human
aacacugguuuuaaauauuuug

SEQ ID NO: 3011792 - RNA, 20 nt, Human
aacacuguucucugcccucc

SEQ ID NO: 3011793 - RNA, 15 nt, Human
aacacuguucucugc

SEQ ID NO: 3011794 - RNA, 21 nt, Human
aacacucuauaacaaaggaua

SEQ ID NO: 3011795 - RNA, 14 nt, Human
aacacucugagacu

SEQ ID NO: 3011796 - RNA, 13 nt, Human
aacacucugagac

SEQ ID NO: 3011797 - RNA, 12 nt, Human
aacacucugaga

SEQ ID NO: 3011798 - RNA, 11 nt, Human
aacacucugag

SEQ ID NO: 3011799 - RNA, 12 nt, Human
aacacuccuuca

SEQ ID NO: 3011800 - RNA, 21 nt, Human
aacacucauugaccugaggcc

SEQ ID NO: 3011801 - RNA, 17 nt, Human
aacacucauugaccuga

SEQ ID NO: 3011802 - RNA, 21 nt, Human
aacacuguucucugcccucca

SEQ ID NO: 3011803 - RNA, 21 nt, Human
gucauuugagcagggcucagc

SEQ ID NO: 3011804 - RNA, 22 nt, Human
gucauuugagcagggcucagcg

SEQ ID NO: 3011805 - RNA, 23 nt, Human
aacaaggcaaggcugucaauuac

SEQ ID NO: 3011806 - RNA, 16 nt, Human
gucacaggcaggucca

SEQ ID NO: 3011807 - RNA, 13 nt, Human
gucacaggcaggu

SEQ ID NO: 3011808 - RNA, 15 nt, Human
gucacaggcaggucc

SEQ ID NO: 3011809 - RNA, 19 nt, Human
aacaagaccacguuucuaa

SEQ ID NO: 3011810 - RNA, 16 nt, Human
aacaagaccacguuuc

SEQ ID NO: 3011811 - RNA, 17 nt, Human
aacaagaccacguuucu

SEQ ID NO: 3011812 - RNA, 22 nt, Human
aacauuuauuugaguggaguua

SEQ ID NO: 3011813 - RNA, 15 nt, Human
aacauacucccaucu

SEQ ID NO: 3011814 - RNA, 14 nt, Human
aacauacucccauc

SEQ ID NO: 3011815 - RNA, 15 nt, Human
aacaguaacauagcu

SEQ ID NO: 3011816 - RNA, 19 nt, Human
aacagguuuuccugaagaa

SEQ ID NO: 3011817 - RNA, 23 nt, Human
aacaggcugggcuucaguggcag

SEQ ID NO: 3011818 - RNA, 19 nt, Human
aacagacuggaagcacagc

SEQ ID NO: 3011819 - RNA, 22 nt, Human
aacaggcugggcuucaguggca

SEQ ID NO: 3011820 - RNA, 13 nt, Human
aacaggcugggcu

SEQ ID NO: 3011821 - RNA, 22 nt, Human
aacaguaacauagcugugauuu

SEQ ID NO: 3011822 - RNA, 13 nt, Human
guccgagcuuuga

SEQ ID NO: 3011823 - RNA, 21 nt, Human
guccggucccugucccagugc

SEQ ID NO: 3011824 - RNA, 21 nt, Human
aacagaaauguacagcaagga

SEQ ID NO: 3011825 - RNA, 10 nt, Human
aacagaaaug

SEQ ID NO: 3011826 - RNA, 15 nt, Human
aacagaaauguacag

SEQ ID NO: 3011827 - RNA, 15 nt, Human
aaaugauuucacagu

SEQ ID NO: 3011828 - RNA, 14 nt, Human
aaaugcaccuggaa

SEQ ID NO: 3011829 - RNA, 18 nt, Human
aaaugcaccuggaauaua

SEQ ID NO: 3011830 - RNA, 22 nt, Human
aaaugcaccuggaauauauaac

SEQ ID NO: 3011831 - RNA, 15 nt, Human
aaaugggcagagcag

SEQ ID NO: 3011832 - RNA, 20 nt, Human
aaaugggcagagcagagacc

SEQ ID NO: 3011833 - RNA, 18 nt, Human
aaaugggcagagcagaga

SEQ ID NO: 3011834 - RNA, 13 nt, Human
aaaugcccagccc

SEQ ID NO: 3011835 - RNA, 15 nt, Human
aaaugcccagccccu

SEQ ID NO: 3011836 - RNA, 14 nt, Human
aaaugcccagcccc

SEQ ID NO: 3011837 - RNA, 18 nt, Human
aaaugcccagccccuucu

SEQ ID NO: 3011838 - RNA, 13 nt, Human
aaaugcccagcuu

SEQ ID NO: 3011839 - RNA, 19 nt, Human
aaaugagccuggcaagaau

SEQ ID NO: 3011840 - RNA, 13 nt, Human
aaaugagccuggc

SEQ ID NO: 3011841 - RNA, 17 nt, Human
aaaugaggucagagccu

SEQ ID NO: 3011842 - RNA, 19 nt, Human
aaaugaggucagagccugc

SEQ ID NO: 3011843 - RNA, 16 nt, Human
aaaugagguacucucc

SEQ ID NO: 3011844 - RNA, 23 nt, Human
aaaugagguacucuccuggaaau

SEQ ID NO: 3011845 - RNA, 15 nt, Human
aaaggauacuuauuu

SEQ ID NO: 3011846 - RNA, 17 nt, Human
aaaggauacuuauuuaa

SEQ ID NO: 3011847 - RNA, 12 nt, Human
guagcugggacu

SEQ ID NO: 3011848 - RNA, 18 nt, Human
guagcugggacuacaggc

SEQ ID NO: 3011849 - RNA, 19 nt, Human
guagcugggacuacaggca

SEQ ID NO: 3011850 - RNA, 21 nt, Human
guagcugggacuacaggcacc

SEQ ID NO: 3011851 - RNA, 15 nt, Human
guaggaagacuuugg

SEQ ID NO: 3011852 - RNA, 18 nt, Human
guaggaagguuaauguuc

SEQ ID NO: 3011853 - RNA, 17 nt, Human
aaaugaaaaucgugaca

SEQ ID NO: 3011854 - RNA, 15 nt, Human
aaaucucaaauuucu

SEQ ID NO: 3011855 - RNA, 16 nt, Human
aaaucucaaauuucua

SEQ ID NO: 3011856 - RNA, 17 nt, Human
aaaucucaaauuucuaa

SEQ ID NO: 3011857 - RNA, 13 nt, Human
aaaucgaugcagu

SEQ ID NO: 3011858 - RNA, 18 nt, Human
aaaucccuuaccucggug

SEQ ID NO: 3011859 - RNA, 15 nt, Human
aaaucccauuuaaaa

SEQ ID NO: 3011860 - RNA, 13 nt, Human
gucaacauuucuc

SEQ ID NO: 3011861 - RNA, 17 nt, Human
gucaacauuucucaugu

SEQ ID NO: 3011862 - RNA, 16 nt, Human
gucacacacuuuggcu

SEQ ID NO: 3011863 - RNA, 20 nt, Human
gucacacaguauuacuucug

SEQ ID NO: 3011864 - RNA, 17 nt, Human
guauuuuuuuacuaaua

SEQ ID NO: 3011865 - RNA, 21 nt, Human
guauuuuuuuacuaauagaca

SEQ ID NO: 3011866 - RNA, 18 nt, Human
gucaaaguggugagaggc

SEQ ID NO: 3011867 - RNA, 19 nt, Human
gucaaaguggugagaggca

SEQ ID NO: 3011868 - RNA, 20 nt, Human
aaauuuacuuuaaacuacau

SEQ ID NO: 3011869 - RNA, 17 nt, Human
aaauuuacuuuaaacua

SEQ ID NO: 3011870 - RNA, 14 nt, Human
guauuuuuuuacua

SEQ ID NO: 3011871 - RNA, 15 nt, Human
guauuuuuuuacuaa

SEQ ID NO: 3011872 - RNA, 14 nt, Human
aaauucaugcugcu

SEQ ID NO: 3011873 - RNA, 16 nt, Human
aaauuccccacccuga

SEQ ID NO: 3011874 - RNA, 22 nt, Human
guauuggcuagagguucaaaga

SEQ ID NO: 3011875 - RNA, 19 nt, Human
aaauuaacuuuuauaaacu

SEQ ID NO: 3011876 - RNA, 21 nt, Human
aaauuaacuuuuauaaacuuu

SEQ ID NO: 3011877 - RNA, 22 nt, Human
aaauuaacuuuuauaaacuuua

SEQ ID NO: 3011878 - RNA, 23 nt, Human
aaauuaacuuuuauaaacuuuac

SEQ ID NO: 3011879 - RNA, 17 nt, Human
aaaugggggugcauuug

SEQ ID NO: 3011880 - RNA, 18 nt, Human
aaaugggggugcauuuga

SEQ ID NO: 3011881 - RNA, 15 nt, Human
aaaugggggugcauu

SEQ ID NO: 3011882 - RNA, 16 nt, Human
aaaugggggugcauuu

SEQ ID NO: 3011883 - RNA, 15 nt, Human
guaugggagagaaga

SEQ ID NO: 3011884 - RNA, 15 nt, Human
guauucuuauuuaau

SEQ ID NO: 3011885 - RNA, 21 nt, Human
guauucucuccuguaccucuu

SEQ ID NO: 3011886 - RNA, 15 nt, Human
guaucccuacuguaa

SEQ ID NO: 3011887 - RNA, 22 nt, Human
guaugaucacggcucacugcag

SEQ ID NO: 3011888 - RNA, 21 nt, Human
guaucccaugagccucagcau

SEQ ID NO: 3011889 - RNA, 14 nt, Human
guaugggagagaag

SEQ ID NO: 3011890 - RNA, 22 nt, Human
cugcugauuuaaacacauuaaa

SEQ ID NO: 3011891 - RNA, 16 nt, Human
cugcugauuuaaacac

SEQ ID NO: 3011892 - RNA, 14 nt, Human
cugcucacauaucu

SEQ ID NO: 3011893 - RNA, 12 nt, Human
cugcugaaggcu

SEQ ID NO: 3011894 - RNA, 16 nt, Human
cugcucacauaucugu

SEQ ID NO: 3011895 - RNA, 19 nt, Human
cugcucacauaucugucau

SEQ ID NO: 3011896 - RNA, 13 nt, Human
cugcugacagugu

SEQ ID NO: 3011897 - RNA, 15 nt, Human
cugcugacaguguug

SEQ ID NO: 3011898 - RNA, 11 nt, Human
cugcugacagu

SEQ ID NO: 3011899 - RNA, 12 nt, Human
cugcugacagug

SEQ ID NO: 3011900 - RNA, 15 nt, Human
cugcugaaggcucga

SEQ ID NO: 3011901 - RNA, 14 nt, Human
cugcugaaggcucg

SEQ ID NO: 3011902 - RNA, 13 nt, Human
cugcugaaggcuc

SEQ ID NO: 3011903 - RNA, 20 nt, Human
cugcuuaacuucacauauug

SEQ ID NO: 3011904 - RNA, 20 nt, Human
cugcuuauccguuagccgug

SEQ ID NO: 3011905 - RNA, 15 nt, Human
cuggaguucugguuc

SEQ ID NO: 3011906 - RNA, 17 nt, Human
cuggaguucugguuccu

SEQ ID NO: 3011907 - RNA, 16 nt, Human
cuggaguucugguucc

SEQ ID NO: 3011908 - RNA, 22 nt, Human
cuggaugcagccucacaguccu

SEQ ID NO: 3011909 - RNA, 12 nt, Human
cuggcccuuccu

SEQ ID NO: 3011910 - RNA, 22 nt, Human
cuggcuaugcauuugaaaauuu

SEQ ID NO: 3011911 - RNA, 15 nt, Human
cuggcuaugcauuug

SEQ ID NO: 3011912 - RNA, 16 nt, Human
cuggcuaugcauuuga

SEQ ID NO: 3011913 - RNA, 13 nt, Human
cuggcuaugcauu

SEQ ID NO: 3011914 - RNA, 14 nt, Human
cuggcuaugcauuu

SEQ ID NO: 3011915 - RNA, 13 nt, Human
cugggacuacagg

SEQ ID NO: 3011916 - RNA, 15 nt, Human
cugggacuacaggca

SEQ ID NO: 3011917 - RNA, 22 nt, Human
cugggagaaccaaaaagaggcu

SEQ ID NO: 3011918 - RNA, 14 nt, Human
cugggacaugggaa

SEQ ID NO: 3011919 - RNA, 22 nt, Human
cugggacaugggaaaggggaag

SEQ ID NO: 3011920 - RNA, 18 nt, Human
cugggacaugggaaaggg

SEQ ID NO: 3011921 - RNA, 15 nt, Human
cuggguguggcgcag

SEQ ID NO: 3011922 - RNA, 21 nt, Human
cuggguggcaccagcagccug

SEQ ID NO: 3011923 - RNA, 14 nt, Human
cuggguguggcgca

SEQ ID NO: 3011924 - RNA, 12 nt, Human
cugggcagagga

SEQ ID NO: 3011925 - RNA, 16 nt, Human
cugggcagaggaaagc

SEQ ID NO: 3011926 - RNA, 13 nt, Human
cugggcagaggaa

SEQ ID NO: 3011927 - RNA, 20 nt, Human
cugggcagaggaaagcaaag

SEQ ID NO: 3011928 - RNA, 20 nt, Human
cugggcagguuggugggggc

SEQ ID NO: 3011929 - RNA, 20 nt, Human
cuggguggcaccagcagccu

SEQ ID NO: 3011930 - RNA, 18 nt, Human
cuggguggcaccagcagc

SEQ ID NO: 3011931 - RNA, 13 nt, Human
cuggggagaaagu

SEQ ID NO: 3011932 - RNA, 14 nt, Human
cugcauuuaaaaga

SEQ ID NO: 3011933 - RNA, 13 nt, Human
cugcauuggcuuu

SEQ ID NO: 3011934 - RNA, 19 nt, Human
cugcccugugggcccccaa

SEQ ID NO: 3011935 - RNA, 12 nt, Human
cugcccuuaccu

SEQ ID NO: 3011936 - RNA, 17 nt, Human
cugcccuuaccugccag

SEQ ID NO: 3011937 - RNA, 16 nt, Human
cugcccuuaccugcca

SEQ ID NO: 3011938 - RNA, 12 nt, Human
cugccauccagg

SEQ ID NO: 3011939 - RNA, 16 nt, Human
cugccauauucuguug

SEQ ID NO: 3011940 - RNA, 16 nt, Human
cugccauccagguuca

SEQ ID NO: 3011941 - RNA, 18 nt, Human
cugccauccagguucagc

SEQ ID NO: 3011942 - RNA, 19 nt, Human
cugccauccagguucagcu

SEQ ID NO: 3011943 - RNA, 23 nt, Human
cugccagggacagaggggguggc

SEQ ID NO: 3011944 - RNA, 22 nt, Human
cugccagggacagagggggugg

SEQ ID NO: 3011945 - RNA, 20 nt, Human
cugccagggacagagggggu

SEQ ID NO: 3011946 - RNA, 17 nt, Human
cugcauuuaaaagauac

SEQ ID NO: 3011947 - RNA, 22 nt, Human
cugcaaccugauugugucucuu

SEQ ID NO: 3011948 - RNA, 18 nt, Human
cugcaagaauugaagcag

SEQ ID NO: 3011949 - RNA, 20 nt, Human
cugcaaccuccgccucuugg

SEQ ID NO: 3011950 - RNA, 22 nt, Human
cugcaaccuccgccucuugggu

SEQ ID NO: 3011951 - RNA, 14 nt, Human
cugcaaccugauug

SEQ ID NO: 3011952 - RNA, 21 nt, Human
cugcaaccugauugugucucu

SEQ ID NO: 3011953 - RNA, 19 nt, Human
cugcaaccugauugugucu

SEQ ID NO: 3011954 - RNA, 20 nt, Human
cugcaccgggccacagagaa

SEQ ID NO: 3011955 - RNA, 23 nt, Human
cugcaccgggccacagagaaagu

SEQ ID NO: 3011956 - RNA, 12 nt, Human
cugcaagggagu

SEQ ID NO: 3011957 - RNA, 20 nt, Human
cugcaagaauugaagcagga

SEQ ID NO: 3011958 - RNA, 24 nt, Human
cugaugggcaacccccagccugcu

SEQ ID NO: 3011959 - RNA, 22 nt, Human
cugaugggcaacccccagccug

SEQ ID NO: 3011960 - RNA, 23 nt, Human
cugaugggcaacccccagccugc

SEQ ID NO: 3011961 - RNA, 21 nt, Human
cugcaaaggguaucaggugcu

SEQ ID NO: 3011962 - RNA, 22 nt, Human
cugcaaaggguaucaggugcug

SEQ ID NO: 3011963 - RNA, 20 nt, Human
cugaugcuucuucagagacu

SEQ ID NO: 3011964 - RNA, 19 nt, Human
cugaugcuucuucagagac

SEQ ID NO: 3011965 - RNA, 18 nt, Human
cugaugcuucuucagaga

SEQ ID NO: 3011966 - RNA, 18 nt, Human
cugaugggcaacccccag

SEQ ID NO: 3011967 - RNA, 21 nt, Human
cugaugggcaacccccagccu

SEQ ID NO: 3011968 - RNA, 15 nt, Human
cucuuaugggcuggg

SEQ ID NO: 3011969 - RNA, 14 nt, Human
cucuuaugggcugg

SEQ ID NO: 3011970 - RNA, 17 nt, Human
cugaugcuucuucagag

SEQ ID NO: 3011971 - RNA, 16 nt, Human
cugaugcuucuucaga

SEQ ID NO: 3011972 - RNA, 12 nt, Human
cugcagcuuugu

SEQ ID NO: 3011973 - RNA, 20 nt, Human
cugcaggcagccaggccaca

SEQ ID NO: 3011974 - RNA, 19 nt, Human
cugcaggcagccaggccac

SEQ ID NO: 3011975 - RNA, 18 nt, Human
cugcaggcagccaggcca

SEQ ID NO: 3011976 - RNA, 17 nt, Human
cugcaggcagccaggcc

SEQ ID NO: 3011977 - RNA, 16 nt, Human
cugcaggcagccaggc

SEQ ID NO: 3011978 - RNA, 15 nt, Human
cugcaggcagccagg

SEQ ID NO: 3011979 - RNA, 14 nt, Human
cugcaggcagccag

SEQ ID NO: 3011980 - RNA, 13 nt, Human
cugcaggcagcca

SEQ ID NO: 3011981 - RNA, 23 nt, Human
cugcagccucaaccuccugggcu

SEQ ID NO: 3011982 - RNA, 19 nt, Human
cugcacuccagccugggug

SEQ ID NO: 3011983 - RNA, 24 nt, Human
cugcagccucaaccuccugggcua

SEQ ID NO: 3011984 - RNA, 18 nt, Human
cugcacuccagccugggu

SEQ ID NO: 3011985 - RNA, 16 nt, Human
cugcacuccagccugg

SEQ ID NO: 3011986 - RNA, 17 nt, Human
cugcacuccagccuggg

SEQ ID NO: 3011987 - RNA, 16 nt, Human
cugcacuauagccuag

SEQ ID NO: 3011988 - RNA, 17 nt, Human
cugcacuauagccuagg

SEQ ID NO: 3011989 - RNA, 18 nt, Human
cugcacuauagccuaggu

SEQ ID NO: 3011990 - RNA, 20 nt, Human
cugcacuauagccuagguga

SEQ ID NO: 3011991 - RNA, 22 nt, Human
cugcacuauagccuaggugaca

SEQ ID NO: 3011992 - RNA, 23 nt, Human
cugcacuauagccuaggugacag

SEQ ID NO: 3011993 - RNA, 13 nt, Human
cugcacuccagcc

SEQ ID NO: 3011994 - RNA, 15 nt, Human
cugcacuccagccug

SEQ ID NO: 3011995 - RNA, 13 nt, Human
cuuggcccaggag

SEQ ID NO: 3011996 - RNA, 12 nt, Human
cuugcucugcug

SEQ ID NO: 3011997 - RNA, 23 nt, Human
cuugccgucuaccugaggggccu

SEQ ID NO: 3011998 - RNA, 12 nt, Human
cuugacagggca

SEQ ID NO: 3011999 - RNA, 20 nt, Human
cuugccgucuaccugagggg

SEQ ID NO: 3012000 - RNA, 23 nt, Human
cuugaaugaugccaugaggaaca

SEQ ID NO: 3012001 - RNA, 20 nt, Human
cuugaaugaugccaugagga

SEQ ID NO: 3012002 - RNA, 22 nt, Human
cuucuucagagacuccugcagg

SEQ ID NO: 3012003 - RNA, 18 nt, Human
cuucuucagagacuccug

SEQ ID NO: 3012004 - RNA, 21 nt, Human
cuucuucagagacuccugcag

SEQ ID NO: 3012005 - RNA, 20 nt, Human
cuucuucagagacuccugca

SEQ ID NO: 3012006 - RNA, 22 nt, Human
cuuucaauaggaaaaacugauu

SEQ ID NO: 3012007 - RNA, 21 nt, Human
cuuucaauaggaaaaacugau

SEQ ID NO: 3012008 - RNA, 20 nt, Human
cuuucaauaggaaaaacuga

SEQ ID NO: 3012009 - RNA, 18 nt, Human
cuuucaauaggaaaaacu

SEQ ID NO: 3012010 - RNA, 13 nt, Human
cuuguggacacag

SEQ ID NO: 3012011 - RNA, 14 nt, Human
cuuguggacacagc

SEQ ID NO: 3012012 - RNA, 15 nt, Human
cuuguggacacagcu

SEQ ID NO: 3012013 - RNA, 22 nt, Human
cuuugacgccaucccagcccca

SEQ ID NO: 3012014 - RNA, 21 nt, Human
cuuugacgccaucccagcccc

SEQ ID NO: 3012015 - RNA, 19 nt, Human
cuuugacgccaucccagcc

SEQ ID NO: 3012016 - RNA, 18 nt, Human
cuuugacgccaucccagc

SEQ ID NO: 3012017 - RNA, 15 nt, Human
cuuuucaaaacauuu

SEQ ID NO: 3012018 - RNA, 20 nt, Human
cuuuggucuacacugugcug

SEQ ID NO: 3012019 - RNA, 16 nt, Human
cuuuggucuacacugu

SEQ ID NO: 3012020 - RNA, 14 nt, Human
cuuuuauaaacuuu

SEQ ID NO: 3012021 - RNA, 16 nt, Human
cuuuuauaaacuuuac

SEQ ID NO: 3012022 - RNA, 18 nt, Human
cuuuuauaaacuuuaccu

SEQ ID NO: 3012023 - RNA, 15 nt, Human
cuuuuauaaacuuua

SEQ ID NO: 3012024 - RNA, 19 nt, Human
cugugucagguggggcagc

SEQ ID NO: 3012025 - RNA, 20 nt, Human
cugugucagcauagaaguaa

SEQ ID NO: 3012026 - RNA, 21 nt, Human
cugugucagguggggcagcuu

SEQ ID NO: 3012027 - RNA, 14 nt, Human
cugugucuugcaau

SEQ ID NO: 3012028 - RNA, 19 nt, Human
cugugucucccuucauccu

SEQ ID NO: 3012029 - RNA, 14 nt, Human
cugugucucccuuc

SEQ ID NO: 3012030 - RNA, 19 nt, Human
cugugcugagucugaaggc

SEQ ID NO: 3012031 - RNA, 11 nt, Human
cugugcugccc

SEQ ID NO: 3012032 - RNA, 22 nt, Human
cugugcugagucugaaggcugg

SEQ ID NO: 3012033 - RNA, 20 nt, Human
cugugcugagucugaaggcu

SEQ ID NO: 3012034 - RNA, 13 nt, Human
cuguucagcucca

SEQ ID NO: 3012035 - RNA, 16 nt, Human
cugugucuugcaaugg

SEQ ID NO: 3012036 - RNA, 19 nt, Human
cugugucuugcaauggcag

SEQ ID NO: 3012037 - RNA, 19 nt, Human
cuuagauguauauauuucc

SEQ ID NO: 3012038 - RNA, 21 nt, Human
cuuaccucggugccuuccucu

SEQ ID NO: 3012039 - RNA, 19 nt, Human
cuuaccucggugccuuccu

SEQ ID NO: 3012040 - RNA, 13 nt, Human
cuuaccucggugc

SEQ ID NO: 3012041 - RNA, 17 nt, Human
cuuacccucauguucuu

SEQ ID NO: 3012042 - RNA, 18 nt, Human
cuuacccucauguucuua

SEQ ID NO: 3012043 - RNA, 19 nt, Human
cuuacccucauguucuuaa

SEQ ID NO: 3012044 - RNA, 16 nt, Human
cuguugggccaggagc

SEQ ID NO: 3012045 - RNA, 20 nt, Human
cuguugggccaggagccucc

SEQ ID NO: 3012046 - RNA, 17 nt, Human
cuguugggccaggagcc

SEQ ID NO: 3012047 - RNA, 13 nt, Human
cuuacacaauggu

SEQ ID NO: 3012048 - RNA, 17 nt, Human
cuuccauggacuuuguu

SEQ ID NO: 3012049 - RNA, 16 nt, Human
cuuccauggacuuugu

SEQ ID NO: 3012050 - RNA, 20 nt, Human
cuuccagugaggcucugccc

SEQ ID NO: 3012051 - RNA, 19 nt, Human
cuuccagugaggcucugcc

SEQ ID NO: 3012052 - RNA, 17 nt, Human
cuuccagugaggcucug

SEQ ID NO: 3012053 - RNA, 18 nt, Human
cuuccagugaggcucugc

SEQ ID NO: 3012054 - RNA, 14 nt, Human
cuucaccuuugucc

SEQ ID NO: 3012055 - RNA, 18 nt, Human
cuuauugcccacgcugga

SEQ ID NO: 3012056 - RNA, 20 nt, Human
cuucaccuuuguccccaccg

SEQ ID NO: 3012057 - RNA, 17 nt, Human
cuucaccuuugucccca

SEQ ID NO: 3012058 - RNA, 22 nt, Human
cuucagagacuccugcaggcag

SEQ ID NO: 3012059 - RNA, 21 nt, Human
cuucagagacuccugcaggca

SEQ ID NO: 3012060 - RNA, 16 nt, Human
cuucagagacuccugc

SEQ ID NO: 3012061 - RNA, 15 nt, Human
cuucauccuccucag

SEQ ID NO: 3012062 - RNA, 13 nt, Human
cuucaucccucug

SEQ ID NO: 3012063 - RNA, 18 nt, Human
cuucaguggcagcugcuu

SEQ ID NO: 3012064 - RNA, 23 nt, Human
cuucagagacuccugcaggcagc

SEQ ID NO: 3012065 - RNA, 16 nt, Human
cuucauccuccucaga

SEQ ID NO: 3012066 - RNA, 21 nt, Human
cuuauggaacacucugagacu

SEQ ID NO: 3012067 - RNA, 21 nt, Human
cuuaugggcuggguucuaccc

SEQ ID NO: 3012068 - RNA, 14 nt, Human
cuuaugggcugggu

SEQ ID NO: 3012069 - RNA, 23 nt, Human
cuuaugggcuggguucuacccag

SEQ ID NO: 3012070 - RNA, 22 nt, Human
cuuaugggcuggguucuaccca

SEQ ID NO: 3012071 - RNA, 12 nt, Human
cuuauugcccac

SEQ ID NO: 3012072 - RNA, 13 nt, Human
cuuauugcccacg

SEQ ID NO: 3012073 - RNA, 18 nt, Human
cuuagcagggaaacagcu

SEQ ID NO: 3012074 - RNA, 13 nt, Human
gacucuucccuca

SEQ ID NO: 3012075 - RNA, 19 nt, Human
gacucugucucaaaaaaac

SEQ ID NO: 3012076 - RNA, 14 nt, Human
gacugaauuucuuu

SEQ ID NO: 3012077 - RNA, 15 nt, Human
gacgccaucccagcc

SEQ ID NO: 3012078 - RNA, 18 nt, Human
gacgccaucccagcccca

SEQ ID NO: 3012079 - RNA, 17 nt, Human
gacgccaucccagcccc

SEQ ID NO: 3012080 - RNA, 19 nt, Human
gacgcuacccgggaagggg

SEQ ID NO: 3012081 - RNA, 18 nt, Human
gacgcuacccgggaaggg

SEQ ID NO: 3012082 - RNA, 16 nt, Human
gacgcuacccgggaag

SEQ ID NO: 3012083 - RNA, 16 nt, Human
gacgccaucccagccc

SEQ ID NO: 3012084 - RNA, 14 nt, Human
gaccugaggcccuu

SEQ ID NO: 3012085 - RNA, 13 nt, Human
gaccugaggcccu

SEQ ID NO: 3012086 - RNA, 11 nt, Human
gaccugaggcc

SEQ ID NO: 3012087 - RNA, 20 nt, Human
gaccaucccugaaggccccg

SEQ ID NO: 3012088 - RNA, 13 nt, Human
gaccucugccuga

SEQ ID NO: 3012089 - RNA, 14 nt, Human
gaccucugcagcaa

SEQ ID NO: 3012090 - RNA, 12 nt, Human
gacauucccugc

SEQ ID NO: 3012091 - RNA, 19 nt, Human
gacagcccgggcucugccu

SEQ ID NO: 3012092 - RNA, 18 nt, Human
gacagcccgggcucugcc

SEQ ID NO: 3012093 - RNA, 14 nt, Human
gacauugacuauuu

SEQ ID NO: 3012094 - RNA, 22 nt, Human
gacauugacuauuuuuguuuuu

SEQ ID NO: 3012095 - RNA, 14 nt, Human
gacauugcggacag

SEQ ID NO: 3012096 - RNA, 15 nt, Human
gacauugcggacagc

SEQ ID NO: 3012097 - RNA, 19 nt, Human
gacauuguuggccaaagcc

SEQ ID NO: 3012098 - RNA, 18 nt, Human
gaccagggauuuccauga

SEQ ID NO: 3012099 - RNA, 20 nt, Human
gaccagggauuuccaugaug

SEQ ID NO: 3012100 - RNA, 19 nt, Human
gaccaucccugaaggcccc

SEQ ID NO: 3012101 - RNA, 18 nt, Human
gaccaucccugaaggccc

SEQ ID NO: 3012102 - RNA, 13 nt, Human
gaccaucccugaa

SEQ ID NO: 3012103 - RNA, 12 nt, Human
gaccaucccuga

SEQ ID NO: 3012104 - RNA, 17 nt, Human
gacagcccgggcucugc

SEQ ID NO: 3012105 - RNA, 22 nt, Human
gacacagcucuucuccaggcug

SEQ ID NO: 3012106 - RNA, 23 nt, Human
gacacagcucuucuccaggcugu

SEQ ID NO: 3012107 - RNA, 13 nt, Human
gacacagcucuuc

SEQ ID NO: 3012108 - RNA, 14 nt, Human
gacacagcucuucu

SEQ ID NO: 3012109 - RNA, 16 nt, Human
gacacagcucuucucc

SEQ ID NO: 3012110 - RNA, 16 nt, Human
gaaguucuauuuauuu

SEQ ID NO: 3012111 - RNA, 22 nt, Human
gaaggggagauaaggguaucug

SEQ ID NO: 3012112 - RNA, 15 nt, Human
gaauauugcugaugg

SEQ ID NO: 3012113 - RNA, 14 nt, Human
gaauauugcugaug

SEQ ID NO: 3012114 - RNA, 20 nt, Human
gaauauugcugauggugcaa

SEQ ID NO: 3012115 - RNA, 19 nt, Human
gaauauugcugauggugca

SEQ ID NO: 3012116 - RNA, 19 nt, Human
gaagcuccgcuuucuaccc

SEQ ID NO: 3012117 - RNA, 22 nt, Human
gaagcuccgcuuucuacccagc

SEQ ID NO: 3012118 - RNA, 17 nt, Human
gaaggccccgcccaggc

SEQ ID NO: 3012119 - RNA, 21 nt, Human
gaaggcucgagcaugccugga

SEQ ID NO: 3012120 - RNA, 19 nt, Human
gaaggccccgcccaggcuu

SEQ ID NO: 3012121 - RNA, 18 nt, Human
gaaggccccgcccaggcu

SEQ ID NO: 3012122 - RNA, 19 nt, Human
gaaggcucgagcaugccug

SEQ ID NO: 3012123 - RNA, 19 nt, Human
gaaggcuggguucugaucc

SEQ ID NO: 3012124 - RNA, 15 nt, Human
gaaggcuggguucug

SEQ ID NO: 3012125 - RNA, 22 nt, Human
gaaggcuggguucugauccuag

SEQ ID NO: 3012126 - RNA, 20 nt, Human
gaaggcuggguucugauccu

SEQ ID NO: 3012127 - RNA, 12 nt, Human
gaagcagagugg

SEQ ID NO: 3012128 - RNA, 11 nt, Human
gaagcagagug

SEQ ID NO: 3012129 - RNA, 15 nt, Human
gaagcagaggaagga

SEQ ID NO: 3012130 - RNA, 14 nt, Human
gaagcacaugccuc

SEQ ID NO: 3012131 - RNA, 15 nt, Human
gaagcacaugccucu

SEQ ID NO: 3012132 - RNA, 20 nt, Human
gaagcacaugccucucucag

SEQ ID NO: 3012133 - RNA, 17 nt, Human
gaagcacaugccucucu

SEQ ID NO: 3012134 - RNA, 16 nt, Human
gaagacaaugacuuac

SEQ ID NO: 3012135 - RNA, 22 nt, Human
gaagacaaugacuuacuguaca

SEQ ID NO: 3012136 - RNA, 23 nt, Human
gaagacaaugugaaaagaaaaau

SEQ ID NO: 3012137 - RNA, 23 nt, Human
gaagauuuugaaauuuuuauuaa

SEQ ID NO: 3012138 - RNA, 15 nt, Human
gaacuccuggccuca

SEQ ID NO: 3012139 - RNA, 11 nt, Human
gaacuggcugc

SEQ ID NO: 3012140 - RNA, 12 nt, Human
gaacuggcugca

SEQ ID NO: 3012141 - RNA, 13 nt, Human
gcacaucauuuca

SEQ ID NO: 3012142 - RNA, 14 nt, Human
gcaccgggccacag

SEQ ID NO: 3012143 - RNA, 22 nt, Human
gcacaucagcacgauuucuguu

SEQ ID NO: 3012144 - RNA, 23 nt, Human
gcacaucagcacgauuucuguuu

SEQ ID NO: 3012145 - RNA, 23 nt, Human
gcaccgggccacagagaaaguac

SEQ ID NO: 3012146 - RNA, 16 nt, Human
gcacuccccugcuggg

SEQ ID NO: 3012147 - RNA, 22 nt, Human
gcacuccccugcuggguguggc

SEQ ID NO: 3012148 - RNA, 13 nt, Human
gcacucagaagac

SEQ ID NO: 3012149 - RNA, 16 nt, Human
gcacucagaagacacu

SEQ ID NO: 3012150 - RNA, 17 nt, Human
gcacuccccugcugggu

SEQ ID NO: 3012151 - RNA, 19 nt, Human
gcaagugagagcugggugu

SEQ ID NO: 3012152 - RNA, 14 nt, Human
gcacacauuuuuua

SEQ ID NO: 3012153 - RNA, 14 nt, Human
gcacaccgggcacu

SEQ ID NO: 3012154 - RNA, 22 nt, Human
gcacaagcugcacccucaggca

SEQ ID NO: 3012155 - RNA, 15 nt, Human
gaugaucuaggaaga

SEQ ID NO: 3012156 - RNA, 21 nt, Human
gaugaucuaggaagacuuugg

SEQ ID NO: 3012157 - RNA, 16 nt, Human
gaugagugagcaugcc

SEQ ID NO: 3012158 - RNA, 14 nt, Human
gaugauccuaggca

SEQ ID NO: 3012159 - RNA, 18 nt, Human
gauucuccugccucagcc

SEQ ID NO: 3012160 - RNA, 14 nt, Human
gauucuccugccuc

SEQ ID NO: 3012161 - RNA, 15 nt, Human
gauucuccugccuca

SEQ ID NO: 3012162 - RNA, 17 nt, Human
gauucuccugccucagc

SEQ ID NO: 3012163 - RNA, 17 nt, Human
gauucuuccucccuccc

SEQ ID NO: 3012164 - RNA, 18 nt, Human
gauucuuccucccucccu

SEQ ID NO: 3012165 - RNA, 12 nt, Human
gauuauuggaaa

SEQ ID NO: 3012166 - RNA, 11 nt, Human
gaguggaguua

SEQ ID NO: 3012167 - RNA, 20 nt, Human
gagugacagaggcagcccca

SEQ ID NO: 3012168 - RNA, 17 nt, Human
gaguggaguuacugaac

SEQ ID NO: 3012169 - RNA, 22 nt, Human
gaguugauagcacagacccugc

SEQ ID NO: 3012170 - RNA, 17 nt, Human
gaguugauucagcucug

SEQ ID NO: 3012171 - RNA, 16 nt, Human
gaguugauucagcucu

SEQ ID NO: 3012172 - RNA, 15 nt, Human
gaguugauucagcuc

SEQ ID NO: 3012173 - RNA, 12 nt, Human
gagucccaccuu

SEQ ID NO: 3012174 - RNA, 18 nt, Human
gagugacagaggcagccc

SEQ ID NO: 3012175 - RNA, 22 nt, Human
gagucagaaguuucugccgcag

SEQ ID NO: 3012176 - RNA, 15 nt, Human
gagucaccaagccca

SEQ ID NO: 3012177 - RNA, 16 nt, Human
gagucaccaagcccag

SEQ ID NO: 3012178 - RNA, 17 nt, Human
gagucaccaagcccagu

SEQ ID NO: 3012179 - RNA, 23 nt, Human
gaggugaccccagguuucuaugu

SEQ ID NO: 3012180 - RNA, 15 nt, Human
gaggucgaggcagga

SEQ ID NO: 3012181 - RNA, 18 nt, Human
gaguugauucagcucugc

SEQ ID NO: 3012182 - RNA, 22 nt, Human
gaguuguuacauuuuuaagugc

SEQ ID NO: 3012183 - RNA, 20 nt, Human
gagccuuccaggggugggac

SEQ ID NO: 3012184 - RNA, 23 nt, Human
gagccuuccaggggugggacacc

SEQ ID NO: 3012185 - RNA, 13 nt, Human
gagccuugaacuu

SEQ ID NO: 3012186 - RNA, 15 nt, Human
gaggcagggucucac

SEQ ID NO: 3012187 - RNA, 22 nt, Human
gaggcagggucucacucugucg

SEQ ID NO: 3012188 - RNA, 22 nt, Human
gaggccaaggugggaggauugc

SEQ ID NO: 3012189 - RNA, 17 nt, Human
gaggccaaggugggagg

SEQ ID NO: 3012190 - RNA, 14 nt, Human
gaggcagggucuca

SEQ ID NO: 3012191 - RNA, 22 nt, Human
gaggcuagugugguguuuccug

SEQ ID NO: 3012192 - RNA, 19 nt, Human
gaggccagagacacaagcc

SEQ ID NO: 3012193 - RNA, 14 nt, Human
gaggccagagacac

SEQ ID NO: 3012194 - RNA, 13 nt, Human
gaggccagagaca

SEQ ID NO: 3012195 - RNA, 16 nt, Human
gcuguacauacuuuuu

SEQ ID NO: 3012196 - RNA, 15 nt, Human
gcuguacauacuuuu

SEQ ID NO: 3012197 - RNA, 14 nt, Human
gcuguacauacuuu

SEQ ID NO: 3012198 - RNA, 13 nt, Human
gcuguacauacuu

SEQ ID NO: 3012199 - RNA, 20 nt, Human
gcuguaucccaugagccuca

SEQ ID NO: 3012200 - RNA, 23 nt, Human
gcuguaucccaugagccucagca

SEQ ID NO: 3012201 - RNA, 19 nt, Human
gcuguaucccaugagccuc

SEQ ID NO: 3012202 - RNA, 14 nt, Human
gcuggguuggaggg

SEQ ID NO: 3012203 - RNA, 21 nt, Human
gcuggguuggaggguguccca

SEQ ID NO: 3012204 - RNA, 15 nt, Human
gcuggguucugaucc

SEQ ID NO: 3012205 - RNA, 15 nt, Human
gcuggguucuaccca

SEQ ID NO: 3012206 - RNA, 20 nt, Human
gcuucacggaagagccuugc

SEQ ID NO: 3012207 - RNA, 19 nt, Human
gcuucacggaagagccuug

SEQ ID NO: 3012208 - RNA, 22 nt, Human
gcuucaaggauccugagccaga

SEQ ID NO: 3012209 - RNA, 18 nt, Human
gcugugcucuggacaggc

SEQ ID NO: 3012210 - RNA, 13 nt, Human
gcugugcugcccu

SEQ ID NO: 3012211 - RNA, 21 nt, Human
gcugugcucuggacaggcaug

SEQ ID NO: 3012212 - RNA, 12 nt, Human
gcugugcugccc

SEQ ID NO: 3012213 - RNA, 21 nt, Human
gcuguuggcugggggccucag

SEQ ID NO: 3012214 - RNA, 22 nt, Human
gcuguuggcugggggccucagu

SEQ ID NO: 3012215 - RNA, 22 nt, Human
gcugugcugcccugcccaccug

SEQ ID NO: 3012216 - RNA, 19 nt, Human
gcugugcugcccugcccac

SEQ ID NO: 3012217 - RNA, 14 nt, Human
gcuuguacauaaug

SEQ ID NO: 3012218 - RNA, 16 nt, Human
gcuuguacauaaugcg

SEQ ID NO: 3012219 - RNA, 16 nt, Human
gcugcugauuuaaaca

SEQ ID NO: 3012220 - RNA, 18 nt, Human
gcugccugggaucccuca

SEQ ID NO: 3012221 - RNA, 16 nt, Human
gcugccugggaucccu

SEQ ID NO: 3012222 - RNA, 19 nt, Human
gcugccugggaucccucau

SEQ ID NO: 3012223 - RNA, 13 nt, Human
gcugccugggauc

SEQ ID NO: 3012224 - RNA, 22 nt, Human
gcugcaccggcuggccuggccc

SEQ ID NO: 3012225 - RNA, 19 nt, Human
gcugcaccggcuggccugg

SEQ ID NO: 3012226 - RNA, 18 nt, Human
gcugcaccggcuggccug

SEQ ID NO: 3012227 - RNA, 17 nt, Human
gcugcaccggcuggccu

SEQ ID NO: 3012228 - RNA, 16 nt, Human
gcugcaccggcuggcc

SEQ ID NO: 3012229 - RNA, 14 nt, Human
gcugcaccggcugg

SEQ ID NO: 3012230 - RNA, 21 nt, Human
gcugccauccagguucagcuu

SEQ ID NO: 3012231 - RNA, 23 nt, Human
gcugccauccagguucagcuugu

SEQ ID NO: 3012232 - RNA, 21 nt, Human
gcugccagccgagauagccaa

SEQ ID NO: 3012233 - RNA, 19 nt, Human
gcugccagccgagauagcc

SEQ ID NO: 3012234 - RNA, 13 nt, Human
gcugccaccugcc

SEQ ID NO: 3012235 - RNA, 12 nt, Human
gcuggagugcag

SEQ ID NO: 3012236 - RNA, 22 nt, Human
gcuggaccuugaacuggguacu

SEQ ID NO: 3012237 - RNA, 15 nt, Human
gcuggguguggcgca

SEQ ID NO: 3012238 - RNA, 20 nt, Human
gcugggcucccuucccaccu

SEQ ID NO: 3012239 - RNA, 17 nt, Human
gcugggcucccuuccca

SEQ ID NO: 3012240 - RNA, 16 nt, Human
gcugggcucccuuccc

SEQ ID NO: 3012241 - RNA, 12 nt, Human
gcugggcucccu

SEQ ID NO: 3012242 - RNA, 17 nt, Human
gcugggcagaggaaagc

SEQ ID NO: 3012243 - RNA, 16 nt, Human
gcugggcagaggaaag

SEQ ID NO: 3012244 - RNA, 19 nt, Human
gcugggcagaggaaagcaa

SEQ ID NO: 3012245 - RNA, 19 nt, Human
gcugggauuacagguguga

SEQ ID NO: 3012246 - RNA, 18 nt, Human
gcugggauuacaggugug

SEQ ID NO: 3012247 - RNA, 13 nt, Human
gcugggcagagga

SEQ ID NO: 3012248 - RNA, 15 nt, Human
gcugggcagaggaaa

SEQ ID NO: 3012249 - RNA, 14 nt, Human
gcugggcagaggaa

SEQ ID NO: 3012250 - RNA, 14 nt, Human
gcuggagugcagug

SEQ ID NO: 3012251 - RNA, 15 nt, Human
gcuggagugcaguga

SEQ ID NO: 3012252 - RNA, 17 nt, Human
gcuggccuggccccuca

SEQ ID NO: 3012253 - RNA, 16 nt, Human
gcuggccuggccccuc

SEQ ID NO: 3012254 - RNA, 16 nt, Human
gcugggauuacaggug

SEQ ID NO: 3012255 - RNA, 19 nt, Human
gcuggccuggccccucagg

SEQ ID NO: 3012256 - RNA, 18 nt, Human
gcuggccuggccccucag

SEQ ID NO: 3012257 - RNA, 14 nt, Human
gcugacagacacag

SEQ ID NO: 3012258 - RNA, 15 nt, Human
gcugacagacacagg

SEQ ID NO: 3012259 - RNA, 16 nt, Human
gcugacagacacaggc

SEQ ID NO: 3012260 - RNA, 20 nt, Human
gcugaaggcucgagcaugcc

SEQ ID NO: 3012261 - RNA, 12 nt, Human
gcugaaggcucg

SEQ ID NO: 3012262 - RNA, 17 nt, Human
gcugaaugguuuucaaa

SEQ ID NO: 3012263 - RNA, 22 nt, Human
gcugaauacagaggcaacugca

SEQ ID NO: 3012264 - RNA, 12 nt, Human
gcucuuccaggc

SEQ ID NO: 3012265 - RNA, 16 nt, Human
gcucuuccaggcuggg

SEQ ID NO: 3012266 - RNA, 15 nt, Human
gcucuuccaggcugg

SEQ ID NO: 3012267 - RNA, 15 nt, Human
gcucuguccugggag

SEQ ID NO: 3012268 - RNA, 14 nt, Human
gcucuguccuggga

SEQ ID NO: 3012269 - RNA, 16 nt, Human
gcucuguccugggagu

SEQ ID NO: 3012270 - RNA, 16 nt, Human
gcucucaggccagcug

SEQ ID NO: 3012271 - RNA, 15 nt, Human
gcucucaggccagcu

SEQ ID NO: 3012272 - RNA, 14 nt, Human
gcucucaggccagc

SEQ ID NO: 3012273 - RNA, 13 nt, Human
gcucucaggccag

SEQ ID NO: 3012274 - RNA, 17 nt, Human
gcucccaggcauucccc

SEQ ID NO: 3012275 - RNA, 22 nt, Human
gcucccaggcauuccccaggag

SEQ ID NO: 3012276 - RNA, 14 nt, Human
gcuccccagcccca

SEQ ID NO: 3012277 - RNA, 21 nt, Human
gcucccaggcauuccccagga

SEQ ID NO: 3012278 - RNA, 20 nt, Human
gcucccaggcauuccccagg

SEQ ID NO: 3012279 - RNA, 22 nt, Human
gcucagguggggucacucuggc

SEQ ID NO: 3012280 - RNA, 21 nt, Human
gcucagguggggucacucugg

SEQ ID NO: 3012281 - RNA, 12 nt, Human
gcucagggccug

SEQ ID NO: 3012282 - RNA, 16 nt, Human
gcucagggccuggcuc

SEQ ID NO: 3012283 - RNA, 13 nt, Human
gcucagggccugg

SEQ ID NO: 3012284 - RNA, 15 nt, Human
gcucagagagggugg

SEQ ID NO: 3012285 - RNA, 20 nt, Human
gcucagagagggugggagug

SEQ ID NO: 3012286 - RNA, 18 nt, Human
gcucagagagggugggag

SEQ ID NO: 3012287 - RNA, 22 nt, Human
gcucagagagggugggaguggg

SEQ ID NO: 3012288 - RNA, 20 nt, Human
gccuguucagcuccagcuca

SEQ ID NO: 3012289 - RNA, 19 nt, Human
gccuguucagcuccagcuc

SEQ ID NO: 3012290 - RNA, 16 nt, Human
gcuaggaacacuccuu

SEQ ID NO: 3012291 - RNA, 18 nt, Human
gcuaggaacacuccuuca

SEQ ID NO: 3012292 - RNA, 21 nt, Human
gcuaggaacacuccuucacag

SEQ ID NO: 3012293 - RNA, 19 nt, Human
gcuaggaacacuccuucac

SEQ ID NO: 3012294 - RNA, 22 nt, Human
gcuaggaccccuccaugugggc

SEQ ID NO: 3012295 - RNA, 14 nt, Human
gcuaggccuggcca

SEQ ID NO: 3012296 - RNA, 15 nt, Human
gcuaggccuggccag

SEQ ID NO: 3012297 - RNA, 23 nt, Human
gccagaagucaaggcuuagaccc

SEQ ID NO: 3012298 - RNA, 16 nt, Human
gccagaagucaaggcu

SEQ ID NO: 3012299 - RNA, 20 nt, Human
gccagaagucaaggcuuaga

SEQ ID NO: 3012300 - RNA, 22 nt, Human
gccagaagucaaggcuuagacc

SEQ ID NO: 3012301 - RNA, 16 nt, Human
gccagcaggcucucag

SEQ ID NO: 3012302 - RNA, 13 nt, Human
gccagcaggcucu

SEQ ID NO: 3012303 - RNA, 21 nt, Human
gccagcaggcucucaggccag

SEQ ID NO: 3012304 - RNA, 20 nt, Human
gccagcaggcucucaggcca

SEQ ID NO: 3012305 - RNA, 19 nt, Human
gccagcaggcucucaggcc

SEQ ID NO: 3012306 - RNA, 18 nt, Human
gccagcaggcucucaggc

SEQ ID NO: 3012307 - RNA, 17 nt, Human
gccagcaggcucucagg

SEQ ID NO: 3012308 - RNA, 13 nt, Human
gccaggccagagg

SEQ ID NO: 3012309 - RNA, 15 nt, Human
gccaggcccucugcc

SEQ ID NO: 3012310 - RNA, 17 nt, Human
gccaggcccucugccca

SEQ ID NO: 3012311 - RNA, 16 nt, Human
gccaggcccucugccc

SEQ ID NO: 3012312 - RNA, 21 nt, Human
gccaggcccucugcccacucc

SEQ ID NO: 3012313 - RNA, 20 nt, Human
gccaggcccucugcccacuc

SEQ ID NO: 3012314 - RNA, 19 nt, Human
gccaggcccucugcccacu

SEQ ID NO: 3012315 - RNA, 23 nt, Human
gccaggccacaagacccuugugg

SEQ ID NO: 3012316 - RNA, 12 nt, Human
gccaggccagag

SEQ ID NO: 3012317 - RNA, 19 nt, Human
gccauauucuguuggccag

SEQ ID NO: 3012318 - RNA, 20 nt, Human
gccauauucuguuggccagu

SEQ ID NO: 3012319 - RNA, 14 nt, Human
gccauguuggccag

SEQ ID NO: 3012320 - RNA, 15 nt, Human
gccauguuggccagg

SEQ ID NO: 3012321 - RNA, 16 nt, Human
gccauguuggccaggc

SEQ ID NO: 3012322 - RNA, 17 nt, Human
gccauguuggccaggcu

SEQ ID NO: 3012323 - RNA, 18 nt, Human
gccauguuggccaggcug

SEQ ID NO: 3012324 - RNA, 15 nt, Human
gcccacgcuggagug

SEQ ID NO: 3012325 - RNA, 16 nt, Human
gcccacgcuggagugc

SEQ ID NO: 3012326 - RNA, 17 nt, Human
gcccacgcuggagugca

SEQ ID NO: 3012327 - RNA, 17 nt, Human
gcccaccuuggcucaag

SEQ ID NO: 3012328 - RNA, 18 nt, Human
gcccaccuuggcucaagu

SEQ ID NO: 3012329 - RNA, 14 nt, Human
gcccacgcccccac

SEQ ID NO: 3012330 - RNA, 13 nt, Human
gcccacgccccca

SEQ ID NO: 3012331 - RNA, 19 nt, Human
gccauguuggccaggcugg

SEQ ID NO: 3012332 - RNA, 20 nt, Human
gccauguuggccaggcuggu

SEQ ID NO: 3012333 - RNA, 22 nt, Human
gccauguuggccaggcuggucu

SEQ ID NO: 3012334 - RNA, 24 nt, Human
gccauguuggccaggcuggucuca

SEQ ID NO: 3012335 - RNA, 14 nt, Human
gccacuuuauuucu

SEQ ID NO: 3012336 - RNA, 19 nt, Human
gccacugugaagagaacca

SEQ ID NO: 3012337 - RNA, 18 nt, Human
gccacugugaagagaacc

SEQ ID NO: 3012338 - RNA, 22 nt, Human
gccacugcaccgggccacagag

SEQ ID NO: 3012339 - RNA, 21 nt, Human
gccacugcacuauagccuagg

SEQ ID NO: 3012340 - RNA, 13 nt, Human
gccacccugggga

SEQ ID NO: 3012341 - RNA, 19 nt, Human
gccacccuggggagaaagu

SEQ ID NO: 3012342 - RNA, 23 nt, Human
gccacugcaccgggccacagaga

SEQ ID NO: 3012343 - RNA, 20 nt, Human
gccacauuccugaugcuucu

SEQ ID NO: 3012344 - RNA, 16 nt, Human
gccacauuccugaugc

SEQ ID NO: 3012345 - RNA, 19 nt, Human
gccaccaacauacucccau

SEQ ID NO: 3012346 - RNA, 21 nt, Human
gccaccaacauacucccaucu

SEQ ID NO: 3012347 - RNA, 20 nt, Human
gccaccaacauacucccauc

SEQ ID NO: 3012348 - RNA, 22 nt, Human
gccaccaacauacucccaucug

SEQ ID NO: 3012349 - RNA, 15 nt, Human
gccuaccaauauuua

SEQ ID NO: 3012350 - RNA, 13 nt, Human
gccuccuccagcc

SEQ ID NO: 3012351 - RNA, 18 nt, Human
gccuccugcccuuaccug

SEQ ID NO: 3012352 - RNA, 12 nt, Human
gccucugggacu

SEQ ID NO: 3012353 - RNA, 17 nt, Human
gccugcccaggccccug

SEQ ID NO: 3012354 - RNA, 18 nt, Human
gccugcccaggccccugc

SEQ ID NO: 3012355 - RNA, 19 nt, Human
gccugcccaggccccugcc

SEQ ID NO: 3012356 - RNA, 23 nt, Human
gccucuucucuacucuagggaaa

SEQ ID NO: 3012357 - RNA, 12 nt, Human
gccucuucucua

SEQ ID NO: 3012358 - RNA, 17 nt, Human
gccuggccccucagggu

SEQ ID NO: 3012359 - RNA, 16 nt, Human
gccuggccccucaggg

SEQ ID NO: 3012360 - RNA, 15 nt, Human
gccuggccccucagg

SEQ ID NO: 3012361 - RNA, 10 nt, Human
gccuggccug

SEQ ID NO: 3012362 - RNA, 22 nt, Human
gccuggccccucagggucccug

SEQ ID NO: 3012363 - RNA, 20 nt, Human
gccuggccccucaggguccc

SEQ ID NO: 3012364 - RNA, 21 nt, Human
gccugggaggucaaggcugca

SEQ ID NO: 3012365 - RNA, 14 nt, Human
gccugggaucccuc

SEQ ID NO: 3012366 - RNA, 22 nt, Human
gccugggaggucaaggcugcag

SEQ ID NO: 3012367 - RNA, 18 nt, Human
gccugggaucccucaucc

SEQ ID NO: 3012368 - RNA, 16 nt, Human
gccugccucuucucua

SEQ ID NO: 3012369 - RNA, 16 nt, Human
gccgccaugcuccugg

SEQ ID NO: 3012370 - RNA, 20 nt, Human
gcccuuaccugccaggaagc

SEQ ID NO: 3012371 - RNA, 16 nt, Human
gcccuuaccugccagg

SEQ ID NO: 3012372 - RNA, 15 nt, Human
gccgccaugcuccug

SEQ ID NO: 3012373 - RNA, 22 nt, Human
gcccugccuccuuugugaggaa

SEQ ID NO: 3012374 - RNA, 16 nt, Human
gcccugccuccuuugu

SEQ ID NO: 3012375 - RNA, 14 nt, Human
gcccugccuccuuu

SEQ ID NO: 3012376 - RNA, 21 nt, Human
gcccugugggcccccaaaugg

SEQ ID NO: 3012377 - RNA, 13 nt, Human
gcccacucccugc

SEQ ID NO: 3012378 - RNA, 19 nt, Human
gcccacucccugcaaccug

SEQ ID NO: 3012379 - RNA, 15 nt, Human
gcccacucccugcaa

SEQ ID NO: 3012380 - RNA, 14 nt, Human
gcccacucccugca

SEQ ID NO: 3012381 - RNA, 22 nt, Human
gcccuaaaguguauuuuuuuac

SEQ ID NO: 3012382 - RNA, 22 nt, Human
gccccuggaugcagccucacag

SEQ ID NO: 3012383 - RNA, 18 nt, Human
gccccuggaugcagccuc

SEQ ID NO: 3012384 - RNA, 16 nt, Human
gccccuggaugcagcc

SEQ ID NO: 3012385 - RNA, 13 nt, Human
gccccugcccggc

SEQ ID NO: 3012386 - RNA, 14 nt, Human
gccccugcccggcu

SEQ ID NO: 3012387 - RNA, 18 nt, Human
gccccaaaacucuccucu

SEQ ID NO: 3012388 - RNA, 19 nt, Human
gccccaaaacucuccucug

SEQ ID NO: 3012389 - RNA, 22 nt, Human
ggcccaggaguuuggccagaag

SEQ ID NO: 3012390 - RNA, 23 nt, Human
ggcccaggaguuuggccagaagu

SEQ ID NO: 3012391 - RNA, 21 nt, Human
ggcccaggaguuuggccagaa

SEQ ID NO: 3012392 - RNA, 14 nt, Human
ggccucccaacuca

SEQ ID NO: 3012393 - RNA, 13 nt, Human
ggccucccaacuc

SEQ ID NO: 3012394 - RNA, 21 nt, Human
ggccaaaggaagcacaugccu

SEQ ID NO: 3012395 - RNA, 15 nt, Human
ggccaaagccaaagc

SEQ ID NO: 3012396 - RNA, 12 nt, Human
ggccaaaggaag

SEQ ID NO: 3012397 - RNA, 21 nt, Human
ggccaaacucaccugccccuc

SEQ ID NO: 3012398 - RNA, 12 nt, Human
ggcauuguggga

SEQ ID NO: 3012399 - RNA, 13 nt, Human
ggccaagguggga

SEQ ID NO: 3012400 - RNA, 22 nt, Human
ggccagagggagugacagaggc

SEQ ID NO: 3012401 - RNA, 23 nt, Human
ggccagagggagugacagaggca

SEQ ID NO: 3012402 - RNA, 17 nt, Human
ggccagaugcaccagcc

SEQ ID NO: 3012403 - RNA, 19 nt, Human
ggccagaugcaccagcccu

SEQ ID NO: 3012404 - RNA, 20 nt, Human
ggccagaugcaccagcccuu

SEQ ID NO: 3012405 - RNA, 12 nt, Human
ggauuuucagcc

SEQ ID NO: 3012406 - RNA, 21 nt, Human
ggauuuugauccaagcugguc

SEQ ID NO: 3012407 - RNA, 23 nt, Human
ggauuaaacuuaaucuaaaugga

SEQ ID NO: 3012408 - RNA, 21 nt, Human
ggaugaauuccaaauucugcu

SEQ ID NO: 3012409 - RNA, 12 nt, Human
ggaugagaaagg

SEQ ID NO: 3012410 - RNA, 22 nt, Human
ggaugagaaagguugaagcacc

SEQ ID NO: 3012411 - RNA, 12 nt, Human
ggcagaaggaag

SEQ ID NO: 3012412 - RNA, 17 nt, Human
ggcagccaggccacaag

SEQ ID NO: 3012413 - RNA, 15 nt, Human
ggcagccaggccaca

SEQ ID NO: 3012414 - RNA, 10 nt, Human
ggcagagcag

SEQ ID NO: 3012415 - RNA, 14 nt, Human
ggcagccaggccac

SEQ ID NO: 3012416 - RNA, 21 nt, Human
ggagcagccacauuccugaug

SEQ ID NO: 3012417 - RNA, 13 nt, Human
ggagcagccacau

SEQ ID NO: 3012418 - RNA, 18 nt, Human
ggaggucgaggcaggagg

SEQ ID NO: 3012419 - RNA, 14 nt, Human
ggaggucgaggcag

SEQ ID NO: 3012420 - RNA, 16 nt, Human
ggaggucgaggcagga

SEQ ID NO: 3012421 - RNA, 15 nt, Human
ggaggucgaggcagg

SEQ ID NO: 3012422 - RNA, 12 nt, Human
ggaggaagagaa

SEQ ID NO: 3012423 - RNA, 21 nt, Human
ggaggcaugugaugagaggaa

SEQ ID NO: 3012424 - RNA, 13 nt, Human
ggaggccagccuu

SEQ ID NO: 3012425 - RNA, 18 nt, Human
ggaggccaaggugggagg

SEQ ID NO: 3012426 - RNA, 12 nt, Human
ggaggccagccu

SEQ ID NO: 3012427 - RNA, 22 nt, Human
ggagcugccuguucagcuccag

SEQ ID NO: 3012428 - RNA, 19 nt, Human
gcuuguacauaaugcgugc

SEQ ID NO: 3012429 - RNA, 19 nt, Human
ggacccugaggcccagagg

SEQ ID NO: 3012430 - RNA, 14 nt, Human
ggacccugaggccc

SEQ ID NO: 3012431 - RNA, 18 nt, Human
ggacccugaggcccagag

SEQ ID NO: 3012432 - RNA, 15 nt, Human
ggacccugaggccca

SEQ ID NO: 3012433 - RNA, 15 nt, Human
ggagagcuagcagca

SEQ ID NO: 3012434 - RNA, 16 nt, Human
ggagagccuuccaggg

SEQ ID NO: 3012435 - RNA, 13 nt, Human
ggagagccuucca

SEQ ID NO: 3012436 - RNA, 18 nt, Human
ggagagccuuccaggggu

SEQ ID NO: 3012437 - RNA, 17 nt, Human
ggagagccuuccagggg

SEQ ID NO: 3012438 - RNA, 22 nt, Human
ggagagccuuccagggguggga

SEQ ID NO: 3012439 - RNA, 9 nt, Human
ggacuuugu

SEQ ID NO: 3012440 - RNA, 19 nt, Human
ggagaaaauggacguguua

SEQ ID NO: 3012441 - RNA, 15 nt, Human
ggacuuggaagcucc

SEQ ID NO: 3012442 - RNA, 17 nt, Human
ggacuuggaagcuccgc

SEQ ID NO: 3012443 - RNA, 22 nt, Human
ggagaaccaaaaagaggcuaug

SEQ ID NO: 3012444 - RNA, 18 nt, Human
ggacucaaugcacugaca

SEQ ID NO: 3012445 - RNA, 22 nt, Human
ggacucaaugcacugacauugu

SEQ ID NO: 3012446 - RNA, 20 nt, Human
ggacuacaggugugagucac

SEQ ID NO: 3012447 - RNA, 19 nt, Human
aaagaugaaggucuguuuu

SEQ ID NO: 3012448 - RNA, 15 nt, Human
aaagaugagugagca

SEQ ID NO: 3012449 - RNA, 18 nt, Human
aaagaggcuaugugagca

SEQ ID NO: 3012450 - RNA, 13 nt, Human
aaagaggcuaugu

SEQ ID NO: 3012451 - RNA, 19 nt, Human
aaagacuuuuccaacccuc

SEQ ID NO: 3012452 - RNA, 15 nt, Human
aaagacuguacaaag

SEQ ID NO: 3012453 - RNA, 19 nt, Human
gguccacccaggagccccg

SEQ ID NO: 3012454 - RNA, 23 nt, Human
gguauuggcuagagguucaaaga

SEQ ID NO: 3012455 - RNA, 20 nt, Human
gguccacccaggagccccga

SEQ ID NO: 3012456 - RNA, 22 nt, Human
gguccacccaggagccccgagg

SEQ ID NO: 3012457 - RNA, 12 nt, Human
ggucccacccca

SEQ ID NO: 3012458 - RNA, 14 nt, Human
aaacuuuaccuuuu

SEQ ID NO: 3012459 - RNA, 22 nt, Human
aaaggaaugcaaagaugaaggu

SEQ ID NO: 3012460 - RNA, 19 nt, Human
aaaggaaugcaaagaugaa

SEQ ID NO: 3012461 - RNA, 11 nt, Human
aaaggaaagag

SEQ ID NO: 3012462 - RNA, 17 nt, Human
aaagcuuuugcauauug

SEQ ID NO: 3012463 - RNA, 17 nt, Human
aaagcuaggccuggcca

SEQ ID NO: 3012464 - RNA, 18 nt, Human
aaagcuaggccuggccag

SEQ ID NO: 3012465 - RNA, 16 nt, Human
aaagcagugcaugcug

SEQ ID NO: 3012466 - RNA, 22 nt, Human
aaagcagugcaugcugucccuu

SEQ ID NO: 3012467 - RNA, 21 nt, Human
aaagcagugcaugcugucccu

SEQ ID NO: 3012468 - RNA, 17 nt, Human
aaagcagugcaugcugu

SEQ ID NO: 3012469 - RNA, 13 nt, Human
ggucugucuuuua

SEQ ID NO: 3012470 - RNA, 14 nt, Human
ggucugucuuuuaa

SEQ ID NO: 3012471 - RNA, 12 nt, Human
ggucuguucuuu

SEQ ID NO: 3012472 - RNA, 21 nt, Human
ggucuugaacuccuggccuca

SEQ ID NO: 3012473 - RNA, 22 nt, Human
ggucuugaacuccuggccucaa

SEQ ID NO: 3012474 - RNA, 17 nt, Human
ggucuguucuuuccaaa

SEQ ID NO: 3012475 - RNA, 19 nt, Human
ggucuguucuuuccaaagu

SEQ ID NO: 3012476 - RNA, 20 nt, Human
ggugauuuagcaggaagcug

SEQ ID NO: 3012477 - RNA, 22 nt, Human
ggugcacaagcuccaagcuccc

SEQ ID NO: 3012478 - RNA, 16 nt, Human
ggugcacaagcuccaa

SEQ ID NO: 3012479 - RNA, 18 nt, Human
aaacaugcuguacauacu

SEQ ID NO: 3012480 - RNA, 16 nt, Human
aaacaugcuguacaua

SEQ ID NO: 3012481 - RNA, 15 nt, Human
aaacaugcuguacau

SEQ ID NO: 3012482 - RNA, 22 nt, Human
aaacaugcuacacacugcaugu

SEQ ID NO: 3012483 - RNA, 16 nt, Human
aaacaugcuacacacu

SEQ ID NO: 3012484 - RNA, 21 nt, Human
aaacaugcuguacauacuuuu

SEQ ID NO: 3012485 - RNA, 20 nt, Human
aaacaugcuguacauacuuu

SEQ ID NO: 3012486 - RNA, 24 nt, Human
ggggaaaaucagccugcuccagcu

SEQ ID NO: 3012487 - RNA, 22 nt, Human
aaacaugcuguacauacuuuuu

SEQ ID NO: 3012488 - RNA, 17 nt, Human
ggggaccucaggccugg

SEQ ID NO: 3012489 - RNA, 16 nt, Human
ggggaccucaggccug

SEQ ID NO: 3012490 - RNA, 15 nt, Human
ggggaccucaggccu

SEQ ID NO: 3012491 - RNA, 13 nt, Human
ggggaccucaggc

SEQ ID NO: 3012492 - RNA, 23 nt, Human
ggggcccugccuccuuugugagg

SEQ ID NO: 3012493 - RNA, 19 nt, Human
ggggcccugccuccuuugu

SEQ ID NO: 3012494 - RNA, 15 nt, Human
ggggcccugccuccu

SEQ ID NO: 3012495 - RNA, 16 nt, Human
ggggcccugccuccuu

SEQ ID NO: 3012496 - RNA, 17 nt, Human
ggggccaguuggucccc

SEQ ID NO: 3012497 - RNA, 20 nt, Human
aaaauggaagacagcucuua

SEQ ID NO: 3012498 - RNA, 21 nt, Human
aaaauguaggguuauaauaau

SEQ ID NO: 3012499 - RNA, 21 nt, Human
aaaauggacguguuaugacuc

SEQ ID NO: 3012500 - RNA, 20 nt, Human
aaacuacauuagguugugaa

SEQ ID NO: 3012501 - RNA, 22 nt, Human
aaacuacauuagguugugaaug

SEQ ID NO: 3012502 - RNA, 21 nt, Human
aaacuacauuagguugugaau

SEQ ID NO: 3012503 - RNA, 17 nt, Human
aaacguggcugcuucaa

SEQ ID NO: 3012504 - RNA, 16 nt, Human
aaacguggcugcuuca

SEQ ID NO: 3012505 - RNA, 16 nt, Human
aaacucauuucuagca

SEQ ID NO: 3012506 - RNA, 18 nt, Human
aaacuacauugacagauu

SEQ ID NO: 3012507 - RNA, 16 nt, Human
aaacuggauuaaacuu

SEQ ID NO: 3012508 - RNA, 22 nt, Human
gggucucacuauguugcccagg

SEQ ID NO: 3012509 - RNA, 23 nt, Human
gggucucacuauguugcccaggc

SEQ ID NO: 3012510 - RNA, 22 nt, Human
gggucacucuggcagcucagag

SEQ ID NO: 3012511 - RNA, 20 nt, Human
ggguaucaggugcugccauc

SEQ ID NO: 3012512 - RNA, 21 nt, Human
gggauuuucagcccucagaau

SEQ ID NO: 3012513 - RNA, 23 nt, Human
gggcagagcagagaccaucccug

SEQ ID NO: 3012514 - RNA, 15 nt, Human
gggauuuccaugaug

SEQ ID NO: 3012515 - RNA, 18 nt, Human
aaaauaguggugugauuu

SEQ ID NO: 3012516 - RNA, 12 nt, Human
aaaauagccugc

SEQ ID NO: 3012517 - RNA, 14 nt, Human
aaaauaccaaggaa

SEQ ID NO: 3012518 - RNA, 15 nt, Human
aaaauaccagccagu

SEQ ID NO: 3012519 - RNA, 14 nt, Human
aaaauaccagccag

SEQ ID NO: 3012520 - RNA, 12 nt, Human
aaaauaaauuau

SEQ ID NO: 3012521 - RNA, 21 nt, Human
aaaacguggcugcuucaagga

SEQ ID NO: 3012522 - RNA, 22 nt, Human
aaaacugauuuuuuuuuccuuc

SEQ ID NO: 3012523 - RNA, 18 nt, Human
aaaacugauuuuuuuuuc

SEQ ID NO: 3012524 - RNA, 15 nt, Human
aaaaccaauguucuc

SEQ ID NO: 3012525 - RNA, 18 nt, Human
aaaacguggcugcuucaa

SEQ ID NO: 3012526 - RNA, 17 nt, Human
aaaacguggcugcuuca

SEQ ID NO: 3012527 - RNA, 16 nt, Human
aaaacguggcugcuuc

SEQ ID NO: 3012528 - RNA, 14 nt, Human
aaaacguggcugcu

SEQ ID NO: 3012529 - RNA, 14 nt, Human
gggaacagacugga

SEQ ID NO: 3012530 - RNA, 22 nt, Human
gggaacagacuggaagcacagc

SEQ ID NO: 3012531 - RNA, 17 nt, Human
aaaaaucucaaauuucu

SEQ ID NO: 3012532 - RNA, 19 nt, Human
aaaaaucucaaauuucuaa

SEQ ID NO: 3012533 - RNA, 20 nt, Human
aaaaaucucaaauuucuaaa

SEQ ID NO: 3012534 - RNA, 13 nt, Human
gggagggcuccag

SEQ ID NO: 3012535 - RNA, 11 nt, Human
gggagggcucc

SEQ ID NO: 3012536 - RNA, 14 nt, Human
aaaagcugggcagg

SEQ ID NO: 3012537 - RNA, 22 nt, Human
aaaacuugauguguuaucucuu

SEQ ID NO: 3012538 - RNA, 16 nt, Human
ggcucccuucccaccu

SEQ ID NO: 3012539 - RNA, 18 nt, Human
ggcucccuucccaccucu

SEQ ID NO: 3012540 - RNA, 17 nt, Human
ggcucccuucccaccuc

SEQ ID NO: 3012541 - RNA, 22 nt, Human
ggcucccuucccaccucucuca

SEQ ID NO: 3012542 - RNA, 20 nt, Human
ggcucccuucccaccucucu

SEQ ID NO: 3012543 - RNA, 21 nt, Human
ggcugccaaugggagcucaug

SEQ ID NO: 3012544 - RNA, 20 nt, Human
ggcugcaugcgggcuuccuc

SEQ ID NO: 3012545 - RNA, 17 nt, Human
ggcugcagggaguccga

SEQ ID NO: 3012546 - RNA, 18 nt, Human
ggcucgagcaugccugga

SEQ ID NO: 3012547 - RNA, 24 nt, Human
ggcucuuccaggcugggagagccu

SEQ ID NO: 3012548 - RNA, 23 nt, Human
ggcucuuccaggcugggagagcc

SEQ ID NO: 3012549 - RNA, 20 nt, Human
ggcucuuccaggcugggaga

SEQ ID NO: 3012550 - RNA, 14 nt, Human
ggcuggcgugcagu

SEQ ID NO: 3012551 - RNA, 16 nt, Human
ggcuggcgugcagugg

SEQ ID NO: 3012552 - RNA, 20 nt, Human
ggcuggcgugcaguggugcg

SEQ ID NO: 3012553 - RNA, 22 nt, Human
ggcuggccuggccccucagggu

SEQ ID NO: 3012554 - RNA, 17 nt, Human
ggcuggccuggccccuc

SEQ ID NO: 3012555 - RNA, 13 nt, Human
aaaaaaacacaaa

SEQ ID NO: 3012556 - RNA, 15 nt, Human
ggcuucaguggcagc

SEQ ID NO: 3012557 - RNA, 20 nt, Human
ggcuguaucccaugagccuc

SEQ ID NO: 3012558 - RNA, 22 nt, Human
ggcuguaucccaugagccucag

SEQ ID NO: 3012559 - RNA, 23 nt, Human
ggcuguaucccaugagccucagc

SEQ ID NO: 3012560 - RNA, 15 nt, Human
ggcugucaauuacag

SEQ ID NO: 3012561 - RNA, 19 nt, Human
ggcuguaucccaugagccu

SEQ ID NO: 3012562 - RNA, 16 nt, Human
ggcuggugucaccuga

SEQ ID NO: 3012563 - RNA, 16 nt, Human
ggcuucaguggcagcu

SEQ ID NO: 3012564 - RNA, 13 nt, Human
gggaaaaucagcc

SEQ ID NO: 3012565 - RNA, 23 nt, Human
gggaaaaucagccugcuccagcu

SEQ ID NO: 3012566 - RNA, 16 nt, Human
auucauucuuuuugaa

SEQ ID NO: 3012567 - RNA, 21 nt, Human
auucauucuuuuugaaauguc

SEQ ID NO: 3012568 - RNA, 15 nt, Human
auucauucuuuuuga

SEQ ID NO: 3012569 - RNA, 20 nt, Human
auucucuaguuugauuaaau

SEQ ID NO: 3012570 - RNA, 19 nt, Human
auucucuaguuugauuaaa

SEQ ID NO: 3012571 - RNA, 23 nt, Human
auucucuaguuugauuaaauucu

SEQ ID NO: 3012572 - RNA, 12 nt, Human
auucucuuaucc

SEQ ID NO: 3012573 - RNA, 14 nt, Human
auucucuuauccaa

SEQ ID NO: 3012574 - RNA, 15 nt, Human
auucucuuauccaac

SEQ ID NO: 3012575 - RNA, 14 nt, Human
auucauuaguuuug

SEQ ID NO: 3012576 - RNA, 15 nt, Human
auucauuaguuuuga

SEQ ID NO: 3012577 - RNA, 14 nt, Human
auucauauuuacuu

SEQ ID NO: 3012578 - RNA, 22 nt, Human
auuacaagcgugagccacugca

SEQ ID NO: 3012579 - RNA, 17 nt, Human
auuucucucaucuguua

SEQ ID NO: 3012580 - RNA, 20 nt, Human
auuucuguuuagauaauaca

SEQ ID NO: 3012581 - RNA, 19 nt, Human
auuucuguuuagauaauac

SEQ ID NO: 3012582 - RNA, 21 nt, Human
auuucuguuuagauaauacac

SEQ ID NO: 3012583 - RNA, 19 nt, Human
auuugcacauuaaaugacu

SEQ ID NO: 3012584 - RNA, 17 nt, Human
auuugcacauuaaauga

SEQ ID NO: 3012585 - RNA, 15 nt, Human
auuugcacauuaaau

SEQ ID NO: 3012586 - RNA, 14 nt, Human
auuugcacauuaaa

SEQ ID NO: 3012587 - RNA, 13 nt, Human
auuuaauuugaag

SEQ ID NO: 3012588 - RNA, 15 nt, Human
auuuaauuugaaggu

SEQ ID NO: 3012589 - RNA, 17 nt, Human
auuucacaguguguggu

SEQ ID NO: 3012590 - RNA, 12 nt, Human
auuucacucucc

SEQ ID NO: 3012591 - RNA, 14 nt, Human
auuucacucuccuu

SEQ ID NO: 3012592 - RNA, 21 nt, Human
auuugcacauuaaaugacucu

SEQ ID NO: 3012593 - RNA, 20 nt, Human
auuugcacauuaaaugacuc

SEQ ID NO: 3012594 - RNA, 14 nt, Human
auuuguuauaauga

SEQ ID NO: 3012595 - RNA, 17 nt, Human
auuuucuccaaauguuc

SEQ ID NO: 3012596 - RNA, 16 nt, Human
caaaccaucauugaaa

SEQ ID NO: 3012597 - RNA, 14 nt, Human
caaaccaucauuga

SEQ ID NO: 3012598 - RNA, 17 nt, Human
caaaccaucauugaaau

SEQ ID NO: 3012599 - RNA, 16 nt, Human
auuuuuauuaaauuau

SEQ ID NO: 3012600 - RNA, 21 nt, Human
auuuuguuuuugucuuaaaaa

SEQ ID NO: 3012601 - RNA, 22 nt, Human
auuuuguuuuugucuuaaaaag

SEQ ID NO: 3012602 - RNA, 20 nt, Human
caaaagguuaauaaaguaau

SEQ ID NO: 3012603 - RNA, 19 nt, Human
caaaagcaucuaugugaga

SEQ ID NO: 3012604 - RNA, 13 nt, Human
caaaagcauguga

SEQ ID NO: 3012605 - RNA, 23 nt, Human
caauugugaaaaaauuuacuuua

SEQ ID NO: 3012606 - RNA, 20 nt, Human
caauuuauuauggcacauca

SEQ ID NO: 3012607 - RNA, 13 nt, Human
caauuuauuaugg

SEQ ID NO: 3012608 - RNA, 17 nt, Human
cacaaggaaauaaaauu

SEQ ID NO: 3012609 - RNA, 22 nt, Human
caauugugaaaaaauuuacuuu

SEQ ID NO: 3012610 - RNA, 13 nt, Human
caauggcagccuu

SEQ ID NO: 3012611 - RNA, 14 nt, Human
caauggcagccuug

SEQ ID NO: 3012612 - RNA, 15 nt, Human
caauggcagccuugg

SEQ ID NO: 3012613 - RNA, 14 nt, Human
caaucaaaucugcu

SEQ ID NO: 3012614 - RNA, 18 nt, Human
caauauuuaaucuuuuau

SEQ ID NO: 3012615 - RNA, 15 nt, Human
caagcucugcuccuc

SEQ ID NO: 3012616 - RNA, 16 nt, Human
caagcucugcuccucu

SEQ ID NO: 3012617 - RNA, 17 nt, Human
caagcucccaggcauuc

SEQ ID NO: 3012618 - RNA, 15 nt, Human
caagcucccaggcau

SEQ ID NO: 3012619 - RNA, 14 nt, Human
caagcucccaggca

SEQ ID NO: 3012620 - RNA, 12 nt, Human
caagcucccagg

SEQ ID NO: 3012621 - RNA, 21 nt, Human
caagcuccaagcucccaggca

SEQ ID NO: 3012622 - RNA, 19 nt, Human
caagcuccaagcucccagg

SEQ ID NO: 3012623 - RNA, 18 nt, Human
caagcuccaagcucccag

SEQ ID NO: 3012624 - RNA, 17 nt, Human
caagcuccaagcuccca

SEQ ID NO: 3012625 - RNA, 13 nt, Human
caaguauuauacc

SEQ ID NO: 3012626 - RNA, 17 nt, Human
caaguauuauaccuuuu

SEQ ID NO: 3012627 - RNA, 22 nt, Human
caaguauuauaccuuuuuuaga

SEQ ID NO: 3012628 - RNA, 14 nt, Human
caaggcaaggcugu

SEQ ID NO: 3012629 - RNA, 19 nt, Human
caaggauugcuacuguccu

SEQ ID NO: 3012630 - RNA, 20 nt, Human
caaggauugcuacuguccua

SEQ ID NO: 3012631 - RNA, 17 nt, Human
caaccccuucgcuccug

SEQ ID NO: 3012632 - RNA, 14 nt, Human
caaccccuucgcuc

SEQ ID NO: 3012633 - RNA, 16 nt, Human
caaccccuucgcuccu

SEQ ID NO: 3012634 - RNA, 14 nt, Human
caacccccagccug

SEQ ID NO: 3012635 - RNA, 17 nt, Human
caagaaggaugauucaa

SEQ ID NO: 3012636 - RNA, 18 nt, Human
caagaagcccaggaaagg

SEQ ID NO: 3012637 - RNA, 15 nt, Human
caagaagcccaggaa

SEQ ID NO: 3012638 - RNA, 14 nt, Human
caagaagcccagga

SEQ ID NO: 3012639 - RNA, 14 nt, Human
caagaccacguuuc

SEQ ID NO: 3012640 - RNA, 16 nt, Human
caagaccacguuucua

SEQ ID NO: 3012641 - RNA, 13 nt, Human
caagcaccuccug

SEQ ID NO: 3012642 - RNA, 15 nt, Human
cacuacauucuguua

SEQ ID NO: 3012643 - RNA, 22 nt, Human
cacggaagagccuugcggaagg

SEQ ID NO: 3012644 - RNA, 16 nt, Human
cacggaagagccuugc

SEQ ID NO: 3012645 - RNA, 21 nt, Human
cacuacauuauaaaugucucu

SEQ ID NO: 3012646 - RNA, 13 nt, Human
cacuacauucugu

SEQ ID NO: 3012647 - RNA, 14 nt, Human
cacuacauucuguu

SEQ ID NO: 3012648 - RNA, 21 nt, Human
cacgcuggagugcagugagcc

SEQ ID NO: 3012649 - RNA, 16 nt, Human
cacgcuggagugcagu

SEQ ID NO: 3012650 - RNA, 17 nt, Human
cacgcuggagugcagug

SEQ ID NO: 3012651 - RNA, 18 nt, Human
cacgcuggagugcaguga

SEQ ID NO: 3012652 - RNA, 20 nt, Human
cacgcuggagugcagugagc

SEQ ID NO: 3012653 - RNA, 15 nt, Human
cacgcuggagugcag

SEQ ID NO: 3012654 - RNA, 17 nt, Human
cacccuggggagaaagu

SEQ ID NO: 3012655 - RNA, 12 nt, Human
caccugccaggg

SEQ ID NO: 3012656 - RNA, 11 nt, Human
caccugccagg

SEQ ID NO: 3012657 - RNA, 21 nt, Human
caccugccccucaacucuccu

SEQ ID NO: 3012658 - RNA, 18 nt, Human
caccugccccucaacucu

SEQ ID NO: 3012659 - RNA, 12 nt, Human
cacccugcucuc

SEQ ID NO: 3012660 - RNA, 12 nt, Human
cacccuccuuuc

SEQ ID NO: 3012661 - RNA, 16 nt, Human
caccugcggugcuauc

SEQ ID NO: 3012662 - RNA, 19 nt, Human
caccugcggugcuaucucc

SEQ ID NO: 3012663 - RNA, 17 nt, Human
caccugcggugcuaucu

SEQ ID NO: 3012664 - RNA, 12 nt, Human
cacccagcccac

SEQ ID NO: 3012665 - RNA, 23 nt, Human
cacaucuugcucugcugacagac

SEQ ID NO: 3012666 - RNA, 19 nt, Human
cacaucuugcucugcugac

SEQ ID NO: 3012667 - RNA, 17 nt, Human
cacauuuauucugcuca

SEQ ID NO: 3012668 - RNA, 18 nt, Human
cacauuuauucugcucac

SEQ ID NO: 3012669 - RNA, 17 nt, Human
caccagccccagugccc

SEQ ID NO: 3012670 - RNA, 18 nt, Human
caccagccccagugccca

SEQ ID NO: 3012671 - RNA, 21 nt, Human
caccagccccagugcccacag

SEQ ID NO: 3012672 - RNA, 22 nt, Human
caccagccccagugcccacagg

SEQ ID NO: 3012673 - RNA, 16 nt, Human
caccagccccagugcc

SEQ ID NO: 3012674 - RNA, 19 nt, Human
caccagcccuuagcaggga

SEQ ID NO: 3012675 - RNA, 13 nt, Human
cacaucuugcucu

SEQ ID NO: 3012676 - RNA, 14 nt, Human
cacaucuugcucug

SEQ ID NO: 3012677 - RNA, 15 nt, Human
cacaucuugcucugc

SEQ ID NO: 3012678 - RNA, 20 nt, Human
cacaucuugcucugcugaca

SEQ ID NO: 3012679 - RNA, 21 nt, Human
cacaucuugcucugcugacag

SEQ ID NO: 3012680 - RNA, 22 nt, Human
cacaucuugcucugcugacaga

SEQ ID NO: 3012681 - RNA, 19 nt, Human
cagacuggauaguccgucu

SEQ ID NO: 3012682 - RNA, 20 nt, Human
cagacuggaagcacagcuuc

SEQ ID NO: 3012683 - RNA, 21 nt, Human
cagacuggaagcacagcuuca

SEQ ID NO: 3012684 - RNA, 13 nt, Human
cagacuggaagca

SEQ ID NO: 3012685 - RNA, 14 nt, Human
cagacuggaagcac

SEQ ID NO: 3012686 - RNA, 16 nt, Human
cagacuggaagcacag

SEQ ID NO: 3012687 - RNA, 17 nt, Human
cagacuggaagcacagc

SEQ ID NO: 3012688 - RNA, 18 nt, Human
cagacuggaagcacagcu

SEQ ID NO: 3012689 - RNA, 23 nt, Human
cagacucuacagaggccaugggc

SEQ ID NO: 3012690 - RNA, 18 nt, Human
cagacucuacagaggcca

SEQ ID NO: 3012691 - RNA, 19 nt, Human
cagacucuacagaggccau

SEQ ID NO: 3012692 - RNA, 20 nt, Human
cagacucuacagaggccaug

SEQ ID NO: 3012693 - RNA, 21 nt, Human
cagacucuacagaggccaugg

SEQ ID NO: 3012694 - RNA, 17 nt, Human
cagacucuacagaggcc

SEQ ID NO: 3012695 - RNA, 22 nt, Human
cagacaggcaagcaccuccugc

SEQ ID NO: 3012696 - RNA, 23 nt, Human
cagacaggcaagcaccuccugcc

SEQ ID NO: 3012697 - RNA, 11 nt, Human
cagacaggcaa

SEQ ID NO: 3012698 - RNA, 24 nt, Human
cagacaggaccagggauuuccaug

SEQ ID NO: 3012699 - RNA, 17 nt, Human
cagacaggaccagggau

SEQ ID NO: 3012700 - RNA, 13 nt, Human
cagacaggcaagc

SEQ ID NO: 3012701 - RNA, 18 nt, Human
cagacaggcaagcaccuc

SEQ ID NO: 3012702 - RNA, 20 nt, Human
cagacaggcaagcaccuccu

SEQ ID NO: 3012703 - RNA, 21 nt, Human
cagacaggcaagcaccuccug

SEQ ID NO: 3012704 - RNA, 18 nt, Human
cagacagcugccugggau

SEQ ID NO: 3012705 - RNA, 17 nt, Human
cagacagcugccuggga

SEQ ID NO: 3012706 - RNA, 16 nt, Human
cagacagcugccuggg

SEQ ID NO: 3012707 - RNA, 15 nt, Human
cagacagcugccugg

SEQ ID NO: 3012708 - RNA, 16 nt, Human
cagacaggaccaggga

SEQ ID NO: 3012709 - RNA, 15 nt, Human
cagacaggaccaggg

SEQ ID NO: 3012710 - RNA, 13 nt, Human
cagacaggaccag

SEQ ID NO: 3012711 - RNA, 14 nt, Human
cagacagcugccug

SEQ ID NO: 3012712 - RNA, 13 nt, Human
cagacagcugccu

SEQ ID NO: 3012713 - RNA, 19 nt, Human
cagauagauauaugcucug

SEQ ID NO: 3012714 - RNA, 19 nt, Human
cagauacuuggggggcuga

SEQ ID NO: 3012715 - RNA, 16 nt, Human
cagaggggguggccuc

SEQ ID NO: 3012716 - RNA, 14 nt, Human
cagaggggguggcc

SEQ ID NO: 3012717 - RNA, 23 nt, Human
cagagacuccugcaggcagccag

SEQ ID NO: 3012718 - RNA, 12 nt, Human
cagagagggugg

SEQ ID NO: 3012719 - RNA, 17 nt, Human
cagagaggguggugacc

SEQ ID NO: 3012720 - RNA, 20 nt, Human
cagagaggguggugaccucu

SEQ ID NO: 3012721 - RNA, 22 nt, Human
cagagaggguggugaccucugc

SEQ ID NO: 3012722 - RNA, 23 nt, Human
cagagagggugggagugggccca

SEQ ID NO: 3012723 - RNA, 23 nt, Human
cagagaggguggugaccucugcc

SEQ ID NO: 3012724 - RNA, 20 nt, Human
cagagagguuaaggugggua

SEQ ID NO: 3012725 - RNA, 13 nt, Human
cagagcugccacc

SEQ ID NO: 3012726 - RNA, 13 nt, Human
cagaggggguggc

SEQ ID NO: 3012727 - RNA, 19 nt, Human
cagaggaaagcaaaggaga

SEQ ID NO: 3012728 - RNA, 17 nt, Human
cagaggaaagcaaagga

SEQ ID NO: 3012729 - RNA, 19 nt, Human
cagauuucacucuccuugg

SEQ ID NO: 3012730 - RNA, 17 nt, Human
cagcaccaucucuccuc

SEQ ID NO: 3012731 - RNA, 19 nt, Human
cagcaccaucucuccuccu

SEQ ID NO: 3012732 - RNA, 20 nt, Human
cagauuucacucuccuuggu

SEQ ID NO: 3012733 - RNA, 19 nt, Human
cagauugcaacaggcuggg

SEQ ID NO: 3012734 - RNA, 20 nt, Human
cagauugcaacaggcugggc

SEQ ID NO: 3012735 - RNA, 18 nt, Human
cagauugcaacaggcugg

SEQ ID NO: 3012736 - RNA, 20 nt, Human
cagcacgauuucuguuuaga

SEQ ID NO: 3012737 - RNA, 14 nt, Human
cagcacgauuucug

SEQ ID NO: 3012738 - RNA, 15 nt, Human
cagcacgauuucugu

SEQ ID NO: 3012739 - RNA, 22 nt, Human
cagccaggccacaagacccuug

SEQ ID NO: 3012740 - RNA, 15 nt, Human
cagccugcuccagcu

SEQ ID NO: 3012741 - RNA, 19 nt, Human
cagccugcuccagcuguuc

SEQ ID NO: 3012742 - RNA, 17 nt, Human
cagccugcuccagcugu

SEQ ID NO: 3012743 - RNA, 16 nt, Human
cagccugcuccagcug

SEQ ID NO: 3012744 - RNA, 19 nt, Human
cagcguuucuaugacacau

SEQ ID NO: 3012745 - RNA, 15 nt, Human
cagcuaacauggaag

SEQ ID NO: 3012746 - RNA, 21 nt, Human
cagcugacuuuucuguccgag

SEQ ID NO: 3012747 - RNA, 20 nt, Human
caggaaaggcuccaggagca

SEQ ID NO: 3012748 - RNA, 19 nt, Human
caggaaaggcuccaggagc

SEQ ID NO: 3012749 - RNA, 17 nt, Human
caggaaaggcuccagga

SEQ ID NO: 3012750 - RNA, 16 nt, Human
caggaaaggcuccagg

SEQ ID NO: 3012751 - RNA, 12 nt, Human
caggccaggccc

SEQ ID NO: 3012752 - RNA, 11 nt, Human
caggccaggcc

SEQ ID NO: 3012753 - RNA, 19 nt, Human
caggaggaucacuugaguc

SEQ ID NO: 3012754 - RNA, 22 nt, Human
caggaggccagccuugaccauu

SEQ ID NO: 3012755 - RNA, 19 nt, Human
caggaggccagccuugacc

SEQ ID NO: 3012756 - RNA, 18 nt, Human
caggaggccagccuugac

SEQ ID NO: 3012757 - RNA, 14 nt, Human
caggcaaugcuggc

SEQ ID NO: 3012758 - RNA, 15 nt, Human
caggcaaugcuggcu

SEQ ID NO: 3012759 - RNA, 16 nt, Human
caggcaaugcuggcug

SEQ ID NO: 3012760 - RNA, 23 nt, Human
caggaccucaggugagaagcaga

SEQ ID NO: 3012761 - RNA, 16 nt, Human
caggaccucaggugag

SEQ ID NO: 3012762 - RNA, 21 nt, Human
caggaccagggauuuccauga

SEQ ID NO: 3012763 - RNA, 23 nt, Human
caggcugggagagccuuccaggg

SEQ ID NO: 3012764 - RNA, 22 nt, Human
caggcugggagagccuuccagg

SEQ ID NO: 3012765 - RNA, 16 nt, Human
caggggaaaagaggag

SEQ ID NO: 3012766 - RNA, 14 nt, Human
caggggaaaagagg

SEQ ID NO: 3012767 - RNA, 14 nt, Human
caggccuccuacag

SEQ ID NO: 3012768 - RNA, 12 nt, Human
caggccuccuac

SEQ ID NO: 3012769 - RNA, 20 nt, Human
caggcugggagagccuucca

SEQ ID NO: 3012770 - RNA, 21 nt, Human
caggcugggagagccuuccag

SEQ ID NO: 3012771 - RNA, 14 nt, Human
caguuguuauuuau

SEQ ID NO: 3012772 - RNA, 19 nt, Human
caguuguuauuuauugaaa

SEQ ID NO: 3012773 - RNA, 22 nt, Human
caguuguuagugugucuuagug

SEQ ID NO: 3012774 - RNA, 18 nt, Human
caguuguuagugugucuu

SEQ ID NO: 3012775 - RNA, 21 nt, Human
caguuguuauuuauugaaaug

SEQ ID NO: 3012776 - RNA, 21 nt, Human
caguuuguuaguaugaggcau

SEQ ID NO: 3012777 - RNA, 23 nt, Human
caguuuguuaguaugaggcauuu

SEQ ID NO: 3012778 - RNA, 23 nt, Human
cauaaugcgugcauaccacuuuu

SEQ ID NO: 3012779 - RNA, 16 nt, Human
cauacaguuugcacuu

SEQ ID NO: 3012780 - RNA, 23 nt, Human
cauacaggaagguagaaauaucu

SEQ ID NO: 3012781 - RNA, 22 nt, Human
cauauuaccacagacauacuaa

SEQ ID NO: 3012782 - RNA, 23 nt, Human
cauagcagagaaugaaagggccc

SEQ ID NO: 3012783 - RNA, 21 nt, Human
caucagcacgauuucuguuua

SEQ ID NO: 3012784 - RNA, 19 nt, Human
caucagcacgauuucuguu

SEQ ID NO: 3012785 - RNA, 19 nt, Human
caucccaaacccuucagug

SEQ ID NO: 3012786 - RNA, 22 nt, Human
cauccucuguacagagcccacg

SEQ ID NO: 3012787 - RNA, 21 nt, Human
cauccucuguacagagcccac

SEQ ID NO: 3012788 - RNA, 20 nt, Human
caucccaaacccuucagugc

SEQ ID NO: 3012789 - RNA, 11 nt, Human
caucccagccc

SEQ ID NO: 3012790 - RNA, 20 nt, Human
caguuacucagaauucucua

SEQ ID NO: 3012791 - RNA, 21 nt, Human
cagugguaugaucacggcuca

SEQ ID NO: 3012792 - RNA, 19 nt, Human
caguggugcgaucuggguu

SEQ ID NO: 3012793 - RNA, 16 nt, Human
cagugggagcugccug

SEQ ID NO: 3012794 - RNA, 15 nt, Human
cagugggagcugccu

SEQ ID NO: 3012795 - RNA, 17 nt, Human
cagugggagcugccugu

SEQ ID NO: 3012796 - RNA, 18 nt, Human
cagugggagcugccuguu

SEQ ID NO: 3012797 - RNA, 20 nt, Human
cagugguaugaucacggcuc

SEQ ID NO: 3012798 - RNA, 21 nt, Human
cagugcccacaggaucagucu

SEQ ID NO: 3012799 - RNA, 18 nt, Human
cagugcccacaggaucag

SEQ ID NO: 3012800 - RNA, 22 nt, Human
cagugcccacaggaucagucug

SEQ ID NO: 3012801 - RNA, 23 nt, Human
cagucugauucccaagcucugcu

SEQ ID NO: 3012802 - RNA, 21 nt, Human
cagucugauucccaagcucug

SEQ ID NO: 3012803 - RNA, 22 nt, Human
cagucugauucccaagcucugc

SEQ ID NO: 3012804 - RNA, 17 nt, Human
cauuauguuaauauuuc

SEQ ID NO: 3012805 - RNA, 14 nt, Human
cauuauguuaauau

SEQ ID NO: 3012806 - RNA, 15 nt, Human
cauuauguuaauauu

SEQ ID NO: 3012807 - RNA, 16 nt, Human
cauuauguuaauauuu

SEQ ID NO: 3012808 - RNA, 21 nt, Human
cauucuccaccugccagggac

SEQ ID NO: 3012809 - RNA, 19 nt, Human
cauucuccaccugccaggg

SEQ ID NO: 3012810 - RNA, 18 nt, Human
cauucuccaccugccagg

SEQ ID NO: 3012811 - RNA, 17 nt, Human
cauucuccaccugccag

SEQ ID NO: 3012812 - RNA, 20 nt, Human
cauucuccuuguguuacuaa

SEQ ID NO: 3012813 - RNA, 18 nt, Human
cauguucuuaauucuuag

SEQ ID NO: 3012814 - RNA, 18 nt, Human
cauguuggccaggcuggu

SEQ ID NO: 3012815 - RNA, 17 nt, Human
cauguuggccaggcugg

SEQ ID NO: 3012816 - RNA, 21 nt, Human
cauguuacauaagauaaaugu

SEQ ID NO: 3012817 - RNA, 13 nt, Human
cauguucuuaauu

SEQ ID NO: 3012818 - RNA, 16 nt, Human
cauguucuuaauucuu

SEQ ID NO: 3012819 - RNA, 16 nt, Human
cauguccaagaagccc

SEQ ID NO: 3012820 - RNA, 15 nt, Human
cauguccaagaagcc

SEQ ID NO: 3012821 - RNA, 16 nt, Human
cauguuacauaagaua

SEQ ID NO: 3012822 - RNA, 17 nt, Human
cauguuacauaagauaa

SEQ ID NO: 3012823 - RNA, 12 nt, Human
caugcaagguca

SEQ ID NO: 3012824 - RNA, 13 nt, Human
caugacaaagacu

SEQ ID NO: 3012825 - RNA, 17 nt, Human
caugcuccuggcccacu

SEQ ID NO: 3012826 - RNA, 16 nt, Human
caugcuccuggcccac

SEQ ID NO: 3012827 - RNA, 14 nt, Human
caugcuccuggccc

SEQ ID NO: 3012828 - RNA, 18 nt, Human
caugggaaaggggaaguu

SEQ ID NO: 3012829 - RNA, 21 nt, Human
cauggccucuucagaucucua

SEQ ID NO: 3012830 - RNA, 22 nt, Human
ccaaaguacacuguuucaaacu

SEQ ID NO: 3012831 - RNA, 23 nt, Human
ccaauggacuaacuugucuuugg

SEQ ID NO: 3012832 - RNA, 15 nt, Human
ccaaaucagcugcua

SEQ ID NO: 3012833 - RNA, 23 nt, Human
ccaaaucagcugcuacuacuccu

SEQ ID NO: 3012834 - RNA, 13 nt, Human
ccaacucacccca

SEQ ID NO: 3012835 - RNA, 16 nt, Human
ccaagcucugcuccuc

SEQ ID NO: 3012836 - RNA, 14 nt, Human
ccaagcucugcucc

SEQ ID NO: 3012837 - RNA, 15 nt, Human
ccaagcucugcuccu

SEQ ID NO: 3012838 - RNA, 21 nt, Human
ccaacucaccccagccccaaa

SEQ ID NO: 3012839 - RNA, 18 nt, Human
cauuuaggugaggaagca

SEQ ID NO: 3012840 - RNA, 16 nt, Human
cauuuaggugaggaag

SEQ ID NO: 3012841 - RNA, 23 nt, Human
cauuuuuuuuaagaaaaaggaug

SEQ ID NO: 3012842 - RNA, 22 nt, Human
cauuuuuuuuaagaaaaaggau

SEQ ID NO: 3012843 - RNA, 14 nt, Human
ccaggaguuuggcc

SEQ ID NO: 3012844 - RNA, 15 nt, Human
ccaggaguuuggcca

SEQ ID NO: 3012845 - RNA, 16 nt, Human
ccaggaguuuggccag

SEQ ID NO: 3012846 - RNA, 17 nt, Human
ccaggaguuuggccaga

SEQ ID NO: 3012847 - RNA, 18 nt, Human
ccaggaguuuggccagaa

SEQ ID NO: 3012848 - RNA, 18 nt, Human
ccagucaccccggccacc

SEQ ID NO: 3012849 - RNA, 17 nt, Human
ccagucaccccggccac

SEQ ID NO: 3012850 - RNA, 16 nt, Human
ccagucaccccggcca

SEQ ID NO: 3012851 - RNA, 22 nt, Human
ccaguaucuugaagacuuuucu

SEQ ID NO: 3012852 - RNA, 19 nt, Human
ccaguaucuugaagacuuu

SEQ ID NO: 3012853 - RNA, 13 nt, Human
ccaguaucuugaa

SEQ ID NO: 3012854 - RNA, 22 nt, Human
ccaggggugggacacccuguga

SEQ ID NO: 3012855 - RNA, 21 nt, Human
ccaggggugggacacccugug

SEQ ID NO: 3012856 - RNA, 20 nt, Human
ccaggggugggacacccugu

SEQ ID NO: 3012857 - RNA, 19 nt, Human
ccaggggugggacacccug

SEQ ID NO: 3012858 - RNA, 17 nt, Human
ccaggaaaggcuccagg

SEQ ID NO: 3012859 - RNA, 19 nt, Human
ccaggaaaggcuccaggag

SEQ ID NO: 3012860 - RNA, 18 nt, Human
ccaggaaaggcuccagga

SEQ ID NO: 3012861 - RNA, 20 nt, Human
ccaggaaaggcuccaggagc

SEQ ID NO: 3012862 - RNA, 21 nt, Human
ccagcgagcccugguggcagu

SEQ ID NO: 3012863 - RNA, 18 nt, Human
ccagccccuucugaccca

SEQ ID NO: 3012864 - RNA, 17 nt, Human
ccagccccuucugaccc

SEQ ID NO: 3012865 - RNA, 16 nt, Human
ccagccccuucugacc

SEQ ID NO: 3012866 - RNA, 15 nt, Human
ccagccccuucugac

SEQ ID NO: 3012867 - RNA, 18 nt, Human
ccagccccuggaugcagc

SEQ ID NO: 3012868 - RNA, 18 nt, Human
ccagccccauccucugua

SEQ ID NO: 3012869 - RNA, 23 nt, Human
ccagccccauccucuguacagag

SEQ ID NO: 3012870 - RNA, 13 nt, Human
ccagcagccugga

SEQ ID NO: 3012871 - RNA, 15 nt, Human
ccagccccuggaugc

SEQ ID NO: 3012872 - RNA, 14 nt, Human
ccagccccuggaug

SEQ ID NO: 3012873 - RNA, 13 nt, Human
ccagccccuggau

SEQ ID NO: 3012874 - RNA, 12 nt, Human
ccagcagaaaug

SEQ ID NO: 3012875 - RNA, 12 nt, Human
ccagcagccugg

SEQ ID NO: 3012876 - RNA, 11 nt, Human
ccagcagccug

SEQ ID NO: 3012877 - RNA, 16 nt, Human
ccagcagaaaugccuu

SEQ ID NO: 3012878 - RNA, 17 nt, Human
ccagcagaaaugccuua

SEQ ID NO: 3012879 - RNA, 22 nt, Human
ccagcagaaaugccuuacccuc

SEQ ID NO: 3012880 - RNA, 18 nt, Human
ccacuugagugucaagcu

SEQ ID NO: 3012881 - RNA, 19 nt, Human
ccacugcacuauagccuag

SEQ ID NO: 3012882 - RNA, 20 nt, Human
ccacugcacuauagccuagg

SEQ ID NO: 3012883 - RNA, 13 nt, Human
ccacugcaccggg

SEQ ID NO: 3012884 - RNA, 14 nt, Human
ccacugcaccgggc

SEQ ID NO: 3012885 - RNA, 17 nt, Human
ccacugcaccgggccac

SEQ ID NO: 3012886 - RNA, 19 nt, Human
ccacugcaccgggccacag

SEQ ID NO: 3012887 - RNA, 17 nt, Human
ccagacccggcugcgug

SEQ ID NO: 3012888 - RNA, 16 nt, Human
ccagacccggcugcgu

SEQ ID NO: 3012889 - RNA, 14 nt, Human
ccacuuuuguucuu

SEQ ID NO: 3012890 - RNA, 15 nt, Human
ccacuuuuguucuug

SEQ ID NO: 3012891 - RNA, 21 nt, Human
ccacuuuuguucuugguuugu

SEQ ID NO: 3012892 - RNA, 13 nt, Human
ccacuuucuagcc

SEQ ID NO: 3012893 - RNA, 19 nt, Human
ccacuuucuagccagagga

SEQ ID NO: 3012894 - RNA, 18 nt, Human
ccacuuucuagccagagg

SEQ ID NO: 3012895 - RNA, 20 nt, Human
ccacuuucuagccagaggag

SEQ ID NO: 3012896 - RNA, 13 nt, Human
ccagaugcaccag

SEQ ID NO: 3012897 - RNA, 14 nt, Human
ccagaugcaccagc

SEQ ID NO: 3012898 - RNA, 18 nt, Human
ccagagacacaagccuuc

SEQ ID NO: 3012899 - RNA, 16 nt, Human
ccagagacacaagccu

SEQ ID NO: 3012900 - RNA, 14 nt, Human
cccauucuuggccc

SEQ ID NO: 3012901 - RNA, 23 nt, Human
cccauucugccugcccaggcccc

SEQ ID NO: 3012902 - RNA, 12 nt, Human
ccccagccccaa

SEQ ID NO: 3012903 - RNA, 10 nt, Human
ccccagcccc

SEQ ID NO: 3012904 - RNA, 21 nt, Human
ccccauucugccugcccaggc

SEQ ID NO: 3012905 - RNA, 14 nt, Human
ccccagccccaaaa

SEQ ID NO: 3012906 - RNA, 14 nt, Human
ccccagccccaucc

SEQ ID NO: 3012907 - RNA, 20 nt, Human
ccccaaaacucuccucugcu

SEQ ID NO: 3012908 - RNA, 18 nt, Human
ccccaaaacucuccucug

SEQ ID NO: 3012909 - RNA, 13 nt, Human
ccccggccaccug

SEQ ID NO: 3012910 - RNA, 18 nt, Human
ccccggccaccugcggug

SEQ ID NO: 3012911 - RNA, 14 nt, Human
ccccggccaccugc

SEQ ID NO: 3012912 - RNA, 14 nt, Human
ccccgcccaggcuu

SEQ ID NO: 3012913 - RNA, 12 nt, Human
ccccgcccaggc

SEQ ID NO: 3012914 - RNA, 14 nt, Human
cccccuuccaugga

SEQ ID NO: 3012915 - RNA, 17 nt, Human
cccagcccacuucugcc

SEQ ID NO: 3012916 - RNA, 19 nt, Human
cccagcccacuucugccau

SEQ ID NO: 3012917 - RNA, 23 nt, Human
cccagccccaaaacucuccucug

SEQ ID NO: 3012918 - RNA, 21 nt, Human
cccagccccaaaacucuccuc

SEQ ID NO: 3012919 - RNA, 19 nt, Human
cccaggcuggcgugcagug

SEQ ID NO: 3012920 - RNA, 20 nt, Human
cccaggcuggcgugcagugg

SEQ ID NO: 3012921 - RNA, 18 nt, Human
cccaggcuggcgugcagu

SEQ ID NO: 3012922 - RNA, 14 nt, Human
cccauccucuguac

SEQ ID NO: 3012923 - RNA, 19 nt, Human
cccauccucuguacagagc

SEQ ID NO: 3012924 - RNA, 15 nt, Human
cccauccucuguaca

SEQ ID NO: 3012925 - RNA, 20 nt, Human
cccauccucuguacagagcc

SEQ ID NO: 3012926 - RNA, 18 nt, Human
cccaccaucaugucuggc

SEQ ID NO: 3012927 - RNA, 15 nt, Human
cccacccaagggccu

SEQ ID NO: 3012928 - RNA, 15 nt, Human
cccaagcucugcucc

SEQ ID NO: 3012929 - RNA, 17 nt, Human
cccaagcucugcuccuc

SEQ ID NO: 3012930 - RNA, 18 nt, Human
cccaccgcagacaggacc

SEQ ID NO: 3012931 - RNA, 15 nt, Human
cccaccgcagacagg

SEQ ID NO: 3012932 - RNA, 17 nt, Human
ccaugggccuccugugu

SEQ ID NO: 3012933 - RNA, 18 nt, Human
ccaugaggaacaaggcaa

SEQ ID NO: 3012934 - RNA, 17 nt, Human
ccaugaggaacaaggca

SEQ ID NO: 3012935 - RNA, 16 nt, Human
ccaugaggaacaaggc

SEQ ID NO: 3012936 - RNA, 13 nt, Human
ccucaugcugcca

SEQ ID NO: 3012937 - RNA, 15 nt, Human
ccucaugcugccaau

SEQ ID NO: 3012938 - RNA, 11 nt, Human
ccucaggcagg

SEQ ID NO: 3012939 - RNA, 21 nt, Human
ccucccaacucaccccagccc

SEQ ID NO: 3012940 - RNA, 20 nt, Human
ccucccaacucaccccagcc

SEQ ID NO: 3012941 - RNA, 17 nt, Human
ccucccaacucacccca

SEQ ID NO: 3012942 - RNA, 16 nt, Human
ccucaugcugccaaua

SEQ ID NO: 3012943 - RNA, 16 nt, Human
ccucgaacuggcugca

SEQ ID NO: 3012944 - RNA, 15 nt, Human
ccucgaacuggcugc

SEQ ID NO: 3012945 - RNA, 18 nt, Human
ccuccuuugugaggaagc

SEQ ID NO: 3012946 - RNA, 20 nt, Human
ccuccuuugugaggaagccg

SEQ ID NO: 3012947 - RNA, 19 nt, Human
ccuccuuugugaggaagcc

SEQ ID NO: 3012948 - RNA, 20 nt, Human
ccucugccucugacacacag

SEQ ID NO: 3012949 - RNA, 21 nt, Human
ccucugccucugacacacagc

SEQ ID NO: 3012950 - RNA, 23 nt, Human
ccucugccucugacacacagcuc

SEQ ID NO: 3012951 - RNA, 11 nt, Human
ccucugccuga

SEQ ID NO: 3012952 - RNA, 20 nt, Human
ccucugccugaagucacaca

SEQ ID NO: 3012953 - RNA, 12 nt, Human
ccugaggggccu

SEQ ID NO: 3012954 - RNA, 16 nt, Human
ccugaggggccucuua

SEQ ID NO: 3012955 - RNA, 21 nt, Human
ccugaggcugggcucccuucc

SEQ ID NO: 3012956 - RNA, 19 nt, Human
ccugaggcugggcucccuu

SEQ ID NO: 3012957 - RNA, 17 nt, Human
ccugaggcugggcuccc

SEQ ID NO: 3012958 - RNA, 16 nt, Human
ccugaggcugggcucc

SEQ ID NO: 3012959 - RNA, 17 nt, Human
ccugcaggcagccaggc

SEQ ID NO: 3012960 - RNA, 16 nt, Human
ccugcaggcagccagg

SEQ ID NO: 3012961 - RNA, 12 nt, Human
ccugcagagggc

SEQ ID NO: 3012962 - RNA, 15 nt, Human
ccugcaggcagccag

SEQ ID NO: 3012963 - RNA, 21 nt, Human
ccugcaggcagccaggccaca

SEQ ID NO: 3012964 - RNA, 20 nt, Human
ccugcaggcagccaggccac

SEQ ID NO: 3012965 - RNA, 19 nt, Human
ccugcaggcagccaggcca

SEQ ID NO: 3012966 - RNA, 18 nt, Human
ccugcaggcagccaggcc

SEQ ID NO: 3012967 - RNA, 23 nt, Human
ccugcaggcagccaggccacaag

SEQ ID NO: 3012968 - RNA, 19 nt, Human
ccucuuuggucuacacugu

SEQ ID NO: 3012969 - RNA, 16 nt, Human
ccucuuugagugaagc

SEQ ID NO: 3012970 - RNA, 21 nt, Human
ccugcugcaguugccagucac

SEQ ID NO: 3012971 - RNA, 22 nt, Human
ccugcugcaguugccagucacc

SEQ ID NO: 3012972 - RNA, 11 nt, Human
ccugcugcagu

SEQ ID NO: 3012973 - RNA, 16 nt, Human
ccugcugcaguugcca

SEQ ID NO: 3012974 - RNA, 12 nt, Human
ccugcugcaguu

SEQ ID NO: 3012975 - RNA, 15 nt, Human
ccugccucuucucua

SEQ ID NO: 3012976 - RNA, 20 nt, Human
ccugccuccuuugugaggaa

SEQ ID NO: 3012977 - RNA, 19 nt, Human
ccugccuccuuugugagga

SEQ ID NO: 3012978 - RNA, 15 nt, Human
ccugccuccuuugug

SEQ ID NO: 3012979 - RNA, 13 nt, Human
ccugccuccuuug

SEQ ID NO: 3012980 - RNA, 22 nt, Human
ccugccuccuuugugaggaagc

SEQ ID NO: 3012981 - RNA, 21 nt, Human
ccugccuccuuugugaggaag

SEQ ID NO: 3012982 - RNA, 23 nt, Human
ccugccuccuuugugaggaagcc

SEQ ID NO: 3012983 - RNA, 16 nt, Human
cccugaaagcccugag

SEQ ID NO: 3012984 - RNA, 12 nt, Human
cccugaaggccc

SEQ ID NO: 3012985 - RNA, 19 nt, Human
cccugaaggccccgcccag

SEQ ID NO: 3012986 - RNA, 16 nt, Human
cccugaaggccccgcc

SEQ ID NO: 3012987 - RNA, 14 nt, Human
cccugaaggccccg

SEQ ID NO: 3012988 - RNA, 13 nt, Human
cccugaaggcccc

SEQ ID NO: 3012989 - RNA, 14 nt, Human
cccugacaacacuc

SEQ ID NO: 3012990 - RNA, 22 nt, Human
cccugaaggccccgcccaggcu

SEQ ID NO: 3012991 - RNA, 20 nt, Human
cccugaaggccccgcccagg

SEQ ID NO: 3012992 - RNA, 22 nt, Human
cccugacaacacucauugaccu

SEQ ID NO: 3012993 - RNA, 16 nt, Human
cccugacaacacucau

SEQ ID NO: 3012994 - RNA, 18 nt, Human
cccugaaagcccugagcu

SEQ ID NO: 3012995 - RNA, 13 nt, Human
cccuggaugcagc

SEQ ID NO: 3012996 - RNA, 21 nt, Human
cccuggaugcagccucacagu

SEQ ID NO: 3012997 - RNA, 17 nt, Human
cccuggaugcagccuca

SEQ ID NO: 3012998 - RNA, 22 nt, Human
cccugcccaccuggccucugca

SEQ ID NO: 3012999 - RNA, 14 nt, Human
cccugcccggcugc

SEQ ID NO: 3013000 - RNA, 17 nt, Human
cccugcccggcugcgga

SEQ ID NO: 3013001 - RNA, 20 nt, Human
cccugcccaccuggccucug

SEQ ID NO: 3013002 - RNA, 16 nt, Human
cccugagcuuucugcu

SEQ ID NO: 3013003 - RNA, 15 nt, Human
cccuuccucuuucca

SEQ ID NO: 3013004 - RNA, 19 nt, Human
ccgaaagggacuuggaagc

SEQ ID NO: 3013005 - RNA, 17 nt, Human
ccgaaaacguggcugcu

SEQ ID NO: 3013006 - RNA, 16 nt, Human
ccgaaaacguggcugc

SEQ ID NO: 3013007 - RNA, 16 nt, Human
ccgaauagcugggacu

SEQ ID NO: 3013008 - RNA, 15 nt, Human
ccgcagacaggacca

SEQ ID NO: 3013009 - RNA, 13 nt, Human
ccgaccagacacc

SEQ ID NO: 3013010 - RNA, 17 nt, Human
ccgaccagacaccuuga

SEQ ID NO: 3013011 - RNA, 12 nt, Human
ccgcccaggcuu

SEQ ID NO: 3013012 - RNA, 17 nt, Human
ccgcagacaggaccagg

SEQ ID NO: 3013013 - RNA, 16 nt, Human
ccgcagacaggaccag

SEQ ID NO: 3013014 - RNA, 23 nt, Human
cccugugauggggcccugccucc

SEQ ID NO: 3013015 - RNA, 22 nt, Human
cccugugauggggcccugccuc

SEQ ID NO: 3013016 - RNA, 21 nt, Human
cccugugauggggcccugccu

SEQ ID NO: 3013017 - RNA, 18 nt, Human
ccggcaggguccuagaaa

SEQ ID NO: 3013018 - RNA, 15 nt, Human
ccggccccugcuggu

SEQ ID NO: 3013019 - RNA, 16 nt, Human
ccggccaccugcggug

SEQ ID NO: 3013020 - RNA, 19 nt, Human
ccuagcauacguacacauu

SEQ ID NO: 3013021 - RNA, 17 nt, Human
ccuagcacuuugggagg

SEQ ID NO: 3013022 - RNA, 20 nt, Human
ccuagccugugccucuggga

SEQ ID NO: 3013023 - RNA, 14 nt, Human
ccuaaucuucugaa

SEQ ID NO: 3013024 - RNA, 12 nt, Human
ccggcuccaggc

SEQ ID NO: 3013025 - RNA, 13 nt, Human
ccggcuccaggcu

SEQ ID NO: 3013026 - RNA, 14 nt, Human
ccggcuccaggcuc

SEQ ID NO: 3013027 - RNA, 15 nt, Human
ccggcuccaggcucc

SEQ ID NO: 3013028 - RNA, 15 nt, Human
ccgucuaccugaggg

SEQ ID NO: 3013029 - RNA, 14 nt, Human
ccgucuaccugagg

SEQ ID NO: 3013030 - RNA, 16 nt, Human
ccgugaggccagagac

SEQ ID NO: 3013031 - RNA, 14 nt, Human
ccgugaggccagag

SEQ ID NO: 3013032 - RNA, 13 nt, Human
ccgugaggccaga

SEQ ID NO: 3013033 - RNA, 12 nt, Human
ccgugaggccag

SEQ ID NO: 3013034 - RNA, 17 nt, Human
ccgucuaccugaggggc

SEQ ID NO: 3013035 - RNA, 13 nt, Human
ccuuucccuuggu

SEQ ID NO: 3013036 - RNA, 17 nt, Human
ccuuucaauaggaaaaa

SEQ ID NO: 3013037 - RNA, 15 nt, Human
ccuuucaauaggaaa

SEQ ID NO: 3013038 - RNA, 22 nt, Human
ccuucuguccuacucuguguca

SEQ ID NO: 3013039 - RNA, 20 nt, Human
ccuucuguccuacucugugu

SEQ ID NO: 3013040 - RNA, 21 nt, Human
ccuucuguccuacucuguguc

SEQ ID NO: 3013041 - RNA, 23 nt, Human
ccuucucuccagccccuggaugc

SEQ ID NO: 3013042 - RNA, 21 nt, Human
ccuucucuccagccccuggau

SEQ ID NO: 3013043 - RNA, 14 nt, Human
ccuucucugaagga

SEQ ID NO: 3013044 - RNA, 16 nt, Human
ccuucucugaaggaca

SEQ ID NO: 3013045 - RNA, 20 nt, Human
ccuucucuccagccccugga

SEQ ID NO: 3013046 - RNA, 13 nt, Human
ccuguucagcucc

SEQ ID NO: 3013047 - RNA, 18 nt, Human
ccuguucccaugagauga

SEQ ID NO: 3013048 - RNA, 17 nt, Human
ccuguucuggcagaguu

SEQ ID NO: 3013049 - RNA, 12 nt, Human
ccuguucuggca

SEQ ID NO: 3013050 - RNA, 23 nt, Human
ccuguucagcuccagcucaccag

SEQ ID NO: 3013051 - RNA, 20 nt, Human
ccuguucagcuccagcucac

SEQ ID NO: 3013052 - RNA, 21 nt, Human
ccuguucagcuccagcucacc

SEQ ID NO: 3013053 - RNA, 14 nt, Human
ccuguucagcucca

SEQ ID NO: 3013054 - RNA, 15 nt, Human
ccuguucagcuccag

SEQ ID NO: 3013055 - RNA, 16 nt, Human
ccuguucagcuccagc

SEQ ID NO: 3013056 - RNA, 19 nt, Human
ccuguucagcuccagcuca

SEQ ID NO: 3013057 - RNA, 16 nt, Human
ccuguugggccaggag

SEQ ID NO: 3013058 - RNA, 20 nt, Human
ccuguugggccaggagccuc

SEQ ID NO: 3013059 - RNA, 19 nt, Human
ccuguugggccaggagccu

SEQ ID NO: 3013060 - RNA, 18 nt, Human
ccuguugggccaggagcc

SEQ ID NO: 3013061 - RNA, 17 nt, Human
ccuguugggccaggagc

SEQ ID NO: 3013062 - RNA, 16 nt, Human
ccuuagcaaauucugu

SEQ ID NO: 3013063 - RNA, 19 nt, Human
ccuuagcagggaaacagcu

SEQ ID NO: 3013064 - RNA, 20 nt, Human
ccuuagcagggaaacagcua

SEQ ID NO: 3013065 - RNA, 12 nt, Human
ccuucccaccuc

SEQ ID NO: 3013066 - RNA, 19 nt, Human
ccuucccaccucucucacu

SEQ ID NO: 3013067 - RNA, 14 nt, Human
ccuucccaccucuc

SEQ ID NO: 3013068 - RNA, 18 nt, Human
ccuuauggaacacucuga

SEQ ID NO: 3013069 - RNA, 17 nt, Human
ccuuauggaacacucug

SEQ ID NO: 3013070 - RNA, 16 nt, Human
ccuuauggaacacucu

SEQ ID NO: 3013071 - RNA, 14 nt, Human
ccuuauggaacacu

SEQ ID NO: 3013072 - RNA, 20 nt, Human
ccuuauggaacacucugaga

SEQ ID NO: 3013073 - RNA, 19 nt, Human
ccuuauggaacacucugag

SEQ ID NO: 3013074 - RNA, 22 nt, Human
ccuuauggaacacucugagacu

SEQ ID NO: 3013075 - RNA, 12 nt, Human
ccuuauggaaca

SEQ ID NO: 3013076 - RNA, 13 nt, Human
cuaacuuggguua

SEQ ID NO: 3013077 - RNA, 22 nt, Human
cuaacuugucuuuggacccuga

SEQ ID NO: 3013078 - RNA, 14 nt, Human
cuaacuugucuuug

SEQ ID NO: 3013079 - RNA, 15 nt, Human
cguguuaugacucca

SEQ ID NO: 3013080 - RNA, 19 nt, Human
cguguuaugacuccagaau

SEQ ID NO: 3013081 - RNA, 18 nt, Human
cgugaguccuggcauggg

SEQ ID NO: 3013082 - RNA, 19 nt, Human
cgugaguccuggcauggga

SEQ ID NO: 3013083 - RNA, 11 nt, Human
cuaaagcugcc

SEQ ID NO: 3013084 - RNA, 22 nt, Human
cgugagccacugcaccgggcca

SEQ ID NO: 3013085 - RNA, 14 nt, Human
cgugaggccagaga

SEQ ID NO: 3013086 - RNA, 14 nt, Human
cgugagccacugca

SEQ ID NO: 3013087 - RNA, 15 nt, Human
cgugagccacugcac

SEQ ID NO: 3013088 - RNA, 20 nt, Human
cgugagccacugcaccgggc

SEQ ID NO: 3013089 - RNA, 14 nt, Human
cgugacaacacuug

SEQ ID NO: 3013090 - RNA, 15 nt, Human
cgugacaacacuugu

SEQ ID NO: 3013091 - RNA, 12 nt, Human
cgugacaacacu

SEQ ID NO: 3013092 - RNA, 19 nt, Human
cuaauaaaaaggugaccau

SEQ ID NO: 3013093 - RNA, 14 nt, Human
cuaaguuuuuaugg

SEQ ID NO: 3013094 - RNA, 19 nt, Human
cuacaaaaagcauaaaaau

SEQ ID NO: 3013095 - RNA, 20 nt, Human
cgcugccccuggcagccccu

SEQ ID NO: 3013096 - RNA, 19 nt, Human
cgcugccccuggcagcccc

SEQ ID NO: 3013097 - RNA, 17 nt, Human
cgcuggagugcagugag

SEQ ID NO: 3013098 - RNA, 18 nt, Human
cgcuggagugcagugagc

SEQ ID NO: 3013099 - RNA, 23 nt, Human
cgccaaggcugggggaagaagcu

SEQ ID NO: 3013100 - RNA, 23 nt, Human
cggagucccaccuuggcugcagg

SEQ ID NO: 3013101 - RNA, 21 nt, Human
cggagucccaccuuggcugca

SEQ ID NO: 3013102 - RNA, 22 nt, Human
cggagucccaccuuggcugcag

SEQ ID NO: 3013103 - RNA, 20 nt, Human
cggagacggagucccaccuu

SEQ ID NO: 3013104 - RNA, 17 nt, Human
cggagacggagucccac

SEQ ID NO: 3013105 - RNA, 17 nt, Human
cgggccacagagaaagu

SEQ ID NO: 3013106 - RNA, 19 nt, Human
cgggcucagcaaaagaugc

SEQ ID NO: 3013107 - RNA, 12 nt, Human
cgggcucugccu

SEQ ID NO: 3013108 - RNA, 22 nt, Human
cguacacauuuuauuuuauuau

SEQ ID NO: 3013109 - RNA, 16 nt, Human
cguacacauuuuauuu

SEQ ID NO: 3013110 - RNA, 20 nt, Human
cgguggcucacgccuguaau

SEQ ID NO: 3013111 - RNA, 13 nt, Human
cuauguuaauauu

SEQ ID NO: 3013112 - RNA, 15 nt, Human
cuauguuaauauuuu

SEQ ID NO: 3013113 - RNA, 17 nt, Human
cuauguuaauauuuuag

SEQ ID NO: 3013114 - RNA, 14 nt, Human
cuauguuaauauuu

SEQ ID NO: 3013115 - RNA, 21 nt, Human
cuauguuaauauuuuaggugu

SEQ ID NO: 3013116 - RNA, 18 nt, Human
cuauguugcccaggcagg

SEQ ID NO: 3013117 - RNA, 19 nt, Human
cuauguugcccaggcaggu

SEQ ID NO: 3013118 - RNA, 21 nt, Human
cuauguugcccaggcaggucu

SEQ ID NO: 3013119 - RNA, 22 nt, Human
cuauguugcccaggcaggucuu

SEQ ID NO: 3013120 - RNA, 14 nt, Human
cuaugugagaccau

SEQ ID NO: 3013121 - RNA, 14 nt, Human
cuaucucccccagc

SEQ ID NO: 3013122 - RNA, 13 nt, Human
cuaucucccccag

SEQ ID NO: 3013123 - RNA, 17 nt, Human
cuaucacugguuugguu

SEQ ID NO: 3013124 - RNA, 12 nt, Human
cuauguuuuugu

SEQ ID NO: 3013125 - RNA, 21 nt, Human
cucaagugauucuccugccuc

SEQ ID NO: 3013126 - RNA, 23 nt, Human
cucaauuauuuugcauuuuuucu

SEQ ID NO: 3013127 - RNA, 18 nt, Human
cucaguagucagacugga

SEQ ID NO: 3013128 - RNA, 23 nt, Human
cucaggugucccugcacuugcag

SEQ ID NO: 3013129 - RNA, 22 nt, Human
cucagucuggcccuuccuuuuc

SEQ ID NO: 3013130 - RNA, 15 nt, Human
cucaguccauagcag

SEQ ID NO: 3013131 - RNA, 17 nt, Human
cucaguccauagcagag

SEQ ID NO: 3013132 - RNA, 20 nt, Human
cucagucuggcccuuccuuu

SEQ ID NO: 3013133 - RNA, 15 nt, Human
cucaggccagcugcu

SEQ ID NO: 3013134 - RNA, 21 nt, Human
cucaggccaaacucaccugcc

SEQ ID NO: 3013135 - RNA, 20 nt, Human
cucaggccaaacucaccugc

SEQ ID NO: 3013136 - RNA, 19 nt, Human
cucaggccaaacucaccug

SEQ ID NO: 3013137 - RNA, 11 nt, Human
cucaggccugg

SEQ ID NO: 3013138 - RNA, 22 nt, Human
cucaggccugggggcugggcag

SEQ ID NO: 3013139 - RNA, 18 nt, Human
cucaggccagcugcuugg

SEQ ID NO: 3013140 - RNA, 17 nt, Human
cucaggccagcugcuug

SEQ ID NO: 3013141 - RNA, 16 nt, Human
cucaggccagcugcuu

SEQ ID NO: 3013142 - RNA, 13 nt, Human
cucagaagacacu

SEQ ID NO: 3013143 - RNA, 15 nt, Human
cucagaagacacuga

SEQ ID NO: 3013144 - RNA, 17 nt, Human
cucagaagacacugaug

SEQ ID NO: 3013145 - RNA, 20 nt, Human
cucagaagacacugaugggc

SEQ ID NO: 3013146 - RNA, 22 nt, Human
cucagaagacacugaugggcaa

SEQ ID NO: 3013147 - RNA, 17 nt, Human
cucaccuuucccaucuu

SEQ ID NO: 3013148 - RNA, 23 nt, Human
cucagaagacacugaugggcaac

SEQ ID NO: 3013149 - RNA, 19 nt, Human
cucagccucccgaauagcu

SEQ ID NO: 3013150 - RNA, 21 nt, Human
cucagccucccgaauagcugg

SEQ ID NO: 3013151 - RNA, 22 nt, Human
cucagccucccgaauagcuggg

SEQ ID NO: 3013152 - RNA, 16 nt, Human
cucucuguaauaaacu

SEQ ID NO: 3013153 - RNA, 21 nt, Human
cucucuguaauaaacucauuu

SEQ ID NO: 3013154 - RNA, 12 nt, Human
cucuccuccaga

SEQ ID NO: 3013155 - RNA, 15 nt, Human
cucuccuccagaguc

SEQ ID NO: 3013156 - RNA, 13 nt, Human
cucuccuccagag

SEQ ID NO: 3013157 - RNA, 16 nt, Human
cucuccuccagaguca

SEQ ID NO: 3013158 - RNA, 18 nt, Human
cuccuuugugaggaagcc

SEQ ID NO: 3013159 - RNA, 17 nt, Human
cuccuuugugaggaagc

SEQ ID NO: 3013160 - RNA, 17 nt, Human
cucgguguggagaagcg

SEQ ID NO: 3013161 - RNA, 16 nt, Human
cucgguguggagaagc

SEQ ID NO: 3013162 - RNA, 14 nt, Human
cucugcacuccccu

SEQ ID NO: 3013163 - RNA, 16 nt, Human
cucugcacuccccugc

SEQ ID NO: 3013164 - RNA, 15 nt, Human
cucugcacuccccug

SEQ ID NO: 3013165 - RNA, 19 nt, Human
cucugcacaagcugcaccc

SEQ ID NO: 3013166 - RNA, 21 nt, Human
cucugcacaagcugcacccuc

SEQ ID NO: 3013167 - RNA, 20 nt, Human
cucugcacaagcugcacccu

SEQ ID NO: 3013168 - RNA, 20 nt, Human
cucugcuccucuccccagca

SEQ ID NO: 3013169 - RNA, 21 nt, Human
cucugcuccucuccccagcaa

SEQ ID NO: 3013170 - RNA, 17 nt, Human
cucugcacuccccugcu

SEQ ID NO: 3013171 - RNA, 21 nt, Human
cucugcugacagacacaggcc

SEQ ID NO: 3013172 - RNA, 22 nt, Human
cucugcugacagacacaggccc

SEQ ID NO: 3013173 - RNA, 20 nt, Human
cucugcugacagacacaggc

SEQ ID NO: 3013174 - RNA, 13 nt, Human
cucugcugcuggc

SEQ ID NO: 3013175 - RNA, 23 nt, Human
cucugcugacagacacaggcccg

SEQ ID NO: 3013176 - RNA, 13 nt, Human
cucuguacagagc

SEQ ID NO: 3013177 - RNA, 15 nt, Human
cucuguacagagccc

SEQ ID NO: 3013178 - RNA, 14 nt, Human
cucuguacagagcc

SEQ ID NO: 3013179 - RNA, 16 nt, Human
cucugcugcuggcugg

SEQ ID NO: 3013180 - RNA, 15 nt, Human
cucugcugcuggcug

SEQ ID NO: 3013181 - RNA, 14 nt, Human
cucugcugcuggcu

SEQ ID NO: 3013182 - RNA, 16 nt, Human
cucuguacagagccca

SEQ ID NO: 3013183 - RNA, 23 nt, Human
cuccgcuuucuacccagcgagcc

SEQ ID NO: 3013184 - RNA, 16 nt, Human
cuccuguaccucuuga

SEQ ID NO: 3013185 - RNA, 15 nt, Human
cuccuuucaccacau

SEQ ID NO: 3013186 - RNA, 14 nt, Human
cuccuuguguuacu

SEQ ID NO: 3013187 - RNA, 19 nt, Human
cuccuggccucaagugauu

SEQ ID NO: 3013188 - RNA, 18 nt, Human
cuccugggcuaagugauc

SEQ ID NO: 3013189 - RNA, 19 nt, Human
cuccuggcccacugcaucg

SEQ ID NO: 3013190 - RNA, 14 nt, Human
cuccucugcugcug

SEQ ID NO: 3013191 - RNA, 13 nt, Human
cuccucugcugcu

SEQ ID NO: 3013192 - RNA, 23 nt, Human
cuccaggugcacaagcuccaagc

SEQ ID NO: 3013193 - RNA, 15 nt, Human
cuccaggcuccuuua

SEQ ID NO: 3013194 - RNA, 23 nt, Human
cuccaggcuccuuuagcgcccag

SEQ ID NO: 3013195 - RNA, 20 nt, Human
cuccaggcuguaucccauga

SEQ ID NO: 3013196 - RNA, 22 nt, Human
cuccaggugcacaagcuccaag

SEQ ID NO: 3013197 - RNA, 20 nt, Human
cucccucuuucccucccuuc

SEQ ID NO: 3013198 - RNA, 11 nt, Human
uuugcagagua

SEQ ID NO: 3013199 - RNA, 14 nt, Human
uuugcagacaggca

SEQ ID NO: 3013200 - RNA, 18 nt, Human
uuugccauguuggccagg

SEQ ID NO: 3013201 - RNA, 17 nt, Human
uuugaggucuguucuuu

SEQ ID NO: 3013202 - RNA, 22 nt, Human
uuugaggucuguucuuuccaaa

SEQ ID NO: 3013203 - RNA, 15 nt, Human
uuugagcagggcuca

SEQ ID NO: 3013204 - RNA, 21 nt, Human
uuuguccccaccgcagacagg

SEQ ID NO: 3013205 - RNA, 13 nt, Human
uuuguccccaccg

SEQ ID NO: 3013206 - RNA, 16 nt, Human
uuuguugucagcugaa

SEQ ID NO: 3013207 - RNA, 19 nt, Human
uuuggugguuucagaaaug

SEQ ID NO: 3013208 - RNA, 16 nt, Human
uuuguaaauuaacuuu

SEQ ID NO: 3013209 - RNA, 17 nt, Human
uuuguaaauuaacuuuu

SEQ ID NO: 3013210 - RNA, 15 nt, Human
uuuguaaauuaacuu

SEQ ID NO: 3013211 - RNA, 22 nt, Human
uuuguaaauuaacuuuuauaaa

SEQ ID NO: 3013212 - RNA, 19 nt, Human
uuuucaauaacuggaacac

SEQ ID NO: 3013213 - RNA, 16 nt, Human
uuuucaauaacuggaa

SEQ ID NO: 3013214 - RNA, 13 nt, Human
uuuucaauaacug

SEQ ID NO: 3013215 - RNA, 23 nt, Human
uuuucaauaacuggaacacucua

SEQ ID NO: 3013216 - RNA, 15 nt, Human
uuuucacaguucucu

SEQ ID NO: 3013217 - RNA, 19 nt, Human
uuuuccaugaguccccugu

SEQ ID NO: 3013218 - RNA, 18 nt, Human
uuuuccaugaguccccug

SEQ ID NO: 3013219 - RNA, 15 nt, Human
uuuuccuucagugcc

SEQ ID NO: 3013220 - RNA, 17 nt, Human
uuuucuugcaugaggcu

SEQ ID NO: 3013221 - RNA, 14 nt, Human
uuuucuucucccuc

SEQ ID NO: 3013222 - RNA, 13 nt, Human
uuuuauauagcaa

SEQ ID NO: 3013223 - RNA, 15 nt, Human
uuuuauauucucagc

SEQ ID NO: 3013224 - RNA, 22 nt, Human
uuuuaucagaacuauguuuuug

SEQ ID NO: 3013225 - RNA, 18 nt, Human
uuuuaucgucacugcuua

SEQ ID NO: 3013226 - RNA, 22 nt, Human
uuuauuuggaaaggaaugcaaa

SEQ ID NO: 3013227 - RNA, 19 nt, Human
uuucaauaggaaaaacuga

SEQ ID NO: 3013228 - RNA, 22 nt, Human
uuucaauaggaaaaacugauuu

SEQ ID NO: 3013229 - RNA, 20 nt, Human
uuucaauaggaaaaacugau

SEQ ID NO: 3013230 - RNA, 16 nt, Human
uuuauuuauuuauuca

SEQ ID NO: 3013231 - RNA, 13 nt, Human
uuuccaggaaggc

SEQ ID NO: 3013232 - RNA, 12 nt, Human
uuuccaaaguac

SEQ ID NO: 3013233 - RNA, 15 nt, Human
uuuccaaaguacacu

SEQ ID NO: 3013234 - RNA, 15 nt, Human
uuucagccaagaauu

SEQ ID NO: 3013235 - RNA, 22 nt, Human
uuucauugcugggcuugucugu

SEQ ID NO: 3013236 - RNA, 21 nt, Human
uuuccucuuuggucuacacug

SEQ ID NO: 3013237 - RNA, 14 nt, Human
uuucuaaaggcuac

SEQ ID NO: 3013238 - RNA, 17 nt, Human
uuucuaaagcugccagc

SEQ ID NO: 3013239 - RNA, 14 nt, Human
uuucuaaagcugcc

SEQ ID NO: 3013240 - RNA, 15 nt, Human
uuucuagccagagga

SEQ ID NO: 3013241 - RNA, 23 nt, Human
uuuacuuuuuggaaaagaauaaa

SEQ ID NO: 3013242 - RNA, 15 nt, Human
uuuacuuuuuggaaa

SEQ ID NO: 3013243 - RNA, 15 nt, Human
uuuacuuuguguuca

SEQ ID NO: 3013244 - RNA, 19 nt, Human
uuuauuuaguuccuugagu

SEQ ID NO: 3013245 - RNA, 16 nt, Human
uuuauugucaaagugg

SEQ ID NO: 3013246 - RNA, 14 nt, Human
uuuauugucaaagu

SEQ ID NO: 3013247 - RNA, 21 nt, Human
uuuaucgucacugcuuaacuu

SEQ ID NO: 3013248 - RNA, 16 nt, Human
uuuaucgucacugcuu

SEQ ID NO: 3013249 - RNA, 16 nt, Human
uuuauaaacuuuaccu

SEQ ID NO: 3013250 - RNA, 14 nt, Human
uuuauaaacuuuac

SEQ ID NO: 3013251 - RNA, 17 nt, Human
uuuuuuccuucagugcc

SEQ ID NO: 3013252 - RNA, 12 nt, Human
uuuuuuacuaau

SEQ ID NO: 3013253 - RNA, 19 nt, Human
uucuccagucauuauguua

SEQ ID NO: 3013254 - RNA, 17 nt, Human
uucuccagucauuaugu

SEQ ID NO: 3013255 - RNA, 11 nt, Human
uucuccaggcu

SEQ ID NO: 3013256 - RNA, 13 nt, Human
uucuccacccugc

SEQ ID NO: 3013257 - RNA, 16 nt, Human
uucuccaagcaggaca

SEQ ID NO: 3013258 - RNA, 18 nt, Human
uucucuccagccccugga

SEQ ID NO: 3013259 - RNA, 22 nt, Human
uucucuccuguaccucuugagc

SEQ ID NO: 3013260 - RNA, 21 nt, Human
uucugacccugcuucaaauau

SEQ ID NO: 3013261 - RNA, 21 nt, Human
uucugacccaugcugcccugu

SEQ ID NO: 3013262 - RNA, 20 nt, Human
uucugacccaugcugcccug

SEQ ID NO: 3013263 - RNA, 18 nt, Human
uucugacccaugcugccc

SEQ ID NO: 3013264 - RNA, 16 nt, Human
uucugacccaugcugc

SEQ ID NO: 3013265 - RNA, 14 nt, Human
uucuauuuauuugu

SEQ ID NO: 3013266 - RNA, 21 nt, Human
uucuauuuauuuauuuauuca

SEQ ID NO: 3013267 - RNA, 14 nt, Human
uucuauuguuucuu

SEQ ID NO: 3013268 - RNA, 16 nt, Human
uucuaugacacaugca

SEQ ID NO: 3013269 - RNA, 17 nt, Human
uucuaugacacaugcaa

SEQ ID NO: 3013270 - RNA, 15 nt, Human
uuccuucagugccuu

SEQ ID NO: 3013271 - RNA, 19 nt, Human
uuccuucagugccuuaugg

SEQ ID NO: 3013272 - RNA, 16 nt, Human
uuccuucagugccuua

SEQ ID NO: 3013273 - RNA, 23 nt, Human
uuccuucagugccuuauggaaca

SEQ ID NO: 3013274 - RNA, 19 nt, Human
uuccuucauucaacccacc

SEQ ID NO: 3013275 - RNA, 17 nt, Human
uucuaaaggcuaccuuu

SEQ ID NO: 3013276 - RNA, 18 nt, Human
uucuaaaggcuaccuuug

SEQ ID NO: 3013277 - RNA, 16 nt, Human
uucuaaaggcuaccuu

SEQ ID NO: 3013278 - RNA, 22 nt, Human
uuccccacuugagaauuacccu

SEQ ID NO: 3013279 - RNA, 19 nt, Human
uucccuuugacgccauccc

SEQ ID NO: 3013280 - RNA, 12 nt, Human
uuccucccuccc

SEQ ID NO: 3013281 - RNA, 19 nt, Human
uuccucccucccucuuucc

SEQ ID NO: 3013282 - RNA, 21 nt, Human
uuccucccucccucuuucccu

SEQ ID NO: 3013283 - RNA, 22 nt, Human
uuccucccucccucuuucccuc

SEQ ID NO: 3013284 - RNA, 23 nt, Human
uuccucauaguaugguggcuggg

SEQ ID NO: 3013285 - RNA, 18 nt, Human
uucaguuuaucuguucau

SEQ ID NO: 3013286 - RNA, 23 nt, Human
uucauaaugacuuaagcacacuu

SEQ ID NO: 3013287 - RNA, 13 nt, Human
uucauaaugacuu

SEQ ID NO: 3013288 - RNA, 15 nt, Human
uucaguuuaucuguu

SEQ ID NO: 3013289 - RNA, 21 nt, Human
uucagugccuuauggaacacu

SEQ ID NO: 3013290 - RNA, 19 nt, Human
uucagugccuuauggaaca

SEQ ID NO: 3013291 - RNA, 18 nt, Human
uucauuuaggugaggaag

SEQ ID NO: 3013292 - RNA, 19 nt, Human
uucauuuaggugaggaagc

SEQ ID NO: 3013293 - RNA, 12 nt, Human
uucaucuugaau

SEQ ID NO: 3013294 - RNA, 11 nt, Human
uucaucuugaa

SEQ ID NO: 3013295 - RNA, 20 nt, Human
uucaucuuccaacucaaacu

SEQ ID NO: 3013296 - RNA, 21 nt, Human
uuccacuugagugucaagcug

SEQ ID NO: 3013297 - RNA, 17 nt, Human
uuccacuugagugucaa

SEQ ID NO: 3013298 - RNA, 17 nt, Human
uuccaugaguccccugu

SEQ ID NO: 3013299 - RNA, 20 nt, Human
uucaaucuggauucauauuu

SEQ ID NO: 3013300 - RNA, 23 nt, Human
uucaaucuggauucauauuuaau

SEQ ID NO: 3013301 - RNA, 19 nt, Human
uucaaucuggauucauauu

SEQ ID NO: 3013302 - RNA, 18 nt, Human
uucaauucucauuuguca

SEQ ID NO: 3013303 - RNA, 20 nt, Human
uuacuaaaaguuuugagaaa

SEQ ID NO: 3013304 - RNA, 19 nt, Human
uuacuaaaaguuuugagaa

SEQ ID NO: 3013305 - RNA, 14 nt, Human
uuacgugaguccug

SEQ ID NO: 3013306 - RNA, 13 nt, Human
uuacgugaguccu

SEQ ID NO: 3013307 - RNA, 13 nt, Human
uucaaagauauuu

SEQ ID NO: 3013308 - RNA, 23 nt, Human
uucagcuccagcucaccagcccc

SEQ ID NO: 3013309 - RNA, 24 nt, Human
uucagcucugcaagaauugaagca

SEQ ID NO: 3013310 - RNA, 17 nt, Human
uucagcucugcaagaau

SEQ ID NO: 3013311 - RNA, 16 nt, Human
uucaggaagcucaggg

SEQ ID NO: 3013312 - RNA, 17 nt, Human
uucagcugacuuuucug

SEQ ID NO: 3013313 - RNA, 18 nt, Human
uucagcugcauacaguuu

SEQ ID NO: 3013314 - RNA, 19 nt, Human
uucaggaagcucagggccu

SEQ ID NO: 3013315 - RNA, 17 nt, Human
uucaggaagcucagggc

SEQ ID NO: 3013316 - RNA, 20 nt, Human
uucaggaagcucagggccug

SEQ ID NO: 3013317 - RNA, 15 nt, Human
uucaggaagcucagg

SEQ ID NO: 3013318 - RNA, 14 nt, Human
uucacucuccuugg

SEQ ID NO: 3013319 - RNA, 15 nt, Human
uucagagacuccugc

SEQ ID NO: 3013320 - RNA, 22 nt, Human
uucagcuccagcucaccagccc

SEQ ID NO: 3013321 - RNA, 12 nt, Human
uugacuauuuuu

SEQ ID NO: 3013322 - RNA, 20 nt, Human
uugacgccaucccagcccca

SEQ ID NO: 3013323 - RNA, 20 nt, Human
uugauagcacagacccugcc

SEQ ID NO: 3013324 - RNA, 19 nt, Human
uugauagcacagacccugc

SEQ ID NO: 3013325 - RNA, 22 nt, Human
uugaccugaggcccuucucucc

SEQ ID NO: 3013326 - RNA, 19 nt, Human
uugaccugaggcccuucuc

SEQ ID NO: 3013327 - RNA, 12 nt, Human
uugaccugaggc

SEQ ID NO: 3013328 - RNA, 22 nt, Human
uugacgccaucccagccccaau

SEQ ID NO: 3013329 - RNA, 14 nt, Human
uugacgccauccca

SEQ ID NO: 3013330 - RNA, 15 nt, Human
uugaccucaggugau

SEQ ID NO: 3013331 - RNA, 21 nt, Human
uugaccgugaggccagagaca

SEQ ID NO: 3013332 - RNA, 20 nt, Human
uugaccgugaggccagagac

SEQ ID NO: 3013333 - RNA, 16 nt, Human
uugcauacuauuaaac

SEQ ID NO: 3013334 - RNA, 18 nt, Human
uugcauacuauuaaacau

SEQ ID NO: 3013335 - RNA, 19 nt, Human
uugcauacuauuaaacaug

SEQ ID NO: 3013336 - RNA, 16 nt, Human
uugcagacaggcaagc

SEQ ID NO: 3013337 - RNA, 22 nt, Human
uugauugggcacaucauuucaa

SEQ ID NO: 3013338 - RNA, 21 nt, Human
uugauagcacagacccugccc

SEQ ID NO: 3013339 - RNA, 18 nt, Human
uugauagcacagacccug

SEQ ID NO: 3013340 - RNA, 14 nt, Human
uugcaacaggcugg

SEQ ID NO: 3013341 - RNA, 17 nt, Human
uugcaacaggcugggcu

SEQ ID NO: 3013342 - RNA, 18 nt, Human
uugauuuccguuaaaaua

SEQ ID NO: 3013343 - RNA, 14 nt, Human
uugaaacuuuaaga

SEQ ID NO: 3013344 - RNA, 18 nt, Human
uucuuuauaauucuacuu

SEQ ID NO: 3013345 - RNA, 21 nt, Human
uugaaaacacuguucucugcc

SEQ ID NO: 3013346 - RNA, 19 nt, Human
uugaaaacacuguucucug

SEQ ID NO: 3013347 - RNA, 22 nt, Human
uugaacuuugaccucugcagca

SEQ ID NO: 3013348 - RNA, 20 nt, Human
uugaacuuugaccucugcag

SEQ ID NO: 3013349 - RNA, 16 nt, Human
uugaacugauaaagau

SEQ ID NO: 3013350 - RNA, 19 nt, Human
uugaacucuucaaucucuu

SEQ ID NO: 3013351 - RNA, 19 nt, Human
uugaagacuuuucuuucag

SEQ ID NO: 3013352 - RNA, 17 nt, Human
uugaagacagagcuaca

SEQ ID NO: 3013353 - RNA, 17 nt, Human
uucuguccuacucugug

SEQ ID NO: 3013354 - RNA, 23 nt, Human
uucuguggguuucuaaagcugcc

SEQ ID NO: 3013355 - RNA, 21 nt, Human
uucuguccgagcuuugaaaau

SEQ ID NO: 3013356 - RNA, 17 nt, Human
uucuguccgagcuuuga

SEQ ID NO: 3013357 - RNA, 19 nt, Human
uucuuauuuaaugaaagac

SEQ ID NO: 3013358 - RNA, 23 nt, Human
uucuuauuuaaugaaagacugua

SEQ ID NO: 3013359 - RNA, 13 nt, Human
uucuugguuugua

SEQ ID NO: 3013360 - RNA, 16 nt, Human
uucuugguuuguaaau

SEQ ID NO: 3013361 - RNA, 23 nt, Human
uucuugguuuguaaauuaacuuu

SEQ ID NO: 3013362 - RNA, 17 nt, Human
uucuugguuuguaaauu

SEQ ID NO: 3013363 - RNA, 18 nt, Human
uucuugguuuguaaauua

SEQ ID NO: 3013364 - RNA, 21 nt, Human
uuggaaaggaaugcaaagaug

SEQ ID NO: 3013365 - RNA, 23 nt, Human
uuggaaagaguaggaagacuuug

SEQ ID NO: 3013366 - RNA, 20 nt, Human
uugcuggggccgaaagaaca

SEQ ID NO: 3013367 - RNA, 15 nt, Human
uuggacauuuuaugu

SEQ ID NO: 3013368 - RNA, 16 nt, Human
uuggacauuuuauguc

SEQ ID NO: 3013369 - RNA, 17 nt, Human
uuggacauuuuaugucu

SEQ ID NO: 3013370 - RNA, 18 nt, Human
uuggacauuuuaugucuu

SEQ ID NO: 3013371 - RNA, 20 nt, Human
uuggacauuuuaugucuuuc

SEQ ID NO: 3013372 - RNA, 19 nt, Human
uuggaaggaacguccccug

SEQ ID NO: 3013373 - RNA, 11 nt, Human
uuggaaggaac

SEQ ID NO: 3013374 - RNA, 14 nt, Human
uuggauuguccccg

SEQ ID NO: 3013375 - RNA, 17 nt, Human
uuggcaaaaaggcagga

SEQ ID NO: 3013376 - RNA, 13 nt, Human
uugcuaacagcaa

SEQ ID NO: 3013377 - RNA, 19 nt, Human
uugcugauggugcaaugac

SEQ ID NO: 3013378 - RNA, 20 nt, Human
uugcugauggugcaaugacc

SEQ ID NO: 3013379 - RNA, 22 nt, Human
uugcugauggugcaaugaccuu

SEQ ID NO: 3013380 - RNA, 23 nt, Human
uugcccacgcuggagugcaguga

SEQ ID NO: 3013381 - RNA, 13 nt, Human
uugccagucaccc

SEQ ID NO: 3013382 - RNA, 18 nt, Human
uugccagucaccccggcc

SEQ ID NO: 3013383 - RNA, 11 nt, Human
uugccucugcc

SEQ ID NO: 3013384 - RNA, 14 nt, Human
uugccucugccucu

SEQ ID NO: 3013385 - RNA, 16 nt, Human
uugccucugccucuga

SEQ ID NO: 3013386 - RNA, 18 nt, Human
uugccucugccucugaca

SEQ ID NO: 3013387 - RNA, 20 nt, Human
uuguacacucauucauuacu

SEQ ID NO: 3013388 - RNA, 13 nt, Human
uuguacagacaac

SEQ ID NO: 3013389 - RNA, 12 nt, Human
uuguacagacaa

SEQ ID NO: 3013390 - RNA, 16 nt, Human
uuggucccccuuccau

SEQ ID NO: 3013391 - RNA, 22 nt, Human
uuggucccccuuccauggacuu

SEQ ID NO: 3013392 - RNA, 12 nt, Human
uugguccugcug

SEQ ID NO: 3013393 - RNA, 14 nt, Human
uuguagagccaggg

SEQ ID NO: 3013394 - RNA, 15 nt, Human
uuguagagccagggu

SEQ ID NO: 3013395 - RNA, 21 nt, Human
uuguauucucuccuguaccuc

SEQ ID NO: 3013396 - RNA, 20 nt, Human
uuggccagaagucaaggcuu

SEQ ID NO: 3013397 - RNA, 16 nt, Human
uuggcugcugaaggcu

SEQ ID NO: 3013398 - RNA, 18 nt, Human
uuggcugggggccucagu

SEQ ID NO: 3013399 - RNA, 21 nt, Human
uuggcugggggccucagugcc

SEQ ID NO: 3013400 - RNA, 22 nt, Human
uuggcugggggccucagugcca

SEQ ID NO: 3013401 - RNA, 13 nt, Human
uuggcauucccca

SEQ ID NO: 3013402 - RNA, 14 nt, Human
uuggccaggcuggu

SEQ ID NO: 3013403 - RNA, 24 nt, Human
uuggccaaagccaaagcuaggccu

SEQ ID NO: 3013404 - RNA, 12 nt, Human
uuggguuuauuu

SEQ ID NO: 3013405 - RNA, 17 nt, Human
uuggguuuauuuggaaa

SEQ ID NO: 3013406 - RNA, 16 nt, Human
uuggguggaugccugg

SEQ ID NO: 3013407 - RNA, 22 nt, Human
uuggcuuuggguugcaggaccu

SEQ ID NO: 3013408 - RNA, 16 nt, Human
uugggaggccauuugu

SEQ ID NO: 3013409 - RNA, 20 nt, Human
ugugaaugcagguuuuauca

SEQ ID NO: 3013410 - RNA, 14 nt, Human
ugugaaugcagguu

SEQ ID NO: 3013411 - RNA, 21 nt, Human
ugugacaaggauugcuacugu

SEQ ID NO: 3013412 - RNA, 21 nt, Human
ugugaauaaagagggugggug

SEQ ID NO: 3013413 - RNA, 18 nt, Human
ugugaguacuacaguccu

SEQ ID NO: 3013414 - RNA, 23 nt, Human
ugugaguacuacaguccucccau

SEQ ID NO: 3013415 - RNA, 20 nt, Human
ugugaguacuacaguccucc

SEQ ID NO: 3013416 - RNA, 19 nt, Human
ugugaguacuacaguccuc

SEQ ID NO: 3013417 - RNA, 21 nt, Human
ugugauacaaugcugugcccu

SEQ ID NO: 3013418 - RNA, 23 nt, Human
ugugaaaaaauuuacuuuaaacu

SEQ ID NO: 3013419 - RNA, 17 nt, Human
ugugaaaaaauuuacuu

SEQ ID NO: 3013420 - RNA, 12 nt, Human
ugugaaaaaauu

SEQ ID NO: 3013421 - RNA, 13 nt, Human
ugugaaaggaaag

SEQ ID NO: 3013422 - RNA, 14 nt, Human
ugugaaaggaaaga

SEQ ID NO: 3013423 - RNA, 16 nt, Human
ugucuuuuuucacuac

SEQ ID NO: 3013424 - RNA, 22 nt, Human
ugucuuuggacccugaggccca

SEQ ID NO: 3013425 - RNA, 19 nt, Human
ugucuuuggacccugaggc

SEQ ID NO: 3013426 - RNA, 18 nt, Human
ugucuuuggacccugagg

SEQ ID NO: 3013427 - RNA, 17 nt, Human
ugucuuuggacccugag

SEQ ID NO: 3013428 - RNA, 14 nt, Human
ugugcguccugucg

SEQ ID NO: 3013429 - RNA, 20 nt, Human
ugugcgugcauguguguuca

SEQ ID NO: 3013430 - RNA, 17 nt, Human
ugugccucugggacugg

SEQ ID NO: 3013431 - RNA, 16 nt, Human
ugugcacaugcacgug

SEQ ID NO: 3013432 - RNA, 22 nt, Human
ugugcacaugcacgugugugca

SEQ ID NO: 3013433 - RNA, 13 nt, Human
ugugccucuggga

SEQ ID NO: 3013434 - RNA, 15 nt, Human
ugugccucugggacu

SEQ ID NO: 3013435 - RNA, 16 nt, Human
ugugccucugggacug

SEQ ID NO: 3013436 - RNA, 15 nt, Human
uguguacuuuuaaga

SEQ ID NO: 3013437 - RNA, 12 nt, Human
uguguacuuuua

SEQ ID NO: 3013438 - RNA, 12 nt, Human
ugugggaagggg

SEQ ID NO: 3013439 - RNA, 14 nt, Human
uguggacacagcuc

SEQ ID NO: 3013440 - RNA, 13 nt, Human
uguggacacagcu

SEQ ID NO: 3013441 - RNA, 15 nt, Human
uguggacacagcucu

SEQ ID NO: 3013442 - RNA, 21 nt, Human
uguggagaagcggcuggcagc

SEQ ID NO: 3013443 - RNA, 12 nt, Human
uguggagaagcg

SEQ ID NO: 3013444 - RNA, 21 nt, Human
uguaacuguuuagaugaaugu

SEQ ID NO: 3013445 - RNA, 13 nt, Human
uguaaauuaacuu

SEQ ID NO: 3013446 - RNA, 14 nt, Human
uguaaauuaacuuu

SEQ ID NO: 3013447 - RNA, 15 nt, Human
uguaaauuaacuuuu

SEQ ID NO: 3013448 - RNA, 16 nt, Human
uguaaauuaacuuuua

SEQ ID NO: 3013449 - RNA, 17 nt, Human
uguaaauuaacuuuuau

SEQ ID NO: 3013450 - RNA, 23 nt, Human
uguaccucuugagccuugaacuu

SEQ ID NO: 3013451 - RNA, 22 nt, Human
uguaccucuugagccuugaacu

SEQ ID NO: 3013452 - RNA, 14 nt, Human
uguaccucuugagc

SEQ ID NO: 3013453 - RNA, 17 nt, Human
uguacgucugacaggca

SEQ ID NO: 3013454 - RNA, 16 nt, Human
uguacgucugacaggc

SEQ ID NO: 3013455 - RNA, 22 nt, Human
ugucaguuguuauuuauugaaa

SEQ ID NO: 3013456 - RNA, 17 nt, Human
ugucaguuguuauuuau

SEQ ID NO: 3013457 - RNA, 18 nt, Human
ugucaguuguuauuuauu

SEQ ID NO: 3013458 - RNA, 20 nt, Human
ugucagugugacugaucucu

SEQ ID NO: 3013459 - RNA, 12 nt, Human
ugucagugugac

SEQ ID NO: 3013460 - RNA, 16 nt, Human
uguaucccaugagccu

SEQ ID NO: 3013461 - RNA, 19 nt, Human
uguaucccaugagccucag

SEQ ID NO: 3013462 - RNA, 23 nt, Human
uguaucccaugagccucagcauc

SEQ ID NO: 3013463 - RNA, 16 nt, Human
uguugaaacuuuaaga

SEQ ID NO: 3013464 - RNA, 11 nt, Human
uguugaaagau

SEQ ID NO: 3013465 - RNA, 20 nt, Human
uguucuuuccaaaguacacu

SEQ ID NO: 3013466 - RNA, 20 nt, Human
uguucuuucuggcuaugcau

SEQ ID NO: 3013467 - RNA, 22 nt, Human
uguucuuucuggcuaugcauuu

SEQ ID NO: 3013468 - RNA, 14 nt, Human
uguucuuucuggcu

SEQ ID NO: 3013469 - RNA, 18 nt, Human
uguucugacccugcuuca

SEQ ID NO: 3013470 - RNA, 19 nt, Human
uguucucugcccuccaaga

SEQ ID NO: 3013471 - RNA, 15 nt, Human
uguucugacccugcu

SEQ ID NO: 3013472 - RNA, 21 nt, Human
uguucuccagucauuauguua

SEQ ID NO: 3013473 - RNA, 13 nt, Human
uguucucugagga

SEQ ID NO: 3013474 - RNA, 16 nt, Human
uguucucugaggacac

SEQ ID NO: 3013475 - RNA, 18 nt, Human
uguucucugaggacacua

SEQ ID NO: 3013476 - RNA, 12 nt, Human
uguucucugccc

SEQ ID NO: 3013477 - RNA, 15 nt, Human
uguuuaaugguaguu

SEQ ID NO: 3013478 - RNA, 14 nt, Human
uguuggccaggcug

SEQ ID NO: 3013479 - RNA, 15 nt, Human
uguuggccaaagcca

SEQ ID NO: 3013480 - RNA, 11 nt, Human
uguuggccagg

SEQ ID NO: 3013481 - RNA, 19 nt, Human
ugugugcguccugucggag

SEQ ID NO: 3013482 - RNA, 16 nt, Human
uguguagggcgggagg

SEQ ID NO: 3013483 - RNA, 16 nt, Human
uguuacugucuucagu

SEQ ID NO: 3013484 - RNA, 15 nt, Human
uguuacugucuucag

SEQ ID NO: 3013485 - RNA, 22 nt, Human
uguuacauuuuuaagugcugca

SEQ ID NO: 3013486 - RNA, 13 nt, Human
uguuacauuuuua

SEQ ID NO: 3013487 - RNA, 15 nt, Human
uguucagcuccagcu

SEQ ID NO: 3013488 - RNA, 16 nt, Human
uguucagcuccagcuc

SEQ ID NO: 3013489 - RNA, 11 nt, Human
uguucagcugg

SEQ ID NO: 3013490 - RNA, 14 nt, Human
uguucagcuccagc

SEQ ID NO: 3013491 - RNA, 15 nt, Human
uguuuuuauuauuaa

SEQ ID NO: 3013492 - RNA, 18 nt, Human
uguuuuuauuauuaacaa

SEQ ID NO: 3013493 - RNA, 23 nt, Human
uguuuugccaauuugcacauuaa

SEQ ID NO: 3013494 - RNA, 13 nt, Human
uguuuuugucuua

SEQ ID NO: 3013495 - RNA, 16 nt, Human
uguuuguugucagcug

SEQ ID NO: 3013496 - RNA, 17 nt, Human
uguuuguugucagcuga

SEQ ID NO: 3013497 - RNA, 15 nt, Human
uguuuccuggcacug

SEQ ID NO: 3013498 - RNA, 22 nt, Human
uguuuccuggcacugcuuccag

SEQ ID NO: 3013499 - RNA, 21 nt, Human
uguuuccuggcacugcuucca

SEQ ID NO: 3013500 - RNA, 20 nt, Human
uguuuccuggcacugcuucc

SEQ ID NO: 3013501 - RNA, 20 nt, Human
uuaaacuuaaucuaaaugga

SEQ ID NO: 3013502 - RNA, 16 nt, Human
uuaaacuuaaucuaaa

SEQ ID NO: 3013503 - RNA, 18 nt, Human
uuaaacuuaaucuaaaug

SEQ ID NO: 3013504 - RNA, 18 nt, Human
uuaaaugcccagccccuu

SEQ ID NO: 3013505 - RNA, 17 nt, Human
uuaaaugcccagccccu

SEQ ID NO: 3013506 - RNA, 17 nt, Human
uuaaaugcaccuggaau

SEQ ID NO: 3013507 - RNA, 18 nt, Human
uuaaaugcaccuggaaua

SEQ ID NO: 3013508 - RNA, 16 nt, Human
uuaaaugcaccuggaa

SEQ ID NO: 3013509 - RNA, 11 nt, Human
uuaaaugcacc

SEQ ID NO: 3013510 - RNA, 20 nt, Human
uuacgguuuuccagguuuaa

SEQ ID NO: 3013511 - RNA, 22 nt, Human
uuaccuuuuuuauacauaaaca

SEQ ID NO: 3013512 - RNA, 19 nt, Human
uuaccuuuuuuauacauaa

SEQ ID NO: 3013513 - RNA, 20 nt, Human
uuaccuuuuuuauacauaaa

SEQ ID NO: 3013514 - RNA, 20 nt, Human
uuacauuuuuaagugcugca

SEQ ID NO: 3013515 - RNA, 21 nt, Human
uuacauuuuuaagugcugcau

SEQ ID NO: 3013516 - RNA, 22 nt, Human
uuacauuuuuaagugcugcauu

SEQ ID NO: 3013517 - RNA, 18 nt, Human
uuaaugucacaggcaggu

SEQ ID NO: 3013518 - RNA, 17 nt, Human
uuaaugucacaggcagg

SEQ ID NO: 3013519 - RNA, 21 nt, Human
uuaaggaagacaaugugaaaa

SEQ ID NO: 3013520 - RNA, 17 nt, Human
uuaaggaugcuuguaca

SEQ ID NO: 3013521 - RNA, 18 nt, Human
uuaaggaugcuuguacau

SEQ ID NO: 3013522 - RNA, 19 nt, Human
uuaaggaugcuuguacaua

SEQ ID NO: 3013523 - RNA, 20 nt, Human
uuaaggaugcuuguacauaa

SEQ ID NO: 3013524 - RNA, 22 nt, Human
uuaaggaugcuuguacauaaug

SEQ ID NO: 3013525 - RNA, 22 nt, Human
ugccuaauaugaugacuguuuu

SEQ ID NO: 3013526 - RNA, 17 nt, Human
ugccuaauaugaugacu

SEQ ID NO: 3013527 - RNA, 17 nt, Human
ugccuaccaauauuuaa

SEQ ID NO: 3013528 - RNA, 23 nt, Human
ugccuaccaauauuuaaucuuuu

SEQ ID NO: 3013529 - RNA, 23 nt, Human
ugcccaggcuggcgugcaguggu

SEQ ID NO: 3013530 - RNA, 11 nt, Human
ugcccagcccc

SEQ ID NO: 3013531 - RNA, 14 nt, Human
ugccucugggacug

SEQ ID NO: 3013532 - RNA, 16 nt, Human
ugccuccuuugugagg

SEQ ID NO: 3013533 - RNA, 18 nt, Human
ugccuccuuugugaggaa

SEQ ID NO: 3013534 - RNA, 17 nt, Human
ugccuccuuugugagga

SEQ ID NO: 3013535 - RNA, 22 nt, Human
ugccugaagucacacagugagu

SEQ ID NO: 3013536 - RNA, 18 nt, Human
ugccugaagucacacagu

SEQ ID NO: 3013537 - RNA, 17 nt, Human
ugccugaagucacacag

SEQ ID NO: 3013538 - RNA, 22 nt, Human
ugccuuauggaacacucugaga

SEQ ID NO: 3013539 - RNA, 21 nt, Human
ugccuuauggaacacucugag

SEQ ID NO: 3013540 - RNA, 20 nt, Human
ugccuuauggaacacucuga

SEQ ID NO: 3013541 - RNA, 18 nt, Human
ugccuuauggaacacucu

SEQ ID NO: 3013542 - RNA, 23 nt, Human
ugcggugcuaucucccccagccc

SEQ ID NO: 3013543 - RNA, 21 nt, Human
ugcggugcuaucucccccagc

SEQ ID NO: 3013544 - RNA, 21 nt, Human
ugcugaaggcucgagcaugcc

SEQ ID NO: 3013545 - RNA, 23 nt, Human
ugcugaauacagaggcaacugca

SEQ ID NO: 3013546 - RNA, 18 nt, Human
ugcugaauacagaggcaa

SEQ ID NO: 3013547 - RNA, 17 nt, Human
ugcugaaugguuuucaa

SEQ ID NO: 3013548 - RNA, 18 nt, Human
ugcugaaugguuuucaaa

SEQ ID NO: 3013549 - RNA, 22 nt, Human
ugcugaaugguuuucaaaauaa

SEQ ID NO: 3013550 - RNA, 19 nt, Human
ugcuccuggcccacugcau

SEQ ID NO: 3013551 - RNA, 15 nt, Human
ugcugcaguugccag

SEQ ID NO: 3013552 - RNA, 23 nt, Human
ugcugauggugcaaugaccuuuc

SEQ ID NO: 3013553 - RNA, 20 nt, Human
ugcugauggugcaaugaccu

SEQ ID NO: 3013554 - RNA, 18 nt, Human
ugcugauggugcaaugac

SEQ ID NO: 3013555 - RNA, 15 nt, Human
ugcugacagacacag

SEQ ID NO: 3013556 - RNA, 16 nt, Human
ugcugacagacacagg

SEQ ID NO: 3013557 - RNA, 18 nt, Human
ugcuccucuccccagcaa

SEQ ID NO: 3013558 - RNA, 19 nt, Human
ugcuccucuccccagcaag

SEQ ID NO: 3013559 - RNA, 16 nt, Human
ugcuaggaacacuccu

SEQ ID NO: 3013560 - RNA, 19 nt, Human
ugcuaggaacacuccuuca

SEQ ID NO: 3013561 - RNA, 17 nt, Human
ugcuaggaacacuccuu

SEQ ID NO: 3013562 - RNA, 15 nt, Human
ugcgugcauaccacu

SEQ ID NO: 3013563 - RNA, 21 nt, Human
ugcacacuguccuauuauauu

SEQ ID NO: 3013564 - RNA, 22 nt, Human
ugaagucuuuguacagacaaca

SEQ ID NO: 3013565 - RNA, 20 nt, Human
ugaagucuuuguacagacaa

SEQ ID NO: 3013566 - RNA, 17 nt, Human
ugaagucuuuguacaga

SEQ ID NO: 3013567 - RNA, 17 nt, Human
ugcacagcuaacaugga

SEQ ID NO: 3013568 - RNA, 23 nt, Human
ugcacagaguuguuacauuuuua

SEQ ID NO: 3013569 - RNA, 20 nt, Human
ugcacagaguuguuacauuu

SEQ ID NO: 3013570 - RNA, 21 nt, Human
ugcacagaguuguuacauuuu

SEQ ID NO: 3013571 - RNA, 22 nt, Human
ugcacagaguuguuacauuuuu

SEQ ID NO: 3013572 - RNA, 13 nt, Human
ugcacaucuguuu

SEQ ID NO: 3013573 - RNA, 23 nt, Human
ugcacagcuaacauggaaguacu

SEQ ID NO: 3013574 - RNA, 20 nt, Human
ugcacagcuaacauggaagu

SEQ ID NO: 3013575 - RNA, 18 nt, Human
ugcacagcuaacauggaa

SEQ ID NO: 3013576 - RNA, 18 nt, Human
ugcaggaccucaggugag

SEQ ID NO: 3013577 - RNA, 16 nt, Human
ugcaggaccucaggug

SEQ ID NO: 3013578 - RNA, 15 nt, Human
ugcaggaccucaggu

SEQ ID NO: 3013579 - RNA, 14 nt, Human
ugcaggaccucagg

SEQ ID NO: 3013580 - RNA, 14 nt, Human
ugcagcaauaaagc

SEQ ID NO: 3013581 - RNA, 15 nt, Human
ugcagcaauaaagca

SEQ ID NO: 3013582 - RNA, 16 nt, Human
ugcagcaauaaagcag

SEQ ID NO: 3013583 - RNA, 21 nt, Human
ugcacuugcagacucuacaga

SEQ ID NO: 3013584 - RNA, 16 nt, Human
ugcacuugcagacucu

SEQ ID NO: 3013585 - RNA, 16 nt, Human
ugcacguacacacaca

SEQ ID NO: 3013586 - RNA, 20 nt, Human
ugcacuuuguucuggcucuu

SEQ ID NO: 3013587 - RNA, 19 nt, Human
ugcacuuuguucuggcucu

SEQ ID NO: 3013588 - RNA, 18 nt, Human
ugcacuuuguucuggcuc

SEQ ID NO: 3013589 - RNA, 15 nt, Human
ugcacuuuguucugg

SEQ ID NO: 3013590 - RNA, 19 nt, Human
ugcauguuacauaagauaa

SEQ ID NO: 3013591 - RNA, 15 nt, Human
ugcaucguuucaucu

SEQ ID NO: 3013592 - RNA, 16 nt, Human
ugcaggcagccaggcc

SEQ ID NO: 3013593 - RNA, 18 nt, Human
ugcaggcagccaggccac

SEQ ID NO: 3013594 - RNA, 17 nt, Human
ugcaggcagccaggcca

SEQ ID NO: 3013595 - RNA, 10 nt, Human
ugcccagccc

SEQ ID NO: 3013596 - RNA, 14 nt, Human
ugcccaccuggccu

SEQ ID NO: 3013597 - RNA, 18 nt, Human
ugcccaccuggccucugc

SEQ ID NO: 3013598 - RNA, 17 nt, Human
ugcccaccuggccucug

SEQ ID NO: 3013599 - RNA, 15 nt, Human
ugcccaccuggccuc

SEQ ID NO: 3013600 - RNA, 22 nt, Human
ugccagggacagaggggguggc

SEQ ID NO: 3013601 - RNA, 11 nt, Human
ugccagggaca

SEQ ID NO: 3013602 - RNA, 24 nt, Human
ugccagguuuuuggucugacccac

SEQ ID NO: 3013603 - RNA, 14 nt, Human
ugccagucaccccg

SEQ ID NO: 3013604 - RNA, 23 nt, Human
uggggcagugcuuggcccaggag

SEQ ID NO: 3013605 - RNA, 20 nt, Human
uggggcagugcuuggcccag

SEQ ID NO: 3013606 - RNA, 22 nt, Human
uggggcagugcuuggcccagga

SEQ ID NO: 3013607 - RNA, 17 nt, Human
ugggguggggaccucag

SEQ ID NO: 3013608 - RNA, 18 nt, Human
uggggcagugcuuggccc

SEQ ID NO: 3013609 - RNA, 13 nt, Human
uggguuuauuugg

SEQ ID NO: 3013610 - RNA, 23 nt, Human
uggguucaagcgauucuucugcu

SEQ ID NO: 3013611 - RNA, 16 nt, Human
uggguucacugcaacc

SEQ ID NO: 3013612 - RNA, 21 nt, Human
ugggugucaagagggucugag

SEQ ID NO: 3013613 - RNA, 23 nt, Human
ugggugucaagagggucugagga

SEQ ID NO: 3013614 - RNA, 20 nt, Human
ugggcuucaguggcagcugc

SEQ ID NO: 3013615 - RNA, 19 nt, Human
ugggcuuggggaccagagc

SEQ ID NO: 3013616 - RNA, 16 nt, Human
uggggcagcuugaggg

SEQ ID NO: 3013617 - RNA, 21 nt, Human
ugggcuuggggaccagagcug

SEQ ID NO: 3013618 - RNA, 13 nt, Human
uggggcagcuuga

SEQ ID NO: 3013619 - RNA, 18 nt, Human
ugggcuucaguggcagcu

SEQ ID NO: 3013620 - RNA, 19 nt, Human
ugggcuucaguggcagcug

SEQ ID NO: 3013621 - RNA, 14 nt, Human
ugggccuccugugu

SEQ ID NO: 3013622 - RNA, 16 nt, Human
ugggccuccugugugu

SEQ ID NO: 3013623 - RNA, 22 nt, Human
ugggccuccugugugugcgccu

SEQ ID NO: 3013624 - RNA, 24 nt, Human
ugggagcugccuguucagcuccag

SEQ ID NO: 3013625 - RNA, 14 nt, Human
uggcugggggccuc

SEQ ID NO: 3013626 - RNA, 22 nt, Human
uggcugguuagagguucccuuu

SEQ ID NO: 3013627 - RNA, 22 nt, Human
ugggaaugaaugucagugugac

SEQ ID NO: 3013628 - RNA, 21 nt, Human
ugggaaugaaugucaguguga

SEQ ID NO: 3013629 - RNA, 23 nt, Human
ugggagcugccuguucagcucca

SEQ ID NO: 3013630 - RNA, 16 nt, Human
ugggacaugggaaagg

SEQ ID NO: 3013631 - RNA, 22 nt, Human
uggcucagguggggucacucug

SEQ ID NO: 3013632 - RNA, 20 nt, Human
uggcucagguggggucacuc

SEQ ID NO: 3013633 - RNA, 16 nt, Human
uggcucuuccaggcug

SEQ ID NO: 3013634 - RNA, 12 nt, Human
uggcugggggcc

SEQ ID NO: 3013635 - RNA, 15 nt, Human
uggcucuuccaggcu

SEQ ID NO: 3013636 - RNA, 13 nt, Human
uggcucuuccagg

SEQ ID NO: 3013637 - RNA, 22 nt, Human
uggcgugcaguggugcgaucug

SEQ ID NO: 3013638 - RNA, 14 nt, Human
uggcgcugccccug

SEQ ID NO: 3013639 - RNA, 15 nt, Human
uggccagaugcacca

SEQ ID NO: 3013640 - RNA, 17 nt, Human
uggccagaagucaaggc

SEQ ID NO: 3013641 - RNA, 20 nt, Human
uggcagugggagcugccugu

SEQ ID NO: 3013642 - RNA, 13 nt, Human
uggcagugggagc

SEQ ID NO: 3013643 - RNA, 14 nt, Human
uggcagugggagcu

SEQ ID NO: 3013644 - RNA, 15 nt, Human
uggcagugggagcug

SEQ ID NO: 3013645 - RNA, 16 nt, Human
uggcagugggagcugc

SEQ ID NO: 3013646 - RNA, 19 nt, Human
uggcagugggagcugccug

SEQ ID NO: 3013647 - RNA, 18 nt, Human
uggcacugcuuccaguga

SEQ ID NO: 3013648 - RNA, 16 nt, Human
uggcacugcuuccagu

SEQ ID NO: 3013649 - RNA, 14 nt, Human
uggcacugcuucca

SEQ ID NO: 3013650 - RNA, 14 nt, Human
uggaugccuggugg

SEQ ID NO: 3013651 - RNA, 19 nt, Human
uggcagcugcgguccaccc

SEQ ID NO: 3013652 - RNA, 23 nt, Human
uggcagcugcgguccacccagga

SEQ ID NO: 3013653 - RNA, 21 nt, Human
uggcagcugcgguccacccag

SEQ ID NO: 3013654 - RNA, 22 nt, Human
uggcagcugcgguccacccagg

SEQ ID NO: 3013655 - RNA, 22 nt, Human
uggaggcaugugaugagaggaa

SEQ ID NO: 3013656 - RNA, 12 nt, Human
uggacaggcaug

SEQ ID NO: 3013657 - RNA, 16 nt, Human
uggacaggcauguucu

SEQ ID NO: 3013658 - RNA, 15 nt, Human
ugcuuuuuuuggccu

SEQ ID NO: 3013659 - RNA, 18 nt, Human
ugcuuccagugaggcucu

SEQ ID NO: 3013660 - RNA, 20 nt, Human
ugcuuccagugaggcucugc

SEQ ID NO: 3013661 - RNA, 19 nt, Human
ugcuuccagugaggcucug

SEQ ID NO: 3013662 - RNA, 16 nt, Human
ugcuucuucagagacu

SEQ ID NO: 3013663 - RNA, 14 nt, Human
uggaagacagcucu

SEQ ID NO: 3013664 - RNA, 15 nt, Human
uggaaaauaaauuau

SEQ ID NO: 3013665 - RNA, 16 nt, Human
uggaaaauaaauuauu

SEQ ID NO: 3013666 - RNA, 12 nt, Human
uggaagacagcu

SEQ ID NO: 3013667 - RNA, 11 nt, Human
uggaagacagc

SEQ ID NO: 3013668 - RNA, 13 nt, Human
ucuucuauauaau

SEQ ID NO: 3013669 - RNA, 12 nt, Human
ucuucuauuuau

SEQ ID NO: 3013670 - RNA, 22 nt, Human
ucuucuauauaauuccuguuuu

SEQ ID NO: 3013671 - RNA, 22 nt, Human
ucuucuauuuauuuauuuauuc

SEQ ID NO: 3013672 - RNA, 21 nt, Human
ucuucuccacuuucuagccag

SEQ ID NO: 3013673 - RNA, 19 nt, Human
ucuucuccacuuucuagcc

SEQ ID NO: 3013674 - RNA, 14 nt, Human
ucuuccaggcuggg

SEQ ID NO: 3013675 - RNA, 16 nt, Human
ucuucaguaagccgug

SEQ ID NO: 3013676 - RNA, 21 nt, Human
ucuuccacaagagcccaggcc

SEQ ID NO: 3013677 - RNA, 15 nt, Human
ucuucaguaagccgu

SEQ ID NO: 3013678 - RNA, 13 nt, Human
ucuuaaaaagugg

SEQ ID NO: 3013679 - RNA, 14 nt, Human
ucuuagugugugca

SEQ ID NO: 3013680 - RNA, 16 nt, Human
ucuuaguggauguucu

SEQ ID NO: 3013681 - RNA, 15 nt, Human
ucuuauacauuugau

SEQ ID NO: 3013682 - RNA, 14 nt, Human
ucuuauacauuuga

SEQ ID NO: 3013683 - RNA, 12 nt, Human
ucuugcucugcu

SEQ ID NO: 3013684 - RNA, 13 nt, Human
ucuugcucugcug

SEQ ID NO: 3013685 - RNA, 11 nt, Human
ucuugcucugc

SEQ ID NO: 3013686 - RNA, 21 nt, Human
ucuugaauuguaaggaaugau

SEQ ID NO: 3013687 - RNA, 16 nt, Human
ucuugaacuccuggcc

SEQ ID NO: 3013688 - RNA, 17 nt, Human
ucuugaacuccuggccu

SEQ ID NO: 3013689 - RNA, 18 nt, Human
ucuugaacuccuggccuc

SEQ ID NO: 3013690 - RNA, 13 nt, Human
ucuucuccaggcu

SEQ ID NO: 3013691 - RNA, 14 nt, Human
ucuucuccaggcug

SEQ ID NO: 3013692 - RNA, 12 nt, Human
ucuucuccaggc

SEQ ID NO: 3013693 - RNA, 20 nt, Human
ucuguuacacaaagaaccac

SEQ ID NO: 3013694 - RNA, 18 nt, Human
ucuuaaaaaguggaaaaa

SEQ ID NO: 3013695 - RNA, 22 nt, Human
ucugugucagguggggcagcuu

SEQ ID NO: 3013696 - RNA, 23 nt, Human
ucuguggguuucuaaagcugcca

SEQ ID NO: 3013697 - RNA, 19 nt, Human
ucuguccgagcuuugaaaa

SEQ ID NO: 3013698 - RNA, 22 nt, Human
ucuguggguuucuaaagcugcc

SEQ ID NO: 3013699 - RNA, 17 nt, Human
ucuguacgucugacagg

SEQ ID NO: 3013700 - RNA, 19 nt, Human
ucuguaauaaacucauuuc

SEQ ID NO: 3013701 - RNA, 23 nt, Human
ucuguaauaaacucauuucuagc

SEQ ID NO: 3013702 - RNA, 24 nt, Human
ucuguaauaaacucauuucuagca

SEQ ID NO: 3013703 - RNA, 23 nt, Human
ucuguacagagcccacgccccca

SEQ ID NO: 3013704 - RNA, 17 nt, Human
ucuggcucuuccaggcu

SEQ ID NO: 3013705 - RNA, 16 nt, Human
ucuggcucuuccaggc

SEQ ID NO: 3013706 - RNA, 15 nt, Human
ucuggcucuuccagg

SEQ ID NO: 3013707 - RNA, 12 nt, Human
ucugggacacag

SEQ ID NO: 3013708 - RNA, 14 nt, Human
ucuggcuaugcauu

SEQ ID NO: 3013709 - RNA, 14 nt, Human
ucuuuuugaaaugu

SEQ ID NO: 3013710 - RNA, 16 nt, Human
ucuuuuugcuuugcuu

SEQ ID NO: 3013711 - RNA, 17 nt, Human
ucuuuugccguuauuaa

SEQ ID NO: 3013712 - RNA, 19 nt, Human
ucuuuugccguuauuaaaa

SEQ ID NO: 3013713 - RNA, 17 nt, Human
ugaaaucuuuuugcuuu

SEQ ID NO: 3013714 - RNA, 15 nt, Human
ugaaagggcccagag

SEQ ID NO: 3013715 - RNA, 16 nt, Human
ugaaagggcccagaga

SEQ ID NO: 3013716 - RNA, 17 nt, Human
ugaaagggcccagagag

SEQ ID NO: 3013717 - RNA, 19 nt, Human
ugaaaugaggucagagccu

SEQ ID NO: 3013718 - RNA, 20 nt, Human
ugaaaugaggucagagccug

SEQ ID NO: 3013719 - RNA, 23 nt, Human
ugaaaugaggucagagccugcag

SEQ ID NO: 3013720 - RNA, 21 nt, Human
ugaaaugaggucagagccugc

SEQ ID NO: 3013721 - RNA, 22 nt, Human
ugaaaugaggucagagccugca

SEQ ID NO: 3013722 - RNA, 12 nt, Human
ugaaaggaaaga

SEQ ID NO: 3013723 - RNA, 17 nt, Human
ugaaaggaaagaggcuc

SEQ ID NO: 3013724 - RNA, 15 nt, Human
ugaacugauaaagau

SEQ ID NO: 3013725 - RNA, 13 nt, Human
ugaacugauaaag

SEQ ID NO: 3013726 - RNA, 18 nt, Human
ugaacucuucaaucucuu

SEQ ID NO: 3013727 - RNA, 20 nt, Human
ugaaccacaucuugcucugc

SEQ ID NO: 3013728 - RNA, 21 nt, Human
ugaaccacaucuugcucugcu

SEQ ID NO: 3013729 - RNA, 22 nt, Human
ugaaccacaucuugcucugcug

SEQ ID NO: 3013730 - RNA, 15 nt, Human
ugaacucuucaaucu

SEQ ID NO: 3013731 - RNA, 19 nt, Human
ugaaccacaucuugcucug

SEQ ID NO: 3013732 - RNA, 20 nt, Human
ugaaggcucgagcaugccug

SEQ ID NO: 3013733 - RNA, 21 nt, Human
ugaaggcucgagcaugccugg

SEQ ID NO: 3013734 - RNA, 14 nt, Human
ugaagacuuuucuu

SEQ ID NO: 3013735 - RNA, 22 nt, Human
ugaagacuuuucuuucagccaa

SEQ ID NO: 3013736 - RNA, 17 nt, Human
ugaagacuuuucuuuca

SEQ ID NO: 3013737 - RNA, 19 nt, Human
ugaacuggguacuugugga

SEQ ID NO: 3013738 - RNA, 12 nt, Human
ugaacuugguuc

SEQ ID NO: 3013739 - RNA, 14 nt, Human
ugaacuuggcgcug

SEQ ID NO: 3013740 - RNA, 16 nt, Human
ugaagacagagcuaca

SEQ ID NO: 3013741 - RNA, 14 nt, Human
ugaagacagagcua

SEQ ID NO: 3013742 - RNA, 17 nt, Human
ucucaaacuaacaggcu

SEQ ID NO: 3013743 - RNA, 15 nt, Human
ucucaaacuaacagg

SEQ ID NO: 3013744 - RNA, 22 nt, Human
ucucaaacucuugaccucaggu

SEQ ID NO: 3013745 - RNA, 13 nt, Human
ucucaaacucuug

SEQ ID NO: 3013746 - RNA, 21 nt, Human
ucucaaacucuugaccucagg

SEQ ID NO: 3013747 - RNA, 17 nt, Human
ucucacuguugcccagg

SEQ ID NO: 3013748 - RNA, 17 nt, Human
ucucagaaucucaaaua

SEQ ID NO: 3013749 - RNA, 21 nt, Human
ucucagaaucucaaauaacua

SEQ ID NO: 3013750 - RNA, 18 nt, Human
ucucacuguugcccaggc

SEQ ID NO: 3013751 - RNA, 19 nt, Human
ucucacuguugcccaggcu

SEQ ID NO: 3013752 - RNA, 20 nt, Human
ucucacuguugcccaggcug

SEQ ID NO: 3013753 - RNA, 21 nt, Human
ucucacuguugcccaggcugg

SEQ ID NO: 3013754 - RNA, 18 nt, Human
ucucacucugucgcccag

SEQ ID NO: 3013755 - RNA, 22 nt, Human
ucucacucugucgcccagucug

SEQ ID NO: 3013756 - RNA, 16 nt, Human
ucucacucugucgccc

SEQ ID NO: 3013757 - RNA, 17 nt, Human
ucucacucugucgccca

SEQ ID NO: 3013758 - RNA, 15 nt, Human
ucuaacuucaccaua

SEQ ID NO: 3013759 - RNA, 16 nt, Human
ucuaacuucaccauau

SEQ ID NO: 3013760 - RNA, 22 nt, Human
ucuaaaucuccaaaauaaaacu

SEQ ID NO: 3013761 - RNA, 19 nt, Human
ucuagggaaaaaccagcgu

SEQ ID NO: 3013762 - RNA, 22 nt, Human
ucuagggaaaaaccagcgugug

SEQ ID NO: 3013763 - RNA, 22 nt, Human
ucuacugaggugcuauguucuu

SEQ ID NO: 3013764 - RNA, 15 nt, Human
ucuacacugugcuga

SEQ ID NO: 3013765 - RNA, 18 nt, Human
ucuacugaggugcuaugu

SEQ ID NO: 3013766 - RNA, 19 nt, Human
ucuacugaggugcuauguu

SEQ ID NO: 3013767 - RNA, 14 nt, Human
ucuacacugugcug

SEQ ID NO: 3013768 - RNA, 12 nt, Human
ucuacacugugc

SEQ ID NO: 3013769 - RNA, 17 nt, Human
ucgaguuacagacaaag

SEQ ID NO: 3013770 - RNA, 15 nt, Human
ucgaguuacagacaa

SEQ ID NO: 3013771 - RNA, 15 nt, Human
uccugguguggaaga

SEQ ID NO: 3013772 - RNA, 17 nt, Human
uccuggcccacugcauc

SEQ ID NO: 3013773 - RNA, 22 nt, Human
uccuggcaugggaaugaauguc

SEQ ID NO: 3013774 - RNA, 10 nt, Human
ucccucccuu

SEQ ID NO: 3013775 - RNA, 12 nt, Human
uccuucuguccu

SEQ ID NO: 3013776 - RNA, 19 nt, Human
uccuucuguccuacucugu

SEQ ID NO: 3013777 - RNA, 22 nt, Human
ucuccugccucagccucccaaa

SEQ ID NO: 3013778 - RNA, 19 nt, Human
ucuccugccucagccuccc

SEQ ID NO: 3013779 - RNA, 20 nt, Human
ucucccccagccccauccuc

SEQ ID NO: 3013780 - RNA, 18 nt, Human
ucucccccagccccaucc

SEQ ID NO: 3013781 - RNA, 13 nt, Human
ucucccccagccc

SEQ ID NO: 3013782 - RNA, 22 nt, Human
ucucccccagccccauccucug

SEQ ID NO: 3013783 - RNA, 14 nt, Human
ucucccccagcccc

SEQ ID NO: 3013784 - RNA, 17 nt, Human
ucucccccagccccauc

SEQ ID NO: 3013785 - RNA, 15 nt, Human
ucucccccagcccca

SEQ ID NO: 3013786 - RNA, 13 nt, Human
ucucugaggacac

SEQ ID NO: 3013787 - RNA, 15 nt, Human
ucucuacaaaaagca

SEQ ID NO: 3013788 - RNA, 16 nt, Human
ucucuaguuugauuaa

SEQ ID NO: 3013789 - RNA, 18 nt, Human
ucucuaguuugauuaaau

SEQ ID NO: 3013790 - RNA, 19 nt, Human
ucucuaguuugauuaaauu

SEQ ID NO: 3013791 - RNA, 14 nt, Human
ucugacccaugcug

SEQ ID NO: 3013792 - RNA, 15 nt, Human
ucugacccacugcuu

SEQ ID NO: 3013793 - RNA, 20 nt, Human
ucugaacuuggcgcugcccc

SEQ ID NO: 3013794 - RNA, 24 nt, Human
ucugagaucaaaacgguuuuacug

SEQ ID NO: 3013795 - RNA, 18 nt, Human
ucugacccaugcugcccu

SEQ ID NO: 3013796 - RNA, 17 nt, Human
ucugacccaugcugccc

SEQ ID NO: 3013797 - RNA, 16 nt, Human
ucugacccaugcugcc

SEQ ID NO: 3013798 - RNA, 15 nt, Human
ucugacccaugcugc

SEQ ID NO: 3013799 - RNA, 19 nt, Human
ucugcacaagcugcacccu

SEQ ID NO: 3013800 - RNA, 14 nt, Human
ucugcacaagcugc

SEQ ID NO: 3013801 - RNA, 23 nt, Human
ucugauucccaagcucugcuccu

SEQ ID NO: 3013802 - RNA, 16 nt, Human
ucugaggaauccagac

SEQ ID NO: 3013803 - RNA, 17 nt, Human
ucugaggaauccagacc

SEQ ID NO: 3013804 - RNA, 20 nt, Human
ucugaggacacuaaccacgc

SEQ ID NO: 3013805 - RNA, 23 nt, Human
ucugaggacacuaaccacgcugg

SEQ ID NO: 3013806 - RNA, 16 nt, Human
ucugaaaauguaugug

SEQ ID NO: 3013807 - RNA, 15 nt, Human
ucucuuuucaaaaca

SEQ ID NO: 3013808 - RNA, 16 nt, Human
ucucuuuucaaaacau

SEQ ID NO: 3013809 - RNA, 14 nt, Human
ucugaaaauguaug

SEQ ID NO: 3013810 - RNA, 23 nt, Human
ucugaaaauguauguguaaguau

SEQ ID NO: 3013811 - RNA, 13 nt, Human
ucugaaagggacg

SEQ ID NO: 3013812 - RNA, 16 nt, Human
ucccauucuuggccca

SEQ ID NO: 3013813 - RNA, 22 nt, Human
uccccacuugagaauuacccuu

SEQ ID NO: 3013814 - RNA, 15 nt, Human
ucccauucuuggccc

SEQ ID NO: 3013815 - RNA, 23 nt, Human
ucccaucucacacaugagcauca

SEQ ID NO: 3013816 - RNA, 20 nt, Human
ucccaucucacacaugagca

SEQ ID NO: 3013817 - RNA, 13 nt, Human
ucccaccucagcc

SEQ ID NO: 3013818 - RNA, 14 nt, Human
ucccaccucagccu

SEQ ID NO: 3013819 - RNA, 15 nt, Human
ucccaccucagccuc

SEQ ID NO: 3013820 - RNA, 21 nt, Human
ucccaggcauuccccaggagg

SEQ ID NO: 3013821 - RNA, 20 nt, Human
ucccaggcauuccccaggag

SEQ ID NO: 3013822 - RNA, 19 nt, Human
ucccaggcauuccccagga

SEQ ID NO: 3013823 - RNA, 22 nt, Human
ucccaggcauuccccaggaggc

SEQ ID NO: 3013824 - RNA, 23 nt, Human
uccagcucaccagccccagugcc

SEQ ID NO: 3013825 - RNA, 21 nt, Human
ucccaaagugcugggauuaca

SEQ ID NO: 3013826 - RNA, 15 nt, Human
uccauggacuuuguu

SEQ ID NO: 3013827 - RNA, 14 nt, Human
uccauggacuuugu

SEQ ID NO: 3013828 - RNA, 13 nt, Human
uccauggacuuug

SEQ ID NO: 3013829 - RNA, 17 nt, Human
ucccaagcucugcuccu

SEQ ID NO: 3013830 - RNA, 12 nt, Human
ucccaagcucug

SEQ ID NO: 3013831 - RNA, 13 nt, Human
ucccaagcucugc

SEQ ID NO: 3013832 - RNA, 14 nt, Human
ucccaagcucugcu

SEQ ID NO: 3013833 - RNA, 15 nt, Human
ucccaagcucugcuc

SEQ ID NO: 3013834 - RNA, 16 nt, Human
ucccaacucaccccag

SEQ ID NO: 3013835 - RNA, 15 nt, Human
ucccaacucacccca

SEQ ID NO: 3013836 - RNA, 14 nt, Human
ucccaacucacccc

SEQ ID NO: 3013837 - RNA, 13 nt, Human
ucccaacucaccc

SEQ ID NO: 3013838 - RNA, 17 nt, Human
ucccccuggcacugguu

SEQ ID NO: 3013839 - RNA, 21 nt, Human
ucccccuuccauggacuuugu

SEQ ID NO: 3013840 - RNA, 20 nt, Human
uccccgcacugggcuugggg

SEQ ID NO: 3013841 - RNA, 19 nt, Human
uccccuguagagugggagc

SEQ ID NO: 3013842 - RNA, 24 nt, Human
uccccugcuggguguggcgcagca

SEQ ID NO: 3013843 - RNA, 23 nt, Human
uccccuguccccgcacugggcuu

SEQ ID NO: 3013844 - RNA, 22 nt, Human
uccccuguagagugggagcuga

SEQ ID NO: 3013845 - RNA, 21 nt, Human
uccccugcuggguguggcgca

SEQ ID NO: 3013846 - RNA, 20 nt, Human
uccccugcuggguguggcgc

SEQ ID NO: 3013847 - RNA, 15 nt, Human
uccccugcugggugu

SEQ ID NO: 3013848 - RNA, 14 nt, Human
uccccugcugggug

SEQ ID NO: 3013849 - RNA, 15 nt, Human
ucccuacuguaauuu

SEQ ID NO: 3013850 - RNA, 15 nt, Human
ucccucccucuuucc

SEQ ID NO: 3013851 - RNA, 17 nt, Human
ucccucccucuuucccu

SEQ ID NO: 3013852 - RNA, 15 nt, Human
ucaucuguuacacaa

SEQ ID NO: 3013853 - RNA, 15 nt, Human
ucauacccaccccca

SEQ ID NO: 3013854 - RNA, 14 nt, Human
ucauacccaccccc

SEQ ID NO: 3013855 - RNA, 20 nt, Human
ucauacccacccccacccaa

SEQ ID NO: 3013856 - RNA, 16 nt, Human
ucauuaggugugacug

SEQ ID NO: 3013857 - RNA, 18 nt, Human
ucauuaggugugacugaa

SEQ ID NO: 3013858 - RNA, 21 nt, Human
ucauuaggugugacugaauuu

SEQ ID NO: 3013859 - RNA, 12 nt, Human
ucagcagagugc

SEQ ID NO: 3013860 - RNA, 11 nt, Human
ucagcagagug

SEQ ID NO: 3013861 - RNA, 22 nt, Human
ucagcagagugcuuuaccaauu

SEQ ID NO: 3013862 - RNA, 16 nt, Human
ucagcagagugcuuua

SEQ ID NO: 3013863 - RNA, 24 nt, Human
ucagucugauucccaagcucugcu

SEQ ID NO: 3013864 - RNA, 15 nt, Human
ucagucuggcccuuc

SEQ ID NO: 3013865 - RNA, 23 nt, Human
ucagugguuggcaauuguuucaa

SEQ ID NO: 3013866 - RNA, 11 nt, Human
ucaguguacau

SEQ ID NO: 3013867 - RNA, 13 nt, Human
ucagugugacuga

SEQ ID NO: 3013868 - RNA, 17 nt, Human
ucagugugacugaucuc

SEQ ID NO: 3013869 - RNA, 13 nt, Human
ucauaaugacuua

SEQ ID NO: 3013870 - RNA, 13 nt, Human
ucauacccacccc

SEQ ID NO: 3013871 - RNA, 13 nt, Human
uccaccugccagg

SEQ ID NO: 3013872 - RNA, 14 nt, Human
uccacaagagccca

SEQ ID NO: 3013873 - RNA, 22 nt, Human
uccaagcaggacauggacaagg

SEQ ID NO: 3013874 - RNA, 12 nt, Human
uccaccugccag

SEQ ID NO: 3013875 - RNA, 17 nt, Human
uccaaaauaaaacuuuu

SEQ ID NO: 3013876 - RNA, 16 nt, Human
uccaaaauaaaacuuu

SEQ ID NO: 3013877 - RNA, 20 nt, Human
uccaagaagcccaggaaagg

SEQ ID NO: 3013878 - RNA, 19 nt, Human
uccaagaagcccaggaaag

SEQ ID NO: 3013879 - RNA, 22 nt, Human
uccaagaagcccaggaaaggcu

SEQ ID NO: 3013880 - RNA, 18 nt, Human
ucaagcugaccuugcuga

SEQ ID NO: 3013881 - RNA, 19 nt, Human
ucaaggauccugagccaga

SEQ ID NO: 3013882 - RNA, 18 nt, Human
ucaaggauccugagccag

SEQ ID NO: 3013883 - RNA, 22 nt, Human
ucaagugauucuccugccucag

SEQ ID NO: 3013884 - RNA, 17 nt, Human
ucaaggauccugagcca

SEQ ID NO: 3013885 - RNA, 20 nt, Human
ucaaggauccugagccagau

SEQ ID NO: 3013886 - RNA, 16 nt, Human
ucaagcgauucuucug

SEQ ID NO: 3013887 - RNA, 22 nt, Human
ucaaacucuugaccucagguga

SEQ ID NO: 3013888 - RNA, 15 nt, Human
ucaaacuuuacuaug

SEQ ID NO: 3013889 - RNA, 13 nt, Human
ucaaacuuuacua

SEQ ID NO: 3013890 - RNA, 16 nt, Human
ucaaacuuuacuaugg

SEQ ID NO: 3013891 - RNA, 13 nt, Human
ucaaccuccuggg

SEQ ID NO: 3013892 - RNA, 14 nt, Human
ucaaccuccugggc

SEQ ID NO: 3013893 - RNA, 19 nt, Human
ucaauuacaggaaguacug

SEQ ID NO: 3013894 - RNA, 21 nt, Human
ucacacaguauuacuucugcu

SEQ ID NO: 3013895 - RNA, 22 nt, Human
ucacacaguauuacuucugcua

SEQ ID NO: 3013896 - RNA, 13 nt, Human
ucacacagugagu

SEQ ID NO: 3013897 - RNA, 21 nt, Human
ucacacaugagcaucaggcca

SEQ ID NO: 3013898 - RNA, 22 nt, Human
ucacacagugagucgaggacag

SEQ ID NO: 3013899 - RNA, 23 nt, Human
ucacacagugagucgaggacagg

SEQ ID NO: 3013900 - RNA, 11 nt, Human
ucacaggcagg

SEQ ID NO: 3013901 - RNA, 13 nt, Human
ucaauaggaaaaa

SEQ ID NO: 3013902 - RNA, 14 nt, Human
ucaaugcacugaca

SEQ ID NO: 3013903 - RNA, 14 nt, Human
ucaauaggaaaaac

SEQ ID NO: 3013904 - RNA, 18 nt, Human
ucaaugcacugacauugu

SEQ ID NO: 3013905 - RNA, 18 nt, Human
ucaauuacaggaaguacu

SEQ ID NO: 3013906 - RNA, 13 nt, Human
ucaauuacaggaa

SEQ ID NO: 3013907 - RNA, 20 nt, Human
uauuuuuguuuuuauuaaaa

SEQ ID NO: 3013908 - RNA, 18 nt, Human
uauuuuuguuuuuauuaa

SEQ ID NO: 3013909 - RNA, 13 nt, Human
ucaaacuaacagg

SEQ ID NO: 3013910 - RNA, 12 nt, Human
ucaaacuaacag

SEQ ID NO: 3013911 - RNA, 14 nt, Human
ucaaacucuuaaaa

SEQ ID NO: 3013912 - RNA, 22 nt, Human
ucaaaacgguuuuacugcagcu

SEQ ID NO: 3013913 - RNA, 15 nt, Human
uauuuuuuuacuaau

SEQ ID NO: 3013914 - RNA, 16 nt, Human
uauuuauugaaaugau

SEQ ID NO: 3013915 - RNA, 20 nt, Human
uauuuauugaaaugauuuca

SEQ ID NO: 3013916 - RNA, 12 nt, Human
uauuuauugaaa

SEQ ID NO: 3013917 - RNA, 20 nt, Human
uaucugaaaauguaugugua

SEQ ID NO: 3013918 - RNA, 14 nt, Human
uaucugaaaaugua

SEQ ID NO: 3013919 - RNA, 15 nt, Human
uaucugaaaauguau

SEQ ID NO: 3013920 - RNA, 23 nt, Human
uauuuauuaaaugcccagccccu

SEQ ID NO: 3013921 - RNA, 23 nt, Human
uauuugaguggaguuacugaaca

SEQ ID NO: 3013922 - RNA, 23 nt, Human
uauuucugaggagccugcaacau

SEQ ID NO: 3013923 - RNA, 12 nt, Human
uauuuuacuuuu

SEQ ID NO: 3013924 - RNA, 13 nt, Human
uauuuuacuuuuu

SEQ ID NO: 3013925 - RNA, 14 nt, Human
uauuuuacuuuuug

SEQ ID NO: 3013926 - RNA, 15 nt, Human
uauuuuacuuuuugg

SEQ ID NO: 3013927 - RNA, 22 nt, Human
uauuuuagguguaaaauaauua

SEQ ID NO: 3013928 - RNA, 19 nt, Human
ucacgccuguaauccuagc

SEQ ID NO: 3013929 - RNA, 20 nt, Human
ucacgccuguaauccuagca

SEQ ID NO: 3013930 - RNA, 16 nt, Human
ucacgccacugcacua

SEQ ID NO: 3013931 - RNA, 13 nt, Human
ucacgccacugca

SEQ ID NO: 3013932 - RNA, 14 nt, Human
ucacgccacugcac

SEQ ID NO: 3013933 - RNA, 22 nt, Human
ucaccuuuguccccaccgcaga

SEQ ID NO: 3013934 - RNA, 18 nt, Human
ucaccuuuguccccaccg

SEQ ID NO: 3013935 - RNA, 17 nt, Human
ucaccuuuguccccacc

SEQ ID NO: 3013936 - RNA, 15 nt, Human
ucaccuuugucccca

SEQ ID NO: 3013937 - RNA, 14 nt, Human
ucaccuuugucccc

SEQ ID NO: 3013938 - RNA, 12 nt, Human
ucaccuuugucc

SEQ ID NO: 3013939 - RNA, 14 nt, Human
ucaccuuucccauc

SEQ ID NO: 3013940 - RNA, 19 nt, Human
ucacaggcagguccagggu

SEQ ID NO: 3013941 - RNA, 12 nt, Human
ucacaggcaggu

SEQ ID NO: 3013942 - RNA, 15 nt, Human
ucacaggcaggucca

SEQ ID NO: 3013943 - RNA, 14 nt, Human
ucacggaagagccu

SEQ ID NO: 3013944 - RNA, 17 nt, Human
ucacggaagagccuugc

SEQ ID NO: 3013945 - RNA, 16 nt, Human
ucacggaagagccuug

SEQ ID NO: 3013946 - RNA, 13 nt, Human
ucacggcucacug

SEQ ID NO: 3013947 - RNA, 15 nt, Human
ucacggcucacugca

SEQ ID NO: 3013948 - RNA, 20 nt, Human
ucacggcucacugcagccuc

SEQ ID NO: 3013949 - RNA, 13 nt, Human
ucacuccuugaaa

SEQ ID NO: 3013950 - RNA, 23 nt, Human
ucacucuccuuggugucgggcau

SEQ ID NO: 3013951 - RNA, 13 nt, Human
ucacucuggcagc

SEQ ID NO: 3013952 - RNA, 12 nt, Human
ucacucuggcag

SEQ ID NO: 3013953 - RNA, 14 nt, Human
ucacucuccuuggu

SEQ ID NO: 3013954 - RNA, 12 nt, Human
ucacucuccuug

SEQ ID NO: 3013955 - RNA, 22 nt, Human
ucacucuggcagcucagagagg

SEQ ID NO: 3013956 - RNA, 20 nt, Human
ucacucuggcagcucagaga

SEQ ID NO: 3013957 - RNA, 19 nt, Human
ucacucuggcagcucagag

SEQ ID NO: 3013958 - RNA, 18 nt, Human
ucacucuggcagcucaga

SEQ ID NO: 3013959 - RNA, 17 nt, Human
ucacucuggcagcucag

SEQ ID NO: 3013960 - RNA, 16 nt, Human
ucacucuggcagcuca

SEQ ID NO: 3013961 - RNA, 15 nt, Human
ucacucuggcagcuc

SEQ ID NO: 3013962 - RNA, 14 nt, Human
ucacucuggcagcu

SEQ ID NO: 3013963 - RNA, 19 nt, Human
ucacucugucgcccagucu

SEQ ID NO: 3013964 - RNA, 12 nt, Human
ucacucugucgc

SEQ ID NO: 3013965 - RNA, 16 nt, Human
ucacucugucgcccag

SEQ ID NO: 3013966 - RNA, 15 nt, Human
ucacugcuuaacuuc

SEQ ID NO: 3013967 - RNA, 17 nt, Human
ucacugcuuaacuucac

SEQ ID NO: 3013968 - RNA, 18 nt, Human
ucacugcuuaacuucaca

SEQ ID NO: 3013969 - RNA, 20 nt, Human
ucacugcuuaacuucacaua

SEQ ID NO: 3013970 - RNA, 18 nt, Human
ucagcacgauuucuguuu

SEQ ID NO: 3013971 - RNA, 19 nt, Human
ucagcacgauuucuguuua

SEQ ID NO: 3013972 - RNA, 14 nt, Human
ucagacagcugccu

SEQ ID NO: 3013973 - RNA, 20 nt, Human
ucagacagcugccugggauc

SEQ ID NO: 3013974 - RNA, 19 nt, Human
ucagacagcugccugggau

SEQ ID NO: 3013975 - RNA, 18 nt, Human
ucagacagcugccuggga

SEQ ID NO: 3013976 - RNA, 17 nt, Human
ucagacagcugccuggg

SEQ ID NO: 3013977 - RNA, 16 nt, Human
ucagacagcugccugg

SEQ ID NO: 3013978 - RNA, 15 nt, Human
ucagacagcugccug

SEQ ID NO: 3013979 - RNA, 12 nt, Human
uaaacacauuaa

SEQ ID NO: 3013980 - RNA, 23 nt, Human
uaaacaagaccacguuucuaaag

SEQ ID NO: 3013981 - RNA, 18 nt, Human
uaaacaagaccacguuuc

SEQ ID NO: 3013982 - RNA, 16 nt, Human
uaaacuuuaccuuuuu

SEQ ID NO: 3013983 - RNA, 22 nt, Human
uaaacuuuaccuuuuuuauaca

SEQ ID NO: 3013984 - RNA, 14 nt, Human
uaaacuuaaucuaa

SEQ ID NO: 3013985 - RNA, 13 nt, Human
uaaacuuaaucua

SEQ ID NO: 3013986 - RNA, 18 nt, Human
uaaacuuaaucuaaaugg

SEQ ID NO: 3013987 - RNA, 19 nt, Human
uaaacuuaaucuaaaugga

SEQ ID NO: 3013988 - RNA, 22 nt, Human
uaaauaucccuuggacauuuua

SEQ ID NO: 3013989 - RNA, 22 nt, Human
uaaauauugguugggaugacuu

SEQ ID NO: 3013990 - RNA, 23 nt, Human
uaaauauugguugggaugacuug

SEQ ID NO: 3013991 - RNA, 18 nt, Human
uaaauauuuugacuuguu

SEQ ID NO: 3013992 - RNA, 15 nt, Human
uaaauauuuugacuu

SEQ ID NO: 3013993 - RNA, 19 nt, Human
uaaauauuuugacuuguug

SEQ ID NO: 3013994 - RNA, 19 nt, Human
uaaaucagccguguaacca

SEQ ID NO: 3013995 - RNA, 21 nt, Human
uaaaguguauuuuuuuacuaa

SEQ ID NO: 3013996 - RNA, 22 nt, Human
uaaaguguauuuuuuuacuaau

SEQ ID NO: 3013997 - RNA, 23 nt, Human
uaaaguguauuuuuuuacuaaua

SEQ ID NO: 3013998 - RNA, 20 nt, Human
uaaaguguauuuuuuuacua

SEQ ID NO: 3013999 - RNA, 13 nt, Human
uaaaguuucuguu

SEQ ID NO: 3014000 - RNA, 16 nt, Human
guuuuguguacuuuua

SEQ ID NO: 3014001 - RNA, 15 nt, Human
guuuuguguacuuuu

SEQ ID NO: 3014002 - RNA, 17 nt, Human
guuuuguguacuuuuaa

SEQ ID NO: 3014003 - RNA, 19 nt, Human
guuuucucuugagagggug

SEQ ID NO: 3014004 - RNA, 12 nt, Human
guuuucucuuga

SEQ ID NO: 3014005 - RNA, 19 nt, Human
guuuuuauggcuuuugugc

SEQ ID NO: 3014006 - RNA, 22 nt, Human
guuuuuauggcuuuugugcauu

SEQ ID NO: 3014007 - RNA, 23 nt, Human
guuuuuauggcuuuugugcauua

SEQ ID NO: 3014008 - RNA, 13 nt, Human
guuuguucccugu

SEQ ID NO: 3014009 - RNA, 17 nt, Human
guuuucaguguacaugg

SEQ ID NO: 3014010 - RNA, 16 nt, Human
guuuucaguguacaug

SEQ ID NO: 3014011 - RNA, 13 nt, Human
guuuuuauuaaaa

SEQ ID NO: 3014012 - RNA, 17 nt, Human
guuuuuauuaaaaggaa

SEQ ID NO: 3014013 - RNA, 14 nt, Human
guuuuuauuaaaag

SEQ ID NO: 3014014 - RNA, 15 nt, Human
guuuuuauuauuaac

SEQ ID NO: 3014015 - RNA, 18 nt, Human
guuuuuauuauuaacaaa

SEQ ID NO: 3014016 - RNA, 23 nt, Human
uaaaaaacugcugacuguuuucu

SEQ ID NO: 3014017 - RNA, 20 nt, Human
uaaaaaacugcugacuguuu

SEQ ID NO: 3014018 - RNA, 17 nt, Human
guuuagaugaaugucag

SEQ ID NO: 3014019 - RNA, 18 nt, Human
guuuagaugaaugucagu

SEQ ID NO: 3014020 - RNA, 18 nt, Human
gguuggcaaaaaggcagg

SEQ ID NO: 3014021 - RNA, 21 nt, Human
gguuggccccugcccggcugc

SEQ ID NO: 3014022 - RNA, 15 nt, Human
guuuagauaauacac

SEQ ID NO: 3014023 - RNA, 20 nt, Human
guuuccuggcacugcuucca

SEQ ID NO: 3014024 - RNA, 16 nt, Human
guuuccuggcacugcu

SEQ ID NO: 3014025 - RNA, 22 nt, Human
guuuccuggcacugcuuccagu

SEQ ID NO: 3014026 - RNA, 21 nt, Human
guuuccuggcacugcuuccag

SEQ ID NO: 3014027 - RNA, 14 nt, Human
guuucagaaaugug

SEQ ID NO: 3014028 - RNA, 18 nt, Human
guuucagaaauguguuau

SEQ ID NO: 3014029 - RNA, 16 nt, Human
guuucuaaagcugcca

SEQ ID NO: 3014030 - RNA, 15 nt, Human
guuucuaaagcugcc

SEQ ID NO: 3014031 - RNA, 14 nt, Human
guuucuaaagcugc

SEQ ID NO: 3014032 - RNA, 18 nt, Human
guuugagaucagccuggg

SEQ ID NO: 3014033 - RNA, 16 nt, Human
guuugaaccaagaacu

SEQ ID NO: 3014034 - RNA, 22 nt, Human
guuugauuaaauucuugcaaag

SEQ ID NO: 3014035 - RNA, 17 nt, Human
guuugauuaaauucuug

SEQ ID NO: 3014036 - RNA, 19 nt, Human
guuugauuaaauucuugca

SEQ ID NO: 3014037 - RNA, 17 nt, Human
guuuguaaauuaacuuu

SEQ ID NO: 3014038 - RNA, 19 nt, Human
guuuguaaauuaacuuuua

SEQ ID NO: 3014039 - RNA, 16 nt, Human
uaagaacuaaaauguu

SEQ ID NO: 3014040 - RNA, 22 nt, Human
uaagaggcagggucucacucug

SEQ ID NO: 3014041 - RNA, 22 nt, Human
uaagaaccuuuugagugccuua

SEQ ID NO: 3014042 - RNA, 21 nt, Human
uaacuuuuauaaacuuuaccu

SEQ ID NO: 3014043 - RNA, 22 nt, Human
uaacuuuuauaaacuuuaccuu

SEQ ID NO: 3014044 - RNA, 19 nt, Human
uaacuuuuauaaacuuuac

SEQ ID NO: 3014045 - RNA, 24 nt, Human
uaagaaagacuaucuaaauguuga

SEQ ID NO: 3014046 - RNA, 16 nt, Human
uaagauaaaugugcug

SEQ ID NO: 3014047 - RNA, 17 nt, Human
uaagauaaaugugcuga

SEQ ID NO: 3014048 - RNA, 14 nt, Human
uaagauaaaugugc

SEQ ID NO: 3014049 - RNA, 23 nt, Human
uaagagggagggagggcuccaga

SEQ ID NO: 3014050 - RNA, 22 nt, Human
uaagagggagggagggcuccag

SEQ ID NO: 3014051 - RNA, 12 nt, Human
uaagagggaggg

SEQ ID NO: 3014052 - RNA, 19 nt, Human
uaaggaugcuuguacauaa

SEQ ID NO: 3014053 - RNA, 18 nt, Human
uaaggaugcuuguacaua

SEQ ID NO: 3014054 - RNA, 20 nt, Human
uaaggaugcuuguacauaau

SEQ ID NO: 3014055 - RNA, 21 nt, Human
uaaggaugcuuguacauaaug

SEQ ID NO: 3014056 - RNA, 22 nt, Human
uaaggaugcuuguacauaaugc

SEQ ID NO: 3014057 - RNA, 23 nt, Human
uaaggaugcuuguacauaaugcg

SEQ ID NO: 3014058 - RNA, 20 nt, Human
uaacagcaacacaaagcuuu

SEQ ID NO: 3014059 - RNA, 18 nt, Human
uaacagcaacacaaagcu

SEQ ID NO: 3014060 - RNA, 12 nt, Human
uaacagaaaugu

SEQ ID NO: 3014061 - RNA, 14 nt, Human
uaacagaaauguac

SEQ ID NO: 3014062 - RNA, 15 nt, Human
uaacagaaauguaca

SEQ ID NO: 3014063 - RNA, 13 nt, Human
uaacagaaaugua

SEQ ID NO: 3014064 - RNA, 21 nt, Human
uaacaggcuuagugauguaau

SEQ ID NO: 3014065 - RNA, 14 nt, Human
uaacaggcuuagug

SEQ ID NO: 3014066 - RNA, 19 nt, Human
uaacaggcagauacaggaa

SEQ ID NO: 3014067 - RNA, 16 nt, Human
uaaccagcagaaaugc

SEQ ID NO: 3014068 - RNA, 19 nt, Human
uaaccagcagaaaugccuu

SEQ ID NO: 3014069 - RNA, 14 nt, Human
uaaccagcagaaau

SEQ ID NO: 3014070 - RNA, 20 nt, Human
uaacuuuuauaaacuuuacc

SEQ ID NO: 3014071 - RNA, 20 nt, Human
uaagugguacuaacuuuccu

SEQ ID NO: 3014072 - RNA, 21 nt, Human
uaauaguucagguaacaggca

SEQ ID NO: 3014073 - RNA, 11 nt, Human
uaaucuaaaug

SEQ ID NO: 3014074 - RNA, 20 nt, Human
uaauccucuaggaggucucu

SEQ ID NO: 3014075 - RNA, 19 nt, Human
uaauuugugauacaaugcu

SEQ ID NO: 3014076 - RNA, 22 nt, Human
uaauuugugauacaaugcugug

SEQ ID NO: 3014077 - RNA, 14 nt, Human
uaauuugugauaca

SEQ ID NO: 3014078 - RNA, 15 nt, Human
uaauuugugauacaa

SEQ ID NO: 3014079 - RNA, 18 nt, Human
uaauuugugauacaaugc

SEQ ID NO: 3014080 - RNA, 18 nt, Human
uaauucuuagcucauucu

SEQ ID NO: 3014081 - RNA, 22 nt, Human
uaauugacaggauuauuggaaa

SEQ ID NO: 3014082 - RNA, 20 nt, Human
uaauugacaggauuauugga

SEQ ID NO: 3014083 - RNA, 14 nt, Human
uaaugcgugcauac

SEQ ID NO: 3014084 - RNA, 17 nt, Human
uaauuaaaacacaacau

SEQ ID NO: 3014085 - RNA, 20 nt, Human
uaauuaaguacuauguauca

SEQ ID NO: 3014086 - RNA, 13 nt, Human
uacacuugugaau

SEQ ID NO: 3014087 - RNA, 19 nt, Human
uacacuguuucaaacuuua

SEQ ID NO: 3014088 - RNA, 17 nt, Human
uacacuguuucaaacuu

SEQ ID NO: 3014089 - RNA, 18 nt, Human
uacacuguuucaaacuuu

SEQ ID NO: 3014090 - RNA, 13 nt, Human
uacacuuuaugca

SEQ ID NO: 3014091 - RNA, 24 nt, Human
uacagcaaggagauuuacaacugg

SEQ ID NO: 3014092 - RNA, 23 nt, Human
uacagcuugaccgugaggccaga

SEQ ID NO: 3014093 - RNA, 17 nt, Human
uacaggaaaagcugcug

SEQ ID NO: 3014094 - RNA, 18 nt, Human
uacaggaaaagcugcuga

SEQ ID NO: 3014095 - RNA, 21 nt, Human
uacagcuugaccgugaggcca

SEQ ID NO: 3014096 - RNA, 22 nt, Human
uacagcuugaccgugaggccag

SEQ ID NO: 3014097 - RNA, 19 nt, Human
uacaggaaaagcugcugac

SEQ ID NO: 3014098 - RNA, 16 nt, Human
uacaggcacccaccau

SEQ ID NO: 3014099 - RNA, 22 nt, Human
uacacacugcauguuugugauu

SEQ ID NO: 3014100 - RNA, 16 nt, Human
uacacugugcugaguc

SEQ ID NO: 3014101 - RNA, 14 nt, Human
uacacuguuucaaa

SEQ ID NO: 3014102 - RNA, 17 nt, Human
uacacacugcauguuug

SEQ ID NO: 3014103 - RNA, 21 nt, Human
uacacacacacgcgugcacac

SEQ ID NO: 3014104 - RNA, 15 nt, Human
uacacacacauacac

SEQ ID NO: 3014105 - RNA, 17 nt, Human
uacacaaugguuuucuu

SEQ ID NO: 3014106 - RNA, 21 nt, Human
uacacaaugguuuucuugugu

SEQ ID NO: 3014107 - RNA, 23 nt, Human
uaccaauauuuaaucuuuuauga

SEQ ID NO: 3014108 - RNA, 21 nt, Human
uaccaauauuuaaucuuuuau

SEQ ID NO: 3014109 - RNA, 16 nt, Human
uaccaauauuuaaucu

SEQ ID NO: 3014110 - RNA, 13 nt, Human
uaccaauauuuaa

SEQ ID NO: 3014111 - RNA, 13 nt, Human
uaccacagacaua

SEQ ID NO: 3014112 - RNA, 23 nt, Human
uaccauuuugggguacccacugc

SEQ ID NO: 3014113 - RNA, 15 nt, Human
uacccacccccaccc

SEQ ID NO: 3014114 - RNA, 12 nt, Human
uacccaccccca

SEQ ID NO: 3014115 - RNA, 23 nt, Human
uacccacccccacccaagggccu

SEQ ID NO: 3014116 - RNA, 19 nt, Human
uacccacccccacccaagg

SEQ ID NO: 3014117 - RNA, 17 nt, Human
uacccacccccacccaa

SEQ ID NO: 3014118 - RNA, 11 nt, Human
uacccacugcu

SEQ ID NO: 3014119 - RNA, 12 nt, Human
uacccacugcuc

SEQ ID NO: 3014120 - RNA, 13 nt, Human
uacccacugcucu

SEQ ID NO: 3014121 - RNA, 14 nt, Human
uacccacugcucug

SEQ ID NO: 3014122 - RNA, 16 nt, Human
uacccagcgagcccug

SEQ ID NO: 3014123 - RNA, 18 nt, Human
uacccagcgagcccuggu

SEQ ID NO: 3014124 - RNA, 22 nt, Human
uacccaggugcuaggaacacuc

SEQ ID NO: 3014125 - RNA, 22 nt, Human
uacauaagauaaaugugcugaa

SEQ ID NO: 3014126 - RNA, 18 nt, Human
uacauaagauaaaugugc

SEQ ID NO: 3014127 - RNA, 19 nt, Human
uacauaagauaaaugugcu

SEQ ID NO: 3014128 - RNA, 23 nt, Human
uacaguuacucagaauucucuag

SEQ ID NO: 3014129 - RNA, 19 nt, Human
uacaguuacucagaauucu

SEQ ID NO: 3014130 - RNA, 21 nt, Human
uacuguaucaugacaaagacu

SEQ ID NO: 3014131 - RNA, 14 nt, Human
uacuuguggacaca

SEQ ID NO: 3014132 - RNA, 19 nt, Human
uacuuguggacacagcucu

SEQ ID NO: 3014133 - RNA, 15 nt, Human
uacuuguggacacag

SEQ ID NO: 3014134 - RNA, 18 nt, Human
uacuuguggacacagcuc

SEQ ID NO: 3014135 - RNA, 15 nt, Human
uagaaauauaauuga

SEQ ID NO: 3014136 - RNA, 20 nt, Human
uagaaauaucugaaaaugua

SEQ ID NO: 3014137 - RNA, 21 nt, Human
uagaaauaucugaaaauguau

SEQ ID NO: 3014138 - RNA, 23 nt, Human
uagaaauaucugaaaauguaugu

SEQ ID NO: 3014139 - RNA, 18 nt, Human
uaccuuuuuuauacauaa

SEQ ID NO: 3014140 - RNA, 19 nt, Human
uaccuuuuuuauacauaaa

SEQ ID NO: 3014141 - RNA, 20 nt, Human
uaccuuuuuuauacauaaac

SEQ ID NO: 3014142 - RNA, 20 nt, Human
uaccuuuguauucucuccug

SEQ ID NO: 3014143 - RNA, 22 nt, Human
uacccaucccauaugccugggc

SEQ ID NO: 3014144 - RNA, 19 nt, Human
uacuaaccagcagaaaugc

SEQ ID NO: 3014145 - RNA, 18 nt, Human
uacuaaccagcagaaaug

SEQ ID NO: 3014146 - RNA, 17 nt, Human
uacuaaccagcagaaau

SEQ ID NO: 3014147 - RNA, 17 nt, Human
uacuacaguccucccau

SEQ ID NO: 3014148 - RNA, 12 nt, Human
uacuacaguccu

SEQ ID NO: 3014149 - RNA, 15 nt, Human
uacuaauagacaauu

SEQ ID NO: 3014150 - RNA, 17 nt, Human
uacuaauagacaauuua

SEQ ID NO: 3014151 - RNA, 22 nt, Human
uacuaauaaaauuuaaaagucu

SEQ ID NO: 3014152 - RNA, 16 nt, Human
uacucagaauucucua

SEQ ID NO: 3014153 - RNA, 22 nt, Human
uacucagaauucucuaguuuga

SEQ ID NO: 3014154 - RNA, 20 nt, Human
uacuacaguuuguuaguaug

SEQ ID NO: 3014155 - RNA, 20 nt, Human
uacuacaguccucccaucuc

SEQ ID NO: 3014156 - RNA, 12 nt, Human
uacucaccucac

SEQ ID NO: 3014157 - RNA, 14 nt, Human
uacucaccucaccc

SEQ ID NO: 3014158 - RNA, 17 nt, Human
uacucccaucugugaaa

SEQ ID NO: 3014159 - RNA, 16 nt, Human
uacucccaucugugaa

SEQ ID NO: 3014160 - RNA, 14 nt, Human
uacucccaucugug

SEQ ID NO: 3014161 - RNA, 12 nt, Human
uacucccaucug

SEQ ID NO: 3014162 - RNA, 15 nt, Human
uacugaggugcuaug

SEQ ID NO: 3014163 - RNA, 23 nt, Human
uagcaguaaaaaaugguguuuua

SEQ ID NO: 3014164 - RNA, 20 nt, Human
uagcagcccucaauugugaa

SEQ ID NO: 3014165 - RNA, 19 nt, Human
uagcagagaaugaaagggc

SEQ ID NO: 3014166 - RNA, 23 nt, Human
uagcagagaaugaaagggcccag

SEQ ID NO: 3014167 - RNA, 11 nt, Human
uagauguugcu

SEQ ID NO: 3014168 - RNA, 13 nt, Human
uagauguugcuaa

SEQ ID NO: 3014169 - RNA, 16 nt, Human
uagcacuuugggaggc

SEQ ID NO: 3014170 - RNA, 12 nt, Human
uagauguauaua

SEQ ID NO: 3014171 - RNA, 18 nt, Human
uagauaauacaccacuac

SEQ ID NO: 3014172 - RNA, 23 nt, Human
uagacccucaugcugccaauauc

SEQ ID NO: 3014173 - RNA, 11 nt, Human
uagagacaggg

SEQ ID NO: 3014174 - RNA, 21 nt, Human
uagagguucaaagauauuuug

SEQ ID NO: 3014175 - RNA, 19 nt, Human
uagagguucaaagauauuu

SEQ ID NO: 3014176 - RNA, 16 nt, Human
uagagguucaaagaua

SEQ ID NO: 3014177 - RNA, 16 nt, Human
uagagagagaccacuu

SEQ ID NO: 3014178 - RNA, 17 nt, Human
uaggaacacuccuucac

SEQ ID NO: 3014179 - RNA, 21 nt, Human
uaggaacuuaaauaaugugaa

SEQ ID NO: 3014180 - RNA, 14 nt, Human
uaggaacacuccuu

SEQ ID NO: 3014181 - RNA, 13 nt, Human
uaggaacacuccu

SEQ ID NO: 3014182 - RNA, 13 nt, Human
uaggaagacuuug

SEQ ID NO: 3014183 - RNA, 15 nt, Human
uaggaagacuuugga

SEQ ID NO: 3014184 - RNA, 14 nt, Human
uaggaagacuuugg

SEQ ID NO: 3014185 - RNA, 17 nt, Human
uaggaagacuuuggaaa

SEQ ID NO: 3014186 - RNA, 16 nt, Human
uaggaagacuuuggaa

SEQ ID NO: 3014187 - RNA, 13 nt, Human
uaggccuggccag

SEQ ID NO: 3014188 - RNA, 14 nt, Human
uaggccuggccaga

SEQ ID NO: 3014189 - RNA, 15 nt, Human
uaggaagguuaaugu

SEQ ID NO: 3014190 - RNA, 11 nt, Human
uagcugggacu

SEQ ID NO: 3014191 - RNA, 18 nt, Human
uagcugggacuacaggug

SEQ ID NO: 3014192 - RNA, 20 nt, Human
uagcugggacuacaggcacc

SEQ ID NO: 3014193 - RNA, 19 nt, Human
uagcugggacuacaggcac

SEQ ID NO: 3014194 - RNA, 22 nt, Human
uagcucauucuccuuguguuac

SEQ ID NO: 3014195 - RNA, 17 nt, Human
uagccugccucuucucu

SEQ ID NO: 3014196 - RNA, 21 nt, Human
uagcucuaggagggcuggcaa

SEQ ID NO: 3014197 - RNA, 14 nt, Human
uagcccaaaaccaa

SEQ ID NO: 3014198 - RNA, 16 nt, Human
uagccuaggugacaga

SEQ ID NO: 3014199 - RNA, 23 nt, Human
uauaauuccuguuuuuauuauua

SEQ ID NO: 3014200 - RNA, 17 nt, Human
uauaauucuacuuugag

SEQ ID NO: 3014201 - RNA, 14 nt, Human
uauaauguaagcuc

SEQ ID NO: 3014202 - RNA, 19 nt, Human
uauaauguaagcucuacug

SEQ ID NO: 3014203 - RNA, 20 nt, Human
uauaauguaagcucuacuga

SEQ ID NO: 3014204 - RNA, 22 nt, Human
uauaacaaaggauacuuauuua

SEQ ID NO: 3014205 - RNA, 18 nt, Human
uauaaugaaugaaacauu

SEQ ID NO: 3014206 - RNA, 20 nt, Human
uauaaugaaugaaacauuuu

SEQ ID NO: 3014207 - RNA, 20 nt, Human
uauaacaaaggauacuuauu

SEQ ID NO: 3014208 - RNA, 21 nt, Human
uaguuugauuaaauucuugca

SEQ ID NO: 3014209 - RNA, 13 nt, Human
uaguuucuccaag

SEQ ID NO: 3014210 - RNA, 23 nt, Human
uaguuugauuaaauucuugcaaa

SEQ ID NO: 3014211 - RNA, 12 nt, Human
uaguuugcaguu

SEQ ID NO: 3014212 - RNA, 15 nt, Human
uaguggauguucuga

SEQ ID NO: 3014213 - RNA, 19 nt, Human
uaucgucacugcuuaacuu

SEQ ID NO: 3014214 - RNA, 16 nt, Human
uaucgucacugcuuaa

SEQ ID NO: 3014215 - RNA, 15 nt, Human
uaucuaaauguugaa

SEQ ID NO: 3014216 - RNA, 16 nt, Human
uaucaugacaaagacu

SEQ ID NO: 3014217 - RNA, 17 nt, Human
uaucaggugcugccauc

SEQ ID NO: 3014218 - RNA, 21 nt, Human
ggggcagugcuuggcccagga

SEQ ID NO: 3014219 - RNA, 23 nt, Human
ggggcagugcuuggcccaggagu

SEQ ID NO: 3014220 - RNA, 16 nt, Human
ggggcaacccugguga

SEQ ID NO: 3014221 - RNA, 17 nt, Human
ggggcugaggugggagg

SEQ ID NO: 3014222 - RNA, 22 nt, Human
gggcuuggggaccagagcugcc

SEQ ID NO: 3014223 - RNA, 16 nt, Human
ggggaaaaucagccug

SEQ ID NO: 3014224 - RNA, 19 nt, Human
ggggaaaaucagccugcuc

SEQ ID NO: 3014225 - RNA, 17 nt, Human
ggggaaaaucagccugc

SEQ ID NO: 3014226 - RNA, 21 nt, Human
ggggaaaaucagccugcucca

SEQ ID NO: 3014227 - RNA, 12 nt, Human
gggguggccucc

SEQ ID NO: 3014228 - RNA, 17 nt, Human
gggguggggaccucagg

SEQ ID NO: 3014229 - RNA, 23 nt, Human
ggggcugcaccggcuggccuggc

SEQ ID NO: 3014230 - RNA, 22 nt, Human
gggggaggugggauccuccagg

SEQ ID NO: 3014231 - RNA, 22 nt, Human
ggggcugcaccggcuggccugg

SEQ ID NO: 3014232 - RNA, 21 nt, Human
ggggcugcaccggcuggccug

SEQ ID NO: 3014233 - RNA, 12 nt, Human
ggggcugcaccg

SEQ ID NO: 3014234 - RNA, 19 nt, Human
ggggcugaggugggaggau

SEQ ID NO: 3014235 - RNA, 12 nt, Human
gggucugaggaa

SEQ ID NO: 3014236 - RNA, 21 nt, Human
gggucugaggaauccagaccc

SEQ ID NO: 3014237 - RNA, 12 nt, Human
gggucucacucu

SEQ ID NO: 3014238 - RNA, 14 nt, Human
gggucucacucugu

SEQ ID NO: 3014239 - RNA, 17 nt, Human
ggguaagugagagaggg

SEQ ID NO: 3014240 - RNA, 22 nt, Human
gguagaagcccuucuaccuucc

SEQ ID NO: 3014241 - RNA, 23 nt, Human
gguagaaauaucugaaaauguau

SEQ ID NO: 3014242 - RNA, 16 nt, Human
gguacuuguggacaca

SEQ ID NO: 3014243 - RNA, 17 nt, Human
gguacuuguggacacag

SEQ ID NO: 3014244 - RNA, 22 nt, Human
gguagaaauaucugaaaaugua

SEQ ID NO: 3014245 - RNA, 11 nt, Human
gguacccacug

SEQ ID NO: 3014246 - RNA, 13 nt, Human
gguacccacugcu

SEQ ID NO: 3014247 - RNA, 16 nt, Human
ggucccaccccacaca

SEQ ID NO: 3014248 - RNA, 15 nt, Human
ggucccaccccacac

SEQ ID NO: 3014249 - RNA, 11 nt, Human
ggucagagccu

SEQ ID NO: 3014250 - RNA, 19 nt, Human
gggugacagagcaagugag

SEQ ID NO: 3014251 - RNA, 17 nt, Human
gggugaagugaagacaa

SEQ ID NO: 3014252 - RNA, 12 nt, Human
ggguucuaccca

SEQ ID NO: 3014253 - RNA, 22 nt, Human
ggguucaagcgauucuucugcu

SEQ ID NO: 3014254 - RNA, 23 nt, Human
ggguucaagcgauucuucugcuu

SEQ ID NO: 3014255 - RNA, 16 nt, Human
gguuauuuuacuuuuu

SEQ ID NO: 3014256 - RNA, 13 nt, Human
gguucaaagauau

SEQ ID NO: 3014257 - RNA, 21 nt, Human
gguucaaagauauuuugcuuu

SEQ ID NO: 3014258 - RNA, 13 nt, Human
gguugagguuuca

SEQ ID NO: 3014259 - RNA, 13 nt, Human
gguuauggagagg

SEQ ID NO: 3014260 - RNA, 17 nt, Human
gguuaggcauuguggga

SEQ ID NO: 3014261 - RNA, 21 nt, Human
gguuacccaguuagcucucaa

SEQ ID NO: 3014262 - RNA, 16 nt, Human
gguggugaccucugcc

SEQ ID NO: 3014263 - RNA, 14 nt, Human
gguggugaccucug

SEQ ID NO: 3014264 - RNA, 15 nt, Human
gguggugaccucugc

SEQ ID NO: 3014265 - RNA, 15 nt, Human
ggugguuuucuguuc

SEQ ID NO: 3014266 - RNA, 18 nt, Human
ggugguuuucuguucuuu

SEQ ID NO: 3014267 - RNA, 17 nt, Human
ggugguuucagaaaugu

SEQ ID NO: 3014268 - RNA, 18 nt, Human
ggugguuucagaaaugug

SEQ ID NO: 3014269 - RNA, 21 nt, Human
ggugguuauggagaggguguc

SEQ ID NO: 3014270 - RNA, 19 nt, Human
ggugucaccugaagacuca

SEQ ID NO: 3014271 - RNA, 19 nt, Human
ggugucaagagggucugag

SEQ ID NO: 3014272 - RNA, 17 nt, Human
ggugucaagagggucug

SEQ ID NO: 3014273 - RNA, 16 nt, Human
ggucucacucugucgc

SEQ ID NO: 3014274 - RNA, 22 nt, Human
ggucucacucugucgcccaguc

SEQ ID NO: 3014275 - RNA, 23 nt, Human
ggucucacucugucgcccagucu

SEQ ID NO: 3014276 - RNA, 14 nt, Human
ggucccaccccaca

SEQ ID NO: 3014277 - RNA, 17 nt, Human
ggucccaccccacacac

SEQ ID NO: 3014278 - RNA, 21 nt, Human
ggugacagagugagacucugu

SEQ ID NO: 3014279 - RNA, 14 nt, Human
ggucugacccacug

SEQ ID NO: 3014280 - RNA, 21 nt, Human
ggugaccucugccugaaguca

SEQ ID NO: 3014281 - RNA, 22 nt, Human
ggugaccagcaccaucucuccu

SEQ ID NO: 3014282 - RNA, 15 nt, Human
ggugcugccauccag

SEQ ID NO: 3014283 - RNA, 19 nt, Human
gguggcagugggagcugcc

SEQ ID NO: 3014284 - RNA, 22 nt, Human
gguggcagugggagcugccugu

SEQ ID NO: 3014285 - RNA, 16 nt, Human
gguggcagugggagcu

SEQ ID NO: 3014286 - RNA, 22 nt, Human
gguggccucccaacucacccca

SEQ ID NO: 3014287 - RNA, 23 nt, Human
gguggccucccaacucaccccag

SEQ ID NO: 3014288 - RNA, 15 nt, Human
ggugagaagcagagg

SEQ ID NO: 3014289 - RNA, 16 nt, Human
ggugagaggggaacag

SEQ ID NO: 3014290 - RNA, 20 nt, Human
ggugcuaucucccccagccc

SEQ ID NO: 3014291 - RNA, 19 nt, Human
ggugcuaucucccccagcc

SEQ ID NO: 3014292 - RNA, 17 nt, Human
ggugcuaucucccccag

SEQ ID NO: 3014293 - RNA, 16 nt, Human
ggugcuaucuccccca

SEQ ID NO: 3014294 - RNA, 16 nt, Human
gggcacaucauuucaa

SEQ ID NO: 3014295 - RNA, 16 nt, Human
gggcacagggucucua

SEQ ID NO: 3014296 - RNA, 13 nt, Human
gggcacagggucu

SEQ ID NO: 3014297 - RNA, 16 nt, Human
gggcacucagaagaca

SEQ ID NO: 3014298 - RNA, 19 nt, Human
gggcacucagaagacacug

SEQ ID NO: 3014299 - RNA, 21 nt, Human
gggcacagaaaauggaagaca

SEQ ID NO: 3014300 - RNA, 20 nt, Human
gggcacagaaaauggaagac

SEQ ID NO: 3014301 - RNA, 18 nt, Human
gggcacagaaaauggaag

SEQ ID NO: 3014302 - RNA, 23 nt, Human
gggcacaccgggcacucagaaga

SEQ ID NO: 3014303 - RNA, 17 nt, Human
gggcagguugguggggg

SEQ ID NO: 3014304 - RNA, 11 nt, Human
gggcagagcag

SEQ ID NO: 3014305 - RNA, 20 nt, Human
gggcacucagaagacacuga

SEQ ID NO: 3014306 - RNA, 14 nt, Human
gggcagaaggaaga

SEQ ID NO: 3014307 - RNA, 18 nt, Human
gggcagaaggaagacuuc

SEQ ID NO: 3014308 - RNA, 18 nt, Human
gggauaucacuuccauga

SEQ ID NO: 3014309 - RNA, 16 nt, Human
gggauccuccaggugc

SEQ ID NO: 3014310 - RNA, 15 nt, Human
gggauccuccaggug

SEQ ID NO: 3014311 - RNA, 13 nt, Human
gggauagagagag

SEQ ID NO: 3014312 - RNA, 21 nt, Human
gggauaugauuuaaaucagcc

SEQ ID NO: 3014313 - RNA, 23 nt, Human
gggauccuggaguucugguuccu

SEQ ID NO: 3014314 - RNA, 20 nt, Human
gggcaacccccagccugcua

SEQ ID NO: 3014315 - RNA, 18 nt, Human
gggcaacccuggugacca

SEQ ID NO: 3014316 - RNA, 16 nt, Human
gggaggugaccccagg

SEQ ID NO: 3014317 - RNA, 17 nt, Human
gggaggugggauccucc

SEQ ID NO: 3014318 - RNA, 17 nt, Human
gggagugacagaggcag

SEQ ID NO: 3014319 - RNA, 18 nt, Human
gggagugacagaggcagc

SEQ ID NO: 3014320 - RNA, 11 nt, Human
gggagugagcu

SEQ ID NO: 3014321 - RNA, 14 nt, Human
gggagugagcuggu

SEQ ID NO: 3014322 - RNA, 18 nt, Human
gggcagugcuuggcccag

SEQ ID NO: 3014323 - RNA, 19 nt, Human
gggcagugcuuggcccagg

SEQ ID NO: 3014324 - RNA, 20 nt, Human
gggcagugcuuggcccagga

SEQ ID NO: 3014325 - RNA, 22 nt, Human
gggcagugcuuggcccaggagu

SEQ ID NO: 3014326 - RNA, 23 nt, Human
gggcagugcuuggcccaggaguu

SEQ ID NO: 3014327 - RNA, 12 nt, Human
gggcaugacacg

SEQ ID NO: 3014328 - RNA, 17 nt, Human
gggcccagagagggugg

SEQ ID NO: 3014329 - RNA, 23 nt, Human
gggccacagagaaaguacuucuc

SEQ ID NO: 3014330 - RNA, 16 nt, Human
gggccacagagaaagu

SEQ ID NO: 3014331 - RNA, 12 nt, Human
gggccuggccug

SEQ ID NO: 3014332 - RNA, 13 nt, Human
gggccuggccuga

SEQ ID NO: 3014333 - RNA, 13 nt, Human
gggcccugccucc

SEQ ID NO: 3014334 - RNA, 13 nt, Human
gggccuggcuccc

SEQ ID NO: 3014335 - RNA, 17 nt, Human
gggccuggcucaggugg

SEQ ID NO: 3014336 - RNA, 18 nt, Human
gggccuggccugagcugg

SEQ ID NO: 3014337 - RNA, 14 nt, Human
gggccuggccugag

SEQ ID NO: 3014338 - RNA, 17 nt, Human
ggcuuagugauguaauu

SEQ ID NO: 3014339 - RNA, 15 nt, Human
ggcuuagucacugag

SEQ ID NO: 3014340 - RNA, 21 nt, Human
ggcuuagucacugagacagcc

SEQ ID NO: 3014341 - RNA, 16 nt, Human
ggcuuagacccucaug

SEQ ID NO: 3014342 - RNA, 21 nt, Human
ggcuuaauuauugauguuuuc

SEQ ID NO: 3014343 - RNA, 17 nt, Human
ggcugggcucccuuccc

SEQ ID NO: 3014344 - RNA, 12 nt, Human
ggcugggcuuca

SEQ ID NO: 3014345 - RNA, 15 nt, Human
ggcuuaaaacaacac

SEQ ID NO: 3014346 - RNA, 13 nt, Human
ggcugggcuucag

SEQ ID NO: 3014347 - RNA, 17 nt, Human
ggcugggcuucaguggc

SEQ ID NO: 3014348 - RNA, 10 nt, Human
ggcuuuugug

SEQ ID NO: 3014349 - RNA, 21 nt, Human
ggcuuggggaccagagcugcc

SEQ ID NO: 3014350 - RNA, 19 nt, Human
ggcuuggggaccagagcug

SEQ ID NO: 3014351 - RNA, 17 nt, Human
gggaagggggcugggac

SEQ ID NO: 3014352 - RNA, 16 nt, Human
gggaagggggcuggga

SEQ ID NO: 3014353 - RNA, 14 nt, Human
gggaagggggcugg

SEQ ID NO: 3014354 - RNA, 16 nt, Human
gggaaggauacaaaag

SEQ ID NO: 3014355 - RNA, 14 nt, Human
ggcuuuugugcauu

SEQ ID NO: 3014356 - RNA, 21 nt, Human
gggaaggauacaaaagcaugu

SEQ ID NO: 3014357 - RNA, 23 nt, Human
gggaaggauacaaaagcauguga

SEQ ID NO: 3014358 - RNA, 17 nt, Human
gggacuacaggcaccca

SEQ ID NO: 3014359 - RNA, 16 nt, Human
gggacucaaugcacug

SEQ ID NO: 3014360 - RNA, 15 nt, Human
gggaccucaggccug

SEQ ID NO: 3014361 - RNA, 13 nt, Human
gggaccucaggcc

SEQ ID NO: 3014362 - RNA, 12 nt, Human
gggaccucaggc

SEQ ID NO: 3014363 - RNA, 22 nt, Human
ggcugcuucaaggauccugagc

SEQ ID NO: 3014364 - RNA, 14 nt, Human
ggcugcuucaagga

SEQ ID NO: 3014365 - RNA, 12 nt, Human
ggcugcuucaag

SEQ ID NO: 3014366 - RNA, 11 nt, Human
ggcugcuucaa

SEQ ID NO: 3014367 - RNA, 12 nt, Human
ggcugcagggag

SEQ ID NO: 3014368 - RNA, 13 nt, Human
ggcugcagggagu

SEQ ID NO: 3014369 - RNA, 14 nt, Human
ggcugcugaaggcu

SEQ ID NO: 3014370 - RNA, 17 nt, Human
ggcugcugaaggcucga

SEQ ID NO: 3014371 - RNA, 15 nt, Human
ggcugcugaaggcuc

SEQ ID NO: 3014372 - RNA, 18 nt, Human
ggcugcugaaggcucgag

SEQ ID NO: 3014373 - RNA, 13 nt, Human
ggcugcugaaggc

SEQ ID NO: 3014374 - RNA, 21 nt, Human
ggcugcuucaaggauccugag

SEQ ID NO: 3014375 - RNA, 23 nt, Human
ggcugcuucaaggauccugagcc

SEQ ID NO: 3014376 - RNA, 19 nt, Human
ggcugggagagccuuccag

SEQ ID NO: 3014377 - RNA, 18 nt, Human
ggcugggagagccuucca

SEQ ID NO: 3014378 - RNA, 19 nt, Human
ggcugggcagaggaaagca

SEQ ID NO: 3014379 - RNA, 15 nt, Human
ggcugggcagaggaa

SEQ ID NO: 3014380 - RNA, 23 nt, Human
ggcugggagagccuuccaggggu

SEQ ID NO: 3014381 - RNA, 20 nt, Human
ggcugggagagccuuccagg

SEQ ID NO: 3014382 - RNA, 14 nt, Human
ggcugggcagagga

SEQ ID NO: 3014383 - RNA, 13 nt, Human
ggcugggcagagg

SEQ ID NO: 3014384 - RNA, 15 nt, Human
ggcugaggugggagg

SEQ ID NO: 3014385 - RNA, 13 nt, Human
ggcugagguggga

SEQ ID NO: 3014386 - RNA, 20 nt, Human
ggccccugcccggcugcgga

SEQ ID NO: 3014387 - RNA, 17 nt, Human
ggcucugccucccauca

SEQ ID NO: 3014388 - RNA, 16 nt, Human
ggccccugcccggcug

SEQ ID NO: 3014389 - RNA, 17 nt, Human
ggccccugcccggcugc

SEQ ID NO: 3014390 - RNA, 24 nt, Human
ggcugcaaaggguaucaggugcug

SEQ ID NO: 3014391 - RNA, 17 nt, Human
ggcugcaccggcuggcc

SEQ ID NO: 3014392 - RNA, 19 nt, Human
ggcugcaccggcuggccug

SEQ ID NO: 3014393 - RNA, 18 nt, Human
ggcugcaccggcuggccu

SEQ ID NO: 3014394 - RNA, 18 nt, Human
ggcugcaaaggguaucag

SEQ ID NO: 3014395 - RNA, 22 nt, Human
ggcugcaaaggguaucaggugc

SEQ ID NO: 3014396 - RNA, 23 nt, Human
ggcugcaaaggguaucaggugcu

SEQ ID NO: 3014397 - RNA, 23 nt, Human
ggagcccugucuccucucucugu

SEQ ID NO: 3014398 - RNA, 20 nt, Human
ggagcaaaaucgaugcagug

SEQ ID NO: 3014399 - RNA, 20 nt, Human
ggagauuuacaacuggggga

SEQ ID NO: 3014400 - RNA, 15 nt, Human
ggagaggggcacagg

SEQ ID NO: 3014401 - RNA, 21 nt, Human
ggagaccccuuggggagcagg

SEQ ID NO: 3014402 - RNA, 21 nt, Human
ggagagcuagcagcagggagg

SEQ ID NO: 3014403 - RNA, 17 nt, Human
ggagagcuagcagcagg

SEQ ID NO: 3014404 - RNA, 20 nt, Human
ggaagccagcaggcucucag

SEQ ID NO: 3014405 - RNA, 15 nt, Human
ggagggcuccagaca

SEQ ID NO: 3014406 - RNA, 14 nt, Human
ggagggcuccagac

SEQ ID NO: 3014407 - RNA, 17 nt, Human
ggagggcuccagacaca

SEQ ID NO: 3014408 - RNA, 20 nt, Human
ggagucccaccuuggcugca

SEQ ID NO: 3014409 - RNA, 11 nt, Human
ggagugacaga

SEQ ID NO: 3014410 - RNA, 16 nt, Human
ggagugacagaggcag

SEQ ID NO: 3014411 - RNA, 16 nt, Human
ggaucacagccucuga

SEQ ID NO: 3014412 - RNA, 12 nt, Human
ggagugagcugg

SEQ ID NO: 3014413 - RNA, 14 nt, Human
ggagugagcugguu

SEQ ID NO: 3014414 - RNA, 21 nt, Human
ggagugaguugauagcacaga

SEQ ID NO: 3014415 - RNA, 17 nt, Human
ggagugacagaggcagc

SEQ ID NO: 3014416 - RNA, 18 nt, Human
ggagugacagaggcagcc

SEQ ID NO: 3014417 - RNA, 19 nt, Human
ggagugacagaggcagccc

SEQ ID NO: 3014418 - RNA, 21 nt, Human
ggagugacagaggcagcccca

SEQ ID NO: 3014419 - RNA, 12 nt, Human
ggagggagggcu

SEQ ID NO: 3014420 - RNA, 13 nt, Human
ggagggcuccaga

SEQ ID NO: 3014421 - RNA, 12 nt, Human
ggagggcuccag

SEQ ID NO: 3014422 - RNA, 21 nt, Human
ggaggaucucuugagccuggg

SEQ ID NO: 3014423 - RNA, 17 nt, Human
ggaggaucucuugagcc

SEQ ID NO: 3014424 - RNA, 23 nt, Human
ggaggaucacuugaguccagaag

SEQ ID NO: 3014425 - RNA, 15 nt, Human
ggaggauguucuggg

SEQ ID NO: 3014426 - RNA, 11 nt, Human
ggccacuguga

SEQ ID NO: 3014427 - RNA, 16 nt, Human
ggccaggagccuccug

SEQ ID NO: 3014428 - RNA, 14 nt, Human
ggccaggagccucc

SEQ ID NO: 3014429 - RNA, 16 nt, Human
ggccacugugaagaga

SEQ ID NO: 3014430 - RNA, 11 nt, Human
ggccaggcugg

SEQ ID NO: 3014431 - RNA, 14 nt, Human
ggccaggccagagg

SEQ ID NO: 3014432 - RNA, 16 nt, Human
ggccaggccagaggga

SEQ ID NO: 3014433 - RNA, 15 nt, Human
ggcagguuggugggg

SEQ ID NO: 3014434 - RNA, 23 nt, Human
ggcauguucucugaggacacuaa

SEQ ID NO: 3014435 - RNA, 22 nt, Human
ggccaccugcggugcuaucucc

SEQ ID NO: 3014436 - RNA, 16 nt, Human
ggccaccugcggugcu

SEQ ID NO: 3014437 - RNA, 17 nt, Human
ggccacaagacccuugu

SEQ ID NO: 3014438 - RNA, 16 nt, Human
ggccacaagacccuug

SEQ ID NO: 3014439 - RNA, 15 nt, Human
ggcauuccccaggag

SEQ ID NO: 3014440 - RNA, 21 nt, Human
ggccccucagggucccuggug

SEQ ID NO: 3014441 - RNA, 20 nt, Human
ggccccucagggucccuggu

SEQ ID NO: 3014442 - RNA, 19 nt, Human
ggccccucagggucccugg

SEQ ID NO: 3014443 - RNA, 16 nt, Human
ggccccucaggguccc

SEQ ID NO: 3014444 - RNA, 17 nt, Human
ggccccugccacccugg

SEQ ID NO: 3014445 - RNA, 18 nt, Human
ggccccugccacccuggg

SEQ ID NO: 3014446 - RNA, 13 nt, Human
ggccccugcccgg

SEQ ID NO: 3014447 - RNA, 13 nt, Human
ggccccugccacc

SEQ ID NO: 3014448 - RNA, 16 nt, Human
ggccccugccacccug

SEQ ID NO: 3014449 - RNA, 12 nt, Human
ggccccugccac

SEQ ID NO: 3014450 - RNA, 13 nt, Human
ggccaugggccuc

SEQ ID NO: 3014451 - RNA, 16 nt, Human
ggcaaggcugucaauu

SEQ ID NO: 3014452 - RNA, 15 nt, Human
ggcacccggccccug

SEQ ID NO: 3014453 - RNA, 16 nt, Human
ggcacccggccccugc

SEQ ID NO: 3014454 - RNA, 12 nt, Human
ggcagagcagag

SEQ ID NO: 3014455 - RNA, 16 nt, Human
ggcagagcagagacca

SEQ ID NO: 3014456 - RNA, 15 nt, Human
ggcagagcagagacc

SEQ ID NO: 3014457 - RNA, 20 nt, Human
ggcagagcagagaccauccc

SEQ ID NO: 3014458 - RNA, 21 nt, Human
ggaucagucugauucccaagc

SEQ ID NO: 3014459 - RNA, 19 nt, Human
ggcaacccccagccugcua

SEQ ID NO: 3014460 - RNA, 15 nt, Human
ggcaaggcugucaau

SEQ ID NO: 3014461 - RNA, 19 nt, Human
ggcaacugcauuggcuuug

SEQ ID NO: 3014462 - RNA, 18 nt, Human
ggcaacugcauuggcuuu

SEQ ID NO: 3014463 - RNA, 17 nt, Human
ggcagaggaaagcaaag

SEQ ID NO: 3014464 - RNA, 23 nt, Human
ggcagauacaggaaaagcugcug

SEQ ID NO: 3014465 - RNA, 23 nt, Human
ggcagaguugaagacagagcuac

SEQ ID NO: 3014466 - RNA, 23 nt, Human
ggcaggucuugaacuccuggccu

SEQ ID NO: 3014467 - RNA, 13 nt, Human
ggcagguccaggg

SEQ ID NO: 3014468 - RNA, 19 nt, Human
ggcagcugcgguccaccca

SEQ ID NO: 3014469 - RNA, 21 nt, Human
ggcagcuugaggguugggcug

SEQ ID NO: 3014470 - RNA, 16 nt, Human
ggcagcucaccucucc

SEQ ID NO: 3014471 - RNA, 22 nt, Human
ggcagcucaccucucccuugga

SEQ ID NO: 3014472 - RNA, 21 nt, Human
ggcagcucaccucucccuugg

SEQ ID NO: 3014473 - RNA, 18 nt, Human
ggcagcucaccucucccu

SEQ ID NO: 3014474 - RNA, 14 nt, Human
gcuuggcccaggag

SEQ ID NO: 3014475 - RNA, 15 nt, Human
gcuuggcccaggagu

SEQ ID NO: 3014476 - RNA, 16 nt, Human
gcuuggcccaggaguu

SEQ ID NO: 3014477 - RNA, 22 nt, Human
gcuuggcccaggaguuuggcca

SEQ ID NO: 3014478 - RNA, 13 nt, Human
gcuuggcccagga

SEQ ID NO: 3014479 - RNA, 23 nt, Human
gcuuggcccaggaguuuggccag

SEQ ID NO: 3014480 - RNA, 22 nt, Human
gcuuuaccaauugaaguaaaau

SEQ ID NO: 3014481 - RNA, 13 nt, Human
ggaaaaauagccu

SEQ ID NO: 3014482 - RNA, 14 nt, Human
ggaaaaacugauuu

SEQ ID NO: 3014483 - RNA, 15 nt, Human
ggaaaaauagccugc

SEQ ID NO: 3014484 - RNA, 14 nt, Human
gcuuuuacuuaaac

SEQ ID NO: 3014485 - RNA, 22 nt, Human
gcuugaggguugggcugguguc

SEQ ID NO: 3014486 - RNA, 15 nt, Human
gcuuggaggaaggaa

SEQ ID NO: 3014487 - RNA, 14 nt, Human
gcuuggaggaagga

SEQ ID NO: 3014488 - RNA, 13 nt, Human
gcuuggaggaagg

SEQ ID NO: 3014489 - RNA, 21 nt, Human
gcuuccagugaggcucugccc

SEQ ID NO: 3014490 - RNA, 20 nt, Human
gcuuccagugaggcucugcc

SEQ ID NO: 3014491 - RNA, 19 nt, Human
gcuuccagugaggcucugc

SEQ ID NO: 3014492 - RNA, 18 nt, Human
gcuuccagugaggcucug

SEQ ID NO: 3014493 - RNA, 10 nt, Human
ggaaaagaau

SEQ ID NO: 3014494 - RNA, 14 nt, Human
ggaaaauaaauuau

SEQ ID NO: 3014495 - RNA, 15 nt, Human
ggaaaaucagccugc

SEQ ID NO: 3014496 - RNA, 17 nt, Human
ggaacagacuggaagca

SEQ ID NO: 3014497 - RNA, 19 nt, Human
ggaacagacuggaagcaca

SEQ ID NO: 3014498 - RNA, 20 nt, Human
ggaacagacuggaagcacag

SEQ ID NO: 3014499 - RNA, 14 nt, Human
ggaagccagcaggc

SEQ ID NO: 3014500 - RNA, 13 nt, Human
ggaagccagcagg

SEQ ID NO: 3014501 - RNA, 18 nt, Human
ggaagccagcaggcucuc

SEQ ID NO: 3014502 - RNA, 17 nt, Human
ggaagccagcaggcucu

SEQ ID NO: 3014503 - RNA, 16 nt, Human
ggaagccagcaggcuc

SEQ ID NO: 3014504 - RNA, 15 nt, Human
ggaagccagcaggcu

SEQ ID NO: 3014505 - RNA, 23 nt, Human
ggaagcacaugccucucucaggc

SEQ ID NO: 3014506 - RNA, 22 nt, Human
ggaagcacaugccucucucagg

SEQ ID NO: 3014507 - RNA, 21 nt, Human
ggaagcacaugccucucucag

SEQ ID NO: 3014508 - RNA, 13 nt, Human
ggaagagccuugc

SEQ ID NO: 3014509 - RNA, 17 nt, Human
ggaagcacagcuucauu

SEQ ID NO: 3014510 - RNA, 17 nt, Human
ggaagcacaugccucuc

SEQ ID NO: 3014511 - RNA, 15 nt, Human
ggaagcacaugccuc

SEQ ID NO: 3014512 - RNA, 14 nt, Human
ggaagcacaugccu

SEQ ID NO: 3014513 - RNA, 13 nt, Human
ggaagcacaugcc

SEQ ID NO: 3014514 - RNA, 17 nt, Human
gcugucuccauguuuga

SEQ ID NO: 3014515 - RNA, 19 nt, Human
gcugucccuuacgugaguc

SEQ ID NO: 3014516 - RNA, 21 nt, Human
gcugucccuuacgugaguccu

SEQ ID NO: 3014517 - RNA, 23 nt, Human
gcugucaauuacaggaaguacug

SEQ ID NO: 3014518 - RNA, 22 nt, Human
gcugucaauuacaggaaguacu

SEQ ID NO: 3014519 - RNA, 19 nt, Human
gcugucaauuacaggaagu

SEQ ID NO: 3014520 - RNA, 17 nt, Human
gcugucaauuacaggaa

SEQ ID NO: 3014521 - RNA, 16 nt, Human
gcuggugucaccugaa

SEQ ID NO: 3014522 - RNA, 18 nt, Human
gcuggugucaccugaaga

SEQ ID NO: 3014523 - RNA, 20 nt, Human
gcuggucccacucaguccau

SEQ ID NO: 3014524 - RNA, 14 nt, Human
gcuggucccacuca

SEQ ID NO: 3014525 - RNA, 15 nt, Human
gcugguucaggguug

SEQ ID NO: 3014526 - RNA, 21 nt, Human
gcugguuagagguucccuuug

SEQ ID NO: 3014527 - RNA, 16 nt, Human
gcugucaauuacagga

SEQ ID NO: 3014528 - RNA, 22 nt, Human
gcugguucaggguuggccccug

SEQ ID NO: 3014529 - RNA, 17 nt, Human
gcugggcuucaguggca

SEQ ID NO: 3014530 - RNA, 21 nt, Human
gcugggaugauuggagggggg

SEQ ID NO: 3014531 - RNA, 22 nt, Human
gcugggagagccuuccaggggu

SEQ ID NO: 3014532 - RNA, 19 nt, Human
gcugggagagccuuccagg

SEQ ID NO: 3014533 - RNA, 18 nt, Human
gcugggagagccuuccag

SEQ ID NO: 3014534 - RNA, 17 nt, Human
gcugggagagccuucca

SEQ ID NO: 3014535 - RNA, 13 nt, Human
gcugggagagccu

SEQ ID NO: 3014536 - RNA, 12 nt, Human
gcugggagagcc

SEQ ID NO: 3014537 - RNA, 19 nt, Human
gcugggggccucagugcca

SEQ ID NO: 3014538 - RNA, 20 nt, Human
gcugggggccucagugccac

SEQ ID NO: 3014539 - RNA, 15 nt, Human
gcuggucccacucag

SEQ ID NO: 3014540 - RNA, 19 nt, Human
gcuggucccacucagucca

SEQ ID NO: 3014541 - RNA, 12 nt, Human
gcuggggccagu

SEQ ID NO: 3014542 - RNA, 23 nt, Human
gcugggggaagaagcucucuccu

SEQ ID NO: 3014543 - RNA, 18 nt, Human
gcugggcuucaguggcag

SEQ ID NO: 3014544 - RNA, 19 nt, Human
gcugggcuucaguggcagc

SEQ ID NO: 3014545 - RNA, 19 nt, Human
gcugggacuacagguguga

SEQ ID NO: 3014546 - RNA, 13 nt, Human
gcugggacuacag

SEQ ID NO: 3014547 - RNA, 18 nt, Human
gcugggacuacaggcacc

SEQ ID NO: 3014548 - RNA, 19 nt, Human
gcugggacuacaggcaccc

SEQ ID NO: 3014549 - RNA, 20 nt, Human
gcugggacuacaggcaccca

SEQ ID NO: 3014550 - RNA, 20 nt, Human
gcugggacaugggaaagggg

SEQ ID NO: 3014551 - RNA, 16 nt, Human
gcuggaccuugaacug

SEQ ID NO: 3014552 - RNA, 18 nt, Human
gcuggaccuugaacuggg

SEQ ID NO: 3014553 - RNA, 22 nt, Human
gcugcuugggcuucauccuccu

SEQ ID NO: 3014554 - RNA, 17 nt, Human
gcugcuugggcuucauc

SEQ ID NO: 3014555 - RNA, 21 nt, Human
gcuggaccuugaacuggguac

SEQ ID NO: 3014556 - RNA, 23 nt, Human
gcugcuucaaggauccugagcca

SEQ ID NO: 3014557 - RNA, 22 nt, Human
gcugcuucaaggauccugagcc

SEQ ID NO: 3014558 - RNA, 21 nt, Human
gcugcuucaaggauccugagc

SEQ ID NO: 3014559 - RNA, 16 nt, Human
gcugcuugggcuucau

SEQ ID NO: 3014560 - RNA, 17 nt, Human
gcugcgguccacccagg

SEQ ID NO: 3014561 - RNA, 18 nt, Human
gcugcgguccacccagga

SEQ ID NO: 3014562 - RNA, 13 nt, Human
gcugcuucaagga

SEQ ID NO: 3014563 - RNA, 16 nt, Human
gcugcgguccacccag

SEQ ID NO: 3014564 - RNA, 14 nt, Human
gcugcccugugagu

SEQ ID NO: 3014565 - RNA, 12 nt, Human
gcugcccuguga

SEQ ID NO: 3014566 - RNA, 11 nt, Human
gcugcccugug

SEQ ID NO: 3014567 - RNA, 19 nt, Human
gccuuuuuauaacuuuuua

SEQ ID NO: 3014568 - RNA, 21 nt, Human
gccuuccaggggugggacacc

SEQ ID NO: 3014569 - RNA, 23 nt, Human
gccuuauggaacacucugagacu

SEQ ID NO: 3014570 - RNA, 22 nt, Human
gccuuauggaacacucugagac

SEQ ID NO: 3014571 - RNA, 21 nt, Human
gccuuauggaacacucugaga

SEQ ID NO: 3014572 - RNA, 19 nt, Human
gccuuacccucauguucuu

SEQ ID NO: 3014573 - RNA, 20 nt, Human
gccuuagaagucacacagua

SEQ ID NO: 3014574 - RNA, 14 nt, Human
gccugguggcagcu

SEQ ID NO: 3014575 - RNA, 15 nt, Human
gccugguggcagcug

SEQ ID NO: 3014576 - RNA, 16 nt, Human
gccugguggcagcugc

SEQ ID NO: 3014577 - RNA, 17 nt, Human
gccugguggcagcugcg

SEQ ID NO: 3014578 - RNA, 22 nt, Human
gcguccugucggagcccugucu

SEQ ID NO: 3014579 - RNA, 14 nt, Human
gcgugagccacugc

SEQ ID NO: 3014580 - RNA, 15 nt, Human
gcgugagccacugca

SEQ ID NO: 3014581 - RNA, 14 nt, Human
gcuaacauggaagu

SEQ ID NO: 3014582 - RNA, 18 nt, Human
gcuaacauggaaguacua

SEQ ID NO: 3014583 - RNA, 17 nt, Human
gcuaacauggaaguacu

SEQ ID NO: 3014584 - RNA, 14 nt, Human
gcuaacuuggguua

SEQ ID NO: 3014585 - RNA, 22 nt, Human
gcuacacaggggaaaagaggag

SEQ ID NO: 3014586 - RNA, 22 nt, Human
gcuagacgagcaggcuucuucc

SEQ ID NO: 3014587 - RNA, 21 nt, Human
gcuagacgagcaggcuucuuc

SEQ ID NO: 3014588 - RNA, 19 nt, Human
gcguccugucggagcccug

SEQ ID NO: 3014589 - RNA, 23 nt, Human
gcggggacagcuccuucuguccu

SEQ ID NO: 3014590 - RNA, 20 nt, Human
gcgguccacccaggagcccc

SEQ ID NO: 3014591 - RNA, 23 nt, Human
gcgguccacccaggagccccgag

SEQ ID NO: 3014592 - RNA, 19 nt, Human
gcggaaugaaccacaucuu

SEQ ID NO: 3014593 - RNA, 16 nt, Human
gcggacagccacggcc

SEQ ID NO: 3014594 - RNA, 19 nt, Human
gcggacagccacggccagg

SEQ ID NO: 3014595 - RNA, 18 nt, Human
gcggggacagcuccuucu

SEQ ID NO: 3014596 - RNA, 19 nt, Human
gcggggacagcuccuucug

SEQ ID NO: 3014597 - RNA, 23 nt, Human
gcggacagccacggccaggccag

SEQ ID NO: 3014598 - RNA, 14 nt, Human
gcgcugccccuggc

SEQ ID NO: 3014599 - RNA, 20 nt, Human
gcgccuacaggagugagcac

SEQ ID NO: 3014600 - RNA, 21 nt, Human
gcgccuacaggagugagcacu

SEQ ID NO: 3014601 - RNA, 18 nt, Human
gcgccuacaggagugagc

SEQ ID NO: 3014602 - RNA, 22 nt, Human
gccucaagugauucuccugccu

SEQ ID NO: 3014603 - RNA, 24 nt, Human
gccucaagugauucuccugccuca

SEQ ID NO: 3014604 - RNA, 18 nt, Human
gccucagcauccuggcac

SEQ ID NO: 3014605 - RNA, 17 nt, Human
gccucagcauccuggca

SEQ ID NO: 3014606 - RNA, 21 nt, Human
gccucagcauccuggcacccg

SEQ ID NO: 3014607 - RNA, 23 nt, Human
gccgucuaccugaggggccucuu

SEQ ID NO: 3014608 - RNA, 22 nt, Human
gccgucuaccugaggggccucu

SEQ ID NO: 3014609 - RNA, 20 nt, Human
gccgucuaccugaggggccu

SEQ ID NO: 3014610 - RNA, 18 nt, Human
gccgucuaccugaggggc

SEQ ID NO: 3014611 - RNA, 13 nt, Human
gccgcagcccugc

SEQ ID NO: 3014612 - RNA, 17 nt, Human
gccgagauagccaaggc

SEQ ID NO: 3014613 - RNA, 15 nt, Human
gccgcagcccugcag

SEQ ID NO: 3014614 - RNA, 17 nt, Human
gccgcagcccugcagag

SEQ ID NO: 3014615 - RNA, 16 nt, Human
gccgcagcccugcaga

SEQ ID NO: 3014616 - RNA, 16 nt, Human
gccgagauagccaagg

SEQ ID NO: 3014617 - RNA, 23 nt, Human
gcccuucucuccagccccuggau

SEQ ID NO: 3014618 - RNA, 13 nt, Human
gcccuucucucca

SEQ ID NO: 3014619 - RNA, 11 nt, Human
gccugcccagg

SEQ ID NO: 3014620 - RNA, 12 nt, Human
gccugcccaggc

SEQ ID NO: 3014621 - RNA, 14 nt, Human
gccuggacccugug

SEQ ID NO: 3014622 - RNA, 15 nt, Human
gccucugacacacag

SEQ ID NO: 3014623 - RNA, 16 nt, Human
gccucugcacuccccu

SEQ ID NO: 3014624 - RNA, 20 nt, Human
gccucugcacuccccugcug

SEQ ID NO: 3014625 - RNA, 19 nt, Human
gccucugcacuccccugcu

SEQ ID NO: 3014626 - RNA, 18 nt, Human
gccucugcacuccccugc

SEQ ID NO: 3014627 - RNA, 17 nt, Human
gccucugcacuccccug

SEQ ID NO: 3014628 - RNA, 15 nt, Human
gccucugcacucccc

SEQ ID NO: 3014629 - RNA, 21 nt, Human
gccucugcacuccccugcugg

SEQ ID NO: 3014630 - RNA, 15 nt, Human
gccucucccaucacu

SEQ ID NO: 3014631 - RNA, 22 nt, Human
gccucagccucccaaagugcug

SEQ ID NO: 3014632 - RNA, 17 nt, Human
gccucccaucacccgcu

SEQ ID NO: 3014633 - RNA, 12 nt, Human
gccucagccucc

SEQ ID NO: 3014634 - RNA, 14 nt, Human
gccucagccuccca

SEQ ID NO: 3014635 - RNA, 20 nt, Human
gccucccgaauagcugggac

SEQ ID NO: 3014636 - RNA, 21 nt, Human
gccucccgaguagcugggacu

SEQ ID NO: 3014637 - RNA, 23 nt, Human
gccucccgaguagcugggacuac

SEQ ID NO: 3014638 - RNA, 18 nt, Human
gccucccgaauagcuggg

SEQ ID NO: 3014639 - RNA, 19 nt, Human
gccucccgaauagcuggga

SEQ ID NO: 3014640 - RNA, 17 nt, Human
gccauuucuuccacaag

SEQ ID NO: 3014641 - RNA, 22 nt, Human
gccauuucuuccacaagagccc

SEQ ID NO: 3014642 - RNA, 20 nt, Human
gccauuucuuccacaagagc

SEQ ID NO: 3014643 - RNA, 15 nt, Human
gcccaccccucaaca

SEQ ID NO: 3014644 - RNA, 19 nt, Human
gcccacaggaucagucuga

SEQ ID NO: 3014645 - RNA, 13 nt, Human
gcccacaggauca

SEQ ID NO: 3014646 - RNA, 18 nt, Human
gcccacaggaucagucug

SEQ ID NO: 3014647 - RNA, 16 nt, Human
gcccaaagaugcagcc

SEQ ID NO: 3014648 - RNA, 15 nt, Human
gcccaaagaugcagc

SEQ ID NO: 3014649 - RNA, 23 nt, Human
gccaggggaaaaucagccugcuc

SEQ ID NO: 3014650 - RNA, 17 nt, Human
gccaggggaaaaucagc

SEQ ID NO: 3014651 - RNA, 22 nt, Human
gccaggggaaaaucagccugcu

SEQ ID NO: 3014652 - RNA, 21 nt, Human
gccaggggaaaaucagccugc

SEQ ID NO: 3014653 - RNA, 19 nt, Human
gccaggaagccagcaggcu

SEQ ID NO: 3014654 - RNA, 11 nt, Human
gccaggaagcc

SEQ ID NO: 3014655 - RNA, 18 nt, Human
gccaggaagccagcaggc

SEQ ID NO: 3014656 - RNA, 17 nt, Human
gccaggaagccagcagg

SEQ ID NO: 3014657 - RNA, 19 nt, Human
gccauccagguucagcuug

SEQ ID NO: 3014658 - RNA, 20 nt, Human
gccauccagguucagcuugu

SEQ ID NO: 3014659 - RNA, 14 nt, Human
gccauccagguuca

SEQ ID NO: 3014660 - RNA, 17 nt, Human
gccaucccagccccaau

SEQ ID NO: 3014661 - RNA, 16 nt, Human
gccaucccagccccaa

SEQ ID NO: 3014662 - RNA, 15 nt, Human
gccaucccagcccca

SEQ ID NO: 3014663 - RNA, 14 nt, Human
gccaucccagcccc

SEQ ID NO: 3014664 - RNA, 13 nt, Human
gccaucccagccc

SEQ ID NO: 3014665 - RNA, 15 nt, Human
gccagagacacaagc

SEQ ID NO: 3014666 - RNA, 12 nt, Human
gccagagacaca

SEQ ID NO: 3014667 - RNA, 17 nt, Human
gccagagggagugacag

SEQ ID NO: 3014668 - RNA, 18 nt, Human
gccagagggagugacaga

SEQ ID NO: 3014669 - RNA, 17 nt, Human
gccacugcaccgggcca

SEQ ID NO: 3014670 - RNA, 18 nt, Human
gccacugcaccgggccac

SEQ ID NO: 3014671 - RNA, 12 nt, Human
gccaaaggaagc

SEQ ID NO: 3014672 - RNA, 14 nt, Human
gccacggccaggcc

SEQ ID NO: 3014673 - RNA, 15 nt, Human
gccacggccaggcca

SEQ ID NO: 3014674 - RNA, 20 nt, Human
gccacuauuguuagucucuu

SEQ ID NO: 3014675 - RNA, 21 nt, Human
gccacuauuguuagucucuug

SEQ ID NO: 3014676 - RNA, 16 nt, Human
gccacggccaggccag

SEQ ID NO: 3014677 - RNA, 17 nt, Human
gccagauucuuuccuga

SEQ ID NO: 3014678 - RNA, 19 nt, Human
gccagagggagugacagag

SEQ ID NO: 3014679 - RNA, 20 nt, Human
gccagagggagugacagagg

SEQ ID NO: 3014680 - RNA, 16 nt, Human
gccagauucuuuccug

SEQ ID NO: 3014681 - RNA, 12 nt, Human
gccagccuugac

SEQ ID NO: 3014682 - RNA, 20 nt, Human
gccagccgagauagccaagg

SEQ ID NO: 3014683 - RNA, 22 nt, Human
gccagccuugaccauucuccac

SEQ ID NO: 3014684 - RNA, 21 nt, Human
gccagccuugaccauucucca

SEQ ID NO: 3014685 - RNA, 20 nt, Human
gccagccuugaccauucucc

SEQ ID NO: 3014686 - RNA, 14 nt, Human
gccagccuugacca

SEQ ID NO: 3014687 - RNA, 15 nt, Human
gccagcugcuugggc

SEQ ID NO: 3014688 - RNA, 14 nt, Human
gccagcugcuuggg

SEQ ID NO: 3014689 - RNA, 23 nt, Human
gccccauccucuguacagagccc

SEQ ID NO: 3014690 - RNA, 17 nt, Human
gccccauucugccugcc

SEQ ID NO: 3014691 - RNA, 18 nt, Human
gccccauucugccugccc

SEQ ID NO: 3014692 - RNA, 20 nt, Human
gccccauucugccugcccag

SEQ ID NO: 3014693 - RNA, 21 nt, Human
gccccauucugccugcccagg

SEQ ID NO: 3014694 - RNA, 15 nt, Human
gccccagugcccaca

SEQ ID NO: 3014695 - RNA, 16 nt, Human
gccccagugcccacag

SEQ ID NO: 3014696 - RNA, 17 nt, Human
gccccagugcccacagg

SEQ ID NO: 3014697 - RNA, 11 nt, Human
gcccaggcugg

SEQ ID NO: 3014698 - RNA, 18 nt, Human
gcccaggccuccuacagc

SEQ ID NO: 3014699 - RNA, 16 nt, Human
gcccaggaaaggcucc

SEQ ID NO: 3014700 - RNA, 15 nt, Human
gcccaggaaaggcuc

SEQ ID NO: 3014701 - RNA, 12 nt, Human
gcccaggaaagg

SEQ ID NO: 3014702 - RNA, 22 nt, Human
gcccagucuggaaugcaguggu

SEQ ID NO: 3014703 - RNA, 20 nt, Human
gcccagucuggaaugcagug

SEQ ID NO: 3014704 - RNA, 16 nt, Human
gcccaggcuggcgugc

SEQ ID NO: 3014705 - RNA, 14 nt, Human
gcccaggcuggcgu

SEQ ID NO: 3014706 - RNA, 15 nt, Human
gcccaggcuggcgug

SEQ ID NO: 3014707 - RNA, 22 nt, Human
gccccgaggccuucucugaagg

SEQ ID NO: 3014708 - RNA, 14 nt, Human
gccccgcccaggcu

SEQ ID NO: 3014709 - RNA, 15 nt, Human
gccccauucugccug

SEQ ID NO: 3014710 - RNA, 23 nt, Human
gccccgaggccuucucugaagga

SEQ ID NO: 3014711 - RNA, 22 nt, Human
gccccauucugccugcccaggc

SEQ ID NO: 3014712 - RNA, 23 nt, Human
gccccauucugccugcccaggcc

SEQ ID NO: 3014713 - RNA, 21 nt, Human
gccccucagggucccuggugg

SEQ ID NO: 3014714 - RNA, 19 nt, Human
gccccucagggucccuggu

SEQ ID NO: 3014715 - RNA, 23 nt, Human
gccccuggcagccccuguucugg

SEQ ID NO: 3014716 - RNA, 19 nt, Human
gccccuucugacccaugcu

SEQ ID NO: 3014717 - RNA, 12 nt, Human
gcccggcuccag

SEQ ID NO: 3014718 - RNA, 13 nt, Human
gcccggcuccagg

SEQ ID NO: 3014719 - RNA, 14 nt, Human
gcccggcuccaggc

SEQ ID NO: 3014720 - RNA, 15 nt, Human
gcccggcuccaggcu

SEQ ID NO: 3014721 - RNA, 12 nt, Human
gcccgggcucug

SEQ ID NO: 3014722 - RNA, 18 nt, Human
gcccgggcucugccuccc

SEQ ID NO: 3014723 - RNA, 15 nt, Human
gcccgggcucugccu

SEQ ID NO: 3014724 - RNA, 14 nt, Human
gcccgggcucugcc

SEQ ID NO: 3014725 - RNA, 13 nt, Human
gcccgggcucugc

SEQ ID NO: 3014726 - RNA, 21 nt, Human
gcccgggcucugccucccauc

SEQ ID NO: 3014727 - RNA, 20 nt, Human
gcccgggcucugccucccau

SEQ ID NO: 3014728 - RNA, 19 nt, Human
gcccgggcucugccuccca

SEQ ID NO: 3014729 - RNA, 22 nt, Human
gcccucugcccacucccugcaa

SEQ ID NO: 3014730 - RNA, 16 nt, Human
gcagugcuuggcccag

SEQ ID NO: 3014731 - RNA, 16 nt, Human
gcagugggagcugccu

SEQ ID NO: 3014732 - RNA, 23 nt, Human
gcagugcuuccaaggauggacca

SEQ ID NO: 3014733 - RNA, 16 nt, Human
gcagggagggcuucug

SEQ ID NO: 3014734 - RNA, 12 nt, Human
gcagggcucagc

SEQ ID NO: 3014735 - RNA, 20 nt, Human
gcaggauucuuccucccucc

SEQ ID NO: 3014736 - RNA, 22 nt, Human
gcauauugcauacuauuaaaca

SEQ ID NO: 3014737 - RNA, 21 nt, Human
gcaucaagaugugacauguuu

SEQ ID NO: 3014738 - RNA, 20 nt, Human
gcauauucaggaagcucagg

SEQ ID NO: 3014739 - RNA, 18 nt, Human
gcauauucaggaagcuca

SEQ ID NO: 3014740 - RNA, 17 nt, Human
gcauauucaggaagcuc

SEQ ID NO: 3014741 - RNA, 15 nt, Human
gcauauucaggaagc

SEQ ID NO: 3014742 - RNA, 17 nt, Human
gcagugggagcugccug

SEQ ID NO: 3014743 - RNA, 18 nt, Human
gcagugggagcugccugu

SEQ ID NO: 3014744 - RNA, 19 nt, Human
gccaaacucaccugccccu

SEQ ID NO: 3014745 - RNA, 21 nt, Human
gccaaacucaccugccccuca

SEQ ID NO: 3014746 - RNA, 14 nt, Human
gccaaaggaagcac

SEQ ID NO: 3014747 - RNA, 20 nt, Human
gccaaaggaagcacaugccu

SEQ ID NO: 3014748 - RNA, 16 nt, Human
gccaaaggaagcacau

SEQ ID NO: 3014749 - RNA, 22 nt, Human
gcauuuugcuaaaugugaauga

SEQ ID NO: 3014750 - RNA, 12 nt, Human
gcauuccccacu

SEQ ID NO: 3014751 - RNA, 23 nt, Human
gcauuugcugaauacagaggcaa

SEQ ID NO: 3014752 - RNA, 21 nt, Human
gcauuuggugguuucagaaau

SEQ ID NO: 3014753 - RNA, 17 nt, Human
gcauuugcugaauacag

SEQ ID NO: 3014754 - RNA, 17 nt, Human
gcauguuugugauugac

SEQ ID NO: 3014755 - RNA, 15 nt, Human
gcaugccuggauggg

SEQ ID NO: 3014756 - RNA, 15 nt, Human
gcaugcugucccuua

SEQ ID NO: 3014757 - RNA, 22 nt, Human
gcaugccuggauggggcugcac

SEQ ID NO: 3014758 - RNA, 17 nt, Human
gcaugccuggauggggc

SEQ ID NO: 3014759 - RNA, 23 nt, Human
gcaugaaguaauaugcacacauu

SEQ ID NO: 3014760 - RNA, 17 nt, Human
gcaucaggccaggcccu

SEQ ID NO: 3014761 - RNA, 16 nt, Human
gcaucaggccaggccc

SEQ ID NO: 3014762 - RNA, 15 nt, Human
gcaucaggccaggcc

SEQ ID NO: 3014763 - RNA, 13 nt, Human
gcaucaggccagg

SEQ ID NO: 3014764 - RNA, 22 nt, Human
gcagaguggcagucuucaguuu

SEQ ID NO: 3014765 - RNA, 13 nt, Human
gcagaguggcagu

SEQ ID NO: 3014766 - RNA, 15 nt, Human
gcagaguugaagaca

SEQ ID NO: 3014767 - RNA, 17 nt, Human
gcagagaccaucccuga

SEQ ID NO: 3014768 - RNA, 15 nt, Human
gcagagaccaucccu

SEQ ID NO: 3014769 - RNA, 14 nt, Human
gcagagaccauccc

SEQ ID NO: 3014770 - RNA, 19 nt, Human
gcagagaaugaaagggccc

SEQ ID NO: 3014771 - RNA, 20 nt, Human
gcagagaaugaaagggccca

SEQ ID NO: 3014772 - RNA, 21 nt, Human
gcagagaaugaaagggcccag

SEQ ID NO: 3014773 - RNA, 21 nt, Human
gcagagaauucucuuauccaa

SEQ ID NO: 3014774 - RNA, 22 nt, Human
gcagagaaugaaagggcccaga

SEQ ID NO: 3014775 - RNA, 23 nt, Human
gcagagaaugaaagggcccagag

SEQ ID NO: 3014776 - RNA, 19 nt, Human
gcagaguugaagacagagc

SEQ ID NO: 3014777 - RNA, 17 nt, Human
gcagaguugaagacaga

SEQ ID NO: 3014778 - RNA, 16 nt, Human
gcagaguugaagacag

SEQ ID NO: 3014779 - RNA, 20 nt, Human
gcagcagggagggcuucugc

SEQ ID NO: 3014780 - RNA, 19 nt, Human
gcagccucaaccuccuggg

SEQ ID NO: 3014781 - RNA, 20 nt, Human
gcagccucaaccuccugggc

SEQ ID NO: 3014782 - RNA, 21 nt, Human
gcagccucaaccuccugggcu

SEQ ID NO: 3014783 - RNA, 22 nt, Human
gcagccucaaccuccugggcua

SEQ ID NO: 3014784 - RNA, 14 nt, Human
gcagccuggacccu

SEQ ID NO: 3014785 - RNA, 14 nt, Human
gcacccggccccug

SEQ ID NO: 3014786 - RNA, 15 nt, Human
gcacccggccccugc

SEQ ID NO: 3014787 - RNA, 17 nt, Human
gcacccggccccugcug

SEQ ID NO: 3014788 - RNA, 14 nt, Human
gcaccuccugccuc

SEQ ID NO: 3014789 - RNA, 15 nt, Human
gcaccuccugccucg

SEQ ID NO: 3014790 - RNA, 19 nt, Human
gcaccacugcacuccagcc

SEQ ID NO: 3014791 - RNA, 16 nt, Human
gcacagcuucauuucc

SEQ ID NO: 3014792 - RNA, 22 nt, Human
gcacaugccucucucaggccaa

SEQ ID NO: 3014793 - RNA, 19 nt, Human
gcacagcuaacauggaagu

SEQ ID NO: 3014794 - RNA, 14 nt, Human
gcaaugaccuuuca

SEQ ID NO: 3014795 - RNA, 13 nt, Human
gcaaugaccuuuc

SEQ ID NO: 3014796 - RNA, 17 nt, Human
gcacuaaggugugcucu

SEQ ID NO: 3014797 - RNA, 18 nt, Human
gcacuaaggugugcucug

SEQ ID NO: 3014798 - RNA, 14 nt, Human
gcacugggcuuggg

SEQ ID NO: 3014799 - RNA, 23 nt, Human
gcacugggcuuggggaccagagc

SEQ ID NO: 3014800 - RNA, 22 nt, Human
gcacugggcuuggggaccagag

SEQ ID NO: 3014801 - RNA, 12 nt, Human
gcagaaggaaga

SEQ ID NO: 3014802 - RNA, 14 nt, Human
gcagaaggaagacu

SEQ ID NO: 3014803 - RNA, 13 nt, Human
gcagaaggaagac

SEQ ID NO: 3014804 - RNA, 15 nt, Human
gcaaacuucagaguu

SEQ ID NO: 3014805 - RNA, 16 nt, Human
gcaaaccaucauugaa

SEQ ID NO: 3014806 - RNA, 21 nt, Human
gcaaaccaucauugaaaucuu

SEQ ID NO: 3014807 - RNA, 20 nt, Human
gcaaaccaucauugaaaucu

SEQ ID NO: 3014808 - RNA, 19 nt, Human
gcaaaccaucauugaaauc

SEQ ID NO: 3014809 - RNA, 17 nt, Human
gcaaaccaucauugaaa

SEQ ID NO: 3014810 - RNA, 18 nt, Human
gcaacugcauuggcuuug

SEQ ID NO: 3014811 - RNA, 17 nt, Human
gcaauccugcaagaaca

SEQ ID NO: 3014812 - RNA, 13 nt, Human
gcaaggcugucaa

SEQ ID NO: 3014813 - RNA, 14 nt, Human
gcaaggucauuuuu

SEQ ID NO: 3014814 - RNA, 18 nt, Human
gcaaggcugucaauuaca

SEQ ID NO: 3014815 - RNA, 14 nt, Human
gcaaggcugucaau

SEQ ID NO: 3014816 - RNA, 18 nt, Human
gcaagcaccuccugccuc

SEQ ID NO: 3014817 - RNA, 20 nt, Human
gcaagcaccuccugccucga

SEQ ID NO: 3014818 - RNA, 15 nt, Human
gcaagcaccuccugc

SEQ ID NO: 3014819 - RNA, 16 nt, Human
gcaagcaccuccugcc

SEQ ID NO: 3014820 - RNA, 20 nt, Human
gauugggcacaucauuucaa

SEQ ID NO: 3014821 - RNA, 20 nt, Human
gauuuaaacacauuaaaggu

SEQ ID NO: 3014822 - RNA, 19 nt, Human
gauuuguuaaugauagcua

SEQ ID NO: 3014823 - RNA, 22 nt, Human
gauuucuguuuagauaauacac

SEQ ID NO: 3014824 - RNA, 21 nt, Human
gauuucuguuuagauaauaca

SEQ ID NO: 3014825 - RNA, 15 nt, Human
gauugcaacaggcug

SEQ ID NO: 3014826 - RNA, 17 nt, Human
gauugcaacaggcuggg

SEQ ID NO: 3014827 - RNA, 18 nt, Human
gauugcaacaggcugggc

SEQ ID NO: 3014828 - RNA, 16 nt, Human
gauugcaacaggcugg

SEQ ID NO: 3014829 - RNA, 22 nt, Human
gauucuuuccugaggcugggcu

SEQ ID NO: 3014830 - RNA, 20 nt, Human
gauucuuuccugaggcuggg

SEQ ID NO: 3014831 - RNA, 16 nt, Human
gauucccaagcucugc

SEQ ID NO: 3014832 - RNA, 17 nt, Human
gauucccaagcucugcu

SEQ ID NO: 3014833 - RNA, 19 nt, Human
gauucuuuccugaggcugg

SEQ ID NO: 3014834 - RNA, 15 nt, Human
gauucccaagcucug

SEQ ID NO: 3014835 - RNA, 13 nt, Human
gauuacaagcgug

SEQ ID NO: 3014836 - RNA, 21 nt, Human
gauuacaagcgugagccacug

SEQ ID NO: 3014837 - RNA, 18 nt, Human
gauucagacagcugccug

SEQ ID NO: 3014838 - RNA, 17 nt, Human
gauucagacagcugccu

SEQ ID NO: 3014839 - RNA, 14 nt, Human
gauucagacagcug

SEQ ID NO: 3014840 - RNA, 13 nt, Human
gauucagacagcu

SEQ ID NO: 3014841 - RNA, 18 nt, Human
gauguucuagcauggcug

SEQ ID NO: 3014842 - RNA, 22 nt, Human
gaugaaugucaguuguuauuua

SEQ ID NO: 3014843 - RNA, 22 nt, Human
gaucuucuguggguuucuaaag

SEQ ID NO: 3014844 - RNA, 19 nt, Human
gaucuucuuuauaauucua

SEQ ID NO: 3014845 - RNA, 15 nt, Human
gaugaaaugagguca

SEQ ID NO: 3014846 - RNA, 21 nt, Human
gaugaaaugaggucagagccu

SEQ ID NO: 3014847 - RNA, 19 nt, Human
gaugcagccucacaguccu

SEQ ID NO: 3014848 - RNA, 14 nt, Human
gaugccugguggca

SEQ ID NO: 3014849 - RNA, 14 nt, Human
gaugcagugcuucc

SEQ ID NO: 3014850 - RNA, 15 nt, Human
gaugccugguggcag

SEQ ID NO: 3014851 - RNA, 16 nt, Human
gaugccugguggcagc

SEQ ID NO: 3014852 - RNA, 18 nt, Human
gaugaccuugaaugaugc

SEQ ID NO: 3014853 - RNA, 23 nt, Human
gaugagaaauaaaguuucuguug

SEQ ID NO: 3014854 - RNA, 14 nt, Human
gaugcaccagcccu

SEQ ID NO: 3014855 - RNA, 14 nt, Human
gaugagaggaaauc

SEQ ID NO: 3014856 - RNA, 15 nt, Human
gaugcaccagcccuu

SEQ ID NO: 3014857 - RNA, 23 nt, Human
gaugcaccagcccuuagcaggga

SEQ ID NO: 3014858 - RNA, 13 nt, Human
gaucauccacugu

SEQ ID NO: 3014859 - RNA, 16 nt, Human
gauccucccaccucag

SEQ ID NO: 3014860 - RNA, 14 nt, Human
gauccuccaggugc

SEQ ID NO: 3014861 - RNA, 21 nt, Human
gauccucccaccucagccucc

SEQ ID NO: 3014862 - RNA, 17 nt, Human
gauccucccaccucagc

SEQ ID NO: 3014863 - RNA, 13 nt, Human
gaucuaggaagac

SEQ ID NO: 3014864 - RNA, 18 nt, Human
gaucuaggaagacuuugg

SEQ ID NO: 3014865 - RNA, 14 nt, Human
gaucuaggaagacu

SEQ ID NO: 3014866 - RNA, 20 nt, Human
gaucuaggaagacuuuggaa

SEQ ID NO: 3014867 - RNA, 12 nt, Human
gauccugagcca

SEQ ID NO: 3014868 - RNA, 20 nt, Human
gaguuauugaagcagagugg

SEQ ID NO: 3014869 - RNA, 19 nt, Human
gaguuauugaagcagagug

SEQ ID NO: 3014870 - RNA, 18 nt, Human
gaguuauugaagcagagu

SEQ ID NO: 3014871 - RNA, 12 nt, Human
gauaauacacca

SEQ ID NO: 3014872 - RNA, 23 nt, Human
gauaauacaccacuacauucugu

SEQ ID NO: 3014873 - RNA, 24 nt, Human
gauaauacaccacuacauucuguu

SEQ ID NO: 3014874 - RNA, 16 nt, Human
gauacaaaagcaugug

SEQ ID NO: 3014875 - RNA, 20 nt, Human
gauagugucccacggugccu

SEQ ID NO: 3014876 - RNA, 18 nt, Human
gauauaugcucugcaugu

SEQ ID NO: 3014877 - RNA, 14 nt, Human
gaucacagccucug

SEQ ID NO: 3014878 - RNA, 23 nt, Human
gaucacggcucacugcagccuca

SEQ ID NO: 3014879 - RNA, 20 nt, Human
gaucacggcucacugcagcc

SEQ ID NO: 3014880 - RNA, 14 nt, Human
gaacaucacagcuu

SEQ ID NO: 3014881 - RNA, 15 nt, Human
gaacacucugagacu

SEQ ID NO: 3014882 - RNA, 14 nt, Human
gaacacucugagac

SEQ ID NO: 3014883 - RNA, 13 nt, Human
gaacacucugaga

SEQ ID NO: 3014884 - RNA, 22 nt, Human
gaaccuuuugagugccuuacac

SEQ ID NO: 3014885 - RNA, 18 nt, Human
gaaccuuuugagugccuu

SEQ ID NO: 3014886 - RNA, 21 nt, Human
gaaccuuuugagugccuuaca

SEQ ID NO: 3014887 - RNA, 19 nt, Human
gaaccuuuugagugccuua

SEQ ID NO: 3014888 - RNA, 20 nt, Human
gaagauucuauguuaauauu

SEQ ID NO: 3014889 - RNA, 23 nt, Human
gaagauucuauguuaauauuuua

SEQ ID NO: 3014890 - RNA, 17 nt, Human
gaagauucuauguuaau

SEQ ID NO: 3014891 - RNA, 17 nt, Human
gaagcauuuacuuugug

SEQ ID NO: 3014892 - RNA, 20 nt, Human
gaagauaauauuaaggaaga

SEQ ID NO: 3014893 - RNA, 23 nt, Human
gaagcccaggaaaggcuccagga

SEQ ID NO: 3014894 - RNA, 23 nt, Human
gaagcccuucuaccuuccugcaa

SEQ ID NO: 3014895 - RNA, 19 nt, Human
gaagcccaggaaaggcucc

SEQ ID NO: 3014896 - RNA, 16 nt, Human
gaagcccaggaaaggc

SEQ ID NO: 3014897 - RNA, 15 nt, Human
gaagcccaggaaagg

SEQ ID NO: 3014898 - RNA, 13 nt, Human
gaagcccaggaaa

SEQ ID NO: 3014899 - RNA, 22 nt, Human
gaagccagcaggcucucaggcc

SEQ ID NO: 3014900 - RNA, 21 nt, Human
gaagccagcaggcucucaggc

SEQ ID NO: 3014901 - RNA, 19 nt, Human
gaagccagcaggcucucag

SEQ ID NO: 3014902 - RNA, 20 nt, Human
gaagccagcaggcucucagg

SEQ ID NO: 3014903 - RNA, 23 nt, Human
gaacuuugaccucugcagcaaua

SEQ ID NO: 3014904 - RNA, 13 nt, Human
gaagacuuuggaa

SEQ ID NO: 3014905 - RNA, 11 nt, Human
gaagacuuugg

SEQ ID NO: 3014906 - RNA, 19 nt, Human
gaagagaaugcacaaacag

SEQ ID NO: 3014907 - RNA, 20 nt, Human
gaagacuuuucuuucagcca

SEQ ID NO: 3014908 - RNA, 17 nt, Human
gaagacuuuggaaagag

SEQ ID NO: 3014909 - RNA, 14 nt, Human
gaagacuuuggaaa

SEQ ID NO: 3014910 - RNA, 23 nt, Human
gaaggugccucuggaugcuguga

SEQ ID NO: 3014911 - RNA, 19 nt, Human
gaagggggcugggacaugg

SEQ ID NO: 3014912 - RNA, 16 nt, Human
gaagggggcugggaca

SEQ ID NO: 3014913 - RNA, 15 nt, Human
gaagggggcugggac

SEQ ID NO: 3014914 - RNA, 14 nt, Human
gaagcggcuggcag

SEQ ID NO: 3014915 - RNA, 18 nt, Human
gaaguacuauaauuuacc

SEQ ID NO: 3014916 - RNA, 15 nt, Human
gaaguacuggagaaa

SEQ ID NO: 3014917 - RNA, 21 nt, Human
gaaguaauaugcacacauuuu

SEQ ID NO: 3014918 - RNA, 22 nt, Human
gaaguaauaugcacacauuuuu

SEQ ID NO: 3014919 - RNA, 20 nt, Human
gaaguuucugccgcagcccu

SEQ ID NO: 3014920 - RNA, 15 nt, Human
gaagucuuagaugua

SEQ ID NO: 3014921 - RNA, 21 nt, Human
gaaguuucugccgcagcccug

SEQ ID NO: 3014922 - RNA, 20 nt, Human
gaaguuugagaucagccugg

SEQ ID NO: 3014923 - RNA, 18 nt, Human
gaauaacauguaauuaag

SEQ ID NO: 3014924 - RNA, 19 nt, Human
gaauaacauguaauuaagu

SEQ ID NO: 3014925 - RNA, 21 nt, Human
gaauacagaggcaacugcauu

SEQ ID NO: 3014926 - RNA, 17 nt, Human
gaauaauacaguaucuc

SEQ ID NO: 3014927 - RNA, 13 nt, Human
gaauaccuguccc

SEQ ID NO: 3014928 - RNA, 15 nt, Human
gaauaccuguccccc

SEQ ID NO: 3014929 - RNA, 23 nt, Human
gaauagcugggacuacaggugug

SEQ ID NO: 3014930 - RNA, 22 nt, Human
gaauagcugggacuacaggugu

SEQ ID NO: 3014931 - RNA, 17 nt, Human
gaaugucaguuguuauu

SEQ ID NO: 3014932 - RNA, 21 nt, Human
gaaugucagugugacugaucu

SEQ ID NO: 3014933 - RNA, 20 nt, Human
gaaugucagugugacugauc

SEQ ID NO: 3014934 - RNA, 17 nt, Human
gaauucucuaguuugau

SEQ ID NO: 3014935 - RNA, 17 nt, Human
gaauucucagaaucuca

SEQ ID NO: 3014936 - RNA, 19 nt, Human
gaauucucuaguuugauua

SEQ ID NO: 3014937 - RNA, 14 nt, Human
gaauugaaaaacca

SEQ ID NO: 3014938 - RNA, 22 nt, Human
gaauugauugggcacaucauuu

SEQ ID NO: 3014939 - RNA, 22 nt, Human
gaauuguaaggaaugauuaauu

SEQ ID NO: 3014940 - RNA, 15 nt, Human
gaauuucccaaagca

SEQ ID NO: 3014941 - RNA, 14 nt, Human
gaaugucaguguga

SEQ ID NO: 3014942 - RNA, 22 nt, Human
gaaugguuuucaaaauaaaaau

SEQ ID NO: 3014943 - RNA, 11 nt, Human
gaaugcagugg

SEQ ID NO: 3014944 - RNA, 23 nt, Human
gaaugaaccacaucuugcucugc

SEQ ID NO: 3014945 - RNA, 22 nt, Human
gaaugaaccacaucuugcucug

SEQ ID NO: 3014946 - RNA, 18 nt, Human
gaaugaaccacaucuugc

SEQ ID NO: 3014947 - RNA, 17 nt, Human
gacuggauaguccgucu

SEQ ID NO: 3014948 - RNA, 16 nt, Human
gacuggauaguccguc

SEQ ID NO: 3014949 - RNA, 22 nt, Human
gacuggauaguccgucucugcu

SEQ ID NO: 3014950 - RNA, 23 nt, Human
gacuggccaagguuuggggaaga

SEQ ID NO: 3014951 - RNA, 18 nt, Human
gacuuacuguacaugaaa

SEQ ID NO: 3014952 - RNA, 23 nt, Human
gacuuacuguacaugaaaacaca

SEQ ID NO: 3014953 - RNA, 15 nt, Human
gacuuacuguacaug

SEQ ID NO: 3014954 - RNA, 16 nt, Human
gacuuacuguacauga

SEQ ID NO: 3014955 - RNA, 12 nt, Human
gacuuacuguac

SEQ ID NO: 3014956 - RNA, 20 nt, Human
gacuucaucccucuggggcu

SEQ ID NO: 3014957 - RNA, 12 nt, Human
gacuucaucccu

SEQ ID NO: 3014958 - RNA, 15 nt, Human
gacucuacagaggcc

SEQ ID NO: 3014959 - RNA, 21 nt, Human
gacucuacagaggccaugggc

SEQ ID NO: 3014960 - RNA, 16 nt, Human
gacugaauuucuuuug

SEQ ID NO: 3014961 - RNA, 18 nt, Human
gacuacaggcacccacca

SEQ ID NO: 3014962 - RNA, 13 nt, Human
gacuacaggcacc

SEQ ID NO: 3014963 - RNA, 15 nt, Human
gacuacaggcaccca

SEQ ID NO: 3014964 - RNA, 21 nt, Human
gacuccugcaggcagccaggc

SEQ ID NO: 3014965 - RNA, 20 nt, Human
gacuccugcaggcagccagg

SEQ ID NO: 3014966 - RNA, 19 nt, Human
gacuccugcaggcagccag

SEQ ID NO: 3014967 - RNA, 18 nt, Human
gacuccugcaggcagcca

SEQ ID NO: 3014968 - RNA, 19 nt, Human
gacccuugccgucuaccug

SEQ ID NO: 3014969 - RNA, 23 nt, Human
gacccuugccgucuaccugaggg

SEQ ID NO: 3014970 - RNA, 20 nt, Human
gacccuugccgucuaccuga

SEQ ID NO: 3014971 - RNA, 14 nt, Human
gaccuucuccuuca

SEQ ID NO: 3014972 - RNA, 16 nt, Human
gaccuucuccuucacc

SEQ ID NO: 3014973 - RNA, 15 nt, Human
gaccuucuccuucac

SEQ ID NO: 3014974 - RNA, 14 nt, Human
gaccuugaacuggg

SEQ ID NO: 3014975 - RNA, 21 nt, Human
gaccuucuccuucaccuuugu

SEQ ID NO: 3014976 - RNA, 20 nt, Human
gaccuucuccuucaccuuug

SEQ ID NO: 3014977 - RNA, 23 nt, Human
gacggagucccaccuuggcugca

SEQ ID NO: 3014978 - RNA, 13 nt, Human
gacggagucccac

SEQ ID NO: 3014979 - RNA, 21 nt, Human
gacgcugugcugcccugccca

SEQ ID NO: 3014980 - RNA, 22 nt, Human
gacgcugugcugcccugcccac

SEQ ID NO: 3014981 - RNA, 20 nt, Human
gaccuuucaauaggaaaaac

SEQ ID NO: 3014982 - RNA, 19 nt, Human
gaccuuucaauaggaaaaa

SEQ ID NO: 3014983 - RNA, 11 nt, Human
gaccuuucaau

SEQ ID NO: 3014984 - RNA, 22 nt, Human
gaccuuuaagagaaaugagcug

SEQ ID NO: 3014985 - RNA, 15 nt, Human
gacguguuaugacuc

SEQ ID NO: 3014986 - RNA, 14 nt, Human
gacguguuaugacu

SEQ ID NO: 3014987 - RNA, 11 nt, Human
gacguguuaug

SEQ ID NO: 3014988 - RNA, 23 nt, Human
gacuaacuugucuuuggacccug

SEQ ID NO: 3014989 - RNA, 16 nt, Human
gacuaacuugucuuug

SEQ ID NO: 3014990 - RNA, 21 nt, Human
gacagagccccacccucagau

SEQ ID NO: 3014991 - RNA, 20 nt, Human
gacagagcuacacaggggaa

SEQ ID NO: 3014992 - RNA, 14 nt, Human
gacagagucucacu

SEQ ID NO: 3014993 - RNA, 23 nt, Human
gacagaggcagccccauucugcc

SEQ ID NO: 3014994 - RNA, 21 nt, Human
gacagagucucacuguugccc

SEQ ID NO: 3014995 - RNA, 16 nt, Human
gacagagugagacucu

SEQ ID NO: 3014996 - RNA, 17 nt, Human
gacagacacaggcccgg

SEQ ID NO: 3014997 - RNA, 16 nt, Human
gacacuagaagauuuu

SEQ ID NO: 3014998 - RNA, 20 nt, Human
gacagacacaggcccggcuc

SEQ ID NO: 3014999 - RNA, 22 nt, Human
gacagacacaggcccggcucca

SEQ ID NO: 3015000 - RNA, 22 nt, Human
gacacgaauauugcugauggug

SEQ ID NO: 3015001 - RNA, 18 nt, Human
gaauuucccaaagcagug

SEQ ID NO: 3015002 - RNA, 16 nt, Human
gaauuucccaaagcag

SEQ ID NO: 3015003 - RNA, 22 nt, Human
gaauuucccaaagcagugcaug

SEQ ID NO: 3015004 - RNA, 13 nt, Human
gacaguuggguuu

SEQ ID NO: 3015005 - RNA, 17 nt, Human
gacaguuggguuuuuua

SEQ ID NO: 3015006 - RNA, 22 nt, Human
gacaguuaagagaaaugagcuu

SEQ ID NO: 3015007 - RNA, 22 nt, Human
gacaggcauguucucugaggac

SEQ ID NO: 3015008 - RNA, 23 nt, Human
gacaucaacugcaucaagaugug

SEQ ID NO: 3015009 - RNA, 16 nt, Human
gacaucaacugcauca

SEQ ID NO: 3015010 - RNA, 23 nt, Human
gacaggcaaugcuggcuguuggc

SEQ ID NO: 3015011 - RNA, 20 nt, Human
gacaggcauguucucugagg

SEQ ID NO: 3015012 - RNA, 21 nt, Human
gacaggcauguucucugagga

SEQ ID NO: 3015013 - RNA, 20 nt, Human
gacaggcaagcaccuccugc

SEQ ID NO: 3015014 - RNA, 21 nt, Human
gacaggcaagcaccuccugcc

SEQ ID NO: 3015015 - RNA, 18 nt, Human
gacaggcaaugcuggcug

SEQ ID NO: 3015016 - RNA, 19 nt, Human
gacaggcaaugcuggcugu

SEQ ID NO: 3015017 - RNA, 13 nt, Human
gacaggcaagcac

SEQ ID NO: 3015018 - RNA, 17 nt, Human
gacaggcaagcaccucc

SEQ ID NO: 3015019 - RNA, 18 nt, Human
gacaggcaagcaccuccu

SEQ ID NO: 3015020 - RNA, 17 nt, Human
gacccaugcugcccugu

SEQ ID NO: 3015021 - RNA, 10 nt, Human
gacccugagg

SEQ ID NO: 3015022 - RNA, 12 nt, Human
gacccugaggcc

SEQ ID NO: 3015023 - RNA, 11 nt, Human
gacccugaggc

SEQ ID NO: 3015024 - RNA, 22 nt, Human
gacccugcccugugggccccca

SEQ ID NO: 3015025 - RNA, 20 nt, Human
gacccugcccugugggcccc

SEQ ID NO: 3015026 - RNA, 17 nt, Human
gacccugcccugugggc

SEQ ID NO: 3015027 - RNA, 16 nt, Human
gacccugaggcccaga

SEQ ID NO: 3015028 - RNA, 18 nt, Human
gacccaugcugcccugug

SEQ ID NO: 3015029 - RNA, 20 nt, Human
gacccaugcugcccugugag

SEQ ID NO: 3015030 - RNA, 19 nt, Human
gacccaugcugcccuguga

SEQ ID NO: 3015031 - RNA, 12 nt, Human
gacccacugcuu

SEQ ID NO: 3015032 - RNA, 18 nt, Human
gaccacaaaacuuuucua

SEQ ID NO: 3015033 - RNA, 21 nt, Human
gaccagagcugccaccugccu

SEQ ID NO: 3015034 - RNA, 23 nt, Human
gaccagacaccuugacagggcac

SEQ ID NO: 3015035 - RNA, 21 nt, Human
gaccagcaccaucucuccucc

SEQ ID NO: 3015036 - RNA, 20 nt, Human
gaccagcaccaucucuccuc

SEQ ID NO: 3015037 - RNA, 16 nt, Human
gaccacguuucuaaag

SEQ ID NO: 3015038 - RNA, 22 nt, Human
gaccagacaccuugacagggca

SEQ ID NO: 3015039 - RNA, 21 nt, Human
gaccagacaccuugacagggc

SEQ ID NO: 3015040 - RNA, 14 nt, Human
cuuuuugaaauguc

SEQ ID NO: 3015041 - RNA, 15 nt, Human
cuuuuucaauaacug

SEQ ID NO: 3015042 - RNA, 22 nt, Human
cuuuuguucuugguuuguaaau

SEQ ID NO: 3015043 - RNA, 20 nt, Human
cuuuuguucuugguuuguaa

SEQ ID NO: 3015044 - RNA, 15 nt, Human
cuuuucuguuugcua

SEQ ID NO: 3015045 - RNA, 21 nt, Human
cuuuguuuguugucagcugaa

SEQ ID NO: 3015046 - RNA, 16 nt, Human
cuuuuuuagaguugau

SEQ ID NO: 3015047 - RNA, 19 nt, Human
gaaaacacuguucucugcc

SEQ ID NO: 3015048 - RNA, 18 nt, Human
gaaaacacuguucucugc

SEQ ID NO: 3015049 - RNA, 21 nt, Human
gaaaacacuguucucugcccu

SEQ ID NO: 3015050 - RNA, 20 nt, Human
gaaaacacuguucucugccc

SEQ ID NO: 3015051 - RNA, 16 nt, Human
gaaaacaugcuacaca

SEQ ID NO: 3015052 - RNA, 18 nt, Human
gaaaacaugcuacacacu

SEQ ID NO: 3015053 - RNA, 19 nt, Human
gaaaacaugcuacacacug

SEQ ID NO: 3015054 - RNA, 23 nt, Human
cuuugggaggccaaggugggagg

SEQ ID NO: 3015055 - RNA, 23 nt, Human
cuuugugaggaagccgcuggggc

SEQ ID NO: 3015056 - RNA, 13 nt, Human
cuuuguggcuucc

SEQ ID NO: 3015057 - RNA, 19 nt, Human
cuuugugaggaagccgcug

SEQ ID NO: 3015058 - RNA, 12 nt, Human
cuuugugauuuu

SEQ ID NO: 3015059 - RNA, 21 nt, Human
cuuuguucuggcucuuccagg

SEQ ID NO: 3015060 - RNA, 16 nt, Human
cuuuguucuggcucuu

SEQ ID NO: 3015061 - RNA, 12 nt, Human
cuuuggaaagac

SEQ ID NO: 3015062 - RNA, 23 nt, Human
cuuuggaaagacuuuuccaaccc

SEQ ID NO: 3015063 - RNA, 14 nt, Human
cuuugcuugaaaga

SEQ ID NO: 3015064 - RNA, 13 nt, Human
cuuucugaaauaa

SEQ ID NO: 3015065 - RNA, 15 nt, Human
cuuuagcgcccaguu

SEQ ID NO: 3015066 - RNA, 16 nt, Human
cuuguacacucauuca

SEQ ID NO: 3015067 - RNA, 14 nt, Human
cuugguuuguaaau

SEQ ID NO: 3015068 - RNA, 15 nt, Human
cuugguuuguaaauu

SEQ ID NO: 3015069 - RNA, 20 nt, Human
cuugggccacugugaagaga

SEQ ID NO: 3015070 - RNA, 18 nt, Human
cuugggccacugugaaga

SEQ ID NO: 3015071 - RNA, 16 nt, Human
cuuguugaggguaugu

SEQ ID NO: 3015072 - RNA, 22 nt, Human
cuuguugaggguauguuuuaua

SEQ ID NO: 3015073 - RNA, 21 nt, Human
cuuguugaggguauguuuuau

SEQ ID NO: 3015074 - RNA, 20 nt, Human
cuuguugaggguauguuuua

SEQ ID NO: 3015075 - RNA, 17 nt, Human
cuuuaccuuuuuuauac

SEQ ID NO: 3015076 - RNA, 19 nt, Human
cuuuaccuuuuuuauacau

SEQ ID NO: 3015077 - RNA, 20 nt, Human
cuuuaccuuuuuuauacaua

SEQ ID NO: 3015078 - RNA, 15 nt, Human
cuuguggucccaccc

SEQ ID NO: 3015079 - RNA, 19 nt, Human
cuuguggucccaccccaca

SEQ ID NO: 3015080 - RNA, 16 nt, Human
cuuguggucccacccc

SEQ ID NO: 3015081 - RNA, 16 nt, Human
cuuguuaagauaguua

SEQ ID NO: 3015082 - RNA, 22 nt, Human
cuugcagcucuccccuucucug

SEQ ID NO: 3015083 - RNA, 21 nt, Human
cuugcagacucuacagaggcc

SEQ ID NO: 3015084 - RNA, 20 nt, Human
cuugcagacucuacagaggc

SEQ ID NO: 3015085 - RNA, 15 nt, Human
cuugcaauggcagcc

SEQ ID NO: 3015086 - RNA, 16 nt, Human
cuugcaauggcagccu

SEQ ID NO: 3015087 - RNA, 17 nt, Human
cuugcaauggcagccuu

SEQ ID NO: 3015088 - RNA, 18 nt, Human
cuugcaauggcagccuug

SEQ ID NO: 3015089 - RNA, 19 nt, Human
cuugaguugauucagcucu

SEQ ID NO: 3015090 - RNA, 18 nt, Human
cuugaguugauucagcuc

SEQ ID NO: 3015091 - RNA, 20 nt, Human
cuugaguugauucagcucug

SEQ ID NO: 3015092 - RNA, 15 nt, Human
cuugaggguugggcu

SEQ ID NO: 3015093 - RNA, 17 nt, Human
cuugaggguugggcugg

SEQ ID NO: 3015094 - RNA, 15 nt, Human
cuugagccugggagg

SEQ ID NO: 3015095 - RNA, 12 nt, Human
cuugagccuggg

SEQ ID NO: 3015096 - RNA, 14 nt, Human
cuugcaugaggcua

SEQ ID NO: 3015097 - RNA, 13 nt, Human
cuugcaugaggcu

SEQ ID NO: 3015098 - RNA, 20 nt, Human
cuuggaagcuccgcuuucua

SEQ ID NO: 3015099 - RNA, 14 nt, Human
cuuggaagcuccgc

SEQ ID NO: 3015100 - RNA, 20 nt, Human
cuugcuucaaccccaugaga

SEQ ID NO: 3015101 - RNA, 22 nt, Human
cuugcucugcugacagacacag

SEQ ID NO: 3015102 - RNA, 14 nt, Human
cuuauuuaaauaga

SEQ ID NO: 3015103 - RNA, 13 nt, Human
cuuauuuaaauag

SEQ ID NO: 3015104 - RNA, 15 nt, Human
cuuauuuaaugaaag

SEQ ID NO: 3015105 - RNA, 19 nt, Human
cuuauuuaaauagaugaca

SEQ ID NO: 3015106 - RNA, 18 nt, Human
cuuauuuaaauagaugac

SEQ ID NO: 3015107 - RNA, 17 nt, Human
cuuagguuggcaaaaag

SEQ ID NO: 3015108 - RNA, 14 nt, Human
cuuagacccucaug

SEQ ID NO: 3015109 - RNA, 11 nt, Human
cuuagacaguc

SEQ ID NO: 3015110 - RNA, 19 nt, Human
cuuagacagucccugccaa

SEQ ID NO: 3015111 - RNA, 18 nt, Human
cuuagacagucccugcca

SEQ ID NO: 3015112 - RNA, 17 nt, Human
cuuagacagucccugcc

SEQ ID NO: 3015113 - RNA, 15 nt, Human
cuuagaagucacaca

SEQ ID NO: 3015114 - RNA, 14 nt, Human
cuuagacagucccu

SEQ ID NO: 3015115 - RNA, 16 nt, Human
cuuagacagucccugc

SEQ ID NO: 3015116 - RNA, 15 nt, Human
cuuagacagucccug

SEQ ID NO: 3015117 - RNA, 13 nt, Human
cuuacuguacaug

SEQ ID NO: 3015118 - RNA, 16 nt, Human
cuuacuguacaugaaa

SEQ ID NO: 3015119 - RNA, 15 nt, Human
cuuacgugaguccug

SEQ ID NO: 3015120 - RNA, 19 nt, Human
cuuaauaaacuguggugcu

SEQ ID NO: 3015121 - RNA, 14 nt, Human
cuuaaucuaaaugg

SEQ ID NO: 3015122 - RNA, 18 nt, Human
cuuaagaaauuuguggaa

SEQ ID NO: 3015123 - RNA, 12 nt, Human
cuuaacuucaca

SEQ ID NO: 3015124 - RNA, 14 nt, Human
cuuaacuucacaua

SEQ ID NO: 3015125 - RNA, 15 nt, Human
cuuaacuucacauau

SEQ ID NO: 3015126 - RNA, 16 nt, Human
cuuaacuucacauauu

SEQ ID NO: 3015127 - RNA, 17 nt, Human
cuuaacuucacauauug

SEQ ID NO: 3015128 - RNA, 22 nt, Human
cuuaacuucacauauugauuuc

SEQ ID NO: 3015129 - RNA, 18 nt, Human
cuguuuguuucugaaagg

SEQ ID NO: 3015130 - RNA, 12 nt, Human
cuguuuagauaa

SEQ ID NO: 3015131 - RNA, 17 nt, Human
cuguuuucucuugagag

SEQ ID NO: 3015132 - RNA, 23 nt, Human
cuguuuguuucugaaagggacgc

SEQ ID NO: 3015133 - RNA, 21 nt, Human
cuguuuguuucugaaagggac

SEQ ID NO: 3015134 - RNA, 21 nt, Human
cuguuuuauuuuaauucaguu

SEQ ID NO: 3015135 - RNA, 14 nt, Human
cuguuuucucuuga

SEQ ID NO: 3015136 - RNA, 13 nt, Human
cuguuuucucuug

SEQ ID NO: 3015137 - RNA, 12 nt, Human
cuucagugccuu

SEQ ID NO: 3015138 - RNA, 11 nt, Human
cuucagugccu

SEQ ID NO: 3015139 - RNA, 18 nt, Human
cuucauuuccugugucuu

SEQ ID NO: 3015140 - RNA, 14 nt, Human
cuucagugccuuau

SEQ ID NO: 3015141 - RNA, 13 nt, Human
cuucagugccuua

SEQ ID NO: 3015142 - RNA, 23 nt, Human
cuuccacaagagcccaggccucc

SEQ ID NO: 3015143 - RNA, 22 nt, Human
cuuccacaagagcccaggccuc

SEQ ID NO: 3015144 - RNA, 11 nt, Human
cuucagcugac

SEQ ID NO: 3015145 - RNA, 14 nt, Human
cuuccagugaggcu

SEQ ID NO: 3015146 - RNA, 15 nt, Human
cuuccagugaggcuc

SEQ ID NO: 3015147 - RNA, 24 nt, Human
cuuccaggggugggacacccugug

SEQ ID NO: 3015148 - RNA, 22 nt, Human
cuuccaggggugggacacccug

SEQ ID NO: 3015149 - RNA, 21 nt, Human
cuuccaggggugggacacccu

SEQ ID NO: 3015150 - RNA, 18 nt, Human
cuucugcuucagccuccc

SEQ ID NO: 3015151 - RNA, 16 nt, Human
cuucugcuucagccuc

SEQ ID NO: 3015152 - RNA, 17 nt, Human
cuucugcuucagccucc

SEQ ID NO: 3015153 - RNA, 15 nt, Human
cuucugccauauucu

SEQ ID NO: 3015154 - RNA, 17 nt, Human
cuucugccauauucugu

SEQ ID NO: 3015155 - RNA, 21 nt, Human
cuucugccauauucuguuggc

SEQ ID NO: 3015156 - RNA, 17 nt, Human
cuucuccaggcuguauc

SEQ ID NO: 3015157 - RNA, 14 nt, Human
cuucuccaggcugu

SEQ ID NO: 3015158 - RNA, 14 nt, Human
cuucuccacccugc

SEQ ID NO: 3015159 - RNA, 15 nt, Human
cuucuccacccugcu

SEQ ID NO: 3015160 - RNA, 19 nt, Human
cuucuccuucaccuuuguc

SEQ ID NO: 3015161 - RNA, 22 nt, Human
cuucuccuucaccuuugucccc

SEQ ID NO: 3015162 - RNA, 13 nt, Human
cuucgcuccugug

SEQ ID NO: 3015163 - RNA, 14 nt, Human
cuucgcuccugugu

SEQ ID NO: 3015164 - RNA, 15 nt, Human
cuucgcuccuguguc

SEQ ID NO: 3015165 - RNA, 21 nt, Human
cuucgggaggucgaggcagga

SEQ ID NO: 3015166 - RNA, 20 nt, Human
cuucgggaggucgaggcagg

SEQ ID NO: 3015167 - RNA, 22 nt, Human
cucccuuccuaugcuguucacu

SEQ ID NO: 3015168 - RNA, 13 nt, Human
cucccuuccucuu

SEQ ID NO: 3015169 - RNA, 14 nt, Human
cucccuuccucuuu

SEQ ID NO: 3015170 - RNA, 17 nt, Human
cucccuuggauuguccc

SEQ ID NO: 3015171 - RNA, 23 nt, Human
cucccuucccaccucucucacuc

SEQ ID NO: 3015172 - RNA, 10 nt, Human
cucccuuccu

SEQ ID NO: 3015173 - RNA, 18 nt, Human
cucccaucucacacauga

SEQ ID NO: 3015174 - RNA, 15 nt, Human
cucccaucucacaca

SEQ ID NO: 3015175 - RNA, 14 nt, Human
cucccaucucacac

SEQ ID NO: 3015176 - RNA, 12 nt, Human
cuccugcaggca

SEQ ID NO: 3015177 - RNA, 14 nt, Human
cuccugcaggcagc

SEQ ID NO: 3015178 - RNA, 13 nt, Human
cuccugcaggcag

SEQ ID NO: 3015179 - RNA, 14 nt, Human
cuccucagaucuuc

SEQ ID NO: 3015180 - RNA, 12 nt, Human
cuccucagaucu

SEQ ID NO: 3015181 - RNA, 15 nt, Human
cuccugugucuugca

SEQ ID NO: 3015182 - RNA, 23 nt, Human
cuccugugucuugcaauggcagc

SEQ ID NO: 3015183 - RNA, 11 nt, Human
cuccugugugu

SEQ ID NO: 3015184 - RNA, 22 nt, Human
cuccugcaggcagccaggccac

SEQ ID NO: 3015185 - RNA, 21 nt, Human
cuccugcaggcagccaggcca

SEQ ID NO: 3015186 - RNA, 15 nt, Human
cuccugcaggcagcc

SEQ ID NO: 3015187 - RNA, 21 nt, Human
cuccuucaccuuuguccccac

SEQ ID NO: 3015188 - RNA, 19 nt, Human
cuccuucaccuuugucccc

SEQ ID NO: 3015189 - RNA, 16 nt, Human
cuccuucaccuuuguc

SEQ ID NO: 3015190 - RNA, 14 nt, Human
cuccuucaccuuug

SEQ ID NO: 3015191 - RNA, 21 nt, Human
cuccuugaaaacacuguucuc

SEQ ID NO: 3015192 - RNA, 11 nt, Human
cuccuucuucc

SEQ ID NO: 3015193 - RNA, 16 nt, Human
cucgaacuggcugcaa

SEQ ID NO: 3015194 - RNA, 13 nt, Human
cuccuucaccuuu

SEQ ID NO: 3015195 - RNA, 14 nt, Human
cuccuucuguccua

SEQ ID NO: 3015196 - RNA, 15 nt, Human
cuccuucuguccuac

SEQ ID NO: 3015197 - RNA, 20 nt, Human
cuccuucuguccuacucugu

SEQ ID NO: 3015198 - RNA, 20 nt, Human
cucgaguuacagacaaagcg

SEQ ID NO: 3015199 - RNA, 16 nt, Human
cucgaguuacagacaa

SEQ ID NO: 3015200 - RNA, 15 nt, Human
cucgcgacaaugcaa

SEQ ID NO: 3015201 - RNA, 13 nt, Human
cucgcgacaaugc

SEQ ID NO: 3015202 - RNA, 13 nt, Human
cucauucauuacu

SEQ ID NO: 3015203 - RNA, 17 nt, Human
cucauucauuacuaaaa

SEQ ID NO: 3015204 - RNA, 13 nt, Human
cucauucuucugu

SEQ ID NO: 3015205 - RNA, 14 nt, Human
cucauucuucugua

SEQ ID NO: 3015206 - RNA, 12 nt, Human
cucauucuucug

SEQ ID NO: 3015207 - RNA, 16 nt, Human
cucauugaccugaggc

SEQ ID NO: 3015208 - RNA, 23 nt, Human
cucauucuucuguacgucugaca

SEQ ID NO: 3015209 - RNA, 15 nt, Human
cucauugaccugagg

SEQ ID NO: 3015210 - RNA, 13 nt, Human
cucauugaccuga

SEQ ID NO: 3015211 - RNA, 21 nt, Human
cucauuagcauuuugcuaaau

SEQ ID NO: 3015212 - RNA, 19 nt, Human
cucaggugucccugcacuu

SEQ ID NO: 3015213 - RNA, 17 nt, Human
cucaggugucccugcac

SEQ ID NO: 3015214 - RNA, 18 nt, Human
cucaggugucccugcacu

SEQ ID NO: 3015215 - RNA, 18 nt, Human
cucauaguaugguggcug

SEQ ID NO: 3015216 - RNA, 19 nt, Human
cucauaguaugguggcugg

SEQ ID NO: 3015217 - RNA, 23 nt, Human
cuaaaagguaugcaaucaaaucu

SEQ ID NO: 3015218 - RNA, 12 nt, Human
cucagggucccu

SEQ ID NO: 3015219 - RNA, 15 nt, Human
cucaggugucccugc

SEQ ID NO: 3015220 - RNA, 16 nt, Human
cucaggugucccugca

SEQ ID NO: 3015221 - RNA, 23 nt, Human
cucagguggggucacucuggcag

SEQ ID NO: 3015222 - RNA, 22 nt, Human
cucagguggggucacucuggca

SEQ ID NO: 3015223 - RNA, 11 nt, Human
cuccacccugc

SEQ ID NO: 3015224 - RNA, 12 nt, Human
cuccacccugcu

SEQ ID NO: 3015225 - RNA, 21 nt, Human
cuccaccugccagggacagag

SEQ ID NO: 3015226 - RNA, 18 nt, Human
cuccaccugccagggaca

SEQ ID NO: 3015227 - RNA, 17 nt, Human
cuccaccugccagggac

SEQ ID NO: 3015228 - RNA, 15 nt, Human
cuccaccugccaggg

SEQ ID NO: 3015229 - RNA, 19 nt, Human
cuccagcucaccagcccca

SEQ ID NO: 3015230 - RNA, 20 nt, Human
cuccagcucaccagccccag

SEQ ID NO: 3015231 - RNA, 19 nt, Human
cuccagcuguucagcuggu

SEQ ID NO: 3015232 - RNA, 18 nt, Human
cuccagcuguucagcugg

SEQ ID NO: 3015233 - RNA, 13 nt, Human
cuccagcuguuca

SEQ ID NO: 3015234 - RNA, 11 nt, Human
cuccaggcucc

SEQ ID NO: 3015235 - RNA, 14 nt, Human
cuccaugugggcua

SEQ ID NO: 3015236 - RNA, 15 nt, Human
cucccaggcauuccc

SEQ ID NO: 3015237 - RNA, 21 nt, Human
cucccaaggggcccaaauucu

SEQ ID NO: 3015238 - RNA, 22 nt, Human
cucccaaggggcccaaauucuu

SEQ ID NO: 3015239 - RNA, 22 nt, Human
cucccaggcauuccccaggagg

SEQ ID NO: 3015240 - RNA, 21 nt, Human
cucccaggcauuccccaggag

SEQ ID NO: 3015241 - RNA, 20 nt, Human
cucccaggcauuccccagga

SEQ ID NO: 3015242 - RNA, 19 nt, Human
cucccaggcauuccccagg

SEQ ID NO: 3015243 - RNA, 17 nt, Human
cucccaggcauucccca

SEQ ID NO: 3015244 - RNA, 16 nt, Human
cugaacuucagagcau

SEQ ID NO: 3015245 - RNA, 15 nt, Human
cugaacuuggcgcug

SEQ ID NO: 3015246 - RNA, 21 nt, Human
cugaacuuggcgcugccccug

SEQ ID NO: 3015247 - RNA, 16 nt, Human
cugaacuuggcgcugc

SEQ ID NO: 3015248 - RNA, 19 nt, Human
cugaagacucauucuucug

SEQ ID NO: 3015249 - RNA, 21 nt, Human
cugaagacucauucuucugua

SEQ ID NO: 3015250 - RNA, 21 nt, Human
cugaaccuggguaacuaggga

SEQ ID NO: 3015251 - RNA, 18 nt, Human
cucuuugggccuggcucc

SEQ ID NO: 3015252 - RNA, 21 nt, Human
cucuuuggucuacacugugcu

SEQ ID NO: 3015253 - RNA, 19 nt, Human
cucuuuggucuacacugug

SEQ ID NO: 3015254 - RNA, 14 nt, Human
cugaagucacacag

SEQ ID NO: 3015255 - RNA, 15 nt, Human
cugaagucacacagu

SEQ ID NO: 3015256 - RNA, 24 nt, Human
cugaagucuuuguacagacaacaa

SEQ ID NO: 3015257 - RNA, 16 nt, Human
cugaauacagaggcaa

SEQ ID NO: 3015258 - RNA, 11 nt, Human
cugacccacug

SEQ ID NO: 3015259 - RNA, 17 nt, Human
cugacauuguuggccaa

SEQ ID NO: 3015260 - RNA, 20 nt, Human
cugacaggcaaugcuggcug

SEQ ID NO: 3015261 - RNA, 16 nt, Human
cugacaggcaaugcug

SEQ ID NO: 3015262 - RNA, 17 nt, Human
cugacaggcaaugcugg

SEQ ID NO: 3015263 - RNA, 18 nt, Human
cugacaggcaaugcuggc

SEQ ID NO: 3015264 - RNA, 19 nt, Human
cugacaggcaaugcuggcu

SEQ ID NO: 3015265 - RNA, 11 nt, Human
cugacaggcaa

SEQ ID NO: 3015266 - RNA, 21 nt, Human
cugacagacacaggcccggcu

SEQ ID NO: 3015267 - RNA, 19 nt, Human
cugacagacacaggcccgg

SEQ ID NO: 3015268 - RNA, 19 nt, Human
cucuggcagcucagagagg

SEQ ID NO: 3015269 - RNA, 18 nt, Human
cucuggcagcucagagag

SEQ ID NO: 3015270 - RNA, 17 nt, Human
cucuggcagcucagaga

SEQ ID NO: 3015271 - RNA, 13 nt, Human
cucuuaaaaccca

SEQ ID NO: 3015272 - RNA, 24 nt, Human
cucuuaaaacccaagugccuuagc

SEQ ID NO: 3015273 - RNA, 12 nt, Human
cucuucuccagg

SEQ ID NO: 3015274 - RNA, 23 nt, Human
cucuuccaggcugggagagccuu

SEQ ID NO: 3015275 - RNA, 21 nt, Human
cucuuccaggcugggagagcc

SEQ ID NO: 3015276 - RNA, 22 nt, Human
cucuuccaggcugggagagccu

SEQ ID NO: 3015277 - RNA, 19 nt, Human
cucuugguccugcugcagu

SEQ ID NO: 3015278 - RNA, 18 nt, Human
cucuugguccugcugcag

SEQ ID NO: 3015279 - RNA, 16 nt, Human
cucuugaccucaggug

SEQ ID NO: 3015280 - RNA, 13 nt, Human
cucuugaccucag

SEQ ID NO: 3015281 - RNA, 15 nt, Human
cucuugaccucaggu

SEQ ID NO: 3015282 - RNA, 17 nt, Human
cucuuucuauuguuucu

SEQ ID NO: 3015283 - RNA, 18 nt, Human
cucuuuggacacucacac

SEQ ID NO: 3015284 - RNA, 15 nt, Human
cucuuuggacacuca

SEQ ID NO: 3015285 - RNA, 17 nt, Human
cucuuuccaucuacccu

SEQ ID NO: 3015286 - RNA, 22 nt, Human
cucuccuguaccucuugagccu

SEQ ID NO: 3015287 - RNA, 17 nt, Human
cucuccuguaccucuug

SEQ ID NO: 3015288 - RNA, 18 nt, Human
cucuccuguaccucuuga

SEQ ID NO: 3015289 - RNA, 13 nt, Human
cucuccuguaccu

SEQ ID NO: 3015290 - RNA, 14 nt, Human
cucuccuguaccuc

SEQ ID NO: 3015291 - RNA, 15 nt, Human
cucuccuguaccucu

SEQ ID NO: 3015292 - RNA, 14 nt, Human
cucucucacuccuu

SEQ ID NO: 3015293 - RNA, 12 nt, Human
cucucucaggcc

SEQ ID NO: 3015294 - RNA, 16 nt, Human
cucucucacuccuuga

SEQ ID NO: 3015295 - RNA, 15 nt, Human
cucucucacuccuug

SEQ ID NO: 3015296 - RNA, 22 nt, Human
cucucaggccagcugcuugggc

SEQ ID NO: 3015297 - RNA, 23 nt, Human
cucucaggccagcugcuugggcu

SEQ ID NO: 3015298 - RNA, 13 nt, Human
cucucccaucacu

SEQ ID NO: 3015299 - RNA, 20 nt, Human
cucucccaucacuucccuac

SEQ ID NO: 3015300 - RNA, 14 nt, Human
cucucccaucacuu

SEQ ID NO: 3015301 - RNA, 18 nt, Human
cucucccaucacuucccu

SEQ ID NO: 3015302 - RNA, 12 nt, Human
cucuccagcccc

SEQ ID NO: 3015303 - RNA, 13 nt, Human
cucuccagccccu

SEQ ID NO: 3015304 - RNA, 14 nt, Human
cucugccucugaca

SEQ ID NO: 3015305 - RNA, 23 nt, Human
cucugcccuccaagaccuucucc

SEQ ID NO: 3015306 - RNA, 16 nt, Human
cucugcccuccaagac

SEQ ID NO: 3015307 - RNA, 15 nt, Human
cucugcccuccaaga

SEQ ID NO: 3015308 - RNA, 14 nt, Human
cucugcccuccaag

SEQ ID NO: 3015309 - RNA, 22 nt, Human
cucugcaagaauugaagcagga

SEQ ID NO: 3015310 - RNA, 16 nt, Human
cucugaggacacuaac

SEQ ID NO: 3015311 - RNA, 20 nt, Human
cuggacacuucacgcccuug

SEQ ID NO: 3015312 - RNA, 22 nt, Human
cuggacacuucacgcccuuggc

SEQ ID NO: 3015313 - RNA, 14 nt, Human
cuggaaugcagugg

SEQ ID NO: 3015314 - RNA, 15 nt, Human
cuggaaugcaguggu

SEQ ID NO: 3015315 - RNA, 14 nt, Human
cuggaagcacagcu

SEQ ID NO: 3015316 - RNA, 18 nt, Human
cuggaagcacagcuucau

SEQ ID NO: 3015317 - RNA, 15 nt, Human
cuggaagcacagcuu

SEQ ID NO: 3015318 - RNA, 23 nt, Human
cuggccuagcauacguacacauu

SEQ ID NO: 3015319 - RNA, 13 nt, Human
cuggcccacugca

SEQ ID NO: 3015320 - RNA, 12 nt, Human
cuggcccacugc

SEQ ID NO: 3015321 - RNA, 17 nt, Human
cuggccuagcauacgua

SEQ ID NO: 3015322 - RNA, 21 nt, Human
cuggccagaugcaccagcccu

SEQ ID NO: 3015323 - RNA, 17 nt, Human
cuggccagaugcaccag

SEQ ID NO: 3015324 - RNA, 18 nt, Human
cuggccagaugcaccagc

SEQ ID NO: 3015325 - RNA, 19 nt, Human
cuggccagaugcaccagcc

SEQ ID NO: 3015326 - RNA, 20 nt, Human
cuggccagaugcaccagccc

SEQ ID NO: 3015327 - RNA, 17 nt, Human
cuggcacugcuuccagu

SEQ ID NO: 3015328 - RNA, 16 nt, Human
cuggcacugcuuccag

SEQ ID NO: 3015329 - RNA, 15 nt, Human
cuggcacugcuucca

SEQ ID NO: 3015330 - RNA, 16 nt, Human
cuggccagaugcacca

SEQ ID NO: 3015331 - RNA, 15 nt, Human
cuggauggggcugca

SEQ ID NO: 3015332 - RNA, 13 nt, Human
cuggauuaaacuu

SEQ ID NO: 3015333 - RNA, 23 nt, Human
cuggauuaaacuuaaucuaaaug

SEQ ID NO: 3015334 - RNA, 16 nt, Human
cuggauggggcugcac

SEQ ID NO: 3015335 - RNA, 14 nt, Human
cuggcacugcuucc

SEQ ID NO: 3015336 - RNA, 13 nt, Human
cuggcacugcuuc

SEQ ID NO: 3015337 - RNA, 23 nt, Human
cuggcacuauaauguaagcucua

SEQ ID NO: 3015338 - RNA, 22 nt, Human
cuggcacuauaauguaagcucu

SEQ ID NO: 3015339 - RNA, 13 nt, Human
cuggccugagcug

SEQ ID NO: 3015340 - RNA, 17 nt, Human
cuggcucuuccaggcug

SEQ ID NO: 3015341 - RNA, 20 nt, Human
cuggcucuuccaggcuggga

SEQ ID NO: 3015342 - RNA, 19 nt, Human
cuggcucuuccaggcuggg

SEQ ID NO: 3015343 - RNA, 18 nt, Human
cuggcucuuccaggcugg

SEQ ID NO: 3015344 - RNA, 19 nt, Human
cuggcuguuggcugggggc

SEQ ID NO: 3015345 - RNA, 21 nt, Human
cuggcuggguggcaccagcag

SEQ ID NO: 3015346 - RNA, 18 nt, Human
cuggcuguuggcuggggg

SEQ ID NO: 3015347 - RNA, 20 nt, Human
cuggcuguuggcugggggcc

SEQ ID NO: 3015348 - RNA, 20 nt, Human
cugggcaaugugauaaaacc

SEQ ID NO: 3015349 - RNA, 16 nt, Human
cugggagugagcuggu

SEQ ID NO: 3015350 - RNA, 13 nt, Human
cugggagugagcu

SEQ ID NO: 3015351 - RNA, 12 nt, Human
cugggagugagc

SEQ ID NO: 3015352 - RNA, 18 nt, Human
cugggaggucaaggcugc

SEQ ID NO: 3015353 - RNA, 21 nt, Human
cugggcuucaguggcagcugc

SEQ ID NO: 3015354 - RNA, 22 nt, Human
cugggcuucaguggcagcugcu

SEQ ID NO: 3015355 - RNA, 23 nt, Human
cugggcuucaguggcagcugcuu

SEQ ID NO: 3015356 - RNA, 13 nt, Human
cugggcuugggga

SEQ ID NO: 3015357 - RNA, 20 nt, Human
cugggcuuggggaccagagc

SEQ ID NO: 3015358 - RNA, 17 nt, Human
cugggcuuggggaccag

SEQ ID NO: 3015359 - RNA, 21 nt, Human
cugggcuuggggaccagagcu

SEQ ID NO: 3015360 - RNA, 18 nt, Human
cugggcuucaguggcagc

SEQ ID NO: 3015361 - RNA, 17 nt, Human
cugggcuucaguggcag

SEQ ID NO: 3015362 - RNA, 19 nt, Human
cugggcuucaguggcagcu

SEQ ID NO: 3015363 - RNA, 20 nt, Human
cugggcuucaguggcagcug

SEQ ID NO: 3015364 - RNA, 19 nt, Human
cuggguacuuguggacaca

SEQ ID NO: 3015365 - RNA, 21 nt, Human
cuggguacuuguggacacagc

SEQ ID NO: 3015366 - RNA, 23 nt, Human
cuggguacuuguggacacagcuc

SEQ ID NO: 3015367 - RNA, 20 nt, Human
cuggguacuuguggacacag

SEQ ID NO: 3015368 - RNA, 23 nt, Human
cugggguggggaccucaggccug

SEQ ID NO: 3015369 - RNA, 22 nt, Human
cugggguggggaccucaggccu

SEQ ID NO: 3015370 - RNA, 21 nt, Human
cugggguggggaccucaggcc

SEQ ID NO: 3015371 - RNA, 13 nt, Human
cugggggccucag

SEQ ID NO: 3015372 - RNA, 17 nt, Human
cugggggccucagugcc

SEQ ID NO: 3015373 - RNA, 18 nt, Human
cugggggccucagugcca

SEQ ID NO: 3015374 - RNA, 17 nt, Human
cugggguggggaccuca

SEQ ID NO: 3015375 - RNA, 19 nt, Human
cugggguggggaccucagg

SEQ ID NO: 3015376 - RNA, 18 nt, Human
cugggguggggaccucag

SEQ ID NO: 3015377 - RNA, 19 nt, Human
cugguggcagugggagcug

SEQ ID NO: 3015378 - RNA, 23 nt, Human
cugguggcagugggagcugccug

SEQ ID NO: 3015379 - RNA, 19 nt, Human
cuggguucuacccaggugc

SEQ ID NO: 3015380 - RNA, 13 nt, Human
cuggguuggaggg

SEQ ID NO: 3015381 - RNA, 17 nt, Human
cugguccauagagagca

SEQ ID NO: 3015382 - RNA, 15 nt, Human
cugguccauagagag

SEQ ID NO: 3015383 - RNA, 15 nt, Human
cuggucccacucagu

SEQ ID NO: 3015384 - RNA, 18 nt, Human
cuggucccacucagucca

SEQ ID NO: 3015385 - RNA, 14 nt, Human
cuggucccacucag

SEQ ID NO: 3015386 - RNA, 18 nt, Human
cugguccauagagagcaa

SEQ ID NO: 3015387 - RNA, 17 nt, Human
cugcagggacagagcau

SEQ ID NO: 3015388 - RNA, 22 nt, Human
cugcagggaguccgaaagggac

SEQ ID NO: 3015389 - RNA, 22 nt, Human
cugcagccucaaccuccugggc

SEQ ID NO: 3015390 - RNA, 19 nt, Human
cugcagccucaaccuccug

SEQ ID NO: 3015391 - RNA, 20 nt, Human
cugcagccucaaccuccugg

SEQ ID NO: 3015392 - RNA, 11 nt, Human
cugcagccuca

SEQ ID NO: 3015393 - RNA, 14 nt, Human
cugcacuugcagac

SEQ ID NO: 3015394 - RNA, 16 nt, Human
cugcacuugcagacuc

SEQ ID NO: 3015395 - RNA, 17 nt, Human
cugcacuugcagacucu

SEQ ID NO: 3015396 - RNA, 19 nt, Human
cugcaccggcuggccuggc

SEQ ID NO: 3015397 - RNA, 18 nt, Human
cugcaccggcuggccugg

SEQ ID NO: 3015398 - RNA, 17 nt, Human
cugcaccggcuggccug

SEQ ID NO: 3015399 - RNA, 16 nt, Human
cugcacaagcugcacc

SEQ ID NO: 3015400 - RNA, 15 nt, Human
cugcacaagcugcac

SEQ ID NO: 3015401 - RNA, 14 nt, Human
cugcacaagcugca

SEQ ID NO: 3015402 - RNA, 13 nt, Human
cugcacaagcugc

SEQ ID NO: 3015403 - RNA, 18 nt, Human
cugcacccucaggcaggu

SEQ ID NO: 3015404 - RNA, 16 nt, Human
cugcacccucaggcag

SEQ ID NO: 3015405 - RNA, 17 nt, Human
cugcacccucaggcagg

SEQ ID NO: 3015406 - RNA, 22 nt, Human
cugauucccaagcucugcuccu

SEQ ID NO: 3015407 - RNA, 19 nt, Human
cugauucccaagcucugcu

SEQ ID NO: 3015408 - RNA, 20 nt, Human
cugauucccaagcucugcuc

SEQ ID NO: 3015409 - RNA, 17 nt, Human
cugauucccaagcucug

SEQ ID NO: 3015410 - RNA, 18 nt, Human
cugauucccaagcucugc

SEQ ID NO: 3015411 - RNA, 15 nt, Human
cugauucccaagcuc

SEQ ID NO: 3015412 - RNA, 22 nt, Human
cugagugggggaucacagccuc

SEQ ID NO: 3015413 - RNA, 13 nt, Human
cugauaaagauga

SEQ ID NO: 3015414 - RNA, 16 nt, Human
cugagucugaaggcug

SEQ ID NO: 3015415 - RNA, 15 nt, Human
cugagucugaaggcu

SEQ ID NO: 3015416 - RNA, 14 nt, Human
cugagucugaaggc

SEQ ID NO: 3015417 - RNA, 13 nt, Human
cugagucugaagg

SEQ ID NO: 3015418 - RNA, 16 nt, Human
cugccauuucugagau

SEQ ID NO: 3015419 - RNA, 13 nt, Human
cugcccaggcccc

SEQ ID NO: 3015420 - RNA, 20 nt, Human
cugcccggcaggguccuaga

SEQ ID NO: 3015421 - RNA, 16 nt, Human
cugccccuggcagccc

SEQ ID NO: 3015422 - RNA, 15 nt, Human
cugccccuggcagcc

SEQ ID NO: 3015423 - RNA, 14 nt, Human
cugccccuggcagc

SEQ ID NO: 3015424 - RNA, 16 nt, Human
cugcccugcccaccug

SEQ ID NO: 3015425 - RNA, 15 nt, Human
cugcccugcccaccu

SEQ ID NO: 3015426 - RNA, 14 nt, Human
cugcccugcccacc

SEQ ID NO: 3015427 - RNA, 13 nt, Human
cugcccugcccac

SEQ ID NO: 3015428 - RNA, 11 nt, Human
cugcccggcug

SEQ ID NO: 3015429 - RNA, 15 nt, Human
cugcccggcugcgga

SEQ ID NO: 3015430 - RNA, 19 nt, Human
cugcccuccaagaccuucu

SEQ ID NO: 3015431 - RNA, 15 nt, Human
cugccacccugggga

SEQ ID NO: 3015432 - RNA, 16 nt, Human
cugccacccuggggag

SEQ ID NO: 3015433 - RNA, 20 nt, Human
cugccacccuggggagaaag

SEQ ID NO: 3015434 - RNA, 14 nt, Human
cugccacccugggg

SEQ ID NO: 3015435 - RNA, 19 nt, Human
cugccaugccagcuuaucu

SEQ ID NO: 3015436 - RNA, 17 nt, Human
cugccaugccagcuuau

SEQ ID NO: 3015437 - RNA, 15 nt, Human
cugccaugccagcuu

SEQ ID NO: 3015438 - RNA, 19 nt, Human
cugccagccgagauagcca

SEQ ID NO: 3015439 - RNA, 19 nt, Human
cugccaggaagccagcagg

SEQ ID NO: 3015440 - RNA, 18 nt, Human
cugccaggaagccagcag

SEQ ID NO: 3015441 - RNA, 16 nt, Human
cugccaggaagccagc

SEQ ID NO: 3015442 - RNA, 15 nt, Human
cugccaggaagccag

SEQ ID NO: 3015443 - RNA, 14 nt, Human
cugcuccagcuguu

SEQ ID NO: 3015444 - RNA, 16 nt, Human
cugcgguccacccagg

SEQ ID NO: 3015445 - RNA, 21 nt, Human
cugcggaaugaaccacaucuu

SEQ ID NO: 3015446 - RNA, 15 nt, Human
cugcgguccacccag

SEQ ID NO: 3015447 - RNA, 20 nt, Human
cugcggaaugaaccacaucu

SEQ ID NO: 3015448 - RNA, 16 nt, Human
cugcuccucuccccag

SEQ ID NO: 3015449 - RNA, 17 nt, Human
cugcuccucuccccagc

SEQ ID NO: 3015450 - RNA, 15 nt, Human
cugcuccagcuguuc

SEQ ID NO: 3015451 - RNA, 18 nt, Human
cugcuccucuccccagca

SEQ ID NO: 3015452 - RNA, 23 nt, Human
cugccugaagucacacagugagu

SEQ ID NO: 3015453 - RNA, 13 nt, Human
cugccucuucucu

SEQ ID NO: 3015454 - RNA, 13 nt, Human
cugccugcccagg

SEQ ID NO: 3015455 - RNA, 14 nt, Human
cugccugcccaggc

SEQ ID NO: 3015456 - RNA, 23 nt, Human
cugccuguugggccaggagccuc

SEQ ID NO: 3015457 - RNA, 13 nt, Human
cugccucagccuc

SEQ ID NO: 3015458 - RNA, 14 nt, Human
ccucaauugugaaa

SEQ ID NO: 3015459 - RNA, 17 nt, Human
ccucacaguccuuacca

SEQ ID NO: 3015460 - RNA, 18 nt, Human
ccucaauaaacauuucau

SEQ ID NO: 3015461 - RNA, 17 nt, Human
ccucaccuuucccaucu

SEQ ID NO: 3015462 - RNA, 15 nt, Human
ccucaccccacugug

SEQ ID NO: 3015463 - RNA, 12 nt, Human
ccucaccccacu

SEQ ID NO: 3015464 - RNA, 22 nt, Human
ccucacaguccuuaccagcaga

SEQ ID NO: 3015465 - RNA, 20 nt, Human
ccucacaguccuuaccagca

SEQ ID NO: 3015466 - RNA, 23 nt, Human
ccgcuuucuacccagcgagcccu

SEQ ID NO: 3015467 - RNA, 12 nt, Human
ccggcuggccug

SEQ ID NO: 3015468 - RNA, 15 nt, Human
ccgggcacucagaag

SEQ ID NO: 3015469 - RNA, 13 nt, Human
ccggcuggccugg

SEQ ID NO: 3015470 - RNA, 22 nt, Human
cccuuuuucaauaacuggaaca

SEQ ID NO: 3015471 - RNA, 17 nt, Human
cccuuuuucaauaacug

SEQ ID NO: 3015472 - RNA, 18 nt, Human
cccuuuuuuggcugcuga

SEQ ID NO: 3015473 - RNA, 17 nt, Human
cccuuuuuuggcugcug

SEQ ID NO: 3015474 - RNA, 13 nt, Human
cccuuuucuguuu

SEQ ID NO: 3015475 - RNA, 11 nt, Human
cccuuuuccuu

SEQ ID NO: 3015476 - RNA, 19 nt, Human
cccuuuuuuggcugcugaa

SEQ ID NO: 3015477 - RNA, 22 nt, Human
ccgagauagccaaggccaaagg

SEQ ID NO: 3015478 - RNA, 19 nt, Human
ccgagauagccaaggccaa

SEQ ID NO: 3015479 - RNA, 18 nt, Human
ccgagauagccaaggcca

SEQ ID NO: 3015480 - RNA, 17 nt, Human
ccgagaaggaagccucc

SEQ ID NO: 3015481 - RNA, 18 nt, Human
ccgagaucacgccacugc

SEQ ID NO: 3015482 - RNA, 17 nt, Human
ccgaggccuucucugaa

SEQ ID NO: 3015483 - RNA, 20 nt, Human
cccuuugacgccaucccagc

SEQ ID NO: 3015484 - RNA, 18 nt, Human
cccuuguggucccacccc

SEQ ID NO: 3015485 - RNA, 16 nt, Human
cccuuguggucccacc

SEQ ID NO: 3015486 - RNA, 14 nt, Human
cccuugugguccca

SEQ ID NO: 3015487 - RNA, 18 nt, Human
cccuuggggagcaggcuc

SEQ ID NO: 3015488 - RNA, 22 nt, Human
cccuugccgucuaccugagggg

SEQ ID NO: 3015489 - RNA, 18 nt, Human
cccuugccgucuaccuga

SEQ ID NO: 3015490 - RNA, 17 nt, Human
cccuugccgucuaccug

SEQ ID NO: 3015491 - RNA, 16 nt, Human
cccugugucauuucaa

SEQ ID NO: 3015492 - RNA, 18 nt, Human
cccugugggcccccaaau

SEQ ID NO: 3015493 - RNA, 15 nt, Human
cccuguuuguuucug

SEQ ID NO: 3015494 - RNA, 15 nt, Human
cccugugggccccca

SEQ ID NO: 3015495 - RNA, 16 nt, Human
cccugugggcccccaa

SEQ ID NO: 3015496 - RNA, 17 nt, Human
ccccucagggucccugg

SEQ ID NO: 3015497 - RNA, 20 nt, Human
ccccucagggucccuggugg

SEQ ID NO: 3015498 - RNA, 18 nt, Human
ccccucagggucccuggu

SEQ ID NO: 3015499 - RNA, 15 nt, Human
cccugguggcagugg

SEQ ID NO: 3015500 - RNA, 16 nt, Human
cccugguggcaguggg

SEQ ID NO: 3015501 - RNA, 19 nt, Human
cccugguggcagugggagc

SEQ ID NO: 3015502 - RNA, 21 nt, Human
cccccgcugucagccauuccu

SEQ ID NO: 3015503 - RNA, 12 nt, Human
cccccagcccca

SEQ ID NO: 3015504 - RNA, 22 nt, Human
ccccaggaggccagccuugacc

SEQ ID NO: 3015505 - RNA, 21 nt, Human
ccccaggaggccagccuugac

SEQ ID NO: 3015506 - RNA, 15 nt, Human
ccccaggaggccagc

SEQ ID NO: 3015507 - RNA, 14 nt, Human
ccccaggaggccag

SEQ ID NO: 3015508 - RNA, 13 nt, Human
ccccaggaggcca

SEQ ID NO: 3015509 - RNA, 13 nt, Human
ccccacuggugac

SEQ ID NO: 3015510 - RNA, 12 nt, Human
ccccacugguga

SEQ ID NO: 3015511 - RNA, 23 nt, Human
ccucuguacagagcccacgcccc

SEQ ID NO: 3015512 - RNA, 18 nt, Human
ccucuguacagagcccac

SEQ ID NO: 3015513 - RNA, 17 nt, Human
ccucuguacagagccca

SEQ ID NO: 3015514 - RNA, 16 nt, Human
ccucuguacagagccc

SEQ ID NO: 3015515 - RNA, 15 nt, Human
ccucuguacagagcc

SEQ ID NO: 3015516 - RNA, 14 nt, Human
ccucuguacagagc

SEQ ID NO: 3015517 - RNA, 14 nt, Human
ccucuuagaaaaac

SEQ ID NO: 3015518 - RNA, 14 nt, Human
ccucuuaugggcug

SEQ ID NO: 3015519 - RNA, 16 nt, Human
ccucuuaugggcuggg

SEQ ID NO: 3015520 - RNA, 15 nt, Human
ccucuuaugggcugg

SEQ ID NO: 3015521 - RNA, 15 nt, Human
ccugaagucacacag

SEQ ID NO: 3015522 - RNA, 13 nt, Human
ccugaaggccccg

SEQ ID NO: 3015523 - RNA, 16 nt, Human
ccugaagucacacagu

SEQ ID NO: 3015524 - RNA, 17 nt, Human
ccugaagucacacagug

SEQ ID NO: 3015525 - RNA, 17 nt, Human
ccucuuaugggcugggu

SEQ ID NO: 3015526 - RNA, 22 nt, Human
ccucuuuggucuacacugugcu

SEQ ID NO: 3015527 - RNA, 18 nt, Human
ccugaugcuucuucagag

SEQ ID NO: 3015528 - RNA, 17 nt, Human
ccugaugcuucuucaga

SEQ ID NO: 3015529 - RNA, 23 nt, Human
ccugauugugucucuugguccug

SEQ ID NO: 3015530 - RNA, 14 nt, Human
ccugaugcuucuuc

SEQ ID NO: 3015531 - RNA, 14 nt, Human
ccugaggcccuucu

SEQ ID NO: 3015532 - RNA, 12 nt, Human
ccugaggcccag

SEQ ID NO: 3015533 - RNA, 14 nt, Human
ccugaggcccagag

SEQ ID NO: 3015534 - RNA, 13 nt, Human
ccugaggcccaga

SEQ ID NO: 3015535 - RNA, 16 nt, Human
ccugacaacacucauu

SEQ ID NO: 3015536 - RNA, 15 nt, Human
ccugacaacacucau

SEQ ID NO: 3015537 - RNA, 14 nt, Human
ccugacaacacuca

SEQ ID NO: 3015538 - RNA, 12 nt, Human
ccugacaacacu

SEQ ID NO: 3015539 - RNA, 23 nt, Human
ccugaggcccuucucuccagccc

SEQ ID NO: 3015540 - RNA, 22 nt, Human
ccugaggcccuucucuccagcc

SEQ ID NO: 3015541 - RNA, 21 nt, Human
ccugaggcccuucucuccagc

SEQ ID NO: 3015542 - RNA, 20 nt, Human
ccugaggcccuucucuccag

SEQ ID NO: 3015543 - RNA, 19 nt, Human
ccugaggcccuucucucca

SEQ ID NO: 3015544 - RNA, 17 nt, Human
ccugaggcccuucucuc

SEQ ID NO: 3015545 - RNA, 16 nt, Human
ccugaggcccuucucu

SEQ ID NO: 3015546 - RNA, 23 nt, Human
ccuccugugugugcgccuacagg

SEQ ID NO: 3015547 - RNA, 12 nt, Human
ccucucccauca

SEQ ID NO: 3015548 - RNA, 16 nt, Human
ccucugacacacagcu

SEQ ID NO: 3015549 - RNA, 15 nt, Human
ccucugacacacagc

SEQ ID NO: 3015550 - RNA, 23 nt, Human
ccucugaaaaccaauguucucuc

SEQ ID NO: 3015551 - RNA, 17 nt, Human
ccucugacacacagcuc

SEQ ID NO: 3015552 - RNA, 18 nt, Human
ccucugacacacagcucu

SEQ ID NO: 3015553 - RNA, 15 nt, Human
ccucugcacaagcug

SEQ ID NO: 3015554 - RNA, 11 nt, Human
ccucugcacaa

SEQ ID NO: 3015555 - RNA, 19 nt, Human
ccucugcacaagcugcacc

SEQ ID NO: 3015556 - RNA, 17 nt, Human
ccucugcacaagcugca

SEQ ID NO: 3015557 - RNA, 20 nt, Human
ccucugcacaagcugcaccc

SEQ ID NO: 3015558 - RNA, 22 nt, Human
ccucugcacuccccugcugggu

SEQ ID NO: 3015559 - RNA, 21 nt, Human
ccucugcacuccccugcuggg

SEQ ID NO: 3015560 - RNA, 20 nt, Human
ccucugcacuccccugcugg

SEQ ID NO: 3015561 - RNA, 19 nt, Human
ccucugcacuccccugcug

SEQ ID NO: 3015562 - RNA, 14 nt, Human
ccucugcacucccc

SEQ ID NO: 3015563 - RNA, 12 nt, Human
ccucugggacug

SEQ ID NO: 3015564 - RNA, 14 nt, Human
ccucagggucccug

SEQ ID NO: 3015565 - RNA, 11 nt, Human
ccucaggccug

SEQ ID NO: 3015566 - RNA, 10 nt, Human
ccucaggccu

SEQ ID NO: 3015567 - RNA, 21 nt, Human
ccucaggccugggggcugggc

SEQ ID NO: 3015568 - RNA, 14 nt, Human
ccucaggccugggg

SEQ ID NO: 3015569 - RNA, 16 nt, Human
ccucagcauccuggca

SEQ ID NO: 3015570 - RNA, 17 nt, Human
ccucagcauccuggcac

SEQ ID NO: 3015571 - RNA, 14 nt, Human
ccucagcauccugg

SEQ ID NO: 3015572 - RNA, 16 nt, Human
ccucaggugagaagca

SEQ ID NO: 3015573 - RNA, 22 nt, Human
ccucagggucccugguggcagc

SEQ ID NO: 3015574 - RNA, 15 nt, Human
ccucagggucccugg

SEQ ID NO: 3015575 - RNA, 22 nt, Human
ccucaggugauccacccaccuc

SEQ ID NO: 3015576 - RNA, 22 nt, Human
ccucaggugagaagcagaggaa

SEQ ID NO: 3015577 - RNA, 17 nt, Human
ccucaggugauccaccc

SEQ ID NO: 3015578 - RNA, 19 nt, Human
ccucaggugauccacccac

SEQ ID NO: 3015579 - RNA, 15 nt, Human
ccucagucuggcccu

SEQ ID NO: 3015580 - RNA, 13 nt, Human
ccuccugggcuaa

SEQ ID NO: 3015581 - RNA, 13 nt, Human
ccuccugugugug

SEQ ID NO: 3015582 - RNA, 15 nt, Human
ccuccugugugugcg

SEQ ID NO: 3015583 - RNA, 22 nt, Human
ccuccugugugugcgccuacag

SEQ ID NO: 3015584 - RNA, 16 nt, Human
ccucccucccucuuuc

SEQ ID NO: 3015585 - RNA, 13 nt, Human
ccucccucccucu

SEQ ID NO: 3015586 - RNA, 15 nt, Human
ccucccucccucuuu

SEQ ID NO: 3015587 - RNA, 13 nt, Human
cgcuccugugucu

SEQ ID NO: 3015588 - RNA, 20 nt, Human
cggaaugaaccacaucuugc

SEQ ID NO: 3015589 - RNA, 15 nt, Human
cggacagccacggcc

SEQ ID NO: 3015590 - RNA, 16 nt, Human
cggacagccacggcca

SEQ ID NO: 3015591 - RNA, 18 nt, Human
cggacagccacggccagg

SEQ ID NO: 3015592 - RNA, 20 nt, Human
cgggaggauguucugggaca

SEQ ID NO: 3015593 - RNA, 16 nt, Human
cgggaggucgaggcag

SEQ ID NO: 3015594 - RNA, 17 nt, Human
cgggaggucgaggcagg

SEQ ID NO: 3015595 - RNA, 15 nt, Human
cgggcaugacacgaa

SEQ ID NO: 3015596 - RNA, 12 nt, Human
cgggcaugacac

SEQ ID NO: 3015597 - RNA, 18 nt, Human
cggcuggccuggccccuc

SEQ ID NO: 3015598 - RNA, 14 nt, Human
cggcuggccuggcc

SEQ ID NO: 3015599 - RNA, 16 nt, Human
cggcuggccuggcccc

SEQ ID NO: 3015600 - RNA, 15 nt, Human
cggcuggccuggccc

SEQ ID NO: 3015601 - RNA, 12 nt, Human
cgauuucuguuu

SEQ ID NO: 3015602 - RNA, 23 nt, Human
cgcacuucgggaggucgaggcag

SEQ ID NO: 3015603 - RNA, 19 nt, Human
cgaucuggguucacugcaa

SEQ ID NO: 3015604 - RNA, 21 nt, Human
cgauucuucugcuucagccuc

SEQ ID NO: 3015605 - RNA, 13 nt, Human
cgauucuucugcu

SEQ ID NO: 3015606 - RNA, 19 nt, Human
cgauucuucugcuucagcc

SEQ ID NO: 3015607 - RNA, 15 nt, Human
ccuuuguauucucuc

SEQ ID NO: 3015608 - RNA, 18 nt, Human
ccuuuguauucucuccug

SEQ ID NO: 3015609 - RNA, 20 nt, Human
ccuuuguauucucuccugua

SEQ ID NO: 3015610 - RNA, 18 nt, Human
cgaggccuucucugaagg

SEQ ID NO: 3015611 - RNA, 19 nt, Human
cgaggccuucucugaagga

SEQ ID NO: 3015612 - RNA, 13 nt, Human
cgaggacagggag

SEQ ID NO: 3015613 - RNA, 12 nt, Human
cgaggacaggga

SEQ ID NO: 3015614 - RNA, 16 nt, Human
ccuuugcuugaaagaa

SEQ ID NO: 3015615 - RNA, 23 nt, Human
ccuuugacgccaucccagcccca

SEQ ID NO: 3015616 - RNA, 12 nt, Human
ccuuggcugcag

SEQ ID NO: 3015617 - RNA, 13 nt, Human
ccuuggcugcagg

SEQ ID NO: 3015618 - RNA, 20 nt, Human
ccuuguggucccaccccaca

SEQ ID NO: 3015619 - RNA, 19 nt, Human
ccuuguggucccaccccac

SEQ ID NO: 3015620 - RNA, 16 nt, Human
ccuuguggucccaccc

SEQ ID NO: 3015621 - RNA, 13 nt, Human
ccuuuaagagaaa

SEQ ID NO: 3015622 - RNA, 14 nt, Human
cgcagacaggacca

SEQ ID NO: 3015623 - RNA, 13 nt, Human
cgcagacaggacc

SEQ ID NO: 3015624 - RNA, 15 nt, Human
cgcccccacugguga

SEQ ID NO: 3015625 - RNA, 15 nt, Human
cgcgacaaugcaaac

SEQ ID NO: 3015626 - RNA, 17 nt, Human
cgcgacaaugcaaacca

SEQ ID NO: 3015627 - RNA, 16 nt, Human
cgcgacaaugcaaacc

SEQ ID NO: 3015628 - RNA, 21 nt, Human
cgcuaagagggagggagggcu

SEQ ID NO: 3015629 - RNA, 14 nt, Human
cgcuaagagggagg

SEQ ID NO: 3015630 - RNA, 16 nt, Human
cgcuaagagggaggga

SEQ ID NO: 3015631 - RNA, 15 nt, Human
cgcuaagagggaggg

SEQ ID NO: 3015632 - RNA, 16 nt, Human
cgcgugcacacaccag

SEQ ID NO: 3015633 - RNA, 19 nt, Human
cgcgugcacacaccagagc

SEQ ID NO: 3015634 - RNA, 20 nt, Human
cgcgugcacacaccagagcc

SEQ ID NO: 3015635 - RNA, 22 nt, Human
cgugcaguggugcgaucugggu

SEQ ID NO: 3015636 - RNA, 22 nt, Human
cgugcacacaccagagcccacc

SEQ ID NO: 3015637 - RNA, 14 nt, Human
cgugcauaccacuu

SEQ ID NO: 3015638 - RNA, 18 nt, Human
cgugcauaccacuuuugu

SEQ ID NO: 3015639 - RNA, 19 nt, Human
cgugcauaccacuuuuguu

SEQ ID NO: 3015640 - RNA, 20 nt, Human
cgugcacacaccagagccca

SEQ ID NO: 3015641 - RNA, 21 nt, Human
cgugcacacaccagagcccac

SEQ ID NO: 3015642 - RNA, 14 nt, Human
cguccccugucccc

SEQ ID NO: 3015643 - RNA, 11 nt, Human
cguccccuguc

SEQ ID NO: 3015644 - RNA, 13 nt, Human
cgucugacaggca

SEQ ID NO: 3015645 - RNA, 14 nt, Human
cgucugacaggcaa

SEQ ID NO: 3015646 - RNA, 14 nt, Human
cgucuaccugaggg

SEQ ID NO: 3015647 - RNA, 23 nt, Human
cggugcuaucucccccagcccca

SEQ ID NO: 3015648 - RNA, 17 nt, Human
cguggcugcuucaagga

SEQ ID NO: 3015649 - RNA, 15 nt, Human
cguggcugcuucaag

SEQ ID NO: 3015650 - RNA, 14 nt, Human
cguggcugcuucaa

SEQ ID NO: 3015651 - RNA, 12 nt, Human
cguggcugcuuc

SEQ ID NO: 3015652 - RNA, 20 nt, Human
cguuucuaugacacaugcaa

SEQ ID NO: 3015653 - RNA, 19 nt, Human
cguuucuaaaggcuaccuu

SEQ ID NO: 3015654 - RNA, 21 nt, Human
cguuucuaaaggcuaccuuug

SEQ ID NO: 3015655 - RNA, 19 nt, Human
ccugcugguucaggguugg

SEQ ID NO: 3015656 - RNA, 13 nt, Human
ccugcugguucag

SEQ ID NO: 3015657 - RNA, 21 nt, Human
ccugcuggguguggcgcagca

SEQ ID NO: 3015658 - RNA, 12 nt, Human
ccugcuccagcu

SEQ ID NO: 3015659 - RNA, 22 nt, Human
ccugcuccagcuguucagcugg

SEQ ID NO: 3015660 - RNA, 14 nt, Human
ccugcuccagcugu

SEQ ID NO: 3015661 - RNA, 13 nt, Human
ccugcuccagcug

SEQ ID NO: 3015662 - RNA, 18 nt, Human
ccugcaacaccuuguuuc

SEQ ID NO: 3015663 - RNA, 16 nt, Human
ccugcaaccugauugu

SEQ ID NO: 3015664 - RNA, 19 nt, Human
ccugcaacaccuuguuucc

SEQ ID NO: 3015665 - RNA, 23 nt, Human
ccugcgucucauacucaccucac

SEQ ID NO: 3015666 - RNA, 14 nt, Human
ccuggacccugugg

SEQ ID NO: 3015667 - RNA, 13 nt, Human
ccuggacccugug

SEQ ID NO: 3015668 - RNA, 14 nt, Human
ccuggcaugggaau

SEQ ID NO: 3015669 - RNA, 17 nt, Human
ccuggcaugggaaugaa

SEQ ID NO: 3015670 - RNA, 16 nt, Human
ccuggcaugggaauga

SEQ ID NO: 3015671 - RNA, 16 nt, Human
ccuggcagccccuguu

SEQ ID NO: 3015672 - RNA, 14 nt, Human
ccuggcagccccug

SEQ ID NO: 3015673 - RNA, 21 nt, Human
ccuggcacugcuuccagugag

SEQ ID NO: 3015674 - RNA, 17 nt, Human
ccuggcacugcuuccag

SEQ ID NO: 3015675 - RNA, 20 nt, Human
ccuggcacugcuuccaguga

SEQ ID NO: 3015676 - RNA, 18 nt, Human
ccuggcaugggaaugaau

SEQ ID NO: 3015677 - RNA, 14 nt, Human
ccuggccccucagg

SEQ ID NO: 3015678 - RNA, 20 nt, Human
ccugggaggucaaggcugca

SEQ ID NO: 3015679 - RNA, 20 nt, Human
ccugggaucccucauccuca

SEQ ID NO: 3015680 - RNA, 16 nt, Human
ccugggaucccucauc

SEQ ID NO: 3015681 - RNA, 14 nt, Human
ccugggcagaagga

SEQ ID NO: 3015682 - RNA, 12 nt, Human
ccugggcagaag

SEQ ID NO: 3015683 - RNA, 18 nt, Human
ccuguccccgcacugggc

SEQ ID NO: 3015684 - RNA, 16 nt, Human
ccugucccccugacaa

SEQ ID NO: 3015685 - RNA, 17 nt, Human
ccugucccccugacaac

SEQ ID NO: 3015686 - RNA, 20 nt, Human
ccugugaguacuacaguccu

SEQ ID NO: 3015687 - RNA, 17 nt, Human
ccugugauggggcccug

SEQ ID NO: 3015688 - RNA, 19 nt, Human
ccugugauggggcccugcc

SEQ ID NO: 3015689 - RNA, 18 nt, Human
ccugugauggggcccugc

SEQ ID NO: 3015690 - RNA, 22 nt, Human
ccugugauggggcccugccucc

SEQ ID NO: 3015691 - RNA, 21 nt, Human
ccugugauggggcccugccuc

SEQ ID NO: 3015692 - RNA, 20 nt, Human
ccugugauggggcccugccu

SEQ ID NO: 3015693 - RNA, 19 nt, Human
ccugugccucugggacugg

SEQ ID NO: 3015694 - RNA, 15 nt, Human
ccugugccucuggga

SEQ ID NO: 3015695 - RNA, 17 nt, Human
ccugugccucugggacu

SEQ ID NO: 3015696 - RNA, 23 nt, Human
ccuguagagugggagcugagugg

SEQ ID NO: 3015697 - RNA, 19 nt, Human
ccuguagagugggagcuga

SEQ ID NO: 3015698 - RNA, 21 nt, Human
ccuguagagugggagcugagu

SEQ ID NO: 3015699 - RNA, 20 nt, Human
ccuguaauccuagcacuuug

SEQ ID NO: 3015700 - RNA, 12 nt, Human
ccuguaccucuu

SEQ ID NO: 3015701 - RNA, 18 nt, Human
ccugguggcagcucaccu

SEQ ID NO: 3015702 - RNA, 17 nt, Human
ccugguggcagcucacc

SEQ ID NO: 3015703 - RNA, 16 nt, Human
ccugguggcagcucac

SEQ ID NO: 3015704 - RNA, 14 nt, Human
ccugguggcagcuc

SEQ ID NO: 3015705 - RNA, 12 nt, Human
ccugguggcagc

SEQ ID NO: 3015706 - RNA, 13 nt, Human
ccugguggcagcu

SEQ ID NO: 3015707 - RNA, 12 nt, Human
ccuucagugccu

SEQ ID NO: 3015708 - RNA, 14 nt, Human
ccuucagugccuua

SEQ ID NO: 3015709 - RNA, 13 nt, Human
ccuucagugccuu

SEQ ID NO: 3015710 - RNA, 19 nt, Human
ccuucagugccuuauggaa

SEQ ID NO: 3015711 - RNA, 15 nt, Human
ccuucagugccuuau

SEQ ID NO: 3015712 - RNA, 20 nt, Human
ccuucagugccuuauggaac

SEQ ID NO: 3015713 - RNA, 14 nt, Human
ccuuccucuuucca

SEQ ID NO: 3015714 - RNA, 22 nt, Human
ccuuccaggggugggacacccu

SEQ ID NO: 3015715 - RNA, 18 nt, Human
ccuuccaggggugggaca

SEQ ID NO: 3015716 - RNA, 16 nt, Human
ccuuccagggguggga

SEQ ID NO: 3015717 - RNA, 15 nt, Human
ccuuccagggguggg

SEQ ID NO: 3015718 - RNA, 17 nt, Human
ccuuagacagucccugc

SEQ ID NO: 3015719 - RNA, 16 nt, Human
ccuuagacagucccug

SEQ ID NO: 3015720 - RNA, 19 nt, Human
ccuuagacagucccugcca

SEQ ID NO: 3015721 - RNA, 18 nt, Human
ccuuagacagucccugcc

SEQ ID NO: 3015722 - RNA, 21 nt, Human
ccuuagacagucccugccaau

SEQ ID NO: 3015723 - RNA, 14 nt, Human
ccuuagacaguccc

SEQ ID NO: 3015724 - RNA, 14 nt, Human
ccuuaccugccagg

SEQ ID NO: 3015725 - RNA, 20 nt, Human
ccuuaccucggugccuuccu

SEQ ID NO: 3015726 - RNA, 19 nt, Human
ccuuacccucauguucuua

SEQ ID NO: 3015727 - RNA, 17 nt, Human
ccuuaccagcagagcac

SEQ ID NO: 3015728 - RNA, 16 nt, Human
ccuuaccagcagagca

SEQ ID NO: 3015729 - RNA, 15 nt, Human
ccuuaccagcagagc

SEQ ID NO: 3015730 - RNA, 14 nt, Human
ccuuaccagcagag

SEQ ID NO: 3015731 - RNA, 20 nt, Human
ccuugaguugauucagcucu

SEQ ID NO: 3015732 - RNA, 21 nt, Human
ccuugaccauucuccaccugc

SEQ ID NO: 3015733 - RNA, 23 nt, Human
ccuugaguugauucagcucugca

SEQ ID NO: 3015734 - RNA, 22 nt, Human
ccuugaguugauucagcucugc

SEQ ID NO: 3015735 - RNA, 19 nt, Human
ccuuggauuguccccgacc

SEQ ID NO: 3015736 - RNA, 14 nt, Human
ccuugacagggcac

SEQ ID NO: 3015737 - RNA, 13 nt, Human
ccuugacagggca

SEQ ID NO: 3015738 - RNA, 15 nt, Human
ccuugacagggcaca

SEQ ID NO: 3015739 - RNA, 17 nt, Human
ccuugacagggcacacc

SEQ ID NO: 3015740 - RNA, 20 nt, Human
ccuugaccauucuccaccug

SEQ ID NO: 3015741 - RNA, 19 nt, Human
ccuugaccauucuccaccu

SEQ ID NO: 3015742 - RNA, 15 nt, Human
ccuugaaaacacugu

SEQ ID NO: 3015743 - RNA, 13 nt, Human
ccuucgcuccugu

SEQ ID NO: 3015744 - RNA, 14 nt, Human
ccuucgcuccugug

SEQ ID NO: 3015745 - RNA, 15 nt, Human
ccuucgcuccugugu

SEQ ID NO: 3015746 - RNA, 18 nt, Human
ccuucgcuccugugucuu

SEQ ID NO: 3015747 - RNA, 14 nt, Human
ccuugaacugggua

SEQ ID NO: 3015748 - RNA, 22 nt, Human
ccuugaaaacacuguucucugc

SEQ ID NO: 3015749 - RNA, 21 nt, Human
ccuugaaaacacuguucucug

SEQ ID NO: 3015750 - RNA, 19 nt, Human
ccuugaaaacacuguucuc

SEQ ID NO: 3015751 - RNA, 16 nt, Human
ccuugaacuggguacu

SEQ ID NO: 3015752 - RNA, 17 nt, Human
ccuugaacuuugaccuc

SEQ ID NO: 3015753 - RNA, 17 nt, Human
ccuugaaugaugccaug

SEQ ID NO: 3015754 - RNA, 11 nt, Human
ccuuuggcuuc

SEQ ID NO: 3015755 - RNA, 18 nt, Human
ccagaagucaaggcuuag

SEQ ID NO: 3015756 - RNA, 22 nt, Human
ccagaaguuugagaucagccug

SEQ ID NO: 3015757 - RNA, 23 nt, Human
ccagaaguuugagaucagccugg

SEQ ID NO: 3015758 - RNA, 14 nt, Human
ccacuucagcugac

SEQ ID NO: 3015759 - RNA, 13 nt, Human
ccacuucagcuga

SEQ ID NO: 3015760 - RNA, 23 nt, Human
ccacugcacuccagccuggguga

SEQ ID NO: 3015761 - RNA, 19 nt, Human
ccagaauuucccaaagcag

SEQ ID NO: 3015762 - RNA, 12 nt, Human
ccagaauuuccc

SEQ ID NO: 3015763 - RNA, 18 nt, Human
ccagaauuucccaaagca

SEQ ID NO: 3015764 - RNA, 21 nt, Human
ccagaauuucccaaagcagug

SEQ ID NO: 3015765 - RNA, 21 nt, Human
ccagacaccuugacagggcac

SEQ ID NO: 3015766 - RNA, 20 nt, Human
ccagacaccuugacagggca

SEQ ID NO: 3015767 - RNA, 15 nt, Human
ccaccccacacacgc

SEQ ID NO: 3015768 - RNA, 23 nt, Human
ccacggccaggccagagggagug

SEQ ID NO: 3015769 - RNA, 18 nt, Human
ccacgcuggagugcagug

SEQ ID NO: 3015770 - RNA, 19 nt, Human
ccacgcuggagugcaguga

SEQ ID NO: 3015771 - RNA, 16 nt, Human
ccacggccaggccaga

SEQ ID NO: 3015772 - RNA, 18 nt, Human
ccacggccaggccagagg

SEQ ID NO: 3015773 - RNA, 15 nt, Human
ccacccccacccaag

SEQ ID NO: 3015774 - RNA, 16 nt, Human
ccacgcuggagugcag

SEQ ID NO: 3015775 - RNA, 13 nt, Human
ccacgcuggagug

SEQ ID NO: 3015776 - RNA, 16 nt, Human
ccacuacauucuguua

SEQ ID NO: 3015777 - RNA, 17 nt, Human
ccacuacauucuguuaa

SEQ ID NO: 3015778 - RNA, 11 nt, Human
ccacuacauuc

SEQ ID NO: 3015779 - RNA, 15 nt, Human
ccacuacauucuguu

SEQ ID NO: 3015780 - RNA, 14 nt, Human
ccacuacauucugu

SEQ ID NO: 3015781 - RNA, 12 nt, Human
ccaauauccuaa

SEQ ID NO: 3015782 - RNA, 13 nt, Human
ccaauauccuaau

SEQ ID NO: 3015783 - RNA, 14 nt, Human
ccaauauccuaaua

SEQ ID NO: 3015784 - RNA, 15 nt, Human
ccaauauccuaauaa

SEQ ID NO: 3015785 - RNA, 16 nt, Human
ccaauauccuaauaaa

SEQ ID NO: 3015786 - RNA, 17 nt, Human
ccaauauccuaauaaaa

SEQ ID NO: 3015787 - RNA, 18 nt, Human
ccaauauccuaauaaaaa

SEQ ID NO: 3015788 - RNA, 19 nt, Human
ccaauauccuaauaaaaag

SEQ ID NO: 3015789 - RNA, 16 nt, Human
ccacaugugcacaugc

SEQ ID NO: 3015790 - RNA, 16 nt, Human
ccacauuccugaugcu

SEQ ID NO: 3015791 - RNA, 19 nt, Human
ccacaucuugcucugcuga

SEQ ID NO: 3015792 - RNA, 18 nt, Human
ccacaucuugcucugcug

SEQ ID NO: 3015793 - RNA, 17 nt, Human
ccacaucuugcucugcu

SEQ ID NO: 3015794 - RNA, 21 nt, Human
ccaccaacauacucccaucug

SEQ ID NO: 3015795 - RNA, 21 nt, Human
ccacacccagcccacuucugc

SEQ ID NO: 3015796 - RNA, 22 nt, Human
ccacacccagcccacuucugcc

SEQ ID NO: 3015797 - RNA, 20 nt, Human
ccacacccagcccacuucug

SEQ ID NO: 3015798 - RNA, 15 nt, Human
ccacacccagcccac

SEQ ID NO: 3015799 - RNA, 16 nt, Human
ccacaggaucagucug

SEQ ID NO: 3015800 - RNA, 21 nt, Human
ccacccaggagccccgaggcc

SEQ ID NO: 3015801 - RNA, 23 nt, Human
ccacccaggagccccgaggccuu

SEQ ID NO: 3015802 - RNA, 17 nt, Human
ccacccccacccaaggg

SEQ ID NO: 3015803 - RNA, 22 nt, Human
ccaaagccuccuccagccgcca

SEQ ID NO: 3015804 - RNA, 17 nt, Human
ccaaagccuccuccagc

SEQ ID NO: 3015805 - RNA, 19 nt, Human
ccaaagccaaagcuaggcc

SEQ ID NO: 3015806 - RNA, 23 nt, Human
ccaaagcagugcaugcugucccu

SEQ ID NO: 3015807 - RNA, 19 nt, Human
ccaaagcagugcaugcugu

SEQ ID NO: 3015808 - RNA, 20 nt, Human
ccaaacucaccugccccuca

SEQ ID NO: 3015809 - RNA, 21 nt, Human
ccaaagcuaggccuggccaga

SEQ ID NO: 3015810 - RNA, 16 nt, Human
ccaaagcuaggccugg

SEQ ID NO: 3015811 - RNA, 17 nt, Human
ccaaagcuaggccuggc

SEQ ID NO: 3015812 - RNA, 15 nt, Human
ccaaagcuaggccug

SEQ ID NO: 3015813 - RNA, 23 nt, Human
ccaaaggaagcacaugccucucu

SEQ ID NO: 3015814 - RNA, 15 nt, Human
ccaaaggaagcacau

SEQ ID NO: 3015815 - RNA, 15 nt, Human
ccaaaguacacuguu

SEQ ID NO: 3015816 - RNA, 18 nt, Human
ccaaaguacacuguuuca

SEQ ID NO: 3015817 - RNA, 20 nt, Human
ccaaaguacacuguuucaaa

SEQ ID NO: 3015818 - RNA, 22 nt, Human
ccaacauacucccaucugugaa

SEQ ID NO: 3015819 - RNA, 21 nt, Human
ccaacauacucccaucuguga

SEQ ID NO: 3015820 - RNA, 16 nt, Human
ccaacauacucccauc

SEQ ID NO: 3015821 - RNA, 20 nt, Human
ccaacauacucccaucugug

SEQ ID NO: 3015822 - RNA, 19 nt, Human
ccaacauacucccaucugu

SEQ ID NO: 3015823 - RNA, 18 nt, Human
ccaacauacucccaucug

SEQ ID NO: 3015824 - RNA, 17 nt, Human
ccaacauacucccaucu

SEQ ID NO: 3015825 - RNA, 20 nt, Human
ccaagaagcccaggaaaggc

SEQ ID NO: 3015826 - RNA, 19 nt, Human
ccaagaagcccaggaaagg

SEQ ID NO: 3015827 - RNA, 12 nt, Human
ccaacccucauc

SEQ ID NO: 3015828 - RNA, 15 nt, Human
ccaagaagcccagga

SEQ ID NO: 3015829 - RNA, 15 nt, Human
ccaagggccuggccu

SEQ ID NO: 3015830 - RNA, 21 nt, Human
ccaaggccaaaggaagcacau

SEQ ID NO: 3015831 - RNA, 18 nt, Human
ccaaggccaaaggaagca

SEQ ID NO: 3015832 - RNA, 22 nt, Human
ccaaggggaauguuugccucug

SEQ ID NO: 3015833 - RNA, 18 nt, Human
ccaagggccuggccugag

SEQ ID NO: 3015834 - RNA, 16 nt, Human
ccaagggccuggccug

SEQ ID NO: 3015835 - RNA, 19 nt, Human
ccaagggccuggccugagc

SEQ ID NO: 3015836 - RNA, 20 nt, Human
ccaagucaagugaaaaagga

SEQ ID NO: 3015837 - RNA, 13 nt, Human
ccaaggugggagg

SEQ ID NO: 3015838 - RNA, 23 nt, Human
ccaagguuuggggaagaacgaag

SEQ ID NO: 3015839 - RNA, 14 nt, Human
ccaagcucccaggc

SEQ ID NO: 3015840 - RNA, 17 nt, Human
ccaaggccaaaggaagc

SEQ ID NO: 3015841 - RNA, 22 nt, Human
ccaagcucccaggcauucccca

SEQ ID NO: 3015842 - RNA, 16 nt, Human
ccaagcucccaggcau

SEQ ID NO: 3015843 - RNA, 15 nt, Human
ccaagcucccaggca

SEQ ID NO: 3015844 - RNA, 12 nt, Human
cauuuaaaagau

SEQ ID NO: 3015845 - RNA, 15 nt, Human
cauuuaaaagauaca

SEQ ID NO: 3015846 - RNA, 16 nt, Human
cauuuaaaagauacag

SEQ ID NO: 3015847 - RNA, 12 nt, Human
cauuuccugugu

SEQ ID NO: 3015848 - RNA, 13 nt, Human
cauuuccuguguc

SEQ ID NO: 3015849 - RNA, 17 nt, Human
cauuguuggccaaagcc

SEQ ID NO: 3015850 - RNA, 18 nt, Human
cauuguuggccaaagcca

SEQ ID NO: 3015851 - RNA, 15 nt, Human
cacccaagggccugg

SEQ ID NO: 3015852 - RNA, 14 nt, Human
cacccaagggccug

SEQ ID NO: 3015853 - RNA, 16 nt, Human
cauuugagcagggcuc

SEQ ID NO: 3015854 - RNA, 20 nt, Human
cauuugagcagggcucagcg

SEQ ID NO: 3015855 - RNA, 17 nt, Human
cauuugagcagggcuca

SEQ ID NO: 3015856 - RNA, 18 nt, Human
cauuugagcagggcucag

SEQ ID NO: 3015857 - RNA, 17 nt, Human
cauuuguuugaacugau

SEQ ID NO: 3015858 - RNA, 20 nt, Human
cauuuguuugaacugauaaa

SEQ ID NO: 3015859 - RNA, 22 nt, Human
cauuuguuugaacugauaaaga

SEQ ID NO: 3015860 - RNA, 14 nt, Human
cauuugcuccuuuc

SEQ ID NO: 3015861 - RNA, 13 nt, Human
cauuugcuccuuu

SEQ ID NO: 3015862 - RNA, 22 nt, Human
cauuugaaaauuuugauguuuu

SEQ ID NO: 3015863 - RNA, 20 nt, Human
cauuugaaaauuuugauguu

SEQ ID NO: 3015864 - RNA, 17 nt, Human
ccaaacucaccugcccc

SEQ ID NO: 3015865 - RNA, 17 nt, Human
cccaggaguuuggccag

SEQ ID NO: 3015866 - RNA, 18 nt, Human
cccaggaguuuggccaga

SEQ ID NO: 3015867 - RNA, 19 nt, Human
cccaggaguuuggccagaa

SEQ ID NO: 3015868 - RNA, 20 nt, Human
cccaggaguuuggccagaag

SEQ ID NO: 3015869 - RNA, 15 nt, Human
cccaggaguuuggcc

SEQ ID NO: 3015870 - RNA, 16 nt, Human
cccaggaguuuggcca

SEQ ID NO: 3015871 - RNA, 11 nt, Human
cccaggcaggu

SEQ ID NO: 3015872 - RNA, 13 nt, Human
cccaggcaggucu

SEQ ID NO: 3015873 - RNA, 21 nt, Human
cccaggagccccgaggccuuc

SEQ ID NO: 3015874 - RNA, 18 nt, Human
cccaggagccccgaggcc

SEQ ID NO: 3015875 - RNA, 22 nt, Human
cccaggaggccagccuugacca

SEQ ID NO: 3015876 - RNA, 13 nt, Human
cccaggaggccag

SEQ ID NO: 3015877 - RNA, 17 nt, Human
cccaggcaggucuugaa

SEQ ID NO: 3015878 - RNA, 18 nt, Human
cccaggcauuccccagga

SEQ ID NO: 3015879 - RNA, 21 nt, Human
cccaggcauuccccaggaggc

SEQ ID NO: 3015880 - RNA, 20 nt, Human
cccaggcauuccccaggagg

SEQ ID NO: 3015881 - RNA, 23 nt, Human
cccaggcauuccccaggaggcca

SEQ ID NO: 3015882 - RNA, 22 nt, Human
cccaggcauuccccaggaggcc

SEQ ID NO: 3015883 - RNA, 11 nt, Human
cccaggccccu

SEQ ID NO: 3015884 - RNA, 16 nt, Human
cccaggccccugccac

SEQ ID NO: 3015885 - RNA, 18 nt, Human
cccaggccccugccaccc

SEQ ID NO: 3015886 - RNA, 21 nt, Human
cccaggccccugccacccugg

SEQ ID NO: 3015887 - RNA, 22 nt, Human
cccaggccccugccacccuggg

SEQ ID NO: 3015888 - RNA, 18 nt, Human
cccaggccuccuacagcu

SEQ ID NO: 3015889 - RNA, 17 nt, Human
cccaggccuccuacagc

SEQ ID NO: 3015890 - RNA, 20 nt, Human
cccagucuggaaugcagugg

SEQ ID NO: 3015891 - RNA, 13 nt, Human
cccagugcccaca

SEQ ID NO: 3015892 - RNA, 23 nt, Human
cccaggugcuaggaacacuccuu

SEQ ID NO: 3015893 - RNA, 22 nt, Human
cccaggugcuaggaacacuccu

SEQ ID NO: 3015894 - RNA, 11 nt, Human
cccagccccuu

SEQ ID NO: 3015895 - RNA, 19 nt, Human
cccagcaagugagagcugg

SEQ ID NO: 3015896 - RNA, 20 nt, Human
cccagcaagugagagcuggg

SEQ ID NO: 3015897 - RNA, 21 nt, Human
cccagcaagugagagcugggu

SEQ ID NO: 3015898 - RNA, 22 nt, Human
cccagcaagugagagcugggug

SEQ ID NO: 3015899 - RNA, 12 nt, Human
cccagccugcua

SEQ ID NO: 3015900 - RNA, 19 nt, Human
cccagcgagcccugguggc

SEQ ID NO: 3015901 - RNA, 23 nt, Human
cccagcgagcccugguggcagug

SEQ ID NO: 3015902 - RNA, 17 nt, Human
cccagcgagcccuggug

SEQ ID NO: 3015903 - RNA, 18 nt, Human
cccagcgagcccuggugg

SEQ ID NO: 3015904 - RNA, 15 nt, Human
cccagcgagcccugg

SEQ ID NO: 3015905 - RNA, 18 nt, Human
cccagagggccugcaagg

SEQ ID NO: 3015906 - RNA, 20 nt, Human
cccagagggccugcaaggga

SEQ ID NO: 3015907 - RNA, 20 nt, Human
cccagauugcaacaggcugg

SEQ ID NO: 3015908 - RNA, 21 nt, Human
cccagauugcaacaggcuggg

SEQ ID NO: 3015909 - RNA, 22 nt, Human
cccagauugcaacaggcugggc

SEQ ID NO: 3015910 - RNA, 16 nt, Human
cccagcaagugagagc

SEQ ID NO: 3015911 - RNA, 18 nt, Human
cccagcaagugagagcug

SEQ ID NO: 3015912 - RNA, 23 nt, Human
cccaagggccuggccugagcugg

SEQ ID NO: 3015913 - RNA, 19 nt, Human
cccaagggccuggccugag

SEQ ID NO: 3015914 - RNA, 18 nt, Human
cccaagggccuggccuga

SEQ ID NO: 3015915 - RNA, 17 nt, Human
cccaagggccuggccug

SEQ ID NO: 3015916 - RNA, 23 nt, Human
cccaaauggaaaugggcagagca

SEQ ID NO: 3015917 - RNA, 23 nt, Human
cccaaugcacuuuguucuggcuc

SEQ ID NO: 3015918 - RNA, 13 nt, Human
cccauucugccug

SEQ ID NO: 3015919 - RNA, 22 nt, Human
ccccaaauggaaaugggcagag

SEQ ID NO: 3015920 - RNA, 20 nt, Human
ccccacccaagggccuggcc

SEQ ID NO: 3015921 - RNA, 14 nt, Human
ccccacccaagggc

SEQ ID NO: 3015922 - RNA, 15 nt, Human
cccagugcccacagg

SEQ ID NO: 3015923 - RNA, 20 nt, Human
cccagugcccacaggaucag

SEQ ID NO: 3015924 - RNA, 17 nt, Human
cccagugccgagaagga

SEQ ID NO: 3015925 - RNA, 18 nt, Human
cccagugccgagaaggaa

SEQ ID NO: 3015926 - RNA, 16 nt, Human
cccaugcugcccugug

SEQ ID NO: 3015927 - RNA, 15 nt, Human
cccaugcugcccugu

SEQ ID NO: 3015928 - RNA, 18 nt, Human
cccaugcugcccugugag

SEQ ID NO: 3015929 - RNA, 17 nt, Human
cccaugcugcccuguga

SEQ ID NO: 3015930 - RNA, 17 nt, Human
ccccaggaggccagccu

SEQ ID NO: 3015931 - RNA, 16 nt, Human
ccauucuccaccugcc

SEQ ID NO: 3015932 - RNA, 15 nt, Human
ccauucuccaccugc

SEQ ID NO: 3015933 - RNA, 14 nt, Human
ccauggacuuuguu

SEQ ID NO: 3015934 - RNA, 13 nt, Human
ccauggacuuugu

SEQ ID NO: 3015935 - RNA, 21 nt, Human
ccauucugccugcccaggccc

SEQ ID NO: 3015936 - RNA, 14 nt, Human
ccauucuccaccug

SEQ ID NO: 3015937 - RNA, 19 nt, Human
ccauucugccugcccaggc

SEQ ID NO: 3015938 - RNA, 20 nt, Human
ccauucugccugcccaggcc

SEQ ID NO: 3015939 - RNA, 16 nt, Human
ccauucugccugccca

SEQ ID NO: 3015940 - RNA, 17 nt, Human
ccauucuccaccugcca

SEQ ID NO: 3015941 - RNA, 17 nt, Human
ccauucugccugcccag

SEQ ID NO: 3015942 - RNA, 18 nt, Human
ccauucugccugcccagg

SEQ ID NO: 3015943 - RNA, 16 nt, Human
cccaaagcagugcaug

SEQ ID NO: 3015944 - RNA, 15 nt, Human
cccaaagaugcagcc

SEQ ID NO: 3015945 - RNA, 12 nt, Human
cccaaagaugca

SEQ ID NO: 3015946 - RNA, 22 nt, Human
ccauuuugggguacccacugcu

SEQ ID NO: 3015947 - RNA, 20 nt, Human
ccauuuugggguacccacug

SEQ ID NO: 3015948 - RNA, 23 nt, Human
ccauuuuggauucuuauggacaa

SEQ ID NO: 3015949 - RNA, 20 nt, Human
cccaaaacucuccucugcug

SEQ ID NO: 3015950 - RNA, 13 nt, Human
ccaugcugcccug

SEQ ID NO: 3015951 - RNA, 11 nt, Human
ccaugcugccc

SEQ ID NO: 3015952 - RNA, 14 nt, Human
ccaugcugcccugu

SEQ ID NO: 3015953 - RNA, 18 nt, Human
ccaugauguuuuccauga

SEQ ID NO: 3015954 - RNA, 21 nt, Human
ccaugauuaaccacuucagcu

SEQ ID NO: 3015955 - RNA, 19 nt, Human
ccaugauuaaccacuucag

SEQ ID NO: 3015956 - RNA, 22 nt, Human
ccaucauugaaaucuuuuugcu

SEQ ID NO: 3015957 - RNA, 19 nt, Human
ccauccucuguacagagcc

SEQ ID NO: 3015958 - RNA, 12 nt, Human
ccauccucugua

SEQ ID NO: 3015959 - RNA, 19 nt, Human
ccagugaggcucugcccuu

SEQ ID NO: 3015960 - RNA, 18 nt, Human
ccagugaggcucugcccu

SEQ ID NO: 3015961 - RNA, 20 nt, Human
ccagugaggcucugcccuug

SEQ ID NO: 3015962 - RNA, 17 nt, Human
ccagugaggcucugccc

SEQ ID NO: 3015963 - RNA, 13 nt, Human
ccaucaccagaca

SEQ ID NO: 3015964 - RNA, 20 nt, Human
ccauccucuguacagagccc

SEQ ID NO: 3015965 - RNA, 11 nt, Human
ccagcucuggu

SEQ ID NO: 3015966 - RNA, 13 nt, Human
ccagcucuggucc

SEQ ID NO: 3015967 - RNA, 12 nt, Human
ccagcucugguc

SEQ ID NO: 3015968 - RNA, 14 nt, Human
ccagcgagcccugg

SEQ ID NO: 3015969 - RNA, 22 nt, Human
ccagccuugaccauucuccacc

SEQ ID NO: 3015970 - RNA, 13 nt, Human
ccagcgagcccug

SEQ ID NO: 3015971 - RNA, 15 nt, Human
ccagcgagcccuggu

SEQ ID NO: 3015972 - RNA, 16 nt, Human
ccagcgagcccuggug

SEQ ID NO: 3015973 - RNA, 22 nt, Human
ccagagcccaccuuggcucaag

SEQ ID NO: 3015974 - RNA, 16 nt, Human
ccagagcccaccuugg

SEQ ID NO: 3015975 - RNA, 20 nt, Human
ccagccuugaccauucucca

SEQ ID NO: 3015976 - RNA, 19 nt, Human
ccagccuugaccauucucc

SEQ ID NO: 3015977 - RNA, 23 nt, Human
ccagcugcuugggcuucauccuc

SEQ ID NO: 3015978 - RNA, 20 nt, Human
ccagcugcuugggcuucauc

SEQ ID NO: 3015979 - RNA, 22 nt, Human
ccagcucugguccauagagagc

SEQ ID NO: 3015980 - RNA, 21 nt, Human
ccagcucugguccauagagag

SEQ ID NO: 3015981 - RNA, 17 nt, Human
ccagcucugguccauag

SEQ ID NO: 3015982 - RNA, 14 nt, Human
ccagcucuggucca

SEQ ID NO: 3015983 - RNA, 22 nt, Human
ccaggaagccagcaggcucuca

SEQ ID NO: 3015984 - RNA, 20 nt, Human
ccaggaagccagcaggcucu

SEQ ID NO: 3015985 - RNA, 13 nt, Human
ccaggaggccagc

SEQ ID NO: 3015986 - RNA, 12 nt, Human
ccaggaggccag

SEQ ID NO: 3015987 - RNA, 12 nt, Human
ccaggagccucc

SEQ ID NO: 3015988 - RNA, 18 nt, Human
ccaggagccuccugcccu

SEQ ID NO: 3015989 - RNA, 14 nt, Human
ccaggagccuccug

SEQ ID NO: 3015990 - RNA, 13 nt, Human
ccaggagccuccu

SEQ ID NO: 3015991 - RNA, 22 nt, Human
ccaggcauuccccaggaggcca

SEQ ID NO: 3015992 - RNA, 23 nt, Human
ccaggcauuccccaggaggccag

SEQ ID NO: 3015993 - RNA, 24 nt, Human
ccaggcauuccccaggaggccagc

SEQ ID NO: 3015994 - RNA, 14 nt, Human
ccaggcauucccca

SEQ ID NO: 3015995 - RNA, 13 nt, Human
ccaggcauggugg

SEQ ID NO: 3015996 - RNA, 15 nt, Human
ccaggagccccgagg

SEQ ID NO: 3015997 - RNA, 16 nt, Human
ccaggagcagccacau

SEQ ID NO: 3015998 - RNA, 15 nt, Human
ccaggagcagccaca

SEQ ID NO: 3015999 - RNA, 20 nt, Human
ccaggcuguaucccaugagc

SEQ ID NO: 3016000 - RNA, 14 nt, Human
ccaggcuggucuca

SEQ ID NO: 3016001 - RNA, 19 nt, Human
ccaggcuggucucaaacuc

SEQ ID NO: 3016002 - RNA, 13 nt, Human
ccaggccccugcc

SEQ ID NO: 3016003 - RNA, 23 nt, Human
ccaguaaaugggggugcauuuga

SEQ ID NO: 3016004 - RNA, 14 nt, Human
ccagguucagcuug

SEQ ID NO: 3016005 - RNA, 19 nt, Human
ccaggugcuaggaacacuc

SEQ ID NO: 3016006 - RNA, 23 nt, Human
cacaguguguggucaacauuucu

SEQ ID NO: 3016007 - RNA, 17 nt, Human
cacaguucaauucucau

SEQ ID NO: 3016008 - RNA, 19 nt, Human
caaggcuuagacccucaug

SEQ ID NO: 3016009 - RNA, 22 nt, Human
caaggcuuagacccucaugcug

SEQ ID NO: 3016010 - RNA, 21 nt, Human
caauauccuaauaaaaaggug

SEQ ID NO: 3016011 - RNA, 15 nt, Human
caauaggaaaaacug

SEQ ID NO: 3016012 - RNA, 17 nt, Human
caauaggaaaaacugau

SEQ ID NO: 3016013 - RNA, 16 nt, Human
caauaggaaaaacuga

SEQ ID NO: 3016014 - RNA, 18 nt, Human
caauaacuggaacacucu

SEQ ID NO: 3016015 - RNA, 18 nt, Human
caagcgauucuucugcuu

SEQ ID NO: 3016016 - RNA, 21 nt, Human
caagcugcacccucaggcagg

SEQ ID NO: 3016017 - RNA, 15 nt, Human
caagcgauucuucug

SEQ ID NO: 3016018 - RNA, 17 nt, Human
caagcgauucuucugcu

SEQ ID NO: 3016019 - RNA, 21 nt, Human
caagcuggucccacucagucc

SEQ ID NO: 3016020 - RNA, 22 nt, Human
caagcugcacccucaggcaggu

SEQ ID NO: 3016021 - RNA, 20 nt, Human
caagcugcacccucaggcag

SEQ ID NO: 3016022 - RNA, 16 nt, Human
caaggagauuuacaac

SEQ ID NO: 3016023 - RNA, 19 nt, Human
caaggauccugagccagau

SEQ ID NO: 3016024 - RNA, 18 nt, Human
caaggauccugagccaga

SEQ ID NO: 3016025 - RNA, 20 nt, Human
caaggauccugagccagauu

SEQ ID NO: 3016026 - RNA, 22 nt, Human
caaggcugcagugagccgagau

SEQ ID NO: 3016027 - RNA, 17 nt, Human
caaggcugcagugagcc

SEQ ID NO: 3016028 - RNA, 22 nt, Human
caagcuggucccacucagucca

SEQ ID NO: 3016029 - RNA, 23 nt, Human
caagcuggucccacucaguccau

SEQ ID NO: 3016030 - RNA, 13 nt, Human
cacaaagcuuuug

SEQ ID NO: 3016031 - RNA, 16 nt, Human
cacaaagcuuuugcau

SEQ ID NO: 3016032 - RNA, 13 nt, Human
cacaaaggagagc

SEQ ID NO: 3016033 - RNA, 17 nt, Human
cacacacgcgugcacac

SEQ ID NO: 3016034 - RNA, 22 nt, Human
caauauccuaauaaaaagguga

SEQ ID NO: 3016035 - RNA, 19 nt, Human
caaugugaaaagaaaaaug

SEQ ID NO: 3016036 - RNA, 22 nt, Human
caaugugaaaagaaaaaugagc

SEQ ID NO: 3016037 - RNA, 17 nt, Human
caauuacaggaaguacu

SEQ ID NO: 3016038 - RNA, 14 nt, Human
caauguucucucuu

SEQ ID NO: 3016039 - RNA, 13 nt, Human
cacaaacagaggc

SEQ ID NO: 3016040 - RNA, 14 nt, Human
cacaaacagaggcc

SEQ ID NO: 3016041 - RNA, 18 nt, Human
caauuacaggaaguacug

SEQ ID NO: 3016042 - RNA, 23 nt, Human
cacagaugggugcuuggaggaag

SEQ ID NO: 3016043 - RNA, 21 nt, Human
cacagaguuguuacauuuuua

SEQ ID NO: 3016044 - RNA, 22 nt, Human
cacagaguuguuacauuuuuaa

SEQ ID NO: 3016045 - RNA, 13 nt, Human
cacagaggcugcc

SEQ ID NO: 3016046 - RNA, 19 nt, Human
cacagagaaaguacuucuc

SEQ ID NO: 3016047 - RNA, 20 nt, Human
cacagagaaaguacuucucc

SEQ ID NO: 3016048 - RNA, 12 nt, Human
cacagagaaagu

SEQ ID NO: 3016049 - RNA, 21 nt, Human
cacagcucuucuccaggcugu

SEQ ID NO: 3016050 - RNA, 22 nt, Human
caaauggaaaugggcagagcag

SEQ ID NO: 3016051 - RNA, 23 nt, Human
caaauggaaaugggcagagcaga

SEQ ID NO: 3016052 - RNA, 13 nt, Human
caaagugcuggga

SEQ ID NO: 3016053 - RNA, 19 nt, Human
caaagugcugggauuacaa

SEQ ID NO: 3016054 - RNA, 19 nt, Human
caaaguggugagaggcauc

SEQ ID NO: 3016055 - RNA, 23 nt, Human
caaagugcugggauuacaagcgu

SEQ ID NO: 3016056 - RNA, 15 nt, Human
caaauuucuaaaucu

SEQ ID NO: 3016057 - RNA, 22 nt, Human
caaauuucuaaaucuccaaaau

SEQ ID NO: 3016058 - RNA, 20 nt, Human
caacauacucccaucuguga

SEQ ID NO: 3016059 - RNA, 12 nt, Human
caacaggcuggg

SEQ ID NO: 3016060 - RNA, 19 nt, Human
caacauacucccaucugug

SEQ ID NO: 3016061 - RNA, 17 nt, Human
caacauacucccaucug

SEQ ID NO: 3016062 - RNA, 15 nt, Human
caagacgcugugcug

SEQ ID NO: 3016063 - RNA, 13 nt, Human
caagacgcugugc

SEQ ID NO: 3016064 - RNA, 23 nt, Human
caagaccuucuccuucaccuuug

SEQ ID NO: 3016065 - RNA, 21 nt, Human
caagaccuucuccuucaccuu

SEQ ID NO: 3016066 - RNA, 13 nt, Human
caagaagcccagg

SEQ ID NO: 3016067 - RNA, 16 nt, Human
caaaacucuccucugc

SEQ ID NO: 3016068 - RNA, 15 nt, Human
caaaacucuccucug

SEQ ID NO: 3016069 - RNA, 18 nt, Human
auuuuauuuuauuaugca

SEQ ID NO: 3016070 - RNA, 21 nt, Human
caaaacgguuuuacugcagcu

SEQ ID NO: 3016071 - RNA, 15 nt, Human
caaaacgguuuuacu

SEQ ID NO: 3016072 - RNA, 14 nt, Human
caaaaguuucucuu

SEQ ID NO: 3016073 - RNA, 23 nt, Human
caaaacucuccucugcugcuggc

SEQ ID NO: 3016074 - RNA, 21 nt, Human
caaaaucgaugcagugcuucc

SEQ ID NO: 3016075 - RNA, 14 nt, Human
caaaauaaaacuuu

SEQ ID NO: 3016076 - RNA, 16 nt, Human
caaaauaaaacuuuuu

SEQ ID NO: 3016077 - RNA, 20 nt, Human
caaaauaaaacuuuuuaaaa

SEQ ID NO: 3016078 - RNA, 22 nt, Human
caaaaugaaacgcaaccaccac

SEQ ID NO: 3016079 - RNA, 11 nt, Human
caaaaugaaac

SEQ ID NO: 3016080 - RNA, 13 nt, Human
caaacagaggccg

SEQ ID NO: 3016081 - RNA, 17 nt, Human
caaacucuugaccucag

SEQ ID NO: 3016082 - RNA, 19 nt, Human
caaacucuugaccucaggu

SEQ ID NO: 3016083 - RNA, 20 nt, Human
caaacucuugaccucaggug

SEQ ID NO: 3016084 - RNA, 21 nt, Human
caaacucuugaccucagguga

SEQ ID NO: 3016085 - RNA, 17 nt, Human
accaagaauugauuggg

SEQ ID NO: 3016086 - RNA, 17 nt, Human
acauuucucauguugaa

SEQ ID NO: 3016087 - RNA, 20 nt, Human
accagccccagugcccacag

SEQ ID NO: 3016088 - RNA, 18 nt, Human
accagccccagugcccac

SEQ ID NO: 3016089 - RNA, 19 nt, Human
accagccccagugcccaca

SEQ ID NO: 3016090 - RNA, 16 nt, Human
accagccccagugccc

SEQ ID NO: 3016091 - RNA, 17 nt, Human
accagccccagugccca

SEQ ID NO: 3016092 - RNA, 14 nt, Human
accagcagaaaugc

SEQ ID NO: 3016093 - RNA, 13 nt, Human
accagcagagcac

SEQ ID NO: 3016094 - RNA, 12 nt, Human
accagcagagca

SEQ ID NO: 3016095 - RNA, 19 nt, Human
acaugccuaccaauauuua

SEQ ID NO: 3016096 - RNA, 18 nt, Human
acaugccuaccaauauuu

SEQ ID NO: 3016097 - RNA, 19 nt, Human
acaugccucucucaggcca

SEQ ID NO: 3016098 - RNA, 23 nt, Human
acaugucuuuucuugcaugaggc

SEQ ID NO: 3016099 - RNA, 15 nt, Human
accaucaagccacca

SEQ ID NO: 3016100 - RNA, 12 nt, Human
accaucauugaa

SEQ ID NO: 3016101 - RNA, 15 nt, Human
accaucauugaaauc

SEQ ID NO: 3016102 - RNA, 23 nt, Human
accaucauugaaaucuuuuugcu

SEQ ID NO: 3016103 - RNA, 14 nt, Human
accaucaagccacc

SEQ ID NO: 3016104 - RNA, 13 nt, Human
acccaugcugccc

SEQ ID NO: 3016105 - RNA, 15 nt, Human
acccacccuccuuuc

SEQ ID NO: 3016106 - RNA, 17 nt, Human
acccacccccacccaag

SEQ ID NO: 3016107 - RNA, 15 nt, Human
acccacccccaccca

SEQ ID NO: 3016108 - RNA, 14 nt, Human
acaugccuaccaau

SEQ ID NO: 3016109 - RNA, 17 nt, Human
acaugcaaggucauuuu

SEQ ID NO: 3016110 - RNA, 18 nt, Human
acaugccucucucaggcc

SEQ ID NO: 3016111 - RNA, 17 nt, Human
acaugccucucucaggc

SEQ ID NO: 3016112 - RNA, 16 nt, Human
acaugccucucucagg

SEQ ID NO: 3016113 - RNA, 15 nt, Human
acaugccucucucag

SEQ ID NO: 3016114 - RNA, 16 nt, Human
acaugcaaggucauuu

SEQ ID NO: 3016115 - RNA, 15 nt, Human
acauaagauaaaugu

SEQ ID NO: 3016116 - RNA, 16 nt, Human
acauaagauaaaugug

SEQ ID NO: 3016117 - RNA, 23 nt, Human
acagugagucgaggacagggagg

SEQ ID NO: 3016118 - RNA, 22 nt, Human
acagugagucgaggacagggag

SEQ ID NO: 3016119 - RNA, 19 nt, Human
acaggugugaaccaccaca

SEQ ID NO: 3016120 - RNA, 22 nt, Human
acaggugugagucaccaagccc

SEQ ID NO: 3016121 - RNA, 23 nt, Human
acaggugugagucaccaagccca

SEQ ID NO: 3016122 - RNA, 14 nt, Human
acaggcaaugcugg

SEQ ID NO: 3016123 - RNA, 19 nt, Human
acaggcaagcaccuccugc

SEQ ID NO: 3016124 - RNA, 20 nt, Human
acaggcaagcaccuccugcc

SEQ ID NO: 3016125 - RNA, 23 nt, Human
acaggcaagcaccuccugccucg

SEQ ID NO: 3016126 - RNA, 13 nt, Human
acagcucuguccu

SEQ ID NO: 3016127 - RNA, 16 nt, Human
acagcucuguccuggg

SEQ ID NO: 3016128 - RNA, 17 nt, Human
acagcucuguccuggga

SEQ ID NO: 3016129 - RNA, 15 nt, Human
acagcuccuucuguc

SEQ ID NO: 3016130 - RNA, 19 nt, Human
acagaggggguggccuccc

SEQ ID NO: 3016131 - RNA, 18 nt, Human
acagaggggguggccucc

SEQ ID NO: 3016132 - RNA, 17 nt, Human
acagaggggguggccuc

SEQ ID NO: 3016133 - RNA, 16 nt, Human
acagcuccuucugucc

SEQ ID NO: 3016134 - RNA, 18 nt, Human
acagcuccuucuguccua

SEQ ID NO: 3016135 - RNA, 23 nt, Human
acagcuccuucuguccuacucug

SEQ ID NO: 3016136 - RNA, 14 nt, Human
acagcucuguccug

SEQ ID NO: 3016137 - RNA, 13 nt, Human
acaauuuauuaug

SEQ ID NO: 3016138 - RNA, 16 nt, Human
acaaggauugcuacug

SEQ ID NO: 3016139 - RNA, 20 nt, Human
acaaggaugaucuaggaaga

SEQ ID NO: 3016140 - RNA, 19 nt, Human
acacagcucuucuccaggc

SEQ ID NO: 3016141 - RNA, 19 nt, Human
acacaaaaguuucucuuuu

SEQ ID NO: 3016142 - RNA, 20 nt, Human
acacagcucuucuccaggcu

SEQ ID NO: 3016143 - RNA, 21 nt, Human
acacagcucuucuccaggcug

SEQ ID NO: 3016144 - RNA, 14 nt, Human
acacauuuuuuaaa

SEQ ID NO: 3016145 - RNA, 16 nt, Human
acacauuuuuuaaaug

SEQ ID NO: 3016146 - RNA, 18 nt, Human
acacauuuuuuaaaugca

SEQ ID NO: 3016147 - RNA, 14 nt, Human
acaccacuacauuc

SEQ ID NO: 3016148 - RNA, 15 nt, Human
acaccacuacauucu

SEQ ID NO: 3016149 - RNA, 14 nt, Human
acacgaauauugcu

SEQ ID NO: 3016150 - RNA, 12 nt, Human
acacgaauauug

SEQ ID NO: 3016151 - RNA, 17 nt, Human
acaccacuacauucugu

SEQ ID NO: 3016152 - RNA, 20 nt, Human
acaccacuacauucuguuaa

SEQ ID NO: 3016153 - RNA, 21 nt, Human
acacgaauauugcugauggug

SEQ ID NO: 3016154 - RNA, 15 nt, Human
acacgaauauugcug

SEQ ID NO: 3016155 - RNA, 22 nt, Human
acacugugcugagucugaaggc

SEQ ID NO: 3016156 - RNA, 17 nt, Human
acacugugcugagucug

SEQ ID NO: 3016157 - RNA, 13 nt, Human
acagaggcagccc

SEQ ID NO: 3016158 - RNA, 23 nt, Human
acagaggcagccccauucugccu

SEQ ID NO: 3016159 - RNA, 17 nt, Human
acagaggccaugggccu

SEQ ID NO: 3016160 - RNA, 14 nt, Human
acagaggggguggc

SEQ ID NO: 3016161 - RNA, 21 nt, Human
acagaggccaugggccuccug

SEQ ID NO: 3016162 - RNA, 13 nt, Human
acagacaaagcgu

SEQ ID NO: 3016163 - RNA, 14 nt, Human
acagacaaagcgug

SEQ ID NO: 3016164 - RNA, 22 nt, Human
acaaaaugaaacgcaaccacca

SEQ ID NO: 3016165 - RNA, 13 nt, Human
acaaaaugaaacg

SEQ ID NO: 3016166 - RNA, 14 nt, Human
aauuuugauguuuu

SEQ ID NO: 3016167 - RNA, 16 nt, Human
aauuuugugcccccau

SEQ ID NO: 3016168 - RNA, 20 nt, Human
aauuuauuuaugggauccug

SEQ ID NO: 3016169 - RNA, 17 nt, Human
aauuuauuauggcacau

SEQ ID NO: 3016170 - RNA, 16 nt, Human
aauuguaaggaaugau

SEQ ID NO: 3016171 - RNA, 12 nt, Human
aauuguaaggaa

SEQ ID NO: 3016172 - RNA, 16 nt, Human
aaugucacaggcaggu

SEQ ID NO: 3016173 - RNA, 19 nt, Human
aaugucacaggcaggucca

SEQ ID NO: 3016174 - RNA, 17 nt, Human
acuucuuauacauuuga

SEQ ID NO: 3016175 - RNA, 18 nt, Human
acuucuuauacauuugau

SEQ ID NO: 3016176 - RNA, 19 nt, Human
acuucugccauauucuguu

SEQ ID NO: 3016177 - RNA, 20 nt, Human
acuucugccauauucuguug

SEQ ID NO: 3016178 - RNA, 14 nt, Human
acuuaaauaaugug

SEQ ID NO: 3016179 - RNA, 22 nt, Human
acugcccggcaggguccuagaa

SEQ ID NO: 3016180 - RNA, 14 nt, Human
acugcuuuuggucu

SEQ ID NO: 3016181 - RNA, 15 nt, Human
acugcuuuuggucug

SEQ ID NO: 3016182 - RNA, 16 nt, Human
acugcuuuuggucugu

SEQ ID NO: 3016183 - RNA, 20 nt, Human
acugcuuuuggucuguguga

SEQ ID NO: 3016184 - RNA, 15 nt, Human
acugcccggcagggu

SEQ ID NO: 3016185 - RNA, 12 nt, Human
acugaugggcaa

SEQ ID NO: 3016186 - RNA, 22 nt, Human
acugaugggcaacccccagccu

SEQ ID NO: 3016187 - RNA, 22 nt, Human
acugauggcuaauguacugcau

SEQ ID NO: 3016188 - RNA, 13 nt, Human
acugaucucucgu

SEQ ID NO: 3016189 - RNA, 22 nt, Human
acugacauuguuggccaaagcc

SEQ ID NO: 3016190 - RNA, 23 nt, Human
acugacauuguuggccaaagcca

SEQ ID NO: 3016191 - RNA, 22 nt, Human
acugauuuuuuuuuccuucagu

SEQ ID NO: 3016192 - RNA, 21 nt, Human
acugauuuuuuuuuccuucag

SEQ ID NO: 3016193 - RNA, 23 nt, Human
acugauuuuuuuuuccuucagug

SEQ ID NO: 3016194 - RNA, 16 nt, Human
acucuaccugcacacu

SEQ ID NO: 3016195 - RNA, 19 nt, Human
acucugucucaaaaaaaca

SEQ ID NO: 3016196 - RNA, 21 nt, Human
acucugugucagguggggcag

SEQ ID NO: 3016197 - RNA, 19 nt, Human
acucugugucagguggggc

SEQ ID NO: 3016198 - RNA, 15 nt, Human
accgggccacagaga

SEQ ID NO: 3016199 - RNA, 19 nt, Human
accgggccacagagaaagu

SEQ ID NO: 3016200 - RNA, 14 nt, Human
accgugaggccaga

SEQ ID NO: 3016201 - RNA, 15 nt, Human
accggcuggccuggc

SEQ ID NO: 3016202 - RNA, 14 nt, Human
accggcuggccugg

SEQ ID NO: 3016203 - RNA, 20 nt, Human
accgggcacucagaagacac

SEQ ID NO: 3016204 - RNA, 19 nt, Human
accggcuggccuggccccu

SEQ ID NO: 3016205 - RNA, 18 nt, Human
accggcuggccuggcccc

SEQ ID NO: 3016206 - RNA, 17 nt, Human
accggcuggccuggccc

SEQ ID NO: 3016207 - RNA, 17 nt, Human
acccuguuaccauuuug

SEQ ID NO: 3016208 - RNA, 15 nt, Human
acccaugcugcccug

SEQ ID NO: 3016209 - RNA, 14 nt, Human
acccaugcugcccu

SEQ ID NO: 3016210 - RNA, 16 nt, Human
accccacacacgccag

SEQ ID NO: 3016211 - RNA, 22 nt, Human
acccugugauggggcccugccu

SEQ ID NO: 3016212 - RNA, 18 nt, Human
accucaggugagaagcag

SEQ ID NO: 3016213 - RNA, 22 nt, Human
accucaggccugggggcugggc

SEQ ID NO: 3016214 - RNA, 14 nt, Human
accucaggccuggg

SEQ ID NO: 3016215 - RNA, 13 nt, Human
accucaggccugg

SEQ ID NO: 3016216 - RNA, 12 nt, Human
accucaggccug

SEQ ID NO: 3016217 - RNA, 17 nt, Human
accgugaggccagagac

SEQ ID NO: 3016218 - RNA, 16 nt, Human
accgugaggccagaga

SEQ ID NO: 3016219 - RNA, 18 nt, Human
accugccagggacagagg

SEQ ID NO: 3016220 - RNA, 16 nt, Human
accugccagggacaga

SEQ ID NO: 3016221 - RNA, 15 nt, Human
accugccagggacag

SEQ ID NO: 3016222 - RNA, 13 nt, Human
accugccagggac

SEQ ID NO: 3016223 - RNA, 12 nt, Human
accugccaggga

SEQ ID NO: 3016224 - RNA, 11 nt, Human
accugccaggg

SEQ ID NO: 3016225 - RNA, 17 nt, Human
accucuugagccuugaa

SEQ ID NO: 3016226 - RNA, 19 nt, Human
accucuugagccuugaacu

SEQ ID NO: 3016227 - RNA, 20 nt, Human
accucuugagccuugaacuu

SEQ ID NO: 3016228 - RNA, 21 nt, Human
accucuugagccuugaacuuu

SEQ ID NO: 3016229 - RNA, 17 nt, Human
acuagggaagauaauau

SEQ ID NO: 3016230 - RNA, 16 nt, Human
acuauuguuagucucu

SEQ ID NO: 3016231 - RNA, 11 nt, Human
accugugucuc

SEQ ID NO: 3016232 - RNA, 15 nt, Human
acuaauagacaauuu

SEQ ID NO: 3016233 - RNA, 15 nt, Human
acgucugacaggcaa

SEQ ID NO: 3016234 - RNA, 23 nt, Human
acgucugacaggcaaugcuggcu

SEQ ID NO: 3016235 - RNA, 19 nt, Human
acgcuggagugcagugagc

SEQ ID NO: 3016236 - RNA, 18 nt, Human
acgcuggagugcagugag

SEQ ID NO: 3016237 - RNA, 16 nt, Human
acggaagagccuugcg

SEQ ID NO: 3016238 - RNA, 15 nt, Human
acggaagagccuugc

SEQ ID NO: 3016239 - RNA, 19 nt, Human
acggacacucaaaagcugg

SEQ ID NO: 3016240 - RNA, 12 nt, Human
aaagugcccagc

SEQ ID NO: 3016241 - RNA, 11 nt, Human
aaauaaauuau

SEQ ID NO: 3016242 - RNA, 14 nt, Human
aaaggcuccaggag

SEQ ID NO: 3016243 - RNA, 17 nt, Human
aaaggcuaccuuuguau

SEQ ID NO: 3016244 - RNA, 14 nt, Human
aaaggcuaccuuug

SEQ ID NO: 3016245 - RNA, 21 nt, Human
aaaggcuccaggagcagccac

SEQ ID NO: 3016246 - RNA, 22 nt, Human
aaaggcuccaggagcagccaca

SEQ ID NO: 3016247 - RNA, 15 nt, Human
aaagccaaagcuagg

SEQ ID NO: 3016248 - RNA, 19 nt, Human
aaacugauuuuuuuuuccu

SEQ ID NO: 3016249 - RNA, 13 nt, Human
aaacugauuuuuu

SEQ ID NO: 3016250 - RNA, 20 nt, Human
aaacugauuuuuuuuuccuu

SEQ ID NO: 3016251 - RNA, 14 nt, Human
aaacccuucagugc

SEQ ID NO: 3016252 - RNA, 17 nt, Human
aaacucuugaccucagg

SEQ ID NO: 3016253 - RNA, 18 nt, Human
aaacccagcucuggucca

SEQ ID NO: 3016254 - RNA, 17 nt, Human
aaaccccaucucuacaa

SEQ ID NO: 3016255 - RNA, 15 nt, Human
aaagauacaguuacu

SEQ ID NO: 3016256 - RNA, 15 nt, Human
aaaauuagccaagug

SEQ ID NO: 3016257 - RNA, 17 nt, Human
aaacagcuaaugggaca

SEQ ID NO: 3016258 - RNA, 17 nt, Human
aacagcaacacaaagcu

SEQ ID NO: 3016259 - RNA, 16 nt, Human
aacagcuaaugggaca

SEQ ID NO: 3016260 - RNA, 20 nt, Human
aacaugcuguacauacuuuu

SEQ ID NO: 3016261 - RNA, 19 nt, Human
aacaugcuguacauacuuu

SEQ ID NO: 3016262 - RNA, 18 nt, Human
aacaugcuguacauacuu

SEQ ID NO: 3016263 - RNA, 21 nt, Human
aacaugcuguacauacuuuuu

SEQ ID NO: 3016264 - RNA, 22 nt, Human
aacaugcuacacacugcauguu

SEQ ID NO: 3016265 - RNA, 15 nt, Human
aacauggaaguacua

SEQ ID NO: 3016266 - RNA, 13 nt, Human
aacccuucagugc

SEQ ID NO: 3016267 - RNA, 19 nt, Human
aaccaguguuguggauuua

SEQ ID NO: 3016268 - RNA, 17 nt, Human
aaccaguguuguggauu

SEQ ID NO: 3016269 - RNA, 18 nt, Human
aacugaaguucuauuuau

SEQ ID NO: 3016270 - RNA, 17 nt, Human
aacucaaacucuuaaaa

SEQ ID NO: 3016271 - RNA, 17 nt, Human
aacucaccccagcccca

SEQ ID NO: 3016272 - RNA, 16 nt, Human
aacucaccccagcccc

SEQ ID NO: 3016273 - RNA, 18 nt, Human
aacucaccccagccccaa

SEQ ID NO: 3016274 - RNA, 15 nt, Human
aacucaccccagccc

SEQ ID NO: 3016275 - RNA, 12 nt, Human
aaauuaacuuuu

SEQ ID NO: 3016276 - RNA, 13 nt, Human
aaauuaacuuuua

SEQ ID NO: 3016277 - RNA, 14 nt, Human
aaauuaacuuuuau

SEQ ID NO: 3016278 - RNA, 22 nt, Human
aacaaaccuguuucugcagcca

SEQ ID NO: 3016279 - RNA, 21 nt, Human
aacacauacaggaagguagaa

SEQ ID NO: 3016280 - RNA, 14 nt, Human
aaauggacguguua

SEQ ID NO: 3016281 - RNA, 17 nt, Human
aaauggacguguuauga

SEQ ID NO: 3016282 - RNA, 15 nt, Human
aaauggacguguuau

SEQ ID NO: 3016283 - RNA, 22 nt, Human
aaaucuccaaaauaaaacuuuu

SEQ ID NO: 3016284 - RNA, 19 nt, Human
aaaucuccaaaauaaaacu

SEQ ID NO: 3016285 - RNA, 13 nt, Human
aauauaaaaauaa

SEQ ID NO: 3016286 - RNA, 21 nt, Human
aauaccugucccccugacaac

SEQ ID NO: 3016287 - RNA, 17 nt, Human
aauaaaauuuuaguuga

SEQ ID NO: 3016288 - RNA, 13 nt, Human
aagugcugcauuu

SEQ ID NO: 3016289 - RNA, 21 nt, Human
aaugcgugcauaccacuuuug

SEQ ID NO: 3016290 - RNA, 23 nt, Human
aaugcgugcauaccacuuuuguu

SEQ ID NO: 3016291 - RNA, 13 nt, Human
aaugggacacuaa

SEQ ID NO: 3016292 - RNA, 14 nt, Human
aaugggagcucaug

SEQ ID NO: 3016293 - RNA, 23 nt, Human
aaugcucuuuacuucauggacuu

SEQ ID NO: 3016294 - RNA, 15 nt, Human
aaugucacaggcagg

SEQ ID NO: 3016295 - RNA, 15 nt, Human
aaugggggugcauuu

SEQ ID NO: 3016296 - RNA, 17 nt, Human
aaugggggugcauuuga

SEQ ID NO: 3016297 - RNA, 18 nt, Human
aaucuccaaaauaaaacu

SEQ ID NO: 3016298 - RNA, 15 nt, Human
aaugauagcuacugu

SEQ ID NO: 3016299 - RNA, 13 nt, Human
aaugauuaauuaa

SEQ ID NO: 3016300 - RNA, 12 nt, Human
aaugauuaauua

SEQ ID NO: 3016301 - RNA, 10 nt, Human
aagcagagug

SEQ ID NO: 3016302 - RNA, 21 nt, Human
aagcagaggaaggagaggaga

SEQ ID NO: 3016303 - RNA, 14 nt, Human
aagcagaguggcag

SEQ ID NO: 3016304 - RNA, 11 nt, Human
aagcagagugg

SEQ ID NO: 3016305 - RNA, 20 nt, Human
aagcagaguggcagucuuca

SEQ ID NO: 3016306 - RNA, 19 nt, Human
aagccaccaacauacuccc

SEQ ID NO: 3016307 - RNA, 19 nt, Human
aagauuuugaaauuuuuau

SEQ ID NO: 3016308 - RNA, 19 nt, Human
aagauucuauguuaauauu

SEQ ID NO: 3016309 - RNA, 21 nt, Human
aagauucuauguuaauauuuu

SEQ ID NO: 3016310 - RNA, 22 nt, Human
aagauucuauguuaauauuuua

SEQ ID NO: 3016311 - RNA, 20 nt, Human
aagauucauauuuacuucuu

SEQ ID NO: 3016312 - RNA, 15 nt, Human
aagacuuugguuauu

SEQ ID NO: 3016313 - RNA, 13 nt, Human
aagacuuugguua

SEQ ID NO: 3016314 - RNA, 23 nt, Human
aagacuuugguuauuuuacuuuu

SEQ ID NO: 3016315 - RNA, 17 nt, Human
aagacuuugguuauuuu

SEQ ID NO: 3016316 - RNA, 13 nt, Human
aacuguuuagaug

SEQ ID NO: 3016317 - RNA, 16 nt, Human
aagacuuuggaaagag

SEQ ID NO: 3016318 - RNA, 16 nt, Human
aaggaaugcaaagaug

SEQ ID NO: 3016319 - RNA, 15 nt, Human
aaggaaugcaaagau

SEQ ID NO: 3016320 - RNA, 23 nt, Human
aaggaaugauuaauuaaaacaca

SEQ ID NO: 3016321 - RNA, 16 nt, Human
aagcugcugacagugu

SEQ ID NO: 3016322 - RNA, 21 nt, Human
aagcgugagccacugcaccgg

SEQ ID NO: 3016323 - RNA, 17 nt, Human
aagcgugagccacugca

SEQ ID NO: 3016324 - RNA, 20 nt, Human
aagcgugagccacugcaccg

SEQ ID NO: 3016325 - RNA, 14 nt, Human
aagcugcugacagu

SEQ ID NO: 3016326 - RNA, 22 nt, Human
aagcugccagccgagauagcca

SEQ ID NO: 3016327 - RNA, 12 nt, Human
aagcugccagcc

SEQ ID NO: 3016328 - RNA, 11 nt, Human
aagcugccagc

SEQ ID NO: 3016329 - RNA, 15 nt, Human
aagcgauucuucugc

SEQ ID NO: 3016330 - RNA, 14 nt, Human
aagcgauucuucug

SEQ ID NO: 3016331 - RNA, 16 nt, Human
aagcgugagccacugc

SEQ ID NO: 3016332 - RNA, 16 nt, Human
aagcgauucuucugcu

SEQ ID NO: 3016333 - RNA, 15 nt, Human
aagccagcaggcucu

SEQ ID NO: 3016334 - RNA, 18 nt, Human
aagccagcaggcucucag

SEQ ID NO: 3016335 - RNA, 21 nt, Human
aagccaccaacauacucccau

SEQ ID NO: 3016336 - RNA, 23 nt, Human
aaggucuguuuuguguacuuuua

SEQ ID NO: 3016337 - RNA, 20 nt, Human
aaggucuguuuuguguacuu

SEQ ID NO: 3016338 - RNA, 19 nt, Human
aaggucuguuuuguguacu

SEQ ID NO: 3016339 - RNA, 21 nt, Human
aagggauuuucagcccucaga

SEQ ID NO: 3016340 - RNA, 23 nt, Human
aagggauuuucagcccucagaau

SEQ ID NO: 3016341 - RNA, 15 nt, Human
aagggauuuucagcc

SEQ ID NO: 3016342 - RNA, 20 nt, Human
aagggacuuggaagcuccgc

SEQ ID NO: 3016343 - RNA, 18 nt, Human
aagggacgcuacccggga

SEQ ID NO: 3016344 - RNA, 17 nt, Human
agaugaaggucuguuuu

SEQ ID NO: 3016345 - RNA, 14 nt, Human
agaugaaggucugu

SEQ ID NO: 3016346 - RNA, 22 nt, Human
agauucuuguauuuauuacaac

SEQ ID NO: 3016347 - RNA, 21 nt, Human
agauucuauguuaauauuuua

SEQ ID NO: 3016348 - RNA, 14 nt, Human
agaugagugagcau

SEQ ID NO: 3016349 - RNA, 18 nt, Human
agcaaaagaugcuucuca

SEQ ID NO: 3016350 - RNA, 18 nt, Human
agauucuuuccugaggcu

SEQ ID NO: 3016351 - RNA, 21 nt, Human
agauucuuuccugaggcuggg

SEQ ID NO: 3016352 - RNA, 19 nt, Human
agauucuuuccugaggcug

SEQ ID NO: 3016353 - RNA, 19 nt, Human
agauugcaacaggcugggc

SEQ ID NO: 3016354 - RNA, 23 nt, Human
agauugcaacaggcugggcuuca

SEQ ID NO: 3016355 - RNA, 20 nt, Human
agauugcaacaggcugggcu

SEQ ID NO: 3016356 - RNA, 21 nt, Human
agauugcaacaggcugggcuu

SEQ ID NO: 3016357 - RNA, 20 nt, Human
agcaaaggagauuggaagga

SEQ ID NO: 3016358 - RNA, 12 nt, Human
agcacagacccu

SEQ ID NO: 3016359 - RNA, 15 nt, Human
agcacagacccugcc

SEQ ID NO: 3016360 - RNA, 14 nt, Human
agcacagacccugc

SEQ ID NO: 3016361 - RNA, 16 nt, Human
agcacagacccugccc

SEQ ID NO: 3016362 - RNA, 17 nt, Human
agcacgauuucuguuua

SEQ ID NO: 3016363 - RNA, 19 nt, Human
agcacgauuucuguuuaga

SEQ ID NO: 3016364 - RNA, 21 nt, Human
agcacgauuucuguuuagaua

SEQ ID NO: 3016365 - RNA, 16 nt, Human
agccaaagcuaggccu

SEQ ID NO: 3016366 - RNA, 14 nt, Human
agcauccuggcacc

SEQ ID NO: 3016367 - RNA, 17 nt, Human
agcauccuggcacccgg

SEQ ID NO: 3016368 - RNA, 15 nt, Human
agccagaggagagag

SEQ ID NO: 3016369 - RNA, 13 nt, Human
agccagaggagag

SEQ ID NO: 3016370 - RNA, 14 nt, Human
agccagcaggcucu

SEQ ID NO: 3016371 - RNA, 18 nt, Human
agccagaggagagaggac

SEQ ID NO: 3016372 - RNA, 17 nt, Human
agccagaggagagagga

SEQ ID NO: 3016373 - RNA, 23 nt, Human
agcccacgcccccacuggugaca

SEQ ID NO: 3016374 - RNA, 20 nt, Human
agcccacgcccccacuggug

SEQ ID NO: 3016375 - RNA, 14 nt, Human
agcccacgccccca

SEQ ID NO: 3016376 - RNA, 16 nt, Human
agcccaccuuggcuca

SEQ ID NO: 3016377 - RNA, 14 nt, Human
agcccaccuuggcu

SEQ ID NO: 3016378 - RNA, 15 nt, Human
agcccaccccucaac

SEQ ID NO: 3016379 - RNA, 16 nt, Human
agccagcaggcucuca

SEQ ID NO: 3016380 - RNA, 13 nt, Human
agcauccuggcac

SEQ ID NO: 3016381 - RNA, 24 nt, Human
agccccaaaacucuccucugcugc

SEQ ID NO: 3016382 - RNA, 21 nt, Human
agcccgggcucugccucccau

SEQ ID NO: 3016383 - RNA, 20 nt, Human
agcccgggcucugccuccca

SEQ ID NO: 3016384 - RNA, 18 nt, Human
agcccgggcucugccucc

SEQ ID NO: 3016385 - RNA, 17 nt, Human
agcccgggcucugccuc

SEQ ID NO: 3016386 - RNA, 15 nt, Human
agccccauccucugu

SEQ ID NO: 3016387 - RNA, 23 nt, Human
agccccauccucuguacagagcc

SEQ ID NO: 3016388 - RNA, 17 nt, Human
agccccauccucuguac

SEQ ID NO: 3016389 - RNA, 17 nt, Human
agccccauucugccugc

SEQ ID NO: 3016390 - RNA, 18 nt, Human
agccccauucugccugcc

SEQ ID NO: 3016391 - RNA, 19 nt, Human
agccccauucugccugccc

SEQ ID NO: 3016392 - RNA, 16 nt, Human
agacuggauaguccgu

SEQ ID NO: 3016393 - RNA, 16 nt, Human
agagagaccacuuuuc

SEQ ID NO: 3016394 - RNA, 13 nt, Human
agagcccaccuug

SEQ ID NO: 3016395 - RNA, 13 nt, Human
agagccagggucu

SEQ ID NO: 3016396 - RNA, 18 nt, Human
agacucugucucaaaaaa

SEQ ID NO: 3016397 - RNA, 13 nt, Human
agacucugucuca

SEQ ID NO: 3016398 - RNA, 22 nt, Human
agacugaguacguugugcauuu

SEQ ID NO: 3016399 - RNA, 20 nt, Human
agacugaguacguugugcau

SEQ ID NO: 3016400 - RNA, 16 nt, Human
agacgcugugcugccc

SEQ ID NO: 3016401 - RNA, 14 nt, Human
agaggacuuuucuu

SEQ ID NO: 3016402 - RNA, 21 nt, Human
agaggacuuuucuuuguggcu

SEQ ID NO: 3016403 - RNA, 22 nt, Human
agaggacuuuucuuuguggcuu

SEQ ID NO: 3016404 - RNA, 19 nt, Human
agaggggguggccucccaa

SEQ ID NO: 3016405 - RNA, 17 nt, Human
agaggggguggccuccc

SEQ ID NO: 3016406 - RNA, 16 nt, Human
agagggccugcaaggg

SEQ ID NO: 3016407 - RNA, 13 nt, Human
agagggccugcaa

SEQ ID NO: 3016408 - RNA, 21 nt, Human
agaagucuucuauuuauuuau

SEQ ID NO: 3016409 - RNA, 18 nt, Human
agaagucuucuauuuauu

SEQ ID NO: 3016410 - RNA, 16 nt, Human
agaaugaaagggccca

SEQ ID NO: 3016411 - RNA, 18 nt, Human
agaaugaaagggcccaga

SEQ ID NO: 3016412 - RNA, 22 nt, Human
agaaugcacaaacagaggccgc

SEQ ID NO: 3016413 - RNA, 19 nt, Human
agaaugcacaaacagaggc

SEQ ID NO: 3016414 - RNA, 21 nt, Human
agaagagauugugguuucauu

SEQ ID NO: 3016415 - RNA, 21 nt, Human
acuuuccucuuuggucuacac

SEQ ID NO: 3016416 - RNA, 13 nt, Human
agaagacacugau

SEQ ID NO: 3016417 - RNA, 21 nt, Human
agaagacacugaugggcaacc

SEQ ID NO: 3016418 - RNA, 14 nt, Human
agaaguaacuuacu

SEQ ID NO: 3016419 - RNA, 20 nt, Human
agacaaugacuuacuguaca

SEQ ID NO: 3016420 - RNA, 11 nt, Human
agacagagucu

SEQ ID NO: 3016421 - RNA, 13 nt, Human
agacagagcuaca

SEQ ID NO: 3016422 - RNA, 19 nt, Human
agacagagucucacuguug

SEQ ID NO: 3016423 - RNA, 20 nt, Human
agacagagucucacuguugc

SEQ ID NO: 3016424 - RNA, 15 nt, Human
agacagagcuacaca

SEQ ID NO: 3016425 - RNA, 21 nt, Human
agacaaugacuuacuguacau

SEQ ID NO: 3016426 - RNA, 22 nt, Human
agacaaugacuuacuguacaug

SEQ ID NO: 3016427 - RNA, 21 nt, Human
agacagagucucacuguugcc

SEQ ID NO: 3016428 - RNA, 22 nt, Human
agacagauacuccuccaagguu

SEQ ID NO: 3016429 - RNA, 15 nt, Human
agaccacguuucuaa

SEQ ID NO: 3016430 - RNA, 24 nt, Human
aggcuuagacccucaugcugccaa

SEQ ID NO: 3016431 - RNA, 17 nt, Human
aggcuuagucacugaga

SEQ ID NO: 3016432 - RNA, 23 nt, Human
aggcuuagacccucaugcugcca

SEQ ID NO: 3016433 - RNA, 22 nt, Human
aggcuguaucccaugagccuca

SEQ ID NO: 3016434 - RNA, 20 nt, Human
aggcuguaucccaugagccu

SEQ ID NO: 3016435 - RNA, 21 nt, Human
aggcuguaucccaugagccuc

SEQ ID NO: 3016436 - RNA, 18 nt, Human
aggcuuagucacugagac

SEQ ID NO: 3016437 - RNA, 15 nt, Human
agggacccuccacca

SEQ ID NO: 3016438 - RNA, 18 nt, Human
aggcuggguucugauccu

SEQ ID NO: 3016439 - RNA, 13 nt, Human
aggcuaccuuugu

SEQ ID NO: 3016440 - RNA, 14 nt, Human
aggcuaccuuugua

SEQ ID NO: 3016441 - RNA, 15 nt, Human
aggcuaccuuuguau

SEQ ID NO: 3016442 - RNA, 15 nt, Human
aggcaugguggccca

SEQ ID NO: 3016443 - RNA, 17 nt, Human
aggcaugugaugagagg

SEQ ID NO: 3016444 - RNA, 17 nt, Human
aggcauguucucugagg

SEQ ID NO: 3016445 - RNA, 21 nt, Human
aggcaugugaugagaggaaau

SEQ ID NO: 3016446 - RNA, 20 nt, Human
aggcaugugaugagaggaaa

SEQ ID NO: 3016447 - RNA, 19 nt, Human
aggcaugugaugagaggaa

SEQ ID NO: 3016448 - RNA, 18 nt, Human
aggcauguucucugagga

SEQ ID NO: 3016449 - RNA, 19 nt, Human
aggcauguucucugaggac

SEQ ID NO: 3016450 - RNA, 12 nt, Human
aggcauguucuc

SEQ ID NO: 3016451 - RNA, 17 nt, Human
aggcauuccccaggagg

SEQ ID NO: 3016452 - RNA, 18 nt, Human
aggcauuccccaggaggc

SEQ ID NO: 3016453 - RNA, 15 nt, Human
aggccaggcccucug

SEQ ID NO: 3016454 - RNA, 14 nt, Human
aggccaggcccucu

SEQ ID NO: 3016455 - RNA, 13 nt, Human
aggccaggcccuc

SEQ ID NO: 3016456 - RNA, 23 nt, Human
aggccagcugcuugggcuucauc

SEQ ID NO: 3016457 - RNA, 20 nt, Human
aggcauuccccaggaggcca

SEQ ID NO: 3016458 - RNA, 19 nt, Human
aggcauuccccaggaggcc

SEQ ID NO: 3016459 - RNA, 12 nt, Human
aggcccuucucu

SEQ ID NO: 3016460 - RNA, 19 nt, Human
aggcccuucucuccagccc

SEQ ID NO: 3016461 - RNA, 15 nt, Human
aggcccuucucucca

SEQ ID NO: 3016462 - RNA, 21 nt, Human
aggcccucugcccacucccug

SEQ ID NO: 3016463 - RNA, 23 nt, Human
aggcccucugcccacucccugca

SEQ ID NO: 3016464 - RNA, 22 nt, Human
aggcccucugcccacucccugc

SEQ ID NO: 3016465 - RNA, 17 nt, Human
agggauuuucagcccuc

SEQ ID NO: 3016466 - RNA, 22 nt, Human
agggauuuucagcccucagaau

SEQ ID NO: 3016467 - RNA, 14 nt, Human
agggccugcaaggg

SEQ ID NO: 3016468 - RNA, 15 nt, Human
agggccugcaaggga

SEQ ID NO: 3016469 - RNA, 13 nt, Human
agggccuggccug

SEQ ID NO: 3016470 - RNA, 12 nt, Human
agggccuggccu

SEQ ID NO: 3016471 - RNA, 16 nt, Human
agggauacccauccca

SEQ ID NO: 3016472 - RNA, 22 nt, Human
aggggcccaaauucuuucagug

SEQ ID NO: 3016473 - RNA, 14 nt, Human
agggccuggccuga

SEQ ID NO: 3016474 - RNA, 21 nt, Human
aggguaucuggugacuuuccu

SEQ ID NO: 3016475 - RNA, 13 nt, Human
aggguauuccaga

SEQ ID NO: 3016476 - RNA, 14 nt, Human
agggucccuggugg

SEQ ID NO: 3016477 - RNA, 12 nt, Human
agggucccuggu

SEQ ID NO: 3016478 - RNA, 22 nt, Human
agggucccugguggcagcucac

SEQ ID NO: 3016479 - RNA, 20 nt, Human
agggucccugguggcagcuc

SEQ ID NO: 3016480 - RNA, 17 nt, Human
agggucccugguggcag

SEQ ID NO: 3016481 - RNA, 16 nt, Human
agggucccugguggca

SEQ ID NO: 3016482 - RNA, 22 nt, Human
aggguuuugccauguuggccag

SEQ ID NO: 3016483 - RNA, 23 nt, Human
aggguuuugccauguuggccagg

SEQ ID NO: 3016484 - RNA, 13 nt, Human
agguacucuccug

SEQ ID NO: 3016485 - RNA, 14 nt, Human
agguacucuccugg

SEQ ID NO: 3016486 - RNA, 22 nt, Human
agguacgaaaagaggggaagag

SEQ ID NO: 3016487 - RNA, 16 nt, Human
agguaacaggcagaua

SEQ ID NO: 3016488 - RNA, 13 nt, Human
agguaacaggcag

SEQ ID NO: 3016489 - RNA, 14 nt, Human
agguaacaggcaga

SEQ ID NO: 3016490 - RNA, 20 nt, Human
agcuuauuuccucauuuuua

SEQ ID NO: 3016491 - RNA, 18 nt, Human
agcuucauuuccuguguc

SEQ ID NO: 3016492 - RNA, 23 nt, Human
agcuuuguuuguugucagcugaa

SEQ ID NO: 3016493 - RNA, 22 nt, Human
agcuuuguuuguugucagcuga

SEQ ID NO: 3016494 - RNA, 19 nt, Human
agcuucauuuccugugucu

SEQ ID NO: 3016495 - RNA, 20 nt, Human
aggaacaaggcaaggcuguc

SEQ ID NO: 3016496 - RNA, 21 nt, Human
aggaacuuaaauaaugugaaa

SEQ ID NO: 3016497 - RNA, 12 nt, Human
aggaacaaggca

SEQ ID NO: 3016498 - RNA, 19 nt, Human
aggaacaaggcaaggcugu

SEQ ID NO: 3016499 - RNA, 17 nt, Human
aggaacaaggcaaggcu

SEQ ID NO: 3016500 - RNA, 16 nt, Human
aggaacaaggcaaggc

SEQ ID NO: 3016501 - RNA, 13 nt, Human
aggaacaaggcaa

SEQ ID NO: 3016502 - RNA, 22 nt, Human
aggaauaccugucccccugaca

SEQ ID NO: 3016503 - RNA, 18 nt, Human
aggaauaccugucccccu

SEQ ID NO: 3016504 - RNA, 15 nt, Human
aggaauaccuguccc

SEQ ID NO: 3016505 - RNA, 15 nt, Human
aggagaggagagggg

SEQ ID NO: 3016506 - RNA, 15 nt, Human
agcugaaccugggua

SEQ ID NO: 3016507 - RNA, 22 nt, Human
agcugguuuuuagcggagacgg

SEQ ID NO: 3016508 - RNA, 16 nt, Human
agcugguugagguuuc

SEQ ID NO: 3016509 - RNA, 18 nt, Human
agcuggucccacucaguc

SEQ ID NO: 3016510 - RNA, 13 nt, Human
agcugcugacagu

SEQ ID NO: 3016511 - RNA, 14 nt, Human
agcugcugacagug

SEQ ID NO: 3016512 - RNA, 16 nt, Human
agcuggucccacucag

SEQ ID NO: 3016513 - RNA, 17 nt, Human
agcuggucccacucagu

SEQ ID NO: 3016514 - RNA, 12 nt, Human
agcugcugacag

SEQ ID NO: 3016515 - RNA, 19 nt, Human
agcugcgguccacccagga

SEQ ID NO: 3016516 - RNA, 20 nt, Human
agcugcgguccacccaggag

SEQ ID NO: 3016517 - RNA, 13 nt, Human
agcugcgguccac

SEQ ID NO: 3016518 - RNA, 16 nt, Human
agcugcgguccaccca

SEQ ID NO: 3016519 - RNA, 17 nt, Human
agcugcgguccacccag

SEQ ID NO: 3016520 - RNA, 18 nt, Human
agcugcgguccacccagg

SEQ ID NO: 3016521 - RNA, 12 nt, Human
agcucagagagg

SEQ ID NO: 3016522 - RNA, 14 nt, Human
agcucagagagggu

SEQ ID NO: 3016523 - RNA, 18 nt, Human
agcucagagaggguggga

SEQ ID NO: 3016524 - RNA, 19 nt, Human
agcucaccagccccagugc

SEQ ID NO: 3016525 - RNA, 20 nt, Human
agcucaccagccccagugcc

SEQ ID NO: 3016526 - RNA, 15 nt, Human
agcucaccagcccca

SEQ ID NO: 3016527 - RNA, 12 nt, Human
agcucaccucuc

SEQ ID NO: 3016528 - RNA, 19 nt, Human
agcucaccucucccuugga

SEQ ID NO: 3016529 - RNA, 18 nt, Human
agcucaccucucccuugg

SEQ ID NO: 3016530 - RNA, 15 nt, Human
agcucaccucucccu

SEQ ID NO: 3016531 - RNA, 16 nt, Human
agcucaccagccccag

SEQ ID NO: 3016532 - RNA, 12 nt, Human
agccugggaggu

SEQ ID NO: 3016533 - RNA, 19 nt, Human
agcgagcccugguggcagu

SEQ ID NO: 3016534 - RNA, 13 nt, Human
agcgagcccuggu

SEQ ID NO: 3016535 - RNA, 14 nt, Human
augacuguuuuuaa

SEQ ID NO: 3016536 - RNA, 13 nt, Human
augaggcauuugu

SEQ ID NO: 3016537 - RNA, 14 nt, Human
augaggcauuuguu

SEQ ID NO: 3016538 - RNA, 21 nt, Human
augaggcauuuguuugaacug

SEQ ID NO: 3016539 - RNA, 22 nt, Human
augaggcauuuguuugaacuga

SEQ ID NO: 3016540 - RNA, 14 nt, Human
augaaaacacauuu

SEQ ID NO: 3016541 - RNA, 15 nt, Human
augaaaacacauuuu

SEQ ID NO: 3016542 - RNA, 16 nt, Human
augaaaacacauuuuu

SEQ ID NO: 3016543 - RNA, 17 nt, Human
aucgcuccaccuugcag

SEQ ID NO: 3016544 - RNA, 21 nt, Human
aucgcuccaccuugcagcucu

SEQ ID NO: 3016545 - RNA, 17 nt, Human
auccucauacccacccc

SEQ ID NO: 3016546 - RNA, 19 nt, Human
auccagacccggcugcgug

SEQ ID NO: 3016547 - RNA, 19 nt, Human
aucccaugagccucagcau

SEQ ID NO: 3016548 - RNA, 14 nt, Human
aucaugucuggcua

SEQ ID NO: 3016549 - RNA, 24 nt, Human
aucaaaagguuaauaaaguaauua

SEQ ID NO: 3016550 - RNA, 23 nt, Human
aucaaagagguuuuaaaaaaauc

SEQ ID NO: 3016551 - RNA, 20 nt, Human
aucaaagagguuuuaaaaaa

SEQ ID NO: 3016552 - RNA, 20 nt, Human
aucaccaacgucugugccau

SEQ ID NO: 3016553 - RNA, 13 nt, Human
aucaccagacagg

SEQ ID NO: 3016554 - RNA, 13 nt, Human
aucacagccucug

SEQ ID NO: 3016555 - RNA, 18 nt, Human
auggauaaauauugguug

SEQ ID NO: 3016556 - RNA, 16 nt, Human
augcuuguacauaaug

SEQ ID NO: 3016557 - RNA, 15 nt, Human
augcuuguacauaau

SEQ ID NO: 3016558 - RNA, 18 nt, Human
auggcuuuugugcauuau

SEQ ID NO: 3016559 - RNA, 16 nt, Human
auggcuuuugugcauu

SEQ ID NO: 3016560 - RNA, 17 nt, Human
auggcuuuugugcauua

SEQ ID NO: 3016561 - RNA, 16 nt, Human
augcugcccugugagu

SEQ ID NO: 3016562 - RNA, 15 nt, Human
augcugcccugugag

SEQ ID NO: 3016563 - RNA, 14 nt, Human
augcugcccuguga

SEQ ID NO: 3016564 - RNA, 12 nt, Human
augcugcccugu

SEQ ID NO: 3016565 - RNA, 13 nt, Human
augcugcccugug

SEQ ID NO: 3016566 - RNA, 15 nt, Human
augcacacauuuuuu

SEQ ID NO: 3016567 - RNA, 13 nt, Human
augcacacauuuu

SEQ ID NO: 3016568 - RNA, 14 nt, Human
augcacacauuuuu

SEQ ID NO: 3016569 - RNA, 19 nt, Human
augcacagaguuguuacau

SEQ ID NO: 3016570 - RNA, 21 nt, Human
augcacagaguuguuacauuu

SEQ ID NO: 3016571 - RNA, 22 nt, Human
augcacagaguuguuacauuuu

SEQ ID NO: 3016572 - RNA, 20 nt, Human
augccuggauggggcugcac

SEQ ID NO: 3016573 - RNA, 19 nt, Human
augccuggauggggcugca

SEQ ID NO: 3016574 - RNA, 18 nt, Human
augcacaaacagaggccg

SEQ ID NO: 3016575 - RNA, 18 nt, Human
augaugaaaugaggucag

SEQ ID NO: 3016576 - RNA, 23 nt, Human
augaugaaaugaggucagagccu

SEQ ID NO: 3016577 - RNA, 15 nt, Human
augaugauccuaggc

SEQ ID NO: 3016578 - RNA, 18 nt, Human
augaucuuugcagacagg

SEQ ID NO: 3016579 - RNA, 19 nt, Human
augaucuuugcagacaggc

SEQ ID NO: 3016580 - RNA, 21 nt, Human
augaucuuugcagacaggcaa

SEQ ID NO: 3016581 - RNA, 17 nt, Human
augaucuuugcagacag

SEQ ID NO: 3016582 - RNA, 18 nt, Human
augaucuucuuuauaauu

SEQ ID NO: 3016583 - RNA, 21 nt, Human
augguaguuuuacaguguuuc

SEQ ID NO: 3016584 - RNA, 15 nt, Human
augguaguuuuacag

SEQ ID NO: 3016585 - RNA, 23 nt, Human
augggugcuuggaggaaggaaac

SEQ ID NO: 3016586 - RNA, 21 nt, Human
augggugcuuggaggaaggaa

SEQ ID NO: 3016587 - RNA, 20 nt, Human
augggugcuuggaggaagga

SEQ ID NO: 3016588 - RNA, 17 nt, Human
augucacaggcaggucc

SEQ ID NO: 3016589 - RNA, 19 nt, Human
augucacaggcagguccag

SEQ ID NO: 3016590 - RNA, 23 nt, Human
auguaauuaaguacuauguauca

SEQ ID NO: 3016591 - RNA, 13 nt, Human
augucacaggcag

SEQ ID NO: 3016592 - RNA, 14 nt, Human
auguuugccucugc

SEQ ID NO: 3016593 - RNA, 15 nt, Human
auguuugccucugcc

SEQ ID NO: 3016594 - RNA, 17 nt, Human
auguuugccucugccuc

SEQ ID NO: 3016595 - RNA, 15 nt, Human
auguucugggacaca

SEQ ID NO: 3016596 - RNA, 14 nt, Human
auguucugggacac

SEQ ID NO: 3016597 - RNA, 13 nt, Human
auguucucugagg

SEQ ID NO: 3016598 - RNA, 17 nt, Human
auguucucucuucucca

SEQ ID NO: 3016599 - RNA, 16 nt, Human
auguucucucuucucc

SEQ ID NO: 3016600 - RNA, 13 nt, Human
auguguaaguauu

SEQ ID NO: 3016601 - RNA, 16 nt, Human
aguacuaacauuuauu

SEQ ID NO: 3016602 - RNA, 18 nt, Human
aguacguugugcauuugg

SEQ ID NO: 3016603 - RNA, 16 nt, Human
aguacguugugcauuu

SEQ ID NO: 3016604 - RNA, 17 nt, Human
aguacguugugcauuug

SEQ ID NO: 3016605 - RNA, 14 nt, Human
aguacuauaauuua

SEQ ID NO: 3016606 - RNA, 22 nt, Human
aguacuacaguccucccaucuc

SEQ ID NO: 3016607 - RNA, 19 nt, Human
aguacuacaguccucccau

SEQ ID NO: 3016608 - RNA, 17 nt, Human
aguacuucuccacccug

SEQ ID NO: 3016609 - RNA, 12 nt, Human
aguacuucuuuu

SEQ ID NO: 3016610 - RNA, 22 nt, Human
aguacuucuccacccugcucuc

SEQ ID NO: 3016611 - RNA, 12 nt, Human
aguacuauguau

SEQ ID NO: 3016612 - RNA, 14 nt, Human
aguacuauguauca

SEQ ID NO: 3016613 - RNA, 15 nt, Human
aguacguugugcauu

SEQ ID NO: 3016614 - RNA, 14 nt, Human
aguacguugugcau

SEQ ID NO: 3016615 - RNA, 16 nt, Human
aggucuguucuuucca

SEQ ID NO: 3016616 - RNA, 13 nt, Human
aggucuguucuuu

SEQ ID NO: 3016617 - RNA, 15 nt, Human
aggucuguucuuucc

SEQ ID NO: 3016618 - RNA, 22 nt, Human
agucacacaguauuacuucugc

SEQ ID NO: 3016619 - RNA, 20 nt, Human
aguaugaggcauuuguuuga

SEQ ID NO: 3016620 - RNA, 21 nt, Human
aguaugaggcauuuguuugaa

SEQ ID NO: 3016621 - RNA, 23 nt, Human
aguaugaggcauuuguuugaacu

SEQ ID NO: 3016622 - RNA, 17 nt, Human
aguaugaggcauuuguu

SEQ ID NO: 3016623 - RNA, 17 nt, Human
agucugaaggcuggguu

SEQ ID NO: 3016624 - RNA, 19 nt, Human
aguccuuaccagcagagca

SEQ ID NO: 3016625 - RNA, 22 nt, Human
aguccucuuuucugagaggacu

SEQ ID NO: 3016626 - RNA, 20 nt, Human
aguccuuaccagcagagcac

SEQ ID NO: 3016627 - RNA, 19 nt, Human
aguccucuuuucugagagg

SEQ ID NO: 3016628 - RNA, 16 nt, Human
aguugauacuacaguu

SEQ ID NO: 3016629 - RNA, 13 nt, Human
aguucaucuugaa

SEQ ID NO: 3016630 - RNA, 19 nt, Human
aguucaucuugaauuguaa

SEQ ID NO: 3016631 - RNA, 15 nt, Human
aguucaucuugaauu

SEQ ID NO: 3016632 - RNA, 14 nt, Human
agugauucuccugc

SEQ ID NO: 3016633 - RNA, 18 nt, Human
agugccuuacacaauggu

SEQ ID NO: 3016634 - RNA, 15 nt, Human
agugauucuccugcc

SEQ ID NO: 3016635 - RNA, 17 nt, Human
agugauucuccugccuc

SEQ ID NO: 3016636 - RNA, 14 nt, Human
agugauccucccac

SEQ ID NO: 3016637 - RNA, 15 nt, Human
agugauccucccacc

SEQ ID NO: 3016638 - RNA, 18 nt, Human
agugauccucccaccuca

SEQ ID NO: 3016639 - RNA, 23 nt, Human
agugauccucccaccucagccuc

SEQ ID NO: 3016640 - RNA, 24 nt, Human
agugauccucccaccucagccucc

SEQ ID NO: 3016641 - RNA, 15 nt, Human
agugccuuauggaac

SEQ ID NO: 3016642 - RNA, 14 nt, Human
agugccuuauggaa

SEQ ID NO: 3016643 - RNA, 13 nt, Human
agugccuuaugga

SEQ ID NO: 3016644 - RNA, 10 nt, Human
agugccuuau

SEQ ID NO: 3016645 - RNA, 16 nt, Human
agugccuuauggaaca

SEQ ID NO: 3016646 - RNA, 16 nt, Human
agugggagcugccugu

SEQ ID NO: 3016647 - RNA, 17 nt, Human
auauucauucuuuuuga

SEQ ID NO: 3016648 - RNA, 17 nt, Human
auauucaggaagcucag

SEQ ID NO: 3016649 - RNA, 19 nt, Human
auauucaggaagcucaggg

SEQ ID NO: 3016650 - RNA, 22 nt, Human
auaugcacacauuuuuuaaaug

SEQ ID NO: 3016651 - RNA, 16 nt, Human
auaugcucugcauguu

SEQ ID NO: 3016652 - RNA, 17 nt, Human
auaugcucugcauguua

SEQ ID NO: 3016653 - RNA, 20 nt, Human
auaugcucugcauguuacau

SEQ ID NO: 3016654 - RNA, 21 nt, Human
auagcagcccucaauugugaa

SEQ ID NO: 3016655 - RNA, 22 nt, Human
auagcagcccucaauugugaaa

SEQ ID NO: 3016656 - RNA, 16 nt, Human
auagcauguccuaaug

SEQ ID NO: 3016657 - RNA, 19 nt, Human
auagcauguccuaaugcuu

SEQ ID NO: 3016658 - RNA, 15 nt, Human
auagcacagacccug

SEQ ID NO: 3016659 - RNA, 18 nt, Human
auagcacagacccugccc

SEQ ID NO: 3016660 - RNA, 17 nt, Human
auagcacagacccugcc

SEQ ID NO: 3016661 - RNA, 15 nt, Human
auagccuaggugaca

SEQ ID NO: 3016662 - RNA, 17 nt, Human
auagccuaggugacaga

SEQ ID NO: 3016663 - RNA, 23 nt, Human
aguuugauuaaauucuugcaaag

SEQ ID NO: 3016664 - RNA, 22 nt, Human
aguuguuacauuuuuaagugcu

SEQ ID NO: 3016665 - RNA, 19 nt, Human
aguuguuacauuuuuaagu

SEQ ID NO: 3016666 - RNA, 20 nt, Human
aguuguuacauuuuuaagug

SEQ ID NO: 3016667 - RNA, 17 nt, Human
aguuugauuaaauucuu

SEQ ID NO: 3016668 - RNA, 18 nt, Human
aguuugauuaaauucuug

SEQ ID NO: 3016669 - RNA, 20 nt, Human
aguuugauuaaauucuugca

SEQ ID NO: 3016670 - RNA, 22 nt, Human
aguuugauuaaauucuugcaaa

SEQ ID NO: 3016671 - RNA, 19 nt, Human
aguuugagaucagccuggg

SEQ ID NO: 3016672 - RNA, 18 nt, Human
aguuugagaucagccugg

SEQ ID NO: 3016673 - RNA, 16 nt, Human
aguuugauuaaauucu

SEQ ID NO: 3016674 - RNA, 20 nt, Human
aguuugagaucagccugggc

SEQ ID NO: 3016675 - RNA, 12 nt, Human
auaacauguaau

SEQ ID NO: 3016676 - RNA, 13 nt, Human
auaacauguaauu

SEQ ID NO: 3016677 - RNA, 18 nt, Human
auaacauguaauuaagua

SEQ ID NO: 3016678 - RNA, 20 nt, Human
auaacauguaauuaaguacu

SEQ ID NO: 3016679 - RNA, 18 nt, Human
auaaggguaucuggugac

SEQ ID NO: 3016680 - RNA, 16 nt, Human
auaccugucccccuga

SEQ ID NO: 3016681 - RNA, 15 nt, Human
auaccugucccccug

SEQ ID NO: 3016682 - RNA, 14 nt, Human
auaccugucccccu

SEQ ID NO: 3016683 - RNA, 13 nt, Human
auaccuguccccc

SEQ ID NO: 3016684 - RNA, 13 nt, Human
auacccaccccca

SEQ ID NO: 3016685 - RNA, 16 nt, Human
auacccacccccaccc

SEQ ID NO: 3016686 - RNA, 14 nt, Human
auacccacccccac

SEQ ID NO: 3016687 - RNA, 17 nt, Human
auacccacccccaccca

SEQ ID NO: 3016688 - RNA, 14 nt, Human
auacaaugcugugc

SEQ ID NO: 3016689 - RNA, 17 nt, Human
auacaaugcugugcccu

SEQ ID NO: 3016690 - RNA, 13 nt, Human
auacacuuacacu

SEQ ID NO: 3016691 - RNA, 22 nt, Human
auacacuuacacuuuaugcaca

SEQ ID NO: 3016692 - RNA, 13 nt, Human
augaaugcccagu

SEQ ID NO: 3016693 - RNA, 21 nt, Human
augaaugcccagugagacugu

SEQ ID NO: 3016694 - RNA, 20 nt, Human
augaaugucagugugacuga

SEQ ID NO: 3016695 - RNA, 22 nt, Human
uuggggggcugaggugggagga

SEQ ID NO: 3016696 - RNA, 14 nt, Human
uuggggauauuuuu

SEQ ID NO: 3016697 - RNA, 18 nt, Human
uuggcuagagguucaaag

SEQ ID NO: 3016698 - RNA, 23 nt, Human
uuggcgcugccccuggcagcccc

SEQ ID NO: 3016699 - RNA, 22 nt, Human
uuggcgcugccccuggcagccc

SEQ ID NO: 3016700 - RNA, 18 nt, Human
aucuuugcagacaggcaa

SEQ ID NO: 3016701 - RNA, 21 nt, Human
uugguugguaacucuguaauu

SEQ ID NO: 3016702 - RNA, 17 nt, Human
uugguugggaugacuug

SEQ ID NO: 3016703 - RNA, 20 nt, Human
uugguucuggacuaaaacua

SEQ ID NO: 3016704 - RNA, 18 nt, Human
uugguucuggacuaaaac

SEQ ID NO: 3016705 - RNA, 14 nt, Human
augacacaugcaag

SEQ ID NO: 3016706 - RNA, 22 nt, Human
augacacaugcaaggucauuuu

SEQ ID NO: 3016707 - RNA, 23 nt, Human
augacuuggugucuaauguguag

SEQ ID NO: 3016708 - RNA, 18 nt, Human
augacuuggugucuaaug

SEQ ID NO: 3016709 - RNA, 16 nt, Human
augacuuacuguacau

SEQ ID NO: 3016710 - RNA, 17 nt, Human
augacuuacuguacaug

SEQ ID NO: 3016711 - RNA, 19 nt, Human
augacauugacuauuuuug

SEQ ID NO: 3016712 - RNA, 16 nt, Human
augacauugacuauuu

SEQ ID NO: 3016713 - RNA, 14 nt, Human
augacauucccugc

SEQ ID NO: 3016714 - RNA, 18 nt, Human
augacacgaauauugcug

SEQ ID NO: 3016715 - RNA, 22 nt, Human
augacuuaagcacacuugacau

SEQ ID NO: 3016716 - RNA, 14 nt, Human
augacuuacuguac

SEQ ID NO: 3016717 - RNA, 21 nt, Human
augagaaagguugaagcacca

SEQ ID NO: 3016718 - RNA, 22 nt, Human
augagaaagguugaagcaccaa

SEQ ID NO: 3016719 - RNA, 11 nt, Human
uugcacauuaa

SEQ ID NO: 3016720 - RNA, 23 nt, Human
uugcacauuaaaugacucuuccc

SEQ ID NO: 3016721 - RNA, 16 nt, Human
uugauucagacagcug

SEQ ID NO: 3016722 - RNA, 15 nt, Human
uugauucagacagcu

SEQ ID NO: 3016723 - RNA, 14 nt, Human
uugauucagacagc

SEQ ID NO: 3016724 - RNA, 19 nt, Human
auccuaguuccaccaucaa

SEQ ID NO: 3016725 - RNA, 15 nt, Human
auccuaguuccacca

SEQ ID NO: 3016726 - RNA, 16 nt, Human
aucucacacaugagca

SEQ ID NO: 3016727 - RNA, 15 nt, Human
aucucacacaugagc

SEQ ID NO: 3016728 - RNA, 13 nt, Human
aucucccccagcc

SEQ ID NO: 3016729 - RNA, 12 nt, Human
aucucccccagc

SEQ ID NO: 3016730 - RNA, 20 nt, Human
uugccuaauaugaugacugu

SEQ ID NO: 3016731 - RNA, 18 nt, Human
uugccgucuaccugaggg

SEQ ID NO: 3016732 - RNA, 15 nt, Human
uugccgucuaccuga

SEQ ID NO: 3016733 - RNA, 19 nt, Human
uugccgucuaccugagggg

SEQ ID NO: 3016734 - RNA, 14 nt, Human
uugccguuauuaaa

SEQ ID NO: 3016735 - RNA, 13 nt, Human
uugccgucuaccu

SEQ ID NO: 3016736 - RNA, 12 nt, Human
aucuguuacaca

SEQ ID NO: 3016737 - RNA, 18 nt, Human
aucuugaauuguaaggaa

SEQ ID NO: 3016738 - RNA, 17 nt, Human
aucuugaauuguaagga

SEQ ID NO: 3016739 - RNA, 17 nt, Human
aucuugcucugcugaca

SEQ ID NO: 3016740 - RNA, 19 nt, Human
aucuugcucugcugacaga

SEQ ID NO: 3016741 - RNA, 23 nt, Human
aucugugaaaggaaagagggagg

SEQ ID NO: 3016742 - RNA, 19 nt, Human
aucuggguucacugcaacc

SEQ ID NO: 3016743 - RNA, 17 nt, Human
aucuggguucacugcaa

SEQ ID NO: 3016744 - RNA, 22 nt, Human
uuuagaugaaugucaguuguua

SEQ ID NO: 3016745 - RNA, 17 nt, Human
uuuagaugaaugucagu

SEQ ID NO: 3016746 - RNA, 18 nt, Human
uuuagaugaaugucaguu

SEQ ID NO: 3016747 - RNA, 15 nt, Human
uuuaguagagacagg

SEQ ID NO: 3016748 - RNA, 24 nt, Human
uuuauggcuuuugugcauuaucua

SEQ ID NO: 3016749 - RNA, 20 nt, Human
uuuauggcuuuugugcauua

SEQ ID NO: 3016750 - RNA, 18 nt, Human
augcuguacauacuuuuu

SEQ ID NO: 3016751 - RNA, 16 nt, Human
augcuguacauacuuu

SEQ ID NO: 3016752 - RNA, 19 nt, Human
augcugucccuuacgugag

SEQ ID NO: 3016753 - RNA, 23 nt, Human
augcugucccuuacgugaguccu

SEQ ID NO: 3016754 - RNA, 11 nt, Human
auggaacacuc

SEQ ID NO: 3016755 - RNA, 15 nt, Human
auggaacacucugag

SEQ ID NO: 3016756 - RNA, 14 nt, Human
auggaacacucuga

SEQ ID NO: 3016757 - RNA, 15 nt, Human
auggaagacagcucu

SEQ ID NO: 3016758 - RNA, 16 nt, Human
auggaacacucugaga

SEQ ID NO: 3016759 - RNA, 15 nt, Human
augcuguacauacuu

SEQ ID NO: 3016760 - RNA, 12 nt, Human
augcuguacaua

SEQ ID NO: 3016761 - RNA, 22 nt, Human
augcuguaacuuucugaaauaa

SEQ ID NO: 3016762 - RNA, 19 nt, Human
augcuccuggcccacugca

SEQ ID NO: 3016763 - RNA, 14 nt, Human
auggacaugaucuu

SEQ ID NO: 3016764 - RNA, 16 nt, Human
auggaagacagcucuu

SEQ ID NO: 3016765 - RNA, 13 nt, Human
uuucagaaaugug

SEQ ID NO: 3016766 - RNA, 17 nt, Human
auggcacaucagcacga

SEQ ID NO: 3016767 - RNA, 23 nt, Human
auggcacaucagcacgauuucug

SEQ ID NO: 3016768 - RNA, 20 nt, Human
auggacguguuaugacucca

SEQ ID NO: 3016769 - RNA, 19 nt, Human
auggacguguuaugacucc

SEQ ID NO: 3016770 - RNA, 23 nt, Human
auggacguguuaugacuccagaa

SEQ ID NO: 3016771 - RNA, 18 nt, Human
auggauuuccagccaaag

SEQ ID NO: 3016772 - RNA, 21 nt, Human
auggccgggcgcgguggcuca

SEQ ID NO: 3016773 - RNA, 20 nt, Human
auggccuuugcuugaaagaa

SEQ ID NO: 3016774 - RNA, 18 nt, Human
augcaguacuaacauuua

SEQ ID NO: 3016775 - RNA, 13 nt, Human
augcagguuuuau

SEQ ID NO: 3016776 - RNA, 15 nt, Human
augcagccucacagu

SEQ ID NO: 3016777 - RNA, 14 nt, Human
augcagccucacag

SEQ ID NO: 3016778 - RNA, 13 nt, Human
augcagccucaca

SEQ ID NO: 3016779 - RNA, 22 nt, Human
uuuaauuugaagguagaauguu

SEQ ID NO: 3016780 - RNA, 12 nt, Human
uuuaauucaguu

SEQ ID NO: 3016781 - RNA, 17 nt, Human
uuuaagugcugcauuua

SEQ ID NO: 3016782 - RNA, 19 nt, Human
uuuaagugcugcauuuaaa

SEQ ID NO: 3016783 - RNA, 15 nt, Human
uuuaagugcugcauu

SEQ ID NO: 3016784 - RNA, 16 nt, Human
uuuaagugcugcauuu

SEQ ID NO: 3016785 - RNA, 14 nt, Human
uuuaagaggcaggg

SEQ ID NO: 3016786 - RNA, 15 nt, Human
augcacuuuguucug

SEQ ID NO: 3016787 - RNA, 13 nt, Human
uuguuuucagugu

SEQ ID NO: 3016788 - RNA, 16 nt, Human
uuguuuucaguguaca

SEQ ID NO: 3016789 - RNA, 13 nt, Human
augauuucacagu

SEQ ID NO: 3016790 - RNA, 21 nt, Human
augauucaacagguuuuccug

SEQ ID NO: 3016791 - RNA, 19 nt, Human
augauuaaccacuucagcu

SEQ ID NO: 3016792 - RNA, 21 nt, Human
augauuaaccacuucagcuga

SEQ ID NO: 3016793 - RNA, 20 nt, Human
augauuaaccacuucagcug

SEQ ID NO: 3016794 - RNA, 12 nt, Human
augcacuuuguu

SEQ ID NO: 3016795 - RNA, 13 nt, Human
augcaccagcccu

SEQ ID NO: 3016796 - RNA, 21 nt, Human
uugugaggaagccgcuggggc

SEQ ID NO: 3016797 - RNA, 18 nt, Human
uugugauacaaugcugug

SEQ ID NO: 3016798 - RNA, 22 nt, Human
uuguucuggcucuuccaggcug

SEQ ID NO: 3016799 - RNA, 20 nt, Human
uuguucuggcucuuccaggc

SEQ ID NO: 3016800 - RNA, 19 nt, Human
uuguucuggcucuuccagg

SEQ ID NO: 3016801 - RNA, 17 nt, Human
uuguguguuuauuguca

SEQ ID NO: 3016802 - RNA, 13 nt, Human
uugugguuaaucu

SEQ ID NO: 3016803 - RNA, 13 nt, Human
aucauuucaagaa

SEQ ID NO: 3016804 - RNA, 21 nt, Human
aucauugaaaucuuuuugcuu

SEQ ID NO: 3016805 - RNA, 20 nt, Human
aucaggccaggcccucugcc

SEQ ID NO: 3016806 - RNA, 20 nt, Human
aucauugaaaucuuuuugcu

SEQ ID NO: 3016807 - RNA, 23 nt, Human
aucaggccaggcccucugcccac

SEQ ID NO: 3016808 - RNA, 22 nt, Human
aucaggccaggcccucugccca

SEQ ID NO: 3016809 - RNA, 21 nt, Human
aucaggccaggcccucugccc

SEQ ID NO: 3016810 - RNA, 13 nt, Human
uucugccgcagcc

SEQ ID NO: 3016811 - RNA, 14 nt, Human
uucugacccaugcu

SEQ ID NO: 3016812 - RNA, 16 nt, Human
uucucuuuucaaaaca

SEQ ID NO: 3016813 - RNA, 17 nt, Human
uucucuacucuagggaa

SEQ ID NO: 3016814 - RNA, 16 nt, Human
uucuggcuaugcauuu

SEQ ID NO: 3016815 - RNA, 15 nt, Human
uucugccgcagcccu

SEQ ID NO: 3016816 - RNA, 14 nt, Human
uucugccgcagccc

SEQ ID NO: 3016817 - RNA, 18 nt, Human
uucuggcuaugcauuuga

SEQ ID NO: 3016818 - RNA, 20 nt, Human
uucuggcuaugcauuugaaa

SEQ ID NO: 3016819 - RNA, 21 nt, Human
auccaagcuggucccacucag

SEQ ID NO: 3016820 - RNA, 21 nt, Human
uugaaauuuuuauuaaauuau

SEQ ID NO: 3016821 - RNA, 20 nt, Human
uugaaauauaggaacuuaaa

SEQ ID NO: 3016822 - RNA, 11 nt, Human
uugaaaucuuu

SEQ ID NO: 3016823 - RNA, 14 nt, Human
uucuuuuugaaaug

SEQ ID NO: 3016824 - RNA, 15 nt, Human
uucuuuuugaaaugu

SEQ ID NO: 3016825 - RNA, 20 nt, Human
auccuagucauucuucccua

SEQ ID NO: 3016826 - RNA, 13 nt, Human
auccuaguuccac

SEQ ID NO: 3016827 - RNA, 21 nt, Human
auccuaggcauuugcugaaua

SEQ ID NO: 3016828 - RNA, 18 nt, Human
auccuaauaaaaagguga

SEQ ID NO: 3016829 - RNA, 22 nt, Human
auccuaauaaaaaggugaccau

SEQ ID NO: 3016830 - RNA, 14 nt, Human
auccuaauaaaaag

SEQ ID NO: 3016831 - RNA, 15 nt, Human
auccuaauaaaaagg

SEQ ID NO: 3016832 - RNA, 16 nt, Human
auccuaauaaaaaggu

SEQ ID NO: 3016833 - RNA, 17 nt, Human
auccuaauaaaaaggug

SEQ ID NO: 3016834 - RNA, 12 nt, Human
auccuaauaaaa

SEQ ID NO: 3016835 - RNA, 21 nt, Human
auccuaagcuauucaguaaua

SEQ ID NO: 3016836 - RNA, 15 nt, Human
uucuuggcccaggau

SEQ ID NO: 3016837 - RNA, 12 nt, Human
uucuugcaaagu

SEQ ID NO: 3016838 - RNA, 22 nt, Human
uucuuucuggcuaugcauuuga

SEQ ID NO: 3016839 - RNA, 20 nt, Human
uucuguuuuucuaggccugg

SEQ ID NO: 3016840 - RNA, 11 nt, Human
uucuguucuuu

SEQ ID NO: 3016841 - RNA, 18 nt, Human
uucuguucuuucuggcua

SEQ ID NO: 3016842 - RNA, 13 nt, Human
uucuuaauucuua

SEQ ID NO: 3016843 - RNA, 23 nt, Human
uucuuccucccucccucuuuccc

SEQ ID NO: 3016844 - RNA, 13 nt, Human
uucucagcagagu

SEQ ID NO: 3016845 - RNA, 13 nt, Human
aucaggccaggcc

SEQ ID NO: 3016846 - RNA, 21 nt, Human
uucucacugccaugccagcuu

SEQ ID NO: 3016847 - RNA, 22 nt, Human
uucuaaauaucccuuggacauu

SEQ ID NO: 3016848 - RNA, 13 nt, Human
uucgcuccugugu

SEQ ID NO: 3016849 - RNA, 21 nt, Human
uucgcaggauucuuccucccu

SEQ ID NO: 3016850 - RNA, 21 nt, Human
uuccuucaagaaugcaguacu

SEQ ID NO: 3016851 - RNA, 14 nt, Human
uuccuucaagaaug

SEQ ID NO: 3016852 - RNA, 19 nt, Human
aucaaccccuucgcuccug

SEQ ID NO: 3016853 - RNA, 20 nt, Human
aucaaccccuucgcuccugu

SEQ ID NO: 3016854 - RNA, 22 nt, Human
aucaaccccuucgcuccugugu

SEQ ID NO: 3016855 - RNA, 18 nt, Human
uucccuuuuuuggcugcu

SEQ ID NO: 3016856 - RNA, 20 nt, Human
uucccuuuuuuggcugcuga

SEQ ID NO: 3016857 - RNA, 19 nt, Human
uucccuuuuuuggcugcug

SEQ ID NO: 3016858 - RNA, 16 nt, Human
auaugaugacuguuuu

SEQ ID NO: 3016859 - RNA, 13 nt, Human
auaugcacacauu

SEQ ID NO: 3016860 - RNA, 16 nt, Human
auaugcacacauuuuu

SEQ ID NO: 3016861 - RNA, 14 nt, Human
auaugcacacauuu

SEQ ID NO: 3016862 - RNA, 15 nt, Human
auaugcacacauuuu

SEQ ID NO: 3016863 - RNA, 17 nt, Human
auauguaacaagccacc

SEQ ID NO: 3016864 - RNA, 16 nt, Human
auauguaacaagccac

SEQ ID NO: 3016865 - RNA, 16 nt, Human
auaucugaaaauguau

SEQ ID NO: 3016866 - RNA, 17 nt, Human
auaucugaaaauguaug

SEQ ID NO: 3016867 - RNA, 20 nt, Human
auaucugaaaauguaugugu

SEQ ID NO: 3016868 - RNA, 17 nt, Human
uucaucccucuggggcu

SEQ ID NO: 3016869 - RNA, 21 nt, Human
uucaucccucuggggcuguuc

SEQ ID NO: 3016870 - RNA, 18 nt, Human
uucagugccuuauggaac

SEQ ID NO: 3016871 - RNA, 13 nt, Human
uucagugccuuau

SEQ ID NO: 3016872 - RNA, 12 nt, Human
uucagugccuua

SEQ ID NO: 3016873 - RNA, 16 nt, Human
uucagugccaaaaaca

SEQ ID NO: 3016874 - RNA, 11 nt, Human
uucagaaaugu

SEQ ID NO: 3016875 - RNA, 13 nt, Human
uucagaaaugugu

SEQ ID NO: 3016876 - RNA, 17 nt, Human
uuccaggggugggacac

SEQ ID NO: 3016877 - RNA, 18 nt, Human
uuccaccaucaagccacc

SEQ ID NO: 3016878 - RNA, 22 nt, Human
uuccacaagagcccaggccucc

SEQ ID NO: 3016879 - RNA, 19 nt, Human
uuccaccaucaagccacca

SEQ ID NO: 3016880 - RNA, 15 nt, Human
uuccaaggguacuaa

SEQ ID NO: 3016881 - RNA, 17 nt, Human
uuccaaggguacuaagg

SEQ ID NO: 3016882 - RNA, 16 nt, Human
auauguggaguucauc

SEQ ID NO: 3016883 - RNA, 15 nt, Human
auauguggaguucau

SEQ ID NO: 3016884 - RNA, 23 nt, Human
uucccaaagcagugcaugcuguc

SEQ ID NO: 3016885 - RNA, 22 nt, Human
uuccagugaggcucugcccuug

SEQ ID NO: 3016886 - RNA, 21 nt, Human
uuccagugaggcucugcccuu

SEQ ID NO: 3016887 - RNA, 20 nt, Human
uuccagugaggcucugcccu

SEQ ID NO: 3016888 - RNA, 19 nt, Human
uuccagugaggcucugccc

SEQ ID NO: 3016889 - RNA, 17 nt, Human
uuccagugaggcucugc

SEQ ID NO: 3016890 - RNA, 21 nt, Human
uuccaggggugggacacccug

SEQ ID NO: 3016891 - RNA, 18 nt, Human
uucccaagcucugcuccu

SEQ ID NO: 3016892 - RNA, 22 nt, Human
uucccaccucucucacuccuug

SEQ ID NO: 3016893 - RNA, 12 nt, Human
uucccaccucuc

SEQ ID NO: 3016894 - RNA, 13 nt, Human
uucccaagcucug

SEQ ID NO: 3016895 - RNA, 14 nt, Human
uucccaagcucugc

SEQ ID NO: 3016896 - RNA, 15 nt, Human
uucccaagcucugcu

SEQ ID NO: 3016897 - RNA, 16 nt, Human
uucccaagcucugcuc

SEQ ID NO: 3016898 - RNA, 23 nt, Human
uucaagaaguccccucuccucca

SEQ ID NO: 3016899 - RNA, 23 nt, Human
uucaagaaugcaguacuaacauu

SEQ ID NO: 3016900 - RNA, 21 nt, Human
uucaagcgauucuucugcuuc

SEQ ID NO: 3016901 - RNA, 18 nt, Human
uuauuuuuagacagaguc

SEQ ID NO: 3016902 - RNA, 17 nt, Human
uuauuuuuagacagagu

SEQ ID NO: 3016903 - RNA, 13 nt, Human
uucacaguucucu

SEQ ID NO: 3016904 - RNA, 20 nt, Human
uucacaguucucuccuucuu

SEQ ID NO: 3016905 - RNA, 15 nt, Human
uucacaguucucucc

SEQ ID NO: 3016906 - RNA, 20 nt, Human
uucacagaugggugcuugga

SEQ ID NO: 3016907 - RNA, 17 nt, Human
auaggaaaaacugauuu

SEQ ID NO: 3016908 - RNA, 16 nt, Human
auaggaaaaacugauu

SEQ ID NO: 3016909 - RNA, 14 nt, Human
auaggaaaaacuga

SEQ ID NO: 3016910 - RNA, 12 nt, Human
auaggaaaaacu

SEQ ID NO: 3016911 - RNA, 12 nt, Human
auauauaaccag

SEQ ID NO: 3016912 - RNA, 13 nt, Human
auauauaaccagu

SEQ ID NO: 3016913 - RNA, 22 nt, Human
auaguuaagcgugcauaaguua

SEQ ID NO: 3016914 - RNA, 22 nt, Human
auaguuggcuaggaccccucca

SEQ ID NO: 3016915 - RNA, 15 nt, Human
auaguggugugauuu

SEQ ID NO: 3016916 - RNA, 17 nt, Human
auaguggcuuaaaacaa

SEQ ID NO: 3016917 - RNA, 14 nt, Human
auucucagcagagu

SEQ ID NO: 3016918 - RNA, 15 nt, Human
auucucagcagagug

SEQ ID NO: 3016919 - RNA, 13 nt, Human
auucuccaccugc

SEQ ID NO: 3016920 - RNA, 18 nt, Human
auucucagaaucucaaau

SEQ ID NO: 3016921 - RNA, 20 nt, Human
auucucagaaucucaaauaa

SEQ ID NO: 3016922 - RNA, 16 nt, Human
auugacagauugaauu

SEQ ID NO: 3016923 - RNA, 16 nt, Human
auucucagcagagugc

SEQ ID NO: 3016924 - RNA, 17 nt, Human
auucuccaccugccagg

SEQ ID NO: 3016925 - RNA, 16 nt, Human
auucuccaccugccag

SEQ ID NO: 3016926 - RNA, 14 nt, Human
auucucagaaucuc

SEQ ID NO: 3016927 - RNA, 13 nt, Human
auucuacuuugag

SEQ ID NO: 3016928 - RNA, 16 nt, Human
auucuacuuugagugc

SEQ ID NO: 3016929 - RNA, 23 nt, Human
auugccauuucuuccacaagagc

SEQ ID NO: 3016930 - RNA, 17 nt, Human
auugcccacgcuggagu

SEQ ID NO: 3016931 - RNA, 21 nt, Human
auugcccacgcuggagugcag

SEQ ID NO: 3016932 - RNA, 16 nt, Human
auugcggacagccacg

SEQ ID NO: 3016933 - RNA, 18 nt, Human
auugcggacagccacggc

SEQ ID NO: 3016934 - RNA, 19 nt, Human
auugcggacagccacggcc

SEQ ID NO: 3016935 - RNA, 21 nt, Human
auugcaacaggcugggcuuca

SEQ ID NO: 3016936 - RNA, 13 nt, Human
auugaccugaggc

SEQ ID NO: 3016937 - RNA, 15 nt, Human
auugcaacaggcugg

SEQ ID NO: 3016938 - RNA, 18 nt, Human
auuuaaacacauuaaagg

SEQ ID NO: 3016939 - RNA, 17 nt, Human
auuuaaacacauuaaag

SEQ ID NO: 3016940 - RNA, 15 nt, Human
auuuaacagaaaugu

SEQ ID NO: 3016941 - RNA, 16 nt, Human
auuuaacagaaaugua

SEQ ID NO: 3016942 - RNA, 17 nt, Human
auuuaacagaaauguac

SEQ ID NO: 3016943 - RNA, 19 nt, Human
auuuaacagaaauguacag

SEQ ID NO: 3016944 - RNA, 20 nt, Human
auuuaacagaaauguacagc

SEQ ID NO: 3016945 - RNA, 19 nt, Human
auuuaauuuuuuugagaca

SEQ ID NO: 3016946 - RNA, 23 nt, Human
auuuaauuuuuuugagacagagu

SEQ ID NO: 3016947 - RNA, 22 nt, Human
auuuaauuugaagguagaaugu

SEQ ID NO: 3016948 - RNA, 23 nt, Human
auuggcuuuggguugcaggaccu

SEQ ID NO: 3016949 - RNA, 13 nt, Human
auuuuauuaugca

SEQ ID NO: 3016950 - RNA, 17 nt, Human
auuuuauuaugcaugaa

SEQ ID NO: 3016951 - RNA, 14 nt, Human
auuuuauuaugcau

SEQ ID NO: 3016952 - RNA, 15 nt, Human
auuuuauuaugcaug

SEQ ID NO: 3016953 - RNA, 13 nt, Human
auuuauuauggca

SEQ ID NO: 3016954 - RNA, 20 nt, Human
auuuauuaaaugcccagccc

SEQ ID NO: 3016955 - RNA, 21 nt, Human
auuucuaaaucuccaaaauaa

SEQ ID NO: 3016956 - RNA, 12 nt, Human
auuucuaaaucu

SEQ ID NO: 3016957 - RNA, 13 nt, Human
auuucuaaaucuc

SEQ ID NO: 3016958 - RNA, 14 nt, Human
auuuccugugucuu

SEQ ID NO: 3016959 - RNA, 16 nt, Human
auuuauuauggcacau

SEQ ID NO: 3016960 - RNA, 17 nt, Human
auuuggugguuucagaa

SEQ ID NO: 3016961 - RNA, 18 nt, Human
auuuggugguuucagaaa

SEQ ID NO: 3016962 - RNA, 20 nt, Human
auuuggugguuucagaaaug

SEQ ID NO: 3016963 - RNA, 20 nt, Human
auuucuuuugccguuauuaa

SEQ ID NO: 3016964 - RNA, 16 nt, Human
auuugagcagggcuca

SEQ ID NO: 3016965 - RNA, 23 nt, Human
auuugaggucuguucuuuccaaa

SEQ ID NO: 3016966 - RNA, 17 nt, Human
auuugagcagggcucag

SEQ ID NO: 3016967 - RNA, 22 nt, Human
auuugaggucuguucuuuccaa

SEQ ID NO: 3016968 - RNA, 23 nt, Human
auuucuuuugccguuauuaaaaa

SEQ ID NO: 3016969 - RNA, 11 nt, Human
auuauuaacaa

SEQ ID NO: 3016970 - RNA, 23 nt, Human
auuauuuauuaaaugcccagccc

SEQ ID NO: 3016971 - RNA, 22 nt, Human
auuaccugaauuuuggcugugu

SEQ ID NO: 3016972 - RNA, 19 nt, Human
auuaccacagacauacuaa

SEQ ID NO: 3016973 - RNA, 22 nt, Human
uuuuuguuccacaaguuaaaua

SEQ ID NO: 3016974 - RNA, 21 nt, Human
auucaguuguuagugugucuu

SEQ ID NO: 3016975 - RNA, 16 nt, Human
auucaguuguuagugu

SEQ ID NO: 3016976 - RNA, 23 nt, Human
auucaggaagcucagggccuggc

SEQ ID NO: 3016977 - RNA, 22 nt, Human
auucaggaagcucagggccugg

SEQ ID NO: 3016978 - RNA, 21 nt, Human
auucaggaagcucagggccug

SEQ ID NO: 3016979 - RNA, 18 nt, Human
auucagcucugcaagaau

SEQ ID NO: 3016980 - RNA, 14 nt, Human
auucagcucugcaa

SEQ ID NO: 3016981 - RNA, 20 nt, Human
auuccccagauugcaacagg

SEQ ID NO: 3016982 - RNA, 22 nt, Human
auuccccacccugaaagcccug

SEQ ID NO: 3016983 - RNA, 16 nt, Human
auuccccaggaggcca

SEQ ID NO: 3016984 - RNA, 12 nt, Human
uuugcacauuaa

SEQ ID NO: 3016985 - RNA, 22 nt, Human
uuugccauguuggccaggcugg

SEQ ID NO: 3016986 - RNA, 16 nt, Human
uuugcacauuaaauga

SEQ ID NO: 3016987 - RNA, 13 nt, Human
uuugcacauuaaa

SEQ ID NO: 3016988 - RNA, 10 nt, Human
uuuggccaga

SEQ ID NO: 3016989 - RNA, 12 nt, Human
uuuggccagaag

SEQ ID NO: 3016990 - RNA, 14 nt, Human
uuuggccagaaguc

SEQ ID NO: 3016991 - RNA, 13 nt, Human
uuuggggaagaac

SEQ ID NO: 3016992 - RNA, 22 nt, Human
uuugggaggccaaggugggagg

SEQ ID NO: 3016993 - RNA, 14 nt, Human
uuuggggauauuuu

SEQ ID NO: 3016994 - RNA, 23 nt, Human
augucuagaccaggaccucccuc

SEQ ID NO: 3016995 - RNA, 23 nt, Human
augucucuuuaaugucacaggca

SEQ ID NO: 3016996 - RNA, 15 nt, Human
augucaguuguuauu

SEQ ID NO: 3016997 - RNA, 17 nt, Human
augucaguuguuauuua

SEQ ID NO: 3016998 - RNA, 23 nt, Human
auguccaagaagcccaggaaagg

SEQ ID NO: 3016999 - RNA, 18 nt, Human
auguccaagaagcccagg

SEQ ID NO: 3017000 - RNA, 19 nt, Human
auguccaagaagcccagga

SEQ ID NO: 3017001 - RNA, 21 nt, Human
augucagugugacugaucucu

SEQ ID NO: 3017002 - RNA, 16 nt, Human
augucagugugacuga

SEQ ID NO: 3017003 - RNA, 15 nt, Human
augucagugugacug

SEQ ID NO: 3017004 - RNA, 12 nt, Human
auguauguguaa

SEQ ID NO: 3017005 - RNA, 15 nt, Human
auguaucugagcagg

SEQ ID NO: 3017006 - RNA, 15 nt, Human
auguaucaaugagua

SEQ ID NO: 3017007 - RNA, 22 nt, Human
uuugggggaaaauuuagaaaua

SEQ ID NO: 3017008 - RNA, 17 nt, Human
uuuuaagacuuugguua

SEQ ID NO: 3017009 - RNA, 16 nt, Human
uuuuaagaggcagggu

SEQ ID NO: 3017010 - RNA, 15 nt, Human
uuuuaagaggcaggg

SEQ ID NO: 3017011 - RNA, 22 nt, Human
uuuuaagggcccuuuuucaaua

SEQ ID NO: 3017012 - RNA, 15 nt, Human
uuuuaagugcugcau

SEQ ID NO: 3017013 - RNA, 21 nt, Human
uuuuaaaaaacugcugacugu

SEQ ID NO: 3017014 - RNA, 18 nt, Human
uuuguuugaacugauaaa

SEQ ID NO: 3017015 - RNA, 22 nt, Human
uuuguaacuguuuagaugaaug

SEQ ID NO: 3017016 - RNA, 13 nt, Human
uuuguagagccag

SEQ ID NO: 3017017 - RNA, 19 nt, Human
uuugugaggaagccgcugg

SEQ ID NO: 3017018 - RNA, 18 nt, Human
uuugugaggaagccgcug

SEQ ID NO: 3017019 - RNA, 12 nt, Human
uuuguuugaacu

SEQ ID NO: 3017020 - RNA, 13 nt, Human
uuuguuugaacug

SEQ ID NO: 3017021 - RNA, 14 nt, Human
uuuguuugaacuga

SEQ ID NO: 3017022 - RNA, 15 nt, Human
uuuuauuauuaacaa

SEQ ID NO: 3017023 - RNA, 23 nt, Human
uuuuccaguaaugagcuuaagaa

SEQ ID NO: 3017024 - RNA, 19 nt, Human
uuuuccagguuuaagcugu

SEQ ID NO: 3017025 - RNA, 19 nt, Human
uuuuauaaacuuuaccuuu

SEQ ID NO: 3017026 - RNA, 14 nt, Human
uuuuauaaacuuua

SEQ ID NO: 3017027 - RNA, 17 nt, Human
uuuuauaaacuuuaccu

SEQ ID NO: 3017028 - RNA, 12 nt, Human
uuuuauaaacuu

SEQ ID NO: 3017029 - RNA, 13 nt, Human
uuuuauaaacuuu

SEQ ID NO: 3017030 - RNA, 23 nt, Human
uuuuagaguugauacuacaguuu

SEQ ID NO: 3017031 - RNA, 16 nt, Human
auguuggccaggcugg

SEQ ID NO: 3017032 - RNA, 13 nt, Human
auguuggccaggc

SEQ ID NO: 3017033 - RNA, 14 nt, Human
auguuggccaggcu

SEQ ID NO: 3017034 - RNA, 21 nt, Human
uuuuaagugcugcauuuaaaa

SEQ ID NO: 3017035 - RNA, 16 nt, Human
uuuuaagugcugcauu

SEQ ID NO: 3017036 - RNA, 17 nt, Human
uuuuaagugcugcauuu

SEQ ID NO: 3017037 - RNA, 21 nt, Human
auguucaucauccuaagcuau

SEQ ID NO: 3017038 - RNA, 13 nt, Human
auuaaagugccca

SEQ ID NO: 3017039 - RNA, 17 nt, Human
auuaaacuuaaucuaaa

SEQ ID NO: 3017040 - RNA, 16 nt, Human
auuaaacuuaaucuaa

SEQ ID NO: 3017041 - RNA, 19 nt, Human
auuaaacuuaaucuaaaug

SEQ ID NO: 3017042 - RNA, 21 nt, Human
auuaaacuuaaucuaaaugga

SEQ ID NO: 3017043 - RNA, 20 nt, Human
auuaaccacuucagcugacu

SEQ ID NO: 3017044 - RNA, 18 nt, Human
auuaaccacuucagcuga

SEQ ID NO: 3017045 - RNA, 17 nt, Human
auuaaccacuucagcug

SEQ ID NO: 3017046 - RNA, 13 nt, Human
auuaagaaagacu

SEQ ID NO: 3017047 - RNA, 14 nt, Human
auuaagaaagacua

SEQ ID NO: 3017048 - RNA, 23 nt, Human
auuaacuuuuauaaacuuuaccu

SEQ ID NO: 3017049 - RNA, 12 nt, Human
auuaacuuuuau

SEQ ID NO: 3017050 - RNA, 16 nt, Human
auuaacuuuuauaaac

SEQ ID NO: 3017051 - RNA, 17 nt, Human
auuaacuuuuauaaacu

SEQ ID NO: 3017052 - RNA, 19 nt, Human
auuaacuuuuauaaacuuu

SEQ ID NO: 3017053 - RNA, 20 nt, Human
auuaacuuuuauaaacuuua

SEQ ID NO: 3017054 - RNA, 19 nt, Human
uuuucucacagaagaugaa

SEQ ID NO: 3017055 - RNA, 14 nt, Human
auguuuuccaugag

SEQ ID NO: 3017056 - RNA, 17 nt, Human
auguuuuucuucucccu

SEQ ID NO: 3017057 - RNA, 18 nt, Human
auguuuuucuucucccuc

SEQ ID NO: 3017058 - RNA, 17 nt, Human
aguuuugaagauucuau

SEQ ID NO: 3017059 - RNA, 18 nt, Human
aguuuugaagauucuaug

SEQ ID NO: 3017060 - RNA, 23 nt, Human
aguuuuuauggcuuuugugcauu

SEQ ID NO: 3017061 - RNA, 21 nt, Human
uuaagaaaaaggaugcacaga

SEQ ID NO: 3017062 - RNA, 19 nt, Human
uuaagaaaaaggaugcaca

SEQ ID NO: 3017063 - RNA, 20 nt, Human
uuaagaaaaaggaugcacag

SEQ ID NO: 3017064 - RNA, 20 nt, Human
uuaagaacuaaaauguucua

SEQ ID NO: 3017065 - RNA, 16 nt, Human
uuaagaacuaaaaugu

SEQ ID NO: 3017066 - RNA, 19 nt, Human
uuaagaacuaaaauguucu

SEQ ID NO: 3017067 - RNA, 22 nt, Human
uuaagaaagacuaucuaaaugu

SEQ ID NO: 3017068 - RNA, 13 nt, Human
uuaaggguaugau

SEQ ID NO: 3017069 - RNA, 9 nt, Human
uuaaggugg

SEQ ID NO: 3017070 - RNA, 14 nt, Human
uuaagugcugcauu

SEQ ID NO: 3017071 - RNA, 19 nt, Human
uuaagugcugcauuuaaaa

SEQ ID NO: 3017072 - RNA, 15 nt, Human
uuaagugcugcauuu

SEQ ID NO: 3017073 - RNA, 16 nt, Human
uuaagugcugcauuua

SEQ ID NO: 3017074 - RNA, 22 nt, Human
uuaaucauuaggugugacugaa

SEQ ID NO: 3017075 - RNA, 23 nt, Human
uuaaucauuaggugugacugaau

SEQ ID NO: 3017076 - RNA, 13 nt, Human
uuaaucauuaggu

SEQ ID NO: 3017077 - RNA, 19 nt, Human
uuaaugaaagacuguacaa

SEQ ID NO: 3017078 - RNA, 22 nt, Human
uuaaucugguuuauuuuuguuc

SEQ ID NO: 3017079 - RNA, 18 nt, Human
uuaaugaaagacuguaca

SEQ ID NO: 3017080 - RNA, 14 nt, Human
uuaaacacauuaaa

SEQ ID NO: 3017081 - RNA, 16 nt, Human
uuaaaaaucucaaauu

SEQ ID NO: 3017082 - RNA, 14 nt, Human
uuaaaaaucucaaa

SEQ ID NO: 3017083 - RNA, 15 nt, Human
uuaaaaaucucaaau

SEQ ID NO: 3017084 - RNA, 19 nt, Human
uuaaacaugcuguacauac

SEQ ID NO: 3017085 - RNA, 23 nt, Human
uuaaacaugcuguacauacuuuu

SEQ ID NO: 3017086 - RNA, 22 nt, Human
uuaaacaugcuguacauacuuu

SEQ ID NO: 3017087 - RNA, 21 nt, Human
uuaaacaugcuguacauacuu

SEQ ID NO: 3017088 - RNA, 15 nt, Human
uuaaauaaugugaaa

SEQ ID NO: 3017089 - RNA, 13 nt, Human
uuaaauagaugac

SEQ ID NO: 3017090 - RNA, 14 nt, Human
uuaaauagaugaca

SEQ ID NO: 3017091 - RNA, 16 nt, Human
uuaaauagaugacauu

SEQ ID NO: 3017092 - RNA, 13 nt, Human
uuaaauaauguga

SEQ ID NO: 3017093 - RNA, 16 nt, Human
uuaaauaaugugaaac

SEQ ID NO: 3017094 - RNA, 18 nt, Human
uuaaauaaugugaaacug

SEQ ID NO: 3017095 - RNA, 20 nt, Human
uuaacagaaauguacagcaa

SEQ ID NO: 3017096 - RNA, 19 nt, Human
uuaacagaaauguacagca

SEQ ID NO: 3017097 - RNA, 16 nt, Human
uuaacagaaauguaca

SEQ ID NO: 3017098 - RNA, 13 nt, Human
uuaaaaaaaaucc

SEQ ID NO: 3017099 - RNA, 17 nt, Human
aguuggucccccuucca

SEQ ID NO: 3017100 - RNA, 13 nt, Human
aguuggucccccu

SEQ ID NO: 3017101 - RNA, 11 nt, Human
aguuggucccc

SEQ ID NO: 3017102 - RNA, 13 nt, Human
aguugggcuuccu

SEQ ID NO: 3017103 - RNA, 19 nt, Human
aguugggcuuccucauagu

SEQ ID NO: 3017104 - RNA, 23 nt, Human
aguugccagucaccccggccacc

SEQ ID NO: 3017105 - RNA, 23 nt, Human
auaaauauugguugggaugacuu

SEQ ID NO: 3017106 - RNA, 20 nt, Human
auaaccaguguuguggauuu

SEQ ID NO: 3017107 - RNA, 11 nt, Human
auaaauuauuu

SEQ ID NO: 3017108 - RNA, 15 nt, Human
uuacugaacaguaac

SEQ ID NO: 3017109 - RNA, 23 nt, Human
uuacugaacaguaacauagcugu

SEQ ID NO: 3017110 - RNA, 13 nt, Human
uuagacagagucu

SEQ ID NO: 3017111 - RNA, 20 nt, Human
uuagacagagucucacuguu

SEQ ID NO: 3017112 - RNA, 13 nt, Human
uuagacagucccu

SEQ ID NO: 3017113 - RNA, 19 nt, Human
uuacccucauguucuuaau

SEQ ID NO: 3017114 - RNA, 17 nt, Human
uuagguugugaaugcag

SEQ ID NO: 3017115 - RNA, 13 nt, Human
uuagguugugaau

SEQ ID NO: 3017116 - RNA, 12 nt, Human
uuagguugugaa

SEQ ID NO: 3017117 - RNA, 15 nt, Human
uuaguuucuccaagc

SEQ ID NO: 3017118 - RNA, 22 nt, Human
uuaguuugcaguuacacuaaaa

SEQ ID NO: 3017119 - RNA, 18 nt, Human
uuagguuggcaaaaaggc

SEQ ID NO: 3017120 - RNA, 21 nt, Human
uuaggugugacugaauuucuu

SEQ ID NO: 3017121 - RNA, 16 nt, Human
uuaggugaggaagcaa

SEQ ID NO: 3017122 - RNA, 16 nt, Human
uuaggugugacugaau

SEQ ID NO: 3017123 - RNA, 20 nt, Human
uuagggaaggauacaaaagc

SEQ ID NO: 3017124 - RNA, 15 nt, Human
uuaggugaggaagca

SEQ ID NO: 3017125 - RNA, 18 nt, Human
uuagccaagugugguaga

SEQ ID NO: 3017126 - RNA, 18 nt, Human
uuagcaaauucuguuuuu

SEQ ID NO: 3017127 - RNA, 12 nt, Human
auaauacaccac

SEQ ID NO: 3017128 - RNA, 18 nt, Human
auaauacaccacuacauu

SEQ ID NO: 3017129 - RNA, 20 nt, Human
auaauacaccacuacauucu

SEQ ID NO: 3017130 - RNA, 15 nt, Human
auaaugcgugcauac

SEQ ID NO: 3017131 - RNA, 15 nt, Human
auaaugaaugaaaca

SEQ ID NO: 3017132 - RNA, 22 nt, Human
auaauugacaggauuauuggaa

SEQ ID NO: 3017133 - RNA, 15 nt, Human
uguuuagaugaaugu

SEQ ID NO: 3017134 - RNA, 20 nt, Human
uguuuagaugaaugucaguu

SEQ ID NO: 3017135 - RNA, 20 nt, Human
uguuuagauaauacaccacu

SEQ ID NO: 3017136 - RNA, 14 nt, Human
uguuuauugucaaa

SEQ ID NO: 3017137 - RNA, 23 nt, Human
aguucuauuuauuugugagacug

SEQ ID NO: 3017138 - RNA, 24 nt, Human
aguucaaucuggauucauauuuaa

SEQ ID NO: 3017139 - RNA, 16 nt, Human
aguucaauucucauuu

SEQ ID NO: 3017140 - RNA, 23 nt, Human
aguuccucauuagcauuuugcua

SEQ ID NO: 3017141 - RNA, 13 nt, Human
uguuauuuauuga

SEQ ID NO: 3017142 - RNA, 15 nt, Human
uguuauuuauugaaa

SEQ ID NO: 3017143 - RNA, 17 nt, Human
uguuauuuauugaaaug

SEQ ID NO: 3017144 - RNA, 18 nt, Human
uguuauuuauugaaauga

SEQ ID NO: 3017145 - RNA, 19 nt, Human
uguuauuuauugaaaugau

SEQ ID NO: 3017146 - RNA, 18 nt, Human
uguucuuaguuugcaguu

SEQ ID NO: 3017147 - RNA, 18 nt, Human
uguucuagcauggcugcc

SEQ ID NO: 3017148 - RNA, 15 nt, Human
aguggaguuacugaa

SEQ ID NO: 3017149 - RNA, 16 nt, Human
aguuacugaacaguaa

SEQ ID NO: 3017150 - RNA, 15 nt, Human
uguugcccaggcugg

SEQ ID NO: 3017151 - RNA, 13 nt, Human
uguugcccaggcu

SEQ ID NO: 3017152 - RNA, 19 nt, Human
uguucuuucacccuuuucu

SEQ ID NO: 3017153 - RNA, 20 nt, Human
uguucuugguuuguaaauua

SEQ ID NO: 3017154 - RNA, 22 nt, Human
uguucuugguuuguaaauuaac

SEQ ID NO: 3017155 - RNA, 12 nt, Human
agugcuuggccc

SEQ ID NO: 3017156 - RNA, 14 nt, Human
agugcuuggcccag

SEQ ID NO: 3017157 - RNA, 15 nt, Human
agugcuuggcccagg

SEQ ID NO: 3017158 - RNA, 16 nt, Human
agugcuuggcccagga

SEQ ID NO: 3017159 - RNA, 18 nt, Human
agugcuuggcccaggagu

SEQ ID NO: 3017160 - RNA, 19 nt, Human
agugcuuggcccaggaguu

SEQ ID NO: 3017161 - RNA, 16 nt, Human
uguggucccaccccac

SEQ ID NO: 3017162 - RNA, 16 nt, Human
agugcuuccaaggaug

SEQ ID NO: 3017163 - RNA, 12 nt, Human
ugugguuucauu

SEQ ID NO: 3017164 - RNA, 19 nt, Human
ugugucagcauagaaguaa

SEQ ID NO: 3017165 - RNA, 20 nt, Human
ugugguguuuccuggcacug

SEQ ID NO: 3017166 - RNA, 20 nt, Human
agugcugggauuacaagcgu

SEQ ID NO: 3017167 - RNA, 22 nt, Human
agugcugcauuuaaaagauaca

SEQ ID NO: 3017168 - RNA, 19 nt, Human
agugcugggauuacaggug

SEQ ID NO: 3017169 - RNA, 15 nt, Human
agugccuuacacaau

SEQ ID NO: 3017170 - RNA, 17 nt, Human
agugccuuacacaaugg

SEQ ID NO: 3017171 - RNA, 20 nt, Human
agugcugcauuuaaaagaua

SEQ ID NO: 3017172 - RNA, 13 nt, Human
uguuaauauuuua

SEQ ID NO: 3017173 - RNA, 21 nt, Human
uguuaacauggacaugaucuu

SEQ ID NO: 3017174 - RNA, 20 nt, Human
agugcuuggcccaggaguuu

SEQ ID NO: 3017175 - RNA, 22 nt, Human
agugcuuuaccaauugaaguaa

SEQ ID NO: 3017176 - RNA, 19 nt, Human
uguuaaugauagcuacugu

SEQ ID NO: 3017177 - RNA, 11 nt, Human
aguggaaaaau

SEQ ID NO: 3017178 - RNA, 19 nt, Human
aguggaaaaauagccugcc

SEQ ID NO: 3017179 - RNA, 18 nt, Human
aguggaaaaauagccugc

SEQ ID NO: 3017180 - RNA, 13 nt, Human
ugugucucuuggu

SEQ ID NO: 3017181 - RNA, 17 nt, Human
ugugucagguggggcag

SEQ ID NO: 3017182 - RNA, 19 nt, Human
ugugucagguggggcagcu

SEQ ID NO: 3017183 - RNA, 23 nt, Human
uguguuaucacccagaagaaaau

SEQ ID NO: 3017184 - RNA, 14 nt, Human
uguguuaugaagca

SEQ ID NO: 3017185 - RNA, 16 nt, Human
agugagucgaggacag

SEQ ID NO: 3017186 - RNA, 22 nt, Human
agugauucuccugccucagccu

SEQ ID NO: 3017187 - RNA, 24 nt, Human
agugauucuccugccucagccucc

SEQ ID NO: 3017188 - RNA, 14 nt, Human
agugccaaaaacaa

SEQ ID NO: 3017189 - RNA, 16 nt, Human
agugccaaaaacaaca

SEQ ID NO: 3017190 - RNA, 14 nt, Human
agugcccacaggau

SEQ ID NO: 3017191 - RNA, 22 nt, Human
ugugcucugaucauccacugug

SEQ ID NO: 3017192 - RNA, 12 nt, Human
ugugcucugauc

SEQ ID NO: 3017193 - RNA, 23 nt, Human
ugugcucugaucauccacugugc

SEQ ID NO: 3017194 - RNA, 15 nt, Human
ugugcucuggacagg

SEQ ID NO: 3017195 - RNA, 20 nt, Human
agucucacuguugcccaggc

SEQ ID NO: 3017196 - RNA, 18 nt, Human
agucucacuguugcccag

SEQ ID NO: 3017197 - RNA, 19 nt, Human
agucucacuguugcccagg

SEQ ID NO: 3017198 - RNA, 20 nt, Human
ugugcccuaaaguguauuuu

SEQ ID NO: 3017199 - RNA, 21 nt, Human
ugugcccuaaaguguauuuuu

SEQ ID NO: 3017200 - RNA, 15 nt, Human
ugugcugcccugccc

SEQ ID NO: 3017201 - RNA, 14 nt, Human
ugugcugcccugcc

SEQ ID NO: 3017202 - RNA, 13 nt, Human
ugugcugcccugc

SEQ ID NO: 3017203 - RNA, 12 nt, Human
ugugcugcccug

SEQ ID NO: 3017204 - RNA, 19 nt, Human
ugugcucuggacaggcaug

SEQ ID NO: 3017205 - RNA, 16 nt, Human
ugugcucuggacaggc

SEQ ID NO: 3017206 - RNA, 18 nt, Human
ugugcucuggacaggcau

SEQ ID NO: 3017207 - RNA, 17 nt, Human
agguagaauguuuucaa

SEQ ID NO: 3017208 - RNA, 23 nt, Human
agguagaaauaucugaaaaugua

SEQ ID NO: 3017209 - RNA, 21 nt, Human
agguaugcaaucaaaucugcu

SEQ ID NO: 3017210 - RNA, 17 nt, Human
agguaugcaaucaaauc

SEQ ID NO: 3017211 - RNA, 18 nt, Human
aggguuggccccugcccg

SEQ ID NO: 3017212 - RNA, 23 nt, Human
aggguuggccccugcccggcugc

SEQ ID NO: 3017213 - RNA, 17 nt, Human
aggguuggccccugccc

SEQ ID NO: 3017214 - RNA, 17 nt, Human
agguagaaauaucugaa

SEQ ID NO: 3017215 - RNA, 19 nt, Human
agguagaaauaucugaaaa

SEQ ID NO: 3017216 - RNA, 12 nt, Human
aggucagagccu

SEQ ID NO: 3017217 - RNA, 17 nt, Human
aggucauuuuuuuuaag

SEQ ID NO: 3017218 - RNA, 20 nt, Human
aggucauuuuuuuuaagaaa

SEQ ID NO: 3017219 - RNA, 15 nt, Human
uggucccaccccaca

SEQ ID NO: 3017220 - RNA, 14 nt, Human
uggucccaccccac

SEQ ID NO: 3017221 - RNA, 18 nt, Human
uggucaccaaaucagcug

SEQ ID NO: 3017222 - RNA, 22 nt, Human
uggucagauuugaacucuucaa

SEQ ID NO: 3017223 - RNA, 17 nt, Human
uggucucaaacucuuga

SEQ ID NO: 3017224 - RNA, 23 nt, Human
uggucucaaacucuugaccucag

SEQ ID NO: 3017225 - RNA, 13 nt, Human
uggucccacccca

SEQ ID NO: 3017226 - RNA, 16 nt, Human
uggucucaaacucuug

SEQ ID NO: 3017227 - RNA, 16 nt, Human
uggucccaccccacac

SEQ ID NO: 3017228 - RNA, 16 nt, Human
uggucugacccacugc

SEQ ID NO: 3017229 - RNA, 17 nt, Human
uggucugacccacugcu

SEQ ID NO: 3017230 - RNA, 21 nt, Human
aggguggugaccucugccuga

SEQ ID NO: 3017231 - RNA, 22 nt, Human
aggguguccggucccuguccca

SEQ ID NO: 3017232 - RNA, 13 nt, Human
aggguuauaauaa

SEQ ID NO: 3017233 - RNA, 24 nt, Human
agggguucccuuuuuuggcugcug

SEQ ID NO: 3017234 - RNA, 20 nt, Human
agggucucacuauguugccc

SEQ ID NO: 3017235 - RNA, 21 nt, Human
agggucucacuauguugccca

SEQ ID NO: 3017236 - RNA, 22 nt, Human
agggucucacuauguugcccag

SEQ ID NO: 3017237 - RNA, 23 nt, Human
agggucucacuauguugcccagg

SEQ ID NO: 3017238 - RNA, 15 nt, Human
aggggguggccuccc

SEQ ID NO: 3017239 - RNA, 18 nt, Human
aggggguggccucccaac

SEQ ID NO: 3017240 - RNA, 17 nt, Human
aggggguggccucccaa

SEQ ID NO: 3017241 - RNA, 22 nt, Human
aggggugggacacccugugaug

SEQ ID NO: 3017242 - RNA, 20 nt, Human
aggggugggacacccuguga

SEQ ID NO: 3017243 - RNA, 18 nt, Human
aggggugggacacccugu

SEQ ID NO: 3017244 - RNA, 19 nt, Human
uggggucacucuggcagcu

SEQ ID NO: 3017245 - RNA, 23 nt, Human
aggggagcaaaaucgaugcagug

SEQ ID NO: 3017246 - RNA, 22 nt, Human
agggucucacucugucgcccag

SEQ ID NO: 3017247 - RNA, 21 nt, Human
agggucucacucugucgccca

SEQ ID NO: 3017248 - RNA, 22 nt, Human
uggguggcaccagcagccugga

SEQ ID NO: 3017249 - RNA, 22 nt, Human
ugggugcuuggaggaaggaaac

SEQ ID NO: 3017250 - RNA, 19 nt, Human
ugggugcuuggaggaagga

SEQ ID NO: 3017251 - RNA, 15 nt, Human
ugggugcuuggagga

SEQ ID NO: 3017252 - RNA, 16 nt, Human
ugguacuaacuuuccu

SEQ ID NO: 3017253 - RNA, 15 nt, Human
ugggcacaucauuuc

SEQ ID NO: 3017254 - RNA, 17 nt, Human
ugggcaacccccagccu

SEQ ID NO: 3017255 - RNA, 20 nt, Human
ugggcaacccccagccugcu

SEQ ID NO: 3017256 - RNA, 20 nt, Human
ugggcacaucauuucaagaa

SEQ ID NO: 3017257 - RNA, 20 nt, Human
ugggcccaaugcacuuuguu

SEQ ID NO: 3017258 - RNA, 16 nt, Human
ugggccaggagccucc

SEQ ID NO: 3017259 - RNA, 14 nt, Human
ugggccaggagccu

SEQ ID NO: 3017260 - RNA, 13 nt, Human
ugggccaggagcc

SEQ ID NO: 3017261 - RNA, 17 nt, Human
ugggaggucaaggcugc

SEQ ID NO: 3017262 - RNA, 23 nt, Human
ugggaggucaaggcugcagugag

SEQ ID NO: 3017263 - RNA, 20 nt, Human
ugggaggucaaggcugcagu

SEQ ID NO: 3017264 - RNA, 19 nt, Human
ugggaggucaaggcugcag

SEQ ID NO: 3017265 - RNA, 18 nt, Human
ugggaggucaaggcugca

SEQ ID NO: 3017266 - RNA, 16 nt, Human
ugggcaacccccagcc

SEQ ID NO: 3017267 - RNA, 17 nt, Human
agggaggugaccccagg

SEQ ID NO: 3017268 - RNA, 17 nt, Human
agggagugacagaggca

SEQ ID NO: 3017269 - RNA, 18 nt, Human
agggagugacagaggcag

SEQ ID NO: 3017270 - RNA, 19 nt, Human
agggagugacagaggcagc

SEQ ID NO: 3017271 - RNA, 15 nt, Human
agggagggcuucugc

SEQ ID NO: 3017272 - RNA, 23 nt, Human
agggcccagagaggguggugacc

SEQ ID NO: 3017273 - RNA, 18 nt, Human
agggcccagagagggugg

SEQ ID NO: 3017274 - RNA, 23 nt, Human
agggcuucugccauuucugagau

SEQ ID NO: 3017275 - RNA, 15 nt, Human
ugggcucccuuccca

SEQ ID NO: 3017276 - RNA, 19 nt, Human
ugggcucccuucccaccuc

SEQ ID NO: 3017277 - RNA, 18 nt, Human
ugggcucccuucccaccu

SEQ ID NO: 3017278 - RNA, 20 nt, Human
ugggcucccuucccaccucu

SEQ ID NO: 3017279 - RNA, 15 nt, Human
uggggaccagagcug

SEQ ID NO: 3017280 - RNA, 14 nt, Human
uggggaccagagcu

SEQ ID NO: 3017281 - RNA, 13 nt, Human
uggggaccucagg

SEQ ID NO: 3017282 - RNA, 18 nt, Human
uggggaccagagcugcca

SEQ ID NO: 3017283 - RNA, 17 nt, Human
uggggaccagagcugcc

SEQ ID NO: 3017284 - RNA, 19 nt, Human
ugggcuggguucuacccag

SEQ ID NO: 3017285 - RNA, 18 nt, Human
ugggcuggguucuaccca

SEQ ID NO: 3017286 - RNA, 20 nt, Human
uggggcugcaccggcuggcc

SEQ ID NO: 3017287 - RNA, 14 nt, Human
ugggguacccacug

SEQ ID NO: 3017288 - RNA, 18 nt, Human
uggggucacucuggcagc

SEQ ID NO: 3017289 - RNA, 17 nt, Human
uggggucacucuggcag

SEQ ID NO: 3017290 - RNA, 15 nt, Human
ugggguacccacugc

SEQ ID NO: 3017291 - RNA, 16 nt, Human
ugggguacccacugcu

SEQ ID NO: 3017292 - RNA, 20 nt, Human
ugggguacccacugcucugg

SEQ ID NO: 3017293 - RNA, 16 nt, Human
uggggcccugccuccu

SEQ ID NO: 3017294 - RNA, 15 nt, Human
uggggcccugccucc

SEQ ID NO: 3017295 - RNA, 18 nt, Human
uggggcggugagagggga

SEQ ID NO: 3017296 - RNA, 23 nt, Human
uggggaccucaggccugggggcu

SEQ ID NO: 3017297 - RNA, 12 nt, Human
uggggagaaagu

SEQ ID NO: 3017298 - RNA, 14 nt, Human
uggggcccugccuc

SEQ ID NO: 3017299 - RNA, 15 nt, Human
ugucaguauuucaac

SEQ ID NO: 3017300 - RNA, 16 nt, Human
ugucagcugaaccugg

SEQ ID NO: 3017301 - RNA, 18 nt, Human
agucacugagacagcccg

SEQ ID NO: 3017302 - RNA, 19 nt, Human
agucacugagacagcccgg

SEQ ID NO: 3017303 - RNA, 19 nt, Human
ugucagcugaaccugggua

SEQ ID NO: 3017304 - RNA, 13 nt, Human
agucaccaagccc

SEQ ID NO: 3017305 - RNA, 13 nt, Human
aguagucagacug

SEQ ID NO: 3017306 - RNA, 16 nt, Human
aguaggaagacuuugg

SEQ ID NO: 3017307 - RNA, 22 nt, Human
aguaggaagacuuuggaaagac

SEQ ID NO: 3017308 - RNA, 19 nt, Human
aguaggaagacuuuggaaa

SEQ ID NO: 3017309 - RNA, 18 nt, Human
aguaggaagacuuuggaa

SEQ ID NO: 3017310 - RNA, 17 nt, Human
aguaggaagacuuugga

SEQ ID NO: 3017311 - RNA, 14 nt, Human
uguauuuuuuuacu

SEQ ID NO: 3017312 - RNA, 19 nt, Human
ugucaagagggucugagga

SEQ ID NO: 3017313 - RNA, 15 nt, Human
ugucaagccauaauu

SEQ ID NO: 3017314 - RNA, 23 nt, Human
agucagacuggauaguccgucuc

SEQ ID NO: 3017315 - RNA, 22 nt, Human
agucagaaguuucugccgcagc

SEQ ID NO: 3017316 - RNA, 15 nt, Human
ugucgggcaugacac

SEQ ID NO: 3017317 - RNA, 14 nt, Human
ugucgggcaugaca

SEQ ID NO: 3017318 - RNA, 14 nt, Human
ugucgcccagucug

SEQ ID NO: 3017319 - RNA, 15 nt, Human
ugucgcccagucugg

SEQ ID NO: 3017320 - RNA, 12 nt, Human
ugucgggcauga

SEQ ID NO: 3017321 - RNA, 22 nt, Human
uguccuaaugcuugcugcugau

SEQ ID NO: 3017322 - RNA, 16 nt, Human
uguccuacccacccuc

SEQ ID NO: 3017323 - RNA, 14 nt, Human
uguccgagcuuuga

SEQ ID NO: 3017324 - RNA, 13 nt, Human
uguccgagcuuug

SEQ ID NO: 3017325 - RNA, 17 nt, Human
ugucccuuuuccuuuuu

SEQ ID NO: 3017326 - RNA, 16 nt, Human
agucucacuguugccc

SEQ ID NO: 3017327 - RNA, 17 nt, Human
agucucacuguugccca

SEQ ID NO: 3017328 - RNA, 23 nt, Human
aguccgaaagggacuuggaagcu

SEQ ID NO: 3017329 - RNA, 12 nt, Human
agucccugccaa

SEQ ID NO: 3017330 - RNA, 23 nt, Human
uguaauuaugguuaguagaggua

SEQ ID NO: 3017331 - RNA, 23 nt, Human
uguaauuaaguacuauguaucaa

SEQ ID NO: 3017332 - RNA, 17 nt, Human
aggugguuauggagagg

SEQ ID NO: 3017333 - RNA, 17 nt, Human
uguaacuuucugaaaua

SEQ ID NO: 3017334 - RNA, 14 nt, Human
agguuggugggggc

SEQ ID NO: 3017335 - RNA, 21 nt, Human
aggugcacaagcuccaagcuc

SEQ ID NO: 3017336 - RNA, 20 nt, Human
aggugggauccuccaggugc

SEQ ID NO: 3017337 - RNA, 18 nt, Human
aggugggauccuccaggu

SEQ ID NO: 3017338 - RNA, 15 nt, Human
aggugcacaagcucc

SEQ ID NO: 3017339 - RNA, 20 nt, Human
aggugcacaagcuccaagcu

SEQ ID NO: 3017340 - RNA, 18 nt, Human
aggugcacaagcuccaag

SEQ ID NO: 3017341 - RNA, 17 nt, Human
aggugcacaagcuccaa

SEQ ID NO: 3017342 - RNA, 16 nt, Human
aggugcacaagcucca

SEQ ID NO: 3017343 - RNA, 23 nt, Human
aggucuugaacuccuggccucaa

SEQ ID NO: 3017344 - RNA, 21 nt, Human
aguagagguacacuugugaau

SEQ ID NO: 3017345 - RNA, 20 nt, Human
aguagagguacacuugugaa

SEQ ID NO: 3017346 - RNA, 22 nt, Human
aguagagguacacuugugaaua

SEQ ID NO: 3017347 - RNA, 14 nt, Human
aguagagguacacu

SEQ ID NO: 3017348 - RNA, 12 nt, Human
aguagagacagg

SEQ ID NO: 3017349 - RNA, 20 nt, Human
uguaggaagguuaauguuca

SEQ ID NO: 3017350 - RNA, 18 nt, Human
uguaggaagguuaauguu

SEQ ID NO: 3017351 - RNA, 16 nt, Human
aguacacuguuucaaa

SEQ ID NO: 3017352 - RNA, 20 nt, Human
aguacacuguuucaaacuuu

SEQ ID NO: 3017353 - RNA, 14 nt, Human
aguacacuguuuca

SEQ ID NO: 3017354 - RNA, 15 nt, Human
uguacuuuuaagacu

SEQ ID NO: 3017355 - RNA, 18 nt, Human
uguacuuuuaagacuuug

SEQ ID NO: 3017356 - RNA, 14 nt, Human
uguagagugggagc

SEQ ID NO: 3017357 - RNA, 13 nt, Human
uguagagugggag

SEQ ID NO: 3017358 - RNA, 14 nt, Human
uguaauuugugaua

SEQ ID NO: 3017359 - RNA, 17 nt, Human
aguaauaugcacacauu

SEQ ID NO: 3017360 - RNA, 20 nt, Human
aguaauaugcacacauuuuu

SEQ ID NO: 3017361 - RNA, 18 nt, Human
aguaauaugcacacauuu

SEQ ID NO: 3017362 - RNA, 19 nt, Human
aguaauaugcacacauuuu

SEQ ID NO: 3017363 - RNA, 11 nt, Human
agguuuuccug

SEQ ID NO: 3017364 - RNA, 20 nt, Human
aguaagccgugauuuucauu

SEQ ID NO: 3017365 - RNA, 17 nt, Human
aggaaugcaaagaugaa

SEQ ID NO: 3017366 - RNA, 15 nt, Human
aggaaugcaaagaug

SEQ ID NO: 3017367 - RNA, 18 nt, Human
ugcugcccugcccaccug

SEQ ID NO: 3017368 - RNA, 17 nt, Human
ugcugcccugcccaccu

SEQ ID NO: 3017369 - RNA, 16 nt, Human
ugcugcccugcccacc

SEQ ID NO: 3017370 - RNA, 13 nt, Human
ugcugcccugccc

SEQ ID NO: 3017371 - RNA, 21 nt, Human
ugcugcccugcccaccuggcc

SEQ ID NO: 3017372 - RNA, 19 nt, Human
ugcugcccugcccaccugg

SEQ ID NO: 3017373 - RNA, 12 nt, Human
ugcugcccugcc

SEQ ID NO: 3017374 - RNA, 11 nt, Human
ugcugcccugu

SEQ ID NO: 3017375 - RNA, 18 nt, Human
ugcuggcuguuggcuggg

SEQ ID NO: 3017376 - RNA, 19 nt, Human
ugcugggauuacaagcgug

SEQ ID NO: 3017377 - RNA, 19 nt, Human
ugcuggcuguuggcugggg

SEQ ID NO: 3017378 - RNA, 21 nt, Human
ugcuggcuguuggcugggggc

SEQ ID NO: 3017379 - RNA, 21 nt, Human
ugcugggauuacaagcgugag

SEQ ID NO: 3017380 - RNA, 17 nt, Human
ugcugggauuacaggug

SEQ ID NO: 3017381 - RNA, 17 nt, Human
ugcugucccuuacguga

SEQ ID NO: 3017382 - RNA, 15 nt, Human
ugcugucccuuuucc

SEQ ID NO: 3017383 - RNA, 19 nt, Human
ugcugucccuuacgugagu

SEQ ID NO: 3017384 - RNA, 17 nt, Human
ugcugucccuuuuccuu

SEQ ID NO: 3017385 - RNA, 23 nt, Human
ugcuucaaggauccugagccaga

SEQ ID NO: 3017386 - RNA, 21 nt, Human
ugcuucaaggauccugagcca

SEQ ID NO: 3017387 - RNA, 20 nt, Human
ugcuucaaggauccugagcc

SEQ ID NO: 3017388 - RNA, 18 nt, Human
aggacacuaaccacgcug

SEQ ID NO: 3017389 - RNA, 16 nt, Human
ugcuuccagugaggcu

SEQ ID NO: 3017390 - RNA, 19 nt, Human
ugcuaucucccccagcccc

SEQ ID NO: 3017391 - RNA, 18 nt, Human
ugcuaucucccccagccc

SEQ ID NO: 3017392 - RNA, 20 nt, Human
ugcuaucucccccagcccca

SEQ ID NO: 3017393 - RNA, 14 nt, Human
ugcucuggacaggc

SEQ ID NO: 3017394 - RNA, 15 nt, Human
ugcucuggacaggca

SEQ ID NO: 3017395 - RNA, 16 nt, Human
ugcucuggacaggcau

SEQ ID NO: 3017396 - RNA, 21 nt, Human
aggaagccagcaggcucucag

SEQ ID NO: 3017397 - RNA, 23 nt, Human
aggaagccagcaggcucucaggc

SEQ ID NO: 3017398 - RNA, 22 nt, Human
aggaagccagcaggcucucagg

SEQ ID NO: 3017399 - RNA, 20 nt, Human
aggaagccgcuggggccagu

SEQ ID NO: 3017400 - RNA, 19 nt, Human
aggaagccgcuggggccag

SEQ ID NO: 3017401 - RNA, 18 nt, Human
aggaagccgcuggggcca

SEQ ID NO: 3017402 - RNA, 18 nt, Human
aggaagccagcaggcucu

SEQ ID NO: 3017403 - RNA, 23 nt, Human
aggaaggaaacccagcucugguc

SEQ ID NO: 3017404 - RNA, 22 nt, Human
aggaaggaaacccagcucuggu

SEQ ID NO: 3017405 - RNA, 20 nt, Human
aggaaggaaacccagcucug

SEQ ID NO: 3017406 - RNA, 12 nt, Human
aggaagcucagg

SEQ ID NO: 3017407 - RNA, 14 nt, Human
aggaaaggcuccag

SEQ ID NO: 3017408 - RNA, 13 nt, Human
aggaaaggcucca

SEQ ID NO: 3017409 - RNA, 15 nt, Human
aggaaaggcuccagg

SEQ ID NO: 3017410 - RNA, 11 nt, Human
aggaagcacau

SEQ ID NO: 3017411 - RNA, 17 nt, Human
aggaagcacaugccucu

SEQ ID NO: 3017412 - RNA, 16 nt, Human
aggaagcacaugccuc

SEQ ID NO: 3017413 - RNA, 19 nt, Human
aggaaaucaccgaaaacgu

SEQ ID NO: 3017414 - RNA, 15 nt, Human
aggaaaucaccgaaa

SEQ ID NO: 3017415 - RNA, 14 nt, Human
agcuguucagcugg

SEQ ID NO: 3017416 - RNA, 18 nt, Human
agcuugaggguugggcug

SEQ ID NO: 3017417 - RNA, 14 nt, Human
agcuugaggguugg

SEQ ID NO: 3017418 - RNA, 19 nt, Human
agcuugaccgugaggccag

SEQ ID NO: 3017419 - RNA, 23 nt, Human
ugcggacagccacggccaggcca

SEQ ID NO: 3017420 - RNA, 22 nt, Human
ugcggacagccacggccaggcc

SEQ ID NO: 3017421 - RNA, 20 nt, Human
ugcgggcuuccuccuggugu

SEQ ID NO: 3017422 - RNA, 19 nt, Human
ugcggccuuuggcuucacg

SEQ ID NO: 3017423 - RNA, 17 nt, Human
ugcggccuuuggcuuca

SEQ ID NO: 3017424 - RNA, 17 nt, Human
ugcgguccacccaggag

SEQ ID NO: 3017425 - RNA, 18 nt, Human
ugcgguccacccaggagc

SEQ ID NO: 3017426 - RNA, 17 nt, Human
ugcggugcuaucucccc

SEQ ID NO: 3017427 - RNA, 14 nt, Human
ugccugcccaggcc

SEQ ID NO: 3017428 - RNA, 15 nt, Human
ugccugcccaggccc

SEQ ID NO: 3017429 - RNA, 12 nt, Human
ugccucugccuc

SEQ ID NO: 3017430 - RNA, 24 nt, Human
ugccugcccaggccccugccaccc

SEQ ID NO: 3017431 - RNA, 16 nt, Human
ugccugcccaggcccc

SEQ ID NO: 3017432 - RNA, 12 nt, Human
ugcccaggcagg

SEQ ID NO: 3017433 - RNA, 13 nt, Human
ugcccaggcaggu

SEQ ID NO: 3017434 - RNA, 14 nt, Human
ugcccaggcagguc

SEQ ID NO: 3017435 - RNA, 13 nt, Human
ugccucugccucu

SEQ ID NO: 3017436 - RNA, 14 nt, Human
ugccucugccucug

SEQ ID NO: 3017437 - RNA, 13 nt, Human
ugccugcccaggc

SEQ ID NO: 3017438 - RNA, 15 nt, Human
ugccucugccucuga

SEQ ID NO: 3017439 - RNA, 21 nt, Human
agcugcuuuugucuaugggac

SEQ ID NO: 3017440 - RNA, 19 nt, Human
agcugccuguucagcucca

SEQ ID NO: 3017441 - RNA, 21 nt, Human
agcugcuugggcuucauccuc

SEQ ID NO: 3017442 - RNA, 21 nt, Human
agcugccuguucagcuccagc

SEQ ID NO: 3017443 - RNA, 20 nt, Human
agcugcuugggcuucauccu

SEQ ID NO: 3017444 - RNA, 15 nt, Human
ugccuggauggggcu

SEQ ID NO: 3017445 - RNA, 14 nt, Human
ugccuggauggggc

SEQ ID NO: 3017446 - RNA, 20 nt, Human
agcugccuguucagcuccag

SEQ ID NO: 3017447 - RNA, 19 nt, Human
agcugugcucuggacaggc

SEQ ID NO: 3017448 - RNA, 20 nt, Human
agcugugcucuggacaggca

SEQ ID NO: 3017449 - RNA, 21 nt, Human
agcugugcucuggacaggcau

SEQ ID NO: 3017450 - RNA, 21 nt, Human
ugccuguucagcuccagcuca

SEQ ID NO: 3017451 - RNA, 19 nt, Human
ugccuguugggccaggagc

SEQ ID NO: 3017452 - RNA, 20 nt, Human
ugccuguugggccaggagcc

SEQ ID NO: 3017453 - RNA, 16 nt, Human
ugccuuauggaacacu

SEQ ID NO: 3017454 - RNA, 15 nt, Human
ugccuuauggaacac

SEQ ID NO: 3017455 - RNA, 17 nt, Human
ugccuguucagcuccag

SEQ ID NO: 3017456 - RNA, 13 nt, Human
agcuguucagcug

SEQ ID NO: 3017457 - RNA, 18 nt, Human
ugccuguucagcuccagc

SEQ ID NO: 3017458 - RNA, 20 nt, Human
ugccuguucagcuccagcuc

SEQ ID NO: 3017459 - RNA, 16 nt, Human
uggcaucuuacaucug

SEQ ID NO: 3017460 - RNA, 17 nt, Human
aggccccgcccaggcuu

SEQ ID NO: 3017461 - RNA, 21 nt, Human
uggccaaagccaaagcuaggc

SEQ ID NO: 3017462 - RNA, 23 nt, Human
uggccaaagccaaagcuaggccu

SEQ ID NO: 3017463 - RNA, 23 nt, Human
uggccagugugacaaggauugcu

SEQ ID NO: 3017464 - RNA, 20 nt, Human
aggccugggggcugggcaga

SEQ ID NO: 3017465 - RNA, 18 nt, Human
aggccugggggcugggca

SEQ ID NO: 3017466 - RNA, 12 nt, Human
aggccuggggac

SEQ ID NO: 3017467 - RNA, 12 nt, Human
uggccuggcccc

SEQ ID NO: 3017468 - RNA, 21 nt, Human
uggccuggccccucagggucc

SEQ ID NO: 3017469 - RNA, 18 nt, Human
uggccuggccccucaggg

SEQ ID NO: 3017470 - RNA, 23 nt, Human
uggccgggcgcgguggcucacgc

SEQ ID NO: 3017471 - RNA, 13 nt, Human
uggccucuucaga

SEQ ID NO: 3017472 - RNA, 14 nt, Human
uggaguauauguca

SEQ ID NO: 3017473 - RNA, 13 nt, Human
uggauuguccccg

SEQ ID NO: 3017474 - RNA, 16 nt, Human
aggccaaggugggagg

SEQ ID NO: 3017475 - RNA, 18 nt, Human
aggcagccaggccacaag

SEQ ID NO: 3017476 - RNA, 16 nt, Human
aggcagccccauucug

SEQ ID NO: 3017477 - RNA, 17 nt, Human
aggcagccccauucugc

SEQ ID NO: 3017478 - RNA, 15 nt, Human
aggccaaaggaagca

SEQ ID NO: 3017479 - RNA, 19 nt, Human
aggccaaaggaagcacaug

SEQ ID NO: 3017480 - RNA, 18 nt, Human
aggccaaaggaagcacau

SEQ ID NO: 3017481 - RNA, 16 nt, Human
aggccaaaggaagcac

SEQ ID NO: 3017482 - RNA, 16 nt, Human
aggccccgcccaggcu

SEQ ID NO: 3017483 - RNA, 21 nt, Human
aggcccagagggccugcaagg

SEQ ID NO: 3017484 - RNA, 20 nt, Human
aggccagagggagugacaga

SEQ ID NO: 3017485 - RNA, 17 nt, Human
uggcagccuuggcaaac

SEQ ID NO: 3017486 - RNA, 15 nt, Human
uggcagcucaccucu

SEQ ID NO: 3017487 - RNA, 19 nt, Human
uggcagcucaccucucccu

SEQ ID NO: 3017488 - RNA, 16 nt, Human
aggccacaagacccuu

SEQ ID NO: 3017489 - RNA, 14 nt, Human
aggccagagggagu

SEQ ID NO: 3017490 - RNA, 19 nt, Human
aggccacaagacccuugug

SEQ ID NO: 3017491 - RNA, 18 nt, Human
aggccacaagacccuugu

SEQ ID NO: 3017492 - RNA, 17 nt, Human
aggccacaagacccuug

SEQ ID NO: 3017493 - RNA, 13 nt, Human
uggcagccuuggc

SEQ ID NO: 3017494 - RNA, 13 nt, Human
aggauacuuauuu

SEQ ID NO: 3017495 - RNA, 16 nt, Human
aggauacuuauuuaaa

SEQ ID NO: 3017496 - RNA, 15 nt, Human
aggauacuuauuuaa

SEQ ID NO: 3017497 - RNA, 14 nt, Human
aggauccugagcca

SEQ ID NO: 3017498 - RNA, 13 nt, Human
aggauccugagcc

SEQ ID NO: 3017499 - RNA, 16 nt, Human
uggaagcacagcuuca

SEQ ID NO: 3017500 - RNA, 17 nt, Human
uggaaaugggcagagca

SEQ ID NO: 3017501 - RNA, 18 nt, Human
ugcuugcugcugauuuaa

SEQ ID NO: 3017502 - RNA, 14 nt, Human
ugcuuggaggaagg

SEQ ID NO: 3017503 - RNA, 16 nt, Human
ugcuuggaggaaggaa

SEQ ID NO: 3017504 - RNA, 15 nt, Human
ugcuuggaggaagga

SEQ ID NO: 3017505 - RNA, 16 nt, Human
ugcuuguacacucauu

SEQ ID NO: 3017506 - RNA, 12 nt, Human
ugcuuguacaua

SEQ ID NO: 3017507 - RNA, 13 nt, Human
ugcuuguacauaa

SEQ ID NO: 3017508 - RNA, 21 nt, Human
ugcuugaggcaacucaucuua

SEQ ID NO: 3017509 - RNA, 22 nt, Human
ugcuuguacacucauucauuac

SEQ ID NO: 3017510 - RNA, 19 nt, Human
ugcuuguacacucauucau

SEQ ID NO: 3017511 - RNA, 22 nt, Human
ugcuuguacauaaugcgugcau

SEQ ID NO: 3017512 - RNA, 14 nt, Human
ugcuuguacauaau

SEQ ID NO: 3017513 - RNA, 16 nt, Human
ugcuuguacauaaugc

SEQ ID NO: 3017514 - RNA, 12 nt, Human
ugcuuugugauu

SEQ ID NO: 3017515 - RNA, 14 nt, Human
ugcuuugugauuuu

SEQ ID NO: 3017516 - RNA, 16 nt, Human
ugcuuugugauuuuug

SEQ ID NO: 3017517 - RNA, 14 nt, Human
ugcuuuuggucugu

SEQ ID NO: 3017518 - RNA, 17 nt, Human
ugcuuuuggucugugug

SEQ ID NO: 3017519 - RNA, 22 nt, Human
uggagaagcggcuggcagccca

SEQ ID NO: 3017520 - RNA, 13 nt, Human
uggagaagcggcu

SEQ ID NO: 3017521 - RNA, 15 nt, Human
aggcacccaccauca

SEQ ID NO: 3017522 - RNA, 14 nt, Human
aggcaaugcuggcu

SEQ ID NO: 3017523 - RNA, 20 nt, Human
aggcacccaccaucaugucu

SEQ ID NO: 3017524 - RNA, 21 nt, Human
aggcacccaccaucaugucug

SEQ ID NO: 3017525 - RNA, 22 nt, Human
aggcacccaccaucaugucugg

SEQ ID NO: 3017526 - RNA, 12 nt, Human
aggaucucuuga

SEQ ID NO: 3017527 - RNA, 19 nt, Human
aggaucucuugagccuggg

SEQ ID NO: 3017528 - RNA, 18 nt, Human
aggaucucuugagccugg

SEQ ID NO: 3017529 - RNA, 17 nt, Human
aggaucucuugagccug

SEQ ID NO: 3017530 - RNA, 21 nt, Human
uggacacagcucuucuccagg

SEQ ID NO: 3017531 - RNA, 22 nt, Human
uggacacagcucuucuccaggc

SEQ ID NO: 3017532 - RNA, 13 nt, Human
uggacacagcucu

SEQ ID NO: 3017533 - RNA, 14 nt, Human
uggacacagcucuu

SEQ ID NO: 3017534 - RNA, 23 nt, Human
uggacacagcucuucuccaggcu

SEQ ID NO: 3017535 - RNA, 18 nt, Human
uggacccugaggcccaga

SEQ ID NO: 3017536 - RNA, 16 nt, Human
uggacccugaggccca

SEQ ID NO: 3017537 - RNA, 20 nt, Human
uggacccugaggcccagagg

SEQ ID NO: 3017538 - RNA, 19 nt, Human
uggacccugaggcccagag

SEQ ID NO: 3017539 - RNA, 21 nt, Human
uggacccugaggcccagaggg

SEQ ID NO: 3017540 - RNA, 23 nt, Human
uggacccuguggaugauaaaaca

SEQ ID NO: 3017541 - RNA, 15 nt, Human
uggacccugaggccc

SEQ ID NO: 3017542 - RNA, 20 nt, Human
uggaccuugaacuggguacu

SEQ ID NO: 3017543 - RNA, 14 nt, Human
ugccaauauccuaa

SEQ ID NO: 3017544 - RNA, 18 nt, Human
ugccaaugggagcucaug

SEQ ID NO: 3017545 - RNA, 13 nt, Human
ugccaauuugcac

SEQ ID NO: 3017546 - RNA, 15 nt, Human
ugccaauuugcacau

SEQ ID NO: 3017547 - RNA, 21 nt, Human
ugccaauuugcacauuaaaug

SEQ ID NO: 3017548 - RNA, 17 nt, Human
ugccaauuugcacauua

SEQ ID NO: 3017549 - RNA, 18 nt, Human
ugcauuaucuagauacug

SEQ ID NO: 3017550 - RNA, 21 nt, Human
ugcauuaucuagauacuguau

SEQ ID NO: 3017551 - RNA, 22 nt, Human
ugcauuaucuagauacuguauc

SEQ ID NO: 3017552 - RNA, 20 nt, Human
ugcauuaucuagauacugua

SEQ ID NO: 3017553 - RNA, 18 nt, Human
agcggagacggaguccca

SEQ ID NO: 3017554 - RNA, 20 nt, Human
agcggagaaaggaagggcug

SEQ ID NO: 3017555 - RNA, 16 nt, Human
agcggagaaaggaagg

SEQ ID NO: 3017556 - RNA, 17 nt, Human
agccuuccagggguggg

SEQ ID NO: 3017557 - RNA, 16 nt, Human
agccuuccaggggugg

SEQ ID NO: 3017558 - RNA, 14 nt, Human
agccuuccaggggu

SEQ ID NO: 3017559 - RNA, 11 nt, Human
agccuuccagg

SEQ ID NO: 3017560 - RNA, 22 nt, Human
agccugggugacagagcaagug

SEQ ID NO: 3017561 - RNA, 22 nt, Human
agccugcuccagcuguucagcu

SEQ ID NO: 3017562 - RNA, 19 nt, Human
agccugcuccagcuguuca

SEQ ID NO: 3017563 - RNA, 12 nt, Human
ugcauaccacuu

SEQ ID NO: 3017564 - RNA, 17 nt, Human
agccugcuccagcuguu

SEQ ID NO: 3017565 - RNA, 16 nt, Human
agccugcuccagcugu

SEQ ID NO: 3017566 - RNA, 15 nt, Human
agccugcuccagcug

SEQ ID NO: 3017567 - RNA, 14 nt, Human
agccugcuccagcu

SEQ ID NO: 3017568 - RNA, 22 nt, Human
agccuuagaagucacacaguau

SEQ ID NO: 3017569 - RNA, 21 nt, Human
agccugugccucugggacugg

SEQ ID NO: 3017570 - RNA, 19 nt, Human
agccugugccucugggacu

SEQ ID NO: 3017571 - RNA, 20 nt, Human
agcucauucuccuuguguua

SEQ ID NO: 3017572 - RNA, 21 nt, Human
agcucauucuccuuguguuac

SEQ ID NO: 3017573 - RNA, 20 nt, Human
ugcccacaggaucagucuga

SEQ ID NO: 3017574 - RNA, 19 nt, Human
ugcccacaggaucagucug

SEQ ID NO: 3017575 - RNA, 16 nt, Human
ugcccacaggaucagu

SEQ ID NO: 3017576 - RNA, 20 nt, Human
ugcccagccccuucugaccc

SEQ ID NO: 3017577 - RNA, 21 nt, Human
ugcccagccccuucugaccca

SEQ ID NO: 3017578 - RNA, 12 nt, Human
agcuaggccugg

SEQ ID NO: 3017579 - RNA, 14 nt, Human
agcuaggccuggcc

SEQ ID NO: 3017580 - RNA, 15 nt, Human
agcuaggccuggcca

SEQ ID NO: 3017581 - RNA, 18 nt, Human
agcucaggugucccugca

SEQ ID NO: 3017582 - RNA, 17 nt, Human
agcucaggugucccugc

SEQ ID NO: 3017583 - RNA, 22 nt, Human
agcucaggugucccugcacuug

SEQ ID NO: 3017584 - RNA, 20 nt, Human
agcucaggugucccugcacu

SEQ ID NO: 3017585 - RNA, 21 nt, Human
agcucaggugucccugcacuu

SEQ ID NO: 3017586 - RNA, 19 nt, Human
agcgugagccacugcaccg

SEQ ID NO: 3017587 - RNA, 22 nt, Human
agcgugagccacugcaccgggc

SEQ ID NO: 3017588 - RNA, 15 nt, Human
agcgugcauaaguua

SEQ ID NO: 3017589 - RNA, 18 nt, Human
agcuagacgagcaggcuu

SEQ ID NO: 3017590 - RNA, 14 nt, Human
ugcaguacuaacau

SEQ ID NO: 3017591 - RNA, 14 nt, Human
ugcauaaguuaacu

SEQ ID NO: 3017592 - RNA, 17 nt, Human
ugcauaaguuaacuucc

SEQ ID NO: 3017593 - RNA, 15 nt, Human
ugcagccucacaguc

SEQ ID NO: 3017594 - RNA, 13 nt, Human
ugcagccucacag

SEQ ID NO: 3017595 - RNA, 16 nt, Human
ugcagccucacagucc

SEQ ID NO: 3017596 - RNA, 23 nt, Human
ugcagccucaaccuccugggcua

SEQ ID NO: 3017597 - RNA, 22 nt, Human
ugcacuauagccuaggugacag

SEQ ID NO: 3017598 - RNA, 23 nt, Human
ugcacuauagccuaggugacaga

SEQ ID NO: 3017599 - RNA, 23 nt, Human
agcccuucuaccuuccugcaaca

SEQ ID NO: 3017600 - RNA, 17 nt, Human
agccucagcauccuggc

SEQ ID NO: 3017601 - RNA, 19 nt, Human
agccucagcauccuggcac

SEQ ID NO: 3017602 - RNA, 20 nt, Human
agccucagcauccuggcacc

SEQ ID NO: 3017603 - RNA, 21 nt, Human
agccucagcauccuggcaccc

SEQ ID NO: 3017604 - RNA, 16 nt, Human
agccucagcauccugg

SEQ ID NO: 3017605 - RNA, 16 nt, Human
agccucccaaagugcu

SEQ ID NO: 3017606 - RNA, 22 nt, Human
agccucagcauccuggcacccg

SEQ ID NO: 3017607 - RNA, 23 nt, Human
agccucagcauccuggcacccgg

SEQ ID NO: 3017608 - RNA, 14 nt, Human
ugcacacuguccua

SEQ ID NO: 3017609 - RNA, 10 nt, Human
ugcacacauu

SEQ ID NO: 3017610 - RNA, 20 nt, Human
ugcacacauuuuuuaaaugc

SEQ ID NO: 3017611 - RNA, 17 nt, Human
ugcacccucaggcaggu

SEQ ID NO: 3017612 - RNA, 16 nt, Human
ugcacccucaggcagg

SEQ ID NO: 3017613 - RNA, 14 nt, Human
ugcacgugugugca

SEQ ID NO: 3017614 - RNA, 15 nt, Human
ugcacgugugugcac

SEQ ID NO: 3017615 - RNA, 22 nt, Human
agcccugguggcagugggagcu

SEQ ID NO: 3017616 - RNA, 23 nt, Human
agcccugguggcagugggagcug

SEQ ID NO: 3017617 - RNA, 15 nt, Human
ugcacaagcugcacc

SEQ ID NO: 3017618 - RNA, 14 nt, Human
ugcacaagcugcac

SEQ ID NO: 3017619 - RNA, 22 nt, Human
ugcacacaccagagcccaccuu

SEQ ID NO: 3017620 - RNA, 21 nt, Human
ugcacaagcugcacccucagg

SEQ ID NO: 3017621 - RNA, 18 nt, Human
ugcacaagcugcacccuc

SEQ ID NO: 3017622 - RNA, 24 nt, Human
agccccuucugacccaugcugccc

SEQ ID NO: 3017623 - RNA, 20 nt, Human
agccccuucugacccaugcu

SEQ ID NO: 3017624 - RNA, 21 nt, Human
agcccugguggcagugggagc

SEQ ID NO: 3017625 - RNA, 17 nt, Human
agccccgaggccuucuc

SEQ ID NO: 3017626 - RNA, 22 nt, Human
agccccgaggccuucucugaag

SEQ ID NO: 3017627 - RNA, 16 nt, Human
agccccgaggccuucu

SEQ ID NO: 3017628 - RNA, 23 nt, Human
agccccauucugccugcccaggc

SEQ ID NO: 3017629 - RNA, 18 nt, Human
agccccuggaugcagccu

SEQ ID NO: 3017630 - RNA, 17 nt, Human
agccccuggaugcagcc

SEQ ID NO: 3017631 - RNA, 19 nt, Human
agccccuggaugcagccuc

SEQ ID NO: 3017632 - RNA, 13 nt, Human
ugauucuccugcc

SEQ ID NO: 3017633 - RNA, 20 nt, Human
ugauucuccugccucagccu

SEQ ID NO: 3017634 - RNA, 19 nt, Human
ugauucuccugccucagcc

SEQ ID NO: 3017635 - RNA, 15 nt, Human
ugauucuccugccuc

SEQ ID NO: 3017636 - RNA, 20 nt, Human
agccccaaaacucuccucug

SEQ ID NO: 3017637 - RNA, 22 nt, Human
agccccaaaacucuccucugcu

SEQ ID NO: 3017638 - RNA, 21 nt, Human
agccccaaaacucuccucugc

SEQ ID NO: 3017639 - RNA, 23 nt, Human
agcauguccuaaugcuugcugcu

SEQ ID NO: 3017640 - RNA, 12 nt, Human
agcauggcugcc

SEQ ID NO: 3017641 - RNA, 20 nt, Human
agcaucaggccaggcccucu

SEQ ID NO: 3017642 - RNA, 19 nt, Human
agcaucaggccaggcccuc

SEQ ID NO: 3017643 - RNA, 18 nt, Human
agcaucaggccaggcccu

SEQ ID NO: 3017644 - RNA, 17 nt, Human
agcaucaggccaggccc

SEQ ID NO: 3017645 - RNA, 16 nt, Human
agcaucaggccaggcc

SEQ ID NO: 3017646 - RNA, 14 nt, Human
agcaucaggccagg

SEQ ID NO: 3017647 - RNA, 22 nt, Human
agcauauucaggaagcucaggg

SEQ ID NO: 3017648 - RNA, 20 nt, Human
ugaucacggcucacugcagc

SEQ ID NO: 3017649 - RNA, 21 nt, Human
ugaucacggcucacugcagcc

SEQ ID NO: 3017650 - RNA, 12 nt, Human
agcaucaggcca

SEQ ID NO: 3017651 - RNA, 13 nt, Human
agcaucaggccag

SEQ ID NO: 3017652 - RNA, 18 nt, Human
ugaucacggcucacugca

SEQ ID NO: 3017653 - RNA, 19 nt, Human
ugaucacggcucacugcag

SEQ ID NO: 3017654 - RNA, 16 nt, Human
ugagugccuuacacaa

SEQ ID NO: 3017655 - RNA, 21 nt, Human
ugagugggugaauaauacagu

SEQ ID NO: 3017656 - RNA, 23 nt, Human
ugagugggggaucacagccucug

SEQ ID NO: 3017657 - RNA, 14 nt, Human
ugagucaccaagcc

SEQ ID NO: 3017658 - RNA, 16 nt, Human
ugagucaccaagccca

SEQ ID NO: 3017659 - RNA, 17 nt, Human
ugagucaccaagcccag

SEQ ID NO: 3017660 - RNA, 20 nt, Human
ugagugccuuacacaauggu

SEQ ID NO: 3017661 - RNA, 17 nt, Human
ugagugccuuacacaau

SEQ ID NO: 3017662 - RNA, 14 nt, Human
ugauacuacaguuu

SEQ ID NO: 3017663 - RNA, 17 nt, Human
ugauacuacaguuuguu

SEQ ID NO: 3017664 - RNA, 18 nt, Human
ugauacaaugcugugccc

SEQ ID NO: 3017665 - RNA, 20 nt, Human
ugauacaaugcugugcccua

SEQ ID NO: 3017666 - RNA, 21 nt, Human
ugauacaaugcugugcccuaa

SEQ ID NO: 3017667 - RNA, 17 nt, Human
ugaguucauacccuguu

SEQ ID NO: 3017668 - RNA, 20 nt, Human
ugauaagaaccuuuugagug

SEQ ID NO: 3017669 - RNA, 20 nt, Human
agcauacguacacauuuuau

SEQ ID NO: 3017670 - RNA, 21 nt, Human
agcauacguacacauuuuauu

SEQ ID NO: 3017671 - RNA, 16 nt, Human
agcauacguacacauu

SEQ ID NO: 3017672 - RNA, 17 nt, Human
agcauacguacacauuu

SEQ ID NO: 3017673 - RNA, 18 nt, Human
agcauacguacacauuuu

SEQ ID NO: 3017674 - RNA, 19 nt, Human
agcauacguacacauuuua

SEQ ID NO: 3017675 - RNA, 12 nt, Human
ugagaauuaccc

SEQ ID NO: 3017676 - RNA, 15 nt, Human
agcauacguacacau

SEQ ID NO: 3017677 - RNA, 14 nt, Human
ugaguacuacaguc

SEQ ID NO: 3017678 - RNA, 23 nt, Human
ugaguacuacaguccucccaucu

SEQ ID NO: 3017679 - RNA, 22 nt, Human
ugaguacuacaguccucccauc

SEQ ID NO: 3017680 - RNA, 21 nt, Human
ugaguacuacaguccucccau

SEQ ID NO: 3017681 - RNA, 17 nt, Human
ugaguacuacaguccuc

SEQ ID NO: 3017682 - RNA, 14 nt, Human
agcauauucaggaa

SEQ ID NO: 3017683 - RNA, 15 nt, Human
ugaguacuacagucc

SEQ ID NO: 3017684 - RNA, 15 nt, Human
agccacggccaggcc

SEQ ID NO: 3017685 - RNA, 14 nt, Human
agccacggccaggc

SEQ ID NO: 3017686 - RNA, 19 nt, Human
agccaccaacauacuccca

SEQ ID NO: 3017687 - RNA, 23 nt, Human
agccaccaacauacucccaucug

SEQ ID NO: 3017688 - RNA, 20 nt, Human
agccaccaacauacucccau

SEQ ID NO: 3017689 - RNA, 18 nt, Human
agccacauuccugaugcu

SEQ ID NO: 3017690 - RNA, 14 nt, Human
agccacauuccuga

SEQ ID NO: 3017691 - RNA, 23 nt, Human
ugauguuuuccaugaguccccug

SEQ ID NO: 3017692 - RNA, 17 nt, Human
ugauguuuuaaggaugc

SEQ ID NO: 3017693 - RNA, 18 nt, Human
ugauguuuuaaggaugcu

SEQ ID NO: 3017694 - RNA, 16 nt, Human
ugauggugcaaugacc

SEQ ID NO: 3017695 - RNA, 23 nt, Human
ugauggugcaaugaccuuucaau

SEQ ID NO: 3017696 - RNA, 17 nt, Human
ugauggugcaaugaccu

SEQ ID NO: 3017697 - RNA, 20 nt, Human
ugaugauccuaggcauuugc

SEQ ID NO: 3017698 - RNA, 14 nt, Human
ugaugauccuaggc

SEQ ID NO: 3017699 - RNA, 20 nt, Human
agccacugcaccgggccaca

SEQ ID NO: 3017700 - RNA, 13 nt, Human
agccacugcaccg

SEQ ID NO: 3017701 - RNA, 21 nt, Human
agccacugcaccgggccacag

SEQ ID NO: 3017702 - RNA, 22 nt, Human
agccacugcaccgggccacaga

SEQ ID NO: 3017703 - RNA, 15 nt, Human
ugauuaauuaaaaca

SEQ ID NO: 3017704 - RNA, 14 nt, Human
ugauucagcucugc

SEQ ID NO: 3017705 - RNA, 13 nt, Human
ugauucagcucug

SEQ ID NO: 3017706 - RNA, 18 nt, Human
agcccaggaaaggcucca

SEQ ID NO: 3017707 - RNA, 24 nt, Human
agcccaggaaaggcuccaggagca

SEQ ID NO: 3017708 - RNA, 23 nt, Human
agcccaggaaaggcuccaggagc

SEQ ID NO: 3017709 - RNA, 22 nt, Human
agcccaggaaaggcuccaggag

SEQ ID NO: 3017710 - RNA, 15 nt, Human
ugauucccaagcucu

SEQ ID NO: 3017711 - RNA, 16 nt, Human
ugauucccaagcucug

SEQ ID NO: 3017712 - RNA, 18 nt, Human
ugauucccaagcucugcu

SEQ ID NO: 3017713 - RNA, 19 nt, Human
ugauucccaagcucugcuc

SEQ ID NO: 3017714 - RNA, 21 nt, Human
ugauucccaagcucugcuccu

SEQ ID NO: 3017715 - RNA, 21 nt, Human
agcccaggaaaggcuccagga

SEQ ID NO: 3017716 - RNA, 20 nt, Human
agcccaggaaaggcuccagg

SEQ ID NO: 3017717 - RNA, 19 nt, Human
agcccaggaaaggcuccag

SEQ ID NO: 3017718 - RNA, 22 nt, Human
agcccacuucugccauauucug

SEQ ID NO: 3017719 - RNA, 23 nt, Human
agccaguaaaugggggugcauuu

SEQ ID NO: 3017720 - RNA, 22 nt, Human
agccaguaaaugggggugcauu

SEQ ID NO: 3017721 - RNA, 12 nt, Human
agccagggucuc

SEQ ID NO: 3017722 - RNA, 22 nt, Human
agccaggccacaagacccuugu

SEQ ID NO: 3017723 - RNA, 21 nt, Human
agccaggccacaagacccuug

SEQ ID NO: 3017724 - RNA, 14 nt, Human
agccaggccacaag

SEQ ID NO: 3017725 - RNA, 12 nt, Human
agccaggccaca

SEQ ID NO: 3017726 - RNA, 21 nt, Human
ugaaaaaauuuacuuuaaacu

SEQ ID NO: 3017727 - RNA, 16 nt, Human
ugaaaaaggaggaaga

SEQ ID NO: 3017728 - RNA, 12 nt, Human
ucuuuuaaacuc

SEQ ID NO: 3017729 - RNA, 11 nt, Human
ucuuuuaaacu

SEQ ID NO: 3017730 - RNA, 22 nt, Human
ucuuuggucuacacugugcuga

SEQ ID NO: 3017731 - RNA, 20 nt, Human
ucuuucuggcuaugcauuug

SEQ ID NO: 3017732 - RNA, 19 nt, Human
ucuuucuggcuaugcauuu

SEQ ID NO: 3017733 - RNA, 21 nt, Human
ucuuucuggcuaugcauuuga

SEQ ID NO: 3017734 - RNA, 17 nt, Human
ugaaaauguauguguaa

SEQ ID NO: 3017735 - RNA, 19 nt, Human
ugaaaaucgugacaacacu

SEQ ID NO: 3017736 - RNA, 16 nt, Human
ugaaacgcaaccacca

SEQ ID NO: 3017737 - RNA, 16 nt, Human
ugaaaaucgugacaac

SEQ ID NO: 3017738 - RNA, 22 nt, Human
ugaaaaaggaggaagagaaaaa

SEQ ID NO: 3017739 - RNA, 20 nt, Human
ugaaaaaggaggaagagaaa

SEQ ID NO: 3017740 - RNA, 21 nt, Human
agagcaguuugguuucuagca

SEQ ID NO: 3017741 - RNA, 23 nt, Human
agagcaguuugguuucuagcaug

SEQ ID NO: 3017742 - RNA, 23 nt, Human
agagcaccuuagacagucccugc

SEQ ID NO: 3017743 - RNA, 21 nt, Human
agagcaccuuagacagucccu

SEQ ID NO: 3017744 - RNA, 22 nt, Human
agagcaccuuagacagucccug

SEQ ID NO: 3017745 - RNA, 20 nt, Human
agagcuagcagcagggaggg

SEQ ID NO: 3017746 - RNA, 22 nt, Human
agagccuuccaggggugggaca

SEQ ID NO: 3017747 - RNA, 17 nt, Human
agagccuuccaggggug

SEQ ID NO: 3017748 - RNA, 15 nt, Human
agagccuuccagggg

SEQ ID NO: 3017749 - RNA, 13 nt, Human
agagccuuccagg

SEQ ID NO: 3017750 - RNA, 14 nt, Human
agagcugccaccug

SEQ ID NO: 3017751 - RNA, 23 nt, Human
agagcaagacgcugugcugcccu

SEQ ID NO: 3017752 - RNA, 19 nt, Human
agagcaagacgcugugcug

SEQ ID NO: 3017753 - RNA, 22 nt, Human
agagaucaaccccuucgcuccu

SEQ ID NO: 3017754 - RNA, 23 nt, Human
agagacuccugcaggcagccagg

SEQ ID NO: 3017755 - RNA, 13 nt, Human
ugaaagacuguac

SEQ ID NO: 3017756 - RNA, 15 nt, Human
ugaaagacuguacaa

SEQ ID NO: 3017757 - RNA, 15 nt, Human
agagacuccugcagg

SEQ ID NO: 3017758 - RNA, 18 nt, Human
agagacuccugcaggcag

SEQ ID NO: 3017759 - RNA, 17 nt, Human
agagacuccugcaggca

SEQ ID NO: 3017760 - RNA, 22 nt, Human
agagacuccugcaggcagccag

SEQ ID NO: 3017761 - RNA, 21 nt, Human
agagacuccugcaggcagcca

SEQ ID NO: 3017762 - RNA, 20 nt, Human
agagacuccugcaggcagcc

SEQ ID NO: 3017763 - RNA, 19 nt, Human
agagacuccugcaggcagc

SEQ ID NO: 3017764 - RNA, 19 nt, Human
ucuugguccugcugcaguu

SEQ ID NO: 3017765 - RNA, 17 nt, Human
ucuugguccugcugcag

SEQ ID NO: 3017766 - RNA, 15 nt, Human
ucuugguccugcugc

SEQ ID NO: 3017767 - RNA, 16 nt, Human
ucuuuccugaggcugg

SEQ ID NO: 3017768 - RNA, 17 nt, Human
ucuuuccugaggcuggg

SEQ ID NO: 3017769 - RNA, 19 nt, Human
ucuugcaauggcagccuug

SEQ ID NO: 3017770 - RNA, 18 nt, Human
ucuugcaauggcagccuu

SEQ ID NO: 3017771 - RNA, 22 nt, Human
ucuugcaauggcagccuuggca

SEQ ID NO: 3017772 - RNA, 14 nt, Human
ucuugguccugcug

SEQ ID NO: 3017773 - RNA, 17 nt, Human
ucuuggucagauuugaa

SEQ ID NO: 3017774 - RNA, 13 nt, Human
ucuugauucauaa

SEQ ID NO: 3017775 - RNA, 20 nt, Human
ucuugagccuugaacuuuga

SEQ ID NO: 3017776 - RNA, 16 nt, Human
ucuugagccugggagg

SEQ ID NO: 3017777 - RNA, 13 nt, Human
ucuugagccuggg

SEQ ID NO: 3017778 - RNA, 11 nt, Human
agaccuucucc

SEQ ID NO: 3017779 - RNA, 18 nt, Human
agaccuucuccuucaccu

SEQ ID NO: 3017780 - RNA, 15 nt, Human
agaccuucuccuuca

SEQ ID NO: 3017781 - RNA, 23 nt, Human
agaccuucuccuucaccuuuguc

SEQ ID NO: 3017782 - RNA, 21 nt, Human
agaccuucuccuucaccuuug

SEQ ID NO: 3017783 - RNA, 15 nt, Human
ucuuccucccucccu

SEQ ID NO: 3017784 - RNA, 14 nt, Human
ucuuccucccuccc

SEQ ID NO: 3017785 - RNA, 22 nt, Human
ucuucccuacaguugaaaaaca

SEQ ID NO: 3017786 - RNA, 19 nt, Human
ucuucccuacaguugaaaa

SEQ ID NO: 3017787 - RNA, 21 nt, Human
ucuuccaggcugggagagccu

SEQ ID NO: 3017788 - RNA, 20 nt, Human
ucuuccaggcugggagagcc

SEQ ID NO: 3017789 - RNA, 17 nt, Human
ucuuccaggcugggaga

SEQ ID NO: 3017790 - RNA, 15 nt, Human
ucuuccaggcuggga

SEQ ID NO: 3017791 - RNA, 20 nt, Human
ucuucagagacuccugcagg

SEQ ID NO: 3017792 - RNA, 12 nt, Human
ucuucagagacu

SEQ ID NO: 3017793 - RNA, 18 nt, Human
ucuucagagacuccugca

SEQ ID NO: 3017794 - RNA, 17 nt, Human
ucuucagagacuccugc

SEQ ID NO: 3017795 - RNA, 20 nt, Human
ucuucuguggguuucuaaag

SEQ ID NO: 3017796 - RNA, 15 nt, Human
ucuucuguacgucug

SEQ ID NO: 3017797 - RNA, 23 nt, Human
ucuucuguacgucugacaggcaa

SEQ ID NO: 3017798 - RNA, 12 nt, Human
ucuucugcuuca

SEQ ID NO: 3017799 - RNA, 21 nt, Human
ucuucugaacuuggcgcugcc

SEQ ID NO: 3017800 - RNA, 19 nt, Human
agacauacuaaccagcaga

SEQ ID NO: 3017801 - RNA, 23 nt, Human
ugacuauuuuuguuuuuauuaaa

SEQ ID NO: 3017802 - RNA, 15 nt, Human
ugacuuacuguacau

SEQ ID NO: 3017803 - RNA, 16 nt, Human
ugacuuacuguacaug

SEQ ID NO: 3017804 - RNA, 13 nt, Human
ugacuuacuguac

SEQ ID NO: 3017805 - RNA, 17 nt, Human
ugaccugaggcccuucu

SEQ ID NO: 3017806 - RNA, 19 nt, Human
ugaccugaggcccuucucu

SEQ ID NO: 3017807 - RNA, 18 nt, Human
ugaccugaggcccuucuc

SEQ ID NO: 3017808 - RNA, 12 nt, Human
agauguugcuaa

SEQ ID NO: 3017809 - RNA, 21 nt, Human
ugacccaugcugcccugugag

SEQ ID NO: 3017810 - RNA, 16 nt, Human
ugacccaugcugcccu

SEQ ID NO: 3017811 - RNA, 12 nt, Human
ugacccaugcug

SEQ ID NO: 3017812 - RNA, 15 nt, Human
ugacccaugcugccc

SEQ ID NO: 3017813 - RNA, 14 nt, Human
ugacccaugcugcc

SEQ ID NO: 3017814 - RNA, 16 nt, Human
agaugccgcauuugga

SEQ ID NO: 3017815 - RNA, 14 nt, Human
agcaagacauuaua

SEQ ID NO: 3017816 - RNA, 16 nt, Human
agcaagacgcugugcu

SEQ ID NO: 3017817 - RNA, 13 nt, Human
agcaagacgcugu

SEQ ID NO: 3017818 - RNA, 23 nt, Human
agcaagacgcugugcugcccugc

SEQ ID NO: 3017819 - RNA, 22 nt, Human
agcaagacgcugugcugcccug

SEQ ID NO: 3017820 - RNA, 21 nt, Human
agcaagacgcugugcugcccu

SEQ ID NO: 3017821 - RNA, 20 nt, Human
agcaagacgcugugcugccc

SEQ ID NO: 3017822 - RNA, 17 nt, Human
agcaagacgcugugcug

SEQ ID NO: 3017823 - RNA, 17 nt, Human
agauuugaacucuucaa

SEQ ID NO: 3017824 - RNA, 21 nt, Human
agauuuugaaauuuuuauuaa

SEQ ID NO: 3017825 - RNA, 19 nt, Human
agauucauauuuacuucuu

SEQ ID NO: 3017826 - RNA, 22 nt, Human
agauucauauuuacuucuuaua

SEQ ID NO: 3017827 - RNA, 19 nt, Human
ugacuuacuguacaugaaa

SEQ ID NO: 3017828 - RNA, 13 nt, Human
agauuggaaggaa

SEQ ID NO: 3017829 - RNA, 14 nt, Human
ugaauuugccuaau

SEQ ID NO: 3017830 - RNA, 23 nt, Human
ugaauuucuuuugccguuauuaa

SEQ ID NO: 3017831 - RNA, 19 nt, Human
ugacacacagcucuguccu

SEQ ID NO: 3017832 - RNA, 19 nt, Human
ugacaaagacugaguacgu

SEQ ID NO: 3017833 - RNA, 16 nt, Human
ugacacacagcucugu

SEQ ID NO: 3017834 - RNA, 18 nt, Human
ugacacacagcucugucc

SEQ ID NO: 3017835 - RNA, 12 nt, Human
ugacacaugcaa

SEQ ID NO: 3017836 - RNA, 20 nt, Human
ugacacaugcaaggucauuu

SEQ ID NO: 3017837 - RNA, 22 nt, Human
agauacaguuacucagaauucu

SEQ ID NO: 3017838 - RNA, 11 nt, Human
agauacuguau

SEQ ID NO: 3017839 - RNA, 20 nt, Human
agauacaggaaaagcugcug

SEQ ID NO: 3017840 - RNA, 13 nt, Human
agauacaguuacu

SEQ ID NO: 3017841 - RNA, 22 nt, Human
agauaauauuaaggaagacaau

SEQ ID NO: 3017842 - RNA, 18 nt, Human
agauaauauuaaggaaga

SEQ ID NO: 3017843 - RNA, 18 nt, Human
agaucaaaagguuaauaa

SEQ ID NO: 3017844 - RNA, 20 nt, Human
agauauuuugcuuugugauu

SEQ ID NO: 3017845 - RNA, 21 nt, Human
agauauuuugcuuugugauuu

SEQ ID NO: 3017846 - RNA, 15 nt, Human
agauacuguaucaug

SEQ ID NO: 3017847 - RNA, 16 nt, Human
agauacuguaucauga

SEQ ID NO: 3017848 - RNA, 18 nt, Human
agauaauacaccacuaca

SEQ ID NO: 3017849 - RNA, 19 nt, Human
agaguuguuacauuuuuaa

SEQ ID NO: 3017850 - RNA, 20 nt, Human
agaguuguuacauuuuuaag

SEQ ID NO: 3017851 - RNA, 15 nt, Human
agagucacuggaaca

SEQ ID NO: 3017852 - RNA, 16 nt, Human
agaguuguuacauuuu

SEQ ID NO: 3017853 - RNA, 17 nt, Human
agaguuguuacauuuuu

SEQ ID NO: 3017854 - RNA, 18 nt, Human
ugaagguagaauguuuuc

SEQ ID NO: 3017855 - RNA, 19 nt, Human
ugaagguagaauguuuuca

SEQ ID NO: 3017856 - RNA, 14 nt, Human
ugaagucacacagu

SEQ ID NO: 3017857 - RNA, 16 nt, Human
agagggagggagggcu

SEQ ID NO: 3017858 - RNA, 15 nt, Human
agagguuaagguggg

SEQ ID NO: 3017859 - RNA, 16 nt, Human
agagguggggagcaga

SEQ ID NO: 3017860 - RNA, 19 nt, Human
ucuggauucauauuuaauu

SEQ ID NO: 3017861 - RNA, 16 nt, Human
ucuggauucauauuua

SEQ ID NO: 3017862 - RNA, 15 nt, Human
ucuggauucauauuu

SEQ ID NO: 3017863 - RNA, 22 nt, Human
ucugcuuugggguuuaucagaa

SEQ ID NO: 3017864 - RNA, 21 nt, Human
ucuggcagcucagagagggug

SEQ ID NO: 3017865 - RNA, 18 nt, Human
ucuggcagcucagagagg

SEQ ID NO: 3017866 - RNA, 23 nt, Human
ucuggcagaguugaagacagagc

SEQ ID NO: 3017867 - RNA, 20 nt, Human
ucuggcagaguugaagacag

SEQ ID NO: 3017868 - RNA, 17 nt, Human
ucuggcagcucagagag

SEQ ID NO: 3017869 - RNA, 16 nt, Human
ucuggcagcucagaga

SEQ ID NO: 3017870 - RNA, 16 nt, Human
agaauaaaccaagaau

SEQ ID NO: 3017871 - RNA, 22 nt, Human
agaaguuugagaucagccuggg

SEQ ID NO: 3017872 - RNA, 17 nt, Human
agaacuauguuuuuguu

SEQ ID NO: 3017873 - RNA, 23 nt, Human
agaaccuuuugagugccuuacac

SEQ ID NO: 3017874 - RNA, 19 nt, Human
agaaccuuuugagugccuu

SEQ ID NO: 3017875 - RNA, 16 nt, Human
agaagcagaggaagga

SEQ ID NO: 3017876 - RNA, 23 nt, Human
agaagcccaggaaaggcuccagg

SEQ ID NO: 3017877 - RNA, 23 nt, Human
ucugcccacucccugcaaccuga

SEQ ID NO: 3017878 - RNA, 23 nt, Human
ucugcccuugguuaggcauugug

SEQ ID NO: 3017879 - RNA, 12 nt, Human
ucugcccuuggu

SEQ ID NO: 3017880 - RNA, 19 nt, Human
agaaaaaauauuuucccua

SEQ ID NO: 3017881 - RNA, 23 nt, Human
agaaaaaauauuuuccugccagg

SEQ ID NO: 3017882 - RNA, 17 nt, Human
agaaaaaauauuuuccu

SEQ ID NO: 3017883 - RNA, 18 nt, Human
agaaaaaugagccuggca

SEQ ID NO: 3017884 - RNA, 17 nt, Human
agaaaaaugagccuggc

SEQ ID NO: 3017885 - RNA, 18 nt, Human
ucucuugguccugcugca

SEQ ID NO: 3017886 - RNA, 17 nt, Human
ucucuugguccugcugc

SEQ ID NO: 3017887 - RNA, 16 nt, Human
ucucuugguccugcug

SEQ ID NO: 3017888 - RNA, 22 nt, Human
ucugaaggacauugcggacagc

SEQ ID NO: 3017889 - RNA, 18 nt, Human
ucugaaggcuggguucug

SEQ ID NO: 3017890 - RNA, 15 nt, Human
agaaaugccuuaccc

SEQ ID NO: 3017891 - RNA, 20 nt, Human
agaaagacuaucuaaauguu

SEQ ID NO: 3017892 - RNA, 22 nt, Human
agaaagacuaucuaaauguuga

SEQ ID NO: 3017893 - RNA, 23 nt, Human
acuuuggaaagaguaggaagacu

SEQ ID NO: 3017894 - RNA, 23 nt, Human
acuuuggaaagacuuuuccaacc

SEQ ID NO: 3017895 - RNA, 14 nt, Human
acuuuggaaagagu

SEQ ID NO: 3017896 - RNA, 13 nt, Human
acuuuggaaagag

SEQ ID NO: 3017897 - RNA, 14 nt, Human
acuuguggacacag

SEQ ID NO: 3017898 - RNA, 16 nt, Human
acuuuaaaaggagcca

SEQ ID NO: 3017899 - RNA, 23 nt, Human
acuuuaccuuuuuuauacauaaa

SEQ ID NO: 3017900 - RNA, 12 nt, Human
ucucucaggcca

SEQ ID NO: 3017901 - RNA, 19 nt, Human
ucuccuguaccucuugagc

SEQ ID NO: 3017902 - RNA, 23 nt, Human
ucuccuuggugucgggcaugaca

SEQ ID NO: 3017903 - RNA, 21 nt, Human
ucuccuuggugucgggcauga

SEQ ID NO: 3017904 - RNA, 16 nt, Human
acuuuguguucaccuu

SEQ ID NO: 3017905 - RNA, 12 nt, Human
ucuagcaugaag

SEQ ID NO: 3017906 - RNA, 24 nt, Human
ucuagauacuguaucaugacaaag

SEQ ID NO: 3017907 - RNA, 13 nt, Human
ucuagauacugua

SEQ ID NO: 3017908 - RNA, 22 nt, Human
ucuaguuugauuaaauucuugc

SEQ ID NO: 3017909 - RNA, 23 nt, Human
ucuaguuugauuaaauucuugca

SEQ ID NO: 3017910 - RNA, 19 nt, Human
ucuaccugaggggccucuu

SEQ ID NO: 3017911 - RNA, 12 nt, Human
ucuaccugaggg

SEQ ID NO: 3017912 - RNA, 13 nt, Human
acuuacuguacau

SEQ ID NO: 3017913 - RNA, 14 nt, Human
acuuacuguacaug

SEQ ID NO: 3017914 - RNA, 15 nt, Human
acuuacuguacauga

SEQ ID NO: 3017915 - RNA, 20 nt, Human
acuuagagguggggagcaga

SEQ ID NO: 3017916 - RNA, 18 nt, Human
acuuccaauuuacauacu

SEQ ID NO: 3017917 - RNA, 17 nt, Human
acuuccacugccauccu

SEQ ID NO: 3017918 - RNA, 16 nt, Human
acuucaucccucuggg

SEQ ID NO: 3017919 - RNA, 20 nt, Human
acuucgggaggucgaggcag

SEQ ID NO: 3017920 - RNA, 17 nt, Human
acuucgggaggucgagg

SEQ ID NO: 3017921 - RNA, 18 nt, Human
acuucuccacccugcucu

SEQ ID NO: 3017922 - RNA, 16 nt, Human
ucuauuguuucuuuca

SEQ ID NO: 3017923 - RNA, 16 nt, Human
ucucaaaaaaagaaaa

SEQ ID NO: 3017924 - RNA, 14 nt, Human
acuuggaagcuccg

SEQ ID NO: 3017925 - RNA, 14 nt, Human
acuugucuuuggac

SEQ ID NO: 3017926 - RNA, 19 nt, Human
acuugagaauuacccuuuu

SEQ ID NO: 3017927 - RNA, 15 nt, Human
acuguccuauuauau

SEQ ID NO: 3017928 - RNA, 16 nt, Human
acuguccuauuauauu

SEQ ID NO: 3017929 - RNA, 23 nt, Human
acuguccuacccacccuccuuuc

SEQ ID NO: 3017930 - RNA, 18 nt, Human
acuguccuauuauauuca

SEQ ID NO: 3017931 - RNA, 16 nt, Human
acuguaucaugacaaa

SEQ ID NO: 3017932 - RNA, 20 nt, Human
acuguaucaugacaaagacu

SEQ ID NO: 3017933 - RNA, 19 nt, Human
acuguacaugaaaacacau

SEQ ID NO: 3017934 - RNA, 16 nt, Human
acuguacaugaaaaca

SEQ ID NO: 3017935 - RNA, 17 nt, Human
acuggguacuuguggac

SEQ ID NO: 3017936 - RNA, 16 nt, Human
acuguacaaaguagaa

SEQ ID NO: 3017937 - RNA, 22 nt, Human
acuguacaaaguagaagucuua

SEQ ID NO: 3017938 - RNA, 14 nt, Human
acuguaucaugaca

SEQ ID NO: 3017939 - RNA, 20 nt, Human
acuguacaugaaaacacauu

SEQ ID NO: 3017940 - RNA, 21 nt, Human
acuguacaugaaaacacauuu

SEQ ID NO: 3017941 - RNA, 23 nt, Human
ucgcugugucagcauagaaguaa

SEQ ID NO: 3017942 - RNA, 21 nt, Human
acugggcuuggggaccagagc

SEQ ID NO: 3017943 - RNA, 15 nt, Human
acuggguacuugugg

SEQ ID NO: 3017944 - RNA, 14 nt, Human
ucgcuccugugucu

SEQ ID NO: 3017945 - RNA, 21 nt, Human
acuguuaauaguucagguaac

SEQ ID NO: 3017946 - RNA, 17 nt, Human
acuguuaauaguucagg

SEQ ID NO: 3017947 - RNA, 17 nt, Human
ucuaaagcugccagccg

SEQ ID NO: 3017948 - RNA, 16 nt, Human
ucuaaagcugccagcc

SEQ ID NO: 3017949 - RNA, 13 nt, Human
ucuaaaggcuacc

SEQ ID NO: 3017950 - RNA, 16 nt, Human
ucuaaaggcuaccuuu

SEQ ID NO: 3017951 - RNA, 22 nt, Human
ucuaacuucaccauauuaccac

SEQ ID NO: 3017952 - RNA, 21 nt, Human
ucuacccucuuagaaaaacca

SEQ ID NO: 3017953 - RNA, 13 nt, Human
ucaguagucagac

SEQ ID NO: 3017954 - RNA, 23 nt, Human
ucagugccuuauggaacacucug

SEQ ID NO: 3017955 - RNA, 22 nt, Human
ucagugccuuauggaacacucu

SEQ ID NO: 3017956 - RNA, 20 nt, Human
ucagugccuuauggaacacu

SEQ ID NO: 3017957 - RNA, 19 nt, Human
ucagugccuuauggaacac

SEQ ID NO: 3017958 - RNA, 14 nt, Human
ucaguggcagcugc

SEQ ID NO: 3017959 - RNA, 15 nt, Human
ucaguggcagcugcu

SEQ ID NO: 3017960 - RNA, 17 nt, Human
ucaguuguuaguguguc

SEQ ID NO: 3017961 - RNA, 16 nt, Human
ucaguggcagcugcuu

SEQ ID NO: 3017962 - RNA, 18 nt, Human
ucagugccuuauggaaca

SEQ ID NO: 3017963 - RNA, 13 nt, Human
ucaguggcagcug

SEQ ID NO: 3017964 - RNA, 15 nt, Human
ucaguuguuauuuau

SEQ ID NO: 3017965 - RNA, 20 nt, Human
ucaguuguuauuuauugaaa

SEQ ID NO: 3017966 - RNA, 19 nt, Human
ucaguuguuagugugucuu

SEQ ID NO: 3017967 - RNA, 14 nt, Human
ucaguuuaucuguu

SEQ ID NO: 3017968 - RNA, 16 nt, Human
ucaguuuaucuguuca

SEQ ID NO: 3017969 - RNA, 12 nt, Human
ucaguuugguug

SEQ ID NO: 3017970 - RNA, 16 nt, Human
ucaguuugcagaguag

SEQ ID NO: 3017971 - RNA, 15 nt, Human
ucaguuugcagagua

SEQ ID NO: 3017972 - RNA, 22 nt, Human
ucaggugucccugcacuugcag

SEQ ID NO: 3017973 - RNA, 13 nt, Human
ucaguaagccgug

SEQ ID NO: 3017974 - RNA, 13 nt, Human
ucaguaauaacuc

SEQ ID NO: 3017975 - RNA, 20 nt, Human
acccuugccgucuaccugag

SEQ ID NO: 3017976 - RNA, 20 nt, Human
accgaaaacguggcugcuuc

SEQ ID NO: 3017977 - RNA, 15 nt, Human
ucaggugucccugca

SEQ ID NO: 3017978 - RNA, 23 nt, Human
ucagguggggucacucuggcagc

SEQ ID NO: 3017979 - RNA, 17 nt, Human
ucaggugucccugcacu

SEQ ID NO: 3017980 - RNA, 18 nt, Human
ucaggugucccugcacuu

SEQ ID NO: 3017981 - RNA, 22 nt, Human
accgaaaacguggcugcuucaa

SEQ ID NO: 3017982 - RNA, 21 nt, Human
accgaaaacguggcugcuuca

SEQ ID NO: 3017983 - RNA, 22 nt, Human
ucagguggggucacucuggcag

SEQ ID NO: 3017984 - RNA, 21 nt, Human
ucagguggggucacucuggca

SEQ ID NO: 3017985 - RNA, 19 nt, Human
acccgcuaagagggaggga

SEQ ID NO: 3017986 - RNA, 18 nt, Human
ucaggguuggccccugcc

SEQ ID NO: 3017987 - RNA, 19 nt, Human
ucaggguuggccccugccc

SEQ ID NO: 3017988 - RNA, 17 nt, Human
ucaggguuggccccugc

SEQ ID NO: 3017989 - RNA, 19 nt, Human
ucaggggugugcggccuuu

SEQ ID NO: 3017990 - RNA, 12 nt, Human
ucaggggugugc

SEQ ID NO: 3017991 - RNA, 19 nt, Human
ucaggccaggcccucugcc

SEQ ID NO: 3017992 - RNA, 18 nt, Human
ucaggccaggcccucugc

SEQ ID NO: 3017993 - RNA, 17 nt, Human
ucaggccaggcccucug

SEQ ID NO: 3017994 - RNA, 17 nt, Human
ucaggcaggugggaugg

SEQ ID NO: 3017995 - RNA, 18 nt, Human
ucaggcaggugggaugga

SEQ ID NO: 3017996 - RNA, 13 nt, Human
acccccagccugc

SEQ ID NO: 3017997 - RNA, 12 nt, Human
acccccagccug

SEQ ID NO: 3017998 - RNA, 12 nt, Human
ucaggccaggcc

SEQ ID NO: 3017999 - RNA, 13 nt, Human
ucaggccagcugc

SEQ ID NO: 3018000 - RNA, 16 nt, Human
ucaggccaggcccucu

SEQ ID NO: 3018001 - RNA, 15 nt, Human
ucaggccaggcccuc

SEQ ID NO: 3018002 - RNA, 14 nt, Human
ucaggccaggcccu

SEQ ID NO: 3018003 - RNA, 13 nt, Human
ucaggccaggccc

SEQ ID NO: 3018004 - RNA, 21 nt, Human
acccuccuuucaccacaugug

SEQ ID NO: 3018005 - RNA, 22 nt, Human
acccgggaagggggcugggaca

SEQ ID NO: 3018006 - RNA, 14 nt, Human
acccucauguucuu

SEQ ID NO: 3018007 - RNA, 15 nt, Human
acccucauguucuua

SEQ ID NO: 3018008 - RNA, 17 nt, Human
acccucauguucuuaau

SEQ ID NO: 3018009 - RNA, 20 nt, Human
acccgggaagggggcuggga

SEQ ID NO: 3018010 - RNA, 19 nt, Human
acccgggaagggggcuggg

SEQ ID NO: 3018011 - RNA, 21 nt, Human
acccugaggcccagagggccu

SEQ ID NO: 3018012 - RNA, 19 nt, Human
acccugaggcccagagggc

SEQ ID NO: 3018013 - RNA, 17 nt, Human
acccugaggcccagagg

SEQ ID NO: 3018014 - RNA, 11 nt, Human
acccugaggcc

SEQ ID NO: 3018015 - RNA, 23 nt, Human
acccugaggcccagagggccugc

SEQ ID NO: 3018016 - RNA, 12 nt, Human
ucagcccucaga

SEQ ID NO: 3018017 - RNA, 13 nt, Human
acccagcgagccc

SEQ ID NO: 3018018 - RNA, 16 nt, Human
acccagcgagcccugg

SEQ ID NO: 3018019 - RNA, 17 nt, Human
acccagcgagcccuggu

SEQ ID NO: 3018020 - RNA, 13 nt, Human
acccaggagcccc

SEQ ID NO: 3018021 - RNA, 15 nt, Human
acccaggagccccga

SEQ ID NO: 3018022 - RNA, 23 nt, Human
acccaggugcuaggaacacuccu

SEQ ID NO: 3018023 - RNA, 11 nt, Human
acccaggugcu

SEQ ID NO: 3018024 - RNA, 13 nt, Human
accccagguuucu

SEQ ID NO: 3018025 - RNA, 22 nt, Human
ucagagacuccugcaggcagcc

SEQ ID NO: 3018026 - RNA, 20 nt, Human
ucagaauucucagaaucuca

SEQ ID NO: 3018027 - RNA, 10 nt, Human
ucagaauucu

SEQ ID NO: 3018028 - RNA, 12 nt, Human
ucagaauucuca

SEQ ID NO: 3018029 - RNA, 15 nt, Human
acccagcccacuucu

SEQ ID NO: 3018030 - RNA, 23 nt, Human
ucagaaguuucugccgcagcccu

SEQ ID NO: 3018031 - RNA, 23 nt, Human
ucagagacuccugcaggcagcca

SEQ ID NO: 3018032 - RNA, 15 nt, Human
ucagaucucuaacuu

SEQ ID NO: 3018033 - RNA, 16 nt, Human
ucagaucucuaacuuc

SEQ ID NO: 3018034 - RNA, 15 nt, Human
ucacuguugcccagg

SEQ ID NO: 3018035 - RNA, 18 nt, Human
ucacugcaaccuccgccu

SEQ ID NO: 3018036 - RNA, 14 nt, Human
ucacuguugcccag

SEQ ID NO: 3018037 - RNA, 22 nt, Human
ucaccagccccagugcccacag

SEQ ID NO: 3018038 - RNA, 20 nt, Human
ucacuauguugcccaggcag

SEQ ID NO: 3018039 - RNA, 21 nt, Human
ucacuauguugcccaggcagg

SEQ ID NO: 3018040 - RNA, 23 nt, Human
ucacugagacagcccgggcucug

SEQ ID NO: 3018041 - RNA, 21 nt, Human
accauuuugggguacccacug

SEQ ID NO: 3018042 - RNA, 23 nt, Human
accauuuugcugucccuuuuccu

SEQ ID NO: 3018043 - RNA, 22 nt, Human
accauuuugcugucccuuuucc

SEQ ID NO: 3018044 - RNA, 19 nt, Human
accauucuccaccugccag

SEQ ID NO: 3018045 - RNA, 21 nt, Human
accauucuccaccugccaggg

SEQ ID NO: 3018046 - RNA, 20 nt, Human
accauucuccaccugccagg

SEQ ID NO: 3018047 - RNA, 20 nt, Human
acccacugcuuuuggucugu

SEQ ID NO: 3018048 - RNA, 13 nt, Human
acauuuuaugucu

SEQ ID NO: 3018049 - RNA, 15 nt, Human
acauuuuaugucuuu

SEQ ID NO: 3018050 - RNA, 21 nt, Human
acauuuuuuaaaugcaccugg

SEQ ID NO: 3018051 - RNA, 13 nt, Human
acauuuuucuuag

SEQ ID NO: 3018052 - RNA, 23 nt, Human
acauuuuucuuagggaaggauac

SEQ ID NO: 3018053 - RNA, 15 nt, Human
acauuuuuaagugcu

SEQ ID NO: 3018054 - RNA, 18 nt, Human
acauuuuuaagugcugca

SEQ ID NO: 3018055 - RNA, 21 nt, Human
acauugcggacagccacggcc

SEQ ID NO: 3018056 - RNA, 22 nt, Human
acauugcggacagccacggcca

SEQ ID NO: 3018057 - RNA, 23 nt, Human
ucaaggauccugagccagauuuc

SEQ ID NO: 3018058 - RNA, 17 nt, Human
ucaagagggucugagga

SEQ ID NO: 3018059 - RNA, 16 nt, Human
ucaagugauucuccug

SEQ ID NO: 3018060 - RNA, 17 nt, Human
ucaagugauucuccugc

SEQ ID NO: 3018061 - RNA, 17 nt, Human
ucaauaggaaaaacuga

SEQ ID NO: 3018062 - RNA, 19 nt, Human
ucaauaggaaaaacugauu

SEQ ID NO: 3018063 - RNA, 18 nt, Human
ucaauaggaaaaacugau

SEQ ID NO: 3018064 - RNA, 22 nt, Human
ucaauaggaaaaacugauuuuu

SEQ ID NO: 3018065 - RNA, 14 nt, Human
ucacagaagaugaa

SEQ ID NO: 3018066 - RNA, 20 nt, Human
ucaauugugaaaaaauuuac

SEQ ID NO: 3018067 - RNA, 16 nt, Human
ucaauugugaaaaaau

SEQ ID NO: 3018068 - RNA, 15 nt, Human
ucacagaugggugcu

SEQ ID NO: 3018069 - RNA, 14 nt, Human
ucacagaugggugc

SEQ ID NO: 3018070 - RNA, 22 nt, Human
ucacagcuuauuuccucauuuu

SEQ ID NO: 3018071 - RNA, 16 nt, Human
ucacauauugauuucc

SEQ ID NO: 3018072 - RNA, 18 nt, Human
ucacauauugauuuccgu

SEQ ID NO: 3018073 - RNA, 20 nt, Human
ucacauauugauuuccguua

SEQ ID NO: 3018074 - RNA, 17 nt, Human
ucaccagccccagugcc

SEQ ID NO: 3018075 - RNA, 16 nt, Human
ucaccagccccagugc

SEQ ID NO: 3018076 - RNA, 16 nt, Human
accaaaucagcugcua

SEQ ID NO: 3018077 - RNA, 19 nt, Human
accaaaucagcugcuacua

SEQ ID NO: 3018078 - RNA, 16 nt, Human
accaacauacucccau

SEQ ID NO: 3018079 - RNA, 20 nt, Human
accaaccacugcgaccacaa

SEQ ID NO: 3018080 - RNA, 17 nt, Human
accacacagaggcugcc

SEQ ID NO: 3018081 - RNA, 15 nt, Human
accacacccagccca

SEQ ID NO: 3018082 - RNA, 16 nt, Human
accacacccagcccac

SEQ ID NO: 3018083 - RNA, 20 nt, Human
accacacccagcccacuucu

SEQ ID NO: 3018084 - RNA, 21 nt, Human
accacacccagcccacuucug

SEQ ID NO: 3018085 - RNA, 23 nt, Human
accacacccagcccacuucugcc

SEQ ID NO: 3018086 - RNA, 20 nt, Human
uauuuugacuuguugagggu

SEQ ID NO: 3018087 - RNA, 14 nt, Human
uauuuugacuuguu

SEQ ID NO: 3018088 - RNA, 20 nt, Human
uauuuugcuuugugauuuuu

SEQ ID NO: 3018089 - RNA, 13 nt, Human
uauuuugcuuugu

SEQ ID NO: 3018090 - RNA, 15 nt, Human
uauuuugcuuuguga

SEQ ID NO: 3018091 - RNA, 17 nt, Human
uauuuuuguagagccag

SEQ ID NO: 3018092 - RNA, 14 nt, Human
acaucuugcucugc

SEQ ID NO: 3018093 - RNA, 19 nt, Human
acaucuuggucagauuuga

SEQ ID NO: 3018094 - RNA, 22 nt, Human
acaucuugcucugcugacagac

SEQ ID NO: 3018095 - RNA, 17 nt, Human
acaucuugcucugcuga

SEQ ID NO: 3018096 - RNA, 15 nt, Human
acaucuugcucugcu

SEQ ID NO: 3018097 - RNA, 16 nt, Human
acaucuugcucugcug

SEQ ID NO: 3018098 - RNA, 15 nt, Human
acaugaaaacacauu

SEQ ID NO: 3018099 - RNA, 13 nt, Human
acaugagcaucag

SEQ ID NO: 3018100 - RNA, 23 nt, Human
acaugaaaacacauuuuucuuag

SEQ ID NO: 3018101 - RNA, 22 nt, Human
acaugaaaacacauuuuucuua

SEQ ID NO: 3018102 - RNA, 22 nt, Human
ucaaagauauuuugcuuuguga

SEQ ID NO: 3018103 - RNA, 13 nt, Human
ucaaagauauuuu

SEQ ID NO: 3018104 - RNA, 20 nt, Human
ucaaagauauuuugcuuugu

SEQ ID NO: 3018105 - RNA, 16 nt, Human
ucaaaagcugggcagg

SEQ ID NO: 3018106 - RNA, 14 nt, Human
acauggccuuugcu

SEQ ID NO: 3018107 - RNA, 15 nt, Human
acauggaguauaugu

SEQ ID NO: 3018108 - RNA, 19 nt, Human
acauggaguauaugucaag

SEQ ID NO: 3018109 - RNA, 23 nt, Human
acaugagcaucaggccaggcccu

SEQ ID NO: 3018110 - RNA, 20 nt, Human
acaugagcaucaggccaggc

SEQ ID NO: 3018111 - RNA, 20 nt, Human
acauggaauaacauguaauu

SEQ ID NO: 3018112 - RNA, 14 nt, Human
acauggaaguacua

SEQ ID NO: 3018113 - RNA, 18 nt, Human
acauggaauaacauguaa

SEQ ID NO: 3018114 - RNA, 21 nt, Human
acaugucuuuucuugcaugag

SEQ ID NO: 3018115 - RNA, 17 nt, Human
acgcccuuggccauggg

SEQ ID NO: 3018116 - RNA, 20 nt, Human
acgcgugcacacaccagagc

SEQ ID NO: 3018117 - RNA, 23 nt, Human
acgcgugcacacaccagagccca

SEQ ID NO: 3018118 - RNA, 14 nt, Human
acgcccccacuggu

SEQ ID NO: 3018119 - RNA, 18 nt, Human
acgcuacccgggaagggg

SEQ ID NO: 3018120 - RNA, 17 nt, Human
acgcuacccgggaaggg

SEQ ID NO: 3018121 - RNA, 13 nt, Human
acgcuacccggga

SEQ ID NO: 3018122 - RNA, 19 nt, Human
acggagucccaccuuggcu

SEQ ID NO: 3018123 - RNA, 13 nt, Human
acggccaggccag

SEQ ID NO: 3018124 - RNA, 16 nt, Human
acggccaggccagagg

SEQ ID NO: 3018125 - RNA, 22 nt, Human
uccaggcuccuuuagcgcccag

SEQ ID NO: 3018126 - RNA, 18 nt, Human
uccaggcugggagagccu

SEQ ID NO: 3018127 - RNA, 17 nt, Human
uccaggcugggagagcc

SEQ ID NO: 3018128 - RNA, 14 nt, Human
uccaggcugggaga

SEQ ID NO: 3018129 - RNA, 18 nt, Human
acgccaucccagccccaa

SEQ ID NO: 3018130 - RNA, 17 nt, Human
acgccaucccagcccca

SEQ ID NO: 3018131 - RNA, 16 nt, Human
acgccaucccagcccc

SEQ ID NO: 3018132 - RNA, 15 nt, Human
acgccaucccagccc

SEQ ID NO: 3018133 - RNA, 14 nt, Human
acgccaucccagcc

SEQ ID NO: 3018134 - RNA, 11 nt, Human
acgccauccca

SEQ ID NO: 3018135 - RNA, 23 nt, Human
acgccaggggaaaaucagccugc

SEQ ID NO: 3018136 - RNA, 15 nt, Human
acgacugcccggcag

SEQ ID NO: 3018137 - RNA, 18 nt, Human
acgccaggggaaaaucag

SEQ ID NO: 3018138 - RNA, 17 nt, Human
uccaugaguccccuguu

SEQ ID NO: 3018139 - RNA, 16 nt, Human
uccaugaguccccugu

SEQ ID NO: 3018140 - RNA, 15 nt, Human
uccaugaguccccug

SEQ ID NO: 3018141 - RNA, 14 nt, Human
acggcucacugcag

SEQ ID NO: 3018142 - RNA, 20 nt, Human
uccagugaggcucugcccuu

SEQ ID NO: 3018143 - RNA, 17 nt, Human
uccagugaggcucugcc

SEQ ID NO: 3018144 - RNA, 19 nt, Human
uccagugaggcucugcccu

SEQ ID NO: 3018145 - RNA, 18 nt, Human
uccagugaggcucugccc

SEQ ID NO: 3018146 - RNA, 14 nt, Human
ucccaccccacaca

SEQ ID NO: 3018147 - RNA, 11 nt, Human
ucccaccccac

SEQ ID NO: 3018148 - RNA, 14 nt, Human
ucccacaaaggaga

SEQ ID NO: 3018149 - RNA, 15 nt, Human
ucccaaagugcuggg

SEQ ID NO: 3018150 - RNA, 16 nt, Human
ucccaaagugcuggga

SEQ ID NO: 3018151 - RNA, 20 nt, Human
accugcacacuguccuauua

SEQ ID NO: 3018152 - RNA, 17 nt, Human
accugccaggaagccag

SEQ ID NO: 3018153 - RNA, 16 nt, Human
accugccaggaagcca

SEQ ID NO: 3018154 - RNA, 18 nt, Human
accugccaggaagccagc

SEQ ID NO: 3018155 - RNA, 15 nt, Human
accugccaggaagcc

SEQ ID NO: 3018156 - RNA, 14 nt, Human
accugaggggccuc

SEQ ID NO: 3018157 - RNA, 23 nt, Human
accugaggcccuucucuccagcc

SEQ ID NO: 3018158 - RNA, 18 nt, Human
accugaagacucauucuu

SEQ ID NO: 3018159 - RNA, 19 nt, Human
accugaauuuuggcugugu

SEQ ID NO: 3018160 - RNA, 12 nt, Human
ucauaaugacuu

SEQ ID NO: 3018161 - RNA, 20 nt, Human
accuggaauauauaaccagu

SEQ ID NO: 3018162 - RNA, 16 nt, Human
accugcggugcuaucu

SEQ ID NO: 3018163 - RNA, 21 nt, Human
accugcgucucauacucaccu

SEQ ID NO: 3018164 - RNA, 23 nt, Human
accugccuguugggccaggagcc

SEQ ID NO: 3018165 - RNA, 16 nt, Human
ucauuugucacacacu

SEQ ID NO: 3018166 - RNA, 14 nt, Human
ucauuugucacaca

SEQ ID NO: 3018167 - RNA, 19 nt, Human
ucauuuuuaguagagacag

SEQ ID NO: 3018168 - RNA, 18 nt, Human
ucauuuuuuuuaagaaaa

SEQ ID NO: 3018169 - RNA, 17 nt, Human
ucauuuuuuuuaagaaa

SEQ ID NO: 3018170 - RNA, 20 nt, Human
uccacccaggagccccgagg

SEQ ID NO: 3018171 - RNA, 12 nt, Human
uccacccaccuc

SEQ ID NO: 3018172 - RNA, 18 nt, Human
uccaccaucaagccacca

SEQ ID NO: 3018173 - RNA, 13 nt, Human
uccacccaccuca

SEQ ID NO: 3018174 - RNA, 17 nt, Human
uccacccaggagccccg

SEQ ID NO: 3018175 - RNA, 13 nt, Human
accuggccucugc

SEQ ID NO: 3018176 - RNA, 12 nt, Human
accuggccucug

SEQ ID NO: 3018177 - RNA, 21 nt, Human
accuggguaacuagggaagau

SEQ ID NO: 3018178 - RNA, 14 nt, Human
accuucuccuucac

SEQ ID NO: 3018179 - RNA, 22 nt, Human
accuucuccuucaccuuugucc

SEQ ID NO: 3018180 - RNA, 16 nt, Human
accuugacagggcaca

SEQ ID NO: 3018181 - RNA, 13 nt, Human
accuuugucccca

SEQ ID NO: 3018182 - RNA, 14 nt, Human
accuuuuuuauaca

SEQ ID NO: 3018183 - RNA, 16 nt, Human
accuuuguccccaccg

SEQ ID NO: 3018184 - RNA, 15 nt, Human
accuuuguccccacc

SEQ ID NO: 3018185 - RNA, 14 nt, Human
accuuuguccccac

SEQ ID NO: 3018186 - RNA, 16 nt, Human
accuuuuuuauacaua

SEQ ID NO: 3018187 - RNA, 17 nt, Human
accuuuuuuauacauaa

SEQ ID NO: 3018188 - RNA, 18 nt, Human
accuuuuuuauacauaaa

SEQ ID NO: 3018189 - RNA, 15 nt, Human
acucuucccucaaau

SEQ ID NO: 3018190 - RNA, 17 nt, Human
acucuggcagcucagag

SEQ ID NO: 3018191 - RNA, 16 nt, Human
acucuggcagcucaga

SEQ ID NO: 3018192 - RNA, 21 nt, Human
acucuuauugcccacgcugga

SEQ ID NO: 3018193 - RNA, 20 nt, Human
acucuggcagcucagagagg

SEQ ID NO: 3018194 - RNA, 19 nt, Human
acucuggcagcucagagag

SEQ ID NO: 3018195 - RNA, 16 nt, Human
acucgcgacaaugcaa

SEQ ID NO: 3018196 - RNA, 15 nt, Human
acucgcgacaaugca

SEQ ID NO: 3018197 - RNA, 16 nt, Human
acucgaguuacagaca

SEQ ID NO: 3018198 - RNA, 20 nt, Human
uccuagcacuuugggaggcc

SEQ ID NO: 3018199 - RNA, 21 nt, Human
uccuagccugugccucuggga

SEQ ID NO: 3018200 - RNA, 15 nt, Human
uccguuaaaauacca

SEQ ID NO: 3018201 - RNA, 13 nt, Human
uccguuaaaauac

SEQ ID NO: 3018202 - RNA, 21 nt, Human
uccucccaccucagccucccg

SEQ ID NO: 3018203 - RNA, 13 nt, Human
uccucccaccuca

SEQ ID NO: 3018204 - RNA, 14 nt, Human
uccucccaccucag

SEQ ID NO: 3018205 - RNA, 15 nt, Human
uccucccaccucagc

SEQ ID NO: 3018206 - RNA, 16 nt, Human
uccucccaccucagcc

SEQ ID NO: 3018207 - RNA, 18 nt, Human
uccucccaccucagccuc

SEQ ID NO: 3018208 - RNA, 20 nt, Human
uccucccaccucagccuccc

SEQ ID NO: 3018209 - RNA, 15 nt, Human
uccugaagaauugaa

SEQ ID NO: 3018210 - RNA, 19 nt, Human
acucuuucuauuguuucuu

SEQ ID NO: 3018211 - RNA, 23 nt, Human
uccucuuuggucuacacugugcu

SEQ ID NO: 3018212 - RNA, 21 nt, Human
acucaccugccccucaacucu

SEQ ID NO: 3018213 - RNA, 19 nt, Human
acucaccugccccucaacu

SEQ ID NO: 3018214 - RNA, 14 nt, Human
acucaccugccccu

SEQ ID NO: 3018215 - RNA, 14 nt, Human
acucagaagacacu

SEQ ID NO: 3018216 - RNA, 15 nt, Human
acucagaagacacug

SEQ ID NO: 3018217 - RNA, 16 nt, Human
acucagaagacacuga

SEQ ID NO: 3018218 - RNA, 17 nt, Human
acucagaagacacugau

SEQ ID NO: 3018219 - RNA, 14 nt, Human
acucagaauucucu

SEQ ID NO: 3018220 - RNA, 21 nt, Human
acucagaauucucuaguuuga

SEQ ID NO: 3018221 - RNA, 22 nt, Human
acucagaauucucuaguuugau

SEQ ID NO: 3018222 - RNA, 18 nt, Human
acucagaagacacugaug

SEQ ID NO: 3018223 - RNA, 17 nt, Human
acucauugaccugaggc

SEQ ID NO: 3018224 - RNA, 16 nt, Human
acucauugaccugagg

SEQ ID NO: 3018225 - RNA, 12 nt, Human
acucaucuuagg

SEQ ID NO: 3018226 - RNA, 22 nt, Human
acucauugaccugaggcccuuc

SEQ ID NO: 3018227 - RNA, 18 nt, Human
acucauugaccugaggcc

SEQ ID NO: 3018228 - RNA, 23 nt, Human
ucccugaaggccccgcccaggcu

SEQ ID NO: 3018229 - RNA, 17 nt, Human
acucaccccagccccaa

SEQ ID NO: 3018230 - RNA, 17 nt, Human
ucccugaaggccccgcc

SEQ ID NO: 3018231 - RNA, 18 nt, Human
ucccugaaggccccgccc

SEQ ID NO: 3018232 - RNA, 22 nt, Human
ucccugaaggccccgcccaggc

SEQ ID NO: 3018233 - RNA, 21 nt, Human
ucccugaaggccccgcccagg

SEQ ID NO: 3018234 - RNA, 18 nt, Human
ucccucagucuggcccuu

SEQ ID NO: 3018235 - RNA, 20 nt, Human
ucccucagucuggcccuucc

SEQ ID NO: 3018236 - RNA, 11 nt, Human
ucccucuuucc

SEQ ID NO: 3018237 - RNA, 13 nt, Human
ucccucuuucccu

SEQ ID NO: 3018238 - RNA, 13 nt, Human
acguacacacaca

SEQ ID NO: 3018239 - RNA, 12 nt, Human
acguacacauuu

SEQ ID NO: 3018240 - RNA, 13 nt, Human
acguacacauuuu

SEQ ID NO: 3018241 - RNA, 14 nt, Human
acguacacauuuua

SEQ ID NO: 3018242 - RNA, 18 nt, Human
acuacggaauaguuggcu

SEQ ID NO: 3018243 - RNA, 19 nt, Human
acucacauuuauucugcuc

SEQ ID NO: 3018244 - RNA, 20 nt, Human
acucacauuuauucugcuca

SEQ ID NO: 3018245 - RNA, 14 nt, Human
acucaaugcacuga

SEQ ID NO: 3018246 - RNA, 12 nt, Human
acuauaauguaa

SEQ ID NO: 3018247 - RNA, 13 nt, Human
acuauaauguaag

SEQ ID NO: 3018248 - RNA, 14 nt, Human
acuauaauguaagc

SEQ ID NO: 3018249 - RNA, 12 nt, Human
acuauguaucaa

SEQ ID NO: 3018250 - RNA, 19 nt, Human
acacaaagcuuuugcauau

SEQ ID NO: 3018251 - RNA, 18 nt, Human
acacaaagcuuuugcaua

SEQ ID NO: 3018252 - RNA, 20 nt, Human
acacaaagcuuuugcauauu

SEQ ID NO: 3018253 - RNA, 23 nt, Human
acaaugcaaaccaucauugaaau

SEQ ID NO: 3018254 - RNA, 21 nt, Human
acaaugcaaaccaucauugaa

SEQ ID NO: 3018255 - RNA, 19 nt, Human
acaaugcaaaccaucauug

SEQ ID NO: 3018256 - RNA, 19 nt, Human
acaaugacuuacuguacau

SEQ ID NO: 3018257 - RNA, 20 nt, Human
acaaugacuuacuguacaug

SEQ ID NO: 3018258 - RNA, 22 nt, Human
acaaugacuuacuguacaugaa

SEQ ID NO: 3018259 - RNA, 18 nt, Human
acaaugcaaaccaucauu

SEQ ID NO: 3018260 - RNA, 17 nt, Human
acaaugcaaaccaucau

SEQ ID NO: 3018261 - RNA, 16 nt, Human
acaaugcaaaccauca

SEQ ID NO: 3018262 - RNA, 11 nt, Human
acaaugcaaac

SEQ ID NO: 3018263 - RNA, 19 nt, Human
uaggguaagugagagaggg

SEQ ID NO: 3018264 - RNA, 17 nt, Human
uaggguuauaauaaugu

SEQ ID NO: 3018265 - RNA, 15 nt, Human
uaggguuauaauaau

SEQ ID NO: 3018266 - RNA, 23 nt, Human
acacaggcccggcuccaggcucc

SEQ ID NO: 3018267 - RNA, 24 nt, Human
acacaggcccggcuccaggcuccu

SEQ ID NO: 3018268 - RNA, 19 nt, Human
acacaggcccggcuccagg

SEQ ID NO: 3018269 - RNA, 20 nt, Human
acacaggcccggcuccaggc

SEQ ID NO: 3018270 - RNA, 21 nt, Human
acacaggcccggcuccaggcu

SEQ ID NO: 3018271 - RNA, 22 nt, Human
acacaggcccggcuccaggcuc

SEQ ID NO: 3018272 - RNA, 17 nt, Human
acacaggcccggcucca

SEQ ID NO: 3018273 - RNA, 18 nt, Human
acacaggcccggcuccag

SEQ ID NO: 3018274 - RNA, 16 nt, Human
acacaggcccggcucc

SEQ ID NO: 3018275 - RNA, 14 nt, Human
uaguagagacaggg

SEQ ID NO: 3018276 - RNA, 15 nt, Human
uaguagagacagggu

SEQ ID NO: 3018277 - RNA, 22 nt, Human
uaguagagacaggguuuugcca

SEQ ID NO: 3018278 - RNA, 14 nt, Human
uagucacugagaca

SEQ ID NO: 3018279 - RNA, 22 nt, Human
uaggggucugucuuuuaaacuc

SEQ ID NO: 3018280 - RNA, 13 nt, Human
uagggaagauaau

SEQ ID NO: 3018281 - RNA, 17 nt, Human
uaggaaaaacugauuuu

SEQ ID NO: 3018282 - RNA, 16 nt, Human
uaggaaaaacugauuu

SEQ ID NO: 3018283 - RNA, 20 nt, Human
uagccuuagaagucacacag

SEQ ID NO: 3018284 - RNA, 17 nt, Human
uagcgcccaguugggug

SEQ ID NO: 3018285 - RNA, 14 nt, Human
uagcgcccaguugg

SEQ ID NO: 3018286 - RNA, 20 nt, Human
uagccugugccucugggacu

SEQ ID NO: 3018287 - RNA, 21 nt, Human
uagccuuagaagucacacagu

SEQ ID NO: 3018288 - RNA, 14 nt, Human
uaggaaaaacugau

SEQ ID NO: 3018289 - RNA, 13 nt, Human
uaggaaaaacuga

SEQ ID NO: 3018290 - RNA, 13 nt, Human
uagagguacacuu

SEQ ID NO: 3018291 - RNA, 18 nt, Human
uagagguacacuugugaa

SEQ ID NO: 3018292 - RNA, 14 nt, Human
uagcacagacccug

SEQ ID NO: 3018293 - RNA, 21 nt, Human
uagcacagacccugcccugug

SEQ ID NO: 3018294 - RNA, 20 nt, Human
uagcacagacccugcccugu

SEQ ID NO: 3018295 - RNA, 15 nt, Human
uagcacagacccugc

SEQ ID NO: 3018296 - RNA, 12 nt, Human
uagccaaggcca

SEQ ID NO: 3018297 - RNA, 22 nt, Human
uagcacagacccugcccugugg

SEQ ID NO: 3018298 - RNA, 13 nt, Human
uagccaaggccaa

SEQ ID NO: 3018299 - RNA, 14 nt, Human
uagagccagggucu

SEQ ID NO: 3018300 - RNA, 22 nt, Human
uagagcggagaaaggaagggcu

SEQ ID NO: 3018301 - RNA, 16 nt, Human
acaaaaagcauaaaaa

SEQ ID NO: 3018302 - RNA, 10 nt, Human
uagacagagu

SEQ ID NO: 3018303 - RNA, 16 nt, Human
uagacagucccugcca

SEQ ID NO: 3018304 - RNA, 18 nt, Human
uagacaauuuauuauggc

SEQ ID NO: 3018305 - RNA, 17 nt, Human
aauuugugauacaaugc

SEQ ID NO: 3018306 - RNA, 18 nt, Human
aauuugugauacaaugcu

SEQ ID NO: 3018307 - RNA, 14 nt, Human
aauuugugauacaa

SEQ ID NO: 3018308 - RNA, 18 nt, Human
aauuugggggaaaauuua

SEQ ID NO: 3018309 - RNA, 21 nt, Human
uagacagucccugccaaugga

SEQ ID NO: 3018310 - RNA, 17 nt, Human
uagacagucccugccaa

SEQ ID NO: 3018311 - RNA, 20 nt, Human
uaugugcacaucuguuuugu

SEQ ID NO: 3018312 - RNA, 18 nt, Human
acaggcccggcuccaggc

SEQ ID NO: 3018313 - RNA, 20 nt, Human
acaggcccggcuccaggcuc

SEQ ID NO: 3018314 - RNA, 21 nt, Human
acaggcccggcuccaggcucc

SEQ ID NO: 3018315 - RNA, 22 nt, Human
acaggcccggcuccaggcuccu

SEQ ID NO: 3018316 - RNA, 20 nt, Human
acaggaaaauuuuaaaaaua

SEQ ID NO: 3018317 - RNA, 15 nt, Human
acaggcagauacagg

SEQ ID NO: 3018318 - RNA, 16 nt, Human
acaggcccggcuccag

SEQ ID NO: 3018319 - RNA, 17 nt, Human
acaggcccggcuccagg

SEQ ID NO: 3018320 - RNA, 23 nt, Human
acagcuugaccgugaggccagag

SEQ ID NO: 3018321 - RNA, 22 nt, Human
acagcuugaccgugaggccaga

SEQ ID NO: 3018322 - RNA, 18 nt, Human
acaggaaaagcugcugac

SEQ ID NO: 3018323 - RNA, 19 nt, Human
acaggaaaagcugcugaca

SEQ ID NO: 3018324 - RNA, 20 nt, Human
acaggaaaagcugcugacag

SEQ ID NO: 3018325 - RNA, 21 nt, Human
acaggaaaagcugcugacagu

SEQ ID NO: 3018326 - RNA, 17 nt, Human
acagcuugaccgugagg

SEQ ID NO: 3018327 - RNA, 21 nt, Human
acagcuugaccgugaggccag

SEQ ID NO: 3018328 - RNA, 20 nt, Human
acagcuugaccgugaggcca

SEQ ID NO: 3018329 - RNA, 17 nt, Human
acagcuucauuuccugu

SEQ ID NO: 3018330 - RNA, 19 nt, Human
acagcuucauuuccugugu

SEQ ID NO: 3018331 - RNA, 21 nt, Human
acagcuucauuuccugugucu

SEQ ID NO: 3018332 - RNA, 15 nt, Human
acagcuaaugggaca

SEQ ID NO: 3018333 - RNA, 16 nt, Human
acagcuaaugggacac

SEQ ID NO: 3018334 - RNA, 17 nt, Human
acagcuaaugggacacu

SEQ ID NO: 3018335 - RNA, 19 nt, Human
acagcuaaugggacacuaa

SEQ ID NO: 3018336 - RNA, 15 nt, Human
acagcccgggcucug

SEQ ID NO: 3018337 - RNA, 16 nt, Human
acagcccgggcucugc

SEQ ID NO: 3018338 - RNA, 21 nt, Human
uaugaggcauuuguuugaacu

SEQ ID NO: 3018339 - RNA, 14 nt, Human
uaugaggcauuugu

SEQ ID NO: 3018340 - RNA, 15 nt, Human
uaugaggcauuuguu

SEQ ID NO: 3018341 - RNA, 16 nt, Human
uaugggacucaaugca

SEQ ID NO: 3018342 - RNA, 23 nt, Human
uaugggacucaaugcacugacau

SEQ ID NO: 3018343 - RNA, 20 nt, Human
uauggcccuggccuagcaua

SEQ ID NO: 3018344 - RNA, 23 nt, Human
uauggcuuuugugcauuaucuag

SEQ ID NO: 3018345 - RNA, 21 nt, Human
uauggcccuggccuagcauac

SEQ ID NO: 3018346 - RNA, 22 nt, Human
uaugcaugaaguaauaugcaca

SEQ ID NO: 3018347 - RNA, 16 nt, Human
acacucauucauuacu

SEQ ID NO: 3018348 - RNA, 20 nt, Human
acacuguuucaaacuuuacu

SEQ ID NO: 3018349 - RNA, 16 nt, Human
acacuuacacuuuaug

SEQ ID NO: 3018350 - RNA, 17 nt, Human
acacucauugaccugag

SEQ ID NO: 3018351 - RNA, 16 nt, Human
acacuguuucaaacuu

SEQ ID NO: 3018352 - RNA, 17 nt, Human
acacuguuucaaacuuu

SEQ ID NO: 3018353 - RNA, 18 nt, Human
acacuguuucaaacuuua

SEQ ID NO: 3018354 - RNA, 18 nt, Human
acacuuacacuuuaugca

SEQ ID NO: 3018355 - RNA, 21 nt, Human
acacuuacacuuuaugcacaa

SEQ ID NO: 3018356 - RNA, 18 nt, Human
acagacauacuaaccagc

SEQ ID NO: 3018357 - RNA, 19 nt, Human
acagacauacuaaccagca

SEQ ID NO: 3018358 - RNA, 14 nt, Human
uauccaaucuguga

SEQ ID NO: 3018359 - RNA, 19 nt, Human
uauccaacaucaacaucuu

SEQ ID NO: 3018360 - RNA, 23 nt, Human
uauccaauugcugcuuguacacu

SEQ ID NO: 3018361 - RNA, 15 nt, Human
uauccaauugcugcu

SEQ ID NO: 3018362 - RNA, 10 nt, Human
uaucagaauu

SEQ ID NO: 3018363 - RNA, 17 nt, Human
uaucagaauucucagaa

SEQ ID NO: 3018364 - RNA, 19 nt, Human
uaucacccagaagaaaaua

SEQ ID NO: 3018365 - RNA, 22 nt, Human
uaucacccagaagaaaauagug

SEQ ID NO: 3018366 - RNA, 18 nt, Human
uauauagcaagacauuau

SEQ ID NO: 3018367 - RNA, 16 nt, Human
uauauagcaguaaaaa

SEQ ID NO: 3018368 - RNA, 20 nt, Human
uauauagcaagacauuauau

SEQ ID NO: 3018369 - RNA, 15 nt, Human
uauauagcaguaaaa

SEQ ID NO: 3018370 - RNA, 23 nt, Human
uauaggaacuuaaauaaugugaa

SEQ ID NO: 3018371 - RNA, 18 nt, Human
uauagcaguaaaaaaugg

SEQ ID NO: 3018372 - RNA, 20 nt, Human
uauagauguugcuaacagca

SEQ ID NO: 3018373 - RNA, 15 nt, Human
uauagauguugcuaa

SEQ ID NO: 3018374 - RNA, 21 nt, Human
uauagauguugcuaacagcaa

SEQ ID NO: 3018375 - RNA, 10 nt, Human
uauagauguu

SEQ ID NO: 3018376 - RNA, 18 nt, Human
uauagccuaggugacaga

SEQ ID NO: 3018377 - RNA, 23 nt, Human
uauauagcaguaaaaaauggugu

SEQ ID NO: 3018378 - RNA, 16 nt, Human
acacucauugaccuga

SEQ ID NO: 3018379 - RNA, 18 nt, Human
uauaauuuaccugaaguc

SEQ ID NO: 3018380 - RNA, 21 nt, Human
uauacacuuacacuuuaugca

SEQ ID NO: 3018381 - RNA, 22 nt, Human
uauacacuuacacuuuaugcac

SEQ ID NO: 3018382 - RNA, 20 nt, Human
uagucacugagacagcccgg

SEQ ID NO: 3018383 - RNA, 17 nt, Human
uagucacugagacagcc

SEQ ID NO: 3018384 - RNA, 21 nt, Human
acacucaaaagcugggcaggu

SEQ ID NO: 3018385 - RNA, 22 nt, Human
acacuaaugaggaaacugcacu

SEQ ID NO: 3018386 - RNA, 15 nt, Human
acacuaaugaggaaa

SEQ ID NO: 3018387 - RNA, 17 nt, Human
uacauuagguugugaau

SEQ ID NO: 3018388 - RNA, 16 nt, Human
uacauuagguugugaa

SEQ ID NO: 3018389 - RNA, 12 nt, Human
uaccagcagagc

SEQ ID NO: 3018390 - RNA, 14 nt, Human
uaccagcagagcac

SEQ ID NO: 3018391 - RNA, 13 nt, Human
uaccagcagagca

SEQ ID NO: 3018392 - RNA, 22 nt, Human
uaccagcagagcaccuuagaca

SEQ ID NO: 3018393 - RNA, 18 nt, Human
uaccagccaguaaauggg

SEQ ID NO: 3018394 - RNA, 22 nt, Human
aauguucacugguacucugcca

SEQ ID NO: 3018395 - RNA, 21 nt, Human
aaugugcugaaugguuuucaa

SEQ ID NO: 3018396 - RNA, 12 nt, Human
aauuaacuuuua

SEQ ID NO: 3018397 - RNA, 13 nt, Human
aauuaacuuuuau

SEQ ID NO: 3018398 - RNA, 15 nt, Human
aauuaacuuuuauaa

SEQ ID NO: 3018399 - RNA, 16 nt, Human
aauuaaguacuaugua

SEQ ID NO: 3018400 - RNA, 17 nt, Human
aauuaaguacuauguau

SEQ ID NO: 3018401 - RNA, 16 nt, Human
uaccugccaggaagcc

SEQ ID NO: 3018402 - RNA, 16 nt, Human
uaccugaggggccucu

SEQ ID NO: 3018403 - RNA, 20 nt, Human
aauuacaggaaguacuggag

SEQ ID NO: 3018404 - RNA, 19 nt, Human
aauuacaggaaguacugga

SEQ ID NO: 3018405 - RNA, 17 nt, Human
aauuacaggaaguacug

SEQ ID NO: 3018406 - RNA, 23 nt, Human
uacccgggaagggggcugggaca

SEQ ID NO: 3018407 - RNA, 21 nt, Human
uaccucuugagccuugaacuu

SEQ ID NO: 3018408 - RNA, 22 nt, Human
uaccucuugagccuugaacuuu

SEQ ID NO: 3018409 - RNA, 23 nt, Human
uaccucuugagccuugaacuuug

SEQ ID NO: 3018410 - RNA, 16 nt, Human
uaccugaagucuuugu

SEQ ID NO: 3018411 - RNA, 15 nt, Human
uaccugaggggccuc

SEQ ID NO: 3018412 - RNA, 13 nt, Human
uaccugaggggcc

SEQ ID NO: 3018413 - RNA, 14 nt, Human
uaccugaagucuuu

SEQ ID NO: 3018414 - RNA, 13 nt, Human
uaccugaagucuu

SEQ ID NO: 3018415 - RNA, 22 nt, Human
aauucaguuguuagugugucuu

SEQ ID NO: 3018416 - RNA, 17 nt, Human
aauucaguuguuagugu

SEQ ID NO: 3018417 - RNA, 11 nt, Human
aauucaguugu

SEQ ID NO: 3018418 - RNA, 22 nt, Human
aauuauuuauuaaaugcccagc

SEQ ID NO: 3018419 - RNA, 21 nt, Human
aauuauuuauuaaaugcccag

SEQ ID NO: 3018420 - RNA, 20 nt, Human
aaugcuugcugcugauuuaa

SEQ ID NO: 3018421 - RNA, 18 nt, Human
aaugcuugcugcugauuu

SEQ ID NO: 3018422 - RNA, 23 nt, Human
aaugcuugcugcugauuuaaaca

SEQ ID NO: 3018423 - RNA, 22 nt, Human
aaugcuugcugcugauuuaaac

SEQ ID NO: 3018424 - RNA, 13 nt, Human
aauggaagacagc

SEQ ID NO: 3018425 - RNA, 21 nt, Human
aaugcuggcuguuggcugggg

SEQ ID NO: 3018426 - RNA, 22 nt, Human
aaugcuggcuguuggcuggggg

SEQ ID NO: 3018427 - RNA, 13 nt, Human
uacaaugcugugc

SEQ ID NO: 3018428 - RNA, 14 nt, Human
uacaaugcugugcc

SEQ ID NO: 3018429 - RNA, 16 nt, Human
uacaaugcugugcccu

SEQ ID NO: 3018430 - RNA, 18 nt, Human
uaauuuuuuugagacaga

SEQ ID NO: 3018431 - RNA, 13 nt, Human
uacagacaaagcg

SEQ ID NO: 3018432 - RNA, 15 nt, Human
uacagacaaagcgug

SEQ ID NO: 3018433 - RNA, 14 nt, Human
uacagacaaagcgu

SEQ ID NO: 3018434 - RNA, 22 nt, Human
uacagagcccacgcccccacug

SEQ ID NO: 3018435 - RNA, 19 nt, Human
uacagagcccacgccccca

SEQ ID NO: 3018436 - RNA, 23 nt, Human
uacagagcagacaguuaagagaa

SEQ ID NO: 3018437 - RNA, 14 nt, Human
aaugguuuucaaaa

SEQ ID NO: 3018438 - RNA, 16 nt, Human
aauggaagacagcucu

SEQ ID NO: 3018439 - RNA, 16 nt, Human
aaugguuuucuugugu

SEQ ID NO: 3018440 - RNA, 16 nt, Human
aaugguuuucaaaaua

SEQ ID NO: 3018441 - RNA, 20 nt, Human
aaugaccuuucaauaggaaa

SEQ ID NO: 3018442 - RNA, 21 nt, Human
aaugaccuuucaauaggaaaa

SEQ ID NO: 3018443 - RNA, 11 nt, Human
aaugagccugg

SEQ ID NO: 3018444 - RNA, 13 nt, Human
aaugagccuggca

SEQ ID NO: 3018445 - RNA, 12 nt, Human
aaugagccuggc

SEQ ID NO: 3018446 - RNA, 16 nt, Human
aaugaggucagagccu

SEQ ID NO: 3018447 - RNA, 18 nt, Human
aaugaggucagagccugc

SEQ ID NO: 3018448 - RNA, 13 nt, Human
aaugcaccuggaa

SEQ ID NO: 3018449 - RNA, 21 nt, Human
uaauuaugguuaguagaggua

SEQ ID NO: 3018450 - RNA, 12 nt, Human
aaugcaaaccau

SEQ ID NO: 3018451 - RNA, 11 nt, Human
aaugcaaacca

SEQ ID NO: 3018452 - RNA, 23 nt, Human
aauauuuugacuuguugagggua

SEQ ID NO: 3018453 - RNA, 19 nt, Human
aaucagccugcuccagcug

SEQ ID NO: 3018454 - RNA, 18 nt, Human
aaucagccugcuccagcu

SEQ ID NO: 3018455 - RNA, 13 nt, Human
aaucagccugcuc

SEQ ID NO: 3018456 - RNA, 11 nt, Human
aaucagccugc

SEQ ID NO: 3018457 - RNA, 18 nt, Human
uaaggaauaccugucccc

SEQ ID NO: 3018458 - RNA, 17 nt, Human
uaaggaauaccuguccc

SEQ ID NO: 3018459 - RNA, 9 nt, Human
uaaggaaua

SEQ ID NO: 3018460 - RNA, 13 nt, Human
uaaggaagacaau

SEQ ID NO: 3018461 - RNA, 14 nt, Human
uaagcuauucagua

SEQ ID NO: 3018462 - RNA, 21 nt, Human
uaagcuauucaguaauaacuc

SEQ ID NO: 3018463 - RNA, 14 nt, Human
uaagauucauauuu

SEQ ID NO: 3018464 - RNA, 14 nt, Human
uaauaaaaagguga

SEQ ID NO: 3018465 - RNA, 15 nt, Human
uaauaaaaaggugac

SEQ ID NO: 3018466 - RNA, 12 nt, Human
uaauaaaaaggu

SEQ ID NO: 3018467 - RNA, 21 nt, Human
uaaguauucuuauuuaaugaa

SEQ ID NO: 3018468 - RNA, 17 nt, Human
aaucccauuuaaaaaaa

SEQ ID NO: 3018469 - RNA, 16 nt, Human
uaacuaucacugguuu

SEQ ID NO: 3018470 - RNA, 21 nt, Human
uaacuaucacugguuugguuc

SEQ ID NO: 3018471 - RNA, 20 nt, Human
uaacuugucuuuggacccug

SEQ ID NO: 3018472 - RNA, 16 nt, Human
uaacuugucuuuggac

SEQ ID NO: 3018473 - RNA, 19 nt, Human
uaacauguaauuaaguacu

SEQ ID NO: 3018474 - RNA, 17 nt, Human
uaacauguaauuaagua

SEQ ID NO: 3018475 - RNA, 18 nt, Human
uaacaaaggauacuuauu

SEQ ID NO: 3018476 - RNA, 17 nt, Human
uaacaaaggauacuuau

SEQ ID NO: 3018477 - RNA, 16 nt, Human
uaacaaaggauacuua

SEQ ID NO: 3018478 - RNA, 15 nt, Human
uaacaaaggauacuu

SEQ ID NO: 3018479 - RNA, 21 nt, Human
uaaauuaacuuuuauaaacuu

SEQ ID NO: 3018480 - RNA, 20 nt, Human
uaacaaaggauacuuauuua

SEQ ID NO: 3018481 - RNA, 19 nt, Human
uaacaaaggauacuuauuu

SEQ ID NO: 3018482 - RNA, 21 nt, Human
uaacaaaggauacuuauuuaa

SEQ ID NO: 3018483 - RNA, 21 nt, Human
aauacaccacuacauucuguu

SEQ ID NO: 3018484 - RNA, 13 nt, Human
aauacagaggcaa

SEQ ID NO: 3018485 - RNA, 18 nt, Human
uaaaugaaaaucgugaca

SEQ ID NO: 3018486 - RNA, 18 nt, Human
aaguguauuuuuuuacua

SEQ ID NO: 3018487 - RNA, 21 nt, Human
aaguguauuuuuuuacuaaua

SEQ ID NO: 3018488 - RNA, 18 nt, Human
uaaauuaacuuuuauaaa

SEQ ID NO: 3018489 - RNA, 19 nt, Human
uaaauuaacuuuuauaaac

SEQ ID NO: 3018490 - RNA, 20 nt, Human
uaaauuaacuuuuauaaacu

SEQ ID NO: 3018491 - RNA, 21 nt, Human
aauagcaaggcugugcaucua

SEQ ID NO: 3018492 - RNA, 22 nt, Human
aauagcagcccucaauugugaa

SEQ ID NO: 3018493 - RNA, 23 nt, Human
aauagcagcccucaauugugaaa

SEQ ID NO: 3018494 - RNA, 20 nt, Human
aauagccugccucuucucua

SEQ ID NO: 3018495 - RNA, 19 nt, Human
aauaccugucccccugaca

SEQ ID NO: 3018496 - RNA, 18 nt, Human
aauaccugucccccugac

SEQ ID NO: 3018497 - RNA, 15 nt, Human
aauaccugucccccu

SEQ ID NO: 3018498 - RNA, 17 nt, Human
aauaccagccaguaaau

SEQ ID NO: 3018499 - RNA, 19 nt, Human
aauaccagccaguaaaugg

SEQ ID NO: 3018500 - RNA, 12 nt, Human
aauaccaaggaa

SEQ ID NO: 3018501 - RNA, 13 nt, Human
gugucauuucaaa

SEQ ID NO: 3018502 - RNA, 20 nt, Human
gugucagguggggcagcuug

SEQ ID NO: 3018503 - RNA, 22 nt, Human
gugugacaaggauugcuacugu

SEQ ID NO: 3018504 - RNA, 16 nt, Human
gugugguagagugugc

SEQ ID NO: 3018505 - RNA, 16 nt, Human
gugucagcauagaagu

SEQ ID NO: 3018506 - RNA, 20 nt, Human
gugucaagagggucugagga

SEQ ID NO: 3018507 - RNA, 17 nt, Human
guguauuuuuuuacuaa

SEQ ID NO: 3018508 - RNA, 23 nt, Human
guguauuuuuuuacuaauagaca

SEQ ID NO: 3018509 - RNA, 18 nt, Human
aagaugaaggucuguuuu

SEQ ID NO: 3018510 - RNA, 16 nt, Human
aagaugcuucucacug

SEQ ID NO: 3018511 - RNA, 17 nt, Human
aagaugcuucucacugc

SEQ ID NO: 3018512 - RNA, 19 nt, Human
aagaugcuucucacugcca

SEQ ID NO: 3018513 - RNA, 13 nt, Human
aagaguaggaaga

SEQ ID NO: 3018514 - RNA, 22 nt, Human
guggggucacucuggcagcuca

SEQ ID NO: 3018515 - RNA, 21 nt, Human
guggggucacucuggcagcuc

SEQ ID NO: 3018516 - RNA, 20 nt, Human
guggggucacucuggcagcu

SEQ ID NO: 3018517 - RNA, 17 nt, Human
guggggucacucuggca

SEQ ID NO: 3018518 - RNA, 12 nt, Human
aagaguaggaag

SEQ ID NO: 3018519 - RNA, 23 nt, Human
aagagggagggagggcuccagac

SEQ ID NO: 3018520 - RNA, 15 nt, Human
gugggagcugccugu

SEQ ID NO: 3018521 - RNA, 18 nt, Human
gugggagcugccuguuca

SEQ ID NO: 3018522 - RNA, 15 nt, Human
guggggucacucugg

SEQ ID NO: 3018523 - RNA, 14 nt, Human
gugggagcugccug

SEQ ID NO: 3018524 - RNA, 15 nt, Human
gugggacacccugug

SEQ ID NO: 3018525 - RNA, 13 nt, Human
gugggacacccug

SEQ ID NO: 3018526 - RNA, 22 nt, Human
guggccucccaacucaccccag

SEQ ID NO: 3018527 - RNA, 21 nt, Human
guggccucccaacucacccca

SEQ ID NO: 3018528 - RNA, 13 nt, Human
aagacgcugugcu

SEQ ID NO: 3018529 - RNA, 19 nt, Human
aagacgcugugcugcccug

SEQ ID NO: 3018530 - RNA, 18 nt, Human
aagacgcugugcugcccu

SEQ ID NO: 3018531 - RNA, 17 nt, Human
aagacgcugugcugccc

SEQ ID NO: 3018532 - RNA, 15 nt, Human
aagacgcugugcugc

SEQ ID NO: 3018533 - RNA, 19 nt, Human
aagaccuucuccuucaccu

SEQ ID NO: 3018534 - RNA, 18 nt, Human
aagaccuucuccuucacc

SEQ ID NO: 3018535 - RNA, 15 nt, Human
aagaccuucuccuuc

SEQ ID NO: 3018536 - RNA, 16 nt, Human
aagacuuuggaaagac

SEQ ID NO: 3018537 - RNA, 23 nt, Human
aagacugaguacguugugcauuu

SEQ ID NO: 3018538 - RNA, 22 nt, Human
aagacugaguacguugugcauu

SEQ ID NO: 3018539 - RNA, 18 nt, Human
guuauugaagcagagugg

SEQ ID NO: 3018540 - RNA, 17 nt, Human
guuauugaagcagagug

SEQ ID NO: 3018541 - RNA, 16 nt, Human
guuauugaagcagagu

SEQ ID NO: 3018542 - RNA, 23 nt, Human
guuauuuuuauuuauuuaaauuu

SEQ ID NO: 3018543 - RNA, 18 nt, Human
guucaagcgauucuucug

SEQ ID NO: 3018544 - RNA, 20 nt, Human
guucaaagauauuuugcuuu

SEQ ID NO: 3018545 - RNA, 21 nt, Human
guucaaagauauuuugcuuug

SEQ ID NO: 3018546 - RNA, 22 nt, Human
guucaaagauauuuugcuuugu

SEQ ID NO: 3018547 - RNA, 18 nt, Human
guuaagagaaaugagcuu

SEQ ID NO: 3018548 - RNA, 12 nt, Human
guuaagagaaau

SEQ ID NO: 3018549 - RNA, 11 nt, Human
guuaagagaaa

SEQ ID NO: 3018550 - RNA, 20 nt, Human
guuaggcauugugggaaggg

SEQ ID NO: 3018551 - RNA, 19 nt, Human
guuaggcauugugggaagg

SEQ ID NO: 3018552 - RNA, 13 nt, Human
guucagcuccagc

SEQ ID NO: 3018553 - RNA, 20 nt, Human
aagccugaguuugcuuucaa

SEQ ID NO: 3018554 - RNA, 22 nt, Human
aagcuagacgagcaggcuucuu

SEQ ID NO: 3018555 - RNA, 12 nt, Human
aagcuaggccug

SEQ ID NO: 3018556 - RNA, 17 nt, Human
aagcucagggccuggcu

SEQ ID NO: 3018557 - RNA, 16 nt, Human
aagcucagggccuggc

SEQ ID NO: 3018558 - RNA, 13 nt, Human
aagcucagggccu

SEQ ID NO: 3018559 - RNA, 12 nt, Human
aagcucagggcc

SEQ ID NO: 3018560 - RNA, 20 nt, Human
aagcucagggccuggcucag

SEQ ID NO: 3018561 - RNA, 19 nt, Human
aagcucagggccuggcuca

SEQ ID NO: 3018562 - RNA, 18 nt, Human
aagcucagggccuggcuc

SEQ ID NO: 3018563 - RNA, 18 nt, Human
aagcuccaagcucccagg

SEQ ID NO: 3018564 - RNA, 17 nt, Human
aagcuccaagcucccag

SEQ ID NO: 3018565 - RNA, 16 nt, Human
aagcauuuacuuugug

SEQ ID NO: 3018566 - RNA, 12 nt, Human
aagcagugcaug

SEQ ID NO: 3018567 - RNA, 21 nt, Human
gugugugcgccuacaggagug

SEQ ID NO: 3018568 - RNA, 15 nt, Human
aagcagugcaugcug

SEQ ID NO: 3018569 - RNA, 14 nt, Human
aagcagugcaugcu

SEQ ID NO: 3018570 - RNA, 20 nt, Human
aagcagugcaugcugucccu

SEQ ID NO: 3018571 - RNA, 20 nt, Human
aagccaaagcuaggccuggc

SEQ ID NO: 3018572 - RNA, 22 nt, Human
aagccaaagcuaggccuggcca

SEQ ID NO: 3018573 - RNA, 17 nt, Human
aagcccaggaaaggcuc

SEQ ID NO: 3018574 - RNA, 14 nt, Human
aagcccaggaaagg

SEQ ID NO: 3018575 - RNA, 22 nt, Human
aagcccaggaaaggcuccagga

SEQ ID NO: 3018576 - RNA, 19 nt, Human
aagcccaggaaaggcucca

SEQ ID NO: 3018577 - RNA, 19 nt, Human
aagcccugagcuuucugcu

SEQ ID NO: 3018578 - RNA, 20 nt, Human
aagccgcuggggccaguugg

SEQ ID NO: 3018579 - RNA, 13 nt, Human
aagucuucuauuu

SEQ ID NO: 3018580 - RNA, 17 nt, Human
aagucuucuauuuauuu

SEQ ID NO: 3018581 - RNA, 14 nt, Human
aagugagagcuggg

SEQ ID NO: 3018582 - RNA, 12 nt, Human
aagugagagagg

SEQ ID NO: 3018583 - RNA, 21 nt, Human
aagugaaaaaggaggaagaga

SEQ ID NO: 3018584 - RNA, 17 nt, Human
aagugaagacaaugacu

SEQ ID NO: 3018585 - RNA, 19 nt, Human
aagugaagacaaugacuua

SEQ ID NO: 3018586 - RNA, 14 nt, Human
guuucugccgcagc

SEQ ID NO: 3018587 - RNA, 15 nt, Human
guuucugccgcagcc

SEQ ID NO: 3018588 - RNA, 16 nt, Human
guuuugccauguuggc

SEQ ID NO: 3018589 - RNA, 20 nt, Human
guuuugccauguuggccagg

SEQ ID NO: 3018590 - RNA, 21 nt, Human
guuuugccauguuggccaggc

SEQ ID NO: 3018591 - RNA, 22 nt, Human
guuuugccauguuggccaggcu

SEQ ID NO: 3018592 - RNA, 13 nt, Human
aaguacacuguuu

SEQ ID NO: 3018593 - RNA, 18 nt, Human
aaguacacuguuucaaac

SEQ ID NO: 3018594 - RNA, 23 nt, Human
aaguacacuguuucaaacuuuac

SEQ ID NO: 3018595 - RNA, 19 nt, Human
aaguacacuguuucaaacu

SEQ ID NO: 3018596 - RNA, 20 nt, Human
aaguacacuguuucaaacuu

SEQ ID NO: 3018597 - RNA, 15 nt, Human
aagugagagcugggu

SEQ ID NO: 3018598 - RNA, 16 nt, Human
aagugaggaugaaaaa

SEQ ID NO: 3018599 - RNA, 19 nt, Human
aagugauucuccugccuca

SEQ ID NO: 3018600 - RNA, 15 nt, Human
aagugauucuccugc

SEQ ID NO: 3018601 - RNA, 16 nt, Human
aagugauucuccugcc

SEQ ID NO: 3018602 - RNA, 17 nt, Human
aagugauucuccugccu

SEQ ID NO: 3018603 - RNA, 18 nt, Human
aagugauucuccugccuc

SEQ ID NO: 3018604 - RNA, 21 nt, Human
uaaaauaccagccaguaaaug

SEQ ID NO: 3018605 - RNA, 22 nt, Human
uaaaauaccagccaguaaaugg

SEQ ID NO: 3018606 - RNA, 15 nt, Human
uaaaaaucucaaauu

SEQ ID NO: 3018607 - RNA, 16 nt, Human
uaaaaaucucaaauuu

SEQ ID NO: 3018608 - RNA, 17 nt, Human
uaaaaaucucaaauuuc

SEQ ID NO: 3018609 - RNA, 15 nt, Human
guuuuucuucucccu

SEQ ID NO: 3018610 - RNA, 15 nt, Human
uaaaaaguggaaaaa

SEQ ID NO: 3018611 - RNA, 19 nt, Human
uaaaaaucucaaauuucua

SEQ ID NO: 3018612 - RNA, 20 nt, Human
uaaaaaucucaaauuucuaa

SEQ ID NO: 3018613 - RNA, 21 nt, Human
uaaaaaucucaaauuucuaaa

SEQ ID NO: 3018614 - RNA, 20 nt, Human
uaaaacuugauguguuaucu

SEQ ID NO: 3018615 - RNA, 22 nt, Human
uaaaacuugauguguuaucucu

SEQ ID NO: 3018616 - RNA, 23 nt, Human
guugcccaggcaggucuugaacu

SEQ ID NO: 3018617 - RNA, 12 nt, Human
guugcccaggcu

SEQ ID NO: 3018618 - RNA, 13 nt, Human
guugcccaggcug

SEQ ID NO: 3018619 - RNA, 19 nt, Human
guugcccaggcaggucuug

SEQ ID NO: 3018620 - RNA, 13 nt, Human
aaggauacuuauu

SEQ ID NO: 3018621 - RNA, 16 nt, Human
aaggauacuuauuuaa

SEQ ID NO: 3018622 - RNA, 13 nt, Human
aaggauacaaaag

SEQ ID NO: 3018623 - RNA, 21 nt, Human
aaggauacaaaagcaugugag

SEQ ID NO: 3018624 - RNA, 20 nt, Human
aaggaggggauagagagaga

SEQ ID NO: 3018625 - RNA, 18 nt, Human
aaggaggaagagaaaaaa

SEQ ID NO: 3018626 - RNA, 18 nt, Human
aaggaauaccuguccccc

SEQ ID NO: 3018627 - RNA, 11 nt, Human
aaggagagcua

SEQ ID NO: 3018628 - RNA, 14 nt, Human
aaggagauuuacaa

SEQ ID NO: 3018629 - RNA, 15 nt, Human
aaggaaagagggagg

SEQ ID NO: 3018630 - RNA, 16 nt, Human
aaggaagcacaugccu

SEQ ID NO: 3018631 - RNA, 17 nt, Human
aaggaauaccugucccc

SEQ ID NO: 3018632 - RNA, 14 nt, Human
aaggaagacuucau

SEQ ID NO: 3018633 - RNA, 13 nt, Human
aaggaagcacaug

SEQ ID NO: 3018634 - RNA, 15 nt, Human
aaggaagacuucauc

SEQ ID NO: 3018635 - RNA, 12 nt, Human
guuuaaugguag

SEQ ID NO: 3018636 - RNA, 17 nt, Human
guuuaaugguaguuuua

SEQ ID NO: 3018637 - RNA, 13 nt, Human
guuuauugucaaa

SEQ ID NO: 3018638 - RNA, 13 nt, Human
guugggcuggugu

SEQ ID NO: 3018639 - RNA, 17 nt, Human
guugggccaggagccuc

SEQ ID NO: 3018640 - RNA, 15 nt, Human
guugggccaggagcc

SEQ ID NO: 3018641 - RNA, 22 nt, Human
guuuauuuggaaaggaaugcaa

SEQ ID NO: 3018642 - RNA, 13 nt, Human
guuucaaacuuua

SEQ ID NO: 3018643 - RNA, 14 nt, Human
guuucaaacuuuac

SEQ ID NO: 3018644 - RNA, 16 nt, Human
guuucaaacuuuacua

SEQ ID NO: 3018645 - RNA, 15 nt, Human
aaggcuccaggagca

SEQ ID NO: 3018646 - RNA, 18 nt, Human
aaggcuccaggagcagcc

SEQ ID NO: 3018647 - RNA, 16 nt, Human
aaggcuccaggagcag

SEQ ID NO: 3018648 - RNA, 22 nt, Human
aaggcucgagcaugccuggaug

SEQ ID NO: 3018649 - RNA, 20 nt, Human
aaggcucgagcaugccugga

SEQ ID NO: 3018650 - RNA, 19 nt, Human
aaggcucgagcaugccugg

SEQ ID NO: 3018651 - RNA, 18 nt, Human
aaggcucgagcaugccug

SEQ ID NO: 3018652 - RNA, 16 nt, Human
aaggcucgagcaugcc

SEQ ID NO: 3018653 - RNA, 22 nt, Human
aaggcuccaggagcagccacau

SEQ ID NO: 3018654 - RNA, 19 nt, Human
aaggcuccaggagcagcca

SEQ ID NO: 3018655 - RNA, 19 nt, Human
guuucuauguguagggcgg

SEQ ID NO: 3018656 - RNA, 18 nt, Human
guuucugaaagggacgcu

SEQ ID NO: 3018657 - RNA, 12 nt, Human
aaggucauuuuu

SEQ ID NO: 3018658 - RNA, 22 nt, Human
guuucuaugacacaugcaaggu

SEQ ID NO: 3018659 - RNA, 22 nt, Human
aaggggcccaaauucuuucagu

SEQ ID NO: 3018660 - RNA, 17 nt, Human
aaggggcaguggugguu

SEQ ID NO: 3018661 - RNA, 20 nt, Human
aagguagaaauaucugaaaa

SEQ ID NO: 3018662 - RNA, 18 nt, Human
aaaugguguuuuaucuuc

SEQ ID NO: 3018663 - RNA, 17 nt, Human
aaaugguguuuuaucuu

SEQ ID NO: 3018664 - RNA, 20 nt, Human
guaacaggaaaauuuuaaaa

SEQ ID NO: 3018665 - RNA, 19 nt, Human
aaaugggggugcauuugag

SEQ ID NO: 3018666 - RNA, 12 nt, Human
guaacaggcaga

SEQ ID NO: 3018667 - RNA, 22 nt, Human
guaacaggaaaauuuuaaaaau

SEQ ID NO: 3018668 - RNA, 19 nt, Human
guaucccaugagccucagc

SEQ ID NO: 3018669 - RNA, 22 nt, Human
guaucaggugcugccauccagg

SEQ ID NO: 3018670 - RNA, 15 nt, Human
guaugguggcugggu

SEQ ID NO: 3018671 - RNA, 16 nt, Human
guaugguggcuggguu

SEQ ID NO: 3018672 - RNA, 14 nt, Human
guaugguggcuggg

SEQ ID NO: 3018673 - RNA, 13 nt, Human
guaugguggcugg

SEQ ID NO: 3018674 - RNA, 16 nt, Human
guaucaggugcugcca

SEQ ID NO: 3018675 - RNA, 18 nt, Human
guaucaggugcugccauc

SEQ ID NO: 3018676 - RNA, 19 nt, Human
aaaugucuaguuguaacac

SEQ ID NO: 3018677 - RNA, 22 nt, Human
guauuuuguuuuugucuuaaaa

SEQ ID NO: 3018678 - RNA, 12 nt, Human
aaauuuguggaa

SEQ ID NO: 3018679 - RNA, 18 nt, Human
aaauuuguuauaaugaau

SEQ ID NO: 3018680 - RNA, 16 nt, Human
gucaguuguuauuuau

SEQ ID NO: 3018681 - RNA, 15 nt, Human
gucagugugacugau

SEQ ID NO: 3018682 - RNA, 17 nt, Human
gucaguuguuauuuauu

SEQ ID NO: 3018683 - RNA, 18 nt, Human
gucaguuguuauuuauug

SEQ ID NO: 3018684 - RNA, 21 nt, Human
gucaguuguuauuuauugaaa

SEQ ID NO: 3018685 - RNA, 22 nt, Human
gucacacaguauuacuucugcu

SEQ ID NO: 3018686 - RNA, 21 nt, Human
gucacacaguauuacuucugc

SEQ ID NO: 3018687 - RNA, 23 nt, Human
gucagaaguuucugccgcagccc

SEQ ID NO: 3018688 - RNA, 21 nt, Human
aacacaaagcuuuugcauauu

SEQ ID NO: 3018689 - RNA, 21 nt, Human
aacaaggcaaggcugucaauu

SEQ ID NO: 3018690 - RNA, 18 nt, Human
aacaaggcaaggcuguca

SEQ ID NO: 3018691 - RNA, 18 nt, Human
aaauuuugauguuuuaag

SEQ ID NO: 3018692 - RNA, 23 nt, Human
aaauuuugauguuuuaaggaugc

SEQ ID NO: 3018693 - RNA, 20 nt, Human
aacaagaccacguuucuaaa

SEQ ID NO: 3018694 - RNA, 16 nt, Human
aacaaggcaaggcugu

SEQ ID NO: 3018695 - RNA, 15 nt, Human
aacaaggcaaggcug

SEQ ID NO: 3018696 - RNA, 18 nt, Human
gucccccugacaacacuc

SEQ ID NO: 3018697 - RNA, 14 nt, Human
gucccccuuccaug

SEQ ID NO: 3018698 - RNA, 18 nt, Human
gucccccuuccauggacu

SEQ ID NO: 3018699 - RNA, 16 nt, Human
gucccccuuccaugga

SEQ ID NO: 3018700 - RNA, 16 nt, Human
guccuacccacccucc

SEQ ID NO: 3018701 - RNA, 15 nt, Human
guccuacccacccuc

SEQ ID NO: 3018702 - RNA, 12 nt, Human
guccuacucugu

SEQ ID NO: 3018703 - RNA, 14 nt, Human
aacagaaauguaca

SEQ ID NO: 3018704 - RNA, 12 nt, Human
aacagaaaugua

SEQ ID NO: 3018705 - RNA, 13 nt, Human
aacagaaauguac

SEQ ID NO: 3018706 - RNA, 11 nt, Human
aacagaaaugu

SEQ ID NO: 3018707 - RNA, 18 nt, Human
aacaggcuuagugaugua

SEQ ID NO: 3018708 - RNA, 14 nt, Human
guccauagagagca

SEQ ID NO: 3018709 - RNA, 13 nt, Human
guccauagagagc

SEQ ID NO: 3018710 - RNA, 21 nt, Human
gucccaccccacacacgccag

SEQ ID NO: 3018711 - RNA, 20 nt, Human
gucccaccccacacacgcca

SEQ ID NO: 3018712 - RNA, 14 nt, Human
gucccaccuuggcu

SEQ ID NO: 3018713 - RNA, 15 nt, Human
gucccaccuuggcug

SEQ ID NO: 3018714 - RNA, 16 nt, Human
gucccaccuuggcugc

SEQ ID NO: 3018715 - RNA, 13 nt, Human
guccaagaagccc

SEQ ID NO: 3018716 - RNA, 16 nt, Human
guccaagaagcccagg

SEQ ID NO: 3018717 - RNA, 15 nt, Human
guccaagaagcccag

SEQ ID NO: 3018718 - RNA, 20 nt, Human
guccaagaagcccaggaaag

SEQ ID NO: 3018719 - RNA, 18 nt, Human
guccaagaagcccaggaa

SEQ ID NO: 3018720 - RNA, 17 nt, Human
guccaagaagcccagga

SEQ ID NO: 3018721 - RNA, 19 nt, Human
gucauuuuuuuuaagaaaa

SEQ ID NO: 3018722 - RNA, 21 nt, Human
gucauuuuuuuuaagaaaaag

SEQ ID NO: 3018723 - RNA, 22 nt, Human
aacucugagugcaaacuucaga

SEQ ID NO: 3018724 - RNA, 20 nt, Human
aacucugagugcaaacuuca

SEQ ID NO: 3018725 - RNA, 21 nt, Human
aacucuucaaucucuugcacu

SEQ ID NO: 3018726 - RNA, 18 nt, Human
aacucugagugcaaacuu

SEQ ID NO: 3018727 - RNA, 19 nt, Human
aacucugagugcaaacuuc

SEQ ID NO: 3018728 - RNA, 15 nt, Human
gugagucgaggacag

SEQ ID NO: 3018729 - RNA, 22 nt, Human
gugagucgaggacagggaggug

SEQ ID NO: 3018730 - RNA, 19 nt, Human
gugaacuugggccacugug

SEQ ID NO: 3018731 - RNA, 17 nt, Human
gugaacuugggccacug

SEQ ID NO: 3018732 - RNA, 22 nt, Human
gugaggccagagacacaagccu

SEQ ID NO: 3018733 - RNA, 17 nt, Human
gugaggccagagacaca

SEQ ID NO: 3018734 - RNA, 20 nt, Human
aacugggaugaggugacuau

SEQ ID NO: 3018735 - RNA, 16 nt, Human
aacuggguacuugugg

SEQ ID NO: 3018736 - RNA, 21 nt, Human
aacuggguacuuguggacaca

SEQ ID NO: 3018737 - RNA, 21 nt, Human
aacugggggagggugaaguga

SEQ ID NO: 3018738 - RNA, 22 nt, Human
aacugggggagggugaagugaa

SEQ ID NO: 3018739 - RNA, 16 nt, Human
aacuggauuaaacuua

SEQ ID NO: 3018740 - RNA, 11 nt, Human
aacuggcugca

SEQ ID NO: 3018741 - RNA, 15 nt, Human
aacuggauuaaacuu

SEQ ID NO: 3018742 - RNA, 23 nt, Human
aacugcugacuguuuucucuuga

SEQ ID NO: 3018743 - RNA, 21 nt, Human
aacugcugacuguuuucucuu

SEQ ID NO: 3018744 - RNA, 20 nt, Human
aacugcugacuguuuucucu

SEQ ID NO: 3018745 - RNA, 15 nt, Human
aacugcugacuguuu

SEQ ID NO: 3018746 - RNA, 16 nt, Human
gugaugagaggaaauc

SEQ ID NO: 3018747 - RNA, 14 nt, Human
gugaugagaggaaa

SEQ ID NO: 3018748 - RNA, 22 nt, Human
gugaugcgcaugucacggaggg

SEQ ID NO: 3018749 - RNA, 18 nt, Human
gugauggggcccugccuc

SEQ ID NO: 3018750 - RNA, 17 nt, Human
gugauggggcccugccu

SEQ ID NO: 3018751 - RNA, 16 nt, Human
gugauggggcccugcc

SEQ ID NO: 3018752 - RNA, 14 nt, Human
gugauggggcccug

SEQ ID NO: 3018753 - RNA, 13 nt, Human
aacuuccaauuua

SEQ ID NO: 3018754 - RNA, 23 nt, Human
gugcauuaucuagauacuguauc

SEQ ID NO: 3018755 - RNA, 19 nt, Human
gugcauguguguucaugca

SEQ ID NO: 3018756 - RNA, 15 nt, Human
gugcauuaucuagau

SEQ ID NO: 3018757 - RNA, 19 nt, Human
gugcauuaucuagauacug

SEQ ID NO: 3018758 - RNA, 19 nt, Human
gugauggggcccugccucc

SEQ ID NO: 3018759 - RNA, 22 nt, Human
gugcaaugaccuuucaauagga

SEQ ID NO: 3018760 - RNA, 21 nt, Human
gugcacacaccagagcccacc

SEQ ID NO: 3018761 - RNA, 22 nt, Human
gugcaugcugucccuuacguga

SEQ ID NO: 3018762 - RNA, 17 nt, Human
gucuucuauuuauuuau

SEQ ID NO: 3018763 - RNA, 12 nt, Human
gucuucuauuua

SEQ ID NO: 3018764 - RNA, 14 nt, Human
gucuucuauuuauu

SEQ ID NO: 3018765 - RNA, 18 nt, Human
gucuuuggacccugaggc

SEQ ID NO: 3018766 - RNA, 14 nt, Human
gucuggcccuuccu

SEQ ID NO: 3018767 - RNA, 12 nt, Human
aacucauuucua

SEQ ID NO: 3018768 - RNA, 12 nt, Human
aacuccuggccu

SEQ ID NO: 3018769 - RNA, 22 nt, Human
gugaaccaccacacccagccca

SEQ ID NO: 3018770 - RNA, 23 nt, Human
gugaaccaccacacccagcccac

SEQ ID NO: 3018771 - RNA, 16 nt, Human
aacucuccucugcugc

SEQ ID NO: 3018772 - RNA, 18 nt, Human
aacucuccuccagaguca

SEQ ID NO: 3018773 - RNA, 15 nt, Human
aacucuccuccagag

SEQ ID NO: 3018774 - RNA, 20 nt, Human
aacuacauuagguugugaau

SEQ ID NO: 3018775 - RNA, 15 nt, Human
aaccaagucaaguga

SEQ ID NO: 3018776 - RNA, 19 nt, Human
aaccaccacacccagccca

SEQ ID NO: 3018777 - RNA, 12 nt, Human
aaccaucauuga

SEQ ID NO: 3018778 - RNA, 21 nt, Human
aaccaccacacccagcccacu

SEQ ID NO: 3018779 - RNA, 18 nt, Human
aaccaucauugaaaucuu

SEQ ID NO: 3018780 - RNA, 17 nt, Human
aaccaucauugaaaucu

SEQ ID NO: 3018781 - RNA, 10 nt, Human
aacccagcuc

SEQ ID NO: 3018782 - RNA, 21 nt, Human
caguaaaaaaugguguuuuau

SEQ ID NO: 3018783 - RNA, 18 nt, Human
caguaaaugggggugcau

SEQ ID NO: 3018784 - RNA, 19 nt, Human
caguauuacuucugcuaca

SEQ ID NO: 3018785 - RNA, 19 nt, Human
caguaaaugggggugcauu

SEQ ID NO: 3018786 - RNA, 14 nt, Human
cagucaccccggcc

SEQ ID NO: 3018787 - RNA, 17 nt, Human
cagucaccccggccacc

SEQ ID NO: 3018788 - RNA, 16 nt, Human
cagucaccccggccac

SEQ ID NO: 3018789 - RNA, 20 nt, Human
caguaaaaaaugguguuuua

SEQ ID NO: 3018790 - RNA, 23 nt, Human
cagguuuuuggucugacccacug

SEQ ID NO: 3018791 - RNA, 13 nt, Human
caggugcugccau

SEQ ID NO: 3018792 - RNA, 14 nt, Human
caggugcugccauc

SEQ ID NO: 3018793 - RNA, 14 nt, Human
caggguuggccccu

SEQ ID NO: 3018794 - RNA, 17 nt, Human
caggguuggccccugcc

SEQ ID NO: 3018795 - RNA, 21 nt, Human
caggguuggccccugcccggc

SEQ ID NO: 3018796 - RNA, 15 nt, Human
caggguuggccccug

SEQ ID NO: 3018797 - RNA, 16 nt, Human
caggguuggccccugc

SEQ ID NO: 3018798 - RNA, 21 nt, Human
cagggucucuaccauccccug

SEQ ID NO: 3018799 - RNA, 22 nt, Human
cagggucucacucugucgccca

SEQ ID NO: 3018800 - RNA, 23 nt, Human
cagggucucacucugucgcccag

SEQ ID NO: 3018801 - RNA, 15 nt, Human
caggcuggcgugcag

SEQ ID NO: 3018802 - RNA, 19 nt, Human
caggcugggagagccuucc

SEQ ID NO: 3018803 - RNA, 18 nt, Human
caggcugggagagccuuc

SEQ ID NO: 3018804 - RNA, 16 nt, Human
caggcugggagagccu

SEQ ID NO: 3018805 - RNA, 17 nt, Human
caggcuggcgugcagug

SEQ ID NO: 3018806 - RNA, 23 nt, Human
caggccugggggcugggcagagg

SEQ ID NO: 3018807 - RNA, 18 nt, Human
caggcuggcgugcagugg

SEQ ID NO: 3018808 - RNA, 19 nt, Human
caggcuggcgugcaguggu

SEQ ID NO: 3018809 - RNA, 22 nt, Human
caggccugggggcugggcagag

SEQ ID NO: 3018810 - RNA, 20 nt, Human
caggccugggggcugggcag

SEQ ID NO: 3018811 - RNA, 12 nt, Human
cagggcucagcg

SEQ ID NO: 3018812 - RNA, 15 nt, Human
cagggcucagcgggg

SEQ ID NO: 3018813 - RNA, 16 nt, Human
cagggagggcuucugc

SEQ ID NO: 3018814 - RNA, 14 nt, Human
caggcugggcuuca

SEQ ID NO: 3018815 - RNA, 23 nt, Human
caggaaaggcuccaggagcagcc

SEQ ID NO: 3018816 - RNA, 22 nt, Human
caggaaaggcuccaggagcagc

SEQ ID NO: 3018817 - RNA, 21 nt, Human
caggaaaggcuccaggagcag

SEQ ID NO: 3018818 - RNA, 19 nt, Human
caggaaaagcugcugacag

SEQ ID NO: 3018819 - RNA, 20 nt, Human
caggaaaagcugcugacagu

SEQ ID NO: 3018820 - RNA, 15 nt, Human
cagcuguucagcugg

SEQ ID NO: 3018821 - RNA, 16 nt, Human
cagcuguucagcuggu

SEQ ID NO: 3018822 - RNA, 15 nt, Human
caggccagcugcuug

SEQ ID NO: 3018823 - RNA, 13 nt, Human
caggccagcugcu

SEQ ID NO: 3018824 - RNA, 17 nt, Human
caggcaaugcuggcugu

SEQ ID NO: 3018825 - RNA, 21 nt, Human
caggcaaugcuggcuguuggc

SEQ ID NO: 3018826 - RNA, 19 nt, Human
caggcaaugcuggcuguug

SEQ ID NO: 3018827 - RNA, 20 nt, Human
caggcaaugcuggcuguugg

SEQ ID NO: 3018828 - RNA, 13 nt, Human
caggaggccagcc

SEQ ID NO: 3018829 - RNA, 12 nt, Human
caggaggccagc

SEQ ID NO: 3018830 - RNA, 16 nt, Human
caggccaggcccucug

SEQ ID NO: 3018831 - RNA, 15 nt, Human
caggccaggcccucu

SEQ ID NO: 3018832 - RNA, 14 nt, Human
caggccaggcccuc

SEQ ID NO: 3018833 - RNA, 13 nt, Human
caggccaggcccu

SEQ ID NO: 3018834 - RNA, 13 nt, Human
caggaccucaggu

SEQ ID NO: 3018835 - RNA, 13 nt, Human
caggaccagggau

SEQ ID NO: 3018836 - RNA, 23 nt, Human
cagauacaggaaaagcugcugac

SEQ ID NO: 3018837 - RNA, 22 nt, Human
cagagacuccugcaggcagcca

SEQ ID NO: 3018838 - RNA, 21 nt, Human
cagagacuccugcaggcagcc

SEQ ID NO: 3018839 - RNA, 20 nt, Human
cagagacuccugcaggcagc

SEQ ID NO: 3018840 - RNA, 13 nt, Human
cagagaggguggg

SEQ ID NO: 3018841 - RNA, 16 nt, Human
cagagagggugggagu

SEQ ID NO: 3018842 - RNA, 14 nt, Human
cagagccugcaguu

SEQ ID NO: 3018843 - RNA, 22 nt, Human
cagagagggugggagugggccc

SEQ ID NO: 3018844 - RNA, 20 nt, Human
cagagagggugggagugggc

SEQ ID NO: 3018845 - RNA, 22 nt, Human
cagagcuacacaggggaaaaga

SEQ ID NO: 3018846 - RNA, 17 nt, Human
cagagcuacacagggga

SEQ ID NO: 3018847 - RNA, 21 nt, Human
cagauugcaacaggcugggcu

SEQ ID NO: 3018848 - RNA, 13 nt, Human
cagauuucacucu

SEQ ID NO: 3018849 - RNA, 18 nt, Human
cagauuucacucuccuug

SEQ ID NO: 3018850 - RNA, 19 nt, Human
cagauuugaacucuucaau

SEQ ID NO: 3018851 - RNA, 16 nt, Human
cagauuucacucuccu

SEQ ID NO: 3018852 - RNA, 15 nt, Human
cagauuucacucucc

SEQ ID NO: 3018853 - RNA, 18 nt, Human
cagcauauucaggaagcu

SEQ ID NO: 3018854 - RNA, 17 nt, Human
cagcauauucaggaagc

SEQ ID NO: 3018855 - RNA, 16 nt, Human
cagcauauucaggaag

SEQ ID NO: 3018856 - RNA, 17 nt, Human
cagcauagaaguaacuu

SEQ ID NO: 3018857 - RNA, 23 nt, Human
cagccccauucugccugcccagg

SEQ ID NO: 3018858 - RNA, 24 nt, Human
cagccccauucugccugcccaggc

SEQ ID NO: 3018859 - RNA, 19 nt, Human
cagccccauucugccugcc

SEQ ID NO: 3018860 - RNA, 20 nt, Human
cagccccauucugccugccc

SEQ ID NO: 3018861 - RNA, 22 nt, Human
cagccccauucugccugcccag

SEQ ID NO: 3018862 - RNA, 16 nt, Human
cagcguuucuaugaca

SEQ ID NO: 3018863 - RNA, 14 nt, Human
cagcguuucuauga

SEQ ID NO: 3018864 - RNA, 23 nt, Human
cagccgccaugcuccuggcccac

SEQ ID NO: 3018865 - RNA, 13 nt, Human
cagcccuuagcag

SEQ ID NO: 3018866 - RNA, 14 nt, Human
cauuucaagaaguc

SEQ ID NO: 3018867 - RNA, 16 nt, Human
cauuuauucugcucac

SEQ ID NO: 3018868 - RNA, 15 nt, Human
cauuuauucugcuca

SEQ ID NO: 3018869 - RNA, 21 nt, Human
cauuuggugguuucagaaaug

SEQ ID NO: 3018870 - RNA, 22 nt, Human
cauuuggugguuucagaaaugu

SEQ ID NO: 3018871 - RNA, 23 nt, Human
cauuuggugguuucagaaaugug

SEQ ID NO: 3018872 - RNA, 23 nt, Human
cauuuuucuuagggaaggauaca

SEQ ID NO: 3018873 - RNA, 17 nt, Human
ccaaaacucuccucugc

SEQ ID NO: 3018874 - RNA, 17 nt, Human
ccaaaaaaugcuugcuu

SEQ ID NO: 3018875 - RNA, 18 nt, Human
cauugcugggcuugucug

SEQ ID NO: 3018876 - RNA, 14 nt, Human
cauugcggacagcc

SEQ ID NO: 3018877 - RNA, 15 nt, Human
cauugcggacagcca

SEQ ID NO: 3018878 - RNA, 17 nt, Human
cauugcggacagccacg

SEQ ID NO: 3018879 - RNA, 21 nt, Human
cauugcggacagccacggcca

SEQ ID NO: 3018880 - RNA, 18 nt, Human
cauuaucuagauacugua

SEQ ID NO: 3018881 - RNA, 16 nt, Human
cauucuccuuguguua

SEQ ID NO: 3018882 - RNA, 22 nt, Human
cauggccucuucagaucucuaa

SEQ ID NO: 3018883 - RNA, 22 nt, Human
cauggcugccaaugggagcuca

SEQ ID NO: 3018884 - RNA, 17 nt, Human
cauggcugccaauggga

SEQ ID NO: 3018885 - RNA, 15 nt, Human
cauguucucugagga

SEQ ID NO: 3018886 - RNA, 12 nt, Human
cauuaucuagau

SEQ ID NO: 3018887 - RNA, 16 nt, Human
cauuaucuagauacug

SEQ ID NO: 3018888 - RNA, 17 nt, Human
cauuaucuagauacugu

SEQ ID NO: 3018889 - RNA, 17 nt, Human
ccaccaucaagccacca

SEQ ID NO: 3018890 - RNA, 16 nt, Human
ccaccaucaagccacc

SEQ ID NO: 3018891 - RNA, 13 nt, Human
ccaccuuggcuca

SEQ ID NO: 3018892 - RNA, 14 nt, Human
ccaccuuggcucaa

SEQ ID NO: 3018893 - RNA, 15 nt, Human
ccaccuuggcucaag

SEQ ID NO: 3018894 - RNA, 13 nt, Human
ccaccgcagacag

SEQ ID NO: 3018895 - RNA, 18 nt, Human
ccaccgcagacaggacca

SEQ ID NO: 3018896 - RNA, 13 nt, Human
ccacccugcucuc

SEQ ID NO: 3018897 - RNA, 20 nt, Human
ccaccaucaagccaccaaca

SEQ ID NO: 3018898 - RNA, 17 nt, Human
ccaccgcagacaggacc

SEQ ID NO: 3018899 - RNA, 14 nt, Human
ccaccgcagacagg

SEQ ID NO: 3018900 - RNA, 20 nt, Human
ccaauguucucucuucucca

SEQ ID NO: 3018901 - RNA, 20 nt, Human
ccaagcuggucccacucagu

SEQ ID NO: 3018902 - RNA, 23 nt, Human
ccaaugcacuuuguucuggcucu

SEQ ID NO: 3018903 - RNA, 22 nt, Human
ccaaugcacuuuguucuggcuc

SEQ ID NO: 3018904 - RNA, 20 nt, Human
ccaaugcacuuuguucuggc

SEQ ID NO: 3018905 - RNA, 14 nt, Human
ccaaagugcuggga

SEQ ID NO: 3018906 - RNA, 16 nt, Human
ccaacgucugugccau

SEQ ID NO: 3018907 - RNA, 16 nt, Human
ccaaaucauaguggcu

SEQ ID NO: 3018908 - RNA, 14 nt, Human
caguuugcagagua

SEQ ID NO: 3018909 - RNA, 21 nt, Human
caguuugguugguaacucugu

SEQ ID NO: 3018910 - RNA, 11 nt, Human
caguuugguug

SEQ ID NO: 3018911 - RNA, 14 nt, Human
cauaaugcgugcau

SEQ ID NO: 3018912 - RNA, 17 nt, Human
cauaaugcgugcauacc

SEQ ID NO: 3018913 - RNA, 20 nt, Human
cauauuaccacagacauacu

SEQ ID NO: 3018914 - RNA, 21 nt, Human
cauauuaccacagacauacua

SEQ ID NO: 3018915 - RNA, 17 nt, Human
cauauuaccacagacau

SEQ ID NO: 3018916 - RNA, 16 nt, Human
cauauuaccacagaca

SEQ ID NO: 3018917 - RNA, 21 nt, Human
cauaaugcgugcauaccacuu

SEQ ID NO: 3018918 - RNA, 15 nt, Human
cauacaauuccaaac

SEQ ID NO: 3018919 - RNA, 18 nt, Human
cagucaccccggccaccu

SEQ ID NO: 3018920 - RNA, 15 nt, Human
caugcugccaauauc

SEQ ID NO: 3018921 - RNA, 17 nt, Human
caugcugccaauauccu

SEQ ID NO: 3018922 - RNA, 19 nt, Human
caugcugccaauauccuaa

SEQ ID NO: 3018923 - RNA, 21 nt, Human
caugcugccaauauccuaaua

SEQ ID NO: 3018924 - RNA, 18 nt, Human
caugcugcccugugagua

SEQ ID NO: 3018925 - RNA, 16 nt, Human
caugcugcccugugag

SEQ ID NO: 3018926 - RNA, 22 nt, Human
caugcugccaauauccuaauaa

SEQ ID NO: 3018927 - RNA, 22 nt, Human
cauggccuuugcuugaaagaaa

SEQ ID NO: 3018928 - RNA, 19 nt, Human
cauggccuuugcuugaaag

SEQ ID NO: 3018929 - RNA, 22 nt, Human
caugcaaggucauuuuuuuuaa

SEQ ID NO: 3018930 - RNA, 15 nt, Human
caugcaaggucauuu

SEQ ID NO: 3018931 - RNA, 17 nt, Human
caugcaaggucauuuuu

SEQ ID NO: 3018932 - RNA, 18 nt, Human
caugcaaggucauuuuuu

SEQ ID NO: 3018933 - RNA, 18 nt, Human
caugacacgaauauugcu

SEQ ID NO: 3018934 - RNA, 17 nt, Human
caugacacgaauauugc

SEQ ID NO: 3018935 - RNA, 14 nt, Human
caugacacgaauau

SEQ ID NO: 3018936 - RNA, 22 nt, Human
caucuuagguuggcaaaaaggc

SEQ ID NO: 3018937 - RNA, 21 nt, Human
caucuuagguuggcaaaaagg

SEQ ID NO: 3018938 - RNA, 19 nt, Human
caucugugaaaggaaagag

SEQ ID NO: 3018939 - RNA, 18 nt, Human
caucugugaaaggaaaga

SEQ ID NO: 3018940 - RNA, 23 nt, Human
cauccuggcacccggccccugcu

SEQ ID NO: 3018941 - RNA, 13 nt, Human
caucccagcccca

SEQ ID NO: 3018942 - RNA, 14 nt, Human
caucccagccccaa

SEQ ID NO: 3018943 - RNA, 16 nt, Human
caucccagccccaaug

SEQ ID NO: 3018944 - RNA, 12 nt, Human
caucccagcccc

SEQ ID NO: 3018945 - RNA, 23 nt, Human
caucaggccaggcccucugccca

SEQ ID NO: 3018946 - RNA, 22 nt, Human
caucaggccaggcccucugccc

SEQ ID NO: 3018947 - RNA, 21 nt, Human
caucaggccaggcccucugcc

SEQ ID NO: 3018948 - RNA, 20 nt, Human
caucaggccaggcccucugc

SEQ ID NO: 3018949 - RNA, 17 nt, Human
caucagcacgauuucug

SEQ ID NO: 3018950 - RNA, 18 nt, Human
caucagcacgauuucugu

SEQ ID NO: 3018951 - RNA, 13 nt, Human
caucaggccaggc

SEQ ID NO: 3018952 - RNA, 16 nt, Human
cacuuacacuuuaugc

SEQ ID NO: 3018953 - RNA, 18 nt, Human
cacuuacacuuuaugcac

SEQ ID NO: 3018954 - RNA, 13 nt, Human
cacugcagccuca

SEQ ID NO: 3018955 - RNA, 16 nt, Human
cacugcauguuuguga

SEQ ID NO: 3018956 - RNA, 19 nt, Human
cacugcacuauagccuagg

SEQ ID NO: 3018957 - RNA, 16 nt, Human
cacugcacuccagccu

SEQ ID NO: 3018958 - RNA, 15 nt, Human
cacugcacuccagcc

SEQ ID NO: 3018959 - RNA, 18 nt, Human
cacugcacuccagccugg

SEQ ID NO: 3018960 - RNA, 19 nt, Human
cacugcacuccagccuggg

SEQ ID NO: 3018961 - RNA, 20 nt, Human
cacugcacuccagccugggu

SEQ ID NO: 3018962 - RNA, 12 nt, Human
cacugcagccuc

SEQ ID NO: 3018963 - RNA, 13 nt, Human
cacuccccugcug

SEQ ID NO: 3018964 - RNA, 12 nt, Human
cacuccccugcu

SEQ ID NO: 3018965 - RNA, 14 nt, Human
cacuccccugcugg

SEQ ID NO: 3018966 - RNA, 16 nt, Human
cacuccagccugggug

SEQ ID NO: 3018967 - RNA, 17 nt, Human
caccugccuguugggcc

SEQ ID NO: 3018968 - RNA, 24 nt, Human
caccugccuguugggccaggagcc

SEQ ID NO: 3018969 - RNA, 19 nt, Human
caccugccuguugggccag

SEQ ID NO: 3018970 - RNA, 14 nt, Human
caccuuggcugcag

SEQ ID NO: 3018971 - RNA, 14 nt, Human
caccuuggcucaag

SEQ ID NO: 3018972 - RNA, 15 nt, Human
caccuuggcucaagu

SEQ ID NO: 3018973 - RNA, 13 nt, Human
caccuuggcugca

SEQ ID NO: 3018974 - RNA, 14 nt, Human
caccucagccuccc

SEQ ID NO: 3018975 - RNA, 12 nt, Human
caccucagccuc

SEQ ID NO: 3018976 - RNA, 13 nt, Human
caccucagccucc

SEQ ID NO: 3018977 - RNA, 14 nt, Human
caccugccccucaa

SEQ ID NO: 3018978 - RNA, 16 nt, Human
caccugccccucaacu

SEQ ID NO: 3018979 - RNA, 15 nt, Human
caccugccccucaac

SEQ ID NO: 3018980 - RNA, 17 nt, Human
cacccugaaagcccuga

SEQ ID NO: 3018981 - RNA, 15 nt, Human
cacccuggggagaaa

SEQ ID NO: 3018982 - RNA, 16 nt, Human
cacccuggggagaaag

SEQ ID NO: 3018983 - RNA, 14 nt, Human
cacccucaggcagg

SEQ ID NO: 3018984 - RNA, 11 nt, Human
caccccagccc

SEQ ID NO: 3018985 - RNA, 19 nt, Human
caauaaagcagcguuucua

SEQ ID NO: 3018986 - RNA, 13 nt, Human
caagcucugcucc

SEQ ID NO: 3018987 - RNA, 12 nt, Human
caagcuccaagc

SEQ ID NO: 3018988 - RNA, 14 nt, Human
caagcucugcuccu

SEQ ID NO: 3018989 - RNA, 13 nt, Human
caagcugcacccu

SEQ ID NO: 3018990 - RNA, 18 nt, Human
caagcugcacccucaggc

SEQ ID NO: 3018991 - RNA, 14 nt, Human
caagcugcacccuc

SEQ ID NO: 3018992 - RNA, 18 nt, Human
caaggccaaaggaagcac

SEQ ID NO: 3018993 - RNA, 17 nt, Human
caaggccaaaggaagca

SEQ ID NO: 3018994 - RNA, 16 nt, Human
caaggccaaaggaagc

SEQ ID NO: 3018995 - RNA, 15 nt, Human
caaggccaaaggaag

SEQ ID NO: 3018996 - RNA, 17 nt, Human
caagucaagugaaaaag

SEQ ID NO: 3018997 - RNA, 13 nt, Human
caagucaagugaa

SEQ ID NO: 3018998 - RNA, 18 nt, Human
caagcgugagccacugca

SEQ ID NO: 3018999 - RNA, 17 nt, Human
cacacagcucuguccug

SEQ ID NO: 3019000 - RNA, 20 nt, Human
cacacagcucuguccuggga

SEQ ID NO: 3019001 - RNA, 11 nt, Human
caauggcagcc

SEQ ID NO: 3019002 - RNA, 12 nt, Human
caauggcagccu

SEQ ID NO: 3019003 - RNA, 14 nt, Human
cacaagagcccagg

SEQ ID NO: 3019004 - RNA, 15 nt, Human
cacaagcuccaagcu

SEQ ID NO: 3019005 - RNA, 14 nt, Human
cacaagcuccaagc

SEQ ID NO: 3019006 - RNA, 13 nt, Human
cacaagcuccaag

SEQ ID NO: 3019007 - RNA, 16 nt, Human
cacaagagcccaggcc

SEQ ID NO: 3019008 - RNA, 23 nt, Human
cacaagcuccaagcucccaggca

SEQ ID NO: 3019009 - RNA, 17 nt, Human
cacaagcuccaagcucc

SEQ ID NO: 3019010 - RNA, 23 nt, Human
cacaagcugcacccucaggcagg

SEQ ID NO: 3019011 - RNA, 17 nt, Human
cacaagcugcacccuca

SEQ ID NO: 3019012 - RNA, 11 nt, Human
cacagccucug

SEQ ID NO: 3019013 - RNA, 13 nt, Human
cacagacccugcc

SEQ ID NO: 3019014 - RNA, 19 nt, Human
cacagacauacuaaccagc

SEQ ID NO: 3019015 - RNA, 21 nt, Human
cacagacauacuaaccagcag

SEQ ID NO: 3019016 - RNA, 18 nt, Human
cacagacauacuaaccag

SEQ ID NO: 3019017 - RNA, 19 nt, Human
cacagaaaauucuucucca

SEQ ID NO: 3019018 - RNA, 23 nt, Human
cacagaaaauggaagacagcucu

SEQ ID NO: 3019019 - RNA, 22 nt, Human
cacacaugagcaucaggccagg

SEQ ID NO: 3019020 - RNA, 21 nt, Human
cacacaugagcaucaggccag

SEQ ID NO: 3019021 - RNA, 22 nt, Human
cacagaaaauggaagacagcuc

SEQ ID NO: 3019022 - RNA, 20 nt, Human
cacagaaaauggaagacagc

SEQ ID NO: 3019023 - RNA, 19 nt, Human
cacagaaaauggaagacag

SEQ ID NO: 3019024 - RNA, 18 nt, Human
cacagaaaauggaagaca

SEQ ID NO: 3019025 - RNA, 18 nt, Human
cacacagugagucgagga

SEQ ID NO: 3019026 - RNA, 20 nt, Human
cacacaguauuacuucugcu

SEQ ID NO: 3019027 - RNA, 23 nt, Human
cacacaguauuacuucugcuaca

SEQ ID NO: 3019028 - RNA, 16 nt, Human
cacacagcucuguccu

SEQ ID NO: 3019029 - RNA, 15 nt, Human
cacacauacacacac

SEQ ID NO: 3019030 - RNA, 21 nt, Human
cacacagugagucgaggacag

SEQ ID NO: 3019031 - RNA, 23 nt, Human
cacacagugagucgaggacaggg

SEQ ID NO: 3019032 - RNA, 20 nt, Human
cacacaugagcaucaggcca

SEQ ID NO: 3019033 - RNA, 20 nt, Human
cacaguauuacuucugcuac

SEQ ID NO: 3019034 - RNA, 21 nt, Human
cacaguauuacuucugcuaca

SEQ ID NO: 3019035 - RNA, 19 nt, Human
cacaguauuacuucugcua

SEQ ID NO: 3019036 - RNA, 19 nt, Human
cacaggggaaaagaggagu

SEQ ID NO: 3019037 - RNA, 18 nt, Human
cacaggggaaaagaggag

SEQ ID NO: 3019038 - RNA, 17 nt, Human
cacaggggaaaagagga

SEQ ID NO: 3019039 - RNA, 17 nt, Human
auugcugcuuguacacu

SEQ ID NO: 3019040 - RNA, 12 nt, Human
auugcugcuuga

SEQ ID NO: 3019041 - RNA, 23 nt, Human
auugcugauggugcaaugaccuu

SEQ ID NO: 3019042 - RNA, 14 nt, Human
auugcuugagcuca

SEQ ID NO: 3019043 - RNA, 19 nt, Human
auugcugauggugcaauga

SEQ ID NO: 3019044 - RNA, 18 nt, Human
auugcugauggugcaaug

SEQ ID NO: 3019045 - RNA, 16 nt, Human
auugcugauggugcaa

SEQ ID NO: 3019046 - RNA, 15 nt, Human
auugcugauggugca

SEQ ID NO: 3019047 - RNA, 16 nt, Human
auuguuagucucuuga

SEQ ID NO: 3019048 - RNA, 23 nt, Human
auugugucucuugguccugcugc

SEQ ID NO: 3019049 - RNA, 21 nt, Human
auugugucucuugguccugcu

SEQ ID NO: 3019050 - RNA, 11 nt, Human
auucuucugcu

SEQ ID NO: 3019051 - RNA, 12 nt, Human
auucuucugcuu

SEQ ID NO: 3019052 - RNA, 11 nt, Human
auucuuuccug

SEQ ID NO: 3019053 - RNA, 14 nt, Human
auugcuacuguccu

SEQ ID NO: 3019054 - RNA, 15 nt, Human
auugcuacuguccua

SEQ ID NO: 3019055 - RNA, 17 nt, Human
auugauaugcuuauaca

SEQ ID NO: 3019056 - RNA, 20 nt, Human
auugcuacuguccuacccac

SEQ ID NO: 3019057 - RNA, 22 nt, Human
auugcuacuguccuacccaccc

SEQ ID NO: 3019058 - RNA, 21 nt, Human
auugauaagaaccuuuugagu

SEQ ID NO: 3019059 - RNA, 20 nt, Human
auuaaugucaguauuucaac

SEQ ID NO: 3019060 - RNA, 17 nt, Human
auuacaacucuauuuaa

SEQ ID NO: 3019061 - RNA, 17 nt, Human
auuacaggaaguacugg

SEQ ID NO: 3019062 - RNA, 16 nt, Human
auuacaggugugaacc

SEQ ID NO: 3019063 - RNA, 13 nt, Human
auuagguugugaa

SEQ ID NO: 3019064 - RNA, 21 nt, Human
auuaggugugacugaauuucu

SEQ ID NO: 3019065 - RNA, 15 nt, Human
auuagguugugaaug

SEQ ID NO: 3019066 - RNA, 14 nt, Human
auuagguugugaau

SEQ ID NO: 3019067 - RNA, 16 nt, Human
auuaggugugacugaa

SEQ ID NO: 3019068 - RNA, 18 nt, Human
auuaggugugacugaauu

SEQ ID NO: 3019069 - RNA, 23 nt, Human
auuaugcaugaaguaauaugcac

SEQ ID NO: 3019070 - RNA, 19 nt, Human
auucauaaugacuuaagca

SEQ ID NO: 3019071 - RNA, 15 nt, Human
auucauaaugacuua

SEQ ID NO: 3019072 - RNA, 14 nt, Human
auucauaaugacuu

SEQ ID NO: 3019073 - RNA, 15 nt, Human
auuuggaaaggaaug

SEQ ID NO: 3019074 - RNA, 13 nt, Human
auuugcuccuuuc

SEQ ID NO: 3019075 - RNA, 18 nt, Human
auuuggaaaggaaugcaa

SEQ ID NO: 3019076 - RNA, 15 nt, Human
auuugugauacaaug

SEQ ID NO: 3019077 - RNA, 17 nt, Human
auuugugauacaaugcu

SEQ ID NO: 3019078 - RNA, 18 nt, Human
auuuguggaaaauaacuc

SEQ ID NO: 3019079 - RNA, 20 nt, Human
auuugugauacaaugcugug

SEQ ID NO: 3019080 - RNA, 22 nt, Human
auuuguuugaacugauaaagau

SEQ ID NO: 3019081 - RNA, 23 nt, Human
auuuguuugaacugauaaagaug

SEQ ID NO: 3019082 - RNA, 20 nt, Human
auuuguuugaacugauaaag

SEQ ID NO: 3019083 - RNA, 21 nt, Human
auuugccuaauaugaugacug

SEQ ID NO: 3019084 - RNA, 13 nt, Human
caaacccaguguu

SEQ ID NO: 3019085 - RNA, 19 nt, Human
caaaccaucauugaaaucu

SEQ ID NO: 3019086 - RNA, 21 nt, Human
caaaccaucauugaaaucuuu

SEQ ID NO: 3019087 - RNA, 15 nt, Human
caaacagaggccgcc

SEQ ID NO: 3019088 - RNA, 23 nt, Human
auuuuuuuuuccuucagugccuu

SEQ ID NO: 3019089 - RNA, 18 nt, Human
caaaagaugcuucucacu

SEQ ID NO: 3019090 - RNA, 16 nt, Human
caaaagaugcuucuca

SEQ ID NO: 3019091 - RNA, 18 nt, Human
caaagauauuuugcuuug

SEQ ID NO: 3019092 - RNA, 20 nt, Human
caaagauauuuugcuuugug

SEQ ID NO: 3019093 - RNA, 20 nt, Human
caaauggaaaugggcagagc

SEQ ID NO: 3019094 - RNA, 21 nt, Human
caaauggaaaugggcagagca

SEQ ID NO: 3019095 - RNA, 20 nt, Human
caacaccucugcacaagcug

SEQ ID NO: 3019096 - RNA, 14 nt, Human
caaaguagaagucu

SEQ ID NO: 3019097 - RNA, 21 nt, Human
caaaguagaagucuuagaugu

SEQ ID NO: 3019098 - RNA, 17 nt, Human
caaagcagugcaugcug

SEQ ID NO: 3019099 - RNA, 15 nt, Human
caaagcagugcaugc

SEQ ID NO: 3019100 - RNA, 22 nt, Human
caaaguacacuguuucaaacuu

SEQ ID NO: 3019101 - RNA, 22 nt, Human
caaagauauuuugcuuugugau

SEQ ID NO: 3019102 - RNA, 23 nt, Human
caaagauauuuugcuuugugauu

SEQ ID NO: 3019103 - RNA, 24 nt, Human
ccguagacgugcacgcacacuguc

SEQ ID NO: 3019104 - RNA, 16 nt, Human
ccucaaccuccugggc

SEQ ID NO: 3019105 - RNA, 11 nt, Human
ccucagccucc

SEQ ID NO: 3019106 - RNA, 22 nt, Human
ccucagccucccaaagugcugg

SEQ ID NO: 3019107 - RNA, 15 nt, Human
ccucaagagaaggca

SEQ ID NO: 3019108 - RNA, 15 nt, Human
ccucaacucuccucc

SEQ ID NO: 3019109 - RNA, 20 nt, Human
ccuccaagaccuucuccuuc

SEQ ID NO: 3019110 - RNA, 19 nt, Human
ccucauguucuuaauucuu

SEQ ID NO: 3019111 - RNA, 23 nt, Human
ccucccaacucaccccagcccca

SEQ ID NO: 3019112 - RNA, 22 nt, Human
ccucccaaggggcccaaauucu

SEQ ID NO: 3019113 - RNA, 13 nt, Human
ccucauguucuua

SEQ ID NO: 3019114 - RNA, 23 nt, Human
ccucagccucccaaagugcuggg

SEQ ID NO: 3019115 - RNA, 22 nt, Human
ccucagccucccgaauagcugg

SEQ ID NO: 3019116 - RNA, 13 nt, Human
cccuucucuguau

SEQ ID NO: 3019117 - RNA, 21 nt, Human
cccuucugacccaugcugccc

SEQ ID NO: 3019118 - RNA, 23 nt, Human
cccuucugacccaugcugcccug

SEQ ID NO: 3019119 - RNA, 22 nt, Human
cccuucugacccaugcugcccu

SEQ ID NO: 3019120 - RNA, 16 nt, Human
cccuucgcuccugugu

SEQ ID NO: 3019121 - RNA, 18 nt, Human
cccuucgcuccugugucu

SEQ ID NO: 3019122 - RNA, 16 nt, Human
cccuucuaccuuccug

SEQ ID NO: 3019123 - RNA, 16 nt, Human
ccgccaugcuccuggc

SEQ ID NO: 3019124 - RNA, 20 nt, Human
ccgcccaggcuuagucacug

SEQ ID NO: 3019125 - RNA, 18 nt, Human
ccgaccagacaccuugac

SEQ ID NO: 3019126 - RNA, 20 nt, Human
ccgaauagcugggacuacag

SEQ ID NO: 3019127 - RNA, 17 nt, Human
ccgaauagcugggacua

SEQ ID NO: 3019128 - RNA, 16 nt, Human
ccgacccuugccgucu

SEQ ID NO: 3019129 - RNA, 17 nt, Human
ccgccaaggcuggggga

SEQ ID NO: 3019130 - RNA, 13 nt, Human
cccugcccugugg

SEQ ID NO: 3019131 - RNA, 12 nt, Human
cccugcccugug

SEQ ID NO: 3019132 - RNA, 11 nt, Human
cccugcccugu

SEQ ID NO: 3019133 - RNA, 14 nt, Human
cccugcccuguggg

SEQ ID NO: 3019134 - RNA, 15 nt, Human
cccugcccugugggc

SEQ ID NO: 3019135 - RNA, 20 nt, Human
cccugcccugugggccccca

SEQ ID NO: 3019136 - RNA, 16 nt, Human
cccugcccugugggcc

SEQ ID NO: 3019137 - RNA, 13 nt, Human
cccuggcagcccc

SEQ ID NO: 3019138 - RNA, 12 nt, Human
cccuggcagccc

SEQ ID NO: 3019139 - RNA, 21 nt, Human
cccugcccugugggcccccaa

SEQ ID NO: 3019140 - RNA, 16 nt, Human
cccuggcagccccugu

SEQ ID NO: 3019141 - RNA, 14 nt, Human
cccuggcagccccu

SEQ ID NO: 3019142 - RNA, 15 nt, Human
ccuggaguucugguu

SEQ ID NO: 3019143 - RNA, 17 nt, Human
ccuggaguucugguucc

SEQ ID NO: 3019144 - RNA, 16 nt, Human
ccuggaguucugguuc

SEQ ID NO: 3019145 - RNA, 13 nt, Human
ccuggaugcagcc

SEQ ID NO: 3019146 - RNA, 19 nt, Human
ccuggaugcagccucacag

SEQ ID NO: 3019147 - RNA, 17 nt, Human
ccuggaugcagccucac

SEQ ID NO: 3019148 - RNA, 14 nt, Human
ccuggaugcagccu

SEQ ID NO: 3019149 - RNA, 20 nt, Human
ccugcuggguguggcgcagc

SEQ ID NO: 3019150 - RNA, 14 nt, Human
ccugcugggugugg

SEQ ID NO: 3019151 - RNA, 12 nt, Human
ccugcugggugu

SEQ ID NO: 3019152 - RNA, 14 nt, Human
ccugcccaggcccc

SEQ ID NO: 3019153 - RNA, 15 nt, Human
ccugcccaggccccu

SEQ ID NO: 3019154 - RNA, 22 nt, Human
ccugcccaggccccugccaccc

SEQ ID NO: 3019155 - RNA, 16 nt, Human
ccugcccaggccccug

SEQ ID NO: 3019156 - RNA, 12 nt, Human
ccuggccucugc

SEQ ID NO: 3019157 - RNA, 13 nt, Human
ccuggccugagcu

SEQ ID NO: 3019158 - RNA, 15 nt, Human
ccuggccucugcacu

SEQ ID NO: 3019159 - RNA, 14 nt, Human
ccuggccucugcac

SEQ ID NO: 3019160 - RNA, 19 nt, Human
ccugcacuugcagacucua

SEQ ID NO: 3019161 - RNA, 22 nt, Human
ccugcacuugcagacucuacag

SEQ ID NO: 3019162 - RNA, 13 nt, Human
ccucuuggguuca

SEQ ID NO: 3019163 - RNA, 13 nt, Human
ccucuugagccuu

SEQ ID NO: 3019164 - RNA, 19 nt, Human
ccucuugagccuugaacuu

SEQ ID NO: 3019165 - RNA, 21 nt, Human
ccucugccugaagucacacag

SEQ ID NO: 3019166 - RNA, 22 nt, Human
ccucugccugaagucacacagu

SEQ ID NO: 3019167 - RNA, 14 nt, Human
ccucugcugcuggc

SEQ ID NO: 3019168 - RNA, 13 nt, Human
ccucugcugcugg

SEQ ID NO: 3019169 - RNA, 18 nt, Human
ccucugcugcuggcuggu

SEQ ID NO: 3019170 - RNA, 17 nt, Human
ccucugcugcuggcugg

SEQ ID NO: 3019171 - RNA, 16 nt, Human
ccucugcugcuggcug

SEQ ID NO: 3019172 - RNA, 15 nt, Human
ccucugcugcuggcu

SEQ ID NO: 3019173 - RNA, 14 nt, Human
ccucucucaggcca

SEQ ID NO: 3019174 - RNA, 12 nt, Human
ccucucucaggc

SEQ ID NO: 3019175 - RNA, 17 nt, Human
ccucucucacuccuuga

SEQ ID NO: 3019176 - RNA, 15 nt, Human
ccucucucacuccuu

SEQ ID NO: 3019177 - RNA, 14 nt, Human
ccucucucacuccu

SEQ ID NO: 3019178 - RNA, 13 nt, Human
ccucucucacucc

SEQ ID NO: 3019179 - RNA, 12 nt, Human
ccucucucacuc

SEQ ID NO: 3019180 - RNA, 17 nt, Human
ccaggcuggcgugcagu

SEQ ID NO: 3019181 - RNA, 18 nt, Human
ccaggcuggcgugcagug

SEQ ID NO: 3019182 - RNA, 16 nt, Human
ccaggcuggcgugcag

SEQ ID NO: 3019183 - RNA, 20 nt, Human
ccaggcuccuuuagcgccca

SEQ ID NO: 3019184 - RNA, 21 nt, Human
ccaggcuccuuuagcgcccag

SEQ ID NO: 3019185 - RNA, 19 nt, Human
ccaggggaaaaucagccug

SEQ ID NO: 3019186 - RNA, 13 nt, Human
ccaggggugggac

SEQ ID NO: 3019187 - RNA, 20 nt, Human
ccaggggaaaaucagccugc

SEQ ID NO: 3019188 - RNA, 17 nt, Human
ccaggggugggacaccc

SEQ ID NO: 3019189 - RNA, 14 nt, Human
ccaggggugggaca

SEQ ID NO: 3019190 - RNA, 23 nt, Human
ccaggggugggacacccugugau

SEQ ID NO: 3019191 - RNA, 17 nt, Human
ccaguuggguggaugcc

SEQ ID NO: 3019192 - RNA, 19 nt, Human
ccaguuggguggaugccug

SEQ ID NO: 3019193 - RNA, 20 nt, Human
ccaguuggguggaugccugg

SEQ ID NO: 3019194 - RNA, 20 nt, Human
ccauggucggaaaacaugcu

SEQ ID NO: 3019195 - RNA, 21 nt, Human
ccaugagccucagcauccugg

SEQ ID NO: 3019196 - RNA, 23 nt, Human
ccaugagccucagcauccuggca

SEQ ID NO: 3019197 - RNA, 20 nt, Human
ccaucccugaaggccccgcc

SEQ ID NO: 3019198 - RNA, 17 nt, Human
ccaucccugaaggcccc

SEQ ID NO: 3019199 - RNA, 15 nt, Human
ccaucccugaaggcc

SEQ ID NO: 3019200 - RNA, 14 nt, Human
ccaucccugaaggc

SEQ ID NO: 3019201 - RNA, 23 nt, Human
ccaguuggucccccuuccaugga

SEQ ID NO: 3019202 - RNA, 15 nt, Human
ccaucccagccccaa

SEQ ID NO: 3019203 - RNA, 13 nt, Human
ccaucccagcccc

SEQ ID NO: 3019204 - RNA, 14 nt, Human
ccaucccagcccca

SEQ ID NO: 3019205 - RNA, 16 nt, Human
ccaggaaaggcuccag

SEQ ID NO: 3019206 - RNA, 15 nt, Human
ccaggaaaggcucca

SEQ ID NO: 3019207 - RNA, 14 nt, Human
ccaggaaaggcucc

SEQ ID NO: 3019208 - RNA, 12 nt, Human
ccaggaagccag

SEQ ID NO: 3019209 - RNA, 13 nt, Human
ccaggaagccagc

SEQ ID NO: 3019210 - RNA, 19 nt, Human
ccagcuuaaaggggcuaga

SEQ ID NO: 3019211 - RNA, 17 nt, Human
ccagcuguucagcuggu

SEQ ID NO: 3019212 - RNA, 22 nt, Human
ccagcucaccagccccagugcc

SEQ ID NO: 3019213 - RNA, 16 nt, Human
ccagcuguucagcugg

SEQ ID NO: 3019214 - RNA, 15 nt, Human
ccagcucaccagccc

SEQ ID NO: 3019215 - RNA, 16 nt, Human
ccagcucaccagcccc

SEQ ID NO: 3019216 - RNA, 12 nt, Human
ccagccccugga

SEQ ID NO: 3019217 - RNA, 11 nt, Human
ccagccccugg

SEQ ID NO: 3019218 - RNA, 15 nt, Human
ccagcaggcucucag

SEQ ID NO: 3019219 - RNA, 13 nt, Human
ccagcaggcucuc

SEQ ID NO: 3019220 - RNA, 18 nt, Human
ccagaugcaccagcccuu

SEQ ID NO: 3019221 - RNA, 17 nt, Human
ccagaugcaccagcccu

SEQ ID NO: 3019222 - RNA, 15 nt, Human
ccagaugcaccagcc

SEQ ID NO: 3019223 - RNA, 20 nt, Human
ccagagggccugcaagggag

SEQ ID NO: 3019224 - RNA, 16 nt, Human
ccaccuuggcucaagu

SEQ ID NO: 3019225 - RNA, 17 nt, Human
ccagagggccugcaagg

SEQ ID NO: 3019226 - RNA, 19 nt, Human
ccagagggccugcaaggga

SEQ ID NO: 3019227 - RNA, 18 nt, Human
ccagagggccugcaaggg

SEQ ID NO: 3019228 - RNA, 14 nt, Human
cccgaauagcuggg

SEQ ID NO: 3019229 - RNA, 11 nt, Human
cccggcuccag

SEQ ID NO: 3019230 - RNA, 12 nt, Human
cccggcuccagg

SEQ ID NO: 3019231 - RNA, 14 nt, Human
cccggccaccugcg

SEQ ID NO: 3019232 - RNA, 13 nt, Human
cccggccaccugc

SEQ ID NO: 3019233 - RNA, 13 nt, Human
cccggcuccaggc

SEQ ID NO: 3019234 - RNA, 14 nt, Human
cccggcuccaggcu

SEQ ID NO: 3019235 - RNA, 15 nt, Human
cccggcuccaggcuc

SEQ ID NO: 3019236 - RNA, 16 nt, Human
cccggcuccaggcucc

SEQ ID NO: 3019237 - RNA, 22 nt, Human
cccgggaagggggcugggacau

SEQ ID NO: 3019238 - RNA, 18 nt, Human
cccuauuagagaagagau

SEQ ID NO: 3019239 - RNA, 23 nt, Human
ccccgacccuugccgucuaccug

SEQ ID NO: 3019240 - RNA, 22 nt, Human
cccccaaauggaaaugggcaga

SEQ ID NO: 3019241 - RNA, 21 nt, Human
ccccagcaagugagagcuggg

SEQ ID NO: 3019242 - RNA, 22 nt, Human
ccccagcaagugagagcugggu

SEQ ID NO: 3019243 - RNA, 23 nt, Human
ccccaaaacucuccucugcugcu

SEQ ID NO: 3019244 - RNA, 21 nt, Human
ccccaaaacucuccucugcug

SEQ ID NO: 3019245 - RNA, 22 nt, Human
ccccaaaacucuccucugcugc

SEQ ID NO: 3019246 - RNA, 17 nt, Human
cccacccccacccaagg

SEQ ID NO: 3019247 - RNA, 15 nt, Human
cccacccccacccaa

SEQ ID NO: 3019248 - RNA, 12 nt, Human
cccacccccacc

SEQ ID NO: 3019249 - RNA, 18 nt, Human
cccacccaagggccuggc

SEQ ID NO: 3019250 - RNA, 18 nt, Human
cccacccugaaagcccug

SEQ ID NO: 3019251 - RNA, 22 nt, Human
cccacccaagggccuggccuga

SEQ ID NO: 3019252 - RNA, 21 nt, Human
cccacccaagggccuggccug

SEQ ID NO: 3019253 - RNA, 20 nt, Human
cccacccaagggccuggccu

SEQ ID NO: 3019254 - RNA, 19 nt, Human
cccacugcuuuuggucugu

SEQ ID NO: 3019255 - RNA, 12 nt, Human
cccacugcucug

SEQ ID NO: 3019256 - RNA, 13 nt, Human
cccacugcucugg

SEQ ID NO: 3019257 - RNA, 13 nt, Human
cccaggcuggcgu

SEQ ID NO: 3019258 - RNA, 17 nt, Human
cccaggcuggcgugcag

SEQ ID NO: 3019259 - RNA, 13 nt, Human
cccauccucugua

SEQ ID NO: 3019260 - RNA, 22 nt, Human
cccagcuuaaaggggcuagagu

SEQ ID NO: 3019261 - RNA, 23 nt, Human
cccagcucugguccauagagagc

SEQ ID NO: 3019262 - RNA, 16 nt, Human
cuagcaugaagacaga

SEQ ID NO: 3019263 - RNA, 17 nt, Human
cuagcauggcugccaau

SEQ ID NO: 3019264 - RNA, 23 nt, Human
cuagcagcagggagggcuucugc

SEQ ID NO: 3019265 - RNA, 12 nt, Human
cuagcagcaggg

SEQ ID NO: 3019266 - RNA, 22 nt, Human
cuagcagcagggagggcuucug

SEQ ID NO: 3019267 - RNA, 19 nt, Human
cuagaaauuccccacccug

SEQ ID NO: 3019268 - RNA, 14 nt, Human
cuaccugaggggcc

SEQ ID NO: 3019269 - RNA, 11 nt, Human
cuaccugaggg

SEQ ID NO: 3019270 - RNA, 18 nt, Human
cuauaacaaaggauacuu

SEQ ID NO: 3019271 - RNA, 22 nt, Human
cuauaacaaaggauacuuauuu

SEQ ID NO: 3019272 - RNA, 22 nt, Human
cuaguuccaccaucaagccacc

SEQ ID NO: 3019273 - RNA, 14 nt, Human
cuaguuccaccauc

SEQ ID NO: 3019274 - RNA, 20 nt, Human
cuaguuccaccaucaagcca

SEQ ID NO: 3019275 - RNA, 18 nt, Human
cuaguuccaccaucaagc

SEQ ID NO: 3019276 - RNA, 21 nt, Human
cuagggaaaaaccagcgugug

SEQ ID NO: 3019277 - RNA, 19 nt, Human
cuagggaaaaaccagcgug

SEQ ID NO: 3019278 - RNA, 18 nt, Human
cuaagugaggaugaaaaa

SEQ ID NO: 3019279 - RNA, 20 nt, Human
cuaagugauccucccaccuc

SEQ ID NO: 3019280 - RNA, 22 nt, Human
cuaagugauccucccaccucag

SEQ ID NO: 3019281 - RNA, 13 nt, Human
cuacaguugaaaa

SEQ ID NO: 3019282 - RNA, 18 nt, Human
cuacaguccucccaucuc

SEQ ID NO: 3019283 - RNA, 17 nt, Human
cuacaguccucccaucu

SEQ ID NO: 3019284 - RNA, 16 nt, Human
cuacaguccucccauc

SEQ ID NO: 3019285 - RNA, 15 nt, Human
cuacaguccucccau

SEQ ID NO: 3019286 - RNA, 16 nt, Human
cuaacuucaccauauu

SEQ ID NO: 3019287 - RNA, 16 nt, Human
cuaacuuuccuucauu

SEQ ID NO: 3019288 - RNA, 15 nt, Human
cuaacuucaccauau

SEQ ID NO: 3019289 - RNA, 16 nt, Human
ccuuggacauuuuaug

SEQ ID NO: 3019290 - RNA, 18 nt, Human
ccuuggacauuuuauguc

SEQ ID NO: 3019291 - RNA, 14 nt, Human
ccuuuagcgcccag

SEQ ID NO: 3019292 - RNA, 20 nt, Human
ccuuuagcgcccaguugggu

SEQ ID NO: 3019293 - RNA, 20 nt, Human
ccuuuucgcaggauucuucc

SEQ ID NO: 3019294 - RNA, 12 nt, Human
ccuuuuuuauac

SEQ ID NO: 3019295 - RNA, 23 nt, Human
cgaccagacaccuugacagggca

SEQ ID NO: 3019296 - RNA, 17 nt, Human
ccuuuuuuauacauaaa

SEQ ID NO: 3019297 - RNA, 18 nt, Human
ccuuuuuuauacauaaac

SEQ ID NO: 3019298 - RNA, 20 nt, Human
ccuugccgucuaccugaggg

SEQ ID NO: 3019299 - RNA, 17 nt, Human
ccuugccgucuaccuga

SEQ ID NO: 3019300 - RNA, 15 nt, Human
ccuggccugagcugg

SEQ ID NO: 3019301 - RNA, 14 nt, Human
ccuggccugagcug

SEQ ID NO: 3019302 - RNA, 20 nt, Human
ccuucugacccaugcugccc

SEQ ID NO: 3019303 - RNA, 17 nt, Human
ccuucugacccaugcug

SEQ ID NO: 3019304 - RNA, 16 nt, Human
ccuucugacccaugcu

SEQ ID NO: 3019305 - RNA, 12 nt, Human
ccuucugaccca

SEQ ID NO: 3019306 - RNA, 22 nt, Human
ccuucuggaauaaggagaauga

SEQ ID NO: 3019307 - RNA, 23 nt, Human
ccuucugacccaugcugcccugu

SEQ ID NO: 3019308 - RNA, 22 nt, Human
ccuucugacccaugcugcccug

SEQ ID NO: 3019309 - RNA, 21 nt, Human
ccuucugacccaugcugcccu

SEQ ID NO: 3019310 - RNA, 12 nt, Human
cgccaaggcugg

SEQ ID NO: 3019311 - RNA, 16 nt, Human
cgccaaggcuggggga

SEQ ID NO: 3019312 - RNA, 13 nt, Human
cgccaaggcuggg

SEQ ID NO: 3019313 - RNA, 18 nt, Human
cgaguuacagacaaagcg

SEQ ID NO: 3019314 - RNA, 17 nt, Human
cgaguuacagacaaagc

SEQ ID NO: 3019315 - RNA, 13 nt, Human
cgaguagcuggga

SEQ ID NO: 3019316 - RNA, 14 nt, Human
cgaguagcugggac

SEQ ID NO: 3019317 - RNA, 15 nt, Human
cgaguagcugggacu

SEQ ID NO: 3019318 - RNA, 17 nt, Human
cggcucacugcagccuc

SEQ ID NO: 3019319 - RNA, 19 nt, Human
cggcucacugcagccucaa

SEQ ID NO: 3019320 - RNA, 18 nt, Human
cggcucacugcagccuca

SEQ ID NO: 3019321 - RNA, 15 nt, Human
cggccuuuggcuuca

SEQ ID NO: 3019322 - RNA, 13 nt, Human
cucuauuucugga

SEQ ID NO: 3019323 - RNA, 14 nt, Human
cucucacuccuuga

SEQ ID NO: 3019324 - RNA, 12 nt, Human
cucucacuccuu

SEQ ID NO: 3019325 - RNA, 15 nt, Human
cucucacuccuugaa

SEQ ID NO: 3019326 - RNA, 19 nt, Human
cucucagauuguaccauug

SEQ ID NO: 3019327 - RNA, 15 nt, Human
cucugaaggacauug

SEQ ID NO: 3019328 - RNA, 21 nt, Human
cucuccgaccagacaccuuga

SEQ ID NO: 3019329 - RNA, 13 nt, Human
cucugcagcaaua

SEQ ID NO: 3019330 - RNA, 23 nt, Human
cucugcagcaauaaagcagcguu

SEQ ID NO: 3019331 - RNA, 18 nt, Human
cucugcagcaauaaagca

SEQ ID NO: 3019332 - RNA, 19 nt, Human
cucugcagcaauaaagcag

SEQ ID NO: 3019333 - RNA, 15 nt, Human
cucugguuaucuaau

SEQ ID NO: 3019334 - RNA, 19 nt, Human
cucugguccauagagagca

SEQ ID NO: 3019335 - RNA, 18 nt, Human
cucugguccauagagagc

SEQ ID NO: 3019336 - RNA, 16 nt, Human
cucugguccauagaga

SEQ ID NO: 3019337 - RNA, 17 nt, Human
cucugcugacagacaca

SEQ ID NO: 3019338 - RNA, 18 nt, Human
cucugcugacagacacag

SEQ ID NO: 3019339 - RNA, 19 nt, Human
cucugcugacagacacagg

SEQ ID NO: 3019340 - RNA, 15 nt, Human
cucugguccauagag

SEQ ID NO: 3019341 - RNA, 21 nt, Human
cucuguacagagcccacgccc

SEQ ID NO: 3019342 - RNA, 17 nt, Human
cucuguacagagcccac

SEQ ID NO: 3019343 - RNA, 12 nt, Human
cugacagacaca

SEQ ID NO: 3019344 - RNA, 14 nt, Human
cugacagacacagg

SEQ ID NO: 3019345 - RNA, 23 nt, Human
cugacccugcuucaaauauuucc

SEQ ID NO: 3019346 - RNA, 20 nt, Human
cugacccaugcugcccugug

SEQ ID NO: 3019347 - RNA, 19 nt, Human
cugacccaugcugcccugu

SEQ ID NO: 3019348 - RNA, 17 nt, Human
cugacccaugcugcccu

SEQ ID NO: 3019349 - RNA, 18 nt, Human
cugacccaugcugcccug

SEQ ID NO: 3019350 - RNA, 14 nt, Human
cugaaaauguaugu

SEQ ID NO: 3019351 - RNA, 16 nt, Human
cugaaaauguaugugu

SEQ ID NO: 3019352 - RNA, 19 nt, Human
cugaaggacauugcggaca

SEQ ID NO: 3019353 - RNA, 20 nt, Human
cugaaggacauugcggacag

SEQ ID NO: 3019354 - RNA, 17 nt, Human
cugaaggccccgcccag

SEQ ID NO: 3019355 - RNA, 17 nt, Human
cugaaggcuggguucug

SEQ ID NO: 3019356 - RNA, 14 nt, Human
cugaaggccccgcc

SEQ ID NO: 3019357 - RNA, 13 nt, Human
cugaaggccccgc

SEQ ID NO: 3019358 - RNA, 14 nt, Human
cucaugcugccaau

SEQ ID NO: 3019359 - RNA, 22 nt, Human
cucaugcugccaauauccuaau

SEQ ID NO: 3019360 - RNA, 12 nt, Human
cucaugcugcca

SEQ ID NO: 3019361 - RNA, 12 nt, Human
cucauguucuua

SEQ ID NO: 3019362 - RNA, 14 nt, Human
cucauguucuuaau

SEQ ID NO: 3019363 - RNA, 18 nt, Human
cucauguucuuaauucuu

SEQ ID NO: 3019364 - RNA, 19 nt, Human
cucauguucuuaauucuua

SEQ ID NO: 3019365 - RNA, 13 nt, Human
cucagugccacua

SEQ ID NO: 3019366 - RNA, 17 nt, Human
cucagucuggcccuucc

SEQ ID NO: 3019367 - RNA, 18 nt, Human
cucagucuggcccuuccu

SEQ ID NO: 3019368 - RNA, 13 nt, Human
cucaggccugggg

SEQ ID NO: 3019369 - RNA, 20 nt, Human
cucaggccugggggcugggc

SEQ ID NO: 3019370 - RNA, 14 nt, Human
cucaggccuggggg

SEQ ID NO: 3019371 - RNA, 21 nt, Human
cucaggccugggggcugggca

SEQ ID NO: 3019372 - RNA, 23 nt, Human
cucagccucccgaauagcuggga

SEQ ID NO: 3019373 - RNA, 22 nt, Human
cucagccucccaaagugcuggg

SEQ ID NO: 3019374 - RNA, 13 nt, Human
cucagccucccga

SEQ ID NO: 3019375 - RNA, 21 nt, Human
cucagccucccaaagugcugg

SEQ ID NO: 3019376 - RNA, 14 nt, Human
cucagccucccaaa

SEQ ID NO: 3019377 - RNA, 16 nt, Human
cucagccucccaaagu

SEQ ID NO: 3019378 - RNA, 13 nt, Human
cucagccucccaa

SEQ ID NO: 3019379 - RNA, 13 nt, Human
cucaggccagcug

SEQ ID NO: 3019380 - RNA, 22 nt, Human
cucaggccagcugcuugggcuu

SEQ ID NO: 3019381 - RNA, 21 nt, Human
cucaggccagcugcuugggcu

SEQ ID NO: 3019382 - RNA, 20 nt, Human
cucaggccagcugcuugggc

SEQ ID NO: 3019383 - RNA, 14 nt, Human
cucaggccagcugc

SEQ ID NO: 3019384 - RNA, 22 nt, Human
cuccagucauuauguuaauauu

SEQ ID NO: 3019385 - RNA, 11 nt, Human
cuccaggugca

SEQ ID NO: 3019386 - RNA, 20 nt, Human
cuccacuuucuagccagagg

SEQ ID NO: 3019387 - RNA, 22 nt, Human
cuccacuuucuagccagaggag

SEQ ID NO: 3019388 - RNA, 15 nt, Human
cuccaagaccuucuc

SEQ ID NO: 3019389 - RNA, 16 nt, Human
cuccaagaccuucucc

SEQ ID NO: 3019390 - RNA, 18 nt, Human
cuccaagaccuucuccuu

SEQ ID NO: 3019391 - RNA, 17 nt, Human
cuccaagaccuucuccu

SEQ ID NO: 3019392 - RNA, 18 nt, Human
cuccagaauuucccaaag

SEQ ID NO: 3019393 - RNA, 15 nt, Human
cuccagaauuuccca

SEQ ID NO: 3019394 - RNA, 19 nt, Human
cuccagacacauguccaag

SEQ ID NO: 3019395 - RNA, 17 nt, Human
cuccagacacaugucca

SEQ ID NO: 3019396 - RNA, 16 nt, Human
cuccagacacaugucc

SEQ ID NO: 3019397 - RNA, 19 nt, Human
cuccgcuuucuacccagcg

SEQ ID NO: 3019398 - RNA, 12 nt, Human
cucccaccucag

SEQ ID NO: 3019399 - RNA, 12 nt, Human
gcugaacaucac

SEQ ID NO: 3019400 - RNA, 23 nt, Human
gcucugguccauagagagcaaga

SEQ ID NO: 3019401 - RNA, 17 nt, Human
gcugaauacagaggcaa

SEQ ID NO: 3019402 - RNA, 23 nt, Human
gcugaaggcucgagcaugccugg

SEQ ID NO: 3019403 - RNA, 13 nt, Human
gcugacagacaca

SEQ ID NO: 3019404 - RNA, 20 nt, Human
gcucugaucauccacugugc

SEQ ID NO: 3019405 - RNA, 21 nt, Human
gcucugaucauccacugugcc

SEQ ID NO: 3019406 - RNA, 22 nt, Human
gcucugaucauccacugugcca

SEQ ID NO: 3019407 - RNA, 19 nt, Human
gcucucaggccagcugcuu

SEQ ID NO: 3019408 - RNA, 18 nt, Human
gcucucaggccagcugcu

SEQ ID NO: 3019409 - RNA, 17 nt, Human
gcucucaggccagcugc

SEQ ID NO: 3019410 - RNA, 19 nt, Human
gcucuacugaggugcuaug

SEQ ID NO: 3019411 - RNA, 16 nt, Human
gcuccucuccccagca

SEQ ID NO: 3019412 - RNA, 19 nt, Human
gcuccucuccccagcaagu

SEQ ID NO: 3019413 - RNA, 18 nt, Human
gcucucaaguuaucaggg

SEQ ID NO: 3019414 - RNA, 9 nt, Human
gcuccagac

SEQ ID NO: 3019415 - RNA, 23 nt, Human
gcuccagacacauguccaagaag

SEQ ID NO: 3019416 - RNA, 21 nt, Human
gcuccagacacauguccaaga

SEQ ID NO: 3019417 - RNA, 18 nt, Human
gcuccagacacaugucca

SEQ ID NO: 3019418 - RNA, 13 nt, Human
gcuccagcucacc

SEQ ID NO: 3019419 - RNA, 14 nt, Human
gcuccagcucacca

SEQ ID NO: 3019420 - RNA, 23 nt, Human
gcucccaggcauuccccaggagg

SEQ ID NO: 3019421 - RNA, 15 nt, Human
gcuccucuccccagc

SEQ ID NO: 3019422 - RNA, 18 nt, Human
gcugcugaaggcucgagc

SEQ ID NO: 3019423 - RNA, 12 nt, Human
gcugcugacagu

SEQ ID NO: 3019424 - RNA, 17 nt, Human
gcugccauccagguuca

SEQ ID NO: 3019425 - RNA, 13 nt, Human
gcugccccuggca

SEQ ID NO: 3019426 - RNA, 16 nt, Human
gcugccccuggcagcc

SEQ ID NO: 3019427 - RNA, 15 nt, Human
gcugccccuggcagc

SEQ ID NO: 3019428 - RNA, 15 nt, Human
gcugcacccucaggc

SEQ ID NO: 3019429 - RNA, 13 nt, Human
gcugcacccucag

SEQ ID NO: 3019430 - RNA, 12 nt, Human
gcugccauccag

SEQ ID NO: 3019431 - RNA, 13 nt, Human
gcugccauccagg

SEQ ID NO: 3019432 - RNA, 15 nt, Human
gcugaggugggagga

SEQ ID NO: 3019433 - RNA, 17 nt, Human
gcuuauuuccucauuuu

SEQ ID NO: 3019434 - RNA, 22 nt, Human
gcuuaauuauugauguuuucau

SEQ ID NO: 3019435 - RNA, 13 nt, Human
gcuguuggcuggg

SEQ ID NO: 3019436 - RNA, 14 nt, Human
gcuucaguggcagc

SEQ ID NO: 3019437 - RNA, 14 nt, Human
gcuucaaggauccu

SEQ ID NO: 3019438 - RNA, 17 nt, Human
gcuguacauacuuuuug

SEQ ID NO: 3019439 - RNA, 22 nt, Human
gcuguacauacuuuuuggguuu

SEQ ID NO: 3019440 - RNA, 23 nt, Human
gcugguucaggguuggccccugc

SEQ ID NO: 3019441 - RNA, 22 nt, Human
gcuggaguuauugaagcagagu

SEQ ID NO: 3019442 - RNA, 22 nt, Human
gcuuccagugaggcucugcccu

SEQ ID NO: 3019443 - RNA, 23 nt, Human
gcuuccagugaggcucugcccuu

SEQ ID NO: 3019444 - RNA, 20 nt, Human
gcuugaccgugaggccagag

SEQ ID NO: 3019445 - RNA, 15 nt, Human
gcuucuucagagacu

SEQ ID NO: 3019446 - RNA, 12 nt, Human
gcuucuucagag

SEQ ID NO: 3019447 - RNA, 23 nt, Human
gcuuucuacccagcgagcccugg

SEQ ID NO: 3019448 - RNA, 18 nt, Human
gcuuguaaauagcucagg

SEQ ID NO: 3019449 - RNA, 19 nt, Human
gcuuguaaauagcucaggu

SEQ ID NO: 3019450 - RNA, 17 nt, Human
gcuuguaaauagcucag

SEQ ID NO: 3019451 - RNA, 18 nt, Human
gcuugaccuuuaagagaa

SEQ ID NO: 3019452 - RNA, 23 nt, Human
gcuugaccgugaggccagagaca

SEQ ID NO: 3019453 - RNA, 20 nt, Human
ggaagacuucaucccucugg

SEQ ID NO: 3019454 - RNA, 17 nt, Human
ggaagacuucaucccuc

SEQ ID NO: 3019455 - RNA, 14 nt, Human
ggaaaugggcagag

SEQ ID NO: 3019456 - RNA, 22 nt, Human
ggaaaugggcagagcagagacc

SEQ ID NO: 3019457 - RNA, 18 nt, Human
ggaaaugggcagagcaga

SEQ ID NO: 3019458 - RNA, 17 nt, Human
ggaaaugggcagagcag

SEQ ID NO: 3019459 - RNA, 16 nt, Human
ggaaaugggcagagca

SEQ ID NO: 3019460 - RNA, 15 nt, Human
ggaacaaggcaaggc

SEQ ID NO: 3019461 - RNA, 21 nt, Human
ggaacaaggcaaggcugucaa

SEQ ID NO: 3019462 - RNA, 17 nt, Human
ggaacaaggcaaggcug

SEQ ID NO: 3019463 - RNA, 13 nt, Human
ggaacaccuccuc

SEQ ID NO: 3019464 - RNA, 23 nt, Human
ggaacaaggcaaggcugucaauu

SEQ ID NO: 3019465 - RNA, 15 nt, Human
ggaacacuccuucac

SEQ ID NO: 3019466 - RNA, 16 nt, Human
ggaagacaaugugaaa

SEQ ID NO: 3019467 - RNA, 14 nt, Human
ggaagacaauguga

SEQ ID NO: 3019468 - RNA, 17 nt, Human
gcuuugaucccuucuua

SEQ ID NO: 3019469 - RNA, 14 nt, Human
gcuuugaucccuuc

SEQ ID NO: 3019470 - RNA, 15 nt, Human
gcuuuuggucugugu

SEQ ID NO: 3019471 - RNA, 18 nt, Human
gcuuuugucuaugggacu

SEQ ID NO: 3019472 - RNA, 18 nt, Human
ggaaaauuuuaaaaauac

SEQ ID NO: 3019473 - RNA, 16 nt, Human
ggaaacccagcucugg

SEQ ID NO: 3019474 - RNA, 12 nt, Human
gcuuuugugcau

SEQ ID NO: 3019475 - RNA, 15 nt, Human
gcccaggaguuuggc

SEQ ID NO: 3019476 - RNA, 16 nt, Human
gcccaggaguuuggcc

SEQ ID NO: 3019477 - RNA, 13 nt, Human
gcccaggaguuug

SEQ ID NO: 3019478 - RNA, 13 nt, Human
gcccaggcagguc

SEQ ID NO: 3019479 - RNA, 12 nt, Human
gcccaggcaggu

SEQ ID NO: 3019480 - RNA, 14 nt, Human
gcccaggcaggucu

SEQ ID NO: 3019481 - RNA, 16 nt, Human
gcccaggcaggucuug

SEQ ID NO: 3019482 - RNA, 15 nt, Human
gcccaggccccugcc

SEQ ID NO: 3019483 - RNA, 13 nt, Human
gcccaggccccug

SEQ ID NO: 3019484 - RNA, 14 nt, Human
gccaugugccaggu

SEQ ID NO: 3019485 - RNA, 17 nt, Human
gcccaggaguuuggcca

SEQ ID NO: 3019486 - RNA, 17 nt, Human
gcccaggccccugccac

SEQ ID NO: 3019487 - RNA, 15 nt, Human
gccccacccucagau

SEQ ID NO: 3019488 - RNA, 18 nt, Human
gccccacccucagaugca

SEQ ID NO: 3019489 - RNA, 15 nt, Human
gccccugcccggcug

SEQ ID NO: 3019490 - RNA, 21 nt, Human
gccccugcugguucaggguug

SEQ ID NO: 3019491 - RNA, 22 nt, Human
gccccugcugguucaggguugg

SEQ ID NO: 3019492 - RNA, 15 nt, Human
gccccuggaugcagc

SEQ ID NO: 3019493 - RNA, 13 nt, Human
gccagugugacaa

SEQ ID NO: 3019494 - RNA, 13 nt, Human
gccaguugguccc

SEQ ID NO: 3019495 - RNA, 23 nt, Human
gccaguuggucccccuuccaugg

SEQ ID NO: 3019496 - RNA, 22 nt, Human
gccaguuggucccccuuccaug

SEQ ID NO: 3019497 - RNA, 21 nt, Human
gccaguuggucccccuuccau

SEQ ID NO: 3019498 - RNA, 20 nt, Human
gccaguuggucccccuucca

SEQ ID NO: 3019499 - RNA, 18 nt, Human
gccaguuggucccccuuc

SEQ ID NO: 3019500 - RNA, 16 nt, Human
gccaguuggucccccu

SEQ ID NO: 3019501 - RNA, 14 nt, Human
gccaggcccucugc

SEQ ID NO: 3019502 - RNA, 13 nt, Human
gccaggcccucug

SEQ ID NO: 3019503 - RNA, 18 nt, Human
gccaggccacaagacccu

SEQ ID NO: 3019504 - RNA, 13 nt, Human
gccaggccacaag

SEQ ID NO: 3019505 - RNA, 22 nt, Human
gccaggccagagggagugacag

SEQ ID NO: 3019506 - RNA, 15 nt, Human
gccaggccagaggga

SEQ ID NO: 3019507 - RNA, 21 nt, Human
gccaggccacaagacccuugu

SEQ ID NO: 3019508 - RNA, 23 nt, Human
gccagcaggcucucaggccagcu

SEQ ID NO: 3019509 - RNA, 13 nt, Human
gccugcuccagcu

SEQ ID NO: 3019510 - RNA, 17 nt, Human
gccugcuaauuccccag

SEQ ID NO: 3019511 - RNA, 23 nt, Human
gccugcuaauuccccagauugca

SEQ ID NO: 3019512 - RNA, 19 nt, Human
gccuccuuugugaggaagc

SEQ ID NO: 3019513 - RNA, 21 nt, Human
gccuccuuugugaggaagccg

SEQ ID NO: 3019514 - RNA, 20 nt, Human
gccuccuuugugaggaagcc

SEQ ID NO: 3019515 - RNA, 14 nt, Human
gcgugcacacacca

SEQ ID NO: 3019516 - RNA, 18 nt, Human
gcgugcacacaccagagc

SEQ ID NO: 3019517 - RNA, 20 nt, Human
gcgugguggacaugcacagc

SEQ ID NO: 3019518 - RNA, 19 nt, Human
gcuacuguccuacccaccc

SEQ ID NO: 3019519 - RNA, 20 nt, Human
gcuacuguccuacccacccu

SEQ ID NO: 3019520 - RNA, 16 nt, Human
gcuaauuuuucauuuu

SEQ ID NO: 3019521 - RNA, 17 nt, Human
gcguuucuaugacacau

SEQ ID NO: 3019522 - RNA, 13 nt, Human
gcgauucuucugc

SEQ ID NO: 3019523 - RNA, 14 nt, Human
gcgauucuucugcu

SEQ ID NO: 3019524 - RNA, 15 nt, Human
gguacacuugugaau

SEQ ID NO: 3019525 - RNA, 17 nt, Human
ggguuucuaaagcugcc

SEQ ID NO: 3019526 - RNA, 14 nt, Human
gguaacaggcagau

SEQ ID NO: 3019527 - RNA, 20 nt, Human
gguaacaggcagauacagga

SEQ ID NO: 3019528 - RNA, 13 nt, Human
gguaacaggcaga

SEQ ID NO: 3019529 - RNA, 17 nt, Human
ggguguggcgcagcaua

SEQ ID NO: 3019530 - RNA, 17 nt, Human
ggguggaugccuggugg

SEQ ID NO: 3019531 - RNA, 15 nt, Human
ggguggcaccagcag

SEQ ID NO: 3019532 - RNA, 13 nt, Human
ggguggaugccug

SEQ ID NO: 3019533 - RNA, 19 nt, Human
gggugggacacccugugau

SEQ ID NO: 3019534 - RNA, 20 nt, Human
ggguggggaccucaggccug

SEQ ID NO: 3019535 - RNA, 17 nt, Human
aaagacuaucuaaaugu

SEQ ID NO: 3019536 - RNA, 12 nt, Human
aaacuuuacuau

SEQ ID NO: 3019537 - RNA, 15 nt, Human
gguccauagagagca

SEQ ID NO: 3019538 - RNA, 17 nt, Human
aaacuuuaccuuuuuua

SEQ ID NO: 3019539 - RNA, 22 nt, Human
aaacuuuaccuuuuuuauacau

SEQ ID NO: 3019540 - RNA, 22 nt, Human
gguaugaucacggcucacugca

SEQ ID NO: 3019541 - RNA, 14 nt, Human
gguaugcaaucaaa

SEQ ID NO: 3019542 - RNA, 17 nt, Human
gguccacccaggagccc

SEQ ID NO: 3019543 - RNA, 12 nt, Human
gguccacccagg

SEQ ID NO: 3019544 - RNA, 13 nt, Human
gguccacccagga

SEQ ID NO: 3019545 - RNA, 15 nt, Human
gguccacccaggagc

SEQ ID NO: 3019546 - RNA, 16 nt, Human
gguccacccaggagcc

SEQ ID NO: 3019547 - RNA, 21 nt, Human
ggucuguuuuguguacuuuua

SEQ ID NO: 3019548 - RNA, 18 nt, Human
ggugcaaugaccuuucaa

SEQ ID NO: 3019549 - RNA, 20 nt, Human
ggugcaaugaccuuucaaua

SEQ ID NO: 3019550 - RNA, 19 nt, Human
ggugcaaugaccuuucaau

SEQ ID NO: 3019551 - RNA, 16 nt, Human
ggugcaaugaccuuuc

SEQ ID NO: 3019552 - RNA, 21 nt, Human
ggugcauuugaggucuguucu

SEQ ID NO: 3019553 - RNA, 21 nt, Human
gguggaugccugguggcagcu

SEQ ID NO: 3019554 - RNA, 14 nt, Human
gguggaugccuggu

SEQ ID NO: 3019555 - RNA, 16 nt, Human
aaagcagcguuucuau

SEQ ID NO: 3019556 - RNA, 18 nt, Human
aaagcagcguuucuauga

SEQ ID NO: 3019557 - RNA, 22 nt, Human
aaagcagcguuucuaugacaca

SEQ ID NO: 3019558 - RNA, 15 nt, Human
aaagcagcguuucua

SEQ ID NO: 3019559 - RNA, 13 nt, Human
aaagcaaaggaga

SEQ ID NO: 3019560 - RNA, 23 nt, Human
gguccuagaaauuccccacccug

SEQ ID NO: 3019561 - RNA, 23 nt, Human
gguccugcugcaguugccaguca

SEQ ID NO: 3019562 - RNA, 21 nt, Human
gguccugcugcaguugccagu

SEQ ID NO: 3019563 - RNA, 14 nt, Human
ggucggaaaacaug

SEQ ID NO: 3019564 - RNA, 17 nt, Human
ggucuacacugugcuga

SEQ ID NO: 3019565 - RNA, 13 nt, Human
ggucggaaaacau

SEQ ID NO: 3019566 - RNA, 14 nt, Human
gguccugcugcagu

SEQ ID NO: 3019567 - RNA, 11 nt, Human
gguuuauuugg

SEQ ID NO: 3019568 - RNA, 12 nt, Human
gguuucuagcau

SEQ ID NO: 3019569 - RNA, 14 nt, Human
gguuucagaaaugu

SEQ ID NO: 3019570 - RNA, 12 nt, Human
gguuucagaaau

SEQ ID NO: 3019571 - RNA, 13 nt, Human
gguuucagaaaug

SEQ ID NO: 3019572 - RNA, 21 nt, Human
gguucccuuugacgccauccc

SEQ ID NO: 3019573 - RNA, 22 nt, Human
gguucaggguuggccccugccc

SEQ ID NO: 3019574 - RNA, 18 nt, Human
gguucaggguuggccccu

SEQ ID NO: 3019575 - RNA, 21 nt, Human
gguucaggguuggccccugcc

SEQ ID NO: 3019576 - RNA, 12 nt, Human
gguucagcuugu

SEQ ID NO: 3019577 - RNA, 12 nt, Human
gguguggaagag

SEQ ID NO: 3019578 - RNA, 13 nt, Human
ggugugcucugau

SEQ ID NO: 3019579 - RNA, 21 nt, Human
ggugugcggccuuuggcuuca

SEQ ID NO: 3019580 - RNA, 18 nt, Human
gguggggcagugcuuggc

SEQ ID NO: 3019581 - RNA, 17 nt, Human
gguggggcagcuugagg

SEQ ID NO: 3019582 - RNA, 13 nt, Human
gguggggcagcuu

SEQ ID NO: 3019583 - RNA, 19 nt, Human
ggugggauccuccaggugc

SEQ ID NO: 3019584 - RNA, 20 nt, Human
ggugggaggaucucuugagc

SEQ ID NO: 3019585 - RNA, 20 nt, Human
ggugggaggauugcuugagc

SEQ ID NO: 3019586 - RNA, 15 nt, Human
ggugggauccuccag

SEQ ID NO: 3019587 - RNA, 14 nt, Human
ggugggauccucca

SEQ ID NO: 3019588 - RNA, 23 nt, Human
gguggggucacucuggcagcuca

SEQ ID NO: 3019589 - RNA, 15 nt, Human
gguggggucacucug

SEQ ID NO: 3019590 - RNA, 16 nt, Human
ggugucgggcaugaca

SEQ ID NO: 3019591 - RNA, 13 nt, Human
ggugucgggcaug

SEQ ID NO: 3019592 - RNA, 18 nt, Human
ggugugagucaccaagcc

SEQ ID NO: 3019593 - RNA, 16 nt, Human
ggugugacugaauuuc

SEQ ID NO: 3019594 - RNA, 22 nt, Human
aaauaaggaaugauauaagguu

SEQ ID NO: 3019595 - RNA, 12 nt, Human
aaauaaugugaa

SEQ ID NO: 3019596 - RNA, 13 nt, Human
aaauaaugugaaa

SEQ ID NO: 3019597 - RNA, 12 nt, Human
aaaguggugaga

SEQ ID NO: 3019598 - RNA, 21 nt, Human
aaaguuucucuuuucaaaaca

SEQ ID NO: 3019599 - RNA, 23 nt, Human
aaaguuucucuuuucaaaacauu

SEQ ID NO: 3019600 - RNA, 16 nt, Human
aaacagucucccuucc

SEQ ID NO: 3019601 - RNA, 18 nt, Human
aaacaagaccacguuucu

SEQ ID NO: 3019602 - RNA, 20 nt, Human
aaacaagaccacguuucuaa

SEQ ID NO: 3019603 - RNA, 12 nt, Human
aaacacauuuuu

SEQ ID NO: 3019604 - RNA, 16 nt, Human
aaacacauuuuucuua

SEQ ID NO: 3019605 - RNA, 12 nt, Human
ggggacagcucc

SEQ ID NO: 3019606 - RNA, 14 nt, Human
ggggacagcuccuu

SEQ ID NO: 3019607 - RNA, 20 nt, Human
ggggacagcuccuucugucc

SEQ ID NO: 3019608 - RNA, 15 nt, Human
ggggccucagugcca

SEQ ID NO: 3019609 - RNA, 21 nt, Human
gggcugcaugcgggcuuccuc

SEQ ID NO: 3019610 - RNA, 18 nt, Human
gggcugcaugcgggcuuc

SEQ ID NO: 3019611 - RNA, 10 nt, Human
gggcucagca

SEQ ID NO: 3019612 - RNA, 22 nt, Human
gggcugcaccggcuggccuggc

SEQ ID NO: 3019613 - RNA, 20 nt, Human
gggcuggguucuacccaggu

SEQ ID NO: 3019614 - RNA, 22 nt, Human
gggcuggguucuacccaggugc

SEQ ID NO: 3019615 - RNA, 19 nt, Human
gggcccuuuuucaauaacu

SEQ ID NO: 3019616 - RNA, 23 nt, Human
gggccaguuggucccccuuccau

SEQ ID NO: 3019617 - RNA, 22 nt, Human
gggccaguuggucccccuucca

SEQ ID NO: 3019618 - RNA, 18 nt, Human
gggccaguuggucccccu

SEQ ID NO: 3019619 - RNA, 14 nt, Human
gggccaguuggucc

SEQ ID NO: 3019620 - RNA, 19 nt, Human
gggccucuuaugggcuggg

SEQ ID NO: 3019621 - RNA, 20 nt, Human
gggccucuuaugggcugggu

SEQ ID NO: 3019622 - RNA, 15 nt, Human
gggccuccugugugu

SEQ ID NO: 3019623 - RNA, 13 nt, Human
gggccuccugugu

SEQ ID NO: 3019624 - RNA, 15 nt, Human
gggcgggaggauguu

SEQ ID NO: 3019625 - RNA, 18 nt, Human
gggcuaguugggcuuccu

SEQ ID NO: 3019626 - RNA, 11 nt, Human
gggccaggagc

SEQ ID NO: 3019627 - RNA, 21 nt, Human
aaaaugagccuggcaagaaug

SEQ ID NO: 3019628 - RNA, 14 nt, Human
aaaaugagccuggc

SEQ ID NO: 3019629 - RNA, 22 nt, Human
aaaagggguaggguuuaaagau

SEQ ID NO: 3019630 - RNA, 15 nt, Human
gggauuacaggugug

SEQ ID NO: 3019631 - RNA, 17 nt, Human
gggauugaaggaugcug

SEQ ID NO: 3019632 - RNA, 16 nt, Human
gggcaacccccagccu

SEQ ID NO: 3019633 - RNA, 18 nt, Human
gggcaacccccagccugc

SEQ ID NO: 3019634 - RNA, 12 nt, Human
gggcagagcaga

SEQ ID NO: 3019635 - RNA, 16 nt, Human
gggcagagcagagacc

SEQ ID NO: 3019636 - RNA, 14 nt, Human
gggcagaggaaagc

SEQ ID NO: 3019637 - RNA, 22 nt, Human
gggcagagcagagaccaucccu

SEQ ID NO: 3019638 - RNA, 17 nt, Human
gggcagagcagagacca

SEQ ID NO: 3019639 - RNA, 15 nt, Human
gggaggucgaggcag

SEQ ID NO: 3019640 - RNA, 17 nt, Human
gggagggcuccagacac

SEQ ID NO: 3019641 - RNA, 15 nt, Human
gggagggcuccagac

SEQ ID NO: 3019642 - RNA, 14 nt, Human
gggagggcuccaga

SEQ ID NO: 3019643 - RNA, 19 nt, Human
gggaggucgaggcaggagg

SEQ ID NO: 3019644 - RNA, 18 nt, Human
gggaggucgaggcaggag

SEQ ID NO: 3019645 - RNA, 18 nt, Human
gggagggcuccagacaca

SEQ ID NO: 3019646 - RNA, 17 nt, Human
gggaggucgaggcagga

SEQ ID NO: 3019647 - RNA, 19 nt, Human
gggaggccaaggugggagg

SEQ ID NO: 3019648 - RNA, 13 nt, Human
gggaaggauacaa

SEQ ID NO: 3019649 - RNA, 16 nt, Human
gggacagcuccuucug

SEQ ID NO: 3019650 - RNA, 23 nt, Human
gggacagaggggguggccuccca

SEQ ID NO: 3019651 - RNA, 22 nt, Human
gggacagaggggguggccuccc

SEQ ID NO: 3019652 - RNA, 13 nt, Human
gggacagaggggg

SEQ ID NO: 3019653 - RNA, 21 nt, Human
gggacagcuccuucuguccua

SEQ ID NO: 3019654 - RNA, 22 nt, Human
aaaacugcugacuguuuucucu

SEQ ID NO: 3019655 - RNA, 20 nt, Human
aaaacugcugacuguuuucu

SEQ ID NO: 3019656 - RNA, 23 nt, Human
aaaacugcugacuguuuucucuu

SEQ ID NO: 3019657 - RNA, 13 nt, Human
aaaagaugcuucu

SEQ ID NO: 3019658 - RNA, 14 nt, Human
aaaaaucucaaauu

SEQ ID NO: 3019659 - RNA, 15 nt, Human
aaaacaugcuacaca

SEQ ID NO: 3019660 - RNA, 21 nt, Human
aaaaccaauguucucucuucu

SEQ ID NO: 3019661 - RNA, 14 nt, Human
ggaguuuggccaga

SEQ ID NO: 3019662 - RNA, 15 nt, Human
ggaguuuggccagaa

SEQ ID NO: 3019663 - RNA, 13 nt, Human
ggaguuuggccag

SEQ ID NO: 3019664 - RNA, 15 nt, Human
ggaguucugguuccu

SEQ ID NO: 3019665 - RNA, 14 nt, Human
ggaguggccacaga

SEQ ID NO: 3019666 - RNA, 19 nt, Human
ggaucuguauguguucuau

SEQ ID NO: 3019667 - RNA, 18 nt, Human
ggaucuguauguguucua

SEQ ID NO: 3019668 - RNA, 14 nt, Human
ggauccugagccag

SEQ ID NO: 3019669 - RNA, 13 nt, Human
ggauccugagcca

SEQ ID NO: 3019670 - RNA, 14 nt, Human
ggauccuccaggug

SEQ ID NO: 3019671 - RNA, 15 nt, Human
ggauccuccaggugc

SEQ ID NO: 3019672 - RNA, 16 nt, Human
ggauggggcugcaccg

SEQ ID NO: 3019673 - RNA, 18 nt, Human
ggauggauuuccagccaa

SEQ ID NO: 3019674 - RNA, 15 nt, Human
ggagugcagugagcc

SEQ ID NO: 3019675 - RNA, 24 nt, Human
ggcacagaaaauggaagacagcuc

SEQ ID NO: 3019676 - RNA, 15 nt, Human
ggauguucugggaca

SEQ ID NO: 3019677 - RNA, 16 nt, Human
ggauguucugggacac

SEQ ID NO: 3019678 - RNA, 13 nt, Human
ggauguucuggga

SEQ ID NO: 3019679 - RNA, 14 nt, Human
ggaggugaccccag

SEQ ID NO: 3019680 - RNA, 20 nt, Human
ggaggucaaggcugcaguga

SEQ ID NO: 3019681 - RNA, 16 nt, Human
ggaggggggagguggg

SEQ ID NO: 3019682 - RNA, 19 nt, Human
ggaggaaggaaacccagcu

SEQ ID NO: 3019683 - RNA, 23 nt, Human
ggaggaaggaaacccagcucugg

SEQ ID NO: 3019684 - RNA, 20 nt, Human
ggaggaaggaaacccagcuc

SEQ ID NO: 3019685 - RNA, 11 nt, Human
ggaggccagcc

SEQ ID NO: 3019686 - RNA, 20 nt, Human
ggaggccaaggugggaggau

SEQ ID NO: 3019687 - RNA, 21 nt, Human
ggagcugccuguucagcucca

SEQ ID NO: 3019688 - RNA, 16 nt, Human
ggagcugaguggggga

SEQ ID NO: 3019689 - RNA, 12 nt, Human
ggagcugccugu

SEQ ID NO: 3019690 - RNA, 16 nt, Human
ggagccccgaggccuu

SEQ ID NO: 3019691 - RNA, 22 nt, Human
ggagccccgaggccuucucuga

SEQ ID NO: 3019692 - RNA, 11 nt, Human
ggcccaggagu

SEQ ID NO: 3019693 - RNA, 13 nt, Human
ggcccaggaguuu

SEQ ID NO: 3019694 - RNA, 18 nt, Human
ggcccaggaguuuggcca

SEQ ID NO: 3019695 - RNA, 19 nt, Human
ggcccaggaguuuggccag

SEQ ID NO: 3019696 - RNA, 20 nt, Human
ggcccaggaguuuggccaga

SEQ ID NO: 3019697 - RNA, 18 nt, Human
ggcccuucucuccagccc

SEQ ID NO: 3019698 - RNA, 14 nt, Human
ggcccuuccuuuuc

SEQ ID NO: 3019699 - RNA, 17 nt, Human
ggcccuucucuccagcc

SEQ ID NO: 3019700 - RNA, 16 nt, Human
ggcccuucucuccagc

SEQ ID NO: 3019701 - RNA, 18 nt, Human
ggcagugggagcugccug

SEQ ID NO: 3019702 - RNA, 19 nt, Human
ggcagugggagcugccugu

SEQ ID NO: 3019703 - RNA, 18 nt, Human
ggcauccaguaucuugaa

SEQ ID NO: 3019704 - RNA, 17 nt, Human
ggcagugggagcugccu

SEQ ID NO: 3019705 - RNA, 24 nt, Human
ggcacugcuuccagugaggcucug

SEQ ID NO: 3019706 - RNA, 22 nt, Human
ggcacugcuuccagugaggcuc

SEQ ID NO: 3019707 - RNA, 16 nt, Human
ggcaccagcagccugg

SEQ ID NO: 3019708 - RNA, 15 nt, Human
ggcaccagcagccug

SEQ ID NO: 3019709 - RNA, 16 nt, Human
ggccagugugacaagg

SEQ ID NO: 3019710 - RNA, 17 nt, Human
ggccaaacucaccugcc

SEQ ID NO: 3019711 - RNA, 16 nt, Human
ggccaggcuggucuca

SEQ ID NO: 3019712 - RNA, 18 nt, Human
ggccaggcuggucucaaa

SEQ ID NO: 3019713 - RNA, 12 nt, Human
ggccaggcuggu

SEQ ID NO: 3019714 - RNA, 14 nt, Human
ggccaggcuggucu

SEQ ID NO: 3019715 - RNA, 19 nt, Human
ggcgugcaguggugcgauc

SEQ ID NO: 3019716 - RNA, 14 nt, Human
ggcgugcaguggug

SEQ ID NO: 3019717 - RNA, 16 nt, Human
ggcucacugcagccuc

SEQ ID NO: 3019718 - RNA, 17 nt, Human
ggcucacugcagccuca

SEQ ID NO: 3019719 - RNA, 21 nt, Human
ggcucagcggggacagcuccu

SEQ ID NO: 3019720 - RNA, 22 nt, Human
ggcucagcggggacagcuccuu

SEQ ID NO: 3019721 - RNA, 23 nt, Human
ggcucagcggggacagcuccuuc

SEQ ID NO: 3019722 - RNA, 19 nt, Human
ggcucagcaaaagaugcuu

SEQ ID NO: 3019723 - RNA, 23 nt, Human
ggcucagcaaaagaugcuucuca

SEQ ID NO: 3019724 - RNA, 12 nt, Human
ggccugagcugg

SEQ ID NO: 3019725 - RNA, 15 nt, Human
ggccugagcugggau

SEQ ID NO: 3019726 - RNA, 14 nt, Human
ggccuuuggcuuca

SEQ ID NO: 3019727 - RNA, 15 nt, Human
ggccuucucugaagg

SEQ ID NO: 3019728 - RNA, 16 nt, Human
ggccuucucugaagga

SEQ ID NO: 3019729 - RNA, 13 nt, Human
ggccuuuggcuuc

SEQ ID NO: 3019730 - RNA, 21 nt, Human
ggccuggccagaugcaccagc

SEQ ID NO: 3019731 - RNA, 21 nt, Human
ggccugugucuaguuguuuga

SEQ ID NO: 3019732 - RNA, 12 nt, Human
ggccuucucuga

SEQ ID NO: 3019733 - RNA, 20 nt, Human
gagaagucuucuauuuauuu

SEQ ID NO: 3019734 - RNA, 21 nt, Human
gagaagucuucuauuuauuua

SEQ ID NO: 3019735 - RNA, 15 nt, Human
gagaagcggcuggca

SEQ ID NO: 3019736 - RNA, 13 nt, Human
gagaagcggcugg

SEQ ID NO: 3019737 - RNA, 12 nt, Human
gagaaggaagcc

SEQ ID NO: 3019738 - RNA, 23 nt, Human
gacuuuucuguccgagcuuugaa

SEQ ID NO: 3019739 - RNA, 21 nt, Human
gacuuuucuuuguggcuuccu

SEQ ID NO: 3019740 - RNA, 23 nt, Human
gacuuuucuuucagccaagaauu

SEQ ID NO: 3019741 - RNA, 22 nt, Human
gacuauuuuuguuuuuauuaaa

SEQ ID NO: 3019742 - RNA, 21 nt, Human
gacuauuuuuguuuuuauuaa

SEQ ID NO: 3019743 - RNA, 12 nt, Human
gacucugucuca

SEQ ID NO: 3019744 - RNA, 18 nt, Human
gacuauuuuuguuuuuau

SEQ ID NO: 3019745 - RNA, 17 nt, Human
gacuauuuuuguuuuua

SEQ ID NO: 3019746 - RNA, 13 nt, Human
gacuauuuuuguu

SEQ ID NO: 3019747 - RNA, 22 nt, Human
gacuaucuaaauguugaaagau

SEQ ID NO: 3019748 - RNA, 13 nt, Human
gagauuuacaacu

SEQ ID NO: 3019749 - RNA, 18 nt, Human
gagauugcaccacugcac

SEQ ID NO: 3019750 - RNA, 21 nt, Human
gagaugaugccaugggcccuc

SEQ ID NO: 3019751 - RNA, 22 nt, Human
gagaggcauccaguaucuugaa

SEQ ID NO: 3019752 - RNA, 14 nt, Human
gagaggcauccagu

SEQ ID NO: 3019753 - RNA, 17 nt, Human
gagacuccugcaggcag

SEQ ID NO: 3019754 - RNA, 16 nt, Human
gagacuccugcaggca

SEQ ID NO: 3019755 - RNA, 15 nt, Human
gagacuccugcaggc

SEQ ID NO: 3019756 - RNA, 14 nt, Human
gagacuccugcagg

SEQ ID NO: 3019757 - RNA, 18 nt, Human
gagcugggugucaagagg

SEQ ID NO: 3019758 - RNA, 17 nt, Human
gagcggagaaaggaagg

SEQ ID NO: 3019759 - RNA, 21 nt, Human
gagcggagaaaggaagggcug

SEQ ID NO: 3019760 - RNA, 18 nt, Human
gagcggagaaaggaaggg

SEQ ID NO: 3019761 - RNA, 20 nt, Human
gagcugccuguucagcucca

SEQ ID NO: 3019762 - RNA, 21 nt, Human
gagcugccuguucagcuccag

SEQ ID NO: 3019763 - RNA, 22 nt, Human
gagcugccuguucagcuccagc

SEQ ID NO: 3019764 - RNA, 22 nt, Human
gagccuugaacuuugaccucug

SEQ ID NO: 3019765 - RNA, 19 nt, Human
gagccuugaacuuugaccu

SEQ ID NO: 3019766 - RNA, 17 nt, Human
gagccuuccaggggugg

SEQ ID NO: 3019767 - RNA, 16 nt, Human
gagccuuccaggggug

SEQ ID NO: 3019768 - RNA, 15 nt, Human
gagccuuccaggggu

SEQ ID NO: 3019769 - RNA, 14 nt, Human
gagccuuccagggg

SEQ ID NO: 3019770 - RNA, 14 nt, Human
gagcagggcucagc

SEQ ID NO: 3019771 - RNA, 12 nt, Human
gagcaucaggcc

SEQ ID NO: 3019772 - RNA, 21 nt, Human
gagcaugccuggauggggcug

SEQ ID NO: 3019773 - RNA, 22 nt, Human
gagcaugccuggauggggcugc

SEQ ID NO: 3019774 - RNA, 20 nt, Human
gacaggguuuugccauguug

SEQ ID NO: 3019775 - RNA, 22 nt, Human
gacaggguuuugccauguuggc

SEQ ID NO: 3019776 - RNA, 11 nt, Human
gacagcuccuu

SEQ ID NO: 3019777 - RNA, 23 nt, Human
gacagcccgggcucugccuccca

SEQ ID NO: 3019778 - RNA, 22 nt, Human
gacagcccgggcucugccuccc

SEQ ID NO: 3019779 - RNA, 21 nt, Human
gacagcccgggcucugccucc

SEQ ID NO: 3019780 - RNA, 20 nt, Human
gacagcccgggcucugccuc

SEQ ID NO: 3019781 - RNA, 13 nt, Human
gacacugaugggc

SEQ ID NO: 3019782 - RNA, 15 nt, Human
gacacugaugggcaa

SEQ ID NO: 3019783 - RNA, 21 nt, Human
gacacacagcucuguccuggg

SEQ ID NO: 3019784 - RNA, 21 nt, Human
gaauuuugugcccccauguaa

SEQ ID NO: 3019785 - RNA, 23 nt, Human
gaauuuuggcugugucucccuuc

SEQ ID NO: 3019786 - RNA, 20 nt, Human
gaauuuugugcccccaugua

SEQ ID NO: 3019787 - RNA, 14 nt, Human
gacacacagcucug

SEQ ID NO: 3019788 - RNA, 13 nt, Human
gacacacagcucu

SEQ ID NO: 3019789 - RNA, 15 nt, Human
gacacacagcucugu

SEQ ID NO: 3019790 - RNA, 17 nt, Human
gacacacagcucugucc

SEQ ID NO: 3019791 - RNA, 18 nt, Human
gacacacagcucuguccu

SEQ ID NO: 3019792 - RNA, 19 nt, Human
gacacacagcucuguccug

SEQ ID NO: 3019793 - RNA, 19 nt, Human
gaauuuuggcugugucucc

SEQ ID NO: 3019794 - RNA, 22 nt, Human
gaaugaaugucagugugacuga

SEQ ID NO: 3019795 - RNA, 18 nt, Human
gaaugaaugucaguguga

SEQ ID NO: 3019796 - RNA, 14 nt, Human
gaaugaaugucagu

SEQ ID NO: 3019797 - RNA, 11 nt, Human
gaaugaauguc

SEQ ID NO: 3019798 - RNA, 15 nt, Human
gaagcucagggccug

SEQ ID NO: 3019799 - RNA, 14 nt, Human
gaagcucagggccu

SEQ ID NO: 3019800 - RNA, 23 nt, Human
gaagcucagggccuggcucaggu

SEQ ID NO: 3019801 - RNA, 21 nt, Human
gaagcucagggccuggcucag

SEQ ID NO: 3019802 - RNA, 20 nt, Human
gaagcucagggccuggcuca

SEQ ID NO: 3019803 - RNA, 19 nt, Human
gaagcucagggccuggcuc

SEQ ID NO: 3019804 - RNA, 18 nt, Human
gaagcucagggccuggcu

SEQ ID NO: 3019805 - RNA, 17 nt, Human
gaagcucagggccuggc

SEQ ID NO: 3019806 - RNA, 16 nt, Human
gaagcucagggccugg

SEQ ID NO: 3019807 - RNA, 18 nt, Human
gaagucuuuguacagaca

SEQ ID NO: 3019808 - RNA, 20 nt, Human
gaagucuuuguacagacaac

SEQ ID NO: 3019809 - RNA, 19 nt, Human
gaagucuuuguacagacaa

SEQ ID NO: 3019810 - RNA, 17 nt, Human
gaaggcucgagcaugcc

SEQ ID NO: 3019811 - RNA, 16 nt, Human
gaaggcucgagcaugc

SEQ ID NO: 3019812 - RNA, 15 nt, Human
gcacaucuguuuugu

SEQ ID NO: 3019813 - RNA, 21 nt, Human
gcacaugagcuggcgggauug

SEQ ID NO: 3019814 - RNA, 13 nt, Human
gcacaugccucuc

SEQ ID NO: 3019815 - RNA, 21 nt, Human
gcacaucagcacgauuucugu

SEQ ID NO: 3019816 - RNA, 19 nt, Human
gcacaucagcacgauuucu

SEQ ID NO: 3019817 - RNA, 20 nt, Human
gcacaucagcacgauuucug

SEQ ID NO: 3019818 - RNA, 18 nt, Human
gcaccggcuggccuggcc

SEQ ID NO: 3019819 - RNA, 23 nt, Human
gcaccggcuggccuggccccuca

SEQ ID NO: 3019820 - RNA, 21 nt, Human
gcaccggcuggccuggccccu

SEQ ID NO: 3019821 - RNA, 19 nt, Human
gcaccggcuggccuggccc

SEQ ID NO: 3019822 - RNA, 21 nt, Human
gcacaugccucucucaggcca

SEQ ID NO: 3019823 - RNA, 20 nt, Human
gcacaugccucucucaggcc

SEQ ID NO: 3019824 - RNA, 19 nt, Human
gcacaugccucucucaggc

SEQ ID NO: 3019825 - RNA, 18 nt, Human
gcacaugccucucucagg

SEQ ID NO: 3019826 - RNA, 17 nt, Human
gcacaugccucucucag

SEQ ID NO: 3019827 - RNA, 14 nt, Human
gcacaugccucucu

SEQ ID NO: 3019828 - RNA, 21 nt, Human
gcaauaaagcagcguuucuau

SEQ ID NO: 3019829 - RNA, 22 nt, Human
gcacaagcuccaagcucccagg

SEQ ID NO: 3019830 - RNA, 21 nt, Human
gcacaagcuccaagcucccag

SEQ ID NO: 3019831 - RNA, 23 nt, Human
gcacaagcuccaagcucccaggc

SEQ ID NO: 3019832 - RNA, 14 nt, Human
gcacaagcugcacc

SEQ ID NO: 3019833 - RNA, 13 nt, Human
gcaagugagagcu

SEQ ID NO: 3019834 - RNA, 12 nt, Human
gcacugacauug

SEQ ID NO: 3019835 - RNA, 20 nt, Human
gcagagcagagaccaucccu

SEQ ID NO: 3019836 - RNA, 19 nt, Human
gcagagcagagaccauccc

SEQ ID NO: 3019837 - RNA, 15 nt, Human
gcagagcagagacca

SEQ ID NO: 3019838 - RNA, 14 nt, Human
gcagagcagagacc

SEQ ID NO: 3019839 - RNA, 12 nt, Human
gcagagcagaga

SEQ ID NO: 3019840 - RNA, 24 nt, Human
gcagagcaccuuagacagucccug

SEQ ID NO: 3019841 - RNA, 19 nt, Human
gcagagcaccuuagacagu

SEQ ID NO: 3019842 - RNA, 23 nt, Human
gcagagcaccuuagacagucccu

SEQ ID NO: 3019843 - RNA, 22 nt, Human
gcagagcaccuuagacaguccc

SEQ ID NO: 3019844 - RNA, 19 nt, Human
gcaguaaaaaaugguguuu

SEQ ID NO: 3019845 - RNA, 22 nt, Human
gcaguaaaaaaugguguuuuau

SEQ ID NO: 3019846 - RNA, 21 nt, Human
gcaguacuaacauuuauuuga

SEQ ID NO: 3019847 - RNA, 15 nt, Human
gcaguacuaacauuu

SEQ ID NO: 3019848 - RNA, 18 nt, Human
gcaggcucucaggccagc

SEQ ID NO: 3019849 - RNA, 23 nt, Human
gcaggcucucaggccagcugcuu

SEQ ID NO: 3019850 - RNA, 17 nt, Human
gcagcugcgguccaccc

SEQ ID NO: 3019851 - RNA, 19 nt, Human
gcagcugcgguccacccag

SEQ ID NO: 3019852 - RNA, 22 nt, Human
gcaggcucucaggccagcugcu

SEQ ID NO: 3019853 - RNA, 20 nt, Human
gcaggcucucaggccagcug

SEQ ID NO: 3019854 - RNA, 16 nt, Human
gcauaccacuuuuguu

SEQ ID NO: 3019855 - RNA, 14 nt, Human
gcauacguacacau

SEQ ID NO: 3019856 - RNA, 17 nt, Human
gcauaccacuuuuguuc

SEQ ID NO: 3019857 - RNA, 20 nt, Human
gcauaccacuuuuguucuug

SEQ ID NO: 3019858 - RNA, 14 nt, Human
gcagccaggccaca

SEQ ID NO: 3019859 - RNA, 13 nt, Human
gcagccaggccac

SEQ ID NO: 3019860 - RNA, 16 nt, Human
gcagccacauuccuga

SEQ ID NO: 3019861 - RNA, 14 nt, Human
gcagccacuauugu

SEQ ID NO: 3019862 - RNA, 12 nt, Human
gcagccaggcca

SEQ ID NO: 3019863 - RNA, 21 nt, Human
gagugcucaguagucagacug

SEQ ID NO: 3019864 - RNA, 18 nt, Human
gagugccuuacacaaugg

SEQ ID NO: 3019865 - RNA, 16 nt, Human
gaguuguuacauuuuu

SEQ ID NO: 3019866 - RNA, 20 nt, Human
gaguuguuacauuuuuaagu

SEQ ID NO: 3019867 - RNA, 12 nt, Human
gaguuuggccag

SEQ ID NO: 3019868 - RNA, 13 nt, Human
gaguuuggccaga

SEQ ID NO: 3019869 - RNA, 20 nt, Human
gaguuugggguaugggagag

SEQ ID NO: 3019870 - RNA, 14 nt, Human
gaguuuggccagaa

SEQ ID NO: 3019871 - RNA, 13 nt, Human
gaggucuguucuu

SEQ ID NO: 3019872 - RNA, 14 nt, Human
gaggucuguucuuu

SEQ ID NO: 3019873 - RNA, 11 nt, Human
gaggugggagg

SEQ ID NO: 3019874 - RNA, 12 nt, Human
gaggugggaucc

SEQ ID NO: 3019875 - RNA, 13 nt, Human
gagucaccaagcc

SEQ ID NO: 3019876 - RNA, 14 nt, Human
gagucaccaagccc

SEQ ID NO: 3019877 - RNA, 16 nt, Human
gagucccaccuuggcu

SEQ ID NO: 3019878 - RNA, 20 nt, Human
gagucccaccuuggcugcag

SEQ ID NO: 3019879 - RNA, 11 nt, Human
gagugcaguga

SEQ ID NO: 3019880 - RNA, 12 nt, Human
gagugcagugag

SEQ ID NO: 3019881 - RNA, 24 nt, Human
gagugagcacuaaggugugcucug

SEQ ID NO: 3019882 - RNA, 13 nt, Human
gagucccaccuug

SEQ ID NO: 3019883 - RNA, 12 nt, Human
gagugagcuggu

SEQ ID NO: 3019884 - RNA, 16 nt, Human
gauacuuauuuaaaua

SEQ ID NO: 3019885 - RNA, 19 nt, Human
gauacuuauuuaaauagau

SEQ ID NO: 3019886 - RNA, 13 nt, Human
gauacuuauuuaa

SEQ ID NO: 3019887 - RNA, 14 nt, Human
gauacccaucccau

SEQ ID NO: 3019888 - RNA, 13 nt, Human
gauacccauccca

SEQ ID NO: 3019889 - RNA, 16 nt, Human
gauacuacaguuuguu

SEQ ID NO: 3019890 - RNA, 11 nt, Human
gauacuacagu

SEQ ID NO: 3019891 - RNA, 16 nt, Human
gaugagaggaaaucac

SEQ ID NO: 3019892 - RNA, 20 nt, Human
gaugaucuuugcagacaggc

SEQ ID NO: 3019893 - RNA, 21 nt, Human
gaugaucuuugcagacaggca

SEQ ID NO: 3019894 - RNA, 14 nt, Human
gaugaucuuugcag

SEQ ID NO: 3019895 - RNA, 17 nt, Human
gaucucuugagccuggg

SEQ ID NO: 3019896 - RNA, 16 nt, Human
gaucucuugagccugg

SEQ ID NO: 3019897 - RNA, 12 nt, Human
gaucucuugagc

SEQ ID NO: 3019898 - RNA, 15 nt, Human
gauauuuugcuuugu

SEQ ID NO: 3019899 - RNA, 16 nt, Human
gauauuuugcuuugug

SEQ ID NO: 3019900 - RNA, 15 nt, Human
gauauuuuuuucuuu

SEQ ID NO: 3019901 - RNA, 20 nt, Human
gauuacaggugugaaccacc

SEQ ID NO: 3019902 - RNA, 15 nt, Human
cuucacgcccuuggc

SEQ ID NO: 3019903 - RNA, 17 nt, Human
cuucacgcccuuggcca

SEQ ID NO: 3019904 - RNA, 17 nt, Human
cuucagagacuccugca

SEQ ID NO: 3019905 - RNA, 16 nt, Human
cuucaguuugcagagu

SEQ ID NO: 3019906 - RNA, 17 nt, Human
cuucaguuugcagagua

SEQ ID NO: 3019907 - RNA, 20 nt, Human
cuucagagacuccugcaggc

SEQ ID NO: 3019908 - RNA, 19 nt, Human
cuucagagacuccugcagg

SEQ ID NO: 3019909 - RNA, 18 nt, Human
cuucagagacuccugcag

SEQ ID NO: 3019910 - RNA, 21 nt, Human
cuuccagugaggcucugcccu

SEQ ID NO: 3019911 - RNA, 23 nt, Human
cuuccagugaggcucugcccuug

SEQ ID NO: 3019912 - RNA, 22 nt, Human
cuuccagugaggcucugcccuu

SEQ ID NO: 3019913 - RNA, 23 nt, Human
cuucccaccucucucacuccuug

SEQ ID NO: 3019914 - RNA, 21 nt, Human
cuucccaccucucucacuccu

SEQ ID NO: 3019915 - RNA, 11 nt, Human
cuucccaccuc

SEQ ID NO: 3019916 - RNA, 16 nt, Human
cuuauggaacacucug

SEQ ID NO: 3019917 - RNA, 13 nt, Human
cuuauggaacacu

SEQ ID NO: 3019918 - RNA, 20 nt, Human
cuuauggaacacucugagac

SEQ ID NO: 3019919 - RNA, 19 nt, Human
cuuauggaacacucugaga

SEQ ID NO: 3019920 - RNA, 17 nt, Human
cuuauggaacacucuga

SEQ ID NO: 3019921 - RNA, 21 nt, Human
cuucaccuuuguccccaccgc

SEQ ID NO: 3019922 - RNA, 22 nt, Human
cuucaccuuuguccccaccgca

SEQ ID NO: 3019923 - RNA, 19 nt, Human
cuucacggaagagccuugc

SEQ ID NO: 3019924 - RNA, 15 nt, Human
cuucacggaagagcc

SEQ ID NO: 3019925 - RNA, 12 nt, Human
cugugcugaguc

SEQ ID NO: 3019926 - RNA, 14 nt, Human
cugugcugagucug

SEQ ID NO: 3019927 - RNA, 22 nt, Human
cuucuauuuauuuauuuauuca

SEQ ID NO: 3019928 - RNA, 17 nt, Human
cuuccugcaacaccuug

SEQ ID NO: 3019929 - RNA, 18 nt, Human
cuuccucccucccucuuu

SEQ ID NO: 3019930 - RNA, 23 nt, Human
cuucugacccaugcugcccugug

SEQ ID NO: 3019931 - RNA, 20 nt, Human
cuucugacccaugcugcccu

SEQ ID NO: 3019932 - RNA, 22 nt, Human
cuucugacccaugcugcccugu

SEQ ID NO: 3019933 - RNA, 21 nt, Human
cuucugacccaugcugcccug

SEQ ID NO: 3019934 - RNA, 23 nt, Human
cuucuucagagacuccugcaggc

SEQ ID NO: 3019935 - RNA, 16 nt, Human
cuugaagacuuuucuu

SEQ ID NO: 3019936 - RNA, 18 nt, Human
cuugaauuguaaggaaug

SEQ ID NO: 3019937 - RNA, 19 nt, Human
cuugaauuguaaggaauga

SEQ ID NO: 3019938 - RNA, 14 nt, Human
cuugacagggcaca

SEQ ID NO: 3019939 - RNA, 15 nt, Human
cuugacagggcacac

SEQ ID NO: 3019940 - RNA, 13 nt, Human
cuugacagggcac

SEQ ID NO: 3019941 - RNA, 20 nt, Human
cuuggcgcugccccuggcag

SEQ ID NO: 3019942 - RNA, 12 nt, Human
cuuggcgcugcc

SEQ ID NO: 3019943 - RNA, 17 nt, Human
cuuggcgcugccccugg

SEQ ID NO: 3019944 - RNA, 14 nt, Human
cuuggcgcugcccc

SEQ ID NO: 3019945 - RNA, 20 nt, Human
gaaaaaauuuacuuuaaacu

SEQ ID NO: 3019946 - RNA, 23 nt, Human
cuuuuuuggcugcugaaggcucg

SEQ ID NO: 3019947 - RNA, 12 nt, Human
cuuuugugcauu

SEQ ID NO: 3019948 - RNA, 13 nt, Human
cuuuugugcauua

SEQ ID NO: 3019949 - RNA, 23 nt, Human
cuuuugcauauugcauacuauua

SEQ ID NO: 3019950 - RNA, 23 nt, Human
cuuuugcccacacuugggagcaa

SEQ ID NO: 3019951 - RNA, 18 nt, Human
cuuuugucuaugggacuc

SEQ ID NO: 3019952 - RNA, 18 nt, Human
gaaaagaaaaaugagccu

SEQ ID NO: 3019953 - RNA, 21 nt, Human
gaaaauggaagacagcucuua

SEQ ID NO: 3019954 - RNA, 14 nt, Human
gaaaaacugauuuu

SEQ ID NO: 3019955 - RNA, 23 nt, Human
gaaaauggacguguuaugacucc

SEQ ID NO: 3019956 - RNA, 19 nt, Human
gaaaauggacguguuauga

SEQ ID NO: 3019957 - RNA, 15 nt, Human
gaaaauguaugugua

SEQ ID NO: 3019958 - RNA, 20 nt, Human
gaaagacuaucuaaauguug

SEQ ID NO: 3019959 - RNA, 21 nt, Human
gaaaggcuccaggagcagcca

SEQ ID NO: 3019960 - RNA, 22 nt, Human
gaaaggcuccaggagcagccac

SEQ ID NO: 3019961 - RNA, 20 nt, Human
gaaaggcuccaggagcagcc

SEQ ID NO: 3019962 - RNA, 19 nt, Human
gaaaucaccgaaaacgugg

SEQ ID NO: 3019963 - RNA, 19 nt, Human
gaaagggacuuggaagcuc

SEQ ID NO: 3019964 - RNA, 20 nt, Human
gaaagggacgcuacccggga

SEQ ID NO: 3019965 - RNA, 22 nt, Human
gaaagggacuuggaagcuccgc

SEQ ID NO: 3019966 - RNA, 22 nt, Human
cuuuuaugauugccuuuuuaua

SEQ ID NO: 3019967 - RNA, 13 nt, Human
cuuuuauaaacuu

SEQ ID NO: 3019968 - RNA, 17 nt, Human
cuuugggccuggcuccc

SEQ ID NO: 3019969 - RNA, 17 nt, Human
cuuucuacccagcgagc

SEQ ID NO: 3019970 - RNA, 15 nt, Human
cuuucuagccagagg

SEQ ID NO: 3019971 - RNA, 16 nt, Human
cuuucuagccagagga

SEQ ID NO: 3019972 - RNA, 22 nt, Human
cuuuccugaggcugggcucccu

SEQ ID NO: 3019973 - RNA, 20 nt, Human
cuuucagccaagaauucuua

SEQ ID NO: 3019974 - RNA, 23 nt, Human
cuuucagccaagaauucuuaaau

SEQ ID NO: 3019975 - RNA, 23 nt, Human
cuuucaauaggaaaaacugauuu

SEQ ID NO: 3019976 - RNA, 22 nt, Human
cugguuuuaaauauuuugacuu

SEQ ID NO: 3019977 - RNA, 18 nt, Human
cuguaggaagguuaaugu

SEQ ID NO: 3019978 - RNA, 21 nt, Human
cuguaggaagguuaauguuca

SEQ ID NO: 3019979 - RNA, 18 nt, Human
cugucagccauuccuguu

SEQ ID NO: 3019980 - RNA, 17 nt, Human
cugucauuugagcaggg

SEQ ID NO: 3019981 - RNA, 18 nt, Human
cugucauuugagcagggc

SEQ ID NO: 3019982 - RNA, 16 nt, Human
cugucauuugagcagg

SEQ ID NO: 3019983 - RNA, 16 nt, Human
cugguuuguucccugu

SEQ ID NO: 3019984 - RNA, 13 nt, Human
cugucgcccaguc

SEQ ID NO: 3019985 - RNA, 15 nt, Human
cugugaagagaacca

SEQ ID NO: 3019986 - RNA, 14 nt, Human
cugugcucuggaca

SEQ ID NO: 3019987 - RNA, 19 nt, Human
cugugcucuggacaggcau

SEQ ID NO: 3019988 - RNA, 13 nt, Human
cuggccccucagg

SEQ ID NO: 3019989 - RNA, 12 nt, Human
cuggcagcucag

SEQ ID NO: 3019990 - RNA, 14 nt, Human
cuggcagcucagag

SEQ ID NO: 3019991 - RNA, 13 nt, Human
cuggcagcucaga

SEQ ID NO: 3019992 - RNA, 21 nt, Human
cuggccccucagggucccugg

SEQ ID NO: 3019993 - RNA, 20 nt, Human
cuggccccucagggucccug

SEQ ID NO: 3019994 - RNA, 18 nt, Human
cuggccccucaggguccc

SEQ ID NO: 3019995 - RNA, 17 nt, Human
cuggccccucagggucc

SEQ ID NO: 3019996 - RNA, 12 nt, Human
cugggacacagu

SEQ ID NO: 3019997 - RNA, 13 nt, Human
cugggacacaguu

SEQ ID NO: 3019998 - RNA, 23 nt, Human
cuggugacuuuccucuuuggucu

SEQ ID NO: 3019999 - RNA, 16 nt, Human
cuggguguggcgcagc

SEQ ID NO: 3020000 - RNA, 17 nt, Human
cuggguguggcgcagca

SEQ ID NO: 3020001 - RNA, 22 nt, Human
cuggguggcaccagcagccugg

SEQ ID NO: 3020002 - RNA, 23 nt, Human
cuggguggcaccagcagccugga

SEQ ID NO: 3020003 - RNA, 14 nt, Human
cuggguucacugca

SEQ ID NO: 3020004 - RNA, 15 nt, Human
cuggugacuuuccuc

SEQ ID NO: 3020005 - RNA, 21 nt, Human
cuggugacuuuccucuuuggu

SEQ ID NO: 3020006 - RNA, 20 nt, Human
cuggugacuuuccucuuugg

SEQ ID NO: 3020007 - RNA, 17 nt, Human
cugggcagaaggaagac

SEQ ID NO: 3020008 - RNA, 16 nt, Human
cuggggccgaaagaac

SEQ ID NO: 3020009 - RNA, 18 nt, Human
cugggcagaaggaagacu

SEQ ID NO: 3020010 - RNA, 16 nt, Human
cugggcagaaggaaga

SEQ ID NO: 3020011 - RNA, 18 nt, Human
cugccaauauccuaauaa

SEQ ID NO: 3020012 - RNA, 19 nt, Human
cugccaauauccuaauaaa

SEQ ID NO: 3020013 - RNA, 20 nt, Human
cugccaauauccuaauaaaa

SEQ ID NO: 3020014 - RNA, 22 nt, Human
cugccaauauccuaauaaaaag

SEQ ID NO: 3020015 - RNA, 17 nt, Human
cugccaaugggagcuca

SEQ ID NO: 3020016 - RNA, 15 nt, Human
cugccaaugggagcu

SEQ ID NO: 3020017 - RNA, 13 nt, Human
cugccaauauccu

SEQ ID NO: 3020018 - RNA, 14 nt, Human
cugccaauauccua

SEQ ID NO: 3020019 - RNA, 16 nt, Human
cugccaauauccuaau

SEQ ID NO: 3020020 - RNA, 17 nt, Human
cugccaauauccuaaua

SEQ ID NO: 3020021 - RNA, 15 nt, Human
cugcauguuugugau

SEQ ID NO: 3020022 - RNA, 13 nt, Human
cugcauguuacau

SEQ ID NO: 3020023 - RNA, 20 nt, Human
cugcauuuaaaagauacagu

SEQ ID NO: 3020024 - RNA, 22 nt, Human
cugcauuuaaaagauacaguua

SEQ ID NO: 3020025 - RNA, 18 nt, Human
cugcauuuaaaagauaca

SEQ ID NO: 3020026 - RNA, 11 nt, Human
cugccagggac

SEQ ID NO: 3020027 - RNA, 15 nt, Human
cugccagggacagag

SEQ ID NO: 3020028 - RNA, 12 nt, Human
cugccagggaca

SEQ ID NO: 3020029 - RNA, 20 nt, Human
cugccauauucuguuggcca

SEQ ID NO: 3020030 - RNA, 21 nt, Human
cugccauauucuguuggccag

SEQ ID NO: 3020031 - RNA, 22 nt, Human
cugccauauucuguuggccagu

SEQ ID NO: 3020032 - RNA, 23 nt, Human
cugccauauucuguuggccagug

SEQ ID NO: 3020033 - RNA, 12 nt, Human
cugcccugugag

SEQ ID NO: 3020034 - RNA, 18 nt, Human
cugcccugugggccccca

SEQ ID NO: 3020035 - RNA, 16 nt, Human
cugcccugugggcccc

SEQ ID NO: 3020036 - RNA, 15 nt, Human
cugcccugugggccc

SEQ ID NO: 3020037 - RNA, 13 nt, Human
cugcccugugagu

SEQ ID NO: 3020038 - RNA, 22 nt, Human
cugccccucaacucuccuccag

SEQ ID NO: 3020039 - RNA, 14 nt, Human
cugccccucaacuc

SEQ ID NO: 3020040 - RNA, 19 nt, Human
cugagacucgcgacaaugc

SEQ ID NO: 3020041 - RNA, 17 nt, Human
cugagacucgcgacaau

SEQ ID NO: 3020042 - RNA, 21 nt, Human
cugcugacagacacaggcccg

SEQ ID NO: 3020043 - RNA, 23 nt, Human
cugcugacagacacaggcccggc

SEQ ID NO: 3020044 - RNA, 15 nt, Human
cugcugacagacaca

SEQ ID NO: 3020045 - RNA, 18 nt, Human
cugcugacagacacaggc

SEQ ID NO: 3020046 - RNA, 19 nt, Human
cugcugacagacacaggcc

SEQ ID NO: 3020047 - RNA, 20 nt, Human
cugcugacagacacaggccc

SEQ ID NO: 3020048 - RNA, 13 nt, Human
cugcuuaacuuca

SEQ ID NO: 3020049 - RNA, 13 nt, Human
cugcuucagccuc

SEQ ID NO: 3020050 - RNA, 15 nt, Human
cugcuuaacuucaca

SEQ ID NO: 3020051 - RNA, 17 nt, Human
cugcuuaacuucacaua

SEQ ID NO: 3020052 - RNA, 14 nt, Human
cugcuucagccucc

SEQ ID NO: 3020053 - RNA, 16 nt, Human
cugcuucagccucccg

SEQ ID NO: 3020054 - RNA, 22 nt, Human
cugcuuuuuaaagaaugcucuu

SEQ ID NO: 3020055 - RNA, 17 nt, Human
cuggaacacuaaugagg

SEQ ID NO: 3020056 - RNA, 16 nt, Human
cuggaaauauuaagaa

SEQ ID NO: 3020057 - RNA, 14 nt, Human
cugcccugugggcc

SEQ ID NO: 3020058 - RNA, 16 nt, Human
cugcuaauuccccaga

SEQ ID NO: 3020059 - RNA, 19 nt, Human
cugccuguugggccaggag

SEQ ID NO: 3020060 - RNA, 18 nt, Human
cugccuguugggccagga

SEQ ID NO: 3020061 - RNA, 14 nt, Human
cugccuguugggcc

SEQ ID NO: 3020062 - RNA, 16 nt, Human
cugccuguugggccag

SEQ ID NO: 3020063 - RNA, 15 nt, Human
cugcuacagagcaga

SEQ ID NO: 3020064 - RNA, 23 nt, Human
cugccugggaucccucauccuca

SEQ ID NO: 3020065 - RNA, 14 nt, Human
cugccuguucagcu

SEQ ID NO: 3020066 - RNA, 15 nt, Human
cugccuguucagcuc

SEQ ID NO: 3020067 - RNA, 15 nt, Human
cugccucgaacuggc

SEQ ID NO: 3020068 - RNA, 17 nt, Human
cugccucgaacuggcug

SEQ ID NO: 3020069 - RNA, 18 nt, Human
cugccucgaacuggcugc

SEQ ID NO: 3020070 - RNA, 22 nt, Human
cugccugggaucccucauccuc

SEQ ID NO: 3020071 - RNA, 18 nt, Human
uguucacuggacacuuca

SEQ ID NO: 3020072 - RNA, 19 nt, Human
uguuaguaugaggcauuug

SEQ ID NO: 3020073 - RNA, 20 nt, Human
uguuaguaugaggcauuugu

SEQ ID NO: 3020074 - RNA, 17 nt, Human
uguuaguaugaggcauu

SEQ ID NO: 3020075 - RNA, 18 nt, Human
uguucagcuccagcucac

SEQ ID NO: 3020076 - RNA, 20 nt, Human
uguucagcuccagcucacca

SEQ ID NO: 3020077 - RNA, 21 nt, Human
uguucagcuccagcucaccag

SEQ ID NO: 3020078 - RNA, 22 nt, Human
uguucagcuccagcucaccagc

SEQ ID NO: 3020079 - RNA, 14 nt, Human
uguuacuaaguuuu

SEQ ID NO: 3020080 - RNA, 14 nt, Human
uguguggucaacau

SEQ ID NO: 3020081 - RNA, 23 nt, Human
uguguggucaacauuucucaugu

SEQ ID NO: 3020082 - RNA, 13 nt, Human
uguguuuauuguc

SEQ ID NO: 3020083 - RNA, 16 nt, Human
uguguuuauugucaaa

SEQ ID NO: 3020084 - RNA, 19 nt, Human
ugugugcacguacacacac

SEQ ID NO: 3020085 - RNA, 15 nt, Human
uguuggccaggcugg

SEQ ID NO: 3020086 - RNA, 16 nt, Human
uguuggccaggcuggu

SEQ ID NO: 3020087 - RNA, 17 nt, Human
uguuggcugggggccuc

SEQ ID NO: 3020088 - RNA, 19 nt, Human
uguuggcugggggccucag

SEQ ID NO: 3020089 - RNA, 16 nt, Human
uguucucucuucucca

SEQ ID NO: 3020090 - RNA, 15 nt, Human
uguucucucuucucc

SEQ ID NO: 3020091 - RNA, 19 nt, Human
uguucaucauccuaagcua

SEQ ID NO: 3020092 - RNA, 12 nt, Human
uguucuggcucu

SEQ ID NO: 3020093 - RNA, 16 nt, Human
uguucuggcucuucca

SEQ ID NO: 3020094 - RNA, 13 nt, Human
uguucuggcucuu

SEQ ID NO: 3020095 - RNA, 16 nt, Human
uguucucugcccucca

SEQ ID NO: 3020096 - RNA, 15 nt, Human
uguucucugcccucc

SEQ ID NO: 3020097 - RNA, 14 nt, Human
uguucucugcccuc

SEQ ID NO: 3020098 - RNA, 13 nt, Human
uguucucugcccu

SEQ ID NO: 3020099 - RNA, 23 nt, Human
uguucuuucuggcuaugcauuug

SEQ ID NO: 3020100 - RNA, 21 nt, Human
uguucuggcucuuccaggcug

SEQ ID NO: 3020101 - RNA, 20 nt, Human
uguucuggcucuuccaggcu

SEQ ID NO: 3020102 - RNA, 17 nt, Human
uguucuggcucuuccag

SEQ ID NO: 3020103 - RNA, 22 nt, Human
uuaaacuacauuagguugugaa

SEQ ID NO: 3020104 - RNA, 23 nt, Human
uuaaacuacauuagguugugaau

SEQ ID NO: 3020105 - RNA, 22 nt, Human
uuaaacuuaaucuaaauggaac

SEQ ID NO: 3020106 - RNA, 14 nt, Human
uuaaaacccaagug

SEQ ID NO: 3020107 - RNA, 20 nt, Human
uuaaauauuuugacuuguug

SEQ ID NO: 3020108 - RNA, 11 nt, Human
uuaaaugacuc

SEQ ID NO: 3020109 - RNA, 18 nt, Human
uuaaaugacucuucccuc

SEQ ID NO: 3020110 - RNA, 14 nt, Human
uuaaaugcccagcc

SEQ ID NO: 3020111 - RNA, 16 nt, Human
uuaaaugcccagcccc

SEQ ID NO: 3020112 - RNA, 15 nt, Human
uuaaaugcccagccc

SEQ ID NO: 3020113 - RNA, 18 nt, Human
uguuucuggcuuagaaca

SEQ ID NO: 3020114 - RNA, 16 nt, Human
uguuuuaagaggcagg

SEQ ID NO: 3020115 - RNA, 17 nt, Human
uguuuuaagaggcaggg

SEQ ID NO: 3020116 - RNA, 19 nt, Human
uguuuuaaggaugcuugua

SEQ ID NO: 3020117 - RNA, 22 nt, Human
uguuuuaaggaugcuuguacau

SEQ ID NO: 3020118 - RNA, 23 nt, Human
uguuuuaaggaugcuuguacaua

SEQ ID NO: 3020119 - RNA, 22 nt, Human
uuaauuaaaacacaacaucuuu

SEQ ID NO: 3020120 - RNA, 13 nt, Human
uuacacuuuaugc

SEQ ID NO: 3020121 - RNA, 20 nt, Human
uuacacuuuaugcacaaaau

SEQ ID NO: 3020122 - RNA, 12 nt, Human
uuacauuuuuaa

SEQ ID NO: 3020123 - RNA, 17 nt, Human
uuacauuuuuaagugcu

SEQ ID NO: 3020124 - RNA, 12 nt, Human
uuaacuuuuaua

SEQ ID NO: 3020125 - RNA, 13 nt, Human
uuaacuuuuauaa

SEQ ID NO: 3020126 - RNA, 13 nt, Human
uuaaaugcccagc

SEQ ID NO: 3020127 - RNA, 14 nt, Human
uuaacuuuuauaaa

SEQ ID NO: 3020128 - RNA, 20 nt, Human
uguaauaaacucauuucuag

SEQ ID NO: 3020129 - RNA, 13 nt, Human
uguacagagccca

SEQ ID NO: 3020130 - RNA, 17 nt, Human
uguacagagcccacgcc

SEQ ID NO: 3020131 - RNA, 16 nt, Human
uguacagagcccacgc

SEQ ID NO: 3020132 - RNA, 18 nt, Human
uguacagagcccacgccc

SEQ ID NO: 3020133 - RNA, 15 nt, Human
uguacgucugacagg

SEQ ID NO: 3020134 - RNA, 19 nt, Human
uguacugcauaugaaagga

SEQ ID NO: 3020135 - RNA, 22 nt, Human
uguauucucuccuguaccucuu

SEQ ID NO: 3020136 - RNA, 13 nt, Human
ugucacacacuuu

SEQ ID NO: 3020137 - RNA, 17 nt, Human
ugucacacacuuuggcu

SEQ ID NO: 3020138 - RNA, 12 nt, Human
ugucacaggcag

SEQ ID NO: 3020139 - RNA, 19 nt, Human
uguauuuuacuaauaaaau

SEQ ID NO: 3020140 - RNA, 13 nt, Human
uguccccaccgca

SEQ ID NO: 3020141 - RNA, 22 nt, Human
uguccccaccgcagacaggacc

SEQ ID NO: 3020142 - RNA, 19 nt, Human
uguccccaccgcagacagg

SEQ ID NO: 3020143 - RNA, 18 nt, Human
uguccccaccgcagacag

SEQ ID NO: 3020144 - RNA, 12 nt, Human
uguccuacucug

SEQ ID NO: 3020145 - RNA, 17 nt, Human
uguccuacucuguguca

SEQ ID NO: 3020146 - RNA, 20 nt, Human
uguccuacccacccuccuuu

SEQ ID NO: 3020147 - RNA, 17 nt, Human
uguccccgacccuugcc

SEQ ID NO: 3020148 - RNA, 16 nt, Human
uguccccgacccuugc

SEQ ID NO: 3020149 - RNA, 13 nt, Human
ugucaccugaaga

SEQ ID NO: 3020150 - RNA, 16 nt, Human
ugucauuugagcaggg

SEQ ID NO: 3020151 - RNA, 19 nt, Human
ugucauuugagcagggcuc

SEQ ID NO: 3020152 - RNA, 23 nt, Human
ugucccaaaaagaaaggagggga

SEQ ID NO: 3020153 - RNA, 23 nt, Human
ugugaaggcaggggaauguaugu

SEQ ID NO: 3020154 - RNA, 15 nt, Human
ugugacauguuuuau

SEQ ID NO: 3020155 - RNA, 12 nt, Human
ugugaggaagcc

SEQ ID NO: 3020156 - RNA, 20 nt, Human
ugugaggaagccgcuggggc

SEQ ID NO: 3020157 - RNA, 18 nt, Human
ugugaggaagccgcuggg

SEQ ID NO: 3020158 - RNA, 13 nt, Human
ugugaggaagccg

SEQ ID NO: 3020159 - RNA, 19 nt, Human
ugugagucaccaagcccag

SEQ ID NO: 3020160 - RNA, 21 nt, Human
ugugagucaccaagcccaguu

SEQ ID NO: 3020161 - RNA, 15 nt, Human
ugugagucaccaagc

SEQ ID NO: 3020162 - RNA, 17 nt, Human
ugugagucaccaagccc

SEQ ID NO: 3020163 - RNA, 14 nt, Human
ugucuuuggacccu

SEQ ID NO: 3020164 - RNA, 21 nt, Human
ugucuuuucuugcaugaggcu

SEQ ID NO: 3020165 - RNA, 16 nt, Human
ugucuuuggacccuga

SEQ ID NO: 3020166 - RNA, 21 nt, Human
ugugaaaagaaaaaugagccu

SEQ ID NO: 3020167 - RNA, 23 nt, Human
ugugaaaagaaaaaugagccugg

SEQ ID NO: 3020168 - RNA, 23 nt, Human
ugucuuuucuugcaugaggcuag

SEQ ID NO: 3020169 - RNA, 17 nt, Human
ugugcacaucuguuuug

SEQ ID NO: 3020170 - RNA, 15 nt, Human
ugugcacaucuguuu

SEQ ID NO: 3020171 - RNA, 14 nt, Human
ugugcacguacaca

SEQ ID NO: 3020172 - RNA, 16 nt, Human
ugugcauuaucuagau

SEQ ID NO: 3020173 - RNA, 19 nt, Human
ugugcauuaucuagauacu

SEQ ID NO: 3020174 - RNA, 14 nt, Human
ugugcauuaucuag

SEQ ID NO: 3020175 - RNA, 23 nt, Human
ugugcauuaucuagauacuguau

SEQ ID NO: 3020176 - RNA, 20 nt, Human
ugugcauuaucuagauacug

SEQ ID NO: 3020177 - RNA, 21 nt, Human
ugugcauuaucuagauacugu

SEQ ID NO: 3020178 - RNA, 14 nt, Human
ugugcgccuacagg

SEQ ID NO: 3020179 - RNA, 19 nt, Human
ugugcgccuacaggaguga

SEQ ID NO: 3020180 - RNA, 12 nt, Human
uguguagggcgg

SEQ ID NO: 3020181 - RNA, 22 nt, Human
ugugggcuaguugggcuuccuc

SEQ ID NO: 3020182 - RNA, 18 nt, Human
uguggacacagcucuucu

SEQ ID NO: 3020183 - RNA, 16 nt, Human
uguggacacagcucuu

SEQ ID NO: 3020184 - RNA, 19 nt, Human
uguggacacagcucuucuc

SEQ ID NO: 3020185 - RNA, 23 nt, Human
uguggcgcagcauauucaggaag

SEQ ID NO: 3020186 - RNA, 21 nt, Human
ugcuuuaccaauugaaguaaa

SEQ ID NO: 3020187 - RNA, 20 nt, Human
uggaaaaauagccugccucu

SEQ ID NO: 3020188 - RNA, 17 nt, Human
uggaaaaauagccugcc

SEQ ID NO: 3020189 - RNA, 21 nt, Human
uggaaagacuuuuccaacccu

SEQ ID NO: 3020190 - RNA, 20 nt, Human
uggaaagaguaggaagacuu

SEQ ID NO: 3020191 - RNA, 19 nt, Human
uggacaugcacagcuaaca

SEQ ID NO: 3020192 - RNA, 13 nt, Human
uggacaugcacag

SEQ ID NO: 3020193 - RNA, 14 nt, Human
uggaauaacaugua

SEQ ID NO: 3020194 - RNA, 15 nt, Human
uggaauaacauguaa

SEQ ID NO: 3020195 - RNA, 19 nt, Human
uggaauaacauguaauuaa

SEQ ID NO: 3020196 - RNA, 15 nt, Human
uggaauauauaacca

SEQ ID NO: 3020197 - RNA, 16 nt, Human
uggaauauauaaccag

SEQ ID NO: 3020198 - RNA, 17 nt, Human
uggaauaaggagaauga

SEQ ID NO: 3020199 - RNA, 12 nt, Human
uggcccaggagu

SEQ ID NO: 3020200 - RNA, 22 nt, Human
uggcccaggaguuuggccagaa

SEQ ID NO: 3020201 - RNA, 20 nt, Human
uggcccaggaguuuggccag

SEQ ID NO: 3020202 - RNA, 21 nt, Human
uggcccaggaguuuggccaga

SEQ ID NO: 3020203 - RNA, 14 nt, Human
uggcccaggaguuu

SEQ ID NO: 3020204 - RNA, 19 nt, Human
uggcccaggaguuuggcca

SEQ ID NO: 3020205 - RNA, 13 nt, Human
uggcccaggaguu

SEQ ID NO: 3020206 - RNA, 20 nt, Human
uggccagaugcaccagcccu

SEQ ID NO: 3020207 - RNA, 21 nt, Human
uggccagaugcaccagcccuu

SEQ ID NO: 3020208 - RNA, 21 nt, Human
uggcacccggccccugcuggu

SEQ ID NO: 3020209 - RNA, 13 nt, Human
uggcagcugcuuu

SEQ ID NO: 3020210 - RNA, 20 nt, Human
uggauuuaacagaaauguac

SEQ ID NO: 3020211 - RNA, 24 nt, Human
uggauuuaacagaaauguacagca

SEQ ID NO: 3020212 - RNA, 20 nt, Human
uggaggaaggaaacccagcu

SEQ ID NO: 3020213 - RNA, 18 nt, Human
uggaggaaggaaacccag

SEQ ID NO: 3020214 - RNA, 12 nt, Human
uggaggaaggaa

SEQ ID NO: 3020215 - RNA, 15 nt, Human
ugguaguuuuacagu

SEQ ID NO: 3020216 - RNA, 18 nt, Human
uggguuucuaaagcugcc

SEQ ID NO: 3020217 - RNA, 17 nt, Human
uggguuucuaaagcugc

SEQ ID NO: 3020218 - RNA, 21 nt, Human
uggguuucuaaagcugccagc

SEQ ID NO: 3020219 - RNA, 23 nt, Human
ugguauuggcuagagguucaaag

SEQ ID NO: 3020220 - RNA, 16 nt, Human
uggguaacuagggaag

SEQ ID NO: 3020221 - RNA, 19 nt, Human
ugggguuuaucagaauucu

SEQ ID NO: 3020222 - RNA, 14 nt, Human
uggguguggcgcag

SEQ ID NO: 3020223 - RNA, 22 nt, Human
uggguucuacccaggugcuagg

SEQ ID NO: 3020224 - RNA, 16 nt, Human
uggguucuacccaggu

SEQ ID NO: 3020225 - RNA, 15 nt, Human
uggguucuacccagg

SEQ ID NO: 3020226 - RNA, 16 nt, Human
ugggcuaguugggcuu

SEQ ID NO: 3020227 - RNA, 17 nt, Human
ugggcuggugucaccug

SEQ ID NO: 3020228 - RNA, 23 nt, Human
ugggcuggguucuacccaggugc

SEQ ID NO: 3020229 - RNA, 22 nt, Human
ugggcuaagugauccucccacc

SEQ ID NO: 3020230 - RNA, 16 nt, Human
ugggcagaggaaagca

SEQ ID NO: 3020231 - RNA, 17 nt, Human
ugggcuucaguggcagc

SEQ ID NO: 3020232 - RNA, 15 nt, Human
ugggcuucaguggca

SEQ ID NO: 3020233 - RNA, 12 nt, Human
ugggggugcauu

SEQ ID NO: 3020234 - RNA, 15 nt, Human
ugggggugcauuuga

SEQ ID NO: 3020235 - RNA, 18 nt, Human
ugggggcugggcagagga

SEQ ID NO: 3020236 - RNA, 17 nt, Human
ugggggcugggcagagg

SEQ ID NO: 3020237 - RNA, 20 nt, Human
ugggggaucacagccucuga

SEQ ID NO: 3020238 - RNA, 21 nt, Human
ugggggaucacagccucugaa

SEQ ID NO: 3020239 - RNA, 21 nt, Human
uggcugcuucaaggauccuga

SEQ ID NO: 3020240 - RNA, 16 nt, Human
uggcugcuucaaggau

SEQ ID NO: 3020241 - RNA, 21 nt, Human
uggcugggggccucagugcca

SEQ ID NO: 3020242 - RNA, 22 nt, Human
uggcuuccuaaaauucagugga

SEQ ID NO: 3020243 - RNA, 14 nt, Human
uggcuuuugugcau

SEQ ID NO: 3020244 - RNA, 12 nt, Human
ugggacacccug

SEQ ID NO: 3020245 - RNA, 12 nt, Human
ugggagcugccu

SEQ ID NO: 3020246 - RNA, 13 nt, Human
ugggagcugccug

SEQ ID NO: 3020247 - RNA, 14 nt, Human
ugggagcugccugu

SEQ ID NO: 3020248 - RNA, 13 nt, Human
ugggagcaaaaga

SEQ ID NO: 3020249 - RNA, 15 nt, Human
ugggcagaggaaagc

SEQ ID NO: 3020250 - RNA, 16 nt, Human
ugggauuacaggugug

SEQ ID NO: 3020251 - RNA, 13 nt, Human
ugggauccuggag

SEQ ID NO: 3020252 - RNA, 18 nt, Human
ugggauccuccaggugca

SEQ ID NO: 3020253 - RNA, 15 nt, Human
ugggagugagcuggu

SEQ ID NO: 3020254 - RNA, 14 nt, Human
ugggauccuccagg

SEQ ID NO: 3020255 - RNA, 15 nt, Human
ugggauccuccaggu

SEQ ID NO: 3020256 - RNA, 17 nt, Human
ugggagcugccuguuca

SEQ ID NO: 3020257 - RNA, 21 nt, Human
ugggagcugccuguucagcuc

SEQ ID NO: 3020258 - RNA, 22 nt, Human
ugggagcugccuguucagcucc

SEQ ID NO: 3020259 - RNA, 19 nt, Human
ugcacgcacacugucugcc

SEQ ID NO: 3020260 - RNA, 17 nt, Human
ugcacgcacacugucug

SEQ ID NO: 3020261 - RNA, 17 nt, Human
ugcaccgggccacagag

SEQ ID NO: 3020262 - RNA, 22 nt, Human
ugcaccgggccacagagaaagu

SEQ ID NO: 3020263 - RNA, 14 nt, Human
ugcaccgggccaca

SEQ ID NO: 3020264 - RNA, 15 nt, Human
ugcaccgggccacag

SEQ ID NO: 3020265 - RNA, 23 nt, Human
ugcaccggcuggccuggccccuc

SEQ ID NO: 3020266 - RNA, 19 nt, Human
ugaguccccuguuuguuuc

SEQ ID NO: 3020267 - RNA, 14 nt, Human
ugcacuuuguucug

SEQ ID NO: 3020268 - RNA, 12 nt, Human
ugcacuuuguuc

SEQ ID NO: 3020269 - RNA, 20 nt, Human
ugcagcaauaaagcagcguu

SEQ ID NO: 3020270 - RNA, 23 nt, Human
ugcagcaauaaagcagcguuucu

SEQ ID NO: 3020271 - RNA, 15 nt, Human
ugcaguugccaguca

SEQ ID NO: 3020272 - RNA, 14 nt, Human
ugcaguugccaguc

SEQ ID NO: 3020273 - RNA, 13 nt, Human
ugcaguugccagu

SEQ ID NO: 3020274 - RNA, 22 nt, Human
ugcagugguaugaucacggcuc

SEQ ID NO: 3020275 - RNA, 15 nt, Human
ugcaggcagccaggc

SEQ ID NO: 3020276 - RNA, 19 nt, Human
ugcaggcagccaggccaca

SEQ ID NO: 3020277 - RNA, 14 nt, Human
ugcaggcagccagg

SEQ ID NO: 3020278 - RNA, 13 nt, Human
ugcaggcagccag

SEQ ID NO: 3020279 - RNA, 16 nt, Human
ugcagugcuuccaagg

SEQ ID NO: 3020280 - RNA, 14 nt, Human
ugcaucaagaugug

SEQ ID NO: 3020281 - RNA, 18 nt, Human
ugccagguuuuuggucug

SEQ ID NO: 3020282 - RNA, 19 nt, Human
ugccagguuuuuggucuga

SEQ ID NO: 3020283 - RNA, 22 nt, Human
ugccagguuuuuggucugaccc

SEQ ID NO: 3020284 - RNA, 22 nt, Human
ugccacuacggaauaguuggcu

SEQ ID NO: 3020285 - RNA, 19 nt, Human
ugccacccuggggagaaag

SEQ ID NO: 3020286 - RNA, 19 nt, Human
ugccccucaacucuccucc

SEQ ID NO: 3020287 - RNA, 17 nt, Human
ugccccuggcagccccu

SEQ ID NO: 3020288 - RNA, 23 nt, Human
ugccccucaacucuccuccagag

SEQ ID NO: 3020289 - RNA, 11 nt, Human
ugcccaggcug

SEQ ID NO: 3020290 - RNA, 16 nt, Human
ugcccacucccugcaa

SEQ ID NO: 3020291 - RNA, 15 nt, Human
ugcccacucccugca

SEQ ID NO: 3020292 - RNA, 14 nt, Human
ugcccacucccugc

SEQ ID NO: 3020293 - RNA, 13 nt, Human
ugcccaccuggcc

SEQ ID NO: 3020294 - RNA, 13 nt, Human
ugcccacucccug

SEQ ID NO: 3020295 - RNA, 21 nt, Human
ugccauccagguucagcuugu

SEQ ID NO: 3020296 - RNA, 20 nt, Human
ugccauccagguucagcuug

SEQ ID NO: 3020297 - RNA, 16 nt, Human
ugcucaguagucagac

SEQ ID NO: 3020298 - RNA, 14 nt, Human
ugcuccucucccca

SEQ ID NO: 3020299 - RNA, 15 nt, Human
ugcucacauaucugu

SEQ ID NO: 3020300 - RNA, 16 nt, Human
ugcucacauaucuguc

SEQ ID NO: 3020301 - RNA, 18 nt, Human
ugcuccuuucuuguuuua

SEQ ID NO: 3020302 - RNA, 17 nt, Human
ugcuccucuccccagca

SEQ ID NO: 3020303 - RNA, 14 nt, Human
ugcugauuuaaaca

SEQ ID NO: 3020304 - RNA, 17 nt, Human
ugcugauuuaaacacau

SEQ ID NO: 3020305 - RNA, 15 nt, Human
ugcugauuuaaacac

SEQ ID NO: 3020306 - RNA, 13 nt, Human
ugcugauggugca

SEQ ID NO: 3020307 - RNA, 17 nt, Human
ugcugauggugcaauga

SEQ ID NO: 3020308 - RNA, 15 nt, Human
ugcugauggugcaau

SEQ ID NO: 3020309 - RNA, 22 nt, Human
ugcugacagacacaggcccggc

SEQ ID NO: 3020310 - RNA, 23 nt, Human
ugcugacagacacaggcccggcu

SEQ ID NO: 3020311 - RNA, 19 nt, Human
ugcugacagacacaggccc

SEQ ID NO: 3020312 - RNA, 13 nt, Human
ugcugaaggcucg

SEQ ID NO: 3020313 - RNA, 12 nt, Human
ugcugaaggcuc

SEQ ID NO: 3020314 - RNA, 13 nt, Human
ugcugcuggcugg

SEQ ID NO: 3020315 - RNA, 23 nt, Human
ugcugcaguugccagucaccccg

SEQ ID NO: 3020316 - RNA, 18 nt, Human
ugcugcaguugccaguca

SEQ ID NO: 3020317 - RNA, 16 nt, Human
ugcugcaguugccagu

SEQ ID NO: 3020318 - RNA, 23 nt, Human
ugcuaacagcaacacaaagcuuu

SEQ ID NO: 3020319 - RNA, 22 nt, Human
ugcuaacagcaacacaaagcuu

SEQ ID NO: 3020320 - RNA, 21 nt, Human
ugcuaacagcaacacaaagcu

SEQ ID NO: 3020321 - RNA, 15 nt, Human
ugcuaaaugugaaug

SEQ ID NO: 3020322 - RNA, 13 nt, Human
ugcgccuacagga

SEQ ID NO: 3020323 - RNA, 22 nt, Human
ugcgccuacaggagugagcacu

SEQ ID NO: 3020324 - RNA, 14 nt, Human
ugcgccuacaggag

SEQ ID NO: 3020325 - RNA, 16 nt, Human
ugcgccuacaggagug

SEQ ID NO: 3020326 - RNA, 14 nt, Human
ugcgaucuggguuc

SEQ ID NO: 3020327 - RNA, 15 nt, Human
ugcgaucuggguuca

SEQ ID NO: 3020328 - RNA, 19 nt, Human
ugcgaucuggguucacugc

SEQ ID NO: 3020329 - RNA, 20 nt, Human
ugcgaucuggguucacugca

SEQ ID NO: 3020330 - RNA, 21 nt, Human
ugcgaucuggguucacugcaa

SEQ ID NO: 3020331 - RNA, 18 nt, Human
ugccccuggcagccccug

SEQ ID NO: 3020332 - RNA, 20 nt, Human
ugccucgaacuggcugcaaa

SEQ ID NO: 3020333 - RNA, 18 nt, Human
ugccucgaacuggcugca

SEQ ID NO: 3020334 - RNA, 19 nt, Human
ugccucgaacuggcugcaa

SEQ ID NO: 3020335 - RNA, 18 nt, Human
ugccugggcagaaggaag

SEQ ID NO: 3020336 - RNA, 21 nt, Human
ugccugggaucccucauccuc

SEQ ID NO: 3020337 - RNA, 14 nt, Human
ugccugguggcagc

SEQ ID NO: 3020338 - RNA, 15 nt, Human
ugccugguggcagcu

SEQ ID NO: 3020339 - RNA, 16 nt, Human
ugccugguggcagcug

SEQ ID NO: 3020340 - RNA, 14 nt, Human
ucggagcccugucu

SEQ ID NO: 3020341 - RNA, 15 nt, Human
ucggagcccugucuc

SEQ ID NO: 3020342 - RNA, 23 nt, Human
ucgucacugcuuaacuucacaua

SEQ ID NO: 3020343 - RNA, 14 nt, Human
ucgcccagucugga

SEQ ID NO: 3020344 - RNA, 19 nt, Human
ucgcccagucuggaaugca

SEQ ID NO: 3020345 - RNA, 23 nt, Human
ucgcccagucuggaaugcagugg

SEQ ID NO: 3020346 - RNA, 15 nt, Human
ucggaaaacaugcua

SEQ ID NO: 3020347 - RNA, 18 nt, Human
ucggaaaacaugcuacac

SEQ ID NO: 3020348 - RNA, 17 nt, Human
ucgcaggauucuuccuc

SEQ ID NO: 3020349 - RNA, 21 nt, Human
ucgcaggauucuuccucccuc

SEQ ID NO: 3020350 - RNA, 23 nt, Human
ucgcaggauucuuccucccuccc

SEQ ID NO: 3020351 - RNA, 22 nt, Human
uccuuuucgcaggauucuuccu

SEQ ID NO: 3020352 - RNA, 18 nt, Human
uccuuuucgcaggauucu

SEQ ID NO: 3020353 - RNA, 22 nt, Human
uccuuggugucgggcaugacac

SEQ ID NO: 3020354 - RNA, 17 nt, Human
uccuuugugaggaagcc

SEQ ID NO: 3020355 - RNA, 22 nt, Human
uccuuugugaggaagccgcugg

SEQ ID NO: 3020356 - RNA, 18 nt, Human
uccuuugugaggaagccg

SEQ ID NO: 3020357 - RNA, 21 nt, Human
uccuuggugucgggcaugaca

SEQ ID NO: 3020358 - RNA, 18 nt, Human
uccuuggugucgggcaug

SEQ ID NO: 3020359 - RNA, 23 nt, Human
uccuugaaaacacuguucucugc

SEQ ID NO: 3020360 - RNA, 22 nt, Human
uccuugaaaacacuguucucug

SEQ ID NO: 3020361 - RNA, 21 nt, Human
uccuuaccagcagagcaccuu

SEQ ID NO: 3020362 - RNA, 20 nt, Human
uccuuaccagcagagcaccu

SEQ ID NO: 3020363 - RNA, 18 nt, Human
ucuaggaggucucuaaga

SEQ ID NO: 3020364 - RNA, 18 nt, Human
ucuacucuagggaaaaac

SEQ ID NO: 3020365 - RNA, 21 nt, Human
ucuacucgaguuacagacaaa

SEQ ID NO: 3020366 - RNA, 20 nt, Human
ucuacucgaguuacagacaa

SEQ ID NO: 3020367 - RNA, 12 nt, Human
ucuagggaaaaa

SEQ ID NO: 3020368 - RNA, 14 nt, Human
ucuaauauguaaca

SEQ ID NO: 3020369 - RNA, 14 nt, Human
ucucacuguugccc

SEQ ID NO: 3020370 - RNA, 15 nt, Human
ucucacuguugccca

SEQ ID NO: 3020371 - RNA, 23 nt, Human
ucucacucugucgcccagucugg

SEQ ID NO: 3020372 - RNA, 21 nt, Human
ucucacacaugagcaucaggc

SEQ ID NO: 3020373 - RNA, 20 nt, Human
ucucacugccaugccagcuu

SEQ ID NO: 3020374 - RNA, 16 nt, Human
ucucacacaugagcau

SEQ ID NO: 3020375 - RNA, 18 nt, Human
ucucaaauuucuaaaucu

SEQ ID NO: 3020376 - RNA, 13 nt, Human
ucucaaauuucua

SEQ ID NO: 3020377 - RNA, 14 nt, Human
ucucaaauuucuaa

SEQ ID NO: 3020378 - RNA, 16 nt, Human
ucucaaauuucuaaau

SEQ ID NO: 3020379 - RNA, 22 nt, Human
ucccaugagccucagcauccug

SEQ ID NO: 3020380 - RNA, 18 nt, Human
ucccucccuuccucuuuc

SEQ ID NO: 3020381 - RNA, 16 nt, Human
ucccugccaauggacu

SEQ ID NO: 3020382 - RNA, 14 nt, Human
ucccugccaaugga

SEQ ID NO: 3020383 - RNA, 20 nt, Human
ucccugcacuugcagacucu

SEQ ID NO: 3020384 - RNA, 17 nt, Human
ucccucuggggcuguuc

SEQ ID NO: 3020385 - RNA, 13 nt, Human
ucccucuggggcu

SEQ ID NO: 3020386 - RNA, 16 nt, Human
ucccuucccaccucuc

SEQ ID NO: 3020387 - RNA, 14 nt, Human
ucccuucccaccuc

SEQ ID NO: 3020388 - RNA, 21 nt, Human
ucccuucccacuggaggcaug

SEQ ID NO: 3020389 - RNA, 17 nt, Human
ucccuucccaccucucu

SEQ ID NO: 3020390 - RNA, 21 nt, Human
uccgaaagggacuuggaagcu

SEQ ID NO: 3020391 - RNA, 17 nt, Human
uccgaccagacaccuug

SEQ ID NO: 3020392 - RNA, 22 nt, Human
uccgaaagggacuuggaagcuc

SEQ ID NO: 3020393 - RNA, 21 nt, Human
uccgcuuucuacccagcgagc

SEQ ID NO: 3020394 - RNA, 12 nt, Human
uccuccucagau

SEQ ID NO: 3020395 - RNA, 13 nt, Human
uccuccaggugca

SEQ ID NO: 3020396 - RNA, 12 nt, Human
uccuccaggugc

SEQ ID NO: 3020397 - RNA, 22 nt, Human
uccuccaggugcacaagcucca

SEQ ID NO: 3020398 - RNA, 20 nt, Human
uccuccaggugcacaagcuc

SEQ ID NO: 3020399 - RNA, 18 nt, Human
uccuccaggugcacaagc

SEQ ID NO: 3020400 - RNA, 14 nt, Human
uccuccaggugcac

SEQ ID NO: 3020401 - RNA, 21 nt, Human
uccuaguuccaccaucaagcc

SEQ ID NO: 3020402 - RNA, 16 nt, Human
uccuaagcuauucagu

SEQ ID NO: 3020403 - RNA, 12 nt, Human
uccuaguuccac

SEQ ID NO: 3020404 - RNA, 18 nt, Human
uccuaagcuauucaguaa

SEQ ID NO: 3020405 - RNA, 17 nt, Human
uccuaguuccaccauca

SEQ ID NO: 3020406 - RNA, 14 nt, Human
uccuaguuccacca

SEQ ID NO: 3020407 - RNA, 21 nt, Human
uccuccuuuucacaguucucu

SEQ ID NO: 3020408 - RNA, 17 nt, Human
uccucuaggaggucucu

SEQ ID NO: 3020409 - RNA, 21 nt, Human
uccucuaggaggucucuaaga

SEQ ID NO: 3020410 - RNA, 15 nt, Human
uccucuggccugugu

SEQ ID NO: 3020411 - RNA, 13 nt, Human
uccucuguacaga

SEQ ID NO: 3020412 - RNA, 17 nt, Human
uccucugcugcuggcug

SEQ ID NO: 3020413 - RNA, 19 nt, Human
uccucuguacagagcccac

SEQ ID NO: 3020414 - RNA, 23 nt, Human
uccucuguacagagcccacgccc

SEQ ID NO: 3020415 - RNA, 17 nt, Human
uccugagccagauuuca

SEQ ID NO: 3020416 - RNA, 19 nt, Human
uccugagccagauuucacu

SEQ ID NO: 3020417 - RNA, 18 nt, Human
uccugagccagauuucac

SEQ ID NO: 3020418 - RNA, 12 nt, Human
uccugaggcugg

SEQ ID NO: 3020419 - RNA, 19 nt, Human
uccugaggcugggcucccu

SEQ ID NO: 3020420 - RNA, 17 nt, Human
uccugaggcugggcucc

SEQ ID NO: 3020421 - RNA, 16 nt, Human
uccugaggcugggcuc

SEQ ID NO: 3020422 - RNA, 15 nt, Human
uccugaggcugggcu

SEQ ID NO: 3020423 - RNA, 15 nt, Human
ucagcugcuacuacu

SEQ ID NO: 3020424 - RNA, 16 nt, Human
ucagccugcuccagcu

SEQ ID NO: 3020425 - RNA, 22 nt, Human
ucagccucccaaagugcuggga

SEQ ID NO: 3020426 - RNA, 12 nt, Human
ucagccucccga

SEQ ID NO: 3020427 - RNA, 20 nt, Human
ucagccucccgaauagcugg

SEQ ID NO: 3020428 - RNA, 15 nt, Human
ucagcuccagcucac

SEQ ID NO: 3020429 - RNA, 18 nt, Human
ucagcuccagcucaccag

SEQ ID NO: 3020430 - RNA, 21 nt, Human
ucagcuccagcucaccagccc

SEQ ID NO: 3020431 - RNA, 22 nt, Human
ucagcuccagcucaccagcccc

SEQ ID NO: 3020432 - RNA, 15 nt, Human
ucagcauccuggcac

SEQ ID NO: 3020433 - RNA, 16 nt, Human
ucagcauccuggcacc

SEQ ID NO: 3020434 - RNA, 17 nt, Human
ucagcauccuggcaccc

SEQ ID NO: 3020435 - RNA, 18 nt, Human
ucagcauccuggcacccg

SEQ ID NO: 3020436 - RNA, 12 nt, Human
ucagccucccaa

SEQ ID NO: 3020437 - RNA, 15 nt, Human
ucagcacgauuucug

SEQ ID NO: 3020438 - RNA, 16 nt, Human
ucagcacgauuucugu

SEQ ID NO: 3020439 - RNA, 17 nt, Human
ucagcacgauuucuguu

SEQ ID NO: 3020440 - RNA, 15 nt, Human
ucauacucaccucac

SEQ ID NO: 3020441 - RNA, 18 nt, Human
ucagugugacugaucucu

SEQ ID NO: 3020442 - RNA, 17 nt, Human
ucagucugauucccaag

SEQ ID NO: 3020443 - RNA, 14 nt, Human
ucagguggggcagc

SEQ ID NO: 3020444 - RNA, 18 nt, Human
ucaggugcugccauccag

SEQ ID NO: 3020445 - RNA, 20 nt, Human
ucaggugcugccauccaggu

SEQ ID NO: 3020446 - RNA, 15 nt, Human
ucagguggggcagcu

SEQ ID NO: 3020447 - RNA, 16 nt, Human
ucagguggggcagcuu

SEQ ID NO: 3020448 - RNA, 21 nt, Human
ucagguggggcagcuugaggg

SEQ ID NO: 3020449 - RNA, 17 nt, Human
ucagguggggcagcuug

SEQ ID NO: 3020450 - RNA, 15 nt, Human
ucaggugcugccauc

SEQ ID NO: 3020451 - RNA, 20 nt, Human
ucagguggggucacucuggc

SEQ ID NO: 3020452 - RNA, 17 nt, Human
ucagguggggucacucu

SEQ ID NO: 3020453 - RNA, 15 nt, Human
ucaguccauagcaga

SEQ ID NO: 3020454 - RNA, 21 nt, Human
uccacaagagcccaggccucc

SEQ ID NO: 3020455 - RNA, 19 nt, Human
uccacaagagcccaggccu

SEQ ID NO: 3020456 - RNA, 20 nt, Human
uccacaagagcccaggccuc

SEQ ID NO: 3020457 - RNA, 14 nt, Human
uccaagaagcccag

SEQ ID NO: 3020458 - RNA, 16 nt, Human
uccaagaagcccagga

SEQ ID NO: 3020459 - RNA, 15 nt, Human
uccaagaagcccagg

SEQ ID NO: 3020460 - RNA, 20 nt, Human
uccaagaccuucuccuucac

SEQ ID NO: 3020461 - RNA, 19 nt, Human
uccaagaccuucuccuuca

SEQ ID NO: 3020462 - RNA, 14 nt, Human
uccaagcaggacau

SEQ ID NO: 3020463 - RNA, 21 nt, Human
uccacccugcucuccgaccag

SEQ ID NO: 3020464 - RNA, 13 nt, Human
uccacccugcucu

SEQ ID NO: 3020465 - RNA, 14 nt, Human
uccacccugcucuc

SEQ ID NO: 3020466 - RNA, 22 nt, Human
uccacugugccaugugccaggu

SEQ ID NO: 3020467 - RNA, 14 nt, Human
uccacuuucuagcc

SEQ ID NO: 3020468 - RNA, 18 nt, Human
ucccaccucagccucccg

SEQ ID NO: 3020469 - RNA, 16 nt, Human
ucccaccucagccucc

SEQ ID NO: 3020470 - RNA, 14 nt, Human
ucccaccucucuca

SEQ ID NO: 3020471 - RNA, 18 nt, Human
ucccaccucucucacucc

SEQ ID NO: 3020472 - RNA, 17 nt, Human
ucccaccucucucacuc

SEQ ID NO: 3020473 - RNA, 19 nt, Human
ucccaccuuggcugcaggg

SEQ ID NO: 3020474 - RNA, 21 nt, Human
ucccaccuuggcugcagggag

SEQ ID NO: 3020475 - RNA, 18 nt, Human
ucccaccuuggcugcagg

SEQ ID NO: 3020476 - RNA, 20 nt, Human
ucccaccucucucacuccuu

SEQ ID NO: 3020477 - RNA, 14 nt, Human
ucccacucagucca

SEQ ID NO: 3020478 - RNA, 18 nt, Human
ucccaggcauuccccagg

SEQ ID NO: 3020479 - RNA, 17 nt, Human
ucccaggcauuccccag

SEQ ID NO: 3020480 - RNA, 15 nt, Human
ucccaugagccucag

SEQ ID NO: 3020481 - RNA, 16 nt, Human
ucccaugagccucagc

SEQ ID NO: 3020482 - RNA, 18 nt, Human
ucccaacucaccccagcc

SEQ ID NO: 3020483 - RNA, 17 nt, Human
ucccaacucaccccagc

SEQ ID NO: 3020484 - RNA, 21 nt, Human
ucccaacucaccccagcccca

SEQ ID NO: 3020485 - RNA, 19 nt, Human
ucccaacucaccccagccc

SEQ ID NO: 3020486 - RNA, 20 nt, Human
uccauagagagcaagacgcu

SEQ ID NO: 3020487 - RNA, 17 nt, Human
uccauagagagcaagac

SEQ ID NO: 3020488 - RNA, 14 nt, Human
ucuggacuaaaacu

SEQ ID NO: 3020489 - RNA, 16 nt, Human
ucuggaaugcaguggu

SEQ ID NO: 3020490 - RNA, 17 nt, Human
ucugcugcuggcugguu

SEQ ID NO: 3020491 - RNA, 15 nt, Human
ucugcugcuggcugg

SEQ ID NO: 3020492 - RNA, 14 nt, Human
ucugcugcuggcug

SEQ ID NO: 3020493 - RNA, 13 nt, Human
ucugcugcuggcu

SEQ ID NO: 3020494 - RNA, 11 nt, Human
ucugcugcugg

SEQ ID NO: 3020495 - RNA, 21 nt, Human
ucugcuccucuccccagcaag

SEQ ID NO: 3020496 - RNA, 16 nt, Human
ucugccugcccaggcc

SEQ ID NO: 3020497 - RNA, 17 nt, Human
ucugccugcccaggccc

SEQ ID NO: 3020498 - RNA, 18 nt, Human
ucugccugcccaggcccc

SEQ ID NO: 3020499 - RNA, 20 nt, Human
ucugccugcccaggccccug

SEQ ID NO: 3020500 - RNA, 16 nt, Human
ucuggugacuuuccuc

SEQ ID NO: 3020501 - RNA, 20 nt, Human
ucuguccuacucugugucag

SEQ ID NO: 3020502 - RNA, 15 nt, Human
ucuguacagagccca

SEQ ID NO: 3020503 - RNA, 14 nt, Human
ucuguacagagccc

SEQ ID NO: 3020504 - RNA, 12 nt, Human
ucuguccuggga

SEQ ID NO: 3020505 - RNA, 17 nt, Human
ucugucgcccagucugg

SEQ ID NO: 3020506 - RNA, 16 nt, Human
ucugucgcccagucug

SEQ ID NO: 3020507 - RNA, 13 nt, Human
ucugucuaggaau

SEQ ID NO: 3020508 - RNA, 18 nt, Human
ucugagaggacuuuucuu

SEQ ID NO: 3020509 - RNA, 23 nt, Human
ucugacccaugcugcccugugag

SEQ ID NO: 3020510 - RNA, 22 nt, Human
ucugacccaugcugcccuguga

SEQ ID NO: 3020511 - RNA, 20 nt, Human
ucugacccaugcugcccugu

SEQ ID NO: 3020512 - RNA, 19 nt, Human
ucugacccaugcugcccug

SEQ ID NO: 3020513 - RNA, 22 nt, Human
ucugaggaauccagacccggcu

SEQ ID NO: 3020514 - RNA, 18 nt, Human
ucugaggaauccagaccc

SEQ ID NO: 3020515 - RNA, 21 nt, Human
ucugaggaauccagacccggc

SEQ ID NO: 3020516 - RNA, 21 nt, Human
ucugcaagaauugaagcagga

SEQ ID NO: 3020517 - RNA, 13 nt, Human
ucugcacuccccu

SEQ ID NO: 3020518 - RNA, 15 nt, Human
ucugccucugacaca

SEQ ID NO: 3020519 - RNA, 18 nt, Human
ucugccucugacacacag

SEQ ID NO: 3020520 - RNA, 21 nt, Human
ucugccucccaucacccgcua

SEQ ID NO: 3020521 - RNA, 20 nt, Human
ucugccucccaucacccgcu

SEQ ID NO: 3020522 - RNA, 17 nt, Human
ucugccucccaucaccc

SEQ ID NO: 3020523 - RNA, 16 nt, Human
ucugccucccaucacc

SEQ ID NO: 3020524 - RNA, 23 nt, Human
ucugccucugacacacagcucug

SEQ ID NO: 3020525 - RNA, 21 nt, Human
ucugccucugacacacagcuc

SEQ ID NO: 3020526 - RNA, 22 nt, Human
ucugccucugacacacagcucu

SEQ ID NO: 3020527 - RNA, 19 nt, Human
ucugccugaagucacacag

SEQ ID NO: 3020528 - RNA, 20 nt, Human
ucugccugaagucacacagu

SEQ ID NO: 3020529 - RNA, 18 nt, Human
ucugccauauucuguugg

SEQ ID NO: 3020530 - RNA, 12 nt, Human
ucugcccacucc

SEQ ID NO: 3020531 - RNA, 22 nt, Human
ucugccauauucuguuggccag

SEQ ID NO: 3020532 - RNA, 23 nt, Human
ucugccauauucuguuggccagu

SEQ ID NO: 3020533 - RNA, 14 nt, Human
ucugcccacucccu

SEQ ID NO: 3020534 - RNA, 13 nt, Human
ucugcccacuccc

SEQ ID NO: 3020535 - RNA, 12 nt, Human
ucugccucccau

SEQ ID NO: 3020536 - RNA, 15 nt, Human
ucugccucccaucac

SEQ ID NO: 3020537 - RNA, 13 nt, Human
ucugccucccauc

SEQ ID NO: 3020538 - RNA, 20 nt, Human
ugaaacacugguuuuaaaua

SEQ ID NO: 3020539 - RNA, 15 nt, Human
ugaaacacugguuuu

SEQ ID NO: 3020540 - RNA, 12 nt, Human
ugaaaauuuuga

SEQ ID NO: 3020541 - RNA, 14 nt, Human
ugaaaauucagugg

SEQ ID NO: 3020542 - RNA, 15 nt, Human
ugaaaagaaaaauga

SEQ ID NO: 3020543 - RNA, 19 nt, Human
ugaaaagaaaaaugagccu

SEQ ID NO: 3020544 - RNA, 22 nt, Human
ugaaaagaaaaaugagccuggc

SEQ ID NO: 3020545 - RNA, 20 nt, Human
ugaaaagaaaaaugagccug

SEQ ID NO: 3020546 - RNA, 23 nt, Human
ugaaaacacuguucucugcccuc

SEQ ID NO: 3020547 - RNA, 22 nt, Human
ugaaaacacuguucucugcccu

SEQ ID NO: 3020548 - RNA, 21 nt, Human
ugaaaacacuguucucugccc

SEQ ID NO: 3020549 - RNA, 20 nt, Human
ugaaaacacuguucucugcc

SEQ ID NO: 3020550 - RNA, 17 nt, Human
ugaaaacacuguucucu

SEQ ID NO: 3020551 - RNA, 20 nt, Human
ugaaaacacauuuuucuuag

SEQ ID NO: 3020552 - RNA, 21 nt, Human
ugaaaacacauuuuucuuagg

SEQ ID NO: 3020553 - RNA, 13 nt, Human
ucuuugcagacag

SEQ ID NO: 3020554 - RNA, 23 nt, Human
ucuuugagugaagcugggagaac

SEQ ID NO: 3020555 - RNA, 14 nt, Human
ucuuugcagacagg

SEQ ID NO: 3020556 - RNA, 17 nt, Human
ucuuugcagacaggcaa

SEQ ID NO: 3020557 - RNA, 13 nt, Human
ucuuuggacccug

SEQ ID NO: 3020558 - RNA, 15 nt, Human
ucuuuggacccugag

SEQ ID NO: 3020559 - RNA, 14 nt, Human
ucuuuggacccuga

SEQ ID NO: 3020560 - RNA, 16 nt, Human
ucuuuggacccugagg

SEQ ID NO: 3020561 - RNA, 13 nt, Human
ucuuguguguuua

SEQ ID NO: 3020562 - RNA, 23 nt, Human
ucuuuccaaaguacacuguuuca

SEQ ID NO: 3020563 - RNA, 13 nt, Human
ucuuucccucccu

SEQ ID NO: 3020564 - RNA, 23 nt, Human
ucuuucccucccuuccucuuucc

SEQ ID NO: 3020565 - RNA, 17 nt, Human
ucuuuccaaaguacacu

SEQ ID NO: 3020566 - RNA, 12 nt, Human
ucuuucccuccc

SEQ ID NO: 3020567 - RNA, 18 nt, Human
ucuucaguuugcagagua

SEQ ID NO: 3020568 - RNA, 17 nt, Human
ucuucaguuugcagagu

SEQ ID NO: 3020569 - RNA, 14 nt, Human
ucuucagaucucua

SEQ ID NO: 3020570 - RNA, 21 nt, Human
ucuucagagacuccugcaggc

SEQ ID NO: 3020571 - RNA, 22 nt, Human
ucuuauccaacaucaacaucuu

SEQ ID NO: 3020572 - RNA, 15 nt, Human
ucuuagauguauaua

SEQ ID NO: 3020573 - RNA, 14 nt, Human
ucuuagauguauau

SEQ ID NO: 3020574 - RNA, 17 nt, Human
ucugugucagguggggc

SEQ ID NO: 3020575 - RNA, 20 nt, Human
ucugugucagguggggcagc

SEQ ID NO: 3020576 - RNA, 23 nt, Human
ucuuagguuggcaaaaaggcagg

SEQ ID NO: 3020577 - RNA, 20 nt, Human
ucuuagguuggcaaaaaggc

SEQ ID NO: 3020578 - RNA, 20 nt, Human
ucuugaaauauaggaacuua

SEQ ID NO: 3020579 - RNA, 21 nt, Human
ucuugaaauauaggaacuuaa

SEQ ID NO: 3020580 - RNA, 15 nt, Human
ucuugcaugaggcua

SEQ ID NO: 3020581 - RNA, 22 nt, Human
ucuugaagacuuuucuuucagc

SEQ ID NO: 3020582 - RNA, 13 nt, Human
ucuugaagacuuu

SEQ ID NO: 3020583 - RNA, 15 nt, Human
ucuugcucugcugac

SEQ ID NO: 3020584 - RNA, 23 nt, Human
ucuugcucugcugacagacacag

SEQ ID NO: 3020585 - RNA, 14 nt, Human
ucuugcucugcuga

SEQ ID NO: 3020586 - RNA, 15 nt, Human
ugacucuucccucaa

SEQ ID NO: 3020587 - RNA, 14 nt, Human
ugaccauucuccac

SEQ ID NO: 3020588 - RNA, 13 nt, Human
ugaccauucucca

SEQ ID NO: 3020589 - RNA, 21 nt, Human
ugacucuuucuauuguuucuu

SEQ ID NO: 3020590 - RNA, 16 nt, Human
ugacuuuccucuuugg

SEQ ID NO: 3020591 - RNA, 14 nt, Human
ugagaccaaccugg

SEQ ID NO: 3020592 - RNA, 18 nt, Human
ugagaggggaacagacug

SEQ ID NO: 3020593 - RNA, 14 nt, Human
ugagaggggaacag

SEQ ID NO: 3020594 - RNA, 22 nt, Human
ugacuuuucuguccgagcuuug

SEQ ID NO: 3020595 - RNA, 15 nt, Human
ugagaaauaaaguuu

SEQ ID NO: 3020596 - RNA, 19 nt, Human
ugagcucaggaguuugaga

SEQ ID NO: 3020597 - RNA, 11 nt, Human
ugagcucagga

SEQ ID NO: 3020598 - RNA, 23 nt, Human
ugagccgagaucacgccacugca

SEQ ID NO: 3020599 - RNA, 20 nt, Human
ugagcagggcucagcgggga

SEQ ID NO: 3020600 - RNA, 22 nt, Human
ugagcagggcucagcggggaca

SEQ ID NO: 3020601 - RNA, 23 nt, Human
ugagcagggcucagcggggacag

SEQ ID NO: 3020602 - RNA, 22 nt, Human
ugagccgagaucacgccacugc

SEQ ID NO: 3020603 - RNA, 22 nt, Human
ugaggaugaaaaaauaacacug

SEQ ID NO: 3020604 - RNA, 21 nt, Human
ugaggugggaggaucucuuga

SEQ ID NO: 3020605 - RNA, 21 nt, Human
ugaggcugggcucccuuccca

SEQ ID NO: 3020606 - RNA, 18 nt, Human
ugaggucagagccugcag

SEQ ID NO: 3020607 - RNA, 19 nt, Human
ugaggucagagccugcagu

SEQ ID NO: 3020608 - RNA, 15 nt, Human
ugaggcucugcccuu

SEQ ID NO: 3020609 - RNA, 16 nt, Human
ugaggcucugcccuug

SEQ ID NO: 3020610 - RNA, 18 nt, Human
ugaggcucugcccuuggu

SEQ ID NO: 3020611 - RNA, 16 nt, Human
ugaggcugggcucccu

SEQ ID NO: 3020612 - RNA, 15 nt, Human
ugaggcugggcuccc

SEQ ID NO: 3020613 - RNA, 20 nt, Human
ugaaugcagguuuuaucaga

SEQ ID NO: 3020614 - RNA, 18 nt, Human
ugaaugcagguuuuauca

SEQ ID NO: 3020615 - RNA, 23 nt, Human
ugaaugaugauccuaggcauuug

SEQ ID NO: 3020616 - RNA, 21 nt, Human
ugaaggcuggguucugauccu

SEQ ID NO: 3020617 - RNA, 20 nt, Human
ugaaggcuggguucugaucc

SEQ ID NO: 3020618 - RNA, 21 nt, Human
ugaaacacugguuuuaaauau

SEQ ID NO: 3020619 - RNA, 23 nt, Human
ugaacuggguacuuguggacaca

SEQ ID NO: 3020620 - RNA, 19 nt, Human
ugaagacucauucuucugu

SEQ ID NO: 3020621 - RNA, 20 nt, Human
ugaagacucauucuucugua

SEQ ID NO: 3020622 - RNA, 18 nt, Human
ugaaggccccgcccaggc

SEQ ID NO: 3020623 - RNA, 16 nt, Human
ugaaggcuggguucug

SEQ ID NO: 3020624 - RNA, 20 nt, Human
ugaaggccccgcccaggcuu

SEQ ID NO: 3020625 - RNA, 19 nt, Human
ugaaggccccgcccaggcu

SEQ ID NO: 3020626 - RNA, 13 nt, Human
ugacaacacucau

SEQ ID NO: 3020627 - RNA, 23 nt, Human
ugacaacacucauugaccugagg

SEQ ID NO: 3020628 - RNA, 21 nt, Human
ugaauuguaaggaaugauuaa

SEQ ID NO: 3020629 - RNA, 13 nt, Human
ugaauuguaagga

SEQ ID NO: 3020630 - RNA, 15 nt, Human
ugacacacagcucug

SEQ ID NO: 3020631 - RNA, 14 nt, Human
ugacacacagcucu

SEQ ID NO: 3020632 - RNA, 14 nt, Human
ugacagacacaggc

SEQ ID NO: 3020633 - RNA, 16 nt, Human
ugacagacacaggccc

SEQ ID NO: 3020634 - RNA, 13 nt, Human
ugacagacacagg

SEQ ID NO: 3020635 - RNA, 23 nt, Human
ugacaaggauugcuacuguccua

SEQ ID NO: 3020636 - RNA, 23 nt, Human
ugacaucaacugcaucaagaugu

SEQ ID NO: 3020637 - RNA, 22 nt, Human
ugacagagcaagugagacccug

SEQ ID NO: 3020638 - RNA, 17 nt, Human
ugacagacacaggcccg

SEQ ID NO: 3020639 - RNA, 18 nt, Human
ugacagacacaggcccgg

SEQ ID NO: 3020640 - RNA, 20 nt, Human
ugaccagcaccaucucuccu

SEQ ID NO: 3020641 - RNA, 18 nt, Human
uacuaacauuuauuugag

SEQ ID NO: 3020642 - RNA, 13 nt, Human
uacuaacuuuccu

SEQ ID NO: 3020643 - RNA, 17 nt, Human
uacuaacauuuauuuga

SEQ ID NO: 3020644 - RNA, 14 nt, Human
uacuaaggaaucuu

SEQ ID NO: 3020645 - RNA, 20 nt, Human
uacuaauagacaauuuauua

SEQ ID NO: 3020646 - RNA, 21 nt, Human
uacuaauagacaauuuauuau

SEQ ID NO: 3020647 - RNA, 22 nt, Human
uaccuuuuuuauacauaaacaa

SEQ ID NO: 3020648 - RNA, 17 nt, Human
uaccuuuuuuauacaua

SEQ ID NO: 3020649 - RNA, 13 nt, Human
uaccuuuuuuaua

SEQ ID NO: 3020650 - RNA, 16 nt, Human
uaccuuuuuuauacau

SEQ ID NO: 3020651 - RNA, 21 nt, Human
uacgaaaagaggggaagagac

SEQ ID NO: 3020652 - RNA, 18 nt, Human
uacgaaaagaggggaaga

SEQ ID NO: 3020653 - RNA, 18 nt, Human
uaccucggugccuuccuc

SEQ ID NO: 3020654 - RNA, 13 nt, Human
uaccuuuuuuaga

SEQ ID NO: 3020655 - RNA, 19 nt, Human
uaccuuuuuuagaguugau

SEQ ID NO: 3020656 - RNA, 22 nt, Human
uaccuuuuuuagaguugauacu

SEQ ID NO: 3020657 - RNA, 15 nt, Human
uaccuacauacaauu

SEQ ID NO: 3020658 - RNA, 23 nt, Human
uacauuuuuaagugcugcauuua

SEQ ID NO: 3020659 - RNA, 15 nt, Human
uacccacugcucugg

SEQ ID NO: 3020660 - RNA, 13 nt, Human
uacuacaguuugu

SEQ ID NO: 3020661 - RNA, 14 nt, Human
uacuacaguuuguu

SEQ ID NO: 3020662 - RNA, 22 nt, Human
uacuacaguccucccaucucac

SEQ ID NO: 3020663 - RNA, 18 nt, Human
uacucgaguuacagacaa

SEQ ID NO: 3020664 - RNA, 22 nt, Human
uacucgaguuacagacaaagcg

SEQ ID NO: 3020665 - RNA, 17 nt, Human
uacugcauaugaaagga

SEQ ID NO: 3020666 - RNA, 13 nt, Human
uacuuguggacac

SEQ ID NO: 3020667 - RNA, 21 nt, Human
uacugucuucaguaagccgug

SEQ ID NO: 3020668 - RNA, 16 nt, Human
uacuguccuacccacc

SEQ ID NO: 3020669 - RNA, 19 nt, Human
uacaugccuaccaauauuu

SEQ ID NO: 3020670 - RNA, 16 nt, Human
uacaugccuaccaaua

SEQ ID NO: 3020671 - RNA, 14 nt, Human
uacauuuuuaagug

SEQ ID NO: 3020672 - RNA, 19 nt, Human
uacauuuuuaagugcugca

SEQ ID NO: 3020673 - RNA, 22 nt, Human
uacauuuuuaagugcugcauuu

SEQ ID NO: 3020674 - RNA, 14 nt, Human
uacauggaauaaca

SEQ ID NO: 3020675 - RNA, 18 nt, Human
uacauggaauaacaugua

SEQ ID NO: 3020676 - RNA, 19 nt, Human
uacauggaauaacauguaa

SEQ ID NO: 3020677 - RNA, 22 nt, Human
uacauggaauaacauguaauua

SEQ ID NO: 3020678 - RNA, 16 nt, Human
uacaugaaaacacauu

SEQ ID NO: 3020679 - RNA, 16 nt, Human
uacauaagauaaaugu

SEQ ID NO: 3020680 - RNA, 17 nt, Human
uacauaagauaaaugug

SEQ ID NO: 3020681 - RNA, 17 nt, Human
uacaugaaaacacauuu

SEQ ID NO: 3020682 - RNA, 18 nt, Human
uacaugaaaacacauuuu

SEQ ID NO: 3020683 - RNA, 19 nt, Human
uacaugaaaacacauuuuu

SEQ ID NO: 3020684 - RNA, 23 nt, Human
uacaugaaaacacauuuuucuua

SEQ ID NO: 3020685 - RNA, 16 nt, Human
uacauaaacaaguccu

SEQ ID NO: 3020686 - RNA, 19 nt, Human
uacaguuuguuaguaugag

SEQ ID NO: 3020687 - RNA, 21 nt, Human
uacaguuuguuaguaugaggc

SEQ ID NO: 3020688 - RNA, 20 nt, Human
uacacuguuucaaacuuuac

SEQ ID NO: 3020689 - RNA, 23 nt, Human
uacacugugcugagucugaaggc

SEQ ID NO: 3020690 - RNA, 22 nt, Human
uacacugugcugagucugaagg

SEQ ID NO: 3020691 - RNA, 22 nt, Human
uacacuguuucaaacuuuacua

SEQ ID NO: 3020692 - RNA, 16 nt, Human
uacacuuacacuuuau

SEQ ID NO: 3020693 - RNA, 20 nt, Human
uacagcuugaccgugaggcc

SEQ ID NO: 3020694 - RNA, 13 nt, Human
uacaggaaguacu

SEQ ID NO: 3020695 - RNA, 18 nt, Human
uacaggaagguagaaaua

SEQ ID NO: 3020696 - RNA, 18 nt, Human
uacaguuuguuaguauga

SEQ ID NO: 3020697 - RNA, 20 nt, Human
uacaguugaaaaacagcuga

SEQ ID NO: 3020698 - RNA, 19 nt, Human
uacaguugaaaaacagcug

SEQ ID NO: 3020699 - RNA, 17 nt, Human
uacaguugaaaaacagc

SEQ ID NO: 3020700 - RNA, 15 nt, Human
uacaggagugagcac

SEQ ID NO: 3020701 - RNA, 22 nt, Human
uacaggaaguacuggagaaaau

SEQ ID NO: 3020702 - RNA, 15 nt, Human
uacaggaaguacugg

SEQ ID NO: 3020703 - RNA, 14 nt, Human
uacaggaaguacug

SEQ ID NO: 3020704 - RNA, 18 nt, Human
uaauuccuguuuuuauua

SEQ ID NO: 3020705 - RNA, 14 nt, Human
uacaaaguagaagu

SEQ ID NO: 3020706 - RNA, 18 nt, Human
uacaaaguagaagucuua

SEQ ID NO: 3020707 - RNA, 11 nt, Human
uacacacacac

SEQ ID NO: 3020708 - RNA, 23 nt, Human
uacacaaugguuuucuugugugu

SEQ ID NO: 3020709 - RNA, 21 nt, Human
uacacugugcugagucugaag

SEQ ID NO: 3020710 - RNA, 15 nt, Human
uacacacugcauguu

SEQ ID NO: 3020711 - RNA, 19 nt, Human
uagaauguuuucaaauguu

SEQ ID NO: 3020712 - RNA, 23 nt, Human
uagaauuaguggcacuugcuuuu

SEQ ID NO: 3020713 - RNA, 18 nt, Human
uagaauguuuucaaaugu

SEQ ID NO: 3020714 - RNA, 12 nt, Human
uacuuuaaacua

SEQ ID NO: 3020715 - RNA, 20 nt, Human
uagaagucuuagauguauau

SEQ ID NO: 3020716 - RNA, 19 nt, Human
uagacccucaugcugccaa

SEQ ID NO: 3020717 - RNA, 17 nt, Human
uagacccucaugcugcc

SEQ ID NO: 3020718 - RNA, 18 nt, Human
uagacccucaugcugcca

SEQ ID NO: 3020719 - RNA, 19 nt, Human
uagagguacacuugugaau

SEQ ID NO: 3020720 - RNA, 14 nt, Human
uagagguucaaaga

SEQ ID NO: 3020721 - RNA, 15 nt, Human
uagagguucaaagau

SEQ ID NO: 3020722 - RNA, 12 nt, Human
uagagugggagc

SEQ ID NO: 3020723 - RNA, 14 nt, Human
uagaguugauacua

SEQ ID NO: 3020724 - RNA, 17 nt, Human
uagaguugauacuacag

SEQ ID NO: 3020725 - RNA, 16 nt, Human
uagcaugaagacagag

SEQ ID NO: 3020726 - RNA, 12 nt, Human
uagcugggacua

SEQ ID NO: 3020727 - RNA, 15 nt, Human
uagcugggacuacag

SEQ ID NO: 3020728 - RNA, 17 nt, Human
uagcugggacuacaggc

SEQ ID NO: 3020729 - RNA, 18 nt, Human
uagccugugccucuggga

SEQ ID NO: 3020730 - RNA, 20 nt, Human
uagcucaggugucccugcac

SEQ ID NO: 3020731 - RNA, 21 nt, Human
uagcucaggugucccugcacu

SEQ ID NO: 3020732 - RNA, 12 nt, Human
uagcucauucuc

SEQ ID NO: 3020733 - RNA, 21 nt, Human
uagcagcccucaauugugaaa

SEQ ID NO: 3020734 - RNA, 11 nt, Human
uagcagggaaa

SEQ ID NO: 3020735 - RNA, 16 nt, Human
uagcauacguacacau

SEQ ID NO: 3020736 - RNA, 17 nt, Human
uagcauacguacacauu

SEQ ID NO: 3020737 - RNA, 18 nt, Human
uagcauacguacacauuu

SEQ ID NO: 3020738 - RNA, 19 nt, Human
uagcauacguacacauuuu

SEQ ID NO: 3020739 - RNA, 16 nt, Human
uagauacuguaucaug

SEQ ID NO: 3020740 - RNA, 17 nt, Human
uaguagagguacacuug

SEQ ID NO: 3020741 - RNA, 21 nt, Human
uaguagagguacacuugugaa

SEQ ID NO: 3020742 - RNA, 20 nt, Human
uaguagagguacacuuguga

SEQ ID NO: 3020743 - RNA, 22 nt, Human
uaguagagguacacuugugaau

SEQ ID NO: 3020744 - RNA, 17 nt, Human
uaguaugaggcauuugu

SEQ ID NO: 3020745 - RNA, 18 nt, Human
uaguaugaggcauuuguu

SEQ ID NO: 3020746 - RNA, 17 nt, Human
uaggugugggggaagca

SEQ ID NO: 3020747 - RNA, 13 nt, Human
uagguguggggga

SEQ ID NO: 3020748 - RNA, 19 nt, Human
uaggugugacugaauuucu

SEQ ID NO: 3020749 - RNA, 21 nt, Human
uaggugugacugaauuucuuu

SEQ ID NO: 3020750 - RNA, 23 nt, Human
uaggugugacugaauuucuuuug

SEQ ID NO: 3020751 - RNA, 22 nt, Human
uagcuggucuuauuuguaaagc

SEQ ID NO: 3020752 - RNA, 11 nt, Human
uaggugacaga

SEQ ID NO: 3020753 - RNA, 16 nt, Human
uaggugacagagugag

SEQ ID NO: 3020754 - RNA, 22 nt, Human
uaguuguuugauucagacagcu

SEQ ID NO: 3020755 - RNA, 21 nt, Human
uaguuguuugauucagacagc

SEQ ID NO: 3020756 - RNA, 20 nt, Human
uaguuguuugauucagacag

SEQ ID NO: 3020757 - RNA, 20 nt, Human
uaguggcuuaaaacaacacu

SEQ ID NO: 3020758 - RNA, 16 nt, Human
uaguaugguggcuggg

SEQ ID NO: 3020759 - RNA, 15 nt, Human
uaguaugaggcauuu

SEQ ID NO: 3020760 - RNA, 15 nt, Human
uaguuugauuaaauu

SEQ ID NO: 3020761 - RNA, 16 nt, Human
uaguuugauuaaauuc

SEQ ID NO: 3020762 - RNA, 17 nt, Human
uauaaacuuuaccuuuu

SEQ ID NO: 3020763 - RNA, 15 nt, Human
uauaaacuuuaccuu

SEQ ID NO: 3020764 - RNA, 16 nt, Human
uauaaacuuuaccuuu

SEQ ID NO: 3020765 - RNA, 11 nt, Human
uauaaacuuua

SEQ ID NO: 3020766 - RNA, 13 nt, Human
uauaaacuuuacc

SEQ ID NO: 3020767 - RNA, 14 nt, Human
uauaaacuuuaccu

SEQ ID NO: 3020768 - RNA, 17 nt, Human
uaucaugacaaagacug

SEQ ID NO: 3020769 - RNA, 20 nt, Human
uaucaggugcugccauccag

SEQ ID NO: 3020770 - RNA, 19 nt, Human
uaucaggugcugccaucca

SEQ ID NO: 3020771 - RNA, 10 nt, Human
uaacuggaac

SEQ ID NO: 3020772 - RNA, 14 nt, Human
uaacuuuuuauauu

SEQ ID NO: 3020773 - RNA, 13 nt, Human
uaacuuuuuauau

SEQ ID NO: 3020774 - RNA, 16 nt, Human
uaacuuuuuauauucu

SEQ ID NO: 3020775 - RNA, 15 nt, Human
uaacuuuuuauauuc

SEQ ID NO: 3020776 - RNA, 16 nt, Human
uaagaaaaaggaugca

SEQ ID NO: 3020777 - RNA, 18 nt, Human
uaagaaaaaggaugcaca

SEQ ID NO: 3020778 - RNA, 19 nt, Human
uaagaaaaaggaugcacag

SEQ ID NO: 3020779 - RNA, 23 nt, Human
uaagaaaaaggaugcacagaguu

SEQ ID NO: 3020780 - RNA, 19 nt, Human
uaagaaccuuuugagugcc

SEQ ID NO: 3020781 - RNA, 18 nt, Human
uaacucaccuggcaucuu

SEQ ID NO: 3020782 - RNA, 11 nt, Human
uaacagaaaug

SEQ ID NO: 3020783 - RNA, 23 nt, Human
uaaccaguguuguggauuuaaca

SEQ ID NO: 3020784 - RNA, 16 nt, Human
uaaccacuucagcuga

SEQ ID NO: 3020785 - RNA, 11 nt, Human
uaaauuauuuu

SEQ ID NO: 3020786 - RNA, 22 nt, Human
uaaauucuugcaaaguaucccu

SEQ ID NO: 3020787 - RNA, 17 nt, Human
uaaauucuugcaaagua

SEQ ID NO: 3020788 - RNA, 18 nt, Human
uaaauucuugcaaaguau

SEQ ID NO: 3020789 - RNA, 16 nt, Human
uaaauucuugcaaagu

SEQ ID NO: 3020790 - RNA, 18 nt, Human
uaacaccaugauuaacca

SEQ ID NO: 3020791 - RNA, 22 nt, Human
uaaaugucucuuuaaugucaca

SEQ ID NO: 3020792 - RNA, 20 nt, Human
uaaaugucuaguuguaacac

SEQ ID NO: 3020793 - RNA, 18 nt, Human
uaaaugggggugcauuug

SEQ ID NO: 3020794 - RNA, 19 nt, Human
uaaaugggggugcauuuga

SEQ ID NO: 3020795 - RNA, 14 nt, Human
uaaaugggggugca

SEQ ID NO: 3020796 - RNA, 17 nt, Human
uaaaugggggugcauuu

SEQ ID NO: 3020797 - RNA, 16 nt, Human
uaaauggaaccacucu

SEQ ID NO: 3020798 - RNA, 17 nt, Human
uaaaugcccagccccuu

SEQ ID NO: 3020799 - RNA, 16 nt, Human
uaaaugcccagccccu

SEQ ID NO: 3020800 - RNA, 15 nt, Human
uaaaugcccagcccc

SEQ ID NO: 3020801 - RNA, 14 nt, Human
uaaaugcccagccc

SEQ ID NO: 3020802 - RNA, 13 nt, Human
uaaaugcccagcc

SEQ ID NO: 3020803 - RNA, 15 nt, Human
uaauauggaucugua

SEQ ID NO: 3020804 - RNA, 19 nt, Human
uaauaugcacacauuuuuu

SEQ ID NO: 3020805 - RNA, 15 nt, Human
uaauaugcacacauu

SEQ ID NO: 3020806 - RNA, 16 nt, Human
uaauaugcacacauuu

SEQ ID NO: 3020807 - RNA, 17 nt, Human
uaauaugcacacauuuu

SEQ ID NO: 3020808 - RNA, 18 nt, Human
uaauaugcacacauuuuu

SEQ ID NO: 3020809 - RNA, 15 nt, Human
uaauaugaugacugu

SEQ ID NO: 3020810 - RNA, 20 nt, Human
uaauauuaaggaagacaaug

SEQ ID NO: 3020811 - RNA, 12 nt, Human
uaaucuaaaugg

SEQ ID NO: 3020812 - RNA, 13 nt, Human
uaaucuaaaugga

SEQ ID NO: 3020813 - RNA, 19 nt, Human
uaaugcuugcugcugauuu

SEQ ID NO: 3020814 - RNA, 15 nt, Human
uaauggggcggugag

SEQ ID NO: 3020815 - RNA, 23 nt, Human
uaaugcgugcauaccacuuuugu

SEQ ID NO: 3020816 - RNA, 19 nt, Human
uaaugcgugcauaccacuu

SEQ ID NO: 3020817 - RNA, 22 nt, Human
uaaugcgugcauaccacuuuug

SEQ ID NO: 3020818 - RNA, 15 nt, Human
uaaugcgugcauacc

SEQ ID NO: 3020819 - RNA, 14 nt, Human
uaauuaaguacuau

SEQ ID NO: 3020820 - RNA, 17 nt, Human
uaauuaaguacuaugua

SEQ ID NO: 3020821 - RNA, 16 nt, Human
uaaggauguucuagca

SEQ ID NO: 3020822 - RNA, 12 nt, Human
uaagaggcaggg

SEQ ID NO: 3020823 - RNA, 15 nt, Human
uaagaggcagggucu

SEQ ID NO: 3020824 - RNA, 20 nt, Human
uaagguggguacgggagggu

SEQ ID NO: 3020825 - RNA, 15 nt, Human
uaaggugugcucuga

SEQ ID NO: 3020826 - RNA, 17 nt, Human
uaaggguaucuggugac

SEQ ID NO: 3020827 - RNA, 15 nt, Human
uaagugcugcauuua

SEQ ID NO: 3020828 - RNA, 16 nt, Human
uaagugcugcauuuaa

SEQ ID NO: 3020829 - RNA, 18 nt, Human
uaagugcugcauuuaaaa

SEQ ID NO: 3020830 - RNA, 22 nt, Human
uaagugcugcauuuaaaagaua

SEQ ID NO: 3020831 - RNA, 23 nt, Human
uaagugaggaugaaaaaauaaca

SEQ ID NO: 3020832 - RNA, 12 nt, Human
uaagugagagag

SEQ ID NO: 3020833 - RNA, 14 nt, Human
uaagugcugcauuu

SEQ ID NO: 3020834 - RNA, 22 nt, Human
uaaacaugcuguacauacuuuu

SEQ ID NO: 3020835 - RNA, 21 nt, Human
uaaacaugcuguacauacuuu

SEQ ID NO: 3020836 - RNA, 23 nt, Human
uaaacaugcuguacauacuuuuu

SEQ ID NO: 3020837 - RNA, 22 nt, Human
uaaacuugguuuuuaaaaaacu

SEQ ID NO: 3020838 - RNA, 22 nt, Human
uaaacacauuaaagguacuuug

SEQ ID NO: 3020839 - RNA, 19 nt, Human
uaaacaugcuguacauacu

SEQ ID NO: 3020840 - RNA, 20 nt, Human
uaaacaugcuguacauacuu

SEQ ID NO: 3020841 - RNA, 21 nt, Human
uaaacaagaccacguuucuaa

SEQ ID NO: 3020842 - RNA, 22 nt, Human
uaaacaagaccacguuucuaaa

SEQ ID NO: 3020843 - RNA, 20 nt, Human
uaaacaagaccacguuucua

SEQ ID NO: 3020844 - RNA, 19 nt, Human
uaaacaagaccacguuucu

SEQ ID NO: 3020845 - RNA, 17 nt, Human
uaaaggcuaccuuugua

SEQ ID NO: 3020846 - RNA, 20 nt, Human
uaaagccugaguuugcuuuc

SEQ ID NO: 3020847 - RNA, 15 nt, Human
uaaaggcuaccuuug

SEQ ID NO: 3020848 - RNA, 12 nt, Human
uaaagaaaacug

SEQ ID NO: 3020849 - RNA, 16 nt, Human
uaaagcagcguuucua

SEQ ID NO: 3020850 - RNA, 17 nt, Human
uaaagcagcguuucuau

SEQ ID NO: 3020851 - RNA, 19 nt, Human
uaaagcagcguuucuauga

SEQ ID NO: 3020852 - RNA, 18 nt, Human
uaaaaggaagcuuacaug

SEQ ID NO: 3020853 - RNA, 21 nt, Human
uaaaaggaagcuuacaugccu

SEQ ID NO: 3020854 - RNA, 12 nt, Human
uaaaaggagcca

SEQ ID NO: 3020855 - RNA, 21 nt, Human
uaaaagguaugcaaucaaauc

SEQ ID NO: 3020856 - RNA, 12 nt, Human
uaaaaggugacc

SEQ ID NO: 3020857 - RNA, 21 nt, Human
uaaaagauacaguuacucaga

SEQ ID NO: 3020858 - RNA, 14 nt, Human
uaaaagauacaguu

SEQ ID NO: 3020859 - RNA, 17 nt, Human
uaaaagauacaguuacu

SEQ ID NO: 3020860 - RNA, 20 nt, Human
uaaaagauacaguuacucag

SEQ ID NO: 3020861 - RNA, 17 nt, Human
uaaaacacaacaucuuu

SEQ ID NO: 3020862 - RNA, 23 nt, Human
uaaaacacaacaucuuuuucuac

SEQ ID NO: 3020863 - RNA, 22 nt, Human
uaaaacacaacaucuuuuucua

SEQ ID NO: 3020864 - RNA, 15 nt, Human
uaaaacaacacucac

SEQ ID NO: 3020865 - RNA, 14 nt, Human
guuuagauaauaca

SEQ ID NO: 3020866 - RNA, 14 nt, Human
guuguuacauuuuu

SEQ ID NO: 3020867 - RNA, 15 nt, Human
guuguuacauuuuua

SEQ ID NO: 3020868 - RNA, 14 nt, Human
guugugguuaaucu

SEQ ID NO: 3020869 - RNA, 22 nt, Human
guuguggauuuaacagaaaugu

SEQ ID NO: 3020870 - RNA, 12 nt, Human
guugucagcuga

SEQ ID NO: 3020871 - RNA, 19 nt, Human
guuggcugggggccucagu

SEQ ID NO: 3020872 - RNA, 20 nt, Human
guuggccccugcccggcugc

SEQ ID NO: 3020873 - RNA, 13 nt, Human
guuggccccugcc

SEQ ID NO: 3020874 - RNA, 14 nt, Human
guuggccccugccc

SEQ ID NO: 3020875 - RNA, 12 nt, Human
guuggcuggggg

SEQ ID NO: 3020876 - RNA, 17 nt, Human
guuugagaucagccugg

SEQ ID NO: 3020877 - RNA, 23 nt, Human
guuugauuaaauucuugcaaagu

SEQ ID NO: 3020878 - RNA, 20 nt, Human
guuuguaaauuaacuuuuau

SEQ ID NO: 3020879 - RNA, 18 nt, Human
guuuggggaugagaaagg

SEQ ID NO: 3020880 - RNA, 21 nt, Human
guuugauucagacagcugccu

SEQ ID NO: 3020881 - RNA, 20 nt, Human
guuugauucagacagcugcc

SEQ ID NO: 3020882 - RNA, 16 nt, Human
guuugauucagacagc

SEQ ID NO: 3020883 - RNA, 18 nt, Human
guuuguuucugaaaggga

SEQ ID NO: 3020884 - RNA, 11 nt, Human
guuuucacucu

SEQ ID NO: 3020885 - RNA, 12 nt, Human
guuuucacucuu

SEQ ID NO: 3020886 - RNA, 17 nt, Human
guuuucaaaauaaaaau

SEQ ID NO: 3020887 - RNA, 20 nt, Human
guuuguuucugaaagggacg

SEQ ID NO: 3020888 - RNA, 13 nt, Human
guuuuccugaaga

SEQ ID NO: 3020889 - RNA, 20 nt, Human
guuuuccaugaguccccugu

SEQ ID NO: 3020890 - RNA, 19 nt, Human
guuuuccaugaguccccug

SEQ ID NO: 3020891 - RNA, 20 nt, Human
guuuuccagguuuaagcugu

SEQ ID NO: 3020892 - RNA, 15 nt, Human
guggguggggcagug

SEQ ID NO: 3020893 - RNA, 23 nt, Human
guggguuucuaaagcugccagcc

SEQ ID NO: 3020894 - RNA, 14 nt, Human
guggggcagugcuu

SEQ ID NO: 3020895 - RNA, 23 nt, Human
guggggcagugcuuggcccagga

SEQ ID NO: 3020896 - RNA, 17 nt, Human
guggggcagcuugaggg

SEQ ID NO: 3020897 - RNA, 13 nt, Human
guggggcagcuug

SEQ ID NO: 3020898 - RNA, 18 nt, Human
guggggaccucaggccug

SEQ ID NO: 3020899 - RNA, 15 nt, Human
guggggaccucaggc

SEQ ID NO: 3020900 - RNA, 15 nt, Human
gugggcuaguugggc

SEQ ID NO: 3020901 - RNA, 17 nt, Human
gugggcccaaugcacuu

SEQ ID NO: 3020902 - RNA, 17 nt, Human
guggcuaacuuggguua

SEQ ID NO: 3020903 - RNA, 14 nt, Human
guggcucacgccug

SEQ ID NO: 3020904 - RNA, 14 nt, Human
guggcugcuucaag

SEQ ID NO: 3020905 - RNA, 12 nt, Human
guggcugcuuca

SEQ ID NO: 3020906 - RNA, 19 nt, Human
guggcuggguuggagggug

SEQ ID NO: 3020907 - RNA, 23 nt, Human
guggcugcuucaaggauccugag

SEQ ID NO: 3020908 - RNA, 22 nt, Human
guggcugcuucaaggauccuga

SEQ ID NO: 3020909 - RNA, 19 nt, Human
guggcugcuucaaggaucc

SEQ ID NO: 3020910 - RNA, 16 nt, Human
guggcugcuucaagga

SEQ ID NO: 3020911 - RNA, 15 nt, Human
guggcugcuucaagg

SEQ ID NO: 3020912 - RNA, 22 nt, Human
guggcuuaaaacaacacucaca

SEQ ID NO: 3020913 - RNA, 21 nt, Human
guguaaguauucuuauuuaau

SEQ ID NO: 3020914 - RNA, 19 nt, Human
guggugcgaucuggguuca

SEQ ID NO: 3020915 - RNA, 14 nt, Human
guggugaccucugc

SEQ ID NO: 3020916 - RNA, 17 nt, Human
guggugaccucugccug

SEQ ID NO: 3020917 - RNA, 21 nt, Human
guggugagaggcauccaguau

SEQ ID NO: 3020918 - RNA, 18 nt, Human
gugguccuaaucuucuga

SEQ ID NO: 3020919 - RNA, 17 nt, Human
guggucccaccccacac

SEQ ID NO: 3020920 - RNA, 16 nt, Human
guggucccaccccaca

SEQ ID NO: 3020921 - RNA, 15 nt, Human
guggucccaccccac

SEQ ID NO: 3020922 - RNA, 14 nt, Human
guggucccacccca

SEQ ID NO: 3020923 - RNA, 17 nt, Human
gugguagagugugccug

SEQ ID NO: 3020924 - RNA, 19 nt, Human
gugguaugaucacggcuca

SEQ ID NO: 3020925 - RNA, 13 nt, Human
gugucccugcacu

SEQ ID NO: 3020926 - RNA, 16 nt, Human
gugucccugcacuugc

SEQ ID NO: 3020927 - RNA, 18 nt, Human
gugucccugcacuugcag

SEQ ID NO: 3020928 - RNA, 22 nt, Human
guguacauggaauaacauguaa

SEQ ID NO: 3020929 - RNA, 17 nt, Human
guguacauggaauaaca

SEQ ID NO: 3020930 - RNA, 14 nt, Human
gugugcguccuguc

SEQ ID NO: 3020931 - RNA, 16 nt, Human
gugugcguccugucgg

SEQ ID NO: 3020932 - RNA, 12 nt, Human
gugugcucugau

SEQ ID NO: 3020933 - RNA, 15 nt, Human
gugugcucugaucau

SEQ ID NO: 3020934 - RNA, 22 nt, Human
gugugcucugaucauccacugu

SEQ ID NO: 3020935 - RNA, 21 nt, Human
guguggagaagcggcuggcag

SEQ ID NO: 3020936 - RNA, 13 nt, Human
guguggagaagcg

SEQ ID NO: 3020937 - RNA, 20 nt, Human
gugugagucaccaagcccag

SEQ ID NO: 3020938 - RNA, 22 nt, Human
gugucucuugguccugcugcag

SEQ ID NO: 3020939 - RNA, 21 nt, Human
gugucucuugguccugcugca

SEQ ID NO: 3020940 - RNA, 20 nt, Human
gugucucuugguccugcugc

SEQ ID NO: 3020941 - RNA, 19 nt, Human
gugucucuugguccugcug

SEQ ID NO: 3020942 - RNA, 18 nt, Human
gugucucuugguccugcu

SEQ ID NO: 3020943 - RNA, 17 nt, Human
gugucucccuucauccu

SEQ ID NO: 3020944 - RNA, 14 nt, Human
gugucucuuggucc

SEQ ID NO: 3020945 - RNA, 23 nt, Human
gugucccugcacuugcagacucu

SEQ ID NO: 3020946 - RNA, 14 nt, Human
guguccggucccug

SEQ ID NO: 3020947 - RNA, 15 nt, Human
gugucgggcaugaca

SEQ ID NO: 3020948 - RNA, 18 nt, Human
guguuaugacuccagaau

SEQ ID NO: 3020949 - RNA, 14 nt, Human
guguuacuaaguuu

SEQ ID NO: 3020950 - RNA, 12 nt, Human
guguuacuaagu

SEQ ID NO: 3020951 - RNA, 15 nt, Human
guuacacuaaaaggu

SEQ ID NO: 3020952 - RNA, 16 nt, Human
guuacacuaaaaggug

SEQ ID NO: 3020953 - RNA, 13 nt, Human
guuacagacaaag

SEQ ID NO: 3020954 - RNA, 22 nt, Human
guuaaaauaccagccaguaaau

SEQ ID NO: 3020955 - RNA, 24 nt, Human
guucacuggacacuucacgcccuu

SEQ ID NO: 3020956 - RNA, 19 nt, Human
guucacugcaaccuccgcc

SEQ ID NO: 3020957 - RNA, 18 nt, Human
guucaucuugaauuguaa

SEQ ID NO: 3020958 - RNA, 13 nt, Human
guucaucuugaau

SEQ ID NO: 3020959 - RNA, 12 nt, Human
guucaucuugaa

SEQ ID NO: 3020960 - RNA, 17 nt, Human
guucaucauccuaagcu

SEQ ID NO: 3020961 - RNA, 20 nt, Human
guuccaccaucaagccacca

SEQ ID NO: 3020962 - RNA, 17 nt, Human
guuccaccaucaagcca

SEQ ID NO: 3020963 - RNA, 14 nt, Human
guuccuaauccucu

SEQ ID NO: 3020964 - RNA, 22 nt, Human
guuccucauuagcauuuugcua

SEQ ID NO: 3020965 - RNA, 23 nt, Human
guucaaucuggauucauauuuaa

SEQ ID NO: 3020966 - RNA, 16 nt, Human
guucaauucucauuug

SEQ ID NO: 3020967 - RNA, 23 nt, Human
guucaauucucauuugucacaca

SEQ ID NO: 3020968 - RNA, 20 nt, Human
guucaagcgauucuucugcu

SEQ ID NO: 3020969 - RNA, 19 nt, Human
guucaagcgauucuucugc

SEQ ID NO: 3020970 - RNA, 19 nt, Human
guuauuaaaaaucucaaau

SEQ ID NO: 3020971 - RNA, 21 nt, Human
guuaugacuccagaauuuccc

SEQ ID NO: 3020972 - RNA, 24 nt, Human
guuaguucaaucuggauucauauu

SEQ ID NO: 3020973 - RNA, 22 nt, Human
guuaguuucuccaagcaggaca

SEQ ID NO: 3020974 - RNA, 19 nt, Human
guuaguuucuccaagcagg

SEQ ID NO: 3020975 - RNA, 16 nt, Human
guuaguuucuccaagc

SEQ ID NO: 3020976 - RNA, 15 nt, Human
guuacucagaauucu

SEQ ID NO: 3020977 - RNA, 22 nt, Human
guuacuaaguuuuuauggcuuu

SEQ ID NO: 3020978 - RNA, 17 nt, Human
guuacagacaaagcgug

SEQ ID NO: 3020979 - RNA, 15 nt, Human
guuacagacaaagcg

SEQ ID NO: 3020980 - RNA, 18 nt, Human
guuacauaagauaaaugu

SEQ ID NO: 3020981 - RNA, 19 nt, Human
guuacauaagauaaaugug

SEQ ID NO: 3020982 - RNA, 21 nt, Human
guuacauuuuuaagugcugca

SEQ ID NO: 3020983 - RNA, 23 nt, Human
guuaccauuuugggguacccacu

SEQ ID NO: 3020984 - RNA, 16 nt, Human
guugaagacagagcua

SEQ ID NO: 3020985 - RNA, 15 nt, Human
guugcaggaccucag

SEQ ID NO: 3020986 - RNA, 14 nt, Human
guugccagucaccc

SEQ ID NO: 3020987 - RNA, 13 nt, Human
guugccagucacc

SEQ ID NO: 3020988 - RNA, 23 nt, Human
guugccagucaccccggccaccu

SEQ ID NO: 3020989 - RNA, 18 nt, Human
guugccagucaccccggc

SEQ ID NO: 3020990 - RNA, 17 nt, Human
guugccagucaccccgg

SEQ ID NO: 3020991 - RNA, 16 nt, Human
guugccagucaccccg

SEQ ID NO: 3020992 - RNA, 12 nt, Human
guugcccaggca

SEQ ID NO: 3020993 - RNA, 14 nt, Human
guugcccaggcagg

SEQ ID NO: 3020994 - RNA, 17 nt, Human
guuggccaggcuggucu

SEQ ID NO: 3020995 - RNA, 19 nt, Human
guuggccaggcuggucuca

SEQ ID NO: 3020996 - RNA, 14 nt, Human
guuggccaguguga

SEQ ID NO: 3020997 - RNA, 15 nt, Human
guuggccaggcuggu

SEQ ID NO: 3020998 - RNA, 14 nt, Human
guuggccaggcugg

SEQ ID NO: 3020999 - RNA, 13 nt, Human
guuggccaggcug

SEQ ID NO: 3021000 - RNA, 18 nt, Human
guuggcaaaaaggcagga

SEQ ID NO: 3021001 - RNA, 14 nt, Human
guuggcaaaaaggc

SEQ ID NO: 3021002 - RNA, 23 nt, Human
guuggccaaagccaaagcuaggc

SEQ ID NO: 3021003 - RNA, 12 nt, Human
guucuggcucuu

SEQ ID NO: 3021004 - RNA, 20 nt, Human
guucuggcucuuccaggcug

SEQ ID NO: 3021005 - RNA, 16 nt, Human
guucuggcucuuccag

SEQ ID NO: 3021006 - RNA, 23 nt, Human
guucuggcagaguugaagacaga

SEQ ID NO: 3021007 - RNA, 11 nt, Human
guucugggaca

SEQ ID NO: 3021008 - RNA, 12 nt, Human
guucugggacac

SEQ ID NO: 3021009 - RNA, 14 nt, Human
guucugggacacag

SEQ ID NO: 3021010 - RNA, 15 nt, Human
guucugggacacagu

SEQ ID NO: 3021011 - RNA, 16 nt, Human
guucugggacacaguu

SEQ ID NO: 3021012 - RNA, 18 nt, Human
guucuuucacccuuuucu

SEQ ID NO: 3021013 - RNA, 13 nt, Human
guucuuuccaaag

SEQ ID NO: 3021014 - RNA, 14 nt, Human
guucuuuccaaagu

SEQ ID NO: 3021015 - RNA, 18 nt, Human
guucuuuccaaaguacac

SEQ ID NO: 3021016 - RNA, 20 nt, Human
guucuuuccaaaguacacug

SEQ ID NO: 3021017 - RNA, 17 nt, Human
guugaaaaacagcugag

SEQ ID NO: 3021018 - RNA, 19 nt, Human
guucugauccuaguuccac

SEQ ID NO: 3021019 - RNA, 17 nt, Human
gucugucuuuuaaacuc

SEQ ID NO: 3021020 - RNA, 18 nt, Human
gucugugccauuuuguau

SEQ ID NO: 3021021 - RNA, 14 nt, Human
gucuguuuugugua

SEQ ID NO: 3021022 - RNA, 14 nt, Human
gucuguucuuucca

SEQ ID NO: 3021023 - RNA, 17 nt, Human
gucuguucuuuccaaag

SEQ ID NO: 3021024 - RNA, 15 nt, Human
gucuguuuuguguac

SEQ ID NO: 3021025 - RNA, 20 nt, Human
gucuguuuuguguacuuuua

SEQ ID NO: 3021026 - RNA, 21 nt, Human
gucuuaaaaaguggaaaaaua

SEQ ID NO: 3021027 - RNA, 16 nt, Human
gucuugaacuccuggc

SEQ ID NO: 3021028 - RNA, 17 nt, Human
gucuugaacuccuggcc

SEQ ID NO: 3021029 - RNA, 21 nt, Human
gucuugaacuccuggccucaa

SEQ ID NO: 3021030 - RNA, 18 nt, Human
gucuugaacuccuggccu

SEQ ID NO: 3021031 - RNA, 20 nt, Human
gucuugaacuccuggccuca

SEQ ID NO: 3021032 - RNA, 16 nt, Human
gucuugcaauggcagc

SEQ ID NO: 3021033 - RNA, 17 nt, Human
gucuugcaauggcagcc

SEQ ID NO: 3021034 - RNA, 18 nt, Human
gucuugcaauggcagccu

SEQ ID NO: 3021035 - RNA, 19 nt, Human
gucuugcaauggcagccuu

SEQ ID NO: 3021036 - RNA, 16 nt, Human
gucuuuuuucacuaca

SEQ ID NO: 3021037 - RNA, 23 nt, Human
gucuugcaauggcagccuuggca

SEQ ID NO: 3021038 - RNA, 20 nt, Human
gucuugcaauggcagccuug

SEQ ID NO: 3021039 - RNA, 21 nt, Human
gucuugcaauggcagccuugg

SEQ ID NO: 3021040 - RNA, 12 nt, Human
gucggagcccug

SEQ ID NO: 3021041 - RNA, 21 nt, Human
gucggaaaacaugcuacacac

SEQ ID NO: 3021042 - RNA, 16 nt, Human
gucggagcccugucuc

SEQ ID NO: 3021043 - RNA, 16 nt, Human
gucgggcaugacacga

SEQ ID NO: 3021044 - RNA, 15 nt, Human
gucccugccaaugga

SEQ ID NO: 3021045 - RNA, 14 nt, Human
gucccugccaaugg

SEQ ID NO: 3021046 - RNA, 11 nt, Human
gucccugccaa

SEQ ID NO: 3021047 - RNA, 19 nt, Human
guccuuaccagcagagcac

SEQ ID NO: 3021048 - RNA, 18 nt, Human
guccuuaccagcagagca

SEQ ID NO: 3021049 - RNA, 21 nt, Human
guccuuaccagcagagcaccu

SEQ ID NO: 3021050 - RNA, 18 nt, Human
gucucacuauguugccca

SEQ ID NO: 3021051 - RNA, 11 nt, Human
gucucacucug

SEQ ID NO: 3021052 - RNA, 19 nt, Human
gucucacuauguugcccag

SEQ ID NO: 3021053 - RNA, 15 nt, Human
gucucacucugucgc

SEQ ID NO: 3021054 - RNA, 16 nt, Human
gucucacucugucgcc

SEQ ID NO: 3021055 - RNA, 18 nt, Human
gucucacucugucgccca

SEQ ID NO: 3021056 - RNA, 19 nt, Human
gucucacucugucgcccag

SEQ ID NO: 3021057 - RNA, 22 nt, Human
gucucacucugucgcccagucu

SEQ ID NO: 3021058 - RNA, 13 nt, Human
gugcguccugucg

SEQ ID NO: 3021059 - RNA, 14 nt, Human
gugcggccuuuggc

SEQ ID NO: 3021060 - RNA, 14 nt, Human
gugcgccuacagga

SEQ ID NO: 3021061 - RNA, 21 nt, Human
gugcgaucuggguucacugca

SEQ ID NO: 3021062 - RNA, 14 nt, Human
gugccaugugccag

SEQ ID NO: 3021063 - RNA, 16 nt, Human
gugccaugugccaggu

SEQ ID NO: 3021064 - RNA, 23 nt, Human
gugauccacccaccucagccucc

SEQ ID NO: 3021065 - RNA, 24 nt, Human
gugauccacccaccucagccuccc

SEQ ID NO: 3021066 - RNA, 13 nt, Human
gugauuuuuguaa

SEQ ID NO: 3021067 - RNA, 18 nt, Human
gugauuuuuguaauuuuu

SEQ ID NO: 3021068 - RNA, 22 nt, Human
gugcauaccacuuuuguucuug

SEQ ID NO: 3021069 - RNA, 20 nt, Human
gugcaguggugcgaucuggg

SEQ ID NO: 3021070 - RNA, 23 nt, Human
gugcaguggugcgaucuggguuc

SEQ ID NO: 3021071 - RNA, 21 nt, Human
gugaaugaugauccuaggcau

SEQ ID NO: 3021072 - RNA, 20 nt, Human
gugacaaggauugcuacugu

SEQ ID NO: 3021073 - RNA, 12 nt, Human
gugaccucugcc

SEQ ID NO: 3021074 - RNA, 15 nt, Human
gugacagaggcagcc

SEQ ID NO: 3021075 - RNA, 13 nt, Human
gugaccucugccu

SEQ ID NO: 3021076 - RNA, 14 nt, Human
gugaccucugccug

SEQ ID NO: 3021077 - RNA, 12 nt, Human
gugacagaggca

SEQ ID NO: 3021078 - RNA, 13 nt, Human
gugacagaggcag

SEQ ID NO: 3021079 - RNA, 14 nt, Human
gugacagaggcagc

SEQ ID NO: 3021080 - RNA, 14 nt, Human
gugagccacugcac

SEQ ID NO: 3021081 - RNA, 15 nt, Human
gugagccacugcacc

SEQ ID NO: 3021082 - RNA, 20 nt, Human
gugagccacugcaccgggcc

SEQ ID NO: 3021083 - RNA, 17 nt, Human
gugaggaugaaaaaaua

SEQ ID NO: 3021084 - RNA, 19 nt, Human
gugagccgagaucacgcca

SEQ ID NO: 3021085 - RNA, 17 nt, Human
gugauacaaugcugugc

SEQ ID NO: 3021086 - RNA, 15 nt, Human
gugauacaaugcugu

SEQ ID NO: 3021087 - RNA, 17 nt, Human
gugaguugauagcacag

SEQ ID NO: 3021088 - RNA, 22 nt, Human
gugauccacccaccucagccuc

SEQ ID NO: 3021089 - RNA, 15 nt, Human
guauagauguugcua

SEQ ID NO: 3021090 - RNA, 16 nt, Human
guauagauguugcuaa

SEQ ID NO: 3021091 - RNA, 22 nt, Human
guauaugucaagccauaauugu

SEQ ID NO: 3021092 - RNA, 20 nt, Human
guauguuuuauauagcaaga

SEQ ID NO: 3021093 - RNA, 20 nt, Human
guaugaucacggcucacugc

SEQ ID NO: 3021094 - RNA, 17 nt, Human
guaugaggcauuuguuu

SEQ ID NO: 3021095 - RNA, 20 nt, Human
guaugaggcauuuguuugaa

SEQ ID NO: 3021096 - RNA, 21 nt, Human
guaugaucacggcucacugca

SEQ ID NO: 3021097 - RNA, 19 nt, Human
guaucuggugacuuuccuc

SEQ ID NO: 3021098 - RNA, 12 nt, Human
guaucuggugac

SEQ ID NO: 3021099 - RNA, 12 nt, Human
guaucugagcag

SEQ ID NO: 3021100 - RNA, 13 nt, Human
guaugaggcauuu

SEQ ID NO: 3021101 - RNA, 15 nt, Human
guaugaggcauuugu

SEQ ID NO: 3021102 - RNA, 16 nt, Human
guagggcgggaggaug

SEQ ID NO: 3021103 - RNA, 23 nt, Human
guagggcgggaggauguucuggg

SEQ ID NO: 3021104 - RNA, 21 nt, Human
guagggcgggaggauguucug

SEQ ID NO: 3021105 - RNA, 22 nt, Human
guagggcgggaggauguucugg

SEQ ID NO: 3021106 - RNA, 15 nt, Human
guagagugugccuga

SEQ ID NO: 3021107 - RNA, 16 nt, Human
guaggguuauaauaau

SEQ ID NO: 3021108 - RNA, 14 nt, Human
guagucaggugccu

SEQ ID NO: 3021109 - RNA, 16 nt, Human
gucaaggcuuagaccc

SEQ ID NO: 3021110 - RNA, 18 nt, Human
gucaaggcuuagacccuc

SEQ ID NO: 3021111 - RNA, 19 nt, Human
guauuuuguuuuugucuua

SEQ ID NO: 3021112 - RNA, 20 nt, Human
gucaaggcuuagacccucau

SEQ ID NO: 3021113 - RNA, 14 nt, Human
gucaaggcuuagac

SEQ ID NO: 3021114 - RNA, 15 nt, Human
gucaagugaaaaagg

SEQ ID NO: 3021115 - RNA, 15 nt, Human
gucaccccggccacc

SEQ ID NO: 3021116 - RNA, 22 nt, Human
guauuuucuccaaauguucacu

SEQ ID NO: 3021117 - RNA, 14 nt, Human
guauuuuacuaaua

SEQ ID NO: 3021118 - RNA, 22 nt, Human
gucaccccggccaccugcggug

SEQ ID NO: 3021119 - RNA, 18 nt, Human
gucaccccggccaccugc

SEQ ID NO: 3021120 - RNA, 17 nt, Human
gucaccccggccaccug

SEQ ID NO: 3021121 - RNA, 19 nt, Human
gucacucuggcagcucaga

SEQ ID NO: 3021122 - RNA, 17 nt, Human
gucacucuggcagcuca

SEQ ID NO: 3021123 - RNA, 16 nt, Human
gucacucuggcagcuc

SEQ ID NO: 3021124 - RNA, 14 nt, Human
gucacucuggcagc

SEQ ID NO: 3021125 - RNA, 13 nt, Human
gucacucuggcag

SEQ ID NO: 3021126 - RNA, 12 nt, Human
gucacucuggca

SEQ ID NO: 3021127 - RNA, 14 nt, Human
gucagagccugcag

SEQ ID NO: 3021128 - RNA, 15 nt, Human
gucagagccugcagu

SEQ ID NO: 3021129 - RNA, 16 nt, Human
gucagagccugcaguu

SEQ ID NO: 3021130 - RNA, 14 nt, Human
gucauucuucccua

SEQ ID NO: 3021131 - RNA, 17 nt, Human
gucauuauguuaauauu

SEQ ID NO: 3021132 - RNA, 19 nt, Human
gucauuauguuaauauuuc

SEQ ID NO: 3021133 - RNA, 23 nt, Human
guccacccaggagccccgaggcc

SEQ ID NO: 3021134 - RNA, 12 nt, Human
guccacccagga

SEQ ID NO: 3021135 - RNA, 21 nt, Human
gucccaccuuggcugcaggga

SEQ ID NO: 3021136 - RNA, 17 nt, Human
guccccaccgcagacag

SEQ ID NO: 3021137 - RNA, 20 nt, Human
gucccaccuuggcugcaggg

SEQ ID NO: 3021138 - RNA, 23 nt, Human
gucccaccuuggcugcagggagu

SEQ ID NO: 3021139 - RNA, 16 nt, Human
gucccugcacuugcag

SEQ ID NO: 3021140 - RNA, 19 nt, Human
gucccugcacuugcagacu

SEQ ID NO: 3021141 - RNA, 21 nt, Human
gucccugcacuugcagacucu

SEQ ID NO: 3021142 - RNA, 13 nt, Human
uuuuccuucaaga

SEQ ID NO: 3021143 - RNA, 21 nt, Human
uuuuccuucaagaaugcagua

SEQ ID NO: 3021144 - RNA, 14 nt, Human
uuuuccuucaagaa

SEQ ID NO: 3021145 - RNA, 16 nt, Human
uuuugguauuugaaac

SEQ ID NO: 3021146 - RNA, 14 nt, Human
uuuugguauuugaa

SEQ ID NO: 3021147 - RNA, 15 nt, Human
uuuuggucuguguga

SEQ ID NO: 3021148 - RNA, 18 nt, Human
uuuuggguuuauuuggaa

SEQ ID NO: 3021149 - RNA, 17 nt, Human
uuuuggguuuauuugga

SEQ ID NO: 3021150 - RNA, 14 nt, Human
uuuuggcugcugaa

SEQ ID NO: 3021151 - RNA, 20 nt, Human
uuuugacaaggggcaguggu

SEQ ID NO: 3021152 - RNA, 19 nt, Human
uuuuguagagccagggucu

SEQ ID NO: 3021153 - RNA, 16 nt, Human
uuuugucauauaagau

SEQ ID NO: 3021154 - RNA, 20 nt, Human
uuuuuaagggcccuuuuuca

SEQ ID NO: 3021155 - RNA, 23 nt, Human
uuuuuaagaaaaaggaugcacag

SEQ ID NO: 3021156 - RNA, 11 nt, Human
uuuuuccuuca

SEQ ID NO: 3021157 - RNA, 21 nt, Human
uuuuuccuucaagaaugcagu

SEQ ID NO: 3021158 - RNA, 19 nt, Human
uuuuuccuucagugccuua

SEQ ID NO: 3021159 - RNA, 23 nt, Human
uuaccaauugaaguaaaaugugg

SEQ ID NO: 3021160 - RNA, 18 nt, Human
uuuccucauuuuuauaau

SEQ ID NO: 3021161 - RNA, 16 nt, Human
uuuccugaggcugggc

SEQ ID NO: 3021162 - RNA, 22 nt, Human
uuaccaauugaaguaaaaugug

SEQ ID NO: 3021163 - RNA, 14 nt, Human
uuaccacagacaua

SEQ ID NO: 3021164 - RNA, 17 nt, Human
uuaccacagacauacua

SEQ ID NO: 3021165 - RNA, 23 nt, Human
uuacauuuuuaagugcugcauuu

SEQ ID NO: 3021166 - RNA, 23 nt, Human
uuucuacucgaguuacagacaaa

SEQ ID NO: 3021167 - RNA, 20 nt, Human
uuucuaaaggcuaccuuugu

SEQ ID NO: 3021168 - RNA, 21 nt, Human
uuucuaaaggcuaccuuugua

SEQ ID NO: 3021169 - RNA, 18 nt, Human
uuucuaaaggcuaccuuu

SEQ ID NO: 3021170 - RNA, 20 nt, Human
uuucuguucuuucuggcuau

SEQ ID NO: 3021171 - RNA, 16 nt, Human
uuugaagauucuaugu

SEQ ID NO: 3021172 - RNA, 22 nt, Human
uuugaagaugccgcauuuggau

SEQ ID NO: 3021173 - RNA, 17 nt, Human
uuugaacugauaaagau

SEQ ID NO: 3021174 - RNA, 19 nt, Human
uuugaacugauaaagauga

SEQ ID NO: 3021175 - RNA, 15 nt, Human
uuugaacugauaaag

SEQ ID NO: 3021176 - RNA, 14 nt, Human
uuugaacucuucaa

SEQ ID NO: 3021177 - RNA, 18 nt, Human
uuucuuagggaaggauac

SEQ ID NO: 3021178 - RNA, 23 nt, Human
uuucuuagggaaggauacaaaag

SEQ ID NO: 3021179 - RNA, 13 nt, Human
uuucuucucccuc

SEQ ID NO: 3021180 - RNA, 12 nt, Human
uuucuucucccu

SEQ ID NO: 3021181 - RNA, 14 nt, Human
uuuggaaaagaaua

SEQ ID NO: 3021182 - RNA, 14 nt, Human
uuuggaauuuugug

SEQ ID NO: 3021183 - RNA, 15 nt, Human
uuugcuuugugauuu

SEQ ID NO: 3021184 - RNA, 16 nt, Human
uuugcuuugugauuuu

SEQ ID NO: 3021185 - RNA, 20 nt, Human
uuugcauauugcauacuauu

SEQ ID NO: 3021186 - RNA, 15 nt, Human
uuugcauauugcaua

SEQ ID NO: 3021187 - RNA, 13 nt, Human
uuugguuucuagc

SEQ ID NO: 3021188 - RNA, 21 nt, Human
uuuggaauuuugugcccccau

SEQ ID NO: 3021189 - RNA, 17 nt, Human
uuuggucuacacugugc

SEQ ID NO: 3021190 - RNA, 12 nt, Human
uuuguucccugu

SEQ ID NO: 3021191 - RNA, 21 nt, Human
uuuguucuggcucuuccaggc

SEQ ID NO: 3021192 - RNA, 17 nt, Human
uuuuaaagaaugcucuu

SEQ ID NO: 3021193 - RNA, 19 nt, Human
uuuuaauauggaucuguau

SEQ ID NO: 3021194 - RNA, 11 nt, Human
uuuuaaaugca

SEQ ID NO: 3021195 - RNA, 12 nt, Human
uuuuaaaugcac

SEQ ID NO: 3021196 - RNA, 21 nt, Human
uuuuaaaugcaccuggaauau

SEQ ID NO: 3021197 - RNA, 22 nt, Human
gccgugugugugcguccugucg

SEQ ID NO: 3021198 - RNA, 18 nt, Human
gccucaaccuccugggcu

SEQ ID NO: 3021199 - RNA, 19 nt, Human
gccucaaccuccugggcua

SEQ ID NO: 3021200 - RNA, 17 nt, Human
gccucaaccuccugggc

SEQ ID NO: 3021201 - RNA, 17 nt, Human
gccucacaguccuuacc

SEQ ID NO: 3021202 - RNA, 13 nt, Human
gccucacaguccu

SEQ ID NO: 3021203 - RNA, 23 nt, Human
gccguggugauuuagcaggaagc

SEQ ID NO: 3021204 - RNA, 20 nt, Human
gccguguaaccauggaccca

SEQ ID NO: 3021205 - RNA, 17 nt, Human
gccgucuaccugagggg

SEQ ID NO: 3021206 - RNA, 16 nt, Human
gccgucuaccugaggg

SEQ ID NO: 3021207 - RNA, 15 nt, Human
gccgucuaccugagg

SEQ ID NO: 3021208 - RNA, 18 nt, Human
gcccuuuuucaauaacug

SEQ ID NO: 3021209 - RNA, 16 nt, Human
gcccuuggccaugggu

SEQ ID NO: 3021210 - RNA, 18 nt, Human
gcccuucucuccagcccc

SEQ ID NO: 3021211 - RNA, 17 nt, Human
gcccuucucuccagccc

SEQ ID NO: 3021212 - RNA, 16 nt, Human
gcccuucucuccagcc

SEQ ID NO: 3021213 - RNA, 14 nt, Human
gcccuucucuccag

SEQ ID NO: 3021214 - RNA, 20 nt, Human
gccgagaucacgccacugca

SEQ ID NO: 3021215 - RNA, 21 nt, Human
gccgagaucacgccacugcac

SEQ ID NO: 3021216 - RNA, 22 nt, Human
gccgagaucacgccacugcacu

SEQ ID NO: 3021217 - RNA, 12 nt, Human
gccgcagcccug

SEQ ID NO: 3021218 - RNA, 11 nt, Human
gccgcagcccu

SEQ ID NO: 3021219 - RNA, 21 nt, Human
gccgggcgcgguggcucacgc

SEQ ID NO: 3021220 - RNA, 12 nt, Human
gccucugccucu

SEQ ID NO: 3021221 - RNA, 13 nt, Human
gccucugccucug

SEQ ID NO: 3021222 - RNA, 15 nt, Human
gccugcaagggagug

SEQ ID NO: 3021223 - RNA, 13 nt, Human
gccugcaagggag

SEQ ID NO: 3021224 - RNA, 14 nt, Human
gccucucucaggcc

SEQ ID NO: 3021225 - RNA, 13 nt, Human
gccucucucaggc

SEQ ID NO: 3021226 - RNA, 17 nt, Human
gccucugacacacagcu

SEQ ID NO: 3021227 - RNA, 18 nt, Human
gccucugacacacagcuc

SEQ ID NO: 3021228 - RNA, 16 nt, Human
gccucugacacacagc

SEQ ID NO: 3021229 - RNA, 16 nt, Human
gccucucucaggccaa

SEQ ID NO: 3021230 - RNA, 19 nt, Human
gccucugacacacagcucu

SEQ ID NO: 3021231 - RNA, 20 nt, Human
gccucugacacacagcucug

SEQ ID NO: 3021232 - RNA, 21 nt, Human
gccucugacacacagcucugu

SEQ ID NO: 3021233 - RNA, 14 nt, Human
gccucugcacuccc

SEQ ID NO: 3021234 - RNA, 18 nt, Human
gccucacaguccuuacca

SEQ ID NO: 3021235 - RNA, 15 nt, Human
gccucagcauccugg

SEQ ID NO: 3021236 - RNA, 16 nt, Human
gccucagcauccuggc

SEQ ID NO: 3021237 - RNA, 18 nt, Human
gccucccaaagugcuggg

SEQ ID NO: 3021238 - RNA, 19 nt, Human
gccucccaaagugcuggga

SEQ ID NO: 3021239 - RNA, 13 nt, Human
gccucccaacuca

SEQ ID NO: 3021240 - RNA, 16 nt, Human
gccucccaucacccgc

SEQ ID NO: 3021241 - RNA, 14 nt, Human
gccucccaucaccc

SEQ ID NO: 3021242 - RNA, 19 nt, Human
gccucccaacucaccccag

SEQ ID NO: 3021243 - RNA, 18 nt, Human
gccucccaacucacccca

SEQ ID NO: 3021244 - RNA, 17 nt, Human
gccucccaacucacccc

SEQ ID NO: 3021245 - RNA, 16 nt, Human
gccucccaacucaccc

SEQ ID NO: 3021246 - RNA, 20 nt, Human
gccucccgaguagcugggac

SEQ ID NO: 3021247 - RNA, 18 nt, Human
gccucccgaguagcuggg

SEQ ID NO: 3021248 - RNA, 19 nt, Human
gccucccgaguagcuggga

SEQ ID NO: 3021249 - RNA, 17 nt, Human
gccucccgaguagcugg

SEQ ID NO: 3021250 - RNA, 13 nt, Human
gcuacacaccuaa

SEQ ID NO: 3021251 - RNA, 20 nt, Human
gcuaagagggagggagggcu

SEQ ID NO: 3021252 - RNA, 13 nt, Human
gcuacacacugca

SEQ ID NO: 3021253 - RNA, 20 nt, Human
gcuacacacugcauguuugu

SEQ ID NO: 3021254 - RNA, 14 nt, Human
gcuacacaggggaa

SEQ ID NO: 3021255 - RNA, 13 nt, Human
gcuaagagggagg

SEQ ID NO: 3021256 - RNA, 16 nt, Human
gcuaccuuuguauucu

SEQ ID NO: 3021257 - RNA, 15 nt, Human
gcuaggaacacuccu

SEQ ID NO: 3021258 - RNA, 15 nt, Human
gcggacagccacggc

SEQ ID NO: 3021259 - RNA, 19 nt, Human
gcgucucauacucaccuca

SEQ ID NO: 3021260 - RNA, 11 nt, Human
gcggacagcca

SEQ ID NO: 3021261 - RNA, 13 nt, Human
gcggacagccacg

SEQ ID NO: 3021262 - RNA, 15 nt, Human
gcgccuacaggagug

SEQ ID NO: 3021263 - RNA, 18 nt, Human
gccugguggcagcugcgg

SEQ ID NO: 3021264 - RNA, 19 nt, Human
gccugguggcagcugcggu

SEQ ID NO: 3021265 - RNA, 21 nt, Human
gccugguggcagcugcggucc

SEQ ID NO: 3021266 - RNA, 13 nt, Human
gccugguggcagc

SEQ ID NO: 3021267 - RNA, 22 nt, Human
gccugggggcugggcagaggaa

SEQ ID NO: 3021268 - RNA, 21 nt, Human
gccugggggcugggcagagga

SEQ ID NO: 3021269 - RNA, 14 nt, Human
gccuuauggaacac

SEQ ID NO: 3021270 - RNA, 10 nt, Human
gccuuaugga

SEQ ID NO: 3021271 - RNA, 19 nt, Human
gccuuagaagucacacagu

SEQ ID NO: 3021272 - RNA, 17 nt, Human
gccuuagaagucacaca

SEQ ID NO: 3021273 - RNA, 18 nt, Human
gccuuagaagucacacag

SEQ ID NO: 3021274 - RNA, 21 nt, Human
gccuguugggccaggagccuc

SEQ ID NO: 3021275 - RNA, 21 nt, Human
gccuuacacaaugguuuucuu

SEQ ID NO: 3021276 - RNA, 18 nt, Human
gccuuacccucauguucu

SEQ ID NO: 3021277 - RNA, 16 nt, Human
gccuuacacaaugguu

SEQ ID NO: 3021278 - RNA, 20 nt, Human
gccuuacacaaugguuuucu

SEQ ID NO: 3021279 - RNA, 16 nt, Human
gccuuccagggguggg

SEQ ID NO: 3021280 - RNA, 15 nt, Human
gccuuccaggggugg

SEQ ID NO: 3021281 - RNA, 12 nt, Human
gccuuccagggg

SEQ ID NO: 3021282 - RNA, 20 nt, Human
gccuuauggaacacucugag

SEQ ID NO: 3021283 - RNA, 19 nt, Human
gccuuauggaacacucuga

SEQ ID NO: 3021284 - RNA, 18 nt, Human
gccuuauggaacacucug

SEQ ID NO: 3021285 - RNA, 16 nt, Human
gccuuauggaacacuc

SEQ ID NO: 3021286 - RNA, 23 nt, Human
gcgacaaugcaaaccaucauuga

SEQ ID NO: 3021287 - RNA, 13 nt, Human
gccuuuggcuuca

SEQ ID NO: 3021288 - RNA, 20 nt, Human
gccaugaggaacaaggcaag

SEQ ID NO: 3021289 - RNA, 14 nt, Human
gccaugcuccuggc

SEQ ID NO: 3021290 - RNA, 13 nt, Human
gccaggcuggucu

SEQ ID NO: 3021291 - RNA, 15 nt, Human
gccaggcuggucuca

SEQ ID NO: 3021292 - RNA, 23 nt, Human
gccaguaaaugggggugcauuug

SEQ ID NO: 3021293 - RNA, 12 nt, Human
gccaguaaaugg

SEQ ID NO: 3021294 - RNA, 21 nt, Human
gccagucaccccggccaccug

SEQ ID NO: 3021295 - RNA, 14 nt, Human
gcccacuucugcca

SEQ ID NO: 3021296 - RNA, 13 nt, Human
gcccaccuuggcu

SEQ ID NO: 3021297 - RNA, 15 nt, Human
gcccaccuuggcuca

SEQ ID NO: 3021298 - RNA, 16 nt, Human
gcccaccuuggcucaa

SEQ ID NO: 3021299 - RNA, 16 nt, Human
gcccaccuggccucug

SEQ ID NO: 3021300 - RNA, 15 nt, Human
gcccaccuggccucu

SEQ ID NO: 3021301 - RNA, 24 nt, Human
gcccaccuggccucugcacucccc

SEQ ID NO: 3021302 - RNA, 21 nt, Human
gcccaccuggccucugcacuc

SEQ ID NO: 3021303 - RNA, 20 nt, Human
gcccaccuggccucugcacu

SEQ ID NO: 3021304 - RNA, 17 nt, Human
gcccaccuggccucugc

SEQ ID NO: 3021305 - RNA, 15 nt, Human
gccaugggccuccug

SEQ ID NO: 3021306 - RNA, 16 nt, Human
gccaugggccuccugu

SEQ ID NO: 3021307 - RNA, 20 nt, Human
gccaggaagccagcaggcuc

SEQ ID NO: 3021308 - RNA, 15 nt, Human
gccaggaagccagca

SEQ ID NO: 3021309 - RNA, 16 nt, Human
gccaggagccuccugc

SEQ ID NO: 3021310 - RNA, 14 nt, Human
gccaggagccuccu

SEQ ID NO: 3021311 - RNA, 20 nt, Human
gccaggagccuccugcccuu

SEQ ID NO: 3021312 - RNA, 19 nt, Human
gccaggagccuccugcccu

SEQ ID NO: 3021313 - RNA, 16 nt, Human
gccagcugcuugggcu

SEQ ID NO: 3021314 - RNA, 18 nt, Human
gccagcugcuugggcuuc

SEQ ID NO: 3021315 - RNA, 17 nt, Human
gccagcugcuugggcuu

SEQ ID NO: 3021316 - RNA, 14 nt, Human
gccaggaagccagc

SEQ ID NO: 3021317 - RNA, 13 nt, Human
gccaggaagccag

SEQ ID NO: 3021318 - RNA, 12 nt, Human
gccaggaagcca

SEQ ID NO: 3021319 - RNA, 20 nt, Human
gccagcugcuugggcuucau

SEQ ID NO: 3021320 - RNA, 19 nt, Human
gccagauucuuuccugagg

SEQ ID NO: 3021321 - RNA, 21 nt, Human
gccagccgagauagccaaggc

SEQ ID NO: 3021322 - RNA, 22 nt, Human
gccagccgagauagccaaggcc

SEQ ID NO: 3021323 - RNA, 15 nt, Human
gccagaugcaccagc

SEQ ID NO: 3021324 - RNA, 20 nt, Human
gccagauucuuuccugaggc

SEQ ID NO: 3021325 - RNA, 13 nt, Human
gccagauuucacu

SEQ ID NO: 3021326 - RNA, 24 nt, Human
gccagauucuuuccugaggcuggg

SEQ ID NO: 3021327 - RNA, 14 nt, Human
gccagaugcaccag

SEQ ID NO: 3021328 - RNA, 20 nt, Human
gccacugcaccgggccacag

SEQ ID NO: 3021329 - RNA, 21 nt, Human
gccacugcaccgggccacaga

SEQ ID NO: 3021330 - RNA, 19 nt, Human
gccacugcaccgggccaca

SEQ ID NO: 3021331 - RNA, 22 nt, Human
gccagagacacaagccuucggc

SEQ ID NO: 3021332 - RNA, 21 nt, Human
gccagagacacaagccuucgg

SEQ ID NO: 3021333 - RNA, 20 nt, Human
gccaaggccaaaggaagcac

SEQ ID NO: 3021334 - RNA, 19 nt, Human
gccaaggccaaaggaagca

SEQ ID NO: 3021335 - RNA, 24 nt, Human
gccaaggccaaaggaagcacaugc

SEQ ID NO: 3021336 - RNA, 22 nt, Human
gcccaguuggguggaugccugg

SEQ ID NO: 3021337 - RNA, 15 nt, Human
gcccagagagggugg

SEQ ID NO: 3021338 - RNA, 21 nt, Human
gcccagagaggguggugaccu

SEQ ID NO: 3021339 - RNA, 23 nt, Human
gcccaggccccugccacccuggg

SEQ ID NO: 3021340 - RNA, 13 nt, Human
gcccaggccuccu

SEQ ID NO: 3021341 - RNA, 22 nt, Human
gcccaggccccugccacccugg

SEQ ID NO: 3021342 - RNA, 12 nt, Human
gcccaggcuggc

SEQ ID NO: 3021343 - RNA, 14 nt, Human
gccccauucugccu

SEQ ID NO: 3021344 - RNA, 22 nt, Human
gccccauccucuguacagagcc

SEQ ID NO: 3021345 - RNA, 14 nt, Human
gccccauccucugu

SEQ ID NO: 3021346 - RNA, 13 nt, Human
gccccauccucug

SEQ ID NO: 3021347 - RNA, 21 nt, Human
gccccagugcccacaggauca

SEQ ID NO: 3021348 - RNA, 13 nt, Human
gccccagugccca

SEQ ID NO: 3021349 - RNA, 14 nt, Human
gccccagugcccac

SEQ ID NO: 3021350 - RNA, 18 nt, Human
gccccaucccaaacccuu

SEQ ID NO: 3021351 - RNA, 12 nt, Human
gccccagugccc

SEQ ID NO: 3021352 - RNA, 20 nt, Human
gccccuucugacccaugcug

SEQ ID NO: 3021353 - RNA, 15 nt, Human
gccccgaggccuucu

SEQ ID NO: 3021354 - RNA, 23 nt, Human
gccccucaacucuccuccagagu

SEQ ID NO: 3021355 - RNA, 18 nt, Human
gccccgaggccuucucug

SEQ ID NO: 3021356 - RNA, 14 nt, Human
gccccucagggucc

SEQ ID NO: 3021357 - RNA, 18 nt, Human
gccccucagggucccugg

SEQ ID NO: 3021358 - RNA, 16 nt, Human
gccccucagggucccu

SEQ ID NO: 3021359 - RNA, 21 nt, Human
gcccuccaagaccuucuccuu

SEQ ID NO: 3021360 - RNA, 19 nt, Human
gcccuccaagaccuucucc

SEQ ID NO: 3021361 - RNA, 23 nt, Human
gcccuccaagaccuucuccuuca

SEQ ID NO: 3021362 - RNA, 22 nt, Human
gcccuccaagaccuucuccuuc

SEQ ID NO: 3021363 - RNA, 19 nt, Human
gcccucugcccacucccug

SEQ ID NO: 3021364 - RNA, 18 nt, Human
gcccucugcccacucccu

SEQ ID NO: 3021365 - RNA, 16 nt, Human
gcccucugcccacucc

SEQ ID NO: 3021366 - RNA, 13 nt, Human
gcccucugcccac

SEQ ID NO: 3021367 - RNA, 13 nt, Human
gcccugcagaggg

SEQ ID NO: 3021368 - RNA, 14 nt, Human
gcccugcagagggc

SEQ ID NO: 3021369 - RNA, 15 nt, Human
gcccugcagagggca

SEQ ID NO: 3021370 - RNA, 19 nt, Human
gcagcccucaauugugaaa

SEQ ID NO: 3021371 - RNA, 13 nt, Human
gcagcccugcaga

SEQ ID NO: 3021372 - RNA, 21 nt, Human
gcagccccuguucuggcagag

SEQ ID NO: 3021373 - RNA, 20 nt, Human
gcagccccuguucuggcaga

SEQ ID NO: 3021374 - RNA, 17 nt, Human
gcagccccauucugccu

SEQ ID NO: 3021375 - RNA, 16 nt, Human
gcagcaauaaagcagc

SEQ ID NO: 3021376 - RNA, 23 nt, Human
gcagcaauaaagcagcguuucua

SEQ ID NO: 3021377 - RNA, 18 nt, Human
gcagccccauucugccug

SEQ ID NO: 3021378 - RNA, 19 nt, Human
gcagccccauucugccugc

SEQ ID NO: 3021379 - RNA, 21 nt, Human
gcagccccauucugccugccc

SEQ ID NO: 3021380 - RNA, 24 nt, Human
gcagccccauucugccugcccagg

SEQ ID NO: 3021381 - RNA, 22 nt, Human
gcagauacaggaaaagcugcug

SEQ ID NO: 3021382 - RNA, 12 nt, Human
gcagcaauaaag

SEQ ID NO: 3021383 - RNA, 17 nt, Human
gcagacaguuaagagaa

SEQ ID NO: 3021384 - RNA, 21 nt, Human
gcagaguugaagacagagcua

SEQ ID NO: 3021385 - RNA, 20 nt, Human
gcagaguugaagacagagcu

SEQ ID NO: 3021386 - RNA, 12 nt, Human
gcaggcagccag

SEQ ID NO: 3021387 - RNA, 14 nt, Human
gcaggcagccaggc

SEQ ID NO: 3021388 - RNA, 13 nt, Human
gcaggcagccagg

SEQ ID NO: 3021389 - RNA, 20 nt, Human
gcaggaggaucacuugaguc

SEQ ID NO: 3021390 - RNA, 23 nt, Human
gcaggaggaucacuugaguccag

SEQ ID NO: 3021391 - RNA, 14 nt, Human
gcagcucaccucuc

SEQ ID NO: 3021392 - RNA, 15 nt, Human
gcagccuuggcaaac

SEQ ID NO: 3021393 - RNA, 15 nt, Human
gcagcucaccucucc

SEQ ID NO: 3021394 - RNA, 17 nt, Human
gcagcccugcagagggc

SEQ ID NO: 3021395 - RNA, 16 nt, Human
gcagcccugcagaggg

SEQ ID NO: 3021396 - RNA, 15 nt, Human
gcagcccugcagagg

SEQ ID NO: 3021397 - RNA, 14 nt, Human
gcagcccugcagag

SEQ ID NO: 3021398 - RNA, 17 nt, Human
gcacugguuuguucccu

SEQ ID NO: 3021399 - RNA, 20 nt, Human
gcacugcuuccagugaggcu

SEQ ID NO: 3021400 - RNA, 18 nt, Human
gcacugcuuccagugagg

SEQ ID NO: 3021401 - RNA, 16 nt, Human
gcacugcuuccaguga

SEQ ID NO: 3021402 - RNA, 19 nt, Human
gcacugguuuguucccugu

SEQ ID NO: 3021403 - RNA, 23 nt, Human
gcagacaggcaagcaccuccugc

SEQ ID NO: 3021404 - RNA, 19 nt, Human
gcagacaggcaagcaccuc

SEQ ID NO: 3021405 - RNA, 15 nt, Human
gcagacaggaccagg

SEQ ID NO: 3021406 - RNA, 13 nt, Human
gcagacaggacca

SEQ ID NO: 3021407 - RNA, 12 nt, Human
gcagacaggacc

SEQ ID NO: 3021408 - RNA, 14 nt, Human
gcaauggcagccuu

SEQ ID NO: 3021409 - RNA, 20 nt, Human
gcaccacugcacuccagccu

SEQ ID NO: 3021410 - RNA, 12 nt, Human
gcaauggcagcc

SEQ ID NO: 3021411 - RNA, 13 nt, Human
gcaauggcagccu

SEQ ID NO: 3021412 - RNA, 14 nt, Human
gcaccagcagccug

SEQ ID NO: 3021413 - RNA, 15 nt, Human
gcaccagcagccugg

SEQ ID NO: 3021414 - RNA, 22 nt, Human
gcaccacugcacuccagccugg

SEQ ID NO: 3021415 - RNA, 21 nt, Human
gcaccacugcacuccagccug

SEQ ID NO: 3021416 - RNA, 16 nt, Human
gcaccagcagccugga

SEQ ID NO: 3021417 - RNA, 22 nt, Human
gcacccaccaucaugucuggcu

SEQ ID NO: 3021418 - RNA, 18 nt, Human
gcacccggccccugcugg

SEQ ID NO: 3021419 - RNA, 19 nt, Human
gcacccggccccugcuggu

SEQ ID NO: 3021420 - RNA, 22 nt, Human
gcaccuggaauauauaaccagu

SEQ ID NO: 3021421 - RNA, 17 nt, Human
gcaccuuagacaguccc

SEQ ID NO: 3021422 - RNA, 14 nt, Human
gcaccuuagacagu

SEQ ID NO: 3021423 - RNA, 15 nt, Human
gcacccucaggcagg

SEQ ID NO: 3021424 - RNA, 18 nt, Human
gcaccuggaauauauaac

SEQ ID NO: 3021425 - RNA, 21 nt, Human
gcaccuggaauauauaaccag

SEQ ID NO: 3021426 - RNA, 18 nt, Human
gcaccuuagacagucccu

SEQ ID NO: 3021427 - RNA, 12 nt, Human
gcacgauuucug

SEQ ID NO: 3021428 - RNA, 17 nt, Human
gcagugcuuggcccagg

SEQ ID NO: 3021429 - RNA, 18 nt, Human
gcagugcuuggcccagga

SEQ ID NO: 3021430 - RNA, 19 nt, Human
gcagugcuuggcccaggag

SEQ ID NO: 3021431 - RNA, 20 nt, Human
gcagugcuuggcccaggagu

SEQ ID NO: 3021432 - RNA, 16 nt, Human
gcagugcaugcugucc

SEQ ID NO: 3021433 - RNA, 15 nt, Human
gcagugcaugcuguc

SEQ ID NO: 3021434 - RNA, 19 nt, Human
gcaggucuugaacuccugg

SEQ ID NO: 3021435 - RNA, 20 nt, Human
gcaggucuugaacuccuggc

SEQ ID NO: 3021436 - RNA, 22 nt, Human
gcagguccaggguuugaguuca

SEQ ID NO: 3021437 - RNA, 19 nt, Human
gcagggcucagcggggaca

SEQ ID NO: 3021438 - RNA, 21 nt, Human
gcagggcucagcggggacagc

SEQ ID NO: 3021439 - RNA, 16 nt, Human
gcaggcagccaggcca

SEQ ID NO: 3021440 - RNA, 15 nt, Human
gcaggcagccaggcc

SEQ ID NO: 3021441 - RNA, 14 nt, Human
gcagggcucagcgg

SEQ ID NO: 3021442 - RNA, 17 nt, Human
gcagggucucacucugu

SEQ ID NO: 3021443 - RNA, 18 nt, Human
gcagggucucacucuguc

SEQ ID NO: 3021444 - RNA, 22 nt, Human
gcaguggugguuuucuguucuu

SEQ ID NO: 3021445 - RNA, 23 nt, Human
gcaguggugguuuucuguucuuu

SEQ ID NO: 3021446 - RNA, 13 nt, Human
gcagugggagcug

SEQ ID NO: 3021447 - RNA, 12 nt, Human
gcagugggagcu

SEQ ID NO: 3021448 - RNA, 14 nt, Human
gcagugggagcugc

SEQ ID NO: 3021449 - RNA, 15 nt, Human
gcagugggagcugcc

SEQ ID NO: 3021450 - RNA, 17 nt, Human
gcaguuauuaacacuaa

SEQ ID NO: 3021451 - RNA, 18 nt, Human
gcaugcgggcuuccuccu

SEQ ID NO: 3021452 - RNA, 14 nt, Human
gcauguucucugag

SEQ ID NO: 3021453 - RNA, 15 nt, Human
gcauguucucugagg

SEQ ID NO: 3021454 - RNA, 21 nt, Human
gcauguucucugaggacacua

SEQ ID NO: 3021455 - RNA, 22 nt, Human
gcauguucucugaggacacuaa

SEQ ID NO: 3021456 - RNA, 17 nt, Human
gcauuaucuagauacug

SEQ ID NO: 3021457 - RNA, 21 nt, Human
gcauuugaggucuguucuuuc

SEQ ID NO: 3021458 - RNA, 13 nt, Human
gcauuugcugaau

SEQ ID NO: 3021459 - RNA, 14 nt, Human
gcauuugcugaaua

SEQ ID NO: 3021460 - RNA, 16 nt, Human
gcauuuguuugaacug

SEQ ID NO: 3021461 - RNA, 13 nt, Human
gccaaagccaaag

SEQ ID NO: 3021462 - RNA, 20 nt, Human
gccaaagccaaagcuaggcc

SEQ ID NO: 3021463 - RNA, 19 nt, Human
gccaaagccuccuccagcc

SEQ ID NO: 3021464 - RNA, 16 nt, Human
gccaaagccuccucca

SEQ ID NO: 3021465 - RNA, 16 nt, Human
gccaaagcuaggccug

SEQ ID NO: 3021466 - RNA, 22 nt, Human
gccaaagcuaggccuggccaga

SEQ ID NO: 3021467 - RNA, 18 nt, Human
gcauuuguuugaacugau

SEQ ID NO: 3021468 - RNA, 16 nt, Human
gccaaacucaccugcc

SEQ ID NO: 3021469 - RNA, 14 nt, Human
gccaaacucaccug

SEQ ID NO: 3021470 - RNA, 12 nt, Human
gauucauauuua

SEQ ID NO: 3021471 - RNA, 17 nt, Human
gauucauauuuacuucu

SEQ ID NO: 3021472 - RNA, 18 nt, Human
gauucauauuuacuucuu

SEQ ID NO: 3021473 - RNA, 19 nt, Human
gauucauauuuacuucuua

SEQ ID NO: 3021474 - RNA, 18 nt, Human
gauucccaagcucugcuc

SEQ ID NO: 3021475 - RNA, 19 nt, Human
gauucagacagcugccugg

SEQ ID NO: 3021476 - RNA, 15 nt, Human
gauucagcucugcaa

SEQ ID NO: 3021477 - RNA, 13 nt, Human
gauucagcucugc

SEQ ID NO: 3021478 - RNA, 19 nt, Human
gauggggcugcaccggcug

SEQ ID NO: 3021479 - RNA, 23 nt, Human
gauggggcugcaccggcuggccu

SEQ ID NO: 3021480 - RNA, 21 nt, Human
gauugcaacaggcugggcuuc

SEQ ID NO: 3021481 - RNA, 23 nt, Human
gauugcaccacugcacuccagcc

SEQ ID NO: 3021482 - RNA, 16 nt, Human
gauugcaccacugcac

SEQ ID NO: 3021483 - RNA, 20 nt, Human
gauugcaacaggcugggcuu

SEQ ID NO: 3021484 - RNA, 18 nt, Human
gauucuuuccugaggcug

SEQ ID NO: 3021485 - RNA, 17 nt, Human
gauucuuuccugaggcu

SEQ ID NO: 3021486 - RNA, 16 nt, Human
gauucuuuccugaggc

SEQ ID NO: 3021487 - RNA, 12 nt, Human
gauucuuuccug

SEQ ID NO: 3021488 - RNA, 19 nt, Human
gauucccaagcucugcucc

SEQ ID NO: 3021489 - RNA, 20 nt, Human
gauucccaagcucugcuccu

SEQ ID NO: 3021490 - RNA, 11 nt, Human
gauuuucagcc

SEQ ID NO: 3021491 - RNA, 15 nt, Human
gauuuucagcccuca

SEQ ID NO: 3021492 - RNA, 19 nt, Human
gauuuucagcccucagaau

SEQ ID NO: 3021493 - RNA, 11 nt, Human
gauuucuguuu

SEQ ID NO: 3021494 - RNA, 19 nt, Human
gauuucuguuuagauaaua

SEQ ID NO: 3021495 - RNA, 15 nt, Human
gauuuccguuaaaau

SEQ ID NO: 3021496 - RNA, 18 nt, Human
gauuuccguuaaaauacc

SEQ ID NO: 3021497 - RNA, 23 nt, Human
gcaagacgcugugcugcccugcc

SEQ ID NO: 3021498 - RNA, 22 nt, Human
gcaagacgcugugcugcccugc

SEQ ID NO: 3021499 - RNA, 21 nt, Human
gcaagacgcugugcugcccug

SEQ ID NO: 3021500 - RNA, 20 nt, Human
gcaagacgcugugcugcccu

SEQ ID NO: 3021501 - RNA, 14 nt, Human
gcaagacgcugugc

SEQ ID NO: 3021502 - RNA, 17 nt, Human
gcaagaauugaagcagg

SEQ ID NO: 3021503 - RNA, 16 nt, Human
gcaaaguaucccuacu

SEQ ID NO: 3021504 - RNA, 23 nt, Human
gcaaugaccuuucaauaggaaaa

SEQ ID NO: 3021505 - RNA, 13 nt, Human
gcaaugcuggcug

SEQ ID NO: 3021506 - RNA, 14 nt, Human
gcaaugcuggcugu

SEQ ID NO: 3021507 - RNA, 22 nt, Human
gcaaugcuggcuguuggcuggg

SEQ ID NO: 3021508 - RNA, 23 nt, Human
gcaaugcuggcuguuggcugggg

SEQ ID NO: 3021509 - RNA, 17 nt, Human
gcaaucaaaucugcuuu

SEQ ID NO: 3021510 - RNA, 15 nt, Human
gcaaucaaaucugcu

SEQ ID NO: 3021511 - RNA, 22 nt, Human
gcaaugaccuuucaauaggaaa

SEQ ID NO: 3021512 - RNA, 20 nt, Human
gcaaugaccuuucaauagga

SEQ ID NO: 3021513 - RNA, 17 nt, Human
gcaaugaccuuucaaua

SEQ ID NO: 3021514 - RNA, 15 nt, Human
gcaaugaccuuucaa

SEQ ID NO: 3021515 - RNA, 18 nt, Human
gcaaggagauuuacaacu

SEQ ID NO: 3021516 - RNA, 11 nt, Human
gcaaggcuguc

SEQ ID NO: 3021517 - RNA, 15 nt, Human
gaugacauucccugc

SEQ ID NO: 3021518 - RNA, 23 nt, Human
gaugacauugacuauuuuuguuu

SEQ ID NO: 3021519 - RNA, 21 nt, Human
gaugacauugacuauuuuugu

SEQ ID NO: 3021520 - RNA, 17 nt, Human
gaugacauugacuauuu

SEQ ID NO: 3021521 - RNA, 17 nt, Human
gaugacauucccugcua

SEQ ID NO: 3021522 - RNA, 13 nt, Human
gaugcaccagccc

SEQ ID NO: 3021523 - RNA, 21 nt, Human
gaugcacagaguuguuacauu

SEQ ID NO: 3021524 - RNA, 22 nt, Human
gaugcacagaguuguuacauuu

SEQ ID NO: 3021525 - RNA, 17 nt, Human
gaugccugguggcagcu

SEQ ID NO: 3021526 - RNA, 12 nt, Human
gaugcagccuca

SEQ ID NO: 3021527 - RNA, 14 nt, Human
gaugcagccucaca

SEQ ID NO: 3021528 - RNA, 20 nt, Human
gaugccugguggcagcugcg

SEQ ID NO: 3021529 - RNA, 18 nt, Human
gaugccugguggcagcug

SEQ ID NO: 3021530 - RNA, 19 nt, Human
gaugccugguggcagcugc

SEQ ID NO: 3021531 - RNA, 22 nt, Human
gauggauuuccagccaaagccu

SEQ ID NO: 3021532 - RNA, 13 nt, Human
gauggggcccugc

SEQ ID NO: 3021533 - RNA, 22 nt, Human
gauggggcccugccuccuuugu

SEQ ID NO: 3021534 - RNA, 14 nt, Human
gauggggcccugcc

SEQ ID NO: 3021535 - RNA, 15 nt, Human
gaugaaggucuguuu

SEQ ID NO: 3021536 - RNA, 18 nt, Human
gaugaaggucuguuuugu

SEQ ID NO: 3021537 - RNA, 18 nt, Human
gaucuuugcagacaggca

SEQ ID NO: 3021538 - RNA, 17 nt, Human
gaucuuugcagacaggc

SEQ ID NO: 3021539 - RNA, 16 nt, Human
gaucccucauccucau

SEQ ID NO: 3021540 - RNA, 15 nt, Human
gaucccucauccuca

SEQ ID NO: 3021541 - RNA, 22 nt, Human
gauccugagccagauuucacuc

SEQ ID NO: 3021542 - RNA, 21 nt, Human
gauccugagccagauuucacu

SEQ ID NO: 3021543 - RNA, 14 nt, Human
gauaauacaccacu

SEQ ID NO: 3021544 - RNA, 18 nt, Human
gauaauacaccacuacau

SEQ ID NO: 3021545 - RNA, 21 nt, Human
gauaauacaccacuacauucu

SEQ ID NO: 3021546 - RNA, 22 nt, Human
gauaauacaccacuacauucug

SEQ ID NO: 3021547 - RNA, 18 nt, Human
gauacaggaaaagcugcu

SEQ ID NO: 3021548 - RNA, 20 nt, Human
gauagcacagacccugcccu

SEQ ID NO: 3021549 - RNA, 22 nt, Human
gauagcacagacccugcccugu

SEQ ID NO: 3021550 - RNA, 21 nt, Human
gauagcacagacccugcccug

SEQ ID NO: 3021551 - RNA, 21 nt, Human
gaggaaggaaacccagcucug

SEQ ID NO: 3021552 - RNA, 20 nt, Human
gaggaaggaaacccagcucu

SEQ ID NO: 3021553 - RNA, 19 nt, Human
gaggaaggaaacccagcuc

SEQ ID NO: 3021554 - RNA, 13 nt, Human
gaggaaggaaacc

SEQ ID NO: 3021555 - RNA, 17 nt, Human
gaucauccacugugcca

SEQ ID NO: 3021556 - RNA, 19 nt, Human
gaucauccacugugccaug

SEQ ID NO: 3021557 - RNA, 16 nt, Human
gaucauccacugugcc

SEQ ID NO: 3021558 - RNA, 21 nt, Human
gaucauccacugugccaugug

SEQ ID NO: 3021559 - RNA, 22 nt, Human
gaucagucugauucccaagcuc

SEQ ID NO: 3021560 - RNA, 15 nt, Human
gaucagccugggcaa

SEQ ID NO: 3021561 - RNA, 12 nt, Human
gaucagccuggg

SEQ ID NO: 3021562 - RNA, 12 nt, Human
gaucacggcuca

SEQ ID NO: 3021563 - RNA, 16 nt, Human
gaucacgccacugcac

SEQ ID NO: 3021564 - RNA, 18 nt, Human
gaucacgccacugcacua

SEQ ID NO: 3021565 - RNA, 13 nt, Human
gaagucuucuauu

SEQ ID NO: 3021566 - RNA, 17 nt, Human
gaagucuucuauuuauu

SEQ ID NO: 3021567 - RNA, 14 nt, Human
gaagucuuuguaca

SEQ ID NO: 3021568 - RNA, 16 nt, Human
gaagucuuuguacaga

SEQ ID NO: 3021569 - RNA, 21 nt, Human
gacaaggauugcuacuguccu

SEQ ID NO: 3021570 - RNA, 22 nt, Human
gacaaggauugcuacuguccua

SEQ ID NO: 3021571 - RNA, 16 nt, Human
gacaaugacccagugg

SEQ ID NO: 3021572 - RNA, 12 nt, Human
gacacaggcccg

SEQ ID NO: 3021573 - RNA, 15 nt, Human
gacacaggcccggcu

SEQ ID NO: 3021574 - RNA, 17 nt, Human
gacacaggcccggcucc

SEQ ID NO: 3021575 - RNA, 22 nt, Human
gacacaagccuucggcgccuua

SEQ ID NO: 3021576 - RNA, 13 nt, Human
gacaauuuauuau

SEQ ID NO: 3021577 - RNA, 19 nt, Human
gacaauuuauuauggcaca

SEQ ID NO: 3021578 - RNA, 12 nt, Human
gacaauuuauua

SEQ ID NO: 3021579 - RNA, 18 nt, Human
gacaaugcaaaccaucau

SEQ ID NO: 3021580 - RNA, 16 nt, Human
gacaaugcaaaccauc

SEQ ID NO: 3021581 - RNA, 17 nt, Human
gacaaugacuuacugua

SEQ ID NO: 3021582 - RNA, 20 nt, Human
gacaaugacuuacuguacau

SEQ ID NO: 3021583 - RNA, 12 nt, Human
gacaaugcaaac

SEQ ID NO: 3021584 - RNA, 21 nt, Human
gacaaugacuuacuguacaug

SEQ ID NO: 3021585 - RNA, 15 nt, Human
gacacgaauauugcu

SEQ ID NO: 3021586 - RNA, 18 nt, Human
gacaccuugacagggcac

SEQ ID NO: 3021587 - RNA, 20 nt, Human
gacaccuugacagggcacac

SEQ ID NO: 3021588 - RNA, 15 nt, Human
gacaccuugacaggg

SEQ ID NO: 3021589 - RNA, 17 nt, Human
gacaccuugacagggca

SEQ ID NO: 3021590 - RNA, 19 nt, Human
gacacgaauauugcugaug

SEQ ID NO: 3021591 - RNA, 18 nt, Human
gacacgaauauugcugau

SEQ ID NO: 3021592 - RNA, 17 nt, Human
gacacgaauauugcuga

SEQ ID NO: 3021593 - RNA, 15 nt, Human
gacacuaaccacgcu

SEQ ID NO: 3021594 - RNA, 16 nt, Human
gacacuaaccacgcug

SEQ ID NO: 3021595 - RNA, 17 nt, Human
gacacuaaccacgcugg

SEQ ID NO: 3021596 - RNA, 18 nt, Human
gacacuaaccacgcugga

SEQ ID NO: 3021597 - RNA, 23 nt, Human
gacacccugugauggggcccugc

SEQ ID NO: 3021598 - RNA, 22 nt, Human
gacacccugugauggggcccug

SEQ ID NO: 3021599 - RNA, 13 nt, Human
gacacccugugau

SEQ ID NO: 3021600 - RNA, 12 nt, Human
gacacccuguga

SEQ ID NO: 3021601 - RNA, 18 nt, Human
gacacaggcccggcucca

SEQ ID NO: 3021602 - RNA, 13 nt, Human
gacagcugccugg

SEQ ID NO: 3021603 - RNA, 12 nt, Human
gacagcugccug

SEQ ID NO: 3021604 - RNA, 12 nt, Human
gacagacacagg

SEQ ID NO: 3021605 - RNA, 14 nt, Human
gacagacacaggcc

SEQ ID NO: 3021606 - RNA, 20 nt, Human
gacacuaaccacgcuggacc

SEQ ID NO: 3021607 - RNA, 21 nt, Human
gacacuaaccacgcuggaccu

SEQ ID NO: 3021608 - RNA, 15 nt, Human
gacagacacaggccc

SEQ ID NO: 3021609 - RNA, 16 nt, Human
gacagacacaggcccg

SEQ ID NO: 3021610 - RNA, 14 nt, Human
gacaggcaaugcug

SEQ ID NO: 3021611 - RNA, 16 nt, Human
gacaggcaaugcuggc

SEQ ID NO: 3021612 - RNA, 24 nt, Human
gacaggcaaugcuggcuguuggcu

SEQ ID NO: 3021613 - RNA, 17 nt, Human
gacaggcaaugcuggcu

SEQ ID NO: 3021614 - RNA, 18 nt, Human
gacaggcauguucucuga

SEQ ID NO: 3021615 - RNA, 19 nt, Human
gacaggcauguucucugag

SEQ ID NO: 3021616 - RNA, 15 nt, Human
gacagcugccuggga

SEQ ID NO: 3021617 - RNA, 14 nt, Human
gacagcugccuggg

SEQ ID NO: 3021618 - RNA, 15 nt, Human
gacauacuaaccagc

SEQ ID NO: 3021619 - RNA, 16 nt, Human
gacauacuaaccagca

SEQ ID NO: 3021620 - RNA, 23 nt, Human
gacauacuaaccagcagaaaugc

SEQ ID NO: 3021621 - RNA, 21 nt, Human
gacaugucuuuucuugcauga

SEQ ID NO: 3021622 - RNA, 17 nt, Human
gacaugucuuuucuugc

SEQ ID NO: 3021623 - RNA, 22 nt, Human
gacguguuaugacuccagaauu

SEQ ID NO: 3021624 - RNA, 12 nt, Human
gacuacaggcac

SEQ ID NO: 3021625 - RNA, 17 nt, Human
gacuacucccccaggug

SEQ ID NO: 3021626 - RNA, 14 nt, Human
gacuccugcaggca

SEQ ID NO: 3021627 - RNA, 16 nt, Human
gacuccugcaggcagc

SEQ ID NO: 3021628 - RNA, 15 nt, Human
gacuccugcaggcag

SEQ ID NO: 3021629 - RNA, 20 nt, Human
gacguguuaugacuccagaa

SEQ ID NO: 3021630 - RNA, 17 nt, Human
gacguguuaugacucca

SEQ ID NO: 3021631 - RNA, 14 nt, Human
gacggagucccacc

SEQ ID NO: 3021632 - RNA, 18 nt, Human
gacggagucccaccuugg

SEQ ID NO: 3021633 - RNA, 21 nt, Human
gacggagucccaccuuggcug

SEQ ID NO: 3021634 - RNA, 21 nt, Human
gaccuuucaauaggaaaaacu

SEQ ID NO: 3021635 - RNA, 23 nt, Human
gaccuugaacuggguacuugugg

SEQ ID NO: 3021636 - RNA, 13 nt, Human
gaccccuccaugu

SEQ ID NO: 3021637 - RNA, 18 nt, Human
gacccugaggcccagagg

SEQ ID NO: 3021638 - RNA, 21 nt, Human
gacccugaggcccagagggcc

SEQ ID NO: 3021639 - RNA, 12 nt, Human
gacccugcccug

SEQ ID NO: 3021640 - RNA, 20 nt, Human
gacccugaggcccagagggc

SEQ ID NO: 3021641 - RNA, 19 nt, Human
gacccugaggcccagaggg

SEQ ID NO: 3021642 - RNA, 15 nt, Human
gacccugcccugugg

SEQ ID NO: 3021643 - RNA, 13 nt, Human
gacccugcccugu

SEQ ID NO: 3021644 - RNA, 16 nt, Human
gacccugcccuguggg

SEQ ID NO: 3021645 - RNA, 23 nt, Human
gacccugucucaaaaaaagaaaa

SEQ ID NO: 3021646 - RNA, 13 nt, Human
gacccaugcugcc

SEQ ID NO: 3021647 - RNA, 15 nt, Human
gacccaugcugcccu

SEQ ID NO: 3021648 - RNA, 14 nt, Human
gacccaugcugccc

SEQ ID NO: 3021649 - RNA, 16 nt, Human
gacccaugcugcccug

SEQ ID NO: 3021650 - RNA, 11 nt, Human
gacccacugcu

SEQ ID NO: 3021651 - RNA, 19 nt, Human
gaccgugaggccagagaca

SEQ ID NO: 3021652 - RNA, 14 nt, Human
gaccgugaggccag

SEQ ID NO: 3021653 - RNA, 21 nt, Human
gaccugaggcccuucucucca

SEQ ID NO: 3021654 - RNA, 18 nt, Human
gaccugaggcccuucucu

SEQ ID NO: 3021655 - RNA, 15 nt, Human
gaccugaggcccuuc

SEQ ID NO: 3021656 - RNA, 13 nt, Human
gaccucaggccug

SEQ ID NO: 3021657 - RNA, 12 nt, Human
gaccucaggccu

SEQ ID NO: 3021658 - RNA, 11 nt, Human
gaccucaggcc

SEQ ID NO: 3021659 - RNA, 21 nt, Human
gagauagccaaggccaaagga

SEQ ID NO: 3021660 - RNA, 20 nt, Human
gagauagccaaggccaaagg

SEQ ID NO: 3021661 - RNA, 19 nt, Human
gagauagccaaggccaaag

SEQ ID NO: 3021662 - RNA, 16 nt, Human
gagcagagaccauccc

SEQ ID NO: 3021663 - RNA, 18 nt, Human
gagcagagaccaucccug

SEQ ID NO: 3021664 - RNA, 17 nt, Human
gagcagagaccaucccu

SEQ ID NO: 3021665 - RNA, 23 nt, Human
gagcagagaccaucccugaaggc

SEQ ID NO: 3021666 - RNA, 21 nt, Human
gagcagagaccaucccugaag

SEQ ID NO: 3021667 - RNA, 19 nt, Human
gagcagagaccaucccuga

SEQ ID NO: 3021668 - RNA, 21 nt, Human
gagcagccacauuccugaugc

SEQ ID NO: 3021669 - RNA, 22 nt, Human
gagcagccacauuccugaugcu

SEQ ID NO: 3021670 - RNA, 13 nt, Human
gagccagauuuca

SEQ ID NO: 3021671 - RNA, 13 nt, Human
gagcccaccuugg

SEQ ID NO: 3021672 - RNA, 15 nt, Human
gagcccaccuuggcu

SEQ ID NO: 3021673 - RNA, 17 nt, Human
gagcccaccuuggcuca

SEQ ID NO: 3021674 - RNA, 18 nt, Human
gagccacugcaccgggcc

SEQ ID NO: 3021675 - RNA, 19 nt, Human
gagccacugcaccgggcca

SEQ ID NO: 3021676 - RNA, 13 nt, Human
gagccacugcacc

SEQ ID NO: 3021677 - RNA, 15 nt, Human
gagccagauuucacu

SEQ ID NO: 3021678 - RNA, 19 nt, Human
gagccagauuucacucucc

SEQ ID NO: 3021679 - RNA, 18 nt, Human
gagccagauuucacucuc

SEQ ID NO: 3021680 - RNA, 21 nt, Human
gagccgagaucacgccacugc

SEQ ID NO: 3021681 - RNA, 22 nt, Human
gagccgagaucacgccacugca

SEQ ID NO: 3021682 - RNA, 19 nt, Human
gagccgagaucacgccacu

SEQ ID NO: 3021683 - RNA, 20 nt, Human
gagccgagaucacgccacug

SEQ ID NO: 3021684 - RNA, 18 nt, Human
gagcccacgcccccacug

SEQ ID NO: 3021685 - RNA, 13 nt, Human
gagccucagcauc

SEQ ID NO: 3021686 - RNA, 17 nt, Human
gagccucagcauccugg

SEQ ID NO: 3021687 - RNA, 14 nt, Human
gagccucagcaucc

SEQ ID NO: 3021688 - RNA, 15 nt, Human
gagccucagcauccu

SEQ ID NO: 3021689 - RNA, 12 nt, Human
gagccugcaguu

SEQ ID NO: 3021690 - RNA, 13 nt, Human
gagccuccugccc

SEQ ID NO: 3021691 - RNA, 15 nt, Human
gagccugcaguuauu

SEQ ID NO: 3021692 - RNA, 17 nt, Human
gagcuagcagcagggag

SEQ ID NO: 3021693 - RNA, 15 nt, Human
gagcuagcagcaggg

SEQ ID NO: 3021694 - RNA, 15 nt, Human
gagcugaguggggga

SEQ ID NO: 3021695 - RNA, 14 nt, Human
gaggaacaaggcaa

SEQ ID NO: 3021696 - RNA, 16 nt, Human
gaggaacaaggcaagg

SEQ ID NO: 3021697 - RNA, 17 nt, Human
gaggaagagaaaaaaua

SEQ ID NO: 3021698 - RNA, 13 nt, Human
gaggaagccgcug

SEQ ID NO: 3021699 - RNA, 18 nt, Human
gaggaagccgcuggggcc

SEQ ID NO: 3021700 - RNA, 17 nt, Human
gaggaagccgcuggggc

SEQ ID NO: 3021701 - RNA, 14 nt, Human
gaggaagccgcugg

SEQ ID NO: 3021702 - RNA, 17 nt, Human
gaggaaagcaaaggaga

SEQ ID NO: 3021703 - RNA, 16 nt, Human
gaggaaagcaaaggag

SEQ ID NO: 3021704 - RNA, 22 nt, Human
gagcuuucugcuaucaaagagg

SEQ ID NO: 3021705 - RNA, 20 nt, Human
gagcuuugaaaauucagugg

SEQ ID NO: 3021706 - RNA, 17 nt, Human
gagagaagagaaugcac

SEQ ID NO: 3021707 - RNA, 14 nt, Human
gagagccuuccagg

SEQ ID NO: 3021708 - RNA, 13 nt, Human
gagagccuuccag

SEQ ID NO: 3021709 - RNA, 13 nt, Human
gagaggggaacag

SEQ ID NO: 3021710 - RNA, 18 nt, Human
gagaggggaacagacugg

SEQ ID NO: 3021711 - RNA, 21 nt, Human
gagagggugggagugggccca

SEQ ID NO: 3021712 - RNA, 20 nt, Human
gagagggugggagugggccc

SEQ ID NO: 3021713 - RNA, 14 nt, Human
gagacucugucuca

SEQ ID NO: 3021714 - RNA, 18 nt, Human
gagacucgcgacaaugca

SEQ ID NO: 3021715 - RNA, 13 nt, Human
gagacucugucuc

SEQ ID NO: 3021716 - RNA, 16 nt, Human
gagacucgcgacaaug

SEQ ID NO: 3021717 - RNA, 22 nt, Human
gagacuccugcaggcagccagg

SEQ ID NO: 3021718 - RNA, 24 nt, Human
gagacagcccgggcucugccuccc

SEQ ID NO: 3021719 - RNA, 23 nt, Human
gagacagcccgggcucugccucc

SEQ ID NO: 3021720 - RNA, 22 nt, Human
gagacagcccgggcucugccuc

SEQ ID NO: 3021721 - RNA, 21 nt, Human
gagacagcccgggcucugccu

SEQ ID NO: 3021722 - RNA, 20 nt, Human
gagacagcccgggcucugcc

SEQ ID NO: 3021723 - RNA, 19 nt, Human
gagacagcccgggcucugc

SEQ ID NO: 3021724 - RNA, 18 nt, Human
gagacagcccgggcucug

SEQ ID NO: 3021725 - RNA, 17 nt, Human
gagacagcccgggcucu

SEQ ID NO: 3021726 - RNA, 14 nt, Human
gagacagcccgggc

SEQ ID NO: 3021727 - RNA, 17 nt, Human
gagacacaagccuucgg

SEQ ID NO: 3021728 - RNA, 15 nt, Human
gagacacaagccuuc

SEQ ID NO: 3021729 - RNA, 19 nt, Human
gagacagaguuuucacucu

SEQ ID NO: 3021730 - RNA, 12 nt, Human
gagacagcccgg

SEQ ID NO: 3021731 - RNA, 22 nt, Human
gagaaugcacaaacagaggccg

SEQ ID NO: 3021732 - RNA, 21 nt, Human
gagaaugcacaaacagaggcc

SEQ ID NO: 3021733 - RNA, 20 nt, Human
gagaaugcacaaacagaggc

SEQ ID NO: 3021734 - RNA, 14 nt, Human
gacuuggaagcucc

SEQ ID NO: 3021735 - RNA, 15 nt, Human
gacuuggaagcuccg

SEQ ID NO: 3021736 - RNA, 16 nt, Human
gacuuggaagcuccgc

SEQ ID NO: 3021737 - RNA, 19 nt, Human
gacucgcgacaaugcaaac

SEQ ID NO: 3021738 - RNA, 18 nt, Human
gacucgcgacaaugcaaa

SEQ ID NO: 3021739 - RNA, 17 nt, Human
gacuccugcaggcagcc

SEQ ID NO: 3021740 - RNA, 21 nt, Human
gagaaaauggacguguuauga

SEQ ID NO: 3021741 - RNA, 13 nt, Human
gacuuggaagcuc

SEQ ID NO: 3021742 - RNA, 23 nt, Human
gagaaaguacuucuccacccugc

SEQ ID NO: 3021743 - RNA, 22 nt, Human
gagaaaguacuucuccacccug

SEQ ID NO: 3021744 - RNA, 17 nt, Human
cuugcugcugauuuaaa

SEQ ID NO: 3021745 - RNA, 19 nt, Human
cuugcugcugauuuaaaca

SEQ ID NO: 3021746 - RNA, 17 nt, Human
cuuggacauuuuauguc

SEQ ID NO: 3021747 - RNA, 18 nt, Human
cuuggacauuuuaugucu

SEQ ID NO: 3021748 - RNA, 16 nt, Human
cuuggacauuuuaugu

SEQ ID NO: 3021749 - RNA, 13 nt, Human
cuugcuugcuuuu

SEQ ID NO: 3021750 - RNA, 19 nt, Human
cuuggacauuuuaugucuu

SEQ ID NO: 3021751 - RNA, 12 nt, Human
cuuggcugcagg

SEQ ID NO: 3021752 - RNA, 13 nt, Human
cuuggcugcaggg

SEQ ID NO: 3021753 - RNA, 23 nt, Human
cuuggcucaaguccucuuuucug

SEQ ID NO: 3021754 - RNA, 13 nt, Human
cuuggauuguccc

SEQ ID NO: 3021755 - RNA, 16 nt, Human
cuuguggacacagcuc

SEQ ID NO: 3021756 - RNA, 17 nt, Human
cuuguggacacagcucu

SEQ ID NO: 3021757 - RNA, 18 nt, Human
cuuguggacacagcucuu

SEQ ID NO: 3021758 - RNA, 16 nt, Human
cuuggggaccagagcu

SEQ ID NO: 3021759 - RNA, 17 nt, Human
cuuggggaccagagcug

SEQ ID NO: 3021760 - RNA, 19 nt, Human
cuuggggaccagagcugcc

SEQ ID NO: 3021761 - RNA, 18 nt, Human
cuuggggaccagagcugc

SEQ ID NO: 3021762 - RNA, 20 nt, Human
cuugguuuguaaauuaacuu

SEQ ID NO: 3021763 - RNA, 21 nt, Human
cuuguaaauagcucagguguc

SEQ ID NO: 3021764 - RNA, 16 nt, Human
cuugagugcucaguag

SEQ ID NO: 3021765 - RNA, 22 nt, Human
cuugagugucaagcugaccuug

SEQ ID NO: 3021766 - RNA, 22 nt, Human
cuugcaaaguaucccuacugua

SEQ ID NO: 3021767 - RNA, 14 nt, Human
cuugcaauggcagc

SEQ ID NO: 3021768 - RNA, 18 nt, Human
cuugcagacucuacagag

SEQ ID NO: 3021769 - RNA, 17 nt, Human
cuugcaugaggcuagug

SEQ ID NO: 3021770 - RNA, 21 nt, Human
cuugcaugaggcuaguguggu

SEQ ID NO: 3021771 - RNA, 19 nt, Human
cuugagccuugaacuuuga

SEQ ID NO: 3021772 - RNA, 20 nt, Human
cuugaccauucuccaccugc

SEQ ID NO: 3021773 - RNA, 17 nt, Human
cuugaccauucuccacc

SEQ ID NO: 3021774 - RNA, 21 nt, Human
cuugaccauucuccaccugcc

SEQ ID NO: 3021775 - RNA, 14 nt, Human
cuugagagggugga

SEQ ID NO: 3021776 - RNA, 20 nt, Human
cuugagccuugaacuuugac

SEQ ID NO: 3021777 - RNA, 22 nt, Human
cuugagccuugaacuuugaccu

SEQ ID NO: 3021778 - RNA, 19 nt, Human
cuugaaauauaggaacuua

SEQ ID NO: 3021779 - RNA, 22 nt, Human
cuucuuuauaauucuacuuuga

SEQ ID NO: 3021780 - RNA, 15 nt, Human
cuugaacuuugaccu

SEQ ID NO: 3021781 - RNA, 18 nt, Human
cuugaacuggguacuugu

SEQ ID NO: 3021782 - RNA, 20 nt, Human
cuugaacuggguacuugugg

SEQ ID NO: 3021783 - RNA, 19 nt, Human
cuugaacuccuggccucaa

SEQ ID NO: 3021784 - RNA, 16 nt, Human
cuugaacuggguacuu

SEQ ID NO: 3021785 - RNA, 14 nt, Human
cuugaacuccuggc

SEQ ID NO: 3021786 - RNA, 15 nt, Human
cuugaacuccuggcc

SEQ ID NO: 3021787 - RNA, 17 nt, Human
cuugaacuccuggccuc

SEQ ID NO: 3021788 - RNA, 18 nt, Human
cuugaacuccuggccuca

SEQ ID NO: 3021789 - RNA, 17 nt, Human
cuuucccuuggugcccu

SEQ ID NO: 3021790 - RNA, 12 nt, Human
cuuucccuuggu

SEQ ID NO: 3021791 - RNA, 14 nt, Human
cuuuccaggaaggc

SEQ ID NO: 3021792 - RNA, 16 nt, Human
cuuuccaaaguacacu

SEQ ID NO: 3021793 - RNA, 22 nt, Human
cuuuccaaaguacacuguuuca

SEQ ID NO: 3021794 - RNA, 16 nt, Human
cuuuccaaaugcccag

SEQ ID NO: 3021795 - RNA, 21 nt, Human
cuuguggacacagcucuucuc

SEQ ID NO: 3021796 - RNA, 14 nt, Human
cuuugcagacaggc

SEQ ID NO: 3021797 - RNA, 15 nt, Human
cuuugcagacaggca

SEQ ID NO: 3021798 - RNA, 23 nt, Human
cuuuggaaagaguaggaagacuu

SEQ ID NO: 3021799 - RNA, 19 nt, Human
cuuuggaaagaguaggaag

SEQ ID NO: 3021800 - RNA, 21 nt, Human
cuuuccugaggcugggcuccc

SEQ ID NO: 3021801 - RNA, 20 nt, Human
cuuuccugaggcugggcucc

SEQ ID NO: 3021802 - RNA, 16 nt, Human
cuuuccugaggcuggg

SEQ ID NO: 3021803 - RNA, 17 nt, Human
cuuuccugaggcugggc

SEQ ID NO: 3021804 - RNA, 11 nt, Human
cuuuuaaacuc

SEQ ID NO: 3021805 - RNA, 17 nt, Human
cuuuuaagacuuugguu

SEQ ID NO: 3021806 - RNA, 22 nt, Human
cuuuucauuuaggugaggaagc

SEQ ID NO: 3021807 - RNA, 23 nt, Human
cuuuuccaacccucaucaccaac

SEQ ID NO: 3021808 - RNA, 13 nt, Human
cuuuuccaacccu

SEQ ID NO: 3021809 - RNA, 20 nt, Human
cuuuucgcaggauucuuccu

SEQ ID NO: 3021810 - RNA, 21 nt, Human
cuuuucgcaggauucuuccuc

SEQ ID NO: 3021811 - RNA, 15 nt, Human
cuuuugcauauugca

SEQ ID NO: 3021812 - RNA, 22 nt, Human
cuuuuuaauauugauaugcuua

SEQ ID NO: 3021813 - RNA, 13 nt, Human
cuuuucuuuucuu

SEQ ID NO: 3021814 - RNA, 17 nt, Human
cuuuucuuucagccaag

SEQ ID NO: 3021815 - RNA, 16 nt, Human
cuuuuuauaacuuuuu

SEQ ID NO: 3021816 - RNA, 18 nt, Human
cuuuuuauauucucagca

SEQ ID NO: 3021817 - RNA, 12 nt, Human
cuuuuuauaacu

SEQ ID NO: 3021818 - RNA, 15 nt, Human
cuuuuuuauacauaa

SEQ ID NO: 3021819 - RNA, 16 nt, Human
cuuuuuuauacauaaa

SEQ ID NO: 3021820 - RNA, 17 nt, Human
cuuuuuuauacauaaac

SEQ ID NO: 3021821 - RNA, 18 nt, Human
cuuuuuuauacauaaaca

SEQ ID NO: 3021822 - RNA, 16 nt, Human
gaaaaagaaaaaauau

SEQ ID NO: 3021823 - RNA, 11 nt, Human
gaaaaagaaaa

SEQ ID NO: 3021824 - RNA, 20 nt, Human
gaaaggaaugcaaagaugaa

SEQ ID NO: 3021825 - RNA, 22 nt, Human
gaaaguacuucuccacccugcu

SEQ ID NO: 3021826 - RNA, 16 nt, Human
gaaaggaaagaggcuc

SEQ ID NO: 3021827 - RNA, 11 nt, Human
gaaaggaaaga

SEQ ID NO: 3021828 - RNA, 16 nt, Human
gaaacugacacaugcu

SEQ ID NO: 3021829 - RNA, 16 nt, Human
gaaaaaugagccuggc

SEQ ID NO: 3021830 - RNA, 16 nt, Human
gaaagaucaaaagguu

SEQ ID NO: 3021831 - RNA, 22 nt, Human
gaacaguaacauagcugugauu

SEQ ID NO: 3021832 - RNA, 22 nt, Human
gaacagacuggaagcacagcuu

SEQ ID NO: 3021833 - RNA, 21 nt, Human
gaacacucuauaacaaaggau

SEQ ID NO: 3021834 - RNA, 15 nt, Human
gaacacucuauaaca

SEQ ID NO: 3021835 - RNA, 17 nt, Human
gaacacuccuucacaga

SEQ ID NO: 3021836 - RNA, 20 nt, Human
gaacagacuggaagcacagc

SEQ ID NO: 3021837 - RNA, 19 nt, Human
gaacagacuggaagcacag

SEQ ID NO: 3021838 - RNA, 16 nt, Human
gaacacuccuucacag

SEQ ID NO: 3021839 - RNA, 15 nt, Human
gaacacuccuucaca

SEQ ID NO: 3021840 - RNA, 18 nt, Human
gaaauaucugaaaaugua

SEQ ID NO: 3021841 - RNA, 19 nt, Human
gaaauaucugaaaauguau

SEQ ID NO: 3021842 - RNA, 17 nt, Human
gaaauauaggaacuuaa

SEQ ID NO: 3021843 - RNA, 18 nt, Human
gaaaugaggucagagccu

SEQ ID NO: 3021844 - RNA, 11 nt, Human
gaaaugagcug

SEQ ID NO: 3021845 - RNA, 15 nt, Human
gaaaugggcagagca

SEQ ID NO: 3021846 - RNA, 16 nt, Human
gaaaugggcagagcag

SEQ ID NO: 3021847 - RNA, 17 nt, Human
gaaauguacagcaagga

SEQ ID NO: 3021848 - RNA, 19 nt, Human
gaaaugggcagagcagaga

SEQ ID NO: 3021849 - RNA, 17 nt, Human
gaaaugggcagagcaga

SEQ ID NO: 3021850 - RNA, 18 nt, Human
gaaguccccucuccucca

SEQ ID NO: 3021851 - RNA, 23 nt, Human
gaaguccccucuccuccacauuu

SEQ ID NO: 3021852 - RNA, 18 nt, Human
gaagucuuagauguauau

SEQ ID NO: 3021853 - RNA, 18 nt, Human
gaagucaaggcuuagacc

SEQ ID NO: 3021854 - RNA, 13 nt, Human
gaagucacacagu

SEQ ID NO: 3021855 - RNA, 19 nt, Human
gaaguaauaugcacacauu

SEQ ID NO: 3021856 - RNA, 20 nt, Human
gaaguaauaugcacacauuu

SEQ ID NO: 3021857 - RNA, 19 nt, Human
gaaggucuguuuuguguac

SEQ ID NO: 3021858 - RNA, 20 nt, Human
gaagguagaauguuuucaaa

SEQ ID NO: 3021859 - RNA, 13 nt, Human
gaagggggcuggg

SEQ ID NO: 3021860 - RNA, 14 nt, Human
gaaggaugcugucu

SEQ ID NO: 3021861 - RNA, 19 nt, Human
gaaggaagacuucaucccu

SEQ ID NO: 3021862 - RNA, 15 nt, Human
gaaggaacguccccu

SEQ ID NO: 3021863 - RNA, 22 nt, Human
gaaggaaacccagcucuggucc

SEQ ID NO: 3021864 - RNA, 21 nt, Human
gaaggaaacccagcucugguc

SEQ ID NO: 3021865 - RNA, 19 nt, Human
gaaggacauugcggacagc

SEQ ID NO: 3021866 - RNA, 20 nt, Human
gaaggacauugcggacagcc

SEQ ID NO: 3021867 - RNA, 21 nt, Human
gaaggacauugcggacagcca

SEQ ID NO: 3021868 - RNA, 20 nt, Human
gaaggaaacccagcucuggu

SEQ ID NO: 3021869 - RNA, 19 nt, Human
gaaggaaacccagcucugg

SEQ ID NO: 3021870 - RNA, 14 nt, Human
gaagccgcuggggc

SEQ ID NO: 3021871 - RNA, 20 nt, Human
gaagccgcuggggccaguug

SEQ ID NO: 3021872 - RNA, 18 nt, Human
gaagccgcuggggccagu

SEQ ID NO: 3021873 - RNA, 20 nt, Human
gaagauucuuguauuuauua

SEQ ID NO: 3021874 - RNA, 18 nt, Human
gaagcauuuacuuugugu

SEQ ID NO: 3021875 - RNA, 16 nt, Human
gaagacuucaucccuc

SEQ ID NO: 3021876 - RNA, 15 nt, Human
gaagacuucaucccu

SEQ ID NO: 3021877 - RNA, 19 nt, Human
gaagacuucaucccucugg

SEQ ID NO: 3021878 - RNA, 17 nt, Human
gaagacuucaucccucu

SEQ ID NO: 3021879 - RNA, 12 nt, Human
gaagagccuugc

SEQ ID NO: 3021880 - RNA, 14 nt, Human
gaagaagcucucuc

SEQ ID NO: 3021881 - RNA, 16 nt, Human
gaacuuugaccucugc

SEQ ID NO: 3021882 - RNA, 22 nt, Human
gaacuuugaccucugcagcaau

SEQ ID NO: 3021883 - RNA, 17 nt, Human
gaacuuuccaggaaggc

SEQ ID NO: 3021884 - RNA, 18 nt, Human
gaacuuggcgcugccccu

SEQ ID NO: 3021885 - RNA, 17 nt, Human
gaacuugggccacugug

SEQ ID NO: 3021886 - RNA, 17 nt, Human
gaacuuaaauaauguga

SEQ ID NO: 3021887 - RNA, 14 nt, Human
gaacuuaaauaaug

SEQ ID NO: 3021888 - RNA, 17 nt, Human
gaacuuggcgcugcccc

SEQ ID NO: 3021889 - RNA, 18 nt, Human
gaaccacaucuugcucug

SEQ ID NO: 3021890 - RNA, 21 nt, Human
cugguacucugccacuuuauu

SEQ ID NO: 3021891 - RNA, 21 nt, Human
cugguccauagagagcaagac

SEQ ID NO: 3021892 - RNA, 13 nt, Human
cuggucccacuca

SEQ ID NO: 3021893 - RNA, 23 nt, Human
cuggucucaaacucuugaccuca

SEQ ID NO: 3021894 - RNA, 15 nt, Human
cuggguuggagggug

SEQ ID NO: 3021895 - RNA, 18 nt, Human
cuggguacuuguggacac

SEQ ID NO: 3021896 - RNA, 16 nt, Human
cuggguacuuguggac

SEQ ID NO: 3021897 - RNA, 14 nt, Human
cuggguacuugugg

SEQ ID NO: 3021898 - RNA, 22 nt, Human
cugggcucccuucccaccucuc

SEQ ID NO: 3021899 - RNA, 21 nt, Human
cugggcucccuucccaccucu

SEQ ID NO: 3021900 - RNA, 20 nt, Human
cugggcucccuucccaccuc

SEQ ID NO: 3021901 - RNA, 19 nt, Human
cugggcucccuucccaccu

SEQ ID NO: 3021902 - RNA, 21 nt, Human
cuguaaguuacaugaaggcag

SEQ ID NO: 3021903 - RNA, 18 nt, Human
cuguaauuugugauacaa

SEQ ID NO: 3021904 - RNA, 17 nt, Human
cuguaauuugugauaca

SEQ ID NO: 3021905 - RNA, 23 nt, Human
cuguacagagcccacgcccccac

SEQ ID NO: 3021906 - RNA, 21 nt, Human
cuguaauuugugauacaaugc

SEQ ID NO: 3021907 - RNA, 22 nt, Human
cuguaauuugugauacaaugcu

SEQ ID NO: 3021908 - RNA, 16 nt, Human
cuguacauacuuuuug

SEQ ID NO: 3021909 - RNA, 21 nt, Human
cuguaccucuugagccuugaa

SEQ ID NO: 3021910 - RNA, 15 nt, Human
cuguacauacuuuuu

SEQ ID NO: 3021911 - RNA, 22 nt, Human
cuguacaugaaaacacauuuuu

SEQ ID NO: 3021912 - RNA, 23 nt, Human
cuguacaugaaaacacauuuuuc

SEQ ID NO: 3021913 - RNA, 12 nt, Human
cugguggcagcu

SEQ ID NO: 3021914 - RNA, 14 nt, Human
cugguggcagcuca

SEQ ID NO: 3021915 - RNA, 13 nt, Human
cugguggcagcuc

SEQ ID NO: 3021916 - RNA, 20 nt, Human
cugguucaggguuggccccu

SEQ ID NO: 3021917 - RNA, 17 nt, Human
cugucuccucucucugu

SEQ ID NO: 3021918 - RNA, 20 nt, Human
cugucuccucucucuguaau

SEQ ID NO: 3021919 - RNA, 15 nt, Human
cuguccuauuauauu

SEQ ID NO: 3021920 - RNA, 21 nt, Human
cuguccuauuauauucauucu

SEQ ID NO: 3021921 - RNA, 22 nt, Human
cugucucaaaaaaagaaaaaga

SEQ ID NO: 3021922 - RNA, 21 nt, Human
cuguccuacucugugucaggu

SEQ ID NO: 3021923 - RNA, 22 nt, Human
cugucccuuacgugaguccugg

SEQ ID NO: 3021924 - RNA, 16 nt, Human
cuguccuacucugugu

SEQ ID NO: 3021925 - RNA, 17 nt, Human
cuguccuacucuguguc

SEQ ID NO: 3021926 - RNA, 18 nt, Human
cuguccuacucuguguca

SEQ ID NO: 3021927 - RNA, 20 nt, Human
cuguccuacucugugucagg

SEQ ID NO: 3021928 - RNA, 14 nt, Human
cugucccccugaca

SEQ ID NO: 3021929 - RNA, 13 nt, Human
cugucccccugac

SEQ ID NO: 3021930 - RNA, 23 nt, Human
cugucauuugagcagggcucagc

SEQ ID NO: 3021931 - RNA, 22 nt, Human
cugucccagugccgagaaggaa

SEQ ID NO: 3021932 - RNA, 14 nt, Human
cuguaucccaugag

SEQ ID NO: 3021933 - RNA, 15 nt, Human
cuguaucccaugagc

SEQ ID NO: 3021934 - RNA, 22 nt, Human
cuguaccucuugagccuugaac

SEQ ID NO: 3021935 - RNA, 18 nt, Human
cuguaucccaugagccuc

SEQ ID NO: 3021936 - RNA, 20 nt, Human
cugggaaagggauuuucagc

SEQ ID NO: 3021937 - RNA, 18 nt, Human
cugggagagccuuccagg

SEQ ID NO: 3021938 - RNA, 17 nt, Human
cugggagagccuuccag

SEQ ID NO: 3021939 - RNA, 21 nt, Human
cugggagagccuuccaggggu

SEQ ID NO: 3021940 - RNA, 20 nt, Human
cugggagagccuuccagggg

SEQ ID NO: 3021941 - RNA, 19 nt, Human
cugggagagccuuccaggg

SEQ ID NO: 3021942 - RNA, 16 nt, Human
cuggcuguuggcuggg

SEQ ID NO: 3021943 - RNA, 17 nt, Human
cuggcuguuggcugggg

SEQ ID NO: 3021944 - RNA, 20 nt, Human
cuggcugguuagagguuccc

SEQ ID NO: 3021945 - RNA, 22 nt, Human
cuggcuggguggcaccagcagc

SEQ ID NO: 3021946 - RNA, 21 nt, Human
cugggaggucaaggcugcagu

SEQ ID NO: 3021947 - RNA, 19 nt, Human
cugggaggucaaggcugca

SEQ ID NO: 3021948 - RNA, 17 nt, Human
cugggauuacaggugug

SEQ ID NO: 3021949 - RNA, 20 nt, Human
cugggauuacaggugugaac

SEQ ID NO: 3021950 - RNA, 18 nt, Human
cugggaugauuggagggg

SEQ ID NO: 3021951 - RNA, 20 nt, Human
cugggaucccucauccucau

SEQ ID NO: 3021952 - RNA, 16 nt, Human
cuggcacccggccccu

SEQ ID NO: 3021953 - RNA, 17 nt, Human
cuggcacccggccccug

SEQ ID NO: 3021954 - RNA, 18 nt, Human
cuggcacccggccccugc

SEQ ID NO: 3021955 - RNA, 22 nt, Human
cuggcacccggccccugcuggu

SEQ ID NO: 3021956 - RNA, 18 nt, Human
cuggaauauauaaccagu

SEQ ID NO: 3021957 - RNA, 14 nt, Human
cuggcaagaaugug

SEQ ID NO: 3021958 - RNA, 15 nt, Human
cuggcacuauaaugu

SEQ ID NO: 3021959 - RNA, 16 nt, Human
cuggcacuauaaugua

SEQ ID NO: 3021960 - RNA, 22 nt, Human
cuggcaugggaaugaaugucag

SEQ ID NO: 3021961 - RNA, 19 nt, Human
cuggcaugggaaugaaugu

SEQ ID NO: 3021962 - RNA, 18 nt, Human
cuggcaugggaaugaaug

SEQ ID NO: 3021963 - RNA, 16 nt, Human
cuggcaugggaaugaa

SEQ ID NO: 3021964 - RNA, 24 nt, Human
cuggcaugggaaugaaugucagug

SEQ ID NO: 3021965 - RNA, 22 nt, Human
cuggccagaugcaccagcccuu

SEQ ID NO: 3021966 - RNA, 23 nt, Human
cuggccucaagugauucuccugc

SEQ ID NO: 3021967 - RNA, 12 nt, Human
cuggccucugca

SEQ ID NO: 3021968 - RNA, 22 nt, Human
cuggccucaagugauucuccug

SEQ ID NO: 3021969 - RNA, 16 nt, Human
cuggccugagcuggga

SEQ ID NO: 3021970 - RNA, 14 nt, Human
cuggccucugcacu

SEQ ID NO: 3021971 - RNA, 13 nt, Human
cuggccucugcac

SEQ ID NO: 3021972 - RNA, 13 nt, Human
cuggccuggcccc

SEQ ID NO: 3021973 - RNA, 14 nt, Human
cuggccuggccccu

SEQ ID NO: 3021974 - RNA, 18 nt, Human
cuggccugagcugggaug

SEQ ID NO: 3021975 - RNA, 15 nt, Human
cuggccugagcuggg

SEQ ID NO: 3021976 - RNA, 14 nt, Human
cuggccugugucua

SEQ ID NO: 3021977 - RNA, 17 nt, Human
cuggccuggccccucag

SEQ ID NO: 3021978 - RNA, 16 nt, Human
cuggccuggccccuca

SEQ ID NO: 3021979 - RNA, 20 nt, Human
cugcaguuuuuuuccuucaa

SEQ ID NO: 3021980 - RNA, 16 nt, Human
cugcaguugccaguca

SEQ ID NO: 3021981 - RNA, 13 nt, Human
cugcaguugccag

SEQ ID NO: 3021982 - RNA, 17 nt, Human
cugcagcaauaaagcag

SEQ ID NO: 3021983 - RNA, 14 nt, Human
cugcaccgggccac

SEQ ID NO: 3021984 - RNA, 15 nt, Human
cugcaccgggccaca

SEQ ID NO: 3021985 - RNA, 16 nt, Human
cugcaccggcuggccu

SEQ ID NO: 3021986 - RNA, 15 nt, Human
cugcaccggcuggcc

SEQ ID NO: 3021987 - RNA, 14 nt, Human
cugcaccggcuggc

SEQ ID NO: 3021988 - RNA, 23 nt, Human
cugaggcccuucucuccagcccc

SEQ ID NO: 3021989 - RNA, 22 nt, Human
cugaggcccuucucuccagccc

SEQ ID NO: 3021990 - RNA, 18 nt, Human
cugcaccgggccacagag

SEQ ID NO: 3021991 - RNA, 20 nt, Human
cugcacuccagccuggguga

SEQ ID NO: 3021992 - RNA, 13 nt, Human
cugcacuccccug

SEQ ID NO: 3021993 - RNA, 20 nt, Human
cugcacuccccugcugggug

SEQ ID NO: 3021994 - RNA, 19 nt, Human
cugcacuccccugcugggu

SEQ ID NO: 3021995 - RNA, 13 nt, Human
cugcagagggcac

SEQ ID NO: 3021996 - RNA, 15 nt, Human
cugcagcaauaaagc

SEQ ID NO: 3021997 - RNA, 16 nt, Human
cugcagcaauaaagca

SEQ ID NO: 3021998 - RNA, 10 nt, Human
cugcagaggg

SEQ ID NO: 3021999 - RNA, 18 nt, Human
cugcacuccccugcuggg

SEQ ID NO: 3022000 - RNA, 21 nt, Human
cugcacuccccugcugggugu

SEQ ID NO: 3022001 - RNA, 22 nt, Human
cugcaguuuuuuuccuucaaga

SEQ ID NO: 3022002 - RNA, 23 nt, Human
cugcaguuuuuuuccuucaagaa

SEQ ID NO: 3022003 - RNA, 15 nt, Human
cugcauaugaaagga

SEQ ID NO: 3022004 - RNA, 20 nt, Human
cugcaucaagaugugacaug

SEQ ID NO: 3022005 - RNA, 21 nt, Human
cugccacccuggggagaaagu

SEQ ID NO: 3022006 - RNA, 12 nt, Human
cugccacccugg

SEQ ID NO: 3022007 - RNA, 21 nt, Human
cugccauccagguucagcuug

SEQ ID NO: 3022008 - RNA, 15 nt, Human
cugccauccucccaa

SEQ ID NO: 3022009 - RNA, 22 nt, Human
cugccaggaagccagcaggcuc

SEQ ID NO: 3022010 - RNA, 21 nt, Human
cugccaggaagccagcaggcu

SEQ ID NO: 3022011 - RNA, 20 nt, Human
cugccaggaagccagcaggc

SEQ ID NO: 3022012 - RNA, 14 nt, Human
cugccaggaagcca

SEQ ID NO: 3022013 - RNA, 13 nt, Human
cugccaggaagcc

SEQ ID NO: 3022014 - RNA, 16 nt, Human
cugcccaggccccugc

SEQ ID NO: 3022015 - RNA, 18 nt, Human
cugcccaggccccugcca

SEQ ID NO: 3022016 - RNA, 19 nt, Human
cugcccaggccccugccac

SEQ ID NO: 3022017 - RNA, 20 nt, Human
cugcccaggccccugccacc

SEQ ID NO: 3022018 - RNA, 12 nt, Human
cugcccaccugg

SEQ ID NO: 3022019 - RNA, 14 nt, Human
cugcccaggccccu

SEQ ID NO: 3022020 - RNA, 15 nt, Human
cugcccaggccccug

SEQ ID NO: 3022021 - RNA, 15 nt, Human
cugccauuucugaga

SEQ ID NO: 3022022 - RNA, 13 nt, Human
cugcccggcaggg

SEQ ID NO: 3022023 - RNA, 19 nt, Human
cugccccuggcagccccug

SEQ ID NO: 3022024 - RNA, 17 nt, Human
cugccccuggcagcccc

SEQ ID NO: 3022025 - RNA, 18 nt, Human
cugccccuggcagccccu

SEQ ID NO: 3022026 - RNA, 19 nt, Human
cugcuugugaaaggaaaga

SEQ ID NO: 3022027 - RNA, 19 nt, Human
cugcuugggcuucauccuc

SEQ ID NO: 3022028 - RNA, 18 nt, Human
cugcuugggcuucauccu

SEQ ID NO: 3022029 - RNA, 17 nt, Human
cugcuugggcuucaucc

SEQ ID NO: 3022030 - RNA, 15 nt, Human
cugcuugggcuucau

SEQ ID NO: 3022031 - RNA, 13 nt, Human
cugcuugggcuuc

SEQ ID NO: 3022032 - RNA, 22 nt, Human
cugcuugaggcaacucaucuua

SEQ ID NO: 3022033 - RNA, 20 nt, Human
cugcuugcuugcuuuuuaau

SEQ ID NO: 3022034 - RNA, 15 nt, Human
cugcuuuuggucugu

SEQ ID NO: 3022035 - RNA, 17 nt, Human
cugcuuuuggucugugu

SEQ ID NO: 3022036 - RNA, 13 nt, Human
cugcugcuggcug

SEQ ID NO: 3022037 - RNA, 12 nt, Human
cugcugcuggcu

SEQ ID NO: 3022038 - RNA, 15 nt, Human
cugcuggguguggcg

SEQ ID NO: 3022039 - RNA, 14 nt, Human
cugcuggguguggc

SEQ ID NO: 3022040 - RNA, 17 nt, Human
cugcuggguguggcgca

SEQ ID NO: 3022041 - RNA, 21 nt, Human
cugcuugaggcaacucaucuu

SEQ ID NO: 3022042 - RNA, 20 nt, Human
cugcuugaggcaacucaucu

SEQ ID NO: 3022043 - RNA, 13 nt, Human
cugcuugaggcaa

SEQ ID NO: 3022044 - RNA, 12 nt, Human
cugcucugguua

SEQ ID NO: 3022045 - RNA, 13 nt, Human
cugcugcaguugc

SEQ ID NO: 3022046 - RNA, 10 nt, Human
cugcugcagu

SEQ ID NO: 3022047 - RNA, 14 nt, Human
cugcugcaguugcc

SEQ ID NO: 3022048 - RNA, 23 nt, Human
cugcggugcuaucucccccagcc

SEQ ID NO: 3022049 - RNA, 22 nt, Human
cugcggugcuaucucccccagc

SEQ ID NO: 3022050 - RNA, 21 nt, Human
cugcggugcuaucucccccag

SEQ ID NO: 3022051 - RNA, 20 nt, Human
cugcggugcuaucuccccca

SEQ ID NO: 3022052 - RNA, 23 nt, Human
cugcuccucuccccagcaaguga

SEQ ID NO: 3022053 - RNA, 19 nt, Human
cugcuccucuccccagcaa

SEQ ID NO: 3022054 - RNA, 20 nt, Human
cugcuccucuccccagcaag

SEQ ID NO: 3022055 - RNA, 15 nt, Human
cugcucuccgaccag

SEQ ID NO: 3022056 - RNA, 23 nt, Human
cugcgguccacccaggagccccg

SEQ ID NO: 3022057 - RNA, 19 nt, Human
cugcggugcuaucuccccc

SEQ ID NO: 3022058 - RNA, 18 nt, Human
cugcggugcuaucucccc

SEQ ID NO: 3022059 - RNA, 19 nt, Human
cugccugaagucacacagu

SEQ ID NO: 3022060 - RNA, 18 nt, Human
cugccugaagucacacag

SEQ ID NO: 3022061 - RNA, 16 nt, Human
cugccugaagucacac

SEQ ID NO: 3022062 - RNA, 21 nt, Human
cugcccugcccaccuggccuc

SEQ ID NO: 3022063 - RNA, 17 nt, Human
cugcccugcccaccugg

SEQ ID NO: 3022064 - RNA, 20 nt, Human
cugcccugcccaccuggccu

SEQ ID NO: 3022065 - RNA, 16 nt, Human
cugaaauaaggaauga

SEQ ID NO: 3022066 - RNA, 23 nt, Human
cugaaagcccugagcuuucugcu

SEQ ID NO: 3022067 - RNA, 19 nt, Human
cugaaagcccugagcuuuc

SEQ ID NO: 3022068 - RNA, 18 nt, Human
cugaaagcccugagcuuu

SEQ ID NO: 3022069 - RNA, 17 nt, Human
cugaaagcccugagcuu

SEQ ID NO: 3022070 - RNA, 16 nt, Human
cugaaagcccugagcu

SEQ ID NO: 3022071 - RNA, 15 nt, Human
cugaaagcccugagc

SEQ ID NO: 3022072 - RNA, 19 nt, Human
cugaagaauugaaaaacca

SEQ ID NO: 3022073 - RNA, 21 nt, Human
cucuuggguucaagcgauucu

SEQ ID NO: 3022074 - RNA, 19 nt, Human
cucuuggguucaagcgauu

SEQ ID NO: 3022075 - RNA, 22 nt, Human
cucuugaaauauaggaacuuaa

SEQ ID NO: 3022076 - RNA, 18 nt, Human
cucuuuaaugucacaggc

SEQ ID NO: 3022077 - RNA, 17 nt, Human
cucuugguccugcugca

SEQ ID NO: 3022078 - RNA, 16 nt, Human
cucuugguccugcugc

SEQ ID NO: 3022079 - RNA, 15 nt, Human
cucuugguccugcug

SEQ ID NO: 3022080 - RNA, 13 nt, Human
cucuugguccugc

SEQ ID NO: 3022081 - RNA, 20 nt, Human
cucuuuaaugucacaggcag

SEQ ID NO: 3022082 - RNA, 21 nt, Human
cucuuuaaugucacaggcagg

SEQ ID NO: 3022083 - RNA, 22 nt, Human
cucuuuaaugucacaggcaggu

SEQ ID NO: 3022084 - RNA, 23 nt, Human
cucuuuaaugucacaggcagguc

SEQ ID NO: 3022085 - RNA, 13 nt, Human
cucuuucccuccc

SEQ ID NO: 3022086 - RNA, 17 nt, Human
cucuuucccucccuucc

SEQ ID NO: 3022087 - RNA, 13 nt, Human
cucucuccucccu

SEQ ID NO: 3022088 - RNA, 22 nt, Human
cucugccugaagucacacagug

SEQ ID NO: 3022089 - RNA, 10 nt, Human
cucugccuga

SEQ ID NO: 3022090 - RNA, 21 nt, Human
cucugccugaagucacacagu

SEQ ID NO: 3022091 - RNA, 15 nt, Human
cucuggacaggcaug

SEQ ID NO: 3022092 - RNA, 14 nt, Human
cucuggcagcucag

SEQ ID NO: 3022093 - RNA, 12 nt, Human
cucuggcagcuc

SEQ ID NO: 3022094 - RNA, 14 nt, Human
cucuggacaggcau

SEQ ID NO: 3022095 - RNA, 16 nt, Human
cucuggacaggcaugu

SEQ ID NO: 3022096 - RNA, 22 nt, Human
cucuggacaggcauguucucug

SEQ ID NO: 3022097 - RNA, 16 nt, Human
cucuggcagcucagag

SEQ ID NO: 3022098 - RNA, 15 nt, Human
cucuggcagcucaga

SEQ ID NO: 3022099 - RNA, 13 nt, Human
cucuuccaggcug

SEQ ID NO: 3022100 - RNA, 15 nt, Human
cucuuccaggcuggg

SEQ ID NO: 3022101 - RNA, 14 nt, Human
cucuuccaggcugg

SEQ ID NO: 3022102 - RNA, 15 nt, Human
cucuuagaaaaacca

SEQ ID NO: 3022103 - RNA, 13 nt, Human
cucuuagaaaaac

SEQ ID NO: 3022104 - RNA, 15 nt, Human
cucugugucaggugg

SEQ ID NO: 3022105 - RNA, 21 nt, Human
cugacauuguuggccaaagcc

SEQ ID NO: 3022106 - RNA, 21 nt, Human
cugacaggcaaugcuggcugu

SEQ ID NO: 3022107 - RNA, 22 nt, Human
cugacauuguuggccaaagcca

SEQ ID NO: 3022108 - RNA, 12 nt, Human
cugacccacugc

SEQ ID NO: 3022109 - RNA, 16 nt, Human
cugacccaugcugccc

SEQ ID NO: 3022110 - RNA, 15 nt, Human
cugacccaugcugcc

SEQ ID NO: 3022111 - RNA, 14 nt, Human
cugacccaugcugc

SEQ ID NO: 3022112 - RNA, 13 nt, Human
cugacccacugcu

SEQ ID NO: 3022113 - RNA, 14 nt, Human
cugacccacugcuu

SEQ ID NO: 3022114 - RNA, 13 nt, Human
cugacccaugcug

SEQ ID NO: 3022115 - RNA, 16 nt, Human
cugacuguuuucucuu

SEQ ID NO: 3022116 - RNA, 18 nt, Human
cugacuguuuucucuuga

SEQ ID NO: 3022117 - RNA, 15 nt, Human
cugagacagcccggg

SEQ ID NO: 3022118 - RNA, 14 nt, Human
cugagacagcccgg

SEQ ID NO: 3022119 - RNA, 20 nt, Human
cugaggcccuucucuccagc

SEQ ID NO: 3022120 - RNA, 19 nt, Human
cugaggcccuucucuccag

SEQ ID NO: 3022121 - RNA, 18 nt, Human
cugaggcccuucucucca

SEQ ID NO: 3022122 - RNA, 15 nt, Human
cugaggcccuucucu

SEQ ID NO: 3022123 - RNA, 14 nt, Human
cugaggcccuucuc

SEQ ID NO: 3022124 - RNA, 23 nt, Human
cugaggcccagagggccugcaag

SEQ ID NO: 3022125 - RNA, 21 nt, Human
cugaggcccagagggccugca

SEQ ID NO: 3022126 - RNA, 19 nt, Human
cugaggcccagagggccug

SEQ ID NO: 3022127 - RNA, 18 nt, Human
cugaggcccagagggccu

SEQ ID NO: 3022128 - RNA, 17 nt, Human
cugaggcccagagggcc

SEQ ID NO: 3022129 - RNA, 16 nt, Human
cugaggcccagagggc

SEQ ID NO: 3022130 - RNA, 15 nt, Human
cugaggcccagaggg

SEQ ID NO: 3022131 - RNA, 14 nt, Human
cugaggcccagagg

SEQ ID NO: 3022132 - RNA, 13 nt, Human
cugaggcccagag

SEQ ID NO: 3022133 - RNA, 12 nt, Human
cugaggcccaga

SEQ ID NO: 3022134 - RNA, 15 nt, Human
cugagccagauuuca

SEQ ID NO: 3022135 - RNA, 21 nt, Human
cugagccagauuucacucucc

SEQ ID NO: 3022136 - RNA, 20 nt, Human
cugagccagauuucacucuc

SEQ ID NO: 3022137 - RNA, 19 nt, Human
cugagccagauuucacucu

SEQ ID NO: 3022138 - RNA, 18 nt, Human
cugagccagauuucacuc

SEQ ID NO: 3022139 - RNA, 17 nt, Human
cugagccagauuucacu

SEQ ID NO: 3022140 - RNA, 18 nt, Human
cugagacagcccgggcuc

SEQ ID NO: 3022141 - RNA, 17 nt, Human
cugagacagcccgggcu

SEQ ID NO: 3022142 - RNA, 16 nt, Human
cugagacagcccgggc

SEQ ID NO: 3022143 - RNA, 13 nt, Human
cuccuccacauuu

SEQ ID NO: 3022144 - RNA, 22 nt, Human
cuccuccagccgccaugcuccu

SEQ ID NO: 3022145 - RNA, 22 nt, Human
cuccucuccccagcaagugaga

SEQ ID NO: 3022146 - RNA, 15 nt, Human
cuccgaccagacacc

SEQ ID NO: 3022147 - RNA, 18 nt, Human
cucccucagucuggcccu

SEQ ID NO: 3022148 - RNA, 17 nt, Human
cucccuuucuucccuac

SEQ ID NO: 3022149 - RNA, 20 nt, Human
cuccugcaggcagccaggcc

SEQ ID NO: 3022150 - RNA, 18 nt, Human
cuccugcaggcagccagg

SEQ ID NO: 3022151 - RNA, 11 nt, Human
cuccugcccuu

SEQ ID NO: 3022152 - RNA, 13 nt, Human
cuccugccucagc

SEQ ID NO: 3022153 - RNA, 14 nt, Human
cuccugccucagcc

SEQ ID NO: 3022154 - RNA, 17 nt, Human
cuccugcaggcagccag

SEQ ID NO: 3022155 - RNA, 16 nt, Human
cuccugcaggcagcca

SEQ ID NO: 3022156 - RNA, 11 nt, Human
cuccugcaggc

SEQ ID NO: 3022157 - RNA, 16 nt, Human
cuccugugugugcgcc

SEQ ID NO: 3022158 - RNA, 19 nt, Human
cuccugugugugcgccuac

SEQ ID NO: 3022159 - RNA, 22 nt, Human
cuccugccucgaacuggcugca

SEQ ID NO: 3022160 - RNA, 15 nt, Human
cuccugccucagccu

SEQ ID NO: 3022161 - RNA, 17 nt, Human
cucccaaagugcuggga

SEQ ID NO: 3022162 - RNA, 13 nt, Human
cuccaugugggcu

SEQ ID NO: 3022163 - RNA, 18 nt, Human
cucacuauguugcccagg

SEQ ID NO: 3022164 - RNA, 22 nt, Human
cucccaacucaccccagcccca

SEQ ID NO: 3022165 - RNA, 18 nt, Human
cucccaaagugcugggau

SEQ ID NO: 3022166 - RNA, 17 nt, Human
cucccaacucaccccag

SEQ ID NO: 3022167 - RNA, 16 nt, Human
cucccaacucacccca

SEQ ID NO: 3022168 - RNA, 23 nt, Human
cucccaucugugaaaggaaagag

SEQ ID NO: 3022169 - RNA, 18 nt, Human
cucccaucugugaaagga

SEQ ID NO: 3022170 - RNA, 15 nt, Human
cucccaucugugaaa

SEQ ID NO: 3022171 - RNA, 14 nt, Human
cucccaucugugaa

SEQ ID NO: 3022172 - RNA, 11 nt, Human
cucccaucugu

SEQ ID NO: 3022173 - RNA, 21 nt, Human
cucccaucucacacaugagca

SEQ ID NO: 3022174 - RNA, 17 nt, Human
cucccgaauagcuggga

SEQ ID NO: 3022175 - RNA, 16 nt, Human
cucccgaauagcuggg

SEQ ID NO: 3022176 - RNA, 13 nt, Human
cuccccugcuggg

SEQ ID NO: 3022177 - RNA, 15 nt, Human
cucccgaguagcugg

SEQ ID NO: 3022178 - RNA, 18 nt, Human
cucccgaauagcugggac

SEQ ID NO: 3022179 - RNA, 16 nt, Human
cucccgaguagcuggg

SEQ ID NO: 3022180 - RNA, 17 nt, Human
cucccgaguagcuggga

SEQ ID NO: 3022181 - RNA, 12 nt, Human
cuccccagcaag

SEQ ID NO: 3022182 - RNA, 20 nt, Human
cuccccagcaagugagagcu

SEQ ID NO: 3022183 - RNA, 20 nt, Human
cuccccagccccaucccaaa

SEQ ID NO: 3022184 - RNA, 12 nt, Human
cuccccugcugg

SEQ ID NO: 3022185 - RNA, 13 nt, Human
cucuacagaggcc

SEQ ID NO: 3022186 - RNA, 19 nt, Human
cucuacagaggccaugggc

SEQ ID NO: 3022187 - RNA, 14 nt, Human
cucuacagaggcca

SEQ ID NO: 3022188 - RNA, 16 nt, Human
cucuacagaggccaug

SEQ ID NO: 3022189 - RNA, 13 nt, Human
cucuacaaaaagc

SEQ ID NO: 3022190 - RNA, 19 nt, Human
cuccuucacagaugggugc

SEQ ID NO: 3022191 - RNA, 20 nt, Human
cuccugugugugcgccuaca

SEQ ID NO: 3022192 - RNA, 14 nt, Human
cuccugugugugcg

SEQ ID NO: 3022193 - RNA, 17 nt, Human
cuccuucacagaugggu

SEQ ID NO: 3022194 - RNA, 16 nt, Human
cuccuucacagauggg

SEQ ID NO: 3022195 - RNA, 20 nt, Human
cucuaccauccccuguagag

SEQ ID NO: 3022196 - RNA, 13 nt, Human
cucuacccuggca

SEQ ID NO: 3022197 - RNA, 23 nt, Human
cucuagggaaaaaccagcgugug

SEQ ID NO: 3022198 - RNA, 15 nt, Human
cucuaguuugauuaa

SEQ ID NO: 3022199 - RNA, 19 nt, Human
cucuaguuugauuaaauuc

SEQ ID NO: 3022200 - RNA, 20 nt, Human
cucuaguuugauuaaauucu

SEQ ID NO: 3022201 - RNA, 21 nt, Human
cucuaguuugauuaaauucuu

SEQ ID NO: 3022202 - RNA, 12 nt, Human
cucucaggccaa

SEQ ID NO: 3022203 - RNA, 21 nt, Human
cucucaggccaaacucaccug

SEQ ID NO: 3022204 - RNA, 20 nt, Human
cucucaggccaaacucaccu

SEQ ID NO: 3022205 - RNA, 15 nt, Human
cucucaggccagcug

SEQ ID NO: 3022206 - RNA, 13 nt, Human
cucucaggccagc

SEQ ID NO: 3022207 - RNA, 23 nt, Human
cucucaggccaaacucaccugcc

SEQ ID NO: 3022208 - RNA, 22 nt, Human
cucucaggccaaacucaccugc

SEQ ID NO: 3022209 - RNA, 14 nt, Human
cucuccagccccug

SEQ ID NO: 3022210 - RNA, 18 nt, Human
cucuccagccccuggaug

SEQ ID NO: 3022211 - RNA, 17 nt, Human
cucuccagccccuggau

SEQ ID NO: 3022212 - RNA, 16 nt, Human
cucuccagccccugga

SEQ ID NO: 3022213 - RNA, 15 nt, Human
cucuccagccccugg

SEQ ID NO: 3022214 - RNA, 21 nt, Human
cucucaggccagcugcuuggg

SEQ ID NO: 3022215 - RNA, 19 nt, Human
cucucaggccagcugcuug

SEQ ID NO: 3022216 - RNA, 18 nt, Human
cucucaggccagcugcuu

SEQ ID NO: 3022217 - RNA, 17 nt, Human
cucucaggccagcugcu

SEQ ID NO: 3022218 - RNA, 18 nt, Human
cucuccucugcugcuggc

SEQ ID NO: 3022219 - RNA, 15 nt, Human
cucuccucugcugcu

SEQ ID NO: 3022220 - RNA, 14 nt, Human
cucuccucugcugc

SEQ ID NO: 3022221 - RNA, 13 nt, Human
cucuccucugcug

SEQ ID NO: 3022222 - RNA, 14 nt, Human
cucuccccagcaag

SEQ ID NO: 3022223 - RNA, 22 nt, Human
cucuccccagcaagugagagcu

SEQ ID NO: 3022224 - RNA, 24 nt, Human
cucuccccagcaagugagagcugg

SEQ ID NO: 3022225 - RNA, 12 nt, Human
cucuccucugcu

SEQ ID NO: 3022226 - RNA, 19 nt, Human
cucuccagccccuggaugc

SEQ ID NO: 3022227 - RNA, 13 nt, Human
cucuccccagcaa

SEQ ID NO: 3022228 - RNA, 13 nt, Human
cucucucaggcca

SEQ ID NO: 3022229 - RNA, 12 nt, Human
cucucucacucc

SEQ ID NO: 3022230 - RNA, 22 nt, Human
cgccagcucaccccaucauccc

SEQ ID NO: 3022231 - RNA, 22 nt, Human
cgccagauucuuuccugaggcu

SEQ ID NO: 3022232 - RNA, 20 nt, Human
ccucugcccacucccugcaa

SEQ ID NO: 3022233 - RNA, 19 nt, Human
ccucugcccacucccugca

SEQ ID NO: 3022234 - RNA, 17 nt, Human
ccucugcccacucccug

SEQ ID NO: 3022235 - RNA, 16 nt, Human
cgccaucccagcccca

SEQ ID NO: 3022236 - RNA, 14 nt, Human
cgccaucccagccc

SEQ ID NO: 3022237 - RNA, 23 nt, Human
cgccaggggaaaaucagccugcu

SEQ ID NO: 3022238 - RNA, 22 nt, Human
cgcccaggcuuagucacugaga

SEQ ID NO: 3022239 - RNA, 22 nt, Human
cgcuaagagggagggagggcuc

SEQ ID NO: 3022240 - RNA, 16 nt, Human
cgcuacccgggaaggg

SEQ ID NO: 3022241 - RNA, 15 nt, Human
cggaaaacaugcuac

SEQ ID NO: 3022242 - RNA, 20 nt, Human
cggaaaacaugcuacacacu

SEQ ID NO: 3022243 - RNA, 18 nt, Human
cgcugugcugcccugccc

SEQ ID NO: 3022244 - RNA, 15 nt, Human
cgcugugcugcccug

SEQ ID NO: 3022245 - RNA, 17 nt, Human
cgcugugcugcccugcc

SEQ ID NO: 3022246 - RNA, 16 nt, Human
cgcugugcugcccugc

SEQ ID NO: 3022247 - RNA, 22 nt, Human
cgcugucagccauuccuguucc

SEQ ID NO: 3022248 - RNA, 23 nt, Human
cggggacagcuccuucuguccua

SEQ ID NO: 3022249 - RNA, 15 nt, Human
cgggggcagagaggg

SEQ ID NO: 3022250 - RNA, 20 nt, Human
cgggaggucgaggcaggagg

SEQ ID NO: 3022251 - RNA, 18 nt, Human
cgggaggucgaggcagga

SEQ ID NO: 3022252 - RNA, 22 nt, Human
cggggacagcuccuucuguccu

SEQ ID NO: 3022253 - RNA, 14 nt, Human
cgggcacucagaag

SEQ ID NO: 3022254 - RNA, 22 nt, Human
cgggcacucagaagacacugau

SEQ ID NO: 3022255 - RNA, 19 nt, Human
cggcuggccuggccccuca

SEQ ID NO: 3022256 - RNA, 22 nt, Human
cggcuggccuggccccucaggg

SEQ ID NO: 3022257 - RNA, 23 nt, Human
cggcuggccuggccccucagggu

SEQ ID NO: 3022258 - RNA, 20 nt, Human
cggugagaggggaacagacu

SEQ ID NO: 3022259 - RNA, 21 nt, Human
cggugagaggggaacagacug

SEQ ID NO: 3022260 - RNA, 14 nt, Human
cgguccacccagga

SEQ ID NO: 3022261 - RNA, 15 nt, Human
cgguccacccaggag

SEQ ID NO: 3022262 - RNA, 16 nt, Human
cgguccacccaggagc

SEQ ID NO: 3022263 - RNA, 20 nt, Human
cgguccacccaggagccccg

SEQ ID NO: 3022264 - RNA, 17 nt, Human
cggccaccugcggugcu

SEQ ID NO: 3022265 - RNA, 16 nt, Human
cggccaccugcggugc

SEQ ID NO: 3022266 - RNA, 15 nt, Human
cggccaccugcggug

SEQ ID NO: 3022267 - RNA, 11 nt, Human
cggccaccugc

SEQ ID NO: 3022268 - RNA, 13 nt, Human
cggaagagccuug

SEQ ID NO: 3022269 - RNA, 13 nt, Human
cggccccugcugg

SEQ ID NO: 3022270 - RNA, 18 nt, Human
cggccccugcugguucag

SEQ ID NO: 3022271 - RNA, 19 nt, Human
cggccccugcugguucagg

SEQ ID NO: 3022272 - RNA, 24 nt, Human
cggccaggccagagggagugacag

SEQ ID NO: 3022273 - RNA, 18 nt, Human
cgugcacgcacacugucu

SEQ ID NO: 3022274 - RNA, 14 nt, Human
cgugcacacaccag

SEQ ID NO: 3022275 - RNA, 18 nt, Human
cgugcacacaccagagcc

SEQ ID NO: 3022276 - RNA, 19 nt, Human
cgugcacacaccagagccc

SEQ ID NO: 3022277 - RNA, 21 nt, Human
cgugcaguggugcgaucuggg

SEQ ID NO: 3022278 - RNA, 23 nt, Human
cgugcauaccacuuuuguucuug

SEQ ID NO: 3022279 - RNA, 20 nt, Human
cgucugacaggcaaugcugg

SEQ ID NO: 3022280 - RNA, 21 nt, Human
cgucugacaggcaaugcuggc

SEQ ID NO: 3022281 - RNA, 22 nt, Human
cgucugacaggcaaugcuggcu

SEQ ID NO: 3022282 - RNA, 16 nt, Human
cgugcacacaccagag

SEQ ID NO: 3022283 - RNA, 16 nt, Human
cgucuaccugaggggc

SEQ ID NO: 3022284 - RNA, 16 nt, Human
cgucucauacucaccu

SEQ ID NO: 3022285 - RNA, 18 nt, Human
cggugcuaucucccccag

SEQ ID NO: 3022286 - RNA, 21 nt, Human
cggugcuaucucccccagccc

SEQ ID NO: 3022287 - RNA, 20 nt, Human
cggugcuaucucccccagcc

SEQ ID NO: 3022288 - RNA, 22 nt, Human
cggugcuaucucccccagcccc

SEQ ID NO: 3022289 - RNA, 13 nt, Human
cuaaaauguucua

SEQ ID NO: 3022290 - RNA, 16 nt, Human
cuaaauguugaaagau

SEQ ID NO: 3022291 - RNA, 17 nt, Human
cuaacauggaaguacua

SEQ ID NO: 3022292 - RNA, 15 nt, Human
cuaacauggaaguac

SEQ ID NO: 3022293 - RNA, 15 nt, Human
cuaaauggaaccacu

SEQ ID NO: 3022294 - RNA, 16 nt, Human
cuaaauggaaccacuc

SEQ ID NO: 3022295 - RNA, 17 nt, Human
cuaaauggaaccacucu

SEQ ID NO: 3022296 - RNA, 18 nt, Human
cuaaauggaaccacucua

SEQ ID NO: 3022297 - RNA, 18 nt, Human
cuacacaccuaacuuaug

SEQ ID NO: 3022298 - RNA, 13 nt, Human
cuacacacugcau

SEQ ID NO: 3022299 - RNA, 15 nt, Human
cuacacacugcaugu

SEQ ID NO: 3022300 - RNA, 18 nt, Human
cuacacugugcugagucu

SEQ ID NO: 3022301 - RNA, 15 nt, Human
cuacagaggccaugg

SEQ ID NO: 3022302 - RNA, 20 nt, Human
cuacccagcgagcccuggug

SEQ ID NO: 3022303 - RNA, 19 nt, Human
cuacccagcgagcccuggu

SEQ ID NO: 3022304 - RNA, 17 nt, Human
cuacccacccuccuuuc

SEQ ID NO: 3022305 - RNA, 13 nt, Human
cuacccacccucc

SEQ ID NO: 3022306 - RNA, 22 nt, Human
cuacccacccuccuuucaccac

SEQ ID NO: 3022307 - RNA, 18 nt, Human
cuaauauguaacaagcca

SEQ ID NO: 3022308 - RNA, 20 nt, Human
cuaauaaaauuuaaaagucu

SEQ ID NO: 3022309 - RNA, 16 nt, Human
cuaaggugugcucuga

SEQ ID NO: 3022310 - RNA, 21 nt, Human
cuaauaaaauuuaaaagucuu

SEQ ID NO: 3022311 - RNA, 14 nt, Human
cuaauguacugcau

SEQ ID NO: 3022312 - RNA, 16 nt, Human
cuaauguacugcauau

SEQ ID NO: 3022313 - RNA, 15 nt, Human
cuaaggugugcucug

SEQ ID NO: 3022314 - RNA, 19 nt, Human
cuaagcuauucaguaauaa

SEQ ID NO: 3022315 - RNA, 21 nt, Human
cuaagcuauucaguaauaacu

SEQ ID NO: 3022316 - RNA, 16 nt, Human
cuaaccagcagaaaug

SEQ ID NO: 3022317 - RNA, 17 nt, Human
cuaaccacgcuggaccu

SEQ ID NO: 3022318 - RNA, 17 nt, Human
cuaaccagcagaaaugc

SEQ ID NO: 3022319 - RNA, 14 nt, Human
cuacugaggugcua

SEQ ID NO: 3022320 - RNA, 17 nt, Human
cuacuguaauuugugau

SEQ ID NO: 3022321 - RNA, 16 nt, Human
cuacuguaauuuguga

SEQ ID NO: 3022322 - RNA, 13 nt, Human
cuacucuguguca

SEQ ID NO: 3022323 - RNA, 16 nt, Human
cuacucugugucaggu

SEQ ID NO: 3022324 - RNA, 21 nt, Human
cuacucugugucagguggggc

SEQ ID NO: 3022325 - RNA, 21 nt, Human
cuacccgggaagggggcuggg

SEQ ID NO: 3022326 - RNA, 20 nt, Human
cuacccgggaagggggcugg

SEQ ID NO: 3022327 - RNA, 15 nt, Human
cuacccgggaagggg

SEQ ID NO: 3022328 - RNA, 14 nt, Human
cuacccgggaaggg

SEQ ID NO: 3022329 - RNA, 21 nt, Human
cuagacgagcaggcuucuucc

SEQ ID NO: 3022330 - RNA, 20 nt, Human
cuagacgagcaggcuucuuc

SEQ ID NO: 3022331 - RNA, 21 nt, Human
cuagagugaacuugggccacu

SEQ ID NO: 3022332 - RNA, 17 nt, Human
cuagagugaacuugggc

SEQ ID NO: 3022333 - RNA, 17 nt, Human
cuagcacuuugggaggc

SEQ ID NO: 3022334 - RNA, 14 nt, Human
cuaugcauuugaaa

SEQ ID NO: 3022335 - RNA, 21 nt, Human
cucaacucuccuccagaguca

SEQ ID NO: 3022336 - RNA, 20 nt, Human
cucaacucuccuccagaguc

SEQ ID NO: 3022337 - RNA, 19 nt, Human
cucaacucuccuccagagu

SEQ ID NO: 3022338 - RNA, 23 nt, Human
cucacaguccuuaccagcagagc

SEQ ID NO: 3022339 - RNA, 18 nt, Human
cucaagugauucuccugc

SEQ ID NO: 3022340 - RNA, 19 nt, Human
cucaagugauucuccugcc

SEQ ID NO: 3022341 - RNA, 20 nt, Human
cucaagugauucuccugccu

SEQ ID NO: 3022342 - RNA, 20 nt, Human
cucaccagccccagugccca

SEQ ID NO: 3022343 - RNA, 21 nt, Human
cucaccagccccagugcccac

SEQ ID NO: 3022344 - RNA, 19 nt, Human
cucaccagccccagugccc

SEQ ID NO: 3022345 - RNA, 14 nt, Human
cucaccccagcccc

SEQ ID NO: 3022346 - RNA, 13 nt, Human
cucaccccagccc

SEQ ID NO: 3022347 - RNA, 12 nt, Human
cucaccccagcc

SEQ ID NO: 3022348 - RNA, 16 nt, Human
cucacuauguugccca

SEQ ID NO: 3022349 - RNA, 17 nt, Human
cucacuauguugcccag

SEQ ID NO: 3022350 - RNA, 11 nt, Human
cuaugcauuug

SEQ ID NO: 3022351 - RNA, 12 nt, Human
cuaugcauuuga

SEQ ID NO: 3022352 - RNA, 20 nt, Human
cuaucaaguauuauaccuuu

SEQ ID NO: 3022353 - RNA, 14 nt, Human
cuaugacacaugca

SEQ ID NO: 3022354 - RNA, 22 nt, Human
cuauauuguuuucaguguacau

SEQ ID NO: 3022355 - RNA, 23 nt, Human
cuauauuguuuucaguguacaug

SEQ ID NO: 3022356 - RNA, 22 nt, Human
cuaggaccccuccaugugggcu

SEQ ID NO: 3022357 - RNA, 17 nt, Human
cuaggaggucucuaaga

SEQ ID NO: 3022358 - RNA, 15 nt, Human
cuaggaacacuccuu

SEQ ID NO: 3022359 - RNA, 13 nt, Human
cuaggaacacucc

SEQ ID NO: 3022360 - RNA, 21 nt, Human
cuaggaagacuuuggaaagag

SEQ ID NO: 3022361 - RNA, 19 nt, Human
cuagugugguguuuccugg

SEQ ID NO: 3022362 - RNA, 23 nt, Human
cuagugugguguuuccuggcacu

SEQ ID NO: 3022363 - RNA, 22 nt, Human
cuagugugguguuuccuggcac

SEQ ID NO: 3022364 - RNA, 21 nt, Human
cuagugugguguuuccuggca

SEQ ID NO: 3022365 - RNA, 21 nt, Human
cuaggcauuugcugaauacag

SEQ ID NO: 3022366 - RNA, 14 nt, Human
cccucaugcugcca

SEQ ID NO: 3022367 - RNA, 17 nt, Human
cccucaugcugccaaua

SEQ ID NO: 3022368 - RNA, 22 nt, Human
cccucauccucauacccacccc

SEQ ID NO: 3022369 - RNA, 21 nt, Human
cccuccaagaccuucuccuuc

SEQ ID NO: 3022370 - RNA, 21 nt, Human
cccucagggucccugguggca

SEQ ID NO: 3022371 - RNA, 20 nt, Human
cccucagucuggcccuuccu

SEQ ID NO: 3022372 - RNA, 22 nt, Human
cccucaucaccaacgucugugc

SEQ ID NO: 3022373 - RNA, 20 nt, Human
cccucauccucauacccacc

SEQ ID NO: 3022374 - RNA, 17 nt, Human
cccucauccucauaccc

SEQ ID NO: 3022375 - RNA, 17 nt, Human
cccuccaugugggcuag

SEQ ID NO: 3022376 - RNA, 13 nt, Human
cccucccucuuuc

SEQ ID NO: 3022377 - RNA, 15 nt, Human
cccucagggucccug

SEQ ID NO: 3022378 - RNA, 19 nt, Human
cccucagggucccuggugg

SEQ ID NO: 3022379 - RNA, 18 nt, Human
cccucagggucccuggug

SEQ ID NO: 3022380 - RNA, 17 nt, Human
cccucagggucccuggu

SEQ ID NO: 3022381 - RNA, 16 nt, Human
cccucagggucccugg

SEQ ID NO: 3022382 - RNA, 22 nt, Human
cccuaaaguguauuuuuuuacu

SEQ ID NO: 3022383 - RNA, 17 nt, Human
cccuaaaguguauuuuu

SEQ ID NO: 3022384 - RNA, 16 nt, Human
cccggcaggguccuag

SEQ ID NO: 3022385 - RNA, 22 nt, Human
ccccuguccccgcacugggcuu

SEQ ID NO: 3022386 - RNA, 20 nt, Human
ccccuguucuggcagaguug

SEQ ID NO: 3022387 - RNA, 20 nt, Human
cccgaggccuucucugaagg

SEQ ID NO: 3022388 - RNA, 15 nt, Human
cccgaggccuucucu

SEQ ID NO: 3022389 - RNA, 13 nt, Human
ccccagccugcua

SEQ ID NO: 3022390 - RNA, 15 nt, Human
ccccagccccauccu

SEQ ID NO: 3022391 - RNA, 16 nt, Human
ccccagccccauccca

SEQ ID NO: 3022392 - RNA, 12 nt, Human
ccccaggaggcc

SEQ ID NO: 3022393 - RNA, 15 nt, Human
ccccuggcagccccu

SEQ ID NO: 3022394 - RNA, 14 nt, Human
ccccuggcagcccc

SEQ ID NO: 3022395 - RNA, 12 nt, Human
ccccuggcagcc

SEQ ID NO: 3022396 - RNA, 22 nt, Human
ccccaggugguuauggagaggg

SEQ ID NO: 3022397 - RNA, 19 nt, Human
cccugcugguucaggguug

SEQ ID NO: 3022398 - RNA, 20 nt, Human
cccugcugguucaggguugg

SEQ ID NO: 3022399 - RNA, 13 nt, Human
cccugcugguuca

SEQ ID NO: 3022400 - RNA, 22 nt, Human
cccugguggcagugggagcugc

SEQ ID NO: 3022401 - RNA, 21 nt, Human
cccugguggcagugggagcug

SEQ ID NO: 3022402 - RNA, 12 nt, Human
cccugccacccu

SEQ ID NO: 3022403 - RNA, 14 nt, Human
cccugccacccugg

SEQ ID NO: 3022404 - RNA, 15 nt, Human
cccugccacccuggg

SEQ ID NO: 3022405 - RNA, 17 nt, Human
cccugccacccugggga

SEQ ID NO: 3022406 - RNA, 18 nt, Human
cccugccacccuggggag

SEQ ID NO: 3022407 - RNA, 23 nt, Human
cccugccuccuuugugaggaagc

SEQ ID NO: 3022408 - RNA, 16 nt, Human
cccugccuccuuugug

SEQ ID NO: 3022409 - RNA, 14 nt, Human
cccugccuccuuug

SEQ ID NO: 3022410 - RNA, 22 nt, Human
cccugcacuugcagacucuaca

SEQ ID NO: 3022411 - RNA, 12 nt, Human
cccugcagaggg

SEQ ID NO: 3022412 - RNA, 18 nt, Human
cccugcagagggcacaga

SEQ ID NO: 3022413 - RNA, 16 nt, Human
cccugcaaccugauug

SEQ ID NO: 3022414 - RNA, 22 nt, Human
cccugcaaccugauugugucuc

SEQ ID NO: 3022415 - RNA, 14 nt, Human
cccugguggcagcu

SEQ ID NO: 3022416 - RNA, 16 nt, Human
ccucccccuggcacug

SEQ ID NO: 3022417 - RNA, 15 nt, Human
ccucccaacucaccc

SEQ ID NO: 3022418 - RNA, 18 nt, Human
ccucccgaauagcuggga

SEQ ID NO: 3022419 - RNA, 13 nt, Human
ccucccucuuucc

SEQ ID NO: 3022420 - RNA, 11 nt, Human
ccuccucagau

SEQ ID NO: 3022421 - RNA, 12 nt, Human
ccuccuccagcc

SEQ ID NO: 3022422 - RNA, 17 nt, Human
ccucccgaguagcuggg

SEQ ID NO: 3022423 - RNA, 18 nt, Human
ccucccgaguagcuggga

SEQ ID NO: 3022424 - RNA, 21 nt, Human
ccucccgaauagcugggacua

SEQ ID NO: 3022425 - RNA, 19 nt, Human
ccucccgaauagcugggac

SEQ ID NO: 3022426 - RNA, 20 nt, Human
ccucccgaauagcugggacu

SEQ ID NO: 3022427 - RNA, 20 nt, Human
ccucaggugagaagcagagg

SEQ ID NO: 3022428 - RNA, 18 nt, Human
ccucaggugagaagcaga

SEQ ID NO: 3022429 - RNA, 17 nt, Human
ccucaggugagaagcag

SEQ ID NO: 3022430 - RNA, 12 nt, Human
ccuccaggugca

SEQ ID NO: 3022431 - RNA, 11 nt, Human
ccuccaggugc

SEQ ID NO: 3022432 - RNA, 17 nt, Human
ccuccaggugcacaagc

SEQ ID NO: 3022433 - RNA, 12 nt, Human
ccuccauguggg

SEQ ID NO: 3022434 - RNA, 15 nt, Human
ccuccaugugggcua

SEQ ID NO: 3022435 - RNA, 17 nt, Human
ccucccaaagugcuggg

SEQ ID NO: 3022436 - RNA, 14 nt, Human
ccucccaacucacc

SEQ ID NO: 3022437 - RNA, 14 nt, Human
ccucuccuccacau

SEQ ID NO: 3022438 - RNA, 13 nt, Human
ccucugacacaca

SEQ ID NO: 3022439 - RNA, 14 nt, Human
ccucugacacacag

SEQ ID NO: 3022440 - RNA, 19 nt, Human
ccucugacacacagcucug

SEQ ID NO: 3022441 - RNA, 20 nt, Human
ccucugacacacagcucugu

SEQ ID NO: 3022442 - RNA, 21 nt, Human
ccucugacacacagcucuguc

SEQ ID NO: 3022443 - RNA, 15 nt, Human
ccucugcacuccccu

SEQ ID NO: 3022444 - RNA, 17 nt, Human
ccucugcacuccccugc

SEQ ID NO: 3022445 - RNA, 16 nt, Human
ccucugcacuccccug

SEQ ID NO: 3022446 - RNA, 18 nt, Human
ccucugcacuccccugcu

SEQ ID NO: 3022447 - RNA, 23 nt, Human
ccucugcacuccccugcugggug

SEQ ID NO: 3022448 - RNA, 14 nt, Human
ccucugcagcaaua

SEQ ID NO: 3022449 - RNA, 18 nt, Human
ccucugcagcaauaaagc

SEQ ID NO: 3022450 - RNA, 16 nt, Human
ccucugcccacucccu

SEQ ID NO: 3022451 - RNA, 13 nt, Human
ccucugcccacuc

SEQ ID NO: 3022452 - RNA, 19 nt, Human
ccucugcagcaauaaagca

SEQ ID NO: 3022453 - RNA, 18 nt, Human
ccucgguguggagaagcg

SEQ ID NO: 3022454 - RNA, 21 nt, Human
ccuccuccagccgccaugcuc

SEQ ID NO: 3022455 - RNA, 15 nt, Human
ccucuccccagcaag

SEQ ID NO: 3022456 - RNA, 22 nt, Human
ccucucccuuggauuguccccg

SEQ ID NO: 3022457 - RNA, 13 nt, Human
ccucucccuugga

SEQ ID NO: 3022458 - RNA, 20 nt, Human
ccucuccccagcaagugaga

SEQ ID NO: 3022459 - RNA, 20 nt, Human
ccucagaugcacaugagcug

SEQ ID NO: 3022460 - RNA, 16 nt, Human
ccucagaucuucugug

SEQ ID NO: 3022461 - RNA, 23 nt, Human
ccucaggccugggggcugggcag

SEQ ID NO: 3022462 - RNA, 20 nt, Human
ccucagggucccugguggca

SEQ ID NO: 3022463 - RNA, 17 nt, Human
ccucagggucccuggug

SEQ ID NO: 3022464 - RNA, 16 nt, Human
ccucagggucccuggu

SEQ ID NO: 3022465 - RNA, 15 nt, Human
ccuaggugacagagu

SEQ ID NO: 3022466 - RNA, 23 nt, Human
ccucacaguccuuaccagcagag

SEQ ID NO: 3022467 - RNA, 24 nt, Human
ccucacaguccuuaccagcagagc

SEQ ID NO: 3022468 - RNA, 16 nt, Human
ccuauuagagaagaga

SEQ ID NO: 3022469 - RNA, 17 nt, Human
ccuauuagagaagagau

SEQ ID NO: 3022470 - RNA, 15 nt, Human
cccuuggacauuuua

SEQ ID NO: 3022471 - RNA, 14 nt, Human
cccuuggacauuuu

SEQ ID NO: 3022472 - RNA, 17 nt, Human
cccuuggauuguccccg

SEQ ID NO: 3022473 - RNA, 20 nt, Human
cccuuguggucccaccccac

SEQ ID NO: 3022474 - RNA, 22 nt, Human
cccuuguggucccaccccacac

SEQ ID NO: 3022475 - RNA, 23 nt, Human
cccuugguuaggcauugugggaa

SEQ ID NO: 3022476 - RNA, 22 nt, Human
cccuugguuaggcauuguggga

SEQ ID NO: 3022477 - RNA, 12 nt, Human
cccuucccaccu

SEQ ID NO: 3022478 - RNA, 13 nt, Human
cccuucccaccuc

SEQ ID NO: 3022479 - RNA, 17 nt, Human
ccgggaagggggcuggg

SEQ ID NO: 3022480 - RNA, 21 nt, Human
ccuagaaauuccccacccuga

SEQ ID NO: 3022481 - RNA, 13 nt, Human
ccuaggugacaga

SEQ ID NO: 3022482 - RNA, 13 nt, Human
ccuacccacccuc

SEQ ID NO: 3022483 - RNA, 18 nt, Human
ccuacccacccuccuuuc

SEQ ID NO: 3022484 - RNA, 19 nt, Human
ccuacuguaauuugugaua

SEQ ID NO: 3022485 - RNA, 22 nt, Human
ccuacaguugaaaaacagcuga

SEQ ID NO: 3022486 - RNA, 19 nt, Human
ccuacagcuugaccgugag

SEQ ID NO: 3022487 - RNA, 16 nt, Human
ccuaaaauucagugga

SEQ ID NO: 3022488 - RNA, 15 nt, Human
ccuaaaauucagugg

SEQ ID NO: 3022489 - RNA, 12 nt, Human
ccguuauuaaaa

SEQ ID NO: 3022490 - RNA, 16 nt, Human
cccaguguuuuaggag

SEQ ID NO: 3022491 - RNA, 17 nt, Human
cccaguguuuuaggagc

SEQ ID NO: 3022492 - RNA, 14 nt, Human
cccaguuagcucuc

SEQ ID NO: 3022493 - RNA, 20 nt, Human
cccagugguuccuaauccuc

SEQ ID NO: 3022494 - RNA, 15 nt, Human
cccagugccgagaag

SEQ ID NO: 3022495 - RNA, 21 nt, Human
cccagugcccacaggaucagu

SEQ ID NO: 3022496 - RNA, 10 nt, Human
cccagucugg

SEQ ID NO: 3022497 - RNA, 18 nt, Human
cccagucuggaaugcagu

SEQ ID NO: 3022498 - RNA, 19 nt, Human
cccagucuggaaugcagug

SEQ ID NO: 3022499 - RNA, 17 nt, Human
cccaggcauuccccagg

SEQ ID NO: 3022500 - RNA, 23 nt, Human
cccaggcaggucuugaacuccug

SEQ ID NO: 3022501 - RNA, 15 nt, Human
cccaggcauucccca

SEQ ID NO: 3022502 - RNA, 16 nt, Human
cccaggaggccagccu

SEQ ID NO: 3022503 - RNA, 15 nt, Human
cccaggaggccagcc

SEQ ID NO: 3022504 - RNA, 13 nt, Human
cccagguuucuau

SEQ ID NO: 3022505 - RNA, 21 nt, Human
ccccaaauggaaaugggcaga

SEQ ID NO: 3022506 - RNA, 20 nt, Human
cccaucugugaaaggaaaga

SEQ ID NO: 3022507 - RNA, 13 nt, Human
cccaucucacaca

SEQ ID NO: 3022508 - RNA, 18 nt, Human
cccaucucacacaugagc

SEQ ID NO: 3022509 - RNA, 12 nt, Human
cccaucugugaa

SEQ ID NO: 3022510 - RNA, 14 nt, Human
cccaugcugcccug

SEQ ID NO: 3022511 - RNA, 13 nt, Human
cccaugcugcccu

SEQ ID NO: 3022512 - RNA, 12 nt, Human
cccaugcugccc

SEQ ID NO: 3022513 - RNA, 20 nt, Human
cccaugagccucagcauccu

SEQ ID NO: 3022514 - RNA, 15 nt, Human
cccaugagccucagc

SEQ ID NO: 3022515 - RNA, 16 nt, Human
cccaugagccucagca

SEQ ID NO: 3022516 - RNA, 13 nt, Human
cccaggagccccg

SEQ ID NO: 3022517 - RNA, 14 nt, Human
cccaggagccccga

SEQ ID NO: 3022518 - RNA, 14 nt, Human
cccaggaggccagc

SEQ ID NO: 3022519 - RNA, 14 nt, Human
cccagcgagcccug

SEQ ID NO: 3022520 - RNA, 18 nt, Human
cccagcucugguccauag

SEQ ID NO: 3022521 - RNA, 16 nt, Human
cccagcucugguccau

SEQ ID NO: 3022522 - RNA, 15 nt, Human
cccagcucuggucca

SEQ ID NO: 3022523 - RNA, 12 nt, Human
cccagcucuggu

SEQ ID NO: 3022524 - RNA, 14 nt, Human
cccagcucuggucc

SEQ ID NO: 3022525 - RNA, 13 nt, Human
cccagcucugguc

SEQ ID NO: 3022526 - RNA, 15 nt, Human
cccagccccauccuc

SEQ ID NO: 3022527 - RNA, 14 nt, Human
cccagccccauccu

SEQ ID NO: 3022528 - RNA, 14 nt, Human
cccagccccauccc

SEQ ID NO: 3022529 - RNA, 13 nt, Human
cccagccccaucc

SEQ ID NO: 3022530 - RNA, 18 nt, Human
cccagccccuucugaccc

SEQ ID NO: 3022531 - RNA, 19 nt, Human
cccagccccauccucugua

SEQ ID NO: 3022532 - RNA, 18 nt, Human
cccagccccauccucugu

SEQ ID NO: 3022533 - RNA, 13 nt, Human
cccagccccaaug

SEQ ID NO: 3022534 - RNA, 12 nt, Human
cccagccccauc

SEQ ID NO: 3022535 - RNA, 11 nt, Human
cccagccccau

SEQ ID NO: 3022536 - RNA, 17 nt, Human
cccagccccaaugaaca

SEQ ID NO: 3022537 - RNA, 23 nt, Human
cccagauugcaacaggcugggcu

SEQ ID NO: 3022538 - RNA, 18 nt, Human
cccaggaggccagccuug

SEQ ID NO: 3022539 - RNA, 19 nt, Human
ccauguuggccaggcuggu

SEQ ID NO: 3022540 - RNA, 21 nt, Human
ccauguuggccaggcuggucu

SEQ ID NO: 3022541 - RNA, 18 nt, Human
ccauguuggccaggcugg

SEQ ID NO: 3022542 - RNA, 15 nt, Human
ccauguuggccaggc

SEQ ID NO: 3022543 - RNA, 15 nt, Human
cccaccuggccucug

SEQ ID NO: 3022544 - RNA, 12 nt, Human
cccaccuggccu

SEQ ID NO: 3022545 - RNA, 16 nt, Human
cccaccuuggcugcag

SEQ ID NO: 3022546 - RNA, 17 nt, Human
cccaccuuggcugcagg

SEQ ID NO: 3022547 - RNA, 19 nt, Human
cccaccuuggcugcaggga

SEQ ID NO: 3022548 - RNA, 14 nt, Human
cccacgcccccacu

SEQ ID NO: 3022549 - RNA, 13 nt, Human
cccacgcccccac

SEQ ID NO: 3022550 - RNA, 15 nt, Human
ccaugcugcccugug

SEQ ID NO: 3022551 - RNA, 18 nt, Human
ccaugcuccuggcccacu

SEQ ID NO: 3022552 - RNA, 15 nt, Human
ccaugcuccuggccc

SEQ ID NO: 3022553 - RNA, 17 nt, Human
ccaugcugcccugugag

SEQ ID NO: 3022554 - RNA, 16 nt, Human
ccaugcugcccuguga

SEQ ID NO: 3022555 - RNA, 13 nt, Human
ccaugcuccuggc

SEQ ID NO: 3022556 - RNA, 13 nt, Human
ccauguuggccag

SEQ ID NO: 3022557 - RNA, 14 nt, Human
ccauguuggccagg

SEQ ID NO: 3022558 - RNA, 13 nt, Human
ccaugugccaggu

SEQ ID NO: 3022559 - RNA, 14 nt, Human
ccaucaugucuggc

SEQ ID NO: 3022560 - RNA, 16 nt, Human
ccaucaugucuggcua

SEQ ID NO: 3022561 - RNA, 21 nt, Human
ccauccucuguacagagccca

SEQ ID NO: 3022562 - RNA, 23 nt, Human
ccauagagagcaagacgcugugc

SEQ ID NO: 3022563 - RNA, 19 nt, Human
ccauauuaccacagacaua

SEQ ID NO: 3022564 - RNA, 15 nt, Human
ccauauucuguuggc

SEQ ID NO: 3022565 - RNA, 18 nt, Human
ccauauucuguuggccag

SEQ ID NO: 3022566 - RNA, 12 nt, Human
ccaucacccgcu

SEQ ID NO: 3022567 - RNA, 23 nt, Human
ccagggacagaggggguggccuc

SEQ ID NO: 3022568 - RNA, 19 nt, Human
ccaggccccugccacccug

SEQ ID NO: 3022569 - RNA, 21 nt, Human
ccaggccccugccacccuggg

SEQ ID NO: 3022570 - RNA, 23 nt, Human
ccaggccccugccacccugggga

SEQ ID NO: 3022571 - RNA, 14 nt, Human
ccaggccagaggga

SEQ ID NO: 3022572 - RNA, 21 nt, Human
ccaggccagagggagugacag

SEQ ID NO: 3022573 - RNA, 14 nt, Human
ccaggagcagccac

SEQ ID NO: 3022574 - RNA, 12 nt, Human
ccaggccagagg

SEQ ID NO: 3022575 - RNA, 19 nt, Human
ccaggccuccuacagcuug

SEQ ID NO: 3022576 - RNA, 18 nt, Human
ccaggccuccuacagcuu

SEQ ID NO: 3022577 - RNA, 13 nt, Human
ccaggccuccuac

SEQ ID NO: 3022578 - RNA, 19 nt, Human
ccaggcccucugcccacuc

SEQ ID NO: 3022579 - RNA, 18 nt, Human
ccaggcccucugcccacu

SEQ ID NO: 3022580 - RNA, 17 nt, Human
ccaggcccucugcccac

SEQ ID NO: 3022581 - RNA, 16 nt, Human
ccaggcccucugccca

SEQ ID NO: 3022582 - RNA, 22 nt, Human
ccagcugugcucuggacaggca

SEQ ID NO: 3022583 - RNA, 23 nt, Human
ccagcugugcucuggacaggcau

SEQ ID NO: 3022584 - RNA, 19 nt, Human
ccaggaagccagcaggcuc

SEQ ID NO: 3022585 - RNA, 17 nt, Human
ccaggaagccagcaggc

SEQ ID NO: 3022586 - RNA, 15 nt, Human
ccaggaagccagcag

SEQ ID NO: 3022587 - RNA, 14 nt, Human
ccaggaagccagca

SEQ ID NO: 3022588 - RNA, 13 nt, Human
ccaggagcagcca

SEQ ID NO: 3022589 - RNA, 12 nt, Human
ccaggagcagcc

SEQ ID NO: 3022590 - RNA, 18 nt, Human
ccagcugugcucuggaca

SEQ ID NO: 3022591 - RNA, 20 nt, Human
ccagcugugcucuggacagg

SEQ ID NO: 3022592 - RNA, 21 nt, Human
ccagcugugcucuggacaggc

SEQ ID NO: 3022593 - RNA, 15 nt, Human
ccagcugcuugggcu

SEQ ID NO: 3022594 - RNA, 13 nt, Human
ccagcugcuuggg

SEQ ID NO: 3022595 - RNA, 18 nt, Human
ccagcugcuugggcuuca

SEQ ID NO: 3022596 - RNA, 16 nt, Human
ccagcugcuugggcuu

SEQ ID NO: 3022597 - RNA, 22 nt, Human
cauugacuauuuuuguuuuuau

SEQ ID NO: 3022598 - RNA, 22 nt, Human
cauugaccugaggcccuucucu

SEQ ID NO: 3022599 - RNA, 13 nt, Human
cauugaccugagg

SEQ ID NO: 3022600 - RNA, 14 nt, Human
cauugacagauuga

SEQ ID NO: 3022601 - RNA, 19 nt, Human
cauugaaaucuuuuugcuu

SEQ ID NO: 3022602 - RNA, 16 nt, Human
cauuucucauguugaa

SEQ ID NO: 3022603 - RNA, 17 nt, Human
cauuucucauguugaaa

SEQ ID NO: 3022604 - RNA, 21 nt, Human
cauuucuuccacaagagccca

SEQ ID NO: 3022605 - RNA, 21 nt, Human
cauuuaaaagauacaguuacu

SEQ ID NO: 3022606 - RNA, 17 nt, Human
cauuuacuuuguguuca

SEQ ID NO: 3022607 - RNA, 21 nt, Human
cauuuacuuuguguucaccuu

SEQ ID NO: 3022608 - RNA, 17 nt, Human
cauuugaggucuguucu

SEQ ID NO: 3022609 - RNA, 18 nt, Human
cauuugaggucuguucuu

SEQ ID NO: 3022610 - RNA, 19 nt, Human
cauuugaggucuguucuuu

SEQ ID NO: 3022611 - RNA, 14 nt, Human
cauuugagcagggc

SEQ ID NO: 3022612 - RNA, 23 nt, Human
cauuucuuccacaagagcccagg

SEQ ID NO: 3022613 - RNA, 20 nt, Human
cauuuugggguacccacugc

SEQ ID NO: 3022614 - RNA, 21 nt, Human
cauuuugggguacccacugcu

SEQ ID NO: 3022615 - RNA, 22 nt, Human
cauuuugggguacccacugcuc

SEQ ID NO: 3022616 - RNA, 24 nt, Human
cauuuugcuaaaugugaaugauga

SEQ ID NO: 3022617 - RNA, 21 nt, Human
cauuuugcuaaaugugaauga

SEQ ID NO: 3022618 - RNA, 18 nt, Human
cauuuugcuaaaugugaa

SEQ ID NO: 3022619 - RNA, 23 nt, Human
cauuuugggguacccacugcucu

SEQ ID NO: 3022620 - RNA, 19 nt, Human
cauuuuuaguagagacagg

SEQ ID NO: 3022621 - RNA, 18 nt, Human
cauuuuuaguagagacag

SEQ ID NO: 3022622 - RNA, 15 nt, Human
cauuuuuaagugcug

SEQ ID NO: 3022623 - RNA, 20 nt, Human
cauuuuuaagugcugcauuu

SEQ ID NO: 3022624 - RNA, 19 nt, Human
cauuuuauuuuauuaugca

SEQ ID NO: 3022625 - RNA, 21 nt, Human
cauuuuauuuuauuaugcaug

SEQ ID NO: 3022626 - RNA, 20 nt, Human
cauuuuuaguagagacaggg

SEQ ID NO: 3022627 - RNA, 18 nt, Human
ccaaaauaaaacuuuuua

SEQ ID NO: 3022628 - RNA, 21 nt, Human
ccaaaauaaaacuuuuuaaaa

SEQ ID NO: 3022629 - RNA, 16 nt, Human
ccaaacccuucagugc

SEQ ID NO: 3022630 - RNA, 20 nt, Human
ccaauuugcacauuaaauga

SEQ ID NO: 3022631 - RNA, 19 nt, Human
ccaauuugcacauuaaaug

SEQ ID NO: 3022632 - RNA, 18 nt, Human
ccacaaaggagagcuagc

SEQ ID NO: 3022633 - RNA, 13 nt, Human
ccacaagagccca

SEQ ID NO: 3022634 - RNA, 16 nt, Human
ccacaagacccuugug

SEQ ID NO: 3022635 - RNA, 18 nt, Human
ccaaggugggaggauugc

SEQ ID NO: 3022636 - RNA, 14 nt, Human
ccaaggcuggggga

SEQ ID NO: 3022637 - RNA, 14 nt, Human
ccaagcaggacaug

SEQ ID NO: 3022638 - RNA, 23 nt, Human
ccaagcagagguugggaggccau

SEQ ID NO: 3022639 - RNA, 13 nt, Human
ccaagcucccagg

SEQ ID NO: 3022640 - RNA, 12 nt, Human
ccaagcucccag

SEQ ID NO: 3022641 - RNA, 15 nt, Human
ccacaaguuaaauaa

SEQ ID NO: 3022642 - RNA, 20 nt, Human
ccacaaguuaaauaaaucau

SEQ ID NO: 3022643 - RNA, 21 nt, Human
ccacaagagcccaggccuccu

SEQ ID NO: 3022644 - RNA, 20 nt, Human
ccacaagagcccaggccucc

SEQ ID NO: 3022645 - RNA, 19 nt, Human
ccacaagagcccaggccuc

SEQ ID NO: 3022646 - RNA, 18 nt, Human
ccacaagagcccaggccu

SEQ ID NO: 3022647 - RNA, 17 nt, Human
ccacaagagcccaggcc

SEQ ID NO: 3022648 - RNA, 16 nt, Human
ccacaagagcccaggc

SEQ ID NO: 3022649 - RNA, 13 nt, Human
ccaacaucaacau

SEQ ID NO: 3022650 - RNA, 14 nt, Human
ccaacauacuccca

SEQ ID NO: 3022651 - RNA, 16 nt, Human
ccaacaucaacaucuu

SEQ ID NO: 3022652 - RNA, 15 nt, Human
ccaaauucuuucagu

SEQ ID NO: 3022653 - RNA, 22 nt, Human
ccaaauucuuucaguggcuacc

SEQ ID NO: 3022654 - RNA, 15 nt, Human
ccaagaccuucuccu

SEQ ID NO: 3022655 - RNA, 15 nt, Human
ccaacccucaucacc

SEQ ID NO: 3022656 - RNA, 13 nt, Human
ccaacccucauca

SEQ ID NO: 3022657 - RNA, 13 nt, Human
ccaaagaugcagc

SEQ ID NO: 3022658 - RNA, 14 nt, Human
ccaaagaugcagcc

SEQ ID NO: 3022659 - RNA, 17 nt, Human
cauuaaagguacuuugc

SEQ ID NO: 3022660 - RNA, 18 nt, Human
cauuaaaugacucuuccc

SEQ ID NO: 3022661 - RNA, 14 nt, Human
cauuaaaugacucu

SEQ ID NO: 3022662 - RNA, 13 nt, Human
cauuaaaugacuc

SEQ ID NO: 3022663 - RNA, 21 nt, Human
cauuaaagccugaguuugcuu

SEQ ID NO: 3022664 - RNA, 15 nt, Human
cauguuuuguuuacg

SEQ ID NO: 3022665 - RNA, 18 nt, Human
cauguuuuucuucucccu

SEQ ID NO: 3022666 - RNA, 15 nt, Human
cauguuugugauuga

SEQ ID NO: 3022667 - RNA, 23 nt, Human
cauguuugauguaucugagcagg

SEQ ID NO: 3022668 - RNA, 21 nt, Human
caugugccagguuuuuggucu

SEQ ID NO: 3022669 - RNA, 15 nt, Human
caugugcacaugcac

SEQ ID NO: 3022670 - RNA, 16 nt, Human
cauggucggaaaacau

SEQ ID NO: 3022671 - RNA, 18 nt, Human
cauguaauuaaguacuau

SEQ ID NO: 3022672 - RNA, 21 nt, Human
cauguaauuaaguacuaugua

SEQ ID NO: 3022673 - RNA, 23 nt, Human
caugucuuuucuugcaugaggcu

SEQ ID NO: 3022674 - RNA, 21 nt, Human
caugucuuuucuugcaugagg

SEQ ID NO: 3022675 - RNA, 19 nt, Human
caugucuuuucuugcauga

SEQ ID NO: 3022676 - RNA, 14 nt, Human
caugucuuuucuug

SEQ ID NO: 3022677 - RNA, 17 nt, Human
caugccuaccaauauuu

SEQ ID NO: 3022678 - RNA, 15 nt, Human
caugccucucucagg

SEQ ID NO: 3022679 - RNA, 14 nt, Human
caugccucucucag

SEQ ID NO: 3022680 - RNA, 13 nt, Human
caugccuggaugg

SEQ ID NO: 3022681 - RNA, 19 nt, Human
caugccucucucaggccaa

SEQ ID NO: 3022682 - RNA, 18 nt, Human
caugccucucucaggcca

SEQ ID NO: 3022683 - RNA, 17 nt, Human
caugccucucucaggcc

SEQ ID NO: 3022684 - RNA, 16 nt, Human
caugccucucucaggc

SEQ ID NO: 3022685 - RNA, 22 nt, Human
cauggaaguacuauaauuuacc

SEQ ID NO: 3022686 - RNA, 20 nt, Human
cauggaaguacuauaauuua

SEQ ID NO: 3022687 - RNA, 16 nt, Human
cauggaauaacaugua

SEQ ID NO: 3022688 - RNA, 18 nt, Human
cauggacaugaucuucuu

SEQ ID NO: 3022689 - RNA, 23 nt, Human
caugccuggauggggcugcaccg

SEQ ID NO: 3022690 - RNA, 21 nt, Human
caugccuggauggggcugcac

SEQ ID NO: 3022691 - RNA, 18 nt, Human
caugccuggauggggcug

SEQ ID NO: 3022692 - RNA, 17 nt, Human
caugcgggcuuccuccu

SEQ ID NO: 3022693 - RNA, 22 nt, Human
caugcugucccuuacgugaguc

SEQ ID NO: 3022694 - RNA, 17 nt, Human
caugcugucccuuacgu

SEQ ID NO: 3022695 - RNA, 18 nt, Human
caugggaaugaaugucag

SEQ ID NO: 3022696 - RNA, 16 nt, Human
cauggaguauauguca

SEQ ID NO: 3022697 - RNA, 17 nt, Human
cauggagguuugaagau

SEQ ID NO: 3022698 - RNA, 13 nt, Human
cauggacuuuguu

SEQ ID NO: 3022699 - RNA, 11 nt, Human
cauggacuuug

SEQ ID NO: 3022700 - RNA, 16 nt, Human
caugggccuccugugu

SEQ ID NO: 3022701 - RNA, 17 nt, Human
caugggccuccugugug

SEQ ID NO: 3022702 - RNA, 15 nt, Human
caugggccuccugug

SEQ ID NO: 3022703 - RNA, 22 nt, Human
caugggaaugaaugucagugug

SEQ ID NO: 3022704 - RNA, 20 nt, Human
caugccagcuuaucucaggg

SEQ ID NO: 3022705 - RNA, 19 nt, Human
caugccagcuuaucucagg

SEQ ID NO: 3022706 - RNA, 13 nt, Human
caugccccugaac

SEQ ID NO: 3022707 - RNA, 18 nt, Human
cauacuuuuuggguuuau

SEQ ID NO: 3022708 - RNA, 16 nt, Human
cauacuuuuuggguuu

SEQ ID NO: 3022709 - RNA, 12 nt, Human
cauacuuuuugg

SEQ ID NO: 3022710 - RNA, 21 nt, Human
cauagagagcaagacgcugug

SEQ ID NO: 3022711 - RNA, 19 nt, Human
cauagagagcaagacgcug

SEQ ID NO: 3022712 - RNA, 23 nt, Human
cauagagagcaagacgcugugcu

SEQ ID NO: 3022713 - RNA, 18 nt, Human
cauacuauuaaacaugcu

SEQ ID NO: 3022714 - RNA, 11 nt, Human
cauacucugcu

SEQ ID NO: 3022715 - RNA, 20 nt, Human
cauacucccaucugugaaag

SEQ ID NO: 3022716 - RNA, 18 nt, Human
cauacucccaucugugaa

SEQ ID NO: 3022717 - RNA, 15 nt, Human
cauacucccaucugu

SEQ ID NO: 3022718 - RNA, 16 nt, Human
cauacucccaucugug

SEQ ID NO: 3022719 - RNA, 17 nt, Human
cauaguaugguggcugg

SEQ ID NO: 3022720 - RNA, 20 nt, Human
cauaguaugguggcuggguu

SEQ ID NO: 3022721 - RNA, 18 nt, Human
cauaguaugguggcuggg

SEQ ID NO: 3022722 - RNA, 19 nt, Human
cauaguaugguggcugggu

SEQ ID NO: 3022723 - RNA, 22 nt, Human
cauaguggcuuaaaacaacacu

SEQ ID NO: 3022724 - RNA, 22 nt, Human
cauauauauguuuuaagaggca

SEQ ID NO: 3022725 - RNA, 14 nt, Human
cauauuuacuucuu

SEQ ID NO: 3022726 - RNA, 20 nt, Human
cauauuuacuucuuauacau

SEQ ID NO: 3022727 - RNA, 16 nt, Human
cauauuuacuucuuau

SEQ ID NO: 3022728 - RNA, 17 nt, Human
cauauuuacuucuuaua

SEQ ID NO: 3022729 - RNA, 14 nt, Human
caucaagaugugac

SEQ ID NO: 3022730 - RNA, 14 nt, Human
caucauuucaagaa

SEQ ID NO: 3022731 - RNA, 12 nt, Human
caucauuucaag

SEQ ID NO: 3022732 - RNA, 15 nt, Human
caucaccaacgucug

SEQ ID NO: 3022733 - RNA, 13 nt, Human
caucauugaaauc

SEQ ID NO: 3022734 - RNA, 21 nt, Human
caucauugaaaucuuuuugcu

SEQ ID NO: 3022735 - RNA, 20 nt, Human
caucauugaaaucuuuuugc

SEQ ID NO: 3022736 - RNA, 15 nt, Human
caucauugaaaucuu

SEQ ID NO: 3022737 - RNA, 14 nt, Human
caucauugaaaucu

SEQ ID NO: 3022738 - RNA, 15 nt, Human
cauccagguucagcu

SEQ ID NO: 3022739 - RNA, 19 nt, Human
caucccucuggggcuguuc

SEQ ID NO: 3022740 - RNA, 13 nt, Human
caucccugaaggc

SEQ ID NO: 3022741 - RNA, 11 nt, Human
caucccugaag

SEQ ID NO: 3022742 - RNA, 21 nt, Human
caucccugaaggccccgccca

SEQ ID NO: 3022743 - RNA, 19 nt, Human
caucccugaaggccccgcc

SEQ ID NO: 3022744 - RNA, 18 nt, Human
caucccugaaggccccgc

SEQ ID NO: 3022745 - RNA, 17 nt, Human
caucccugaaggccccg

SEQ ID NO: 3022746 - RNA, 15 nt, Human
caucuacccuccgau

SEQ ID NO: 3022747 - RNA, 19 nt, Human
cauccucuguacagagccc

SEQ ID NO: 3022748 - RNA, 18 nt, Human
cauccucuguacagagcc

SEQ ID NO: 3022749 - RNA, 15 nt, Human
cauccucuguacaga

SEQ ID NO: 3022750 - RNA, 20 nt, Human
caucucacacaugagcauca

SEQ ID NO: 3022751 - RNA, 17 nt, Human
caucucacacaugagca

SEQ ID NO: 3022752 - RNA, 16 nt, Human
caucucacacaugagc

SEQ ID NO: 3022753 - RNA, 16 nt, Human
cauccucauacccacc

SEQ ID NO: 3022754 - RNA, 15 nt, Human
cauccucauacccac

SEQ ID NO: 3022755 - RNA, 12 nt, Human
cauccuccucag

SEQ ID NO: 3022756 - RNA, 11 nt, Human
cauccuccuca

SEQ ID NO: 3022757 - RNA, 19 nt, Human
cauccuccucagaucuucu

SEQ ID NO: 3022758 - RNA, 18 nt, Human
cauccuccucagaucuuc

SEQ ID NO: 3022759 - RNA, 16 nt, Human
cauccuccucagaucu

SEQ ID NO: 3022760 - RNA, 15 nt, Human
cauccuccucagauc

SEQ ID NO: 3022761 - RNA, 13 nt, Human
cauccucccaagg

SEQ ID NO: 3022762 - RNA, 22 nt, Human
cauccucauacccacccccacc

SEQ ID NO: 3022763 - RNA, 21 nt, Human
cauccucauacccacccccac

SEQ ID NO: 3022764 - RNA, 18 nt, Human
cauccucauacccacccc

SEQ ID NO: 3022765 - RNA, 17 nt, Human
cauccucauacccaccc

SEQ ID NO: 3022766 - RNA, 20 nt, Human
caucuugcucugcugacaga

SEQ ID NO: 3022767 - RNA, 14 nt, Human
caucuugcucugcu

SEQ ID NO: 3022768 - RNA, 13 nt, Human
caucuugcucugc

SEQ ID NO: 3022769 - RNA, 22 nt, Human
caucuuccaaggguacuaagga

SEQ ID NO: 3022770 - RNA, 14 nt, Human
cauacuauuaaaca

SEQ ID NO: 3022771 - RNA, 21 nt, Human
cauacccacccccacccaagg

SEQ ID NO: 3022772 - RNA, 18 nt, Human
cauacccacccccaccca

SEQ ID NO: 3022773 - RNA, 17 nt, Human
cauacccacccccaccc

SEQ ID NO: 3022774 - RNA, 14 nt, Human
cauacccaccccca

SEQ ID NO: 3022775 - RNA, 13 nt, Human
cauacguacacau

SEQ ID NO: 3022776 - RNA, 15 nt, Human
cauacguacacauuu

SEQ ID NO: 3022777 - RNA, 16 nt, Human
cauacguacacauuuu

SEQ ID NO: 3022778 - RNA, 17 nt, Human
cauacguacacauuuua

SEQ ID NO: 3022779 - RNA, 18 nt, Human
cauacguacacauuuuau

SEQ ID NO: 3022780 - RNA, 14 nt, Human
cauacuaaccagca

SEQ ID NO: 3022781 - RNA, 21 nt, Human
cauacuaaccagcagaaaugc

SEQ ID NO: 3022782 - RNA, 18 nt, Human
caguuggguuuuuuaagg

SEQ ID NO: 3022783 - RNA, 16 nt, Human
caguuggguuuuuuaa

SEQ ID NO: 3022784 - RNA, 11 nt, Human
caguuggguuu

SEQ ID NO: 3022785 - RNA, 18 nt, Human
caguuggucccccuucca

SEQ ID NO: 3022786 - RNA, 18 nt, Human
caguuggguggaugccug

SEQ ID NO: 3022787 - RNA, 19 nt, Human
caguuggguggaugccugg

SEQ ID NO: 3022788 - RNA, 22 nt, Human
caguuggucccccuuccaugga

SEQ ID NO: 3022789 - RNA, 21 nt, Human
caguuggucccccuuccaugg

SEQ ID NO: 3022790 - RNA, 20 nt, Human
caguuggucccccuuccaug

SEQ ID NO: 3022791 - RNA, 19 nt, Human
caguuggucccccuuccau

SEQ ID NO: 3022792 - RNA, 16 nt, Human
caguuggguggaugcc

SEQ ID NO: 3022793 - RNA, 23 nt, Human
caguugccagucaccccggccac

SEQ ID NO: 3022794 - RNA, 19 nt, Human
caguuuuuuuccuucaaga

SEQ ID NO: 3022795 - RNA, 17 nt, Human
caguuguuagugugucu

SEQ ID NO: 3022796 - RNA, 22 nt, Human
cauaagugcuauugcagagccg

SEQ ID NO: 3022797 - RNA, 18 nt, Human
cauaagugcuauugcaga

SEQ ID NO: 3022798 - RNA, 14 nt, Human
cauaagauaaaugu

SEQ ID NO: 3022799 - RNA, 19 nt, Human
cauaccacuuuuguucuug

SEQ ID NO: 3022800 - RNA, 12 nt, Human
cauacccacccc

SEQ ID NO: 3022801 - RNA, 11 nt, Human
cauacccaccc

SEQ ID NO: 3022802 - RNA, 13 nt, Human
cauaccacuuuug

SEQ ID NO: 3022803 - RNA, 14 nt, Human
cauaccacuuuugu

SEQ ID NO: 3022804 - RNA, 15 nt, Human
cauaccacuuuuguu

SEQ ID NO: 3022805 - RNA, 18 nt, Human
cauaccacuuuuguucuu

SEQ ID NO: 3022806 - RNA, 16 nt, Human
cauaaccuagccuuag

SEQ ID NO: 3022807 - RNA, 21 nt, Human
cauaaaaauuagccaagugug

SEQ ID NO: 3022808 - RNA, 22 nt, Human
cauaaacaagaccacguuucua

SEQ ID NO: 3022809 - RNA, 20 nt, Human
cauaaacaagaccacguuuc

SEQ ID NO: 3022810 - RNA, 21 nt, Human
cauaaacaagaccacguuucu

SEQ ID NO: 3022811 - RNA, 20 nt, Human
caguguuuuaggagcaugag

SEQ ID NO: 3022812 - RNA, 16 nt, Human
caguguuuuaggagca

SEQ ID NO: 3022813 - RNA, 19 nt, Human
caguguuguggauuuaaca

SEQ ID NO: 3022814 - RNA, 20 nt, Human
caguguuguggauuuaacag

SEQ ID NO: 3022815 - RNA, 22 nt, Human
caguguuguggauuuaacagaa

SEQ ID NO: 3022816 - RNA, 14 nt, Human
caguuaagagaaau

SEQ ID NO: 3022817 - RNA, 13 nt, Human
caguuaagagaaa

SEQ ID NO: 3022818 - RNA, 14 nt, Human
caguuacucagaau

SEQ ID NO: 3022819 - RNA, 19 nt, Human
caguugaaaaacagcugag

SEQ ID NO: 3022820 - RNA, 18 nt, Human
caguugaaaaacagcuga

SEQ ID NO: 3022821 - RNA, 12 nt, Human
caguugaaaaac

SEQ ID NO: 3022822 - RNA, 13 nt, Human
caguucucuccuu

SEQ ID NO: 3022823 - RNA, 15 nt, Human
caguucucuccuucu

SEQ ID NO: 3022824 - RNA, 14 nt, Human
caguucucuccuuc

SEQ ID NO: 3022825 - RNA, 22 nt, Human
caguucucuccuucuucccccc

SEQ ID NO: 3022826 - RNA, 13 nt, Human
cagugcuuggccc

SEQ ID NO: 3022827 - RNA, 14 nt, Human
cagugcuuggccca

SEQ ID NO: 3022828 - RNA, 15 nt, Human
cagugcuuggcccag

SEQ ID NO: 3022829 - RNA, 16 nt, Human
cagugcuuggcccagg

SEQ ID NO: 3022830 - RNA, 12 nt, Human
cagugcuuggcc

SEQ ID NO: 3022831 - RNA, 17 nt, Human
cagugcuuggcccagga

SEQ ID NO: 3022832 - RNA, 18 nt, Human
cagugcuuggcccaggag

SEQ ID NO: 3022833 - RNA, 19 nt, Human
cagugcuuggcccaggagu

SEQ ID NO: 3022834 - RNA, 20 nt, Human
cagugcuuggcccaggaguu

SEQ ID NO: 3022835 - RNA, 12 nt, Human
caguggcagcug

SEQ ID NO: 3022836 - RNA, 13 nt, Human
caguggcagcugc

SEQ ID NO: 3022837 - RNA, 14 nt, Human
caguggcagcugcu

SEQ ID NO: 3022838 - RNA, 15 nt, Human
caguggcagcugcuu

SEQ ID NO: 3022839 - RNA, 16 nt, Human
caguggcagcugcuuu

SEQ ID NO: 3022840 - RNA, 22 nt, Human
cagugguuccuaauccucuagg

SEQ ID NO: 3022841 - RNA, 17 nt, Human
caguguguggucaacau

SEQ ID NO: 3022842 - RNA, 21 nt, Human
caguguguggucaacauuucu

SEQ ID NO: 3022843 - RNA, 14 nt, Human
cagugugacaagga

SEQ ID NO: 3022844 - RNA, 12 nt, Human
cagugugacuga

SEQ ID NO: 3022845 - RNA, 16 nt, Human
caguguacauggaaua

SEQ ID NO: 3022846 - RNA, 20 nt, Human
caguguacauggaauaacau

SEQ ID NO: 3022847 - RNA, 23 nt, Human
caguguacauggaauaacaugua

SEQ ID NO: 3022848 - RNA, 21 nt, Human
cugacacaugcugaacaucac

SEQ ID NO: 3022849 - RNA, 13 nt, Human
cugacacacagcu

SEQ ID NO: 3022850 - RNA, 15 nt, Human
cugacacacagcucu

SEQ ID NO: 3022851 - RNA, 16 nt, Human
cugacacacagcucug

SEQ ID NO: 3022852 - RNA, 17 nt, Human
cugacacacagcucugu

SEQ ID NO: 3022853 - RNA, 18 nt, Human
cugacacacagcucuguc

SEQ ID NO: 3022854 - RNA, 19 nt, Human
cugacacacagcucugucc

SEQ ID NO: 3022855 - RNA, 20 nt, Human
cugacacacagcucuguccu

SEQ ID NO: 3022856 - RNA, 21 nt, Human
cugacacacagcucuguccug

SEQ ID NO: 3022857 - RNA, 22 nt, Human
cugacacacagcucuguccugg

SEQ ID NO: 3022858 - RNA, 23 nt, Human
cugacacacagcucuguccuggg

SEQ ID NO: 3022859 - RNA, 18 nt, Human
cucugcacaagcugcacc

SEQ ID NO: 3022860 - RNA, 17 nt, Human
cucugcacaagcugcac

SEQ ID NO: 3022861 - RNA, 23 nt, Human
cucuugagccuugaacuuugacc

SEQ ID NO: 3022862 - RNA, 16 nt, Human
cucuugagccugggag

SEQ ID NO: 3022863 - RNA, 15 nt, Human
cucuugagccuggga

SEQ ID NO: 3022864 - RNA, 22 nt, Human
cucuugauucauaaugacuuaa

SEQ ID NO: 3022865 - RNA, 14 nt, Human
cucuugagccuggg

SEQ ID NO: 3022866 - RNA, 13 nt, Human
cucuugagccugg

SEQ ID NO: 3022867 - RNA, 24 nt, Human
cucuugauucauaaugacuuaagc

SEQ ID NO: 3022868 - RNA, 19 nt, Human
cugacccugcuucaaauau

SEQ ID NO: 3022869 - RNA, 22 nt, Human
cugagcugggaugauuggaggg

SEQ ID NO: 3022870 - RNA, 12 nt, Human
cugagcugggau

SEQ ID NO: 3022871 - RNA, 21 nt, Human
cugaggaauccagacccggcu

SEQ ID NO: 3022872 - RNA, 22 nt, Human
cugaggugggaggaucucuuga

SEQ ID NO: 3022873 - RNA, 12 nt, Human
cugaggugggag

SEQ ID NO: 3022874 - RNA, 13 nt, Human
cugaggugggagg

SEQ ID NO: 3022875 - RNA, 14 nt, Human
cugaggggccucuu

SEQ ID NO: 3022876 - RNA, 23 nt, Human
cugaggaauccagacccggcugc

SEQ ID NO: 3022877 - RNA, 14 nt, Human
cugaucucucguga

SEQ ID NO: 3022878 - RNA, 18 nt, Human
cugaucucucgugauuga

SEQ ID NO: 3022879 - RNA, 17 nt, Human
cugaucucucgugauug

SEQ ID NO: 3022880 - RNA, 16 nt, Human
cucuccgaccagacac

SEQ ID NO: 3022881 - RNA, 20 nt, Human
cucuccuccuuuucacaguu

SEQ ID NO: 3022882 - RNA, 13 nt, Human
cucuccuccuuuu

SEQ ID NO: 3022883 - RNA, 13 nt, Human
cucucccuuggau

SEQ ID NO: 3022884 - RNA, 10 nt, Human
cucuccucug

SEQ ID NO: 3022885 - RNA, 16 nt, Human
cucugcacaagcugca

SEQ ID NO: 3022886 - RNA, 23 nt, Human
cucgguguggagaagcggcuggc

SEQ ID NO: 3022887 - RNA, 11 nt, Human
cucggugccuu

SEQ ID NO: 3022888 - RNA, 24 nt, Human
cuccuuuucacaguucucuccuuc

SEQ ID NO: 3022889 - RNA, 23 nt, Human
cuccuuugugaggaagccgcugg

SEQ ID NO: 3022890 - RNA, 16 nt, Human
cuccuuuagcgcccag

SEQ ID NO: 3022891 - RNA, 17 nt, Human
cuccuuuagcgcccagu

SEQ ID NO: 3022892 - RNA, 22 nt, Human
cuccuagccugugccucuggga

SEQ ID NO: 3022893 - RNA, 22 nt, Human
cuccuuuagcgcccaguugggu

SEQ ID NO: 3022894 - RNA, 14 nt, Human
cucccaccucagcc

SEQ ID NO: 3022895 - RNA, 16 nt, Human
cucccaccucagccuc

SEQ ID NO: 3022896 - RNA, 17 nt, Human
cucccaccucagccucc

SEQ ID NO: 3022897 - RNA, 13 nt, Human
cucccaccucagc

SEQ ID NO: 3022898 - RNA, 18 nt, Human
cuccaggugcacaagcuc

SEQ ID NO: 3022899 - RNA, 20 nt, Human
cuccaggugcacaagcucca

SEQ ID NO: 3022900 - RNA, 19 nt, Human
cuccaggugcacaagcucc

SEQ ID NO: 3022901 - RNA, 23 nt, Human
cuccaggcuguaucccaugagcc

SEQ ID NO: 3022902 - RNA, 22 nt, Human
cuccaggcuguaucccaugagc

SEQ ID NO: 3022903 - RNA, 21 nt, Human
cuccagaauuucccaaagcag

SEQ ID NO: 3022904 - RNA, 16 nt, Human
cucagaaucucaaaua

SEQ ID NO: 3022905 - RNA, 17 nt, Human
cucagaaucucaaauaa

SEQ ID NO: 3022906 - RNA, 11 nt, Human
cuccagacaca

SEQ ID NO: 3022907 - RNA, 22 nt, Human
cuccagaauuucccaaagcagu

SEQ ID NO: 3022908 - RNA, 15 nt, Human
cucccucuuucccuc

SEQ ID NO: 3022909 - RNA, 16 nt, Human
cucccucccucuuucc

SEQ ID NO: 3022910 - RNA, 19 nt, Human
cucccucuuucccucccuu

SEQ ID NO: 3022911 - RNA, 21 nt, Human
cuccgcuuucuacccagcgag

SEQ ID NO: 3022912 - RNA, 20 nt, Human
cuccgcuuucuacccagcga

SEQ ID NO: 3022913 - RNA, 22 nt, Human
cuccgcuuucuacccagcgagc

SEQ ID NO: 3022914 - RNA, 17 nt, Human
cucacaauccuugccac

SEQ ID NO: 3022915 - RNA, 12 nt, Human
cucaaauaacua

SEQ ID NO: 3022916 - RNA, 14 nt, Human
cucacaaaggaugc

SEQ ID NO: 3022917 - RNA, 21 nt, Human
cucacacaugagcaucaggcc

SEQ ID NO: 3022918 - RNA, 14 nt, Human
cucacacaugagca

SEQ ID NO: 3022919 - RNA, 14 nt, Human
cuauguugcccagg

SEQ ID NO: 3022920 - RNA, 15 nt, Human
cuauguugcccaggc

SEQ ID NO: 3022921 - RNA, 22 nt, Human
cuauguguagggcgggaggaug

SEQ ID NO: 3022922 - RNA, 16 nt, Human
cuauguaucaaugagu

SEQ ID NO: 3022923 - RNA, 17 nt, Human
cuaugugagcacaaagg

SEQ ID NO: 3022924 - RNA, 18 nt, Human
cuaucucccccagcccca

SEQ ID NO: 3022925 - RNA, 19 nt, Human
cuauguaucaaugaguaac

SEQ ID NO: 3022926 - RNA, 20 nt, Human
cuaucucccccagccccauc

SEQ ID NO: 3022927 - RNA, 16 nt, Human
cuauguugcccaggca

SEQ ID NO: 3022928 - RNA, 17 nt, Human
cuauguugcccaggcag

SEQ ID NO: 3022929 - RNA, 17 nt, Human
cucaaaaaaagaaaaag

SEQ ID NO: 3022930 - RNA, 18 nt, Human
cucaaaaaaagaaaaaga

SEQ ID NO: 3022931 - RNA, 13 nt, Human
cucaccucucccu

SEQ ID NO: 3022932 - RNA, 17 nt, Human
cucaccucucccuugga

SEQ ID NO: 3022933 - RNA, 16 nt, Human
cucaccucucccuugg

SEQ ID NO: 3022934 - RNA, 15 nt, Human
cucaccucucccuug

SEQ ID NO: 3022935 - RNA, 14 nt, Human
cucaccucucccuu

SEQ ID NO: 3022936 - RNA, 13 nt, Human
cucaccugccccu

SEQ ID NO: 3022937 - RNA, 18 nt, Human
cucaccugccccucaacu

SEQ ID NO: 3022938 - RNA, 16 nt, Human
cucaccugccccucaa

SEQ ID NO: 3022939 - RNA, 14 nt, Human
cucaccugccccuc

SEQ ID NO: 3022940 - RNA, 15 nt, Human
cuaguuugauuaaau

SEQ ID NO: 3022941 - RNA, 20 nt, Human
cuaguuugauuaaauucuug

SEQ ID NO: 3022942 - RNA, 17 nt, Human
cuaguuugauuaaauuc

SEQ ID NO: 3022943 - RNA, 19 nt, Human
cuaguuugauuaaauucuu

SEQ ID NO: 3022944 - RNA, 14 nt, Human
cuagggaagauaau

SEQ ID NO: 3022945 - RNA, 17 nt, Human
cuagccagaggagagag

SEQ ID NO: 3022946 - RNA, 19 nt, Human
cuagccagaggagagagga

SEQ ID NO: 3022947 - RNA, 13 nt, Human
cuaggccuggcca

SEQ ID NO: 3022948 - RNA, 13 nt, Human
cuaggccugggga

SEQ ID NO: 3022949 - RNA, 12 nt, Human
cuaggccugggg

SEQ ID NO: 3022950 - RNA, 14 nt, Human
cuaggccuggccag

SEQ ID NO: 3022951 - RNA, 15 nt, Human
cuaggccuggccaga

SEQ ID NO: 3022952 - RNA, 18 nt, Human
cuaggccuggccagaugc

SEQ ID NO: 3022953 - RNA, 19 nt, Human
cuaggccuggccagaugca

SEQ ID NO: 3022954 - RNA, 16 nt, Human
cuagcauacguacaca

SEQ ID NO: 3022955 - RNA, 18 nt, Human
cuagcauacguacacauu

SEQ ID NO: 3022956 - RNA, 19 nt, Human
cuagcauacguacacauuu

SEQ ID NO: 3022957 - RNA, 20 nt, Human
cuagcauacguacacauuuu

SEQ ID NO: 3022958 - RNA, 23 nt, Human
cuaccugaggggccucuuauggg

SEQ ID NO: 3022959 - RNA, 19 nt, Human
cuaccugaggggccucuua

SEQ ID NO: 3022960 - RNA, 16 nt, Human
cuaccugaggggccuc

SEQ ID NO: 3022961 - RNA, 15 nt, Human
cuaccugaggggccu

SEQ ID NO: 3022962 - RNA, 22 nt, Human
cuaaaguguauuuuuuuacuaa

SEQ ID NO: 3022963 - RNA, 17 nt, Human
cuaaaggcuaccuuugu

SEQ ID NO: 3022964 - RNA, 19 nt, Human
cuaaaggcuaccuuuguau

SEQ ID NO: 3022965 - RNA, 19 nt, Human
cuaaaguguauuuuuuuac

SEQ ID NO: 3022966 - RNA, 14 nt, Human
cuaaagcugccagc

SEQ ID NO: 3022967 - RNA, 15 nt, Human
cuaaaggcuaccuuu

SEQ ID NO: 3022968 - RNA, 16 nt, Human
cuaaaggcuaccuuug

SEQ ID NO: 3022969 - RNA, 15 nt, Human
cuaaagcugccagcc

SEQ ID NO: 3022970 - RNA, 13 nt, Human
cguuaaaauacca

SEQ ID NO: 3022971 - RNA, 13 nt, Human
cguacacauuuua

SEQ ID NO: 3022972 - RNA, 15 nt, Human
cggagacggaguccc

SEQ ID NO: 3022973 - RNA, 16 nt, Human
cgccuuaaggauguuc

SEQ ID NO: 3022974 - RNA, 18 nt, Human
cgcugccccuggcagccc

SEQ ID NO: 3022975 - RNA, 19 nt, Human
cgcuggaccuugaacuggg

SEQ ID NO: 3022976 - RNA, 23 nt, Human
cgcuggaccuugaacuggguacu

SEQ ID NO: 3022977 - RNA, 13 nt, Human
cgcugccccuggc

SEQ ID NO: 3022978 - RNA, 17 nt, Human
cgcugccccuggcagcc

SEQ ID NO: 3022979 - RNA, 16 nt, Human
cgcugccccuggcagc

SEQ ID NO: 3022980 - RNA, 17 nt, Human
cgcuggggccaguuggu

SEQ ID NO: 3022981 - RNA, 20 nt, Human
cgcuggggccaguugguccc

SEQ ID NO: 3022982 - RNA, 20 nt, Human
cccagcacaaagcagauccu

SEQ ID NO: 3022983 - RNA, 23 nt, Human
cccagcaagugagagcugggugu

SEQ ID NO: 3022984 - RNA, 16 nt, Human
cccaggaaaggcucca

SEQ ID NO: 3022985 - RNA, 15 nt, Human
cccaggaaaggcucc

SEQ ID NO: 3022986 - RNA, 22 nt, Human
cccaggcuuagucacugagaca

SEQ ID NO: 3022987 - RNA, 20 nt, Human
cccaggcuuagucacugaga

SEQ ID NO: 3022988 - RNA, 18 nt, Human
cccaggaaaggcuccagg

SEQ ID NO: 3022989 - RNA, 17 nt, Human
cccaggaaaggcuccag

SEQ ID NO: 3022990 - RNA, 22 nt, Human
cccauccucuguacagagccca

SEQ ID NO: 3022991 - RNA, 21 nt, Human
cccauccucuguacagagccc

SEQ ID NO: 3022992 - RNA, 15 nt, Human
ccccagauugcaaca

SEQ ID NO: 3022993 - RNA, 20 nt, Human
ccccagauugcaacaggcug

SEQ ID NO: 3022994 - RNA, 15 nt, Human
cccauuugcuccuuu

SEQ ID NO: 3022995 - RNA, 19 nt, Human
cccauucugccugcccagg

SEQ ID NO: 3022996 - RNA, 14 nt, Human
cccauucugccugc

SEQ ID NO: 3022997 - RNA, 15 nt, Human
cccauucugccugcc

SEQ ID NO: 3022998 - RNA, 23 nt, Human
ccccgaggccuucucugaaggac

SEQ ID NO: 3022999 - RNA, 14 nt, Human
ccccgcacugggcu

SEQ ID NO: 3023000 - RNA, 16 nt, Human
cccggccccugcuggu

SEQ ID NO: 3023001 - RNA, 15 nt, Human
cccggccccugcugg

SEQ ID NO: 3023002 - RNA, 12 nt, Human
cccgggaagggg

SEQ ID NO: 3023003 - RNA, 15 nt, Human
cccgggaagggggcu

SEQ ID NO: 3023004 - RNA, 13 nt, Human
ccccuucugaccc

SEQ ID NO: 3023005 - RNA, 14 nt, Human
ccccuucugaccca

SEQ ID NO: 3023006 - RNA, 16 nt, Human
cccgaauagcugggac

SEQ ID NO: 3023007 - RNA, 17 nt, Human
cccgaauagcugggacu

SEQ ID NO: 3023008 - RNA, 18 nt, Human
cccgaauagcugggacua

SEQ ID NO: 3023009 - RNA, 17 nt, Human
cccggccaccugcggug

SEQ ID NO: 3023010 - RNA, 16 nt, Human
cccucaacucuccucc

SEQ ID NO: 3023011 - RNA, 16 nt, Human
cccucaacaccucugc

SEQ ID NO: 3023012 - RNA, 21 nt, Human
cccgggaagggggcugggaca

SEQ ID NO: 3023013 - RNA, 18 nt, Human
cccgggaagggggcuggg

SEQ ID NO: 3023014 - RNA, 14 nt, Human
ccccugccacccug

SEQ ID NO: 3023015 - RNA, 16 nt, Human
ccccugccacccuggg

SEQ ID NO: 3023016 - RNA, 15 nt, Human
ccccugacaacacuc

SEQ ID NO: 3023017 - RNA, 21 nt, Human
ccagucauuauguuaauauuu

SEQ ID NO: 3023018 - RNA, 22 nt, Human
ccagucauuauguuaauauuuc

SEQ ID NO: 3023019 - RNA, 21 nt, Human
ccaggggaaaaucagccugcu

SEQ ID NO: 3023020 - RNA, 12 nt, Human
ccaggcuggcgu

SEQ ID NO: 3023021 - RNA, 23 nt, Human
ccaggcaggucuugaacuccugg

SEQ ID NO: 3023022 - RNA, 12 nt, Human
ccaggcaggucu

SEQ ID NO: 3023023 - RNA, 14 nt, Human
ccaggcaggucuug

SEQ ID NO: 3023024 - RNA, 17 nt, Human
ccagccccauccucugu

SEQ ID NO: 3023025 - RNA, 15 nt, Human
ccagccccauccucu

SEQ ID NO: 3023026 - RNA, 17 nt, Human
ccagccccagugcccac

SEQ ID NO: 3023027 - RNA, 14 nt, Human
ccagcagagcaccu

SEQ ID NO: 3023028 - RNA, 13 nt, Human
ccagcagagcacc

SEQ ID NO: 3023029 - RNA, 12 nt, Human
ccagcagagcac

SEQ ID NO: 3023030 - RNA, 24 nt, Human
ccagccccuucugacccaugcugc

SEQ ID NO: 3023031 - RNA, 23 nt, Human
ccagccccuucugacccaugcug

SEQ ID NO: 3023032 - RNA, 16 nt, Human
ccauucuuggcccagg

SEQ ID NO: 3023033 - RNA, 16 nt, Human
cccaacucaccccagc

SEQ ID NO: 3023034 - RNA, 15 nt, Human
cccaacucaccccag

SEQ ID NO: 3023035 - RNA, 13 nt, Human
cccaagcucugcu

SEQ ID NO: 3023036 - RNA, 14 nt, Human
cccaagcucugcuc

SEQ ID NO: 3023037 - RNA, 12 nt, Human
cccaagcucugc

SEQ ID NO: 3023038 - RNA, 20 nt, Human
cccaacucaccccagcccca

SEQ ID NO: 3023039 - RNA, 17 nt, Human
cccaacucaccccagcc

SEQ ID NO: 3023040 - RNA, 12 nt, Human
cccacucccugc

SEQ ID NO: 3023041 - RNA, 13 nt, Human
cccacucccugca

SEQ ID NO: 3023042 - RNA, 23 nt, Human
cccacugcuuuuggucuguguga

SEQ ID NO: 3023043 - RNA, 22 nt, Human
cccacugcuuuuggucugugug

SEQ ID NO: 3023044 - RNA, 18 nt, Human
ccaugaguccccuguuug

SEQ ID NO: 3023045 - RNA, 23 nt, Human
ccaugaggaacaaggcaaggcug

SEQ ID NO: 3023046 - RNA, 20 nt, Human
ccaugaggaacaaggcaagg

SEQ ID NO: 3023047 - RNA, 23 nt, Human
ccaguuggguggaugccuggugg

SEQ ID NO: 3023048 - RNA, 13 nt, Human
ccaguuggucccc

SEQ ID NO: 3023049 - RNA, 20 nt, Human
ccaguuggucccccuuccau

SEQ ID NO: 3023050 - RNA, 18 nt, Human
ccaguuggucccccuucc

SEQ ID NO: 3023051 - RNA, 18 nt, Human
ccauccagguucagcuug

SEQ ID NO: 3023052 - RNA, 19 nt, Human
ccauccagguucagcuugu

SEQ ID NO: 3023053 - RNA, 20 nt, Human
ccaucccaaacccuucagug

SEQ ID NO: 3023054 - RNA, 20 nt, Human
ccaucccauaugccugggca

SEQ ID NO: 3023055 - RNA, 19 nt, Human
ccaucccauaugccugggc

SEQ ID NO: 3023056 - RNA, 21 nt, Human
ccaucccauaugccugggcag

SEQ ID NO: 3023057 - RNA, 22 nt, Human
ccauccccuguagagugggagc

SEQ ID NO: 3023058 - RNA, 15 nt, Human
ccuaauaaaaaggug

SEQ ID NO: 3023059 - RNA, 16 nt, Human
ccuaauaaaaagguga

SEQ ID NO: 3023060 - RNA, 20 nt, Human
ccuaauaaaaaggugaccau

SEQ ID NO: 3023061 - RNA, 14 nt, Human
ccuaauaaaaaggu

SEQ ID NO: 3023062 - RNA, 12 nt, Human
ccuaauguguuu

SEQ ID NO: 3023063 - RNA, 21 nt, Human
ccuagcauacguacacauuuu

SEQ ID NO: 3023064 - RNA, 22 nt, Human
ccuagccuuagaagucacacag

SEQ ID NO: 3023065 - RNA, 19 nt, Human
ccuagccuuagaagucaca

SEQ ID NO: 3023066 - RNA, 23 nt, Human
ccuagccugugccucugggacug

SEQ ID NO: 3023067 - RNA, 17 nt, Human
ccggccaccugcggugc

SEQ ID NO: 3023068 - RNA, 18 nt, Human
ccggccaccugcggugcu

SEQ ID NO: 3023069 - RNA, 23 nt, Human
ccgcagcccugcagagggcacag

SEQ ID NO: 3023070 - RNA, 18 nt, Human
ccgcagcccugcagaggg

SEQ ID NO: 3023071 - RNA, 14 nt, Human
ccgcagcccugcag

SEQ ID NO: 3023072 - RNA, 14 nt, Human
cccuccuuucacca

SEQ ID NO: 3023073 - RNA, 21 nt, Human
cccugugaguacuacaguccu

SEQ ID NO: 3023074 - RNA, 15 nt, Human
cccugugauggggcc

SEQ ID NO: 3023075 - RNA, 23 nt, Human
cccugugaguacuacaguccucc

SEQ ID NO: 3023076 - RNA, 23 nt, Human
cccuuuuuuggcugcugaaggcu

SEQ ID NO: 3023077 - RNA, 22 nt, Human
cccuuuuuuggcugcugaaggc

SEQ ID NO: 3023078 - RNA, 21 nt, Human
cccuuuuuuggcugcugaagg

SEQ ID NO: 3023079 - RNA, 19 nt, Human
cccuucucuccagccccug

SEQ ID NO: 3023080 - RNA, 14 nt, Human
cccuucucuccagc

SEQ ID NO: 3023081 - RNA, 12 nt, Human
ccucccaucacc

SEQ ID NO: 3023082 - RNA, 16 nt, Human
ccuccaagaccuucuc

SEQ ID NO: 3023083 - RNA, 19 nt, Human
ccuccaagaccuucuccuu

SEQ ID NO: 3023084 - RNA, 17 nt, Human
ccuccaagaccuucucc

SEQ ID NO: 3023085 - RNA, 17 nt, Human
ccucccaucacccgcua

SEQ ID NO: 3023086 - RNA, 23 nt, Human
ccucaagugauucuccugccuca

SEQ ID NO: 3023087 - RNA, 20 nt, Human
ccucaagugauucuccugcc

SEQ ID NO: 3023088 - RNA, 18 nt, Human
ccucaggcaggugggaug

SEQ ID NO: 3023089 - RNA, 12 nt, Human
ccucaggcaggu

SEQ ID NO: 3023090 - RNA, 18 nt, Human
ccucauuagcauuuugcu

SEQ ID NO: 3023091 - RNA, 15 nt, Human
ccucaaccuccuggg

SEQ ID NO: 3023092 - RNA, 19 nt, Human
ccucaacucuccuccagag

SEQ ID NO: 3023093 - RNA, 23 nt, Human
ccucaacucuccuccagagucag

SEQ ID NO: 3023094 - RNA, 21 nt, Human
ccucaacucuccuccagaguc

SEQ ID NO: 3023095 - RNA, 16 nt, Human
ccucaacaccucugca

SEQ ID NO: 3023096 - RNA, 13 nt, Human
ccuccgccucuug

SEQ ID NO: 3023097 - RNA, 14 nt, Human
ccuccgccucuugg

SEQ ID NO: 3023098 - RNA, 23 nt, Human
ccuccuuugugaggaagccgcug

SEQ ID NO: 3023099 - RNA, 18 nt, Human
ccuccuuuucacaguucu

SEQ ID NO: 3023100 - RNA, 16 nt, Human
ccugccucagccuccc

SEQ ID NO: 3023101 - RNA, 15 nt, Human
ccugccucagccucc

SEQ ID NO: 3023102 - RNA, 21 nt, Human
ccugcccaggccccugccacc

SEQ ID NO: 3023103 - RNA, 18 nt, Human
ccugcccaggccccugcc

SEQ ID NO: 3023104 - RNA, 19 nt, Human
ccugcccaggccccugcca

SEQ ID NO: 3023105 - RNA, 19 nt, Human
ccugcccaccuggccucug

SEQ ID NO: 3023106 - RNA, 18 nt, Human
ccugcccaccuggccucu

SEQ ID NO: 3023107 - RNA, 17 nt, Human
ccugcccaccuggccuc

SEQ ID NO: 3023108 - RNA, 15 nt, Human
ccugcccaccuggcc

SEQ ID NO: 3023109 - RNA, 14 nt, Human
ccugcaggcagcca

SEQ ID NO: 3023110 - RNA, 13 nt, Human
ccugcaggcagcc

SEQ ID NO: 3023111 - RNA, 12 nt, Human
ccugcaggcagc

SEQ ID NO: 3023112 - RNA, 16 nt, Human
ccucuuucccucccuu

SEQ ID NO: 3023113 - RNA, 19 nt, Human
ccucuuucccucccuuccu

SEQ ID NO: 3023114 - RNA, 15 nt, Human
ccucuuugagugaag

SEQ ID NO: 3023115 - RNA, 15 nt, Human
ccuggggagaaagua

SEQ ID NO: 3023116 - RNA, 13 nt, Human
ccugguguggaag

SEQ ID NO: 3023117 - RNA, 20 nt, Human
ccugguggcagugggagcug

SEQ ID NO: 3023118 - RNA, 15 nt, Human
ccugguggcaguggg

SEQ ID NO: 3023119 - RNA, 18 nt, Human
ccugguggcagugggagc

SEQ ID NO: 3023120 - RNA, 19 nt, Human
ccugguggcagugggagcu

SEQ ID NO: 3023121 - RNA, 20 nt, Human
ccuggccugagcugggauga

SEQ ID NO: 3023122 - RNA, 22 nt, Human
ccuggccucaagugauucuccu

SEQ ID NO: 3023123 - RNA, 21 nt, Human
ccuggccccucagggucccug

SEQ ID NO: 3023124 - RNA, 20 nt, Human
ccuggccccucagggucccu

SEQ ID NO: 3023125 - RNA, 18 nt, Human
ccuggccccucagggucc

SEQ ID NO: 3023126 - RNA, 16 nt, Human
ccuggccccucagggu

SEQ ID NO: 3023127 - RNA, 18 nt, Human
ccuggauggggcugcacc

SEQ ID NO: 3023128 - RNA, 17 nt, Human
ccuggauggggcugcac

SEQ ID NO: 3023129 - RNA, 15 nt, Human
ccuggauggggcugc

SEQ ID NO: 3023130 - RNA, 23 nt, Human
caauugaaguaaaauguggcagg

SEQ ID NO: 3023131 - RNA, 15 nt, Human
caaugggagcucaug

SEQ ID NO: 3023132 - RNA, 19 nt, Human
cacaagagcccaggccucc

SEQ ID NO: 3023133 - RNA, 18 nt, Human
cacaagagcccaggccuc

SEQ ID NO: 3023134 - RNA, 19 nt, Human
cacaagcuccaagcuccca

SEQ ID NO: 3023135 - RNA, 18 nt, Human
cacaagcuccaagcuccc

SEQ ID NO: 3023136 - RNA, 20 nt, Human
cacaagagcccaggccuccu

SEQ ID NO: 3023137 - RNA, 17 nt, Human
cacaagagcccaggccu

SEQ ID NO: 3023138 - RNA, 16 nt, Human
caauggcagccuuggc

SEQ ID NO: 3023139 - RNA, 12 nt, Human
caaugcuggcug

SEQ ID NO: 3023140 - RNA, 20 nt, Human
caaugcuggcuguuggcugg

SEQ ID NO: 3023141 - RNA, 21 nt, Human
caaugcuggcuguuggcuggg

SEQ ID NO: 3023142 - RNA, 13 nt, Human
caaugcuggcugu

SEQ ID NO: 3023143 - RNA, 21 nt, Human
cacaagcuccaagcucccagg

SEQ ID NO: 3023144 - RNA, 20 nt, Human
cacaagcuccaagcucccag

SEQ ID NO: 3023145 - RNA, 21 nt, Human
caaggccaaaggaagcacaug

SEQ ID NO: 3023146 - RNA, 20 nt, Human
caaggccaaaggaagcacau

SEQ ID NO: 3023147 - RNA, 19 nt, Human
caaggccaaaggaagcaca

SEQ ID NO: 3023148 - RNA, 16 nt, Human
caaggcaaggcuguca

SEQ ID NO: 3023149 - RNA, 17 nt, Human
caaggcaaggcugucaa

SEQ ID NO: 3023150 - RNA, 18 nt, Human
caaggcaaggcugucaau

SEQ ID NO: 3023151 - RNA, 13 nt, Human
cacagaagaugaa

SEQ ID NO: 3023152 - RNA, 14 nt, Human
cacagacccugccc

SEQ ID NO: 3023153 - RNA, 17 nt, Human
cacagacccugcccugu

SEQ ID NO: 3023154 - RNA, 16 nt, Human
cacagacccugcccug

SEQ ID NO: 3023155 - RNA, 11 nt, Human
cacagcucugu

SEQ ID NO: 3023156 - RNA, 14 nt, Human
cacagcucuguccu

SEQ ID NO: 3023157 - RNA, 18 nt, Human
cacagacccugcccugug

SEQ ID NO: 3023158 - RNA, 17 nt, Human
cacagcucuucuccagg

SEQ ID NO: 3023159 - RNA, 14 nt, Human
cacagcucuucucc

SEQ ID NO: 3023160 - RNA, 15 nt, Human
cacagcucuucucca

SEQ ID NO: 3023161 - RNA, 15 nt, Human
cacagcucuguccug

SEQ ID NO: 3023162 - RNA, 16 nt, Human
cacagcucuguccugg

SEQ ID NO: 3023163 - RNA, 18 nt, Human
cacagcucuguccuggga

SEQ ID NO: 3023164 - RNA, 10 nt, Human
cacagcucuu

SEQ ID NO: 3023165 - RNA, 10 nt, Human
cacacauuuu

SEQ ID NO: 3023166 - RNA, 11 nt, Human
cacacauuuuu

SEQ ID NO: 3023167 - RNA, 12 nt, Human
cacacauuuuuu

SEQ ID NO: 3023168 - RNA, 16 nt, Human
cacacauuuuuuaaau

SEQ ID NO: 3023169 - RNA, 19 nt, Human
cacacauuuuuuaaaugca

SEQ ID NO: 3023170 - RNA, 20 nt, Human
cacacauuuuuuaaaugcac

SEQ ID NO: 3023171 - RNA, 18 nt, Human
cacccaggaacuccugac

SEQ ID NO: 3023172 - RNA, 16 nt, Human
cacccaggagccccga

SEQ ID NO: 3023173 - RNA, 18 nt, Human
cacccaccucagccuccc

SEQ ID NO: 3023174 - RNA, 13 nt, Human
caccagccccagu

SEQ ID NO: 3023175 - RNA, 17 nt, Human
cacccaccucagccucc

SEQ ID NO: 3023176 - RNA, 15 nt, Human
cacaucuguuuugua

SEQ ID NO: 3023177 - RNA, 21 nt, Human
cacauuuuauuuuauuaugca

SEQ ID NO: 3023178 - RNA, 19 nt, Human
cacauuuuauuuuauuaug

SEQ ID NO: 3023179 - RNA, 20 nt, Human
cacauuuuauuuuauuaugc

SEQ ID NO: 3023180 - RNA, 17 nt, Human
cacauuuuauuuuauua

SEQ ID NO: 3023181 - RNA, 14 nt, Human
caccaacgucugug

SEQ ID NO: 3023182 - RNA, 14 nt, Human
caccuuucccaucu

SEQ ID NO: 3023183 - RNA, 18 nt, Human
caccuuggcugcagggag

SEQ ID NO: 3023184 - RNA, 15 nt, Human
caccuuggcugcagg

SEQ ID NO: 3023185 - RNA, 16 nt, Human
caccuuggcugcaggg

SEQ ID NO: 3023186 - RNA, 20 nt, Human
cacucuuauugcccacgcug

SEQ ID NO: 3023187 - RNA, 21 nt, Human
cacucuuauugcccacgcugg

SEQ ID NO: 3023188 - RNA, 22 nt, Human
cacucuuauugcccacgcugga

SEQ ID NO: 3023189 - RNA, 14 nt, Human
cacggcucacugca

SEQ ID NO: 3023190 - RNA, 17 nt, Human
cacggccaggccagagg

SEQ ID NO: 3023191 - RNA, 12 nt, Human
cacggccaggcc

SEQ ID NO: 3023192 - RNA, 13 nt, Human
cacggccaggcca

SEQ ID NO: 3023193 - RNA, 20 nt, Human
cacucugucgcccagucugg

SEQ ID NO: 3023194 - RNA, 13 nt, Human
cacuccagccugg

SEQ ID NO: 3023195 - RNA, 14 nt, Human
cacuccagccuggg

SEQ ID NO: 3023196 - RNA, 16 nt, Human
cacuacauucuguuaa

SEQ ID NO: 3023197 - RNA, 17 nt, Human
cacuacauucuguuaau

SEQ ID NO: 3023198 - RNA, 21 nt, Human
cacuacauucuguuaaucauu

SEQ ID NO: 3023199 - RNA, 16 nt, Human
cagaaauguacagcaa

SEQ ID NO: 3023200 - RNA, 16 nt, Human
cagaaguuucugccgc

SEQ ID NO: 3023201 - RNA, 14 nt, Human
cagaaguuucugcc

SEQ ID NO: 3023202 - RNA, 13 nt, Human
cacuuucuagcca

SEQ ID NO: 3023203 - RNA, 17 nt, Human
cacuuucuagccagagg

SEQ ID NO: 3023204 - RNA, 16 nt, Human
cacuuucuagccagag

SEQ ID NO: 3023205 - RNA, 18 nt, Human
cacuuguguuaugaagca

SEQ ID NO: 3023206 - RNA, 17 nt, Human
cacugccaugccagcuu

SEQ ID NO: 3023207 - RNA, 20 nt, Human
cacugcagccucaaccuccu

SEQ ID NO: 3023208 - RNA, 21 nt, Human
cacugcagccucaaccuccug

SEQ ID NO: 3023209 - RNA, 22 nt, Human
cacugcagccucaaccuccugg

SEQ ID NO: 3023210 - RNA, 23 nt, Human
cacugcagccucaaccuccuggg

SEQ ID NO: 3023211 - RNA, 19 nt, Human
cacugcagccucaaccucc

SEQ ID NO: 3023212 - RNA, 14 nt, Human
cacugcagccucaa

SEQ ID NO: 3023213 - RNA, 23 nt, Human
cacuguugcccaggcuggcgugc

SEQ ID NO: 3023214 - RNA, 18 nt, Human
cacuguugcccaggcugg

SEQ ID NO: 3023215 - RNA, 19 nt, Human
cacuguugcccaggcuggc

SEQ ID NO: 3023216 - RNA, 13 nt, Human
auuuuaugucuuu

SEQ ID NO: 3023217 - RNA, 14 nt, Human
auuuuuagacagag

SEQ ID NO: 3023218 - RNA, 16 nt, Human
auuuuuaagugcugca

SEQ ID NO: 3023219 - RNA, 18 nt, Human
auuuuuaagugcugcauu

SEQ ID NO: 3023220 - RNA, 19 nt, Human
auuuuuaagugcugcauuu

SEQ ID NO: 3023221 - RNA, 17 nt, Human
caaacagucucccuucc

SEQ ID NO: 3023222 - RNA, 24 nt, Human
caaacccaguguuuuaggagcaug

SEQ ID NO: 3023223 - RNA, 19 nt, Human
caaaagcugggcagguugg

SEQ ID NO: 3023224 - RNA, 22 nt, Human
auuuuuuuuuccuucagugccu

SEQ ID NO: 3023225 - RNA, 20 nt, Human
auuuuuuuuuccuucagugc

SEQ ID NO: 3023226 - RNA, 16 nt, Human
auuuuuuugagacaga

SEQ ID NO: 3023227 - RNA, 18 nt, Human
auuuuuuuuuccuucagu

SEQ ID NO: 3023228 - RNA, 23 nt, Human
caaaugcuguaacuuucugaaau

SEQ ID NO: 3023229 - RNA, 21 nt, Human
caaaucugcuuuuuaaagaau

SEQ ID NO: 3023230 - RNA, 22 nt, Human
caaaguagaagucuuagaugua

SEQ ID NO: 3023231 - RNA, 19 nt, Human
caaaguaucccuacuguaa

SEQ ID NO: 3023232 - RNA, 21 nt, Human
caaaguaucccuacuguaauu

SEQ ID NO: 3023233 - RNA, 22 nt, Human
caaagcagugcaugcugucccu

SEQ ID NO: 3023234 - RNA, 21 nt, Human
caaagcagugcaugcuguccc

SEQ ID NO: 3023235 - RNA, 18 nt, Human
caaagcagugcaugcugu

SEQ ID NO: 3023236 - RNA, 14 nt, Human
caaagauauuuugc

SEQ ID NO: 3023237 - RNA, 16 nt, Human
caaagauauuuugcuu

SEQ ID NO: 3023238 - RNA, 18 nt, Human
caacucaccccagcccca

SEQ ID NO: 3023239 - RNA, 17 nt, Human
caacucaccccagcccc

SEQ ID NO: 3023240 - RNA, 22 nt, Human
caagaauugaagcaggacuaaa

SEQ ID NO: 3023241 - RNA, 14 nt, Human
caacucuccuccag

SEQ ID NO: 3023242 - RNA, 17 nt, Human
caagaccacguuucuaa

SEQ ID NO: 3023243 - RNA, 18 nt, Human
caagaccacguuucuaaa

SEQ ID NO: 3023244 - RNA, 13 nt, Human
auuaaaugacucu

SEQ ID NO: 3023245 - RNA, 12 nt, Human
auuaaaugacuc

SEQ ID NO: 3023246 - RNA, 19 nt, Human
auuaaaugcccagccccuu

SEQ ID NO: 3023247 - RNA, 17 nt, Human
auuaaaugcccagcccc

SEQ ID NO: 3023248 - RNA, 18 nt, Human
auucaacagguuuuccug

SEQ ID NO: 3023249 - RNA, 17 nt, Human
auucuccuuguguuacu

SEQ ID NO: 3023250 - RNA, 18 nt, Human
auucuccuuguguuacua

SEQ ID NO: 3023251 - RNA, 19 nt, Human
auucuccuuguguuacuaa

SEQ ID NO: 3023252 - RNA, 21 nt, Human
auucuccuuguguuacuaagu

SEQ ID NO: 3023253 - RNA, 22 nt, Human
auucuccuuguguuacuaaguu

SEQ ID NO: 3023254 - RNA, 17 nt, Human
auucucuaguuugauua

SEQ ID NO: 3023255 - RNA, 18 nt, Human
auucucuaguuugauuaa

SEQ ID NO: 3023256 - RNA, 19 nt, Human
auucuucugcuucagccuc

SEQ ID NO: 3023257 - RNA, 20 nt, Human
auucuucugcuucagccucc

SEQ ID NO: 3023258 - RNA, 22 nt, Human
auucuucuguacgucugacagg

SEQ ID NO: 3023259 - RNA, 14 nt, Human
auucuucugcuuca

SEQ ID NO: 3023260 - RNA, 14 nt, Human
auucuugcaaagua

SEQ ID NO: 3023261 - RNA, 15 nt, Human
auucuugcaaaguau

SEQ ID NO: 3023262 - RNA, 16 nt, Human
auucuugcaaaguauc

SEQ ID NO: 3023263 - RNA, 16 nt, Human
auuuaaugaaagacug

SEQ ID NO: 3023264 - RNA, 15 nt, Human
auuuaaugaaagacu

SEQ ID NO: 3023265 - RNA, 20 nt, Human
auuuaaugaaagacuguaca

SEQ ID NO: 3023266 - RNA, 21 nt, Human
auuuaaugaaagacuguacaa

SEQ ID NO: 3023267 - RNA, 18 nt, Human
auugcuugagcucaggag

SEQ ID NO: 3023268 - RNA, 16 nt, Human
cauuagguugugaaug

SEQ ID NO: 3023269 - RNA, 15 nt, Human
cauuagguugugaau

SEQ ID NO: 3023270 - RNA, 14 nt, Human
cauuagguugugaa

SEQ ID NO: 3023271 - RNA, 22 nt, Human
cauuaggugugacugaauuucu

SEQ ID NO: 3023272 - RNA, 23 nt, Human
cauuaucuagauacuguaucaug

SEQ ID NO: 3023273 - RNA, 12 nt, Human
cauguuggccag

SEQ ID NO: 3023274 - RNA, 13 nt, Human
cauguuggccagg

SEQ ID NO: 3023275 - RNA, 18 nt, Human
cauguccaagaagcccag

SEQ ID NO: 3023276 - RNA, 20 nt, Human
cauguccaagaagcccagga

SEQ ID NO: 3023277 - RNA, 19 nt, Human
cauguccaagaagcccagg

SEQ ID NO: 3023278 - RNA, 12 nt, Human
cauuccuguucc

SEQ ID NO: 3023279 - RNA, 15 nt, Human
caugcugcccuguga

SEQ ID NO: 3023280 - RNA, 14 nt, Human
caugcugcccugug

SEQ ID NO: 3023281 - RNA, 23 nt, Human
caugacacgaauauugcugaugg

SEQ ID NO: 3023282 - RNA, 21 nt, Human
caugacacgaauauugcugau

SEQ ID NO: 3023283 - RNA, 15 nt, Human
caugaaguaauaugc

SEQ ID NO: 3023284 - RNA, 19 nt, Human
caugaaguaauaugcacac

SEQ ID NO: 3023285 - RNA, 22 nt, Human
caugaaguaauaugcacacauu

SEQ ID NO: 3023286 - RNA, 23 nt, Human
caugaaguaauaugcacacauuu

SEQ ID NO: 3023287 - RNA, 16 nt, Human
caugcacgugugugca

SEQ ID NO: 3023288 - RNA, 13 nt, Human
caugcuccuggcc

SEQ ID NO: 3023289 - RNA, 13 nt, Human
caugcugcccugu

SEQ ID NO: 3023290 - RNA, 12 nt, Human
caugcugcccug

SEQ ID NO: 3023291 - RNA, 24 nt, Human
caugauuaaccacuucagcugacu

SEQ ID NO: 3023292 - RNA, 23 nt, Human
caugauuaaccacuucagcugac

SEQ ID NO: 3023293 - RNA, 22 nt, Human
caugauuaaccacuucagcuga

SEQ ID NO: 3023294 - RNA, 18 nt, Human
cauagcugugauuuuugg

SEQ ID NO: 3023295 - RNA, 15 nt, Human
cauagcugugauuuu

SEQ ID NO: 3023296 - RNA, 13 nt, Human
cauagcugugauu

SEQ ID NO: 3023297 - RNA, 19 nt, Human
cauagcagagaaugaaagg

SEQ ID NO: 3023298 - RNA, 22 nt, Human
cauagcagagaaugaaagggcc

SEQ ID NO: 3023299 - RNA, 15 nt, Human
cauauucaggaagcu

SEQ ID NO: 3023300 - RNA, 14 nt, Human
cauauucaggaagc

SEQ ID NO: 3023301 - RNA, 20 nt, Human
cauauucaggaagcucaggg

SEQ ID NO: 3023302 - RNA, 20 nt, Human
cauaugccugggcagaagga

SEQ ID NO: 3023303 - RNA, 15 nt, Human
cauaugccugggcag

SEQ ID NO: 3023304 - RNA, 13 nt, Human
cauaugccugggc

SEQ ID NO: 3023305 - RNA, 22 nt, Human
cauaugccugggcagaaggaag

SEQ ID NO: 3023306 - RNA, 14 nt, Human
cauccccuguagag

SEQ ID NO: 3023307 - RNA, 19 nt, Human
caucccauaugccugggca

SEQ ID NO: 3023308 - RNA, 17 nt, Human
caucccagccccaauga

SEQ ID NO: 3023309 - RNA, 19 nt, Human
caucaggccaggcccucug

SEQ ID NO: 3023310 - RNA, 16 nt, Human
caucaggccaggcccu

SEQ ID NO: 3023311 - RNA, 14 nt, Human
caucaggccaggcc

SEQ ID NO: 3023312 - RNA, 15 nt, Human
caucaggccaggccc

SEQ ID NO: 3023313 - RNA, 12 nt, Human
ccaagcuggucc

SEQ ID NO: 3023314 - RNA, 19 nt, Human
ccaagcuggucccacucag

SEQ ID NO: 3023315 - RNA, 14 nt, Human
ccaagaagcccagg

SEQ ID NO: 3023316 - RNA, 15 nt, Human
ccaaggccaaaggaa

SEQ ID NO: 3023317 - RNA, 22 nt, Human
ccaaauggaaaugggcagagca

SEQ ID NO: 3023318 - RNA, 15 nt, Human
ccaacgucugugcca

SEQ ID NO: 3023319 - RNA, 13 nt, Human
ccaacgucugugc

SEQ ID NO: 3023320 - RNA, 13 nt, Human
ccaagaagcccag

SEQ ID NO: 3023321 - RNA, 16 nt, Human
ccaaggccaaaggaag

SEQ ID NO: 3023322 - RNA, 19 nt, Human
cauuuuuuaaaugcaccug

SEQ ID NO: 3023323 - RNA, 15 nt, Human
cauuuuuuaaaugca

SEQ ID NO: 3023324 - RNA, 16 nt, Human
cauuuuuuaaaugcac

SEQ ID NO: 3023325 - RNA, 14 nt, Human
cauuuauucugcuc

SEQ ID NO: 3023326 - RNA, 17 nt, Human
cauuugucacacacuuu

SEQ ID NO: 3023327 - RNA, 15 nt, Human
cauuuggauuggaug

SEQ ID NO: 3023328 - RNA, 18 nt, Human
ccacgcuggaccuugaac

SEQ ID NO: 3023329 - RNA, 18 nt, Human
ccaccuuggcugcaggga

SEQ ID NO: 3023330 - RNA, 19 nt, Human
ccaccuuggcugcagggag

SEQ ID NO: 3023331 - RNA, 12 nt, Human
ccaccuuggcug

SEQ ID NO: 3023332 - RNA, 14 nt, Human
ccaccuuggcugca

SEQ ID NO: 3023333 - RNA, 15 nt, Human
ccaccuuggcugcag

SEQ ID NO: 3023334 - RNA, 16 nt, Human
ccaccuuggcugcagg

SEQ ID NO: 3023335 - RNA, 19 nt, Human
ccaccaucaugucuggcua

SEQ ID NO: 3023336 - RNA, 18 nt, Human
ccaccaucaccagacagg

SEQ ID NO: 3023337 - RNA, 18 nt, Human
ccaccaucaugucuggcu

SEQ ID NO: 3023338 - RNA, 22 nt, Human
ccacagagaaaguacuucucca

SEQ ID NO: 3023339 - RNA, 20 nt, Human
cagaguaggggucugucuuu

SEQ ID NO: 3023340 - RNA, 23 nt, Human
cagaguaggggucugucuuuuaa

SEQ ID NO: 3023341 - RNA, 22 nt, Human
cagaguaggggucugucuuuua

SEQ ID NO: 3023342 - RNA, 20 nt, Human
cagagucagaaguuucugcc

SEQ ID NO: 3023343 - RNA, 20 nt, Human
cagaggggguggccucccaa

SEQ ID NO: 3023344 - RNA, 19 nt, Human
cagaggggguggccuccca

SEQ ID NO: 3023345 - RNA, 17 nt, Human
cagaggggguggccucc

SEQ ID NO: 3023346 - RNA, 18 nt, Human
cagaggggguggccuccc

SEQ ID NO: 3023347 - RNA, 22 nt, Human
cagagggccugcaagggaguga

SEQ ID NO: 3023348 - RNA, 18 nt, Human
cagagcugccaccugccu

SEQ ID NO: 3023349 - RNA, 16 nt, Human
cagagcugccaccugc

SEQ ID NO: 3023350 - RNA, 22 nt, Human
cagaaguuugagaucagccugg

SEQ ID NO: 3023351 - RNA, 23 nt, Human
cagaaguuucugccgcagcccug

SEQ ID NO: 3023352 - RNA, 20 nt, Human
cagaaguuugagaucagccu

SEQ ID NO: 3023353 - RNA, 13 nt, Human
cagccaggccaca

SEQ ID NO: 3023354 - RNA, 12 nt, Human
cagccaggccac

SEQ ID NO: 3023355 - RNA, 23 nt, Human
cagcauauucaggaagcucaggg

SEQ ID NO: 3023356 - RNA, 22 nt, Human
cagcauauucaggaagcucagg

SEQ ID NO: 3023357 - RNA, 19 nt, Human
cagcauauucaggaagcuc

SEQ ID NO: 3023358 - RNA, 15 nt, Human
cagcggggacagcuc

SEQ ID NO: 3023359 - RNA, 14 nt, Human
cagcggggacagcu

SEQ ID NO: 3023360 - RNA, 16 nt, Human
cagcggggacagcucc

SEQ ID NO: 3023361 - RNA, 17 nt, Human
cagcggggacagcuccu

SEQ ID NO: 3023362 - RNA, 15 nt, Human
cagcccuuagcaggg

SEQ ID NO: 3023363 - RNA, 16 nt, Human
cagcccuuagcaggga

SEQ ID NO: 3023364 - RNA, 21 nt, Human
cagcccuuagcagggaaacag

SEQ ID NO: 3023365 - RNA, 21 nt, Human
cagccccuggaugcagccuca

SEQ ID NO: 3023366 - RNA, 19 nt, Human
cagccccuggaugcagccu

SEQ ID NO: 3023367 - RNA, 18 nt, Human
cagccccuggaugcagcc

SEQ ID NO: 3023368 - RNA, 17 nt, Human
cagccccuggaugcagc

SEQ ID NO: 3023369 - RNA, 14 nt, Human
cagccccuggaugc

SEQ ID NO: 3023370 - RNA, 13 nt, Human
cagccccuggaug

SEQ ID NO: 3023371 - RNA, 12 nt, Human
cagccccuggau

SEQ ID NO: 3023372 - RNA, 21 nt, Human
cagccgagauagccaaggcca

SEQ ID NO: 3023373 - RNA, 20 nt, Human
cagccgagauagccaaggcc

SEQ ID NO: 3023374 - RNA, 22 nt, Human
cagcuccagcucaccagcccca

SEQ ID NO: 3023375 - RNA, 16 nt, Human
cagcuccagcucacca

SEQ ID NO: 3023376 - RNA, 17 nt, Human
cagcuccagcucaccag

SEQ ID NO: 3023377 - RNA, 18 nt, Human
cagcuccagcucaccagc

SEQ ID NO: 3023378 - RNA, 20 nt, Human
cagcuccagcucaccagccc

SEQ ID NO: 3023379 - RNA, 13 nt, Human
cagcuccagcuca

SEQ ID NO: 3023380 - RNA, 14 nt, Human
cagcuccagcucac

SEQ ID NO: 3023381 - RNA, 15 nt, Human
cagcuccagcucacc

SEQ ID NO: 3023382 - RNA, 18 nt, Human
cagcugugcucuggacag

SEQ ID NO: 3023383 - RNA, 15 nt, Human
cagcuucauuuccug

SEQ ID NO: 3023384 - RNA, 18 nt, Human
cagcuucauuuccugugu

SEQ ID NO: 3023385 - RNA, 15 nt, Human
caggaaaggcuccag

SEQ ID NO: 3023386 - RNA, 14 nt, Human
caggaaaggcucca

SEQ ID NO: 3023387 - RNA, 15 nt, Human
cagugccaaaaacaa

SEQ ID NO: 3023388 - RNA, 11 nt, Human
cagugggagcu

SEQ ID NO: 3023389 - RNA, 12 nt, Human
cagugcccacag

SEQ ID NO: 3023390 - RNA, 19 nt, Human
cagucugauucccaagcuc

SEQ ID NO: 3023391 - RNA, 20 nt, Human
cagucugauucccaagcucu

SEQ ID NO: 3023392 - RNA, 19 nt, Human
cagugcaugcugucccuua

SEQ ID NO: 3023393 - RNA, 23 nt, Human
cagugcaugcugucccuuacgug

SEQ ID NO: 3023394 - RNA, 22 nt, Human
cagugcaugcugucccuuacgu

SEQ ID NO: 3023395 - RNA, 21 nt, Human
cagggucucacucugucgccc

SEQ ID NO: 3023396 - RNA, 17 nt, Human
cagggucucacucuguc

SEQ ID NO: 3023397 - RNA, 18 nt, Human
cagggucucacucugucg

SEQ ID NO: 3023398 - RNA, 22 nt, Human
caggugcacaagcuccaagcuc

SEQ ID NO: 3023399 - RNA, 12 nt, Human
caggguuggccc

SEQ ID NO: 3023400 - RNA, 16 nt, Human
caggugauccacccac

SEQ ID NO: 3023401 - RNA, 17 nt, Human
caggugauccacccacc

SEQ ID NO: 3023402 - RNA, 14 nt, Human
caggugcgaaagga

SEQ ID NO: 3023403 - RNA, 20 nt, Human
caggugcuaggaacacuccu

SEQ ID NO: 3023404 - RNA, 18 nt, Human
caggugcuaggaacacuc

SEQ ID NO: 3023405 - RNA, 14 nt, Human
cagguugguggggg

SEQ ID NO: 3023406 - RNA, 19 nt, Human
cagucaccccggccaccug

SEQ ID NO: 3023407 - RNA, 20 nt, Human
cagucaccccggccaccugc

SEQ ID NO: 3023408 - RNA, 22 nt, Human
cagucaccccggccaccugcgg

SEQ ID NO: 3023409 - RNA, 18 nt, Human
cagguuuaagcuguuacu

SEQ ID NO: 3023410 - RNA, 16 nt, Human
cagguuuaagcuguua

SEQ ID NO: 3023411 - RNA, 17 nt, Human
caggaggccagccuuga

SEQ ID NO: 3023412 - RNA, 18 nt, Human
caggcacccaccaucaug

SEQ ID NO: 3023413 - RNA, 22 nt, Human
caggcacccaccaucaugucug

SEQ ID NO: 3023414 - RNA, 23 nt, Human
caggcacccaccaucaugucugg

SEQ ID NO: 3023415 - RNA, 16 nt, Human
caggaggccagccuug

SEQ ID NO: 3023416 - RNA, 15 nt, Human
caggaggccagccuu

SEQ ID NO: 3023417 - RNA, 14 nt, Human
caggaggccagccu

SEQ ID NO: 3023418 - RNA, 23 nt, Human
caggccagagggagugacagagg

SEQ ID NO: 3023419 - RNA, 16 nt, Human
caggccagagggagug

SEQ ID NO: 3023420 - RNA, 19 nt, Human
caggccagagggagugaca

SEQ ID NO: 3023421 - RNA, 21 nt, Human
caggccagagggagugacaga

SEQ ID NO: 3023422 - RNA, 22 nt, Human
cagggaguccgaaagggacuug

SEQ ID NO: 3023423 - RNA, 18 nt, Human
cagggaggugaccccagg

SEQ ID NO: 3023424 - RNA, 16 nt, Human
caggcugggcuucagu

SEQ ID NO: 3023425 - RNA, 15 nt, Human
caggcugggcuucag

SEQ ID NO: 3023426 - RNA, 17 nt, Human
caggcugggcuucagug

SEQ ID NO: 3023427 - RNA, 19 nt, Human
caggcugggcuucaguggc

SEQ ID NO: 3023428 - RNA, 16 nt, Human
gcccucaauugugaaa

SEQ ID NO: 3023429 - RNA, 23 nt, Human
gcccgggcucugccucccaucac

SEQ ID NO: 3023430 - RNA, 12 nt, Human
gcccccacuggu

SEQ ID NO: 3023431 - RNA, 17 nt, Human
gccccugccacccuggg

SEQ ID NO: 3023432 - RNA, 16 nt, Human
gccccugccacccugg

SEQ ID NO: 3023433 - RNA, 16 nt, Human
gcccugcagagggcac

SEQ ID NO: 3023434 - RNA, 18 nt, Human
gcccugcagagggcacag

SEQ ID NO: 3023435 - RNA, 11 nt, Human
gcccugccucc

SEQ ID NO: 3023436 - RNA, 22 nt, Human
gcccugcccaccuggccucugc

SEQ ID NO: 3023437 - RNA, 21 nt, Human
gcccugcccaccuggccucug

SEQ ID NO: 3023438 - RNA, 20 nt, Human
gcccugcccaccuggccucu

SEQ ID NO: 3023439 - RNA, 17 nt, Human
gcccugcccaccuggcc

SEQ ID NO: 3023440 - RNA, 19 nt, Human
gccgcagcccugcagaggg

SEQ ID NO: 3023441 - RNA, 20 nt, Human
gccgcagcccugcagagggc

SEQ ID NO: 3023442 - RNA, 22 nt, Human
gcccuuagcagggaaacagcua

SEQ ID NO: 3023443 - RNA, 13 nt, Human
gcccugccuccuu

SEQ ID NO: 3023444 - RNA, 12 nt, Human
gcccugccuccu

SEQ ID NO: 3023445 - RNA, 19 nt, Human
gcccuuagcagggaaacag

SEQ ID NO: 3023446 - RNA, 20 nt, Human
gcccuuagcagggaaacagc

SEQ ID NO: 3023447 - RNA, 20 nt, Human
gccuaggugacagagugaga

SEQ ID NO: 3023448 - RNA, 23 nt, Human
gccuagcauacguacacauuuua

SEQ ID NO: 3023449 - RNA, 21 nt, Human
gccuagcauacguacacauuu

SEQ ID NO: 3023450 - RNA, 22 nt, Human
gccuagcauacguacacauuuu

SEQ ID NO: 3023451 - RNA, 20 nt, Human
gccuagcauacguacacauu

SEQ ID NO: 3023452 - RNA, 13 nt, Human
gccuaggugacag

SEQ ID NO: 3023453 - RNA, 14 nt, Human
gccuaggugacaga

SEQ ID NO: 3023454 - RNA, 15 nt, Human
gccuaggugacagag

SEQ ID NO: 3023455 - RNA, 22 nt, Human
gccugcccaggccccugccacc

SEQ ID NO: 3023456 - RNA, 15 nt, Human
gccugcccaggcccc

SEQ ID NO: 3023457 - RNA, 20 nt, Human
gccugcccaggccccugcca

SEQ ID NO: 3023458 - RNA, 17 nt, Human
gccucgaacuggcugca

SEQ ID NO: 3023459 - RNA, 19 nt, Human
gccuccugugugugcgccu

SEQ ID NO: 3023460 - RNA, 23 nt, Human
gccuccugugugugcgccuacag

SEQ ID NO: 3023461 - RNA, 16 nt, Human
gccucccaaagugcug

SEQ ID NO: 3023462 - RNA, 13 nt, Human
gccuccugugugu

SEQ ID NO: 3023463 - RNA, 17 nt, Human
gccucccaaagugcugg

SEQ ID NO: 3023464 - RNA, 13 nt, Human
gccugcccaggcc

SEQ ID NO: 3023465 - RNA, 14 nt, Human
gccugcccaggccc

SEQ ID NO: 3023466 - RNA, 14 nt, Human
gccucuuggguuca

SEQ ID NO: 3023467 - RNA, 21 nt, Human
gccucuuaugggcuggguucu

SEQ ID NO: 3023468 - RNA, 20 nt, Human
gccucgaacuggcugcaaag

SEQ ID NO: 3023469 - RNA, 22 nt, Human
gccucgaacuggcugcaaaggg

SEQ ID NO: 3023470 - RNA, 16 nt, Human
gccucuuaugggcugg

SEQ ID NO: 3023471 - RNA, 18 nt, Human
gccucuuaugggcugggu

SEQ ID NO: 3023472 - RNA, 17 nt, Human
gccucuuaugggcuggg

SEQ ID NO: 3023473 - RNA, 20 nt, Human
gccuggccugagcugggaug

SEQ ID NO: 3023474 - RNA, 18 nt, Human
gccuggccugagcuggga

SEQ ID NO: 3023475 - RNA, 14 nt, Human
gccuggccugagcu

SEQ ID NO: 3023476 - RNA, 13 nt, Human
gccuggccugagc

SEQ ID NO: 3023477 - RNA, 18 nt, Human
gccugugccucugggacu

SEQ ID NO: 3023478 - RNA, 13 nt, Human
gccuggcucaggu

SEQ ID NO: 3023479 - RNA, 16 nt, Human
gccugugccucuggga

SEQ ID NO: 3023480 - RNA, 17 nt, Human
gccugugccucugggac

SEQ ID NO: 3023481 - RNA, 14 nt, Human
gccuguugggccag

SEQ ID NO: 3023482 - RNA, 20 nt, Human
gccuguugggccaggagccu

SEQ ID NO: 3023483 - RNA, 18 nt, Human
gccuguugggccaggagc

SEQ ID NO: 3023484 - RNA, 16 nt, Human
gccuguugggccagga

SEQ ID NO: 3023485 - RNA, 15 nt, Human
gccuguugggccagg

SEQ ID NO: 3023486 - RNA, 22 nt, Human
gcgaucuggguucacugcaacc

SEQ ID NO: 3023487 - RNA, 17 nt, Human
gcgagcccugguggcag

SEQ ID NO: 3023488 - RNA, 15 nt, Human
gcgagcccugguggc

SEQ ID NO: 3023489 - RNA, 20 nt, Human
gccuugaccauucuccaccu

SEQ ID NO: 3023490 - RNA, 19 nt, Human
gccuugaccauucuccacc

SEQ ID NO: 3023491 - RNA, 17 nt, Human
gccuugaccauucucca

SEQ ID NO: 3023492 - RNA, 16 nt, Human
gccuugaccauucucc

SEQ ID NO: 3023493 - RNA, 19 nt, Human
gcuccaccuugcagcucuc

SEQ ID NO: 3023494 - RNA, 20 nt, Human
gcuccagcucaccagcccca

SEQ ID NO: 3023495 - RNA, 21 nt, Human
gcuccagcucaccagccccag

SEQ ID NO: 3023496 - RNA, 17 nt, Human
gcuccagcucaccagcc

SEQ ID NO: 3023497 - RNA, 18 nt, Human
gcuccagcucaccagccc

SEQ ID NO: 3023498 - RNA, 15 nt, Human
gcuccuggcccacug

SEQ ID NO: 3023499 - RNA, 14 nt, Human
gcuccuggcccacu

SEQ ID NO: 3023500 - RNA, 20 nt, Human
gcuccuggcccacugcaucg

SEQ ID NO: 3023501 - RNA, 19 nt, Human
gcuccuggcccacugcauc

SEQ ID NO: 3023502 - RNA, 18 nt, Human
gcuccuggcccacugcau

SEQ ID NO: 3023503 - RNA, 23 nt, Human
gcucugaucauccacugugccau

SEQ ID NO: 3023504 - RNA, 17 nt, Human
gcucugaucauccacug

SEQ ID NO: 3023505 - RNA, 23 nt, Human
gcucugcaagaauugaagcagga

SEQ ID NO: 3023506 - RNA, 11 nt, Human
gcucugcccuu

SEQ ID NO: 3023507 - RNA, 17 nt, Human
gcuaggccuggccagau

SEQ ID NO: 3023508 - RNA, 23 nt, Human
gcuaggccuggccagaugcacca

SEQ ID NO: 3023509 - RNA, 16 nt, Human
gcuaggccuggccaga

SEQ ID NO: 3023510 - RNA, 19 nt, Human
gcuauucaguaauaacucu

SEQ ID NO: 3023511 - RNA, 13 nt, Human
gcuaugcauuuga

SEQ ID NO: 3023512 - RNA, 12 nt, Human
gcuaugcauuug

SEQ ID NO: 3023513 - RNA, 22 nt, Human
gcuagugugguguuuccuggca

SEQ ID NO: 3023514 - RNA, 21 nt, Human
gcuagugugguguuuccuggc

SEQ ID NO: 3023515 - RNA, 13 nt, Human
gcucagagagggu

SEQ ID NO: 3023516 - RNA, 14 nt, Human
gcucagagagggug

SEQ ID NO: 3023517 - RNA, 16 nt, Human
gcucaggugucccugc

SEQ ID NO: 3023518 - RNA, 14 nt, Human
gcucaggugucccu

SEQ ID NO: 3023519 - RNA, 23 nt, Human
gcucagguggggucacucuggca

SEQ ID NO: 3023520 - RNA, 17 nt, Human
gcucacugcagccucaa

SEQ ID NO: 3023521 - RNA, 15 nt, Human
gcucacugcagccuc

SEQ ID NO: 3023522 - RNA, 16 nt, Human
gcucacugcagccuca

SEQ ID NO: 3023523 - RNA, 11 nt, Human
gcucacugcag

SEQ ID NO: 3023524 - RNA, 12 nt, Human
gcucacugcagc

SEQ ID NO: 3023525 - RNA, 13 nt, Human
gcucacugcagcc

SEQ ID NO: 3023526 - RNA, 14 nt, Human
gcucacugcagccu

SEQ ID NO: 3023527 - RNA, 18 nt, Human
gcuauucaguaauaacuc

SEQ ID NO: 3023528 - RNA, 20 nt, Human
gcuauucaguaauaacucua

SEQ ID NO: 3023529 - RNA, 20 nt, Human
gcgugcacacaccagagccc

SEQ ID NO: 3023530 - RNA, 21 nt, Human
gcgggaggauguucugggaca

SEQ ID NO: 3023531 - RNA, 22 nt, Human
gcgggaggauguucugggacac

SEQ ID NO: 3023532 - RNA, 20 nt, Human
gcgggaggauguucugggac

SEQ ID NO: 3023533 - RNA, 19 nt, Human
gcgugcacacaccagagcc

SEQ ID NO: 3023534 - RNA, 23 nt, Human
gcgugcacacaccagagcccacc

SEQ ID NO: 3023535 - RNA, 18 nt, Human
gcguuucuaugacacaug

SEQ ID NO: 3023536 - RNA, 23 nt, Human
gcuaagugauccucccaccucag

SEQ ID NO: 3023537 - RNA, 13 nt, Human
gcuaaugggacac

SEQ ID NO: 3023538 - RNA, 15 nt, Human
gcuaaugggacacua

SEQ ID NO: 3023539 - RNA, 23 nt, Human
ggaacagaagaggaaagagagac

SEQ ID NO: 3023540 - RNA, 16 nt, Human
ggaacacucugagacu

SEQ ID NO: 3023541 - RNA, 15 nt, Human
ggaacacucugagac

SEQ ID NO: 3023542 - RNA, 19 nt, Human
ggaacacuccuucacagau

SEQ ID NO: 3023543 - RNA, 14 nt, Human
ggaacacucugaga

SEQ ID NO: 3023544 - RNA, 12 nt, Human
ggaacacucuga

SEQ ID NO: 3023545 - RNA, 15 nt, Human
ggaagagaaaaaaua

SEQ ID NO: 3023546 - RNA, 18 nt, Human
ggaagacuuuggaaagag

SEQ ID NO: 3023547 - RNA, 13 nt, Human
ggaagagaaaaaa

SEQ ID NO: 3023548 - RNA, 22 nt, Human
ggaagacaaugugaaaagaaaa

SEQ ID NO: 3023549 - RNA, 14 nt, Human
ggaagacagcucuu

SEQ ID NO: 3023550 - RNA, 13 nt, Human
ggaagacagcucu

SEQ ID NO: 3023551 - RNA, 12 nt, Human
ggaagacuuugg

SEQ ID NO: 3023552 - RNA, 17 nt, Human
ggaagacuuuggaaaga

SEQ ID NO: 3023553 - RNA, 13 nt, Human
ggaagacuuugga

SEQ ID NO: 3023554 - RNA, 15 nt, Human
ggaagccgcuggggc

SEQ ID NO: 3023555 - RNA, 20 nt, Human
ggaaggaaacccagcucugg

SEQ ID NO: 3023556 - RNA, 19 nt, Human
ggaaggaaacccagcucug

SEQ ID NO: 3023557 - RNA, 22 nt, Human
ggaagcucagggccuggcucag

SEQ ID NO: 3023558 - RNA, 11 nt, Human
ggaagcuccgc

SEQ ID NO: 3023559 - RNA, 23 nt, Human
ggaagcucagggccuggcucagg

SEQ ID NO: 3023560 - RNA, 15 nt, Human
ggaagcucagggccu

SEQ ID NO: 3023561 - RNA, 16 nt, Human
ggaaggaaacccagcu

SEQ ID NO: 3023562 - RNA, 17 nt, Human
ggacacuaaccacgcug

SEQ ID NO: 3023563 - RNA, 22 nt, Human
ggacacuaaccacgcuggaccu

SEQ ID NO: 3023564 - RNA, 19 nt, Human
ggacagcuccuucuguccu

SEQ ID NO: 3023565 - RNA, 20 nt, Human
ggacagcuccuucuguccua

SEQ ID NO: 3023566 - RNA, 17 nt, Human
ggacagcuccuucuguc

SEQ ID NO: 3023567 - RNA, 14 nt, Human
ggacacagcucuuc

SEQ ID NO: 3023568 - RNA, 15 nt, Human
ggacacagcucuucu

SEQ ID NO: 3023569 - RNA, 18 nt, Human
ggacacagcucuucucca

SEQ ID NO: 3023570 - RNA, 13 nt, Human
ggacaagagcagg

SEQ ID NO: 3023571 - RNA, 23 nt, Human
ggacaaggaugaucuaggaagac

SEQ ID NO: 3023572 - RNA, 22 nt, Human
ggacaaggaugaucuaggaaga

SEQ ID NO: 3023573 - RNA, 16 nt, Human
ggaauccagacccggc

SEQ ID NO: 3023574 - RNA, 18 nt, Human
ggaauaacauguaauuaa

SEQ ID NO: 3023575 - RNA, 12 nt, Human
ggacccccugaa

SEQ ID NO: 3023576 - RNA, 11 nt, Human
ggacccugagg

SEQ ID NO: 3023577 - RNA, 13 nt, Human
ggacccugaggcc

SEQ ID NO: 3023578 - RNA, 12 nt, Human
ggacccugaggc

SEQ ID NO: 3023579 - RNA, 12 nt, Human
ggaccucaggcc

SEQ ID NO: 3023580 - RNA, 13 nt, Human
ggaccucaggccu

SEQ ID NO: 3023581 - RNA, 20 nt, Human
ggacguguuaugacuccaga

SEQ ID NO: 3023582 - RNA, 15 nt, Human
ggaccucaggccugg

SEQ ID NO: 3023583 - RNA, 14 nt, Human
ggaccucaggccug

SEQ ID NO: 3023584 - RNA, 14 nt, Human
ggacuuggaagcuc

SEQ ID NO: 3023585 - RNA, 16 nt, Human
ggagaaaggaagggcu

SEQ ID NO: 3023586 - RNA, 20 nt, Human
ggacuaacuugucuuuggac

SEQ ID NO: 3023587 - RNA, 15 nt, Human
ggacucaaugcacug

SEQ ID NO: 3023588 - RNA, 14 nt, Human
ggacuacaggugug

SEQ ID NO: 3023589 - RNA, 24 nt, Human
ggacuaacuugucuuuggacccug

SEQ ID NO: 3023590 - RNA, 16 nt, Human
ggacucaaugcacuga

SEQ ID NO: 3023591 - RNA, 16 nt, Human
gcuuguacacucauuc

SEQ ID NO: 3023592 - RNA, 20 nt, Human
gcuuguaaauagcucaggug

SEQ ID NO: 3023593 - RNA, 14 nt, Human
gcuugagcucagga

SEQ ID NO: 3023594 - RNA, 22 nt, Human
gcuugaccuuuaagagaaauga

SEQ ID NO: 3023595 - RNA, 12 nt, Human
gcuuguacauaa

SEQ ID NO: 3023596 - RNA, 23 nt, Human
gcuucuucagagacuccugcagg

SEQ ID NO: 3023597 - RNA, 22 nt, Human
gcuuccucauaguaugguggcu

SEQ ID NO: 3023598 - RNA, 18 nt, Human
gcuucaaggauccugagc

SEQ ID NO: 3023599 - RNA, 19 nt, Human
gcuucaaggauccugagcc

SEQ ID NO: 3023600 - RNA, 21 nt, Human
gcuucaaggauccugagccag

SEQ ID NO: 3023601 - RNA, 20 nt, Human
gcuucaaggauccugagcca

SEQ ID NO: 3023602 - RNA, 15 nt, Human
gcuucacggaagagc

SEQ ID NO: 3023603 - RNA, 17 nt, Human
gcuucacggaagagccu

SEQ ID NO: 3023604 - RNA, 12 nt, Human
gcuucagccucc

SEQ ID NO: 3023605 - RNA, 18 nt, Human
gcuucacggaagagccuu

SEQ ID NO: 3023606 - RNA, 13 nt, Human
gcugcuggcuggu

SEQ ID NO: 3023607 - RNA, 16 nt, Human
gcucugguccauagag

SEQ ID NO: 3023608 - RNA, 15 nt, Human
gcucugguccauaga

SEQ ID NO: 3023609 - RNA, 15 nt, Human
gcugcugaaggcucg

SEQ ID NO: 3023610 - RNA, 14 nt, Human
gcugcugaaggcuc

SEQ ID NO: 3023611 - RNA, 13 nt, Human
gcugcugaaggcu

SEQ ID NO: 3023612 - RNA, 20 nt, Human
gcuggcgugcaguggugcga

SEQ ID NO: 3023613 - RNA, 18 nt, Human
gcuggagugcagugagcc

SEQ ID NO: 3023614 - RNA, 17 nt, Human
gcuggagugcagugagc

SEQ ID NO: 3023615 - RNA, 22 nt, Human
gcuggagugcagugagccgaga

SEQ ID NO: 3023616 - RNA, 20 nt, Human
gcuggccuggccccucaggg

SEQ ID NO: 3023617 - RNA, 23 nt, Human
gcuggguggcaccagcagccugg

SEQ ID NO: 3023618 - RNA, 22 nt, Human
gcuggguggcaccagcagccug

SEQ ID NO: 3023619 - RNA, 21 nt, Human
gcuggguggcaccagcagccu

SEQ ID NO: 3023620 - RNA, 15 nt, Human
gcuggcuguuggcug

SEQ ID NO: 3023621 - RNA, 16 nt, Human
gcuggcuguuggcugg

SEQ ID NO: 3023622 - RNA, 23 nt, Human
aaacaugcuguacauacuuuuug

SEQ ID NO: 3023623 - RNA, 17 nt, Human
aaacauggccuuugcuu

SEQ ID NO: 3023624 - RNA, 16 nt, Human
aaacauggccuuugcu

SEQ ID NO: 3023625 - RNA, 18 nt, Human
ggggaauguuugccucug

SEQ ID NO: 3023626 - RNA, 22 nt, Human
ggggaauguuugccucugccuc

SEQ ID NO: 3023627 - RNA, 15 nt, Human
ggggaccagagcugc

SEQ ID NO: 3023628 - RNA, 16 nt, Human
ggggaccagagcugcc

SEQ ID NO: 3023629 - RNA, 12 nt, Human
gggggccucagu

SEQ ID NO: 3023630 - RNA, 15 nt, Human
gggggccucagugcc

SEQ ID NO: 3023631 - RNA, 17 nt, Human
gggggccucagugccac

SEQ ID NO: 3023632 - RNA, 18 nt, Human
gggggccucagugccacu

SEQ ID NO: 3023633 - RNA, 15 nt, Human
aaacacauuaaaggu

SEQ ID NO: 3023634 - RNA, 11 nt, Human
aaacacauuaa

SEQ ID NO: 3023635 - RNA, 11 nt, Human
aaacacauuuu

SEQ ID NO: 3023636 - RNA, 21 nt, Human
aaacacauuaaagguacuuug

SEQ ID NO: 3023637 - RNA, 19 nt, Human
aaacacaaacgggcucagc

SEQ ID NO: 3023638 - RNA, 20 nt, Human
aaaauuuugauguuuuaagg

SEQ ID NO: 3023639 - RNA, 19 nt, Human
aaaauuuagaaauauaauu

SEQ ID NO: 3023640 - RNA, 13 nt, Human
gggaugagaaagg

SEQ ID NO: 3023641 - RNA, 19 nt, Human
ggguggcaccagcagccug

SEQ ID NO: 3023642 - RNA, 17 nt, Human
aaacuuaaucuaaaugg

SEQ ID NO: 3023643 - RNA, 18 nt, Human
aaacuuaaucuaaaugga

SEQ ID NO: 3023644 - RNA, 16 nt, Human
aaacuuaaucuaaaug

SEQ ID NO: 3023645 - RNA, 14 nt, Human
aaacuuaaucuaaa

SEQ ID NO: 3023646 - RNA, 15 nt, Human
aaacgggcucagcaa

SEQ ID NO: 3023647 - RNA, 23 nt, Human
aaaccaagucaagugaaaaagga

SEQ ID NO: 3023648 - RNA, 14 nt, Human
aaagcuuuugcaua

SEQ ID NO: 3023649 - RNA, 22 nt, Human
aaaggaaagagggagguaagga

SEQ ID NO: 3023650 - RNA, 17 nt, Human
aaaggagauuggaagga

SEQ ID NO: 3023651 - RNA, 17 nt, Human
aaaggagagcuagcagc

SEQ ID NO: 3023652 - RNA, 21 nt, Human
aaaggagagcuagcagcaggg

SEQ ID NO: 3023653 - RNA, 22 nt, Human
aaagggacuuggaagcuccgcu

SEQ ID NO: 3023654 - RNA, 13 nt, Human
aaagcuuuugcau

SEQ ID NO: 3023655 - RNA, 15 nt, Human
aaagcuuguuaagau

SEQ ID NO: 3023656 - RNA, 13 nt, Human
aaagcugcugaca

SEQ ID NO: 3023657 - RNA, 15 nt, Human
aaagcucacuuuacu

SEQ ID NO: 3023658 - RNA, 13 nt, Human
gguggaugccugg

SEQ ID NO: 3023659 - RNA, 12 nt, Human
ggugcaaugacc

SEQ ID NO: 3023660 - RNA, 13 nt, Human
ggugcaaugaccu

SEQ ID NO: 3023661 - RNA, 18 nt, Human
ggugauccacccaccuca

SEQ ID NO: 3023662 - RNA, 23 nt, Human
ggugauccacccaccucagccuc

SEQ ID NO: 3023663 - RNA, 24 nt, Human
ggugauccacccaccucagccucc

SEQ ID NO: 3023664 - RNA, 13 nt, Human
ggugaacagaaca

SEQ ID NO: 3023665 - RNA, 13 nt, Human
ggucgaggcagga

SEQ ID NO: 3023666 - RNA, 14 nt, Human
ggguggggcagugc

SEQ ID NO: 3023667 - RNA, 14 nt, Human
ggguggccucccaa

SEQ ID NO: 3023668 - RNA, 11 nt, Human
gguccugcugc

SEQ ID NO: 3023669 - RNA, 12 nt, Human
gguccugcugca

SEQ ID NO: 3023670 - RNA, 23 nt, Human
aaagacugaguacguugugcauu

SEQ ID NO: 3023671 - RNA, 13 nt, Human
aaagacuguacaa

SEQ ID NO: 3023672 - RNA, 14 nt, Human
aaagacuguacaaa

SEQ ID NO: 3023673 - RNA, 19 nt, Human
aaagaugcuucucacugcc

SEQ ID NO: 3023674 - RNA, 14 nt, Human
aaagaugcuucuca

SEQ ID NO: 3023675 - RNA, 17 nt, Human
aaagaugcuucucacug

SEQ ID NO: 3023676 - RNA, 16 nt, Human
aaagguacuuugcagg

SEQ ID NO: 3023677 - RNA, 20 nt, Human
aaaguacacuguuucaaacu

SEQ ID NO: 3023678 - RNA, 19 nt, Human
aaaguacuucuccacccug

SEQ ID NO: 3023679 - RNA, 23 nt, Human
aaaguacuucuccacccugcucu

SEQ ID NO: 3023680 - RNA, 20 nt, Human
aaaguacuucuccacccugc

SEQ ID NO: 3023681 - RNA, 21 nt, Human
aaaguacuucuccacccugcu

SEQ ID NO: 3023682 - RNA, 18 nt, Human
aaaguaucccuacuguaa

SEQ ID NO: 3023683 - RNA, 14 nt, Human
guaacucuguaauu

SEQ ID NO: 3023684 - RNA, 22 nt, Human
guaauuugugauacaaugcugu

SEQ ID NO: 3023685 - RNA, 14 nt, Human
guaauaugcacaca

SEQ ID NO: 3023686 - RNA, 16 nt, Human
guaauaugcacacauu

SEQ ID NO: 3023687 - RNA, 17 nt, Human
guaauaugcacacauuu

SEQ ID NO: 3023688 - RNA, 18 nt, Human
guaauaugcacacauuuu

SEQ ID NO: 3023689 - RNA, 14 nt, Human
aaauauaauugaca

SEQ ID NO: 3023690 - RNA, 18 nt, Human
aaauaccagccaguaaau

SEQ ID NO: 3023691 - RNA, 17 nt, Human
aaauacagauagauaua

SEQ ID NO: 3023692 - RNA, 21 nt, Human
guacucugccacuuuauuucu

SEQ ID NO: 3023693 - RNA, 15 nt, Human
guacuauguaucaau

SEQ ID NO: 3023694 - RNA, 17 nt, Human
guacuauguaucaauga

SEQ ID NO: 3023695 - RNA, 17 nt, Human
guacuacaguccuccca

SEQ ID NO: 3023696 - RNA, 13 nt, Human
guacuauguauca

SEQ ID NO: 3023697 - RNA, 13 nt, Human
guacccacugcuc

SEQ ID NO: 3023698 - RNA, 14 nt, Human
guacccacugcucu

SEQ ID NO: 3023699 - RNA, 19 nt, Human
guacuacaguccucccauc

SEQ ID NO: 3023700 - RNA, 18 nt, Human
guacuacaguccucccau

SEQ ID NO: 3023701 - RNA, 16 nt, Human
guacuggagaaaaugg

SEQ ID NO: 3023702 - RNA, 20 nt, Human
guagacgugcacgcacacug

SEQ ID NO: 3023703 - RNA, 23 nt, Human
guagacgugcacgcacacugucu

SEQ ID NO: 3023704 - RNA, 11 nt, Human
guagagacagg

SEQ ID NO: 3023705 - RNA, 12 nt, Human
guagagacaggg

SEQ ID NO: 3023706 - RNA, 16 nt, Human
guagacaguuggguuu

SEQ ID NO: 3023707 - RNA, 15 nt, Human
guagagccagggucu

SEQ ID NO: 3023708 - RNA, 13 nt, Human
guagagacagggu

SEQ ID NO: 3023709 - RNA, 10 nt, Human
guagagccag

SEQ ID NO: 3023710 - RNA, 11 nt, Human
guagagccagg

SEQ ID NO: 3023711 - RNA, 14 nt, Human
guagaauguuuuca

SEQ ID NO: 3023712 - RNA, 18 nt, Human
guagaagcccuucuaccu

SEQ ID NO: 3023713 - RNA, 21 nt, Human
guagaagucuuagauguauau

SEQ ID NO: 3023714 - RNA, 20 nt, Human
guagaaauaucugaaaaugu

SEQ ID NO: 3023715 - RNA, 21 nt, Human
guagaaauaucugaaaaugua

SEQ ID NO: 3023716 - RNA, 23 nt, Human
guagaaauaucugaaaauguaug

SEQ ID NO: 3023717 - RNA, 12 nt, Human
guacccacugcu

SEQ ID NO: 3023718 - RNA, 19 nt, Human
guacauggaauaacaugua

SEQ ID NO: 3023719 - RNA, 17 nt, Human
guacaugaaaacacauu

SEQ ID NO: 3023720 - RNA, 18 nt, Human
guacaugaaaacacauuu

SEQ ID NO: 3023721 - RNA, 19 nt, Human
guacaugaaaacacauuuu

SEQ ID NO: 3023722 - RNA, 20 nt, Human
guacaugaaaacacauuuuu

SEQ ID NO: 3023723 - RNA, 14 nt, Human
guacaugaaaacac

SEQ ID NO: 3023724 - RNA, 15 nt, Human
guacaugaaaacaca

SEQ ID NO: 3023725 - RNA, 16 nt, Human
guacaugaaaacacau

SEQ ID NO: 3023726 - RNA, 19 nt, Human
aaauauuaagaaagacuau

SEQ ID NO: 3023727 - RNA, 16 nt, Human
aaaucagcugcuacua

SEQ ID NO: 3023728 - RNA, 18 nt, Human
aaaucagccugcuccagc

SEQ ID NO: 3023729 - RNA, 12 nt, Human
aaaucagccugc

SEQ ID NO: 3023730 - RNA, 19 nt, Human
aaaucagccguguaaccau

SEQ ID NO: 3023731 - RNA, 20 nt, Human
aaaaggaagcuuacaugccu

SEQ ID NO: 3023732 - RNA, 21 nt, Human
gggagaaccaaaaagaggcua

SEQ ID NO: 3023733 - RNA, 15 nt, Human
gggacuuggaagcuc

SEQ ID NO: 3023734 - RNA, 17 nt, Human
gggacuuggaagcuccg

SEQ ID NO: 3023735 - RNA, 18 nt, Human
gggacuuggaagcuccgc

SEQ ID NO: 3023736 - RNA, 23 nt, Human
gggacuuggaagcuccgcuuucu

SEQ ID NO: 3023737 - RNA, 23 nt, Human
gggagcaggcucgggcuccccag

SEQ ID NO: 3023738 - RNA, 19 nt, Human
gggagagccuuccaggggu

SEQ ID NO: 3023739 - RNA, 15 nt, Human
gggagagccuuccag

SEQ ID NO: 3023740 - RNA, 16 nt, Human
gggagggagggcucca

SEQ ID NO: 3023741 - RNA, 15 nt, Human
gggagggagggcucc

SEQ ID NO: 3023742 - RNA, 18 nt, Human
gggaggucaaggcugcag

SEQ ID NO: 3023743 - RNA, 13 nt, Human
aaaacaugcuaca

SEQ ID NO: 3023744 - RNA, 14 nt, Human
aaaacaugcuacac

SEQ ID NO: 3023745 - RNA, 12 nt, Human
aaaacccaagug

SEQ ID NO: 3023746 - RNA, 20 nt, Human
gggaccagagcugccaccug

SEQ ID NO: 3023747 - RNA, 14 nt, Human
gggaccagagcugc

SEQ ID NO: 3023748 - RNA, 18 nt, Human
aaaacucuccucugcugc

SEQ ID NO: 3023749 - RNA, 22 nt, Human
ggcuucauccuccucagaucuu

SEQ ID NO: 3023750 - RNA, 18 nt, Human
ggcuucauccuccucaga

SEQ ID NO: 3023751 - RNA, 16 nt, Human
ggcuuccucauaguau

SEQ ID NO: 3023752 - RNA, 18 nt, Human
ggcuucaguggcagcugc

SEQ ID NO: 3023753 - RNA, 17 nt, Human
ggcuucaguggcagcug

SEQ ID NO: 3023754 - RNA, 19 nt, Human
ggcuucaguggcagcugcu

SEQ ID NO: 3023755 - RNA, 20 nt, Human
ggcuucaguggcagcugcuu

SEQ ID NO: 3023756 - RNA, 18 nt, Human
ggcuguaucccaugagcc

SEQ ID NO: 3023757 - RNA, 19 nt, Human
ggcuggguggcaccagcag

SEQ ID NO: 3023758 - RNA, 21 nt, Human
ggcuggguucuacccaggugc

SEQ ID NO: 3023759 - RNA, 19 nt, Human
ggcuggguucuacccaggu

SEQ ID NO: 3023760 - RNA, 15 nt, Human
ggcugggggccucag

SEQ ID NO: 3023761 - RNA, 16 nt, Human
ggcugggggccucagu

SEQ ID NO: 3023762 - RNA, 17 nt, Human
ggcugggggccucagug

SEQ ID NO: 3023763 - RNA, 19 nt, Human
ggcugggggccucagugcc

SEQ ID NO: 3023764 - RNA, 21 nt, Human
ggcuuccuccugguguggaag

SEQ ID NO: 3023765 - RNA, 18 nt, Human
gggaagaagcucucuccu

SEQ ID NO: 3023766 - RNA, 12 nt, Human
gggacagcuccu

SEQ ID NO: 3023767 - RNA, 13 nt, Human
gggacagcuccuu

SEQ ID NO: 3023768 - RNA, 13 nt, Human
gggaagagacuug

SEQ ID NO: 3023769 - RNA, 15 nt, Human
gggacagcuccuucu

SEQ ID NO: 3023770 - RNA, 18 nt, Human
ggcugaacuuuguggucg

SEQ ID NO: 3023771 - RNA, 22 nt, Human
ggcugcaugcgggcuuccuccu

SEQ ID NO: 3023772 - RNA, 20 nt, Human
ggcugccaaugggagcucau

SEQ ID NO: 3023773 - RNA, 19 nt, Human
ggcugccaaugggagcuca

SEQ ID NO: 3023774 - RNA, 22 nt, Human
ggcugcggaaugaaccacaucu

SEQ ID NO: 3023775 - RNA, 11 nt, Human
ggcucucaggc

SEQ ID NO: 3023776 - RNA, 13 nt, Human
ggcucucaggcca

SEQ ID NO: 3023777 - RNA, 12 nt, Human
ggcucuuccagg

SEQ ID NO: 3023778 - RNA, 16 nt, Human
ggcugggagagccuuc

SEQ ID NO: 3023779 - RNA, 15 nt, Human
ggcugggagagccuu

SEQ ID NO: 3023780 - RNA, 14 nt, Human
ggcugggagagccu

SEQ ID NO: 3023781 - RNA, 13 nt, Human
ggcugggagagcc

SEQ ID NO: 3023782 - RNA, 20 nt, Human
ggcucagguggggucacucu

SEQ ID NO: 3023783 - RNA, 19 nt, Human
ggcucagguggggucacuc

SEQ ID NO: 3023784 - RNA, 19 nt, Human
ggcucagcggggacagcuc

SEQ ID NO: 3023785 - RNA, 20 nt, Human
ggcucagcggggacagcucc

SEQ ID NO: 3023786 - RNA, 18 nt, Human
ggcucagcggggacagcu

SEQ ID NO: 3023787 - RNA, 19 nt, Human
ggcccuuuuucaauaacug

SEQ ID NO: 3023788 - RNA, 23 nt, Human
ggcccuucucuccagccccugga

SEQ ID NO: 3023789 - RNA, 22 nt, Human
ggcccuucucuccagccccugg

SEQ ID NO: 3023790 - RNA, 23 nt, Human
ggccucaagugauucuccugccu

SEQ ID NO: 3023791 - RNA, 23 nt, Human
ggccccugcugguucaggguugg

SEQ ID NO: 3023792 - RNA, 13 nt, Human
ggcccggcuccag

SEQ ID NO: 3023793 - RNA, 13 nt, Human
ggccccugcuggu

SEQ ID NO: 3023794 - RNA, 14 nt, Human
ggccccugcugguu

SEQ ID NO: 3023795 - RNA, 15 nt, Human
ggcccggcuccaggc

SEQ ID NO: 3023796 - RNA, 21 nt, Human
ggcccuucucuccagccccug

SEQ ID NO: 3023797 - RNA, 20 nt, Human
ggcccuucucuccagccccu

SEQ ID NO: 3023798 - RNA, 19 nt, Human
ggcccuucucuccagcccc

SEQ ID NO: 3023799 - RNA, 17 nt, Human
ggccaguuggucccccu

SEQ ID NO: 3023800 - RNA, 14 nt, Human
ggccaguugguccc

SEQ ID NO: 3023801 - RNA, 20 nt, Human
ggccagugugacaaggauug

SEQ ID NO: 3023802 - RNA, 20 nt, Human
ggcacugguuuguucccugu

SEQ ID NO: 3023803 - RNA, 23 nt, Human
ggcagccccauucugccugccca

SEQ ID NO: 3023804 - RNA, 11 nt, Human
ggcagccccug

SEQ ID NO: 3023805 - RNA, 19 nt, Human
ggcacagaaaauggaagac

SEQ ID NO: 3023806 - RNA, 21 nt, Human
ggcacagaaaauggaagacag

SEQ ID NO: 3023807 - RNA, 20 nt, Human
ggcacagaaaauggaagaca

SEQ ID NO: 3023808 - RNA, 23 nt, Human
ggcacucagaagacacugauggg

SEQ ID NO: 3023809 - RNA, 20 nt, Human
ggcacucagaagacacugau

SEQ ID NO: 3023810 - RNA, 13 nt, Human
ggcacaucagcac

SEQ ID NO: 3023811 - RNA, 23 nt, Human
ggcacagaaaauggaagacagcu

SEQ ID NO: 3023812 - RNA, 16 nt, Human
ggagagaagagaaugc

SEQ ID NO: 3023813 - RNA, 20 nt, Human
ggcaguggugguuuucuguu

SEQ ID NO: 3023814 - RNA, 21 nt, Human
ggcaguggugguuuucuguuc

SEQ ID NO: 3023815 - RNA, 22 nt, Human
ggcagccccuguucuggcagag

SEQ ID NO: 3023816 - RNA, 21 nt, Human
gacccucucaaacuaacaggc

SEQ ID NO: 3023817 - RNA, 12 nt, Human
gacgcugugcug

SEQ ID NO: 3023818 - RNA, 13 nt, Human
gacgcugugcugc

SEQ ID NO: 3023819 - RNA, 22 nt, Human
gacuuugguuauuuuacuuuuu

SEQ ID NO: 3023820 - RNA, 20 nt, Human
gacuuuuccaacccucauca

SEQ ID NO: 3023821 - RNA, 22 nt, Human
gacuuuguuaguuucuccaagc

SEQ ID NO: 3023822 - RNA, 21 nt, Human
gacuuuucuguccgagcuuug

SEQ ID NO: 3023823 - RNA, 14 nt, Human
gacuuuggaaagag

SEQ ID NO: 3023824 - RNA, 14 nt, Human
gacuuuggaaagac

SEQ ID NO: 3023825 - RNA, 18 nt, Human
gacuguuuucucuugaga

SEQ ID NO: 3023826 - RNA, 16 nt, Human
gacuguuuucucuuga

SEQ ID NO: 3023827 - RNA, 22 nt, Human
gacuguacaaaguagaagucuu

SEQ ID NO: 3023828 - RNA, 17 nt, Human
gacucaaugcacugaca

SEQ ID NO: 3023829 - RNA, 14 nt, Human
gacucaaugcacug

SEQ ID NO: 3023830 - RNA, 16 nt, Human
gagaagcggcuggcag

SEQ ID NO: 3023831 - RNA, 17 nt, Human
gagaagcggcuggcagc

SEQ ID NO: 3023832 - RNA, 15 nt, Human
gaccaucccugaagg

SEQ ID NO: 3023833 - RNA, 14 nt, Human
gaccaucccugaag

SEQ ID NO: 3023834 - RNA, 16 nt, Human
gaccauucuccaccug

SEQ ID NO: 3023835 - RNA, 17 nt, Human
gaccaucccugaaggcc

SEQ ID NO: 3023836 - RNA, 16 nt, Human
gaccaucccugaaggc

SEQ ID NO: 3023837 - RNA, 12 nt, Human
gacccggcugcg

SEQ ID NO: 3023838 - RNA, 13 nt, Human
gacccggcugcgu

SEQ ID NO: 3023839 - RNA, 16 nt, Human
gacccuauugcugcuu

SEQ ID NO: 3023840 - RNA, 13 nt, Human
gacagcuccuucu

SEQ ID NO: 3023841 - RNA, 14 nt, Human
gacagcuccuucug

SEQ ID NO: 3023842 - RNA, 15 nt, Human
gacagcuccuucugu

SEQ ID NO: 3023843 - RNA, 20 nt, Human
gaggccagagacacaagccu

SEQ ID NO: 3023844 - RNA, 17 nt, Human
gaggcucugcccuuggu

SEQ ID NO: 3023845 - RNA, 15 nt, Human
gaggcucugcccuug

SEQ ID NO: 3023846 - RNA, 14 nt, Human
gaggcucugcccuu

SEQ ID NO: 3023847 - RNA, 13 nt, Human
gaggcucugcccu

SEQ ID NO: 3023848 - RNA, 12 nt, Human
gaggcucugccc

SEQ ID NO: 3023849 - RNA, 12 nt, Human
gaggggaacaga

SEQ ID NO: 3023850 - RNA, 15 nt, Human
gagggcuccagacac

SEQ ID NO: 3023851 - RNA, 14 nt, Human
gagggcuccagaca

SEQ ID NO: 3023852 - RNA, 13 nt, Human
gagggcuccagac

SEQ ID NO: 3023853 - RNA, 12 nt, Human
gagggcuccaga

SEQ ID NO: 3023854 - RNA, 13 nt, Human
gaggugggauccu

SEQ ID NO: 3023855 - RNA, 16 nt, Human
gaggugggauccucca

SEQ ID NO: 3023856 - RNA, 15 nt, Human
gaggugggauccucc

SEQ ID NO: 3023857 - RNA, 17 nt, Human
gaggugggauccuccag

SEQ ID NO: 3023858 - RNA, 21 nt, Human
gagucacuggaacacuaauga

SEQ ID NO: 3023859 - RNA, 14 nt, Human
gagucacuggaaca

SEQ ID NO: 3023860 - RNA, 19 nt, Human
gaguugauacuacaguuug

SEQ ID NO: 3023861 - RNA, 21 nt, Human
gaguugauagcacagacccug

SEQ ID NO: 3023862 - RNA, 22 nt, Human
gaguugauacuacaguuuguua

SEQ ID NO: 3023863 - RNA, 13 nt, Human
gagugcagugagc

SEQ ID NO: 3023864 - RNA, 18 nt, Human
gagugcagugagccgaga

SEQ ID NO: 3023865 - RNA, 14 nt, Human
gagugagacucugu

SEQ ID NO: 3023866 - RNA, 18 nt, Human
gagugagacucugucuca

SEQ ID NO: 3023867 - RNA, 18 nt, Human
gagucagaaguuucugcc

SEQ ID NO: 3023868 - RNA, 22 nt, Human
gagcaucaggccaggcccucug

SEQ ID NO: 3023869 - RNA, 20 nt, Human
gagcaucaggccaggcccuc

SEQ ID NO: 3023870 - RNA, 15 nt, Human
gagcugccuguucag

SEQ ID NO: 3023871 - RNA, 16 nt, Human
gagcugccuguucagc

SEQ ID NO: 3023872 - RNA, 19 nt, Human
gagcugccuguucagcucc

SEQ ID NO: 3023873 - RNA, 17 nt, Human
gagcaucaggccaggcc

SEQ ID NO: 3023874 - RNA, 13 nt, Human
gagccuuccaggg

SEQ ID NO: 3023875 - RNA, 12 nt, Human
gagccuuccagg

SEQ ID NO: 3023876 - RNA, 14 nt, Human
gcaggcuggaguua

SEQ ID NO: 3023877 - RNA, 17 nt, Human
gcaggcucucaggccag

SEQ ID NO: 3023878 - RNA, 13 nt, Human
gcagggaaacagc

SEQ ID NO: 3023879 - RNA, 22 nt, Human
gcagggaaacagcuaaugggac

SEQ ID NO: 3023880 - RNA, 19 nt, Human
gcagcuugaggguugggcu

SEQ ID NO: 3023881 - RNA, 21 nt, Human
gcagcuugaggguugggcugg

SEQ ID NO: 3023882 - RNA, 12 nt, Human
gcaggcucucag

SEQ ID NO: 3023883 - RNA, 22 nt, Human
gcaggcucgggcuccccagccc

SEQ ID NO: 3023884 - RNA, 16 nt, Human
gcaggcucucaggcca

SEQ ID NO: 3023885 - RNA, 15 nt, Human
gcaggcucucaggcc

SEQ ID NO: 3023886 - RNA, 14 nt, Human
gcaggcucucaggc

SEQ ID NO: 3023887 - RNA, 13 nt, Human
gcaggcucucagg

SEQ ID NO: 3023888 - RNA, 22 nt, Human
gcagcugcgguccacccaggag

SEQ ID NO: 3023889 - RNA, 23 nt, Human
gcagcugcgguccacccaggagc

SEQ ID NO: 3023890 - RNA, 13 nt, Human
gcagcugcuuuug

SEQ ID NO: 3023891 - RNA, 20 nt, Human
gcagcugcuuuugucuaugg

SEQ ID NO: 3023892 - RNA, 16 nt, Human
gcagcuugaggguugg

SEQ ID NO: 3023893 - RNA, 16 nt, Human
gcacuuuguucuggcu

SEQ ID NO: 3023894 - RNA, 15 nt, Human
gcauaccacuuuugu

SEQ ID NO: 3023895 - RNA, 15 nt, Human
gcauaaaaauuagcc

SEQ ID NO: 3023896 - RNA, 23 nt, Human
gcaguugccagucaccccggcca

SEQ ID NO: 3023897 - RNA, 14 nt, Human
gcaguugccaguca

SEQ ID NO: 3023898 - RNA, 17 nt, Human
gcauccuggcacccggc

SEQ ID NO: 3023899 - RNA, 21 nt, Human
gcauccuggcacccggccccu

SEQ ID NO: 3023900 - RNA, 14 nt, Human
gcauccuggcaccc

SEQ ID NO: 3023901 - RNA, 22 nt, Human
gcauccuggcacccggccccug

SEQ ID NO: 3023902 - RNA, 23 nt, Human
gcauccuggcacccggccccugc

SEQ ID NO: 3023903 - RNA, 19 nt, Human
gcaugggaaugaaugucag

SEQ ID NO: 3023904 - RNA, 16 nt, Human
gcaugggaaugaaugu

SEQ ID NO: 3023905 - RNA, 13 nt, Human
gcaugggaaugaa

SEQ ID NO: 3023906 - RNA, 17 nt, Human
gcaugugaugagaggaa

SEQ ID NO: 3023907 - RNA, 12 nt, Human
gcauuuaaaaga

SEQ ID NO: 3023908 - RNA, 15 nt, Human
gcauuuaaaagauac

SEQ ID NO: 3023909 - RNA, 14 nt, Human
gcauuugaaaauuu

SEQ ID NO: 3023910 - RNA, 16 nt, Human
gcauuugaaaauuuug

SEQ ID NO: 3023911 - RNA, 18 nt, Human
gccaagaauucuuaaaua

SEQ ID NO: 3023912 - RNA, 14 nt, Human
gccaagaauucuua

SEQ ID NO: 3023913 - RNA, 11 nt, Human
gccaaggccaa

SEQ ID NO: 3023914 - RNA, 17 nt, Human
gccaaggccaaaggaag

SEQ ID NO: 3023915 - RNA, 21 nt, Human
gaugcugucuucguacuggga

SEQ ID NO: 3023916 - RNA, 21 nt, Human
gaugaugaaaugaggucagag

SEQ ID NO: 3023917 - RNA, 14 nt, Human
gaugcuuguacaua

SEQ ID NO: 3023918 - RNA, 16 nt, Human
gaugcuuguacauaau

SEQ ID NO: 3023919 - RNA, 20 nt, Human
gaucuggguucacugcaacc

SEQ ID NO: 3023920 - RNA, 18 nt, Human
gaucuggguucacugcaa

SEQ ID NO: 3023921 - RNA, 21 nt, Human
gauucuuguauuuauuacaac

SEQ ID NO: 3023922 - RNA, 15 nt, Human
gauucuuguauuuau

SEQ ID NO: 3023923 - RNA, 20 nt, Human
gauuuaacagaaauguacag

SEQ ID NO: 3023924 - RNA, 23 nt, Human
gauuuaacagaaauguacagcaa

SEQ ID NO: 3023925 - RNA, 21 nt, Human
gauucuucugcuucagccucc

SEQ ID NO: 3023926 - RNA, 20 nt, Human
gauucuucugcuucagccuc

SEQ ID NO: 3023927 - RNA, 23 nt, Human
gauucuuauggacaaugacccag

SEQ ID NO: 3023928 - RNA, 19 nt, Human
gauucuccugccucagccu

SEQ ID NO: 3023929 - RNA, 20 nt, Human
gauucuccugccucagccuc

SEQ ID NO: 3023930 - RNA, 21 nt, Human
gauucuccugccucagccucc

SEQ ID NO: 3023931 - RNA, 22 nt, Human
gauuuuuuuuuccuucagugcc

SEQ ID NO: 3023932 - RNA, 23 nt, Human
gauuuuuuuuuccuucagugccu

SEQ ID NO: 3023933 - RNA, 16 nt, Human
gauuucacucuccuug

SEQ ID NO: 3023934 - RNA, 13 nt, Human
gauuucacucucc

SEQ ID NO: 3023935 - RNA, 18 nt, Human
gauuucacucuccuuggu

SEQ ID NO: 3023936 - RNA, 17 nt, Human
gauuucacucuccuugg

SEQ ID NO: 3023937 - RNA, 22 nt, Human
gcacuauaauguaagcucuacu

SEQ ID NO: 3023938 - RNA, 22 nt, Human
gcacuauagccuaggugacaga

SEQ ID NO: 3023939 - RNA, 15 nt, Human
gcacuccagccuggg

SEQ ID NO: 3023940 - RNA, 17 nt, Human
gcacuccagccugggug

SEQ ID NO: 3023941 - RNA, 12 nt, Human
gcaccuccugcc

SEQ ID NO: 3023942 - RNA, 16 nt, Human
gcaccggcuggccugg

SEQ ID NO: 3023943 - RNA, 15 nt, Human
gcaccggcuggccug

SEQ ID NO: 3023944 - RNA, 17 nt, Human
gcaccggcuggccuggc

SEQ ID NO: 3023945 - RNA, 20 nt, Human
gcacacaccagagcccaccu

SEQ ID NO: 3023946 - RNA, 11 nt, Human
gcacacauuuu

SEQ ID NO: 3023947 - RNA, 12 nt, Human
gcacacauuuuu

SEQ ID NO: 3023948 - RNA, 18 nt, Human
gcaaccuccgccucuugg

SEQ ID NO: 3023949 - RNA, 22 nt, Human
gcaacccuggugaccagcacca

SEQ ID NO: 3023950 - RNA, 17 nt, Human
gcaacccccagccugcu

SEQ ID NO: 3023951 - RNA, 16 nt, Human
gcaaaagaugcuucuc

SEQ ID NO: 3023952 - RNA, 18 nt, Human
gcaacccccagccugcua

SEQ ID NO: 3023953 - RNA, 15 nt, Human
gcaaaagaugcuucu

SEQ ID NO: 3023954 - RNA, 12 nt, Human
gcacacaccaga

SEQ ID NO: 3023955 - RNA, 14 nt, Human
gcacacaccagagc

SEQ ID NO: 3023956 - RNA, 15 nt, Human
gcacacaccagagcc

SEQ ID NO: 3023957 - RNA, 16 nt, Human
gcacacaccagagccc

SEQ ID NO: 3023958 - RNA, 17 nt, Human
gcacacaccagagccca

SEQ ID NO: 3023959 - RNA, 18 nt, Human
gcacacaccagagcccac

SEQ ID NO: 3023960 - RNA, 19 nt, Human
gcacacaccagagcccacc

SEQ ID NO: 3023961 - RNA, 23 nt, Human
gcaauaaggggagaguaacccug

SEQ ID NO: 3023962 - RNA, 11 nt, Human
gcaauaaagca

SEQ ID NO: 3023963 - RNA, 12 nt, Human
gaaagggauuuu

SEQ ID NO: 3023964 - RNA, 20 nt, Human
gaaagggauuuucagcccuc

SEQ ID NO: 3023965 - RNA, 13 nt, Human
gaaagggcccaga

SEQ ID NO: 3023966 - RNA, 12 nt, Human
gaaaggcuccag

SEQ ID NO: 3023967 - RNA, 13 nt, Human
gaaaggcuccagg

SEQ ID NO: 3023968 - RNA, 15 nt, Human
gaaaggcuccaggag

SEQ ID NO: 3023969 - RNA, 14 nt, Human
gaaaggcuccagga

SEQ ID NO: 3023970 - RNA, 13 nt, Human
gaaacuggauuaa

SEQ ID NO: 3023971 - RNA, 17 nt, Human
gaaacuggauuaaacuu

SEQ ID NO: 3023972 - RNA, 21 nt, Human
gaaagaaaauaccaaggaaca

SEQ ID NO: 3023973 - RNA, 15 nt, Human
gaaagggcccagaga

SEQ ID NO: 3023974 - RNA, 16 nt, Human
gaaagggcccagagag

SEQ ID NO: 3023975 - RNA, 23 nt, Human
gaaaagaaaaaugagccuggcaa

SEQ ID NO: 3023976 - RNA, 18 nt, Human
gaaccaccacacccagcc

SEQ ID NO: 3023977 - RNA, 20 nt, Human
gaaccaccacacccagccca

SEQ ID NO: 3023978 - RNA, 21 nt, Human
gaaccaccacacccagcccac

SEQ ID NO: 3023979 - RNA, 22 nt, Human
gaaccaccacacccagcccacu

SEQ ID NO: 3023980 - RNA, 14 nt, Human
gaacuccuggccuc

SEQ ID NO: 3023981 - RNA, 13 nt, Human
gaacuccuggccu

SEQ ID NO: 3023982 - RNA, 23 nt, Human
gaaccaccacacccagcccacuu

SEQ ID NO: 3023983 - RNA, 22 nt, Human
gaaccauggucggaaaacaugc

SEQ ID NO: 3023984 - RNA, 16 nt, Human
gaagacacugaugggc

SEQ ID NO: 3023985 - RNA, 21 nt, Human
gaagacacugaugggcaaccc

SEQ ID NO: 3023986 - RNA, 13 nt, Human
gaagacagcucuu

SEQ ID NO: 3023987 - RNA, 12 nt, Human
gaagacagcucu

SEQ ID NO: 3023988 - RNA, 15 nt, Human
gaagacagagcuaca

SEQ ID NO: 3023989 - RNA, 13 nt, Human
gaagacagagcua

SEQ ID NO: 3023990 - RNA, 15 nt, Human
gaagacagcucuuau

SEQ ID NO: 3023991 - RNA, 14 nt, Human
gaagacagcucuua

SEQ ID NO: 3023992 - RNA, 21 nt, Human
gaagcacaugccucucucagg

SEQ ID NO: 3023993 - RNA, 16 nt, Human
gaagcaccauaacuuu

SEQ ID NO: 3023994 - RNA, 13 nt, Human
gaagcacagcuuc

SEQ ID NO: 3023995 - RNA, 14 nt, Human
gaagcacagcuuca

SEQ ID NO: 3023996 - RNA, 22 nt, Human
gaagcacaugccucucucaggc

SEQ ID NO: 3023997 - RNA, 17 nt, Human
gaagacucauucuucug

SEQ ID NO: 3023998 - RNA, 18 nt, Human
gaagacucauucuucugu

SEQ ID NO: 3023999 - RNA, 16 nt, Human
gaagacucauucuucu

SEQ ID NO: 3024000 - RNA, 22 nt, Human
cuugugaauaaagagggugggu

SEQ ID NO: 3024001 - RNA, 18 nt, Human
cuugucuuuggacccuga

SEQ ID NO: 3024002 - RNA, 15 nt, Human
cuugucuuuggaccc

SEQ ID NO: 3024003 - RNA, 13 nt, Human
cuugucuuuggac

SEQ ID NO: 3024004 - RNA, 19 nt, Human
cuuggugucgggcaugaca

SEQ ID NO: 3024005 - RNA, 22 nt, Human
cuugguagaagcccuucuaccu

SEQ ID NO: 3024006 - RNA, 14 nt, Human
cuugguccugcugc

SEQ ID NO: 3024007 - RNA, 20 nt, Human
cuuuaccaauugaaguaaaa

SEQ ID NO: 3024008 - RNA, 19 nt, Human
cuuuaccaauugaaguaaa

SEQ ID NO: 3024009 - RNA, 16 nt, Human
cuuuaccaauugaagu

SEQ ID NO: 3024010 - RNA, 18 nt, Human
cuuuaccaauugaaguaa

SEQ ID NO: 3024011 - RNA, 20 nt, Human
cuuucacccuuuucuguuug

SEQ ID NO: 3024012 - RNA, 15 nt, Human
cuuucacccuuuucu

SEQ ID NO: 3024013 - RNA, 14 nt, Human
cuuucacccuuuuc

SEQ ID NO: 3024014 - RNA, 23 nt, Human
cuuuaaugucacaggcaggucca

SEQ ID NO: 3024015 - RNA, 13 nt, Human
cuuugguuauuuu

SEQ ID NO: 3024016 - RNA, 19 nt, Human
cuuugguuauuuuacuuuu

SEQ ID NO: 3024017 - RNA, 17 nt, Human
cuuugguuauuuuacuu

SEQ ID NO: 3024018 - RNA, 23 nt, Human
cuuugguuauuuuacuuuuugga

SEQ ID NO: 3024019 - RNA, 17 nt, Human
cuuuguauucucuccug

SEQ ID NO: 3024020 - RNA, 19 nt, Human
cuuuuauaaacuuuaccuu

SEQ ID NO: 3024021 - RNA, 22 nt, Human
cuuuguauucucuccuguaccu

SEQ ID NO: 3024022 - RNA, 20 nt, Human
cuuuuauaaacuuuaccuuu

SEQ ID NO: 3024023 - RNA, 21 nt, Human
cuuuuauaaacuuuaccuuuu

SEQ ID NO: 3024024 - RNA, 15 nt, Human
cuuucuacccagcga

SEQ ID NO: 3024025 - RNA, 16 nt, Human
cuuucuacccagcgag

SEQ ID NO: 3024026 - RNA, 17 nt, Human
cuuugacgccaucccag

SEQ ID NO: 3024027 - RNA, 16 nt, Human
cuuugacgccauccca

SEQ ID NO: 3024028 - RNA, 22 nt, Human
cuuggauuguccccgacccuug

SEQ ID NO: 3024029 - RNA, 24 nt, Human
cuuggauuguccccgacccuugcc

SEQ ID NO: 3024030 - RNA, 23 nt, Human
cuuggauuguccccgacccuugc

SEQ ID NO: 3024031 - RNA, 12 nt, Human
cuugauucauaa

SEQ ID NO: 3024032 - RNA, 12 nt, Human
cuugcaaaguau

SEQ ID NO: 3024033 - RNA, 18 nt, Human
cuugauguguuaucucuu

SEQ ID NO: 3024034 - RNA, 15 nt, Human
cuugauguguuaucu

SEQ ID NO: 3024035 - RNA, 17 nt, Human
cuugauauccucuuuga

SEQ ID NO: 3024036 - RNA, 22 nt, Human
cuugauauccucuuugagugaa

SEQ ID NO: 3024037 - RNA, 20 nt, Human
cuugacagggcacaccgggc

SEQ ID NO: 3024038 - RNA, 16 nt, Human
cuugacaucaacugca

SEQ ID NO: 3024039 - RNA, 14 nt, Human
cuucuucagagacu

SEQ ID NO: 3024040 - RNA, 13 nt, Human
cuucuucagagac

SEQ ID NO: 3024041 - RNA, 23 nt, Human
cuucugaacuuggcgcugccccu

SEQ ID NO: 3024042 - RNA, 13 nt, Human
cuuccuccuggug

SEQ ID NO: 3024043 - RNA, 22 nt, Human
cuuccucuuuccaucuacccuc

SEQ ID NO: 3024044 - RNA, 21 nt, Human
cuuccucuuuccaucuacccu

SEQ ID NO: 3024045 - RNA, 17 nt, Human
cugucggagcccugucu

SEQ ID NO: 3024046 - RNA, 15 nt, Human
cugucgcccagucug

SEQ ID NO: 3024047 - RNA, 16 nt, Human
cugucgcccagucugg

SEQ ID NO: 3024048 - RNA, 21 nt, Human
cuguccugggagugagcuggu

SEQ ID NO: 3024049 - RNA, 20 nt, Human
cugucaauuacaggaaguac

SEQ ID NO: 3024050 - RNA, 19 nt, Human
cugucaauuacaggaagua

SEQ ID NO: 3024051 - RNA, 23 nt, Human
cugucaauuacaggaaguacugg

SEQ ID NO: 3024052 - RNA, 13 nt, Human
cuguagaguggga

SEQ ID NO: 3024053 - RNA, 12 nt, Human
cugugcugcccu

SEQ ID NO: 3024054 - RNA, 14 nt, Human
cugugcugcccugc

SEQ ID NO: 3024055 - RNA, 13 nt, Human
cugugcugcccug

SEQ ID NO: 3024056 - RNA, 18 nt, Human
cugugccucugggacugg

SEQ ID NO: 3024057 - RNA, 19 nt, Human
cugugucagcauagaagua

SEQ ID NO: 3024058 - RNA, 17 nt, Human
cugugucagcauagaag

SEQ ID NO: 3024059 - RNA, 19 nt, Human
cugugcugcccugcccacc

SEQ ID NO: 3024060 - RNA, 18 nt, Human
cugugcugcccugcccac

SEQ ID NO: 3024061 - RNA, 17 nt, Human
cugugcugcccugccca

SEQ ID NO: 3024062 - RNA, 15 nt, Human
cugugcugcccugcc

SEQ ID NO: 3024063 - RNA, 21 nt, Human
cuuagggaaggauacaaaagc

SEQ ID NO: 3024064 - RNA, 19 nt, Human
cuuagggaaggauacaaaa

SEQ ID NO: 3024065 - RNA, 21 nt, Human
cuuagcagggaaacagcuaau

SEQ ID NO: 3024066 - RNA, 16 nt, Human
cuuaccagcagagcac

SEQ ID NO: 3024067 - RNA, 22 nt, Human
cuuagcucauucuccuuguguu

SEQ ID NO: 3024068 - RNA, 23 nt, Human
cuuagcucauucuccuuguguua

SEQ ID NO: 3024069 - RNA, 14 nt, Human
cuguuggcuggggg

SEQ ID NO: 3024070 - RNA, 19 nt, Human
cuguuggcugggggccuca

SEQ ID NO: 3024071 - RNA, 22 nt, Human
cuguuggcugggggccucagug

SEQ ID NO: 3024072 - RNA, 15 nt, Human
cuuaccagcagagca

SEQ ID NO: 3024073 - RNA, 14 nt, Human
cuuaaaacaacacu

SEQ ID NO: 3024074 - RNA, 18 nt, Human
cuggauaguccgucucug

SEQ ID NO: 3024075 - RNA, 19 nt, Human
cuggauaguccgucucugc

SEQ ID NO: 3024076 - RNA, 19 nt, Human
cugcuuuugucuaugggac

SEQ ID NO: 3024077 - RNA, 21 nt, Human
cugcuuuugucuaugggacuc

SEQ ID NO: 3024078 - RNA, 19 nt, Human
cugcuuuuuaaagaaugcu

SEQ ID NO: 3024079 - RNA, 14 nt, Human
cuggagaaaaugga

SEQ ID NO: 3024080 - RNA, 14 nt, Human
cugcuucaaauauu

SEQ ID NO: 3024081 - RNA, 20 nt, Human
cugcuucaaggauccugagc

SEQ ID NO: 3024082 - RNA, 20 nt, Human
cugcuuuugucuaugggacu

SEQ ID NO: 3024083 - RNA, 23 nt, Human
cugcuucaaggauccugagccag

SEQ ID NO: 3024084 - RNA, 22 nt, Human
cugcuucaaggauccugagcca

SEQ ID NO: 3024085 - RNA, 21 nt, Human
cugcuucaaggauccugagcc

SEQ ID NO: 3024086 - RNA, 13 nt, Human
cugcuucaaggau

SEQ ID NO: 3024087 - RNA, 12 nt, Human
cugcuucaagga

SEQ ID NO: 3024088 - RNA, 19 nt, Human
cugcuucaaauauuucccu

SEQ ID NO: 3024089 - RNA, 21 nt, Human
cugcugacuguuuucucuuga

SEQ ID NO: 3024090 - RNA, 18 nt, Human
cugcugacuguuuucucu

SEQ ID NO: 3024091 - RNA, 22 nt, Human
cugccuguugggccaggagccu

SEQ ID NO: 3024092 - RNA, 21 nt, Human
cugccuguugggccaggagcc

SEQ ID NO: 3024093 - RNA, 17 nt, Human
cugccuguucagcucca

SEQ ID NO: 3024094 - RNA, 18 nt, Human
cugccuguucagcuccag

SEQ ID NO: 3024095 - RNA, 19 nt, Human
cugccuguucagcuccagc

SEQ ID NO: 3024096 - RNA, 20 nt, Human
cugccuguugggccaggagc

SEQ ID NO: 3024097 - RNA, 15 nt, Human
cugccucucccauca

SEQ ID NO: 3024098 - RNA, 22 nt, Human
cugccucucccaucacuucccu

SEQ ID NO: 3024099 - RNA, 23 nt, Human
cugccucucccaucacuucccua

SEQ ID NO: 3024100 - RNA, 18 nt, Human
cuggcagaguugaagaca

SEQ ID NO: 3024101 - RNA, 17 nt, Human
cuggcagaguugaagac

SEQ ID NO: 3024102 - RNA, 12 nt, Human
cuggcagccccu

SEQ ID NO: 3024103 - RNA, 11 nt, Human
cuggcagccca

SEQ ID NO: 3024104 - RNA, 11 nt, Human
cugggacacag

SEQ ID NO: 3024105 - RNA, 14 nt, Human
cuggccuagcauac

SEQ ID NO: 3024106 - RNA, 22 nt, Human
cuggccccucagggucccuggu

SEQ ID NO: 3024107 - RNA, 15 nt, Human
cugggcagaaggaag

SEQ ID NO: 3024108 - RNA, 12 nt, Human
cugggcagaagg

SEQ ID NO: 3024109 - RNA, 14 nt, Human
cuggggagaaagua

SEQ ID NO: 3024110 - RNA, 18 nt, Human
cuggguucacugcaaccu

SEQ ID NO: 3024111 - RNA, 20 nt, Human
cuggguucacugcaaccucc

SEQ ID NO: 3024112 - RNA, 15 nt, Human
cuggguucacugcaa

SEQ ID NO: 3024113 - RNA, 14 nt, Human
auuauguuaauauu

SEQ ID NO: 3024114 - RNA, 16 nt, Human
auuauguuaauauuuc

SEQ ID NO: 3024115 - RNA, 13 nt, Human
auuauguuaauau

SEQ ID NO: 3024116 - RNA, 17 nt, Human
auuauguuaauauuucu

SEQ ID NO: 3024117 - RNA, 14 nt, Human
auuaucuagauacu

SEQ ID NO: 3024118 - RNA, 18 nt, Human
auuaucuagauacuguau

SEQ ID NO: 3024119 - RNA, 11 nt, Human
auucagacagc

SEQ ID NO: 3024120 - RNA, 13 nt, Human
auucagacagcug

SEQ ID NO: 3024121 - RNA, 12 nt, Human
auucagacagcu

SEQ ID NO: 3024122 - RNA, 12 nt, Human
auucaggaagcu

SEQ ID NO: 3024123 - RNA, 18 nt, Human
auucagacagcugccugg

SEQ ID NO: 3024124 - RNA, 17 nt, Human
auucagacagcugccug

SEQ ID NO: 3024125 - RNA, 16 nt, Human
auucagacagcugccu

SEQ ID NO: 3024126 - RNA, 15 nt, Human
auucagacagcugcc

SEQ ID NO: 3024127 - RNA, 14 nt, Human
auucagacagcugc

SEQ ID NO: 3024128 - RNA, 13 nt, Human
auucaggaagcuc

SEQ ID NO: 3024129 - RNA, 16 nt, Human
auuauauucauucuuu

SEQ ID NO: 3024130 - RNA, 17 nt, Human
uuuguggaaaauaacuc

SEQ ID NO: 3024131 - RNA, 19 nt, Human
auucagacagcugccuggg

SEQ ID NO: 3024132 - RNA, 13 nt, Human
auugaagcagagu

SEQ ID NO: 3024133 - RNA, 15 nt, Human
auugaagcagagugg

SEQ ID NO: 3024134 - RNA, 14 nt, Human
auugaagcagagug

SEQ ID NO: 3024135 - RNA, 18 nt, Human
auugaagcagaguggcag

SEQ ID NO: 3024136 - RNA, 17 nt, Human
auugaccugaggcccuu

SEQ ID NO: 3024137 - RNA, 16 nt, Human
auucuuuuugaaaugu

SEQ ID NO: 3024138 - RNA, 14 nt, Human
auucuuaaauaugu

SEQ ID NO: 3024139 - RNA, 12 nt, Human
auugaaaucuuu

SEQ ID NO: 3024140 - RNA, 20 nt, Human
auugaaaucuuuuugcuuug

SEQ ID NO: 3024141 - RNA, 18 nt, Human
auugaaaucuuuuugcuu

SEQ ID NO: 3024142 - RNA, 17 nt, Human
auugaaaucuuuuugcu

SEQ ID NO: 3024143 - RNA, 17 nt, Human
auucucauuugucacac

SEQ ID NO: 3024144 - RNA, 11 nt, Human
auucugccugc

SEQ ID NO: 3024145 - RNA, 13 nt, Human
auucugccugccc

SEQ ID NO: 3024146 - RNA, 14 nt, Human
auucugccugccca

SEQ ID NO: 3024147 - RNA, 15 nt, Human
auucugccugcccag

SEQ ID NO: 3024148 - RNA, 16 nt, Human
auucugccugcccagg

SEQ ID NO: 3024149 - RNA, 17 nt, Human
auucugccugcccaggc

SEQ ID NO: 3024150 - RNA, 18 nt, Human
auucugccugcccaggcc

SEQ ID NO: 3024151 - RNA, 19 nt, Human
auucugccugcccaggccc

SEQ ID NO: 3024152 - RNA, 18 nt, Human
auucugcucacauaucug

SEQ ID NO: 3024153 - RNA, 20 nt, Human
auucugccugcccaggcccc

SEQ ID NO: 3024154 - RNA, 21 nt, Human
auucugccugcccaggccccu

SEQ ID NO: 3024155 - RNA, 19 nt, Human
auucugcucacauaucugu

SEQ ID NO: 3024156 - RNA, 20 nt, Human
auucugcucacauaucuguc

SEQ ID NO: 3024157 - RNA, 21 nt, Human
auucugcucacauaucuguca

SEQ ID NO: 3024158 - RNA, 22 nt, Human
auucugcucacauaucugucau

SEQ ID NO: 3024159 - RNA, 19 nt, Human
auucuguuggccaguguga

SEQ ID NO: 3024160 - RNA, 21 nt, Human
auucuguuggccagugugaca

SEQ ID NO: 3024161 - RNA, 14 nt, Human
auucuguuggccag

SEQ ID NO: 3024162 - RNA, 19 nt, Human
auuuuugguauuugaaaca

SEQ ID NO: 3024163 - RNA, 22 nt, Human
auuuuucuuagggaaggauaca

SEQ ID NO: 3024164 - RNA, 21 nt, Human
auuuuucuuagggaaggauac

SEQ ID NO: 3024165 - RNA, 19 nt, Human
auuuuuguuuuuauuaaaa

SEQ ID NO: 3024166 - RNA, 21 nt, Human
auuuuuguuuuuauuaaaagg

SEQ ID NO: 3024167 - RNA, 13 nt, Human
auuuuuuaaaugc

SEQ ID NO: 3024168 - RNA, 14 nt, Human
auuuuuuaaaugca

SEQ ID NO: 3024169 - RNA, 19 nt, Human
auuuuuguagagccagggu

SEQ ID NO: 3024170 - RNA, 12 nt, Human
auuuuuguaauu

SEQ ID NO: 3024171 - RNA, 20 nt, Human
auuuuggaaaauaaauuauu

SEQ ID NO: 3024172 - RNA, 14 nt, Human
auuuuggaaaauaa

SEQ ID NO: 3024173 - RNA, 19 nt, Human
auuuuggaaaauaaauuau

SEQ ID NO: 3024174 - RNA, 18 nt, Human
auuuugcuuugugauuuu

SEQ ID NO: 3024175 - RNA, 20 nt, Human
auuuugcuuugugauuuuug

SEQ ID NO: 3024176 - RNA, 12 nt, Human
auuuugcuuugu

SEQ ID NO: 3024177 - RNA, 19 nt, Human
auuuugugcccccauguaa

SEQ ID NO: 3024178 - RNA, 23 nt, Human
auuuugucauauaagauucauau

SEQ ID NO: 3024179 - RNA, 20 nt, Human
auuuugcuaaaugugaauga

SEQ ID NO: 3024180 - RNA, 21 nt, Human
auuuugcugucccuuuuccuu

SEQ ID NO: 3024181 - RNA, 18 nt, Human
auuuugauccaagcuggu

SEQ ID NO: 3024182 - RNA, 19 nt, Human
auuuugauccaagcugguc

SEQ ID NO: 3024183 - RNA, 15 nt, Human
auuuugauguuuuaa

SEQ ID NO: 3024184 - RNA, 17 nt, Human
auuuugauguuuuaagg

SEQ ID NO: 3024185 - RNA, 16 nt, Human
auuuuccugccaggca

SEQ ID NO: 3024186 - RNA, 19 nt, Human
auuuucccuauuagagaag

SEQ ID NO: 3024187 - RNA, 17 nt, Human
auuugaaacacugguuu

SEQ ID NO: 3024188 - RNA, 14 nt, Human
auuugaaacacugg

SEQ ID NO: 3024189 - RNA, 16 nt, Human
auuugaaaauuuugau

SEQ ID NO: 3024190 - RNA, 15 nt, Human
auuugaaaauuuuga

SEQ ID NO: 3024191 - RNA, 16 nt, Human
auuucuuccacaagag

SEQ ID NO: 3024192 - RNA, 23 nt, Human
auuucuuccacaagagcccaggc

SEQ ID NO: 3024193 - RNA, 20 nt, Human
auuucuuccacaagagccca

SEQ ID NO: 3024194 - RNA, 16 nt, Human
auuuauuuauuuauuc

SEQ ID NO: 3024195 - RNA, 12 nt, Human
auuuauuuaaau

SEQ ID NO: 3024196 - RNA, 14 nt, Human
auuuauuuaaauuu

SEQ ID NO: 3024197 - RNA, 19 nt, Human
auuucccaaagcagugcau

SEQ ID NO: 3024198 - RNA, 22 nt, Human
auuuuaaaaauacagauagaua

SEQ ID NO: 3024199 - RNA, 23 nt, Human
auugauugggcacaucauuucaa

SEQ ID NO: 3024200 - RNA, 19 nt, Human
auugauugggcacaucauu

SEQ ID NO: 3024201 - RNA, 21 nt, Human
auugauuuccguuaaaauacc

SEQ ID NO: 3024202 - RNA, 17 nt, Human
auuuaaaagauacaguu

SEQ ID NO: 3024203 - RNA, 14 nt, Human
auuuaaaagauaca

SEQ ID NO: 3024204 - RNA, 16 nt, Human
auuuaaaagauacagu

SEQ ID NO: 3024205 - RNA, 13 nt, Human
auuuaaaagauac

SEQ ID NO: 3024206 - RNA, 21 nt, Human
auuguuuggggaugagaaagg

SEQ ID NO: 3024207 - RNA, 16 nt, Human
auugucaaagugguga

SEQ ID NO: 3024208 - RNA, 23 nt, Human
auugucaaaguggugagaggcau

SEQ ID NO: 3024209 - RNA, 13 nt, Human
auugugggaaggg

SEQ ID NO: 3024210 - RNA, 14 nt, Human
auugugggaagggg

SEQ ID NO: 3024211 - RNA, 14 nt, Human
uuucaaauguucuc

SEQ ID NO: 3024212 - RNA, 18 nt, Human
uuuccaugaguccccugu

SEQ ID NO: 3024213 - RNA, 17 nt, Human
uuuccaugaguccccug

SEQ ID NO: 3024214 - RNA, 19 nt, Human
auggacuaacuugucuuug

SEQ ID NO: 3024215 - RNA, 12 nt, Human
auggacuuuguu

SEQ ID NO: 3024216 - RNA, 11 nt, Human
auggacuuugu

SEQ ID NO: 3024217 - RNA, 15 nt, Human
augggagagaagaga

SEQ ID NO: 3024218 - RNA, 19 nt, Human
augggagagaagagaaugc

SEQ ID NO: 3024219 - RNA, 18 nt, Human
auggcuaauguacugcau

SEQ ID NO: 3024220 - RNA, 15 nt, Human
uuucaaacuuuacua

SEQ ID NO: 3024221 - RNA, 22 nt, Human
uuucaaacuuuacuauggcccu

SEQ ID NO: 3024222 - RNA, 16 nt, Human
uuucaaacuuuacuau

SEQ ID NO: 3024223 - RNA, 22 nt, Human
augcugugcccuaaaguguauu

SEQ ID NO: 3024224 - RNA, 13 nt, Human
augcuucucacug

SEQ ID NO: 3024225 - RNA, 19 nt, Human
augauugccuuuuuauaac

SEQ ID NO: 3024226 - RNA, 22 nt, Human
augcaccagcccuuagcaggga

SEQ ID NO: 3024227 - RNA, 13 nt, Human
augcaccuggaau

SEQ ID NO: 3024228 - RNA, 14 nt, Human
augcaccagcccuu

SEQ ID NO: 3024229 - RNA, 16 nt, Human
augcacuuuguucugg

SEQ ID NO: 3024230 - RNA, 17 nt, Human
augcacuuuguucuggc

SEQ ID NO: 3024231 - RNA, 20 nt, Human
augcacuuuguucuggcucu

SEQ ID NO: 3024232 - RNA, 19 nt, Human
augcacuuuguucuggcuc

SEQ ID NO: 3024233 - RNA, 17 nt, Human
uuuaaagauguagacag

SEQ ID NO: 3024234 - RNA, 13 nt, Human
uuuaaagaaugcu

SEQ ID NO: 3024235 - RNA, 18 nt, Human
uuguuuugccaauuugca

SEQ ID NO: 3024236 - RNA, 23 nt, Human
uuuaaaaauacagauagauauau

SEQ ID NO: 3024237 - RNA, 16 nt, Human
augauauaagguuuuu

SEQ ID NO: 3024238 - RNA, 15 nt, Human
augaucuaggaagac

SEQ ID NO: 3024239 - RNA, 20 nt, Human
augaucuaggaagacuuugg

SEQ ID NO: 3024240 - RNA, 17 nt, Human
augaucuaggaagacuu

SEQ ID NO: 3024241 - RNA, 21 nt, Human
uuguuccacaaguuaaauaaa

SEQ ID NO: 3024242 - RNA, 13 nt, Human
uuguguuacuaag

SEQ ID NO: 3024243 - RNA, 15 nt, Human
uuguguuacuaaguu

SEQ ID NO: 3024244 - RNA, 20 nt, Human
uuguguuacuaaguuuuuau

SEQ ID NO: 3024245 - RNA, 20 nt, Human
uuguucuugguuuguaaauu

SEQ ID NO: 3024246 - RNA, 15 nt, Human
uuuaaauagaugaca

SEQ ID NO: 3024247 - RNA, 18 nt, Human
augcagccucacaguccu

SEQ ID NO: 3024248 - RNA, 17 nt, Human
augcagccucacagucc

SEQ ID NO: 3024249 - RNA, 19 nt, Human
uuuaauuuuuuugagacag

SEQ ID NO: 3024250 - RNA, 14 nt, Human
augcccagccccuu

SEQ ID NO: 3024251 - RNA, 13 nt, Human
augcccagccccu

SEQ ID NO: 3024252 - RNA, 12 nt, Human
augcccagcccc

SEQ ID NO: 3024253 - RNA, 11 nt, Human
augcccagccc

SEQ ID NO: 3024254 - RNA, 23 nt, Human
augcagugguaugaucacggcuc

SEQ ID NO: 3024255 - RNA, 13 nt, Human
augcagugcuucc

SEQ ID NO: 3024256 - RNA, 18 nt, Human
auguagacaguuggguuu

SEQ ID NO: 3024257 - RNA, 20 nt, Human
auguagacaguuggguuuuu

SEQ ID NO: 3024258 - RNA, 12 nt, Human
uuugaccucugc

SEQ ID NO: 3024259 - RNA, 22 nt, Human
uuugauguucuuucacccuuuu

SEQ ID NO: 3024260 - RNA, 13 nt, Human
uuugauuaaauuc

SEQ ID NO: 3024261 - RNA, 18 nt, Human
uuugauuaaauucuugca

SEQ ID NO: 3024262 - RNA, 21 nt, Human
uuugauuaaauucuugcaaag

SEQ ID NO: 3024263 - RNA, 21 nt, Human
uuugauucagacagcugccug

SEQ ID NO: 3024264 - RNA, 20 nt, Human
uuugacgccaucccagcccc

SEQ ID NO: 3024265 - RNA, 19 nt, Human
uuugacgccaucccagccc

SEQ ID NO: 3024266 - RNA, 16 nt, Human
uuugacgccaucccag

SEQ ID NO: 3024267 - RNA, 14 nt, Human
uuugacgccauccc

SEQ ID NO: 3024268 - RNA, 13 nt, Human
uuugacgccaucc

SEQ ID NO: 3024269 - RNA, 22 nt, Human
uuugauucagacagcugccugg

SEQ ID NO: 3024270 - RNA, 15 nt, Human
uuugccguuauuaaa

SEQ ID NO: 3024271 - RNA, 13 nt, Human
uuugccucugccu

SEQ ID NO: 3024272 - RNA, 16 nt, Human
augucaguauuucaac

SEQ ID NO: 3024273 - RNA, 13 nt, Human
augucaguauuuc

SEQ ID NO: 3024274 - RNA, 16 nt, Human
auguauguguaaguau

SEQ ID NO: 3024275 - RNA, 15 nt, Human
auguauguguaagua

SEQ ID NO: 3024276 - RNA, 13 nt, Human
augucagugugac

SEQ ID NO: 3024277 - RNA, 12 nt, Human
augucaguguga

SEQ ID NO: 3024278 - RNA, 19 nt, Human
augugcacaucuguuuugu

SEQ ID NO: 3024279 - RNA, 23 nt, Human
augugcacaugcacgugugugca

SEQ ID NO: 3024280 - RNA, 19 nt, Human
augugaugagaggaaauca

SEQ ID NO: 3024281 - RNA, 17 nt, Human
augugaugagaggaaau

SEQ ID NO: 3024282 - RNA, 15 nt, Human
augugaugagaggaa

SEQ ID NO: 3024283 - RNA, 16 nt, Human
augugaugagaggaaa

SEQ ID NO: 3024284 - RNA, 14 nt, Human
augguuuucuugug

SEQ ID NO: 3024285 - RNA, 16 nt, Human
augguuuucaaaauaa

SEQ ID NO: 3024286 - RNA, 14 nt, Human
augguuuucaaaau

SEQ ID NO: 3024287 - RNA, 15 nt, Human
augguuuucaaaaua

SEQ ID NO: 3024288 - RNA, 12 nt, Human
augguggcuggg

SEQ ID NO: 3024289 - RNA, 13 nt, Human
augguggcugggu

SEQ ID NO: 3024290 - RNA, 15 nt, Human
augguggcuggguug

SEQ ID NO: 3024291 - RNA, 17 nt, Human
augguggcuggguugga

SEQ ID NO: 3024292 - RNA, 20 nt, Human
auggugagggauacccaucc

SEQ ID NO: 3024293 - RNA, 15 nt, Human
augggugcuuggagg

SEQ ID NO: 3024294 - RNA, 15 nt, Human
auggugcaaugaccu

SEQ ID NO: 3024295 - RNA, 13 nt, Human
auggugcaaugac

SEQ ID NO: 3024296 - RNA, 12 nt, Human
auggugcaauga

SEQ ID NO: 3024297 - RNA, 17 nt, Human
auggugcaaugaccuuu

SEQ ID NO: 3024298 - RNA, 16 nt, Human
auggugcaaugaccuu

SEQ ID NO: 3024299 - RNA, 19 nt, Human
auggugcaaugaccuuuca

SEQ ID NO: 3024300 - RNA, 19 nt, Human
uuucugcagccacuauugu

SEQ ID NO: 3024301 - RNA, 15 nt, Human
uuucuggcuaugcau

SEQ ID NO: 3024302 - RNA, 16 nt, Human
uuucuggcuaugcauu

SEQ ID NO: 3024303 - RNA, 18 nt, Human
uuucuggcuaugcauuug

SEQ ID NO: 3024304 - RNA, 19 nt, Human
uuucuggcuaugcauuuga

SEQ ID NO: 3024305 - RNA, 15 nt, Human
augggauccuggagu

SEQ ID NO: 3024306 - RNA, 15 nt, Human
augggggugcauuug

SEQ ID NO: 3024307 - RNA, 14 nt, Human
augggggugcauuu

SEQ ID NO: 3024308 - RNA, 24 nt, Human
auggggcugcaccggcuggccugg

SEQ ID NO: 3024309 - RNA, 12 nt, Human
auggggcugcac

SEQ ID NO: 3024310 - RNA, 20 nt, Human
augggcuggguucuacccag

SEQ ID NO: 3024311 - RNA, 18 nt, Human
augggccuccugugugug

SEQ ID NO: 3024312 - RNA, 17 nt, Human
augggccuccugugugu

SEQ ID NO: 3024313 - RNA, 15 nt, Human
uucccucaaaugugu

SEQ ID NO: 3024314 - RNA, 20 nt, Human
uucccucaccuuucccaucu

SEQ ID NO: 3024315 - RNA, 15 nt, Human
uucccuauuagagaa

SEQ ID NO: 3024316 - RNA, 14 nt, Human
uuccguuaaaauac

SEQ ID NO: 3024317 - RNA, 16 nt, Human
uuccguuaaaauacca

SEQ ID NO: 3024318 - RNA, 17 nt, Human
uuccuaauccucuagga

SEQ ID NO: 3024319 - RNA, 14 nt, Human
uuccugaaccgaug

SEQ ID NO: 3024320 - RNA, 17 nt, Human
uuccucuuuccaucuac

SEQ ID NO: 3024321 - RNA, 22 nt, Human
uuccucuuuccaucuacccucc

SEQ ID NO: 3024322 - RNA, 13 nt, Human
uuccucuuuccau

SEQ ID NO: 3024323 - RNA, 18 nt, Human
aucacggcucacugcagc

SEQ ID NO: 3024324 - RNA, 19 nt, Human
aucacggcucacugcagcc

SEQ ID NO: 3024325 - RNA, 13 nt, Human
aucacgccacugc

SEQ ID NO: 3024326 - RNA, 15 nt, Human
aucacggcucacugc

SEQ ID NO: 3024327 - RNA, 14 nt, Human
aucaaugaguaaca

SEQ ID NO: 3024328 - RNA, 11 nt, Human
uuccugugucu

SEQ ID NO: 3024329 - RNA, 21 nt, Human
aucaagaugugacauguuuua

SEQ ID NO: 3024330 - RNA, 19 nt, Human
uucuagcaugaagacagag

SEQ ID NO: 3024331 - RNA, 16 nt, Human
uucuagcauggcugcc

SEQ ID NO: 3024332 - RNA, 15 nt, Human
uucgcuccugugucu

SEQ ID NO: 3024333 - RNA, 19 nt, Human
uucgcuccugugucuugca

SEQ ID NO: 3024334 - RNA, 21 nt, Human
uucuaaaucuccaaaauaaaa

SEQ ID NO: 3024335 - RNA, 19 nt, Human
uucuaaaucuccaaaauaa

SEQ ID NO: 3024336 - RNA, 19 nt, Human
uucuaaaggcuaccuuugu

SEQ ID NO: 3024337 - RNA, 20 nt, Human
uucuaaaggcuaccuuugua

SEQ ID NO: 3024338 - RNA, 21 nt, Human
uucuaaaggcuaccuuuguau

SEQ ID NO: 3024339 - RNA, 12 nt, Human
aucagaauucuc

SEQ ID NO: 3024340 - RNA, 18 nt, Human
aucaggccaggcccucug

SEQ ID NO: 3024341 - RNA, 16 nt, Human
aucaggccaggcccuc

SEQ ID NO: 3024342 - RNA, 15 nt, Human
aucaggccaggcccu

SEQ ID NO: 3024343 - RNA, 13 nt, Human
aucagcacgauuu

SEQ ID NO: 3024344 - RNA, 14 nt, Human
aucaggccaggccc

SEQ ID NO: 3024345 - RNA, 11 nt, Human
aucagaauucu

SEQ ID NO: 3024346 - RNA, 14 nt, Human
uugaaaugauuuca

SEQ ID NO: 3024347 - RNA, 16 nt, Human
auccuccucagaucuu

SEQ ID NO: 3024348 - RNA, 16 nt, Human
auccuaggcauuugcu

SEQ ID NO: 3024349 - RNA, 12 nt, Human
auccuaagcuau

SEQ ID NO: 3024350 - RNA, 20 nt, Human
uucuucugcuucagccuccc

SEQ ID NO: 3024351 - RNA, 13 nt, Human
uucuucugcuuca

SEQ ID NO: 3024352 - RNA, 15 nt, Human
uucuucugcuucagc

SEQ ID NO: 3024353 - RNA, 14 nt, Human
uucuucucccucag

SEQ ID NO: 3024354 - RNA, 11 nt, Human
uucuucucccu

SEQ ID NO: 3024355 - RNA, 13 nt, Human
uucuucucccuca

SEQ ID NO: 3024356 - RNA, 24 nt, Human
aucccauaugccugggcagaagga

SEQ ID NO: 3024357 - RNA, 14 nt, Human
aucccucauccuca

SEQ ID NO: 3024358 - RNA, 13 nt, Human
aucccucauccuc

SEQ ID NO: 3024359 - RNA, 23 nt, Human
aucccucauccucauacccaccc

SEQ ID NO: 3024360 - RNA, 21 nt, Human
aucccucauccucauacccac

SEQ ID NO: 3024361 - RNA, 18 nt, Human
auccaagcuggucccacu

SEQ ID NO: 3024362 - RNA, 13 nt, Human
auccacccaccuc

SEQ ID NO: 3024363 - RNA, 15 nt, Human
auccacccaccucag

SEQ ID NO: 3024364 - RNA, 16 nt, Human
auccaguaucuugaag

SEQ ID NO: 3024365 - RNA, 15 nt, Human
auccaguaucuugaa

SEQ ID NO: 3024366 - RNA, 18 nt, Human
aucccauaugccugggca

SEQ ID NO: 3024367 - RNA, 12 nt, Human
aucccagcccca

SEQ ID NO: 3024368 - RNA, 20 nt, Human
aucccaaacccuucagugcc

SEQ ID NO: 3024369 - RNA, 19 nt, Human
aucccaaacccuucagugc

SEQ ID NO: 3024370 - RNA, 21 nt, Human
auccaguaucuugaagacuuu

SEQ ID NO: 3024371 - RNA, 17 nt, Human
uucuggcucuuccaggc

SEQ ID NO: 3024372 - RNA, 16 nt, Human
uucuggcucuuccagg

SEQ ID NO: 3024373 - RNA, 21 nt, Human
uucugccugcccaggccccug

SEQ ID NO: 3024374 - RNA, 15 nt, Human
uucuggcucuuccag

SEQ ID NO: 3024375 - RNA, 17 nt, Human
uucugccugcccaggcc

SEQ ID NO: 3024376 - RNA, 18 nt, Human
uucugccugcccaggccc

SEQ ID NO: 3024377 - RNA, 15 nt, Human
uucugccauauucug

SEQ ID NO: 3024378 - RNA, 22 nt, Human
uucugaacuuggcgcugccccu

SEQ ID NO: 3024379 - RNA, 19 nt, Human
uucugaacuuggcgcugcc

SEQ ID NO: 3024380 - RNA, 21 nt, Human
uucuccuuguguuacuaaguu

SEQ ID NO: 3024381 - RNA, 15 nt, Human
uucucuaguuugauu

SEQ ID NO: 3024382 - RNA, 17 nt, Human
uucucuaguuugauuaa

SEQ ID NO: 3024383 - RNA, 17 nt, Human
aucugaaauaaggaaug

SEQ ID NO: 3024384 - RNA, 12 nt, Human
aucugaaaaugu

SEQ ID NO: 3024385 - RNA, 23 nt, Human
aucugaaaauguauguguaagua

SEQ ID NO: 3024386 - RNA, 13 nt, Human
uugauuaaauucu

SEQ ID NO: 3024387 - RNA, 23 nt, Human
uugauguuuuaaggaugcuugua

SEQ ID NO: 3024388 - RNA, 14 nt, Human
uugauuaaauucuu

SEQ ID NO: 3024389 - RNA, 17 nt, Human
uugcauauugcauacua

SEQ ID NO: 3024390 - RNA, 16 nt, Human
uugcaauggcagccuu

SEQ ID NO: 3024391 - RNA, 17 nt, Human
uugcaauggcagccuug

SEQ ID NO: 3024392 - RNA, 19 nt, Human
uugcaauggcagccuuggc

SEQ ID NO: 3024393 - RNA, 18 nt, Human
uugcaccacugcacucca

SEQ ID NO: 3024394 - RNA, 16 nt, Human
uugcaccacugcacuc

SEQ ID NO: 3024395 - RNA, 15 nt, Human
uugcaccacugcacu

SEQ ID NO: 3024396 - RNA, 14 nt, Human
uugcaccacugcac

SEQ ID NO: 3024397 - RNA, 15 nt, Human
aucucuugagccugg

SEQ ID NO: 3024398 - RNA, 14 nt, Human
aucugaaaauguau

SEQ ID NO: 3024399 - RNA, 16 nt, Human
aucugaaaauguaugu

SEQ ID NO: 3024400 - RNA, 19 nt, Human
aucugaaaauguaugugua

SEQ ID NO: 3024401 - RNA, 20 nt, Human
aucugaaaauguauguguaa

SEQ ID NO: 3024402 - RNA, 22 nt, Human
aucugaaaauguauguguaagu

SEQ ID NO: 3024403 - RNA, 15 nt, Human
aucucccccagcccc

SEQ ID NO: 3024404 - RNA, 14 nt, Human
aucucccccagccc

SEQ ID NO: 3024405 - RNA, 17 nt, Human
aucucccccagccccau

SEQ ID NO: 3024406 - RNA, 16 nt, Human
aucucccccagcccca

SEQ ID NO: 3024407 - RNA, 16 nt, Human
aucucagggccugguc

SEQ ID NO: 3024408 - RNA, 14 nt, Human
aucucagggccugg

SEQ ID NO: 3024409 - RNA, 14 nt, Human
aucuccaaaauaaa

SEQ ID NO: 3024410 - RNA, 17 nt, Human
aucuccaaaauaaaacu

SEQ ID NO: 3024411 - RNA, 20 nt, Human
aucuccaaaauaaaacuuuu

SEQ ID NO: 3024412 - RNA, 21 nt, Human
aucuccaaaauaaaacuuuuu

SEQ ID NO: 3024413 - RNA, 13 nt, Human
aucuccaaaauaa

SEQ ID NO: 3024414 - RNA, 21 nt, Human
uugaaggaugcugucuucgua

SEQ ID NO: 3024415 - RNA, 17 nt, Human
auccucuguacagagcc

SEQ ID NO: 3024416 - RNA, 16 nt, Human
auccucuguacagagc

SEQ ID NO: 3024417 - RNA, 17 nt, Human
aucuaaauggaaccacu

SEQ ID NO: 3024418 - RNA, 18 nt, Human
aucuaaauggaaccacuc

SEQ ID NO: 3024419 - RNA, 13 nt, Human
aucuaaauggaac

SEQ ID NO: 3024420 - RNA, 15 nt, Human
uugagaucagccugg

SEQ ID NO: 3024421 - RNA, 16 nt, Human
uugagaucagccuggg

SEQ ID NO: 3024422 - RNA, 12 nt, Human
uugagacagagu

SEQ ID NO: 3024423 - RNA, 20 nt, Human
uugaguugauucagcucugc

SEQ ID NO: 3024424 - RNA, 20 nt, Human
uugagugaagcugggagaac

SEQ ID NO: 3024425 - RNA, 18 nt, Human
aucuaauauguaacaagc

SEQ ID NO: 3024426 - RNA, 13 nt, Human
aucuugcucugcu

SEQ ID NO: 3024427 - RNA, 20 nt, Human
aucuuggucagauuugaacu

SEQ ID NO: 3024428 - RNA, 18 nt, Human
aucugugaaaggaaagag

SEQ ID NO: 3024429 - RNA, 17 nt, Human
aucugugaaaggaaaga

SEQ ID NO: 3024430 - RNA, 10 nt, Human
aucuggugac

SEQ ID NO: 3024431 - RNA, 17 nt, Human
aucuggugacuuuccuc

SEQ ID NO: 3024432 - RNA, 16 nt, Human
aucuggugacuuuccu

SEQ ID NO: 3024433 - RNA, 15 nt, Human
augaaagggcccaga

SEQ ID NO: 3024434 - RNA, 18 nt, Human
augaaagggcccagagag

SEQ ID NO: 3024435 - RNA, 17 nt, Human
aucuuugcagacaggca

SEQ ID NO: 3024436 - RNA, 22 nt, Human
aucuuuucauuuaggugaggaa

SEQ ID NO: 3024437 - RNA, 23 nt, Human
uuggcuauuagagaucaaccccu

SEQ ID NO: 3024438 - RNA, 18 nt, Human
uuggccccugcccggcug

SEQ ID NO: 3024439 - RNA, 16 nt, Human
uuggagggugucccaa

SEQ ID NO: 3024440 - RNA, 14 nt, Human
uugcuugaaagaaa

SEQ ID NO: 3024441 - RNA, 14 nt, Human
augaaaugagguca

SEQ ID NO: 3024442 - RNA, 19 nt, Human
augaaagggcccagagagg

SEQ ID NO: 3024443 - RNA, 18 nt, Human
uuggggaccagagcugcc

SEQ ID NO: 3024444 - RNA, 18 nt, Human
auaacuuuuuauauucuc

SEQ ID NO: 3024445 - RNA, 22 nt, Human
auaacuuuuuauauucucagca

SEQ ID NO: 3024446 - RNA, 14 nt, Human
auaagauucauauu

SEQ ID NO: 3024447 - RNA, 16 nt, Human
uuagaagucacacagu

SEQ ID NO: 3024448 - RNA, 15 nt, Human
uuacugcagcuuugu

SEQ ID NO: 3024449 - RNA, 12 nt, Human
uuacuguacaug

SEQ ID NO: 3024450 - RNA, 13 nt, Human
uuacuguacauga

SEQ ID NO: 3024451 - RNA, 14 nt, Human
uuacuguacaugaa

SEQ ID NO: 3024452 - RNA, 22 nt, Human
uuacuguacaugaaaacacauu

SEQ ID NO: 3024453 - RNA, 23 nt, Human
uuacuguacaugaaaacacauuu

SEQ ID NO: 3024454 - RNA, 14 nt, Human
uuacaggugugaac

SEQ ID NO: 3024455 - RNA, 19 nt, Human
uuaccagcagagcaccuua

SEQ ID NO: 3024456 - RNA, 14 nt, Human
uuaccagcagagca

SEQ ID NO: 3024457 - RNA, 13 nt, Human
uuauaaacuuuac

SEQ ID NO: 3024458 - RNA, 14 nt, Human
uuaguagagacagg

SEQ ID NO: 3024459 - RNA, 13 nt, Human
uuaguagagacag

SEQ ID NO: 3024460 - RNA, 19 nt, Human
uuaggugugggggaagcac

SEQ ID NO: 3024461 - RNA, 22 nt, Human
auaagccaaaaaaugcuugcuu

SEQ ID NO: 3024462 - RNA, 21 nt, Human
auaagauucauauuuacuucu

SEQ ID NO: 3024463 - RNA, 18 nt, Human
auaauuuaccugaagucu

SEQ ID NO: 3024464 - RNA, 15 nt, Human
aguuuuacaguguuu

SEQ ID NO: 3024465 - RNA, 22 nt, Human
aguuuguuaguaugaggcauuu

SEQ ID NO: 3024466 - RNA, 19 nt, Human
aguuucugccgcagcccug

SEQ ID NO: 3024467 - RNA, 14 nt, Human
aguuucucuuuuca

SEQ ID NO: 3024468 - RNA, 15 nt, Human
aguuucugccgcagc

SEQ ID NO: 3024469 - RNA, 15 nt, Human
aguuuaucuguucau

SEQ ID NO: 3024470 - RNA, 12 nt, Human
uuaacagaaaug

SEQ ID NO: 3024471 - RNA, 13 nt, Human
uuaacagaaaugu

SEQ ID NO: 3024472 - RNA, 14 nt, Human
uuaacagaaaugua

SEQ ID NO: 3024473 - RNA, 17 nt, Human
uuaaaaaucucaaauuu

SEQ ID NO: 3024474 - RNA, 20 nt, Human
uuaaaaaucucaaauuucua

SEQ ID NO: 3024475 - RNA, 19 nt, Human
uuaaaaaucucaaauuucu

SEQ ID NO: 3024476 - RNA, 19 nt, Human
uuaagacuuugguuauuuu

SEQ ID NO: 3024477 - RNA, 15 nt, Human
uuaaucuaaauggaa

SEQ ID NO: 3024478 - RNA, 19 nt, Human
aguuuuuuuccuucaagaa

SEQ ID NO: 3024479 - RNA, 23 nt, Human
uuaacuuuuauaaacuuuaccuu

SEQ ID NO: 3024480 - RNA, 22 nt, Human
uuaacuuuuauaaacuuuaccu

SEQ ID NO: 3024481 - RNA, 18 nt, Human
uuaacuuuuauaaacuuu

SEQ ID NO: 3024482 - RNA, 13 nt, Human
uuauguuaauauu

SEQ ID NO: 3024483 - RNA, 12 nt, Human
uuauuaugcaug

SEQ ID NO: 3024484 - RNA, 18 nt, Human
uuauucauuaguuuugaa

SEQ ID NO: 3024485 - RNA, 21 nt, Human
uuauucauuaguuuugaagau

SEQ ID NO: 3024486 - RNA, 14 nt, Human
uuauuauuaacaaa

SEQ ID NO: 3024487 - RNA, 13 nt, Human
uuauuauuaacaa

SEQ ID NO: 3024488 - RNA, 13 nt, Human
uuauuaugcauga

SEQ ID NO: 3024489 - RNA, 18 nt, Human
auacugccuuguuuaaug

SEQ ID NO: 3024490 - RNA, 20 nt, Human
auacugccuuguuuaauggu

SEQ ID NO: 3024491 - RNA, 11 nt, Human
auacucccauc

SEQ ID NO: 3024492 - RNA, 14 nt, Human
auacucccaucugu

SEQ ID NO: 3024493 - RNA, 17 nt, Human
auacuccuccaagguua

SEQ ID NO: 3024494 - RNA, 16 nt, Human
auacucugcuuagaau

SEQ ID NO: 3024495 - RNA, 14 nt, Human
auagauguugcuaa

SEQ ID NO: 3024496 - RNA, 20 nt, Human
auagauguugcuaacagcaa

SEQ ID NO: 3024497 - RNA, 14 nt, Human
auagagagagacca

SEQ ID NO: 3024498 - RNA, 23 nt, Human
auagacaauuuauuauggcacau

SEQ ID NO: 3024499 - RNA, 16 nt, Human
auagacaauuuauuau

SEQ ID NO: 3024500 - RNA, 22 nt, Human
auagacaauuuauuauggcaca

SEQ ID NO: 3024501 - RNA, 17 nt, Human
auacuauuaaacaugcu

SEQ ID NO: 3024502 - RNA, 13 nt, Human
auacuaaccagca

SEQ ID NO: 3024503 - RNA, 19 nt, Human
auacuaaccagcagaaaug

SEQ ID NO: 3024504 - RNA, 20 nt, Human
auacuaaccagcagaaaugc

SEQ ID NO: 3024505 - RNA, 19 nt, Human
auacuauuaaacaugcugu

SEQ ID NO: 3024506 - RNA, 18 nt, Human
auacuauuaaacaugcug

SEQ ID NO: 3024507 - RNA, 13 nt, Human
auacguacacauu

SEQ ID NO: 3024508 - RNA, 14 nt, Human
auacguacacauuu

SEQ ID NO: 3024509 - RNA, 15 nt, Human
auacguacacauuuu

SEQ ID NO: 3024510 - RNA, 16 nt, Human
auacguacacauuuua

SEQ ID NO: 3024511 - RNA, 14 nt, Human
auaccuuuuuuaga

SEQ ID NO: 3024512 - RNA, 17 nt, Human
auaccacuuuuguucuu

SEQ ID NO: 3024513 - RNA, 18 nt, Human
auaccacuuuuguucuug

SEQ ID NO: 3024514 - RNA, 20 nt, Human
auacauaaacaagaccacgu

SEQ ID NO: 3024515 - RNA, 20 nt, Human
auacaguuacucagaauucu

SEQ ID NO: 3024516 - RNA, 18 nt, Human
auacaguuacucagaauu

SEQ ID NO: 3024517 - RNA, 23 nt, Human
auacagauagauauaugcucugc

SEQ ID NO: 3024518 - RNA, 22 nt, Human
auacaggaaaagcugcugacag

SEQ ID NO: 3024519 - RNA, 23 nt, Human
auacaggaaaagcugcugacagu

SEQ ID NO: 3024520 - RNA, 17 nt, Human
auacagaggcaacugca

SEQ ID NO: 3024521 - RNA, 16 nt, Human
auacagaggcaacugc

SEQ ID NO: 3024522 - RNA, 17 nt, Human
uuauaaacuuuaccuuu

SEQ ID NO: 3024523 - RNA, 18 nt, Human
uuauaaacuuuaccuuuu

SEQ ID NO: 3024524 - RNA, 22 nt, Human
uuaugggcuggguucuacccag

SEQ ID NO: 3024525 - RNA, 13 nt, Human
uuaugggcugggu

SEQ ID NO: 3024526 - RNA, 19 nt, Human
uuauggcuuuugugcauua

SEQ ID NO: 3024527 - RNA, 18 nt, Human
uuauggcuuuugugcauu

SEQ ID NO: 3024528 - RNA, 17 nt, Human
uuaucacccagaagaaa

SEQ ID NO: 3024529 - RNA, 18 nt, Human
uuaucacccagaagaaaa

SEQ ID NO: 3024530 - RNA, 19 nt, Human
uuaucacccagaagaaaau

SEQ ID NO: 3024531 - RNA, 21 nt, Human
uuaucacccagaagaaaauag

SEQ ID NO: 3024532 - RNA, 11 nt, Human
uuaugacucca

SEQ ID NO: 3024533 - RNA, 15 nt, Human
agucucccuuccuau

SEQ ID NO: 3024534 - RNA, 11 nt, Human
ugugaggaagc

SEQ ID NO: 3024535 - RNA, 16 nt, Human
ugugacugaucucucg

SEQ ID NO: 3024536 - RNA, 17 nt, Human
agucucuugauucauaa

SEQ ID NO: 3024537 - RNA, 16 nt, Human
agucucuugauucaua

SEQ ID NO: 3024538 - RNA, 14 nt, Human
agucuuagauguau

SEQ ID NO: 3024539 - RNA, 16 nt, Human
agucuuagauguauau

SEQ ID NO: 3024540 - RNA, 13 nt, Human
agucuuagaugua

SEQ ID NO: 3024541 - RNA, 18 nt, Human
ugugaugagaggaaauca

SEQ ID NO: 3024542 - RNA, 19 nt, Human
ugugaugagaggaaaucac

SEQ ID NO: 3024543 - RNA, 22 nt, Human
ugugaugaugaaaugaggucag

SEQ ID NO: 3024544 - RNA, 12 nt, Human
agugagcugguu

SEQ ID NO: 3024545 - RNA, 14 nt, Human
agugagcacuaagg

SEQ ID NO: 3024546 - RNA, 22 nt, Human
agugagcacuaaggugugcucu

SEQ ID NO: 3024547 - RNA, 21 nt, Human
agugacugauggcuaauguac

SEQ ID NO: 3024548 - RNA, 16 nt, Human
agugaacuugggccac

SEQ ID NO: 3024549 - RNA, 18 nt, Human
agugcaaacuucagaguu

SEQ ID NO: 3024550 - RNA, 16 nt, Human
agugaggaugaaaaaa

SEQ ID NO: 3024551 - RNA, 12 nt, Human
agugaggcucug

SEQ ID NO: 3024552 - RNA, 13 nt, Human
agugaggcucugc

SEQ ID NO: 3024553 - RNA, 17 nt, Human
agugcagugagccgaga

SEQ ID NO: 3024554 - RNA, 16 nt, Human
agugcaugcugucccu

SEQ ID NO: 3024555 - RNA, 14 nt, Human
agugcaugcugucc

SEQ ID NO: 3024556 - RNA, 17 nt, Human
ugugccuaauguguuug

SEQ ID NO: 3024557 - RNA, 18 nt, Human
ugugccuaauguguuuga

SEQ ID NO: 3024558 - RNA, 14 nt, Human
ugugccuaaugugu

SEQ ID NO: 3024559 - RNA, 15 nt, Human
ugugccuaauguguu

SEQ ID NO: 3024560 - RNA, 19 nt, Human
ugugcugagucugaaggcu

SEQ ID NO: 3024561 - RNA, 18 nt, Human
ugugcugagucugaaggc

SEQ ID NO: 3024562 - RNA, 21 nt, Human
ugugcugcccugcccaccugg

SEQ ID NO: 3024563 - RNA, 20 nt, Human
ugugcugcccugcccaccug

SEQ ID NO: 3024564 - RNA, 19 nt, Human
ugugcugcccugcccaccu

SEQ ID NO: 3024565 - RNA, 18 nt, Human
ugugcugcccugcccacc

SEQ ID NO: 3024566 - RNA, 14 nt, Human
uguggaugauaaaa

SEQ ID NO: 3024567 - RNA, 23 nt, Human
agugagcugguuuuuagcggaga

SEQ ID NO: 3024568 - RNA, 22 nt, Human
uguggauuuaacagaaauguac

SEQ ID NO: 3024569 - RNA, 19 nt, Human
uguggauuuaacagaaaug

SEQ ID NO: 3024570 - RNA, 20 nt, Human
uguggauuuaacagaaaugu

SEQ ID NO: 3024571 - RNA, 22 nt, Human
uguggucaacauuucucauguu

SEQ ID NO: 3024572 - RNA, 14 nt, Human
ugugucauuucaaa

SEQ ID NO: 3024573 - RNA, 13 nt, Human
ugugucauuucaa

SEQ ID NO: 3024574 - RNA, 20 nt, Human
ugugucagguggggcagcuu

SEQ ID NO: 3024575 - RNA, 11 nt, Human
uguguguuuau

SEQ ID NO: 3024576 - RNA, 22 nt, Human
ugugucucuugguccugcugca

SEQ ID NO: 3024577 - RNA, 18 nt, Human
agugggggaucacagccu

SEQ ID NO: 3024578 - RNA, 22 nt, Human
agugggcccaaugcacuuuguu

SEQ ID NO: 3024579 - RNA, 22 nt, Human
uguguuaucacccagaagaaaa

SEQ ID NO: 3024580 - RNA, 19 nt, Human
uguuacauaagauaaaugu

SEQ ID NO: 3024581 - RNA, 22 nt, Human
uguucuaaauaucccuuggaca

SEQ ID NO: 3024582 - RNA, 19 nt, Human
aguguguggucaacauuuc

SEQ ID NO: 3024583 - RNA, 23 nt, Human
uguugcccaggcuggcgugcagu

SEQ ID NO: 3024584 - RNA, 20 nt, Human
uguugcccaggcuggcgugc

SEQ ID NO: 3024585 - RNA, 13 nt, Human
aguuacucagaau

SEQ ID NO: 3024586 - RNA, 19 nt, Human
aguguuguggauuuaacag

SEQ ID NO: 3024587 - RNA, 20 nt, Human
aguguuguggauuuaacaga

SEQ ID NO: 3024588 - RNA, 16 nt, Human
aguguuguggauuuaa

SEQ ID NO: 3024589 - RNA, 19 nt, Human
uguuccacaaguuaaauaa

SEQ ID NO: 3024590 - RNA, 22 nt, Human
agugugguguuuccuggcacug

SEQ ID NO: 3024591 - RNA, 13 nt, Human
uguuaugacucca

SEQ ID NO: 3024592 - RNA, 17 nt, Human
uguuaugacuccagaau

SEQ ID NO: 3024593 - RNA, 20 nt, Human
agugugacugaucucucgug

SEQ ID NO: 3024594 - RNA, 20 nt, Human
agugugccugaagucccaga

SEQ ID NO: 3024595 - RNA, 21 nt, Human
agugugccugaagucccagau

SEQ ID NO: 3024596 - RNA, 20 nt, Human
agugugguguuuccuggcac

SEQ ID NO: 3024597 - RNA, 20 nt, Human
aguaaaaaaugguguuuuau

SEQ ID NO: 3024598 - RNA, 16 nt, Human
agguuuuuuuuucuca

SEQ ID NO: 3024599 - RNA, 21 nt, Human
uguacauggaauaacauguaa

SEQ ID NO: 3024600 - RNA, 17 nt, Human
aguaaugagcuuaagaa

SEQ ID NO: 3024601 - RNA, 23 nt, Human
aguacacuguuucaaacuuuacu

SEQ ID NO: 3024602 - RNA, 21 nt, Human
aguacacuguuucaaacuuua

SEQ ID NO: 3024603 - RNA, 16 nt, Human
uguaggguuauaauaa

SEQ ID NO: 3024604 - RNA, 17 nt, Human
uguaggguuauaauaau

SEQ ID NO: 3024605 - RNA, 22 nt, Human
uguauauauuuccuauauuguu

SEQ ID NO: 3024606 - RNA, 18 nt, Human
uguauauauuuccuauau

SEQ ID NO: 3024607 - RNA, 15 nt, Human
uguacauacuuuuug

SEQ ID NO: 3024608 - RNA, 20 nt, Human
uguacauacuuuuuggguuu

SEQ ID NO: 3024609 - RNA, 20 nt, Human
uguacaugaaaacacauuuu

SEQ ID NO: 3024610 - RNA, 16 nt, Human
uguacaugaaaacaca

SEQ ID NO: 3024611 - RNA, 14 nt, Human
uguacaugaaaaca

SEQ ID NO: 3024612 - RNA, 20 nt, Human
uguaauuuuuuuaucgucac

SEQ ID NO: 3024613 - RNA, 19 nt, Human
uguacauaaugcgugcaua

SEQ ID NO: 3024614 - RNA, 20 nt, Human
uguacauaaugcgugcauac

SEQ ID NO: 3024615 - RNA, 20 nt, Human
agguuggcaaaaaggcagga

SEQ ID NO: 3024616 - RNA, 17 nt, Human
uguaauuaaguacuaug

SEQ ID NO: 3024617 - RNA, 18 nt, Human
uguaauuaaguacuaugu

SEQ ID NO: 3024618 - RNA, 19 nt, Human
uguaauuaaguacuaugua

SEQ ID NO: 3024619 - RNA, 21 nt, Human
uguaauuaaguacuauguauc

SEQ ID NO: 3024620 - RNA, 22 nt, Human
aggugggauaucacuuccauga

SEQ ID NO: 3024621 - RNA, 12 nt, Human
aggugggaggau

SEQ ID NO: 3024622 - RNA, 14 nt, Human
agguugaagcacca

SEQ ID NO: 3024623 - RNA, 16 nt, Human
aggugucccugcacuu

SEQ ID NO: 3024624 - RNA, 21 nt, Human
aggugugagucaccaagccca

SEQ ID NO: 3024625 - RNA, 22 nt, Human
aggugugagucaccaagcccag

SEQ ID NO: 3024626 - RNA, 20 nt, Human
uguccagccccguagacgug

SEQ ID NO: 3024627 - RNA, 22 nt, Human
uguccaagaagcccaggaaagg

SEQ ID NO: 3024628 - RNA, 18 nt, Human
uguccaagaagcccagga

SEQ ID NO: 3024629 - RNA, 17 nt, Human
uguccaagaagcccagg

SEQ ID NO: 3024630 - RNA, 16 nt, Human
uguccaagaagcccag

SEQ ID NO: 3024631 - RNA, 20 nt, Human
ugucccugcacuugcagacu

SEQ ID NO: 3024632 - RNA, 22 nt, Human
ugucccugcacuugcagacucu

SEQ ID NO: 3024633 - RNA, 23 nt, Human
ugucccugcacuugcagacucua

SEQ ID NO: 3024634 - RNA, 16 nt, Human
ugucagguggggcagc

SEQ ID NO: 3024635 - RNA, 15 nt, Human
uguccaagaagccca

SEQ ID NO: 3024636 - RNA, 14 nt, Human
uguccaagaagccc

SEQ ID NO: 3024637 - RNA, 17 nt, Human
ugucagguggggcagcu

SEQ ID NO: 3024638 - RNA, 18 nt, Human
ugucagguggggcagcuu

SEQ ID NO: 3024639 - RNA, 20 nt, Human
ugucagguggggcagcuuga

SEQ ID NO: 3024640 - RNA, 20 nt, Human
ugucauuugagcagggcuca

SEQ ID NO: 3024641 - RNA, 21 nt, Human
ugucauuugagcagggcucag

SEQ ID NO: 3024642 - RNA, 22 nt, Human
ugucauuugagcagggcucagc

SEQ ID NO: 3024643 - RNA, 14 nt, Human
agucaccaagccca

SEQ ID NO: 3024644 - RNA, 15 nt, Human
agucaccaagcccag

SEQ ID NO: 3024645 - RNA, 17 nt, Human
agucaccccggccaccu

SEQ ID NO: 3024646 - RNA, 19 nt, Human
aguauucuuauuuaaugaa

SEQ ID NO: 3024647 - RNA, 14 nt, Human
ugucccugcacuug

SEQ ID NO: 3024648 - RNA, 23 nt, Human
ugucccuuacgugaguccuggca

SEQ ID NO: 3024649 - RNA, 19 nt, Human
ugucccuuacgugaguccu

SEQ ID NO: 3024650 - RNA, 18 nt, Human
agucccaccuuggcugca

SEQ ID NO: 3024651 - RNA, 19 nt, Human
agucccaccuuggcugcag

SEQ ID NO: 3024652 - RNA, 15 nt, Human
agucccaccuuggcu

SEQ ID NO: 3024653 - RNA, 16 nt, Human
agucccaccuuggcug

SEQ ID NO: 3024654 - RNA, 23 nt, Human
agucucacuguugcccaggcugg

SEQ ID NO: 3024655 - RNA, 21 nt, Human
agucucacuguugcccaggcu

SEQ ID NO: 3024656 - RNA, 16 nt, Human
aguccucccaucucac

SEQ ID NO: 3024657 - RNA, 14 nt, Human
aguccucccaucuc

SEQ ID NO: 3024658 - RNA, 16 nt, Human
uggcuaacuuggguua

SEQ ID NO: 3024659 - RNA, 17 nt, Human
uggcuaauguacugcau

SEQ ID NO: 3024660 - RNA, 19 nt, Human
uggcuaauguacugcauau

SEQ ID NO: 3024661 - RNA, 14 nt, Human
uggcuaaauucaug

SEQ ID NO: 3024662 - RNA, 23 nt, Human
aggcuccaggagcagccacauuc

SEQ ID NO: 3024663 - RNA, 19 nt, Human
aggcuccaggagcagccac

SEQ ID NO: 3024664 - RNA, 18 nt, Human
aggcuccaggagcagcca

SEQ ID NO: 3024665 - RNA, 17 nt, Human
aggcuccaggagcagcc

SEQ ID NO: 3024666 - RNA, 13 nt, Human
uggcucacgccug

SEQ ID NO: 3024667 - RNA, 23 nt, Human
uggcuguuggcugggggccucag

SEQ ID NO: 3024668 - RNA, 14 nt, Human
uggcuucacggaag

SEQ ID NO: 3024669 - RNA, 16 nt, Human
uggcuguuggcugggg

SEQ ID NO: 3024670 - RNA, 18 nt, Human
uggcuguuggcugggggc

SEQ ID NO: 3024671 - RNA, 23 nt, Human
uggcugcaaaggguaucaggugc

SEQ ID NO: 3024672 - RNA, 21 nt, Human
uggcuuuugugcauuaucuag

SEQ ID NO: 3024673 - RNA, 15 nt, Human
uggcuuuugugcauu

SEQ ID NO: 3024674 - RNA, 16 nt, Human
uggcuuuugugcauua

SEQ ID NO: 3024675 - RNA, 20 nt, Human
uggcuucacggaagagccuu

SEQ ID NO: 3024676 - RNA, 17 nt, Human
uggcuucacggaagagc

SEQ ID NO: 3024677 - RNA, 18 nt, Human
aggcuuagugauguaauu

SEQ ID NO: 3024678 - RNA, 17 nt, Human
aggcuuagugauguaau

SEQ ID NO: 3024679 - RNA, 19 nt, Human
aggcuuagugauguaauua

SEQ ID NO: 3024680 - RNA, 23 nt, Human
aggcuuagucacugagacagccc

SEQ ID NO: 3024681 - RNA, 22 nt, Human
aggcuuagucacugagacagcc

SEQ ID NO: 3024682 - RNA, 21 nt, Human
aggcuuagucacugagacagc

SEQ ID NO: 3024683 - RNA, 17 nt, Human
aggcugggggaagaagc

SEQ ID NO: 3024684 - RNA, 22 nt, Human
aggcugggcuucaguggcagcu

SEQ ID NO: 3024685 - RNA, 23 nt, Human
aggcugggcuucaguggcagcug

SEQ ID NO: 3024686 - RNA, 18 nt, Human
aggcugggcuucaguggc

SEQ ID NO: 3024687 - RNA, 19 nt, Human
aggcugggcuucaguggca

SEQ ID NO: 3024688 - RNA, 20 nt, Human
aggcugggcuucaguggcag

SEQ ID NO: 3024689 - RNA, 21 nt, Human
aggcugggcuucaguggcagc

SEQ ID NO: 3024690 - RNA, 17 nt, Human
aggcuggguucugaucc

SEQ ID NO: 3024691 - RNA, 14 nt, Human
aggcuggguucuga

SEQ ID NO: 3024692 - RNA, 22 nt, Human
aggcugggggaagaagcucucu

SEQ ID NO: 3024693 - RNA, 13 nt, Human
aggcugggcuccc

SEQ ID NO: 3024694 - RNA, 18 nt, Human
aggcugggcucccuuccc

SEQ ID NO: 3024695 - RNA, 14 nt, Human
aggcugggcucccu

SEQ ID NO: 3024696 - RNA, 14 nt, Human
aggcugggcuucag

SEQ ID NO: 3024697 - RNA, 23 nt, Human
aggcugggcucccuucccaccuc

SEQ ID NO: 3024698 - RNA, 21 nt, Human
aggcugggcucccuucccacc

SEQ ID NO: 3024699 - RNA, 22 nt, Human
aggcugggagagccuuccaggg

SEQ ID NO: 3024700 - RNA, 21 nt, Human
aggcugggagagccuuccagg

SEQ ID NO: 3024701 - RNA, 20 nt, Human
aggcugggagagccuuccag

SEQ ID NO: 3024702 - RNA, 16 nt, Human
aggcugggagagccuu

SEQ ID NO: 3024703 - RNA, 19 nt, Human
aggcugggagagccuucca

SEQ ID NO: 3024704 - RNA, 12 nt, Human
agggcccagaga

SEQ ID NO: 3024705 - RNA, 13 nt, Human
agggcccagagag

SEQ ID NO: 3024706 - RNA, 23 nt, Human
agggaguccgaaagggacuugga

SEQ ID NO: 3024707 - RNA, 20 nt, Human
agggagugacagaggcagcc

SEQ ID NO: 3024708 - RNA, 20 nt, Human
agggagugaguugauagcac

SEQ ID NO: 3024709 - RNA, 20 nt, Human
agggaguccgaaagggacuu

SEQ ID NO: 3024710 - RNA, 22 nt, Human
agggagggcuccagacacaugu

SEQ ID NO: 3024711 - RNA, 17 nt, Human
agggagggagggcucca

SEQ ID NO: 3024712 - RNA, 12 nt, Human
agggagggcucc

SEQ ID NO: 3024713 - RNA, 19 nt, Human
agggagggcuccagacaca

SEQ ID NO: 3024714 - RNA, 17 nt, Human
agggagggcuccagaca

SEQ ID NO: 3024715 - RNA, 14 nt, Human
agggcccagagagg

SEQ ID NO: 3024716 - RNA, 15 nt, Human
agggcuccagacaca

SEQ ID NO: 3024717 - RNA, 20 nt, Human
agggcuccagacacaugucc

SEQ ID NO: 3024718 - RNA, 21 nt, Human
ugggcucccuucccaccucuc

SEQ ID NO: 3024719 - RNA, 14 nt, Human
ugggcucccuuccc

SEQ ID NO: 3024720 - RNA, 18 nt, Human
agggacuuggaagcuccg

SEQ ID NO: 3024721 - RNA, 19 nt, Human
agggacuuggaagcuccgc

SEQ ID NO: 3024722 - RNA, 15 nt, Human
agggacuuggaagcu

SEQ ID NO: 3024723 - RNA, 20 nt, Human
agggacuuggaagcuccgcu

SEQ ID NO: 3024724 - RNA, 18 nt, Human
ugggacuacaggcaccca

SEQ ID NO: 3024725 - RNA, 16 nt, Human
ugggacuacaggugug

SEQ ID NO: 3024726 - RNA, 21 nt, Human
ugggcaacccccagccugcua

SEQ ID NO: 3024727 - RNA, 13 nt, Human
ugggcagaaggaa

SEQ ID NO: 3024728 - RNA, 20 nt, Human
ugggcagaaggaagacuuca

SEQ ID NO: 3024729 - RNA, 16 nt, Human
ugggcagaaggaagac

SEQ ID NO: 3024730 - RNA, 23 nt, Human
ugggcagaaggaagacuucaucc

SEQ ID NO: 3024731 - RNA, 22 nt, Human
ugggaggaucucuugagccugg

SEQ ID NO: 3024732 - RNA, 21 nt, Human
ugggagaaccaaaaagaggcu

SEQ ID NO: 3024733 - RNA, 21 nt, Human
ugggaggauugcuugagcuca

SEQ ID NO: 3024734 - RNA, 18 nt, Human
ugggaggauugcuugagc

SEQ ID NO: 3024735 - RNA, 22 nt, Human
ugggaggauugcuugagcucag

SEQ ID NO: 3024736 - RNA, 11 nt, Human
uggcccaggag

SEQ ID NO: 3024737 - RNA, 22 nt, Human
uggcaugggaaugaaugucagu

SEQ ID NO: 3024738 - RNA, 19 nt, Human
uggcccacgcacuucggga

SEQ ID NO: 3024739 - RNA, 13 nt, Human
uggcccacgcacu

SEQ ID NO: 3024740 - RNA, 14 nt, Human
uggcccacugcauc

SEQ ID NO: 3024741 - RNA, 13 nt, Human
uggcccacugcau

SEQ ID NO: 3024742 - RNA, 18 nt, Human
uggccugagcugggauga

SEQ ID NO: 3024743 - RNA, 20 nt, Human
uggccucugcacuccccugc

SEQ ID NO: 3024744 - RNA, 18 nt, Human
uggccucugcacuccccu

SEQ ID NO: 3024745 - RNA, 19 nt, Human
uggccucugcacuccccug

SEQ ID NO: 3024746 - RNA, 17 nt, Human
aggccuucucugaagga

SEQ ID NO: 3024747 - RNA, 18 nt, Human
aggccuucucugaaggac

SEQ ID NO: 3024748 - RNA, 13 nt, Human
aggcuccaggagc

SEQ ID NO: 3024749 - RNA, 16 nt, Human
aggcuccaggagcagc

SEQ ID NO: 3024750 - RNA, 14 nt, Human
aggcuccaggagca

SEQ ID NO: 3024751 - RNA, 16 nt, Human
aggcccagagggccug

SEQ ID NO: 3024752 - RNA, 15 nt, Human
aggcccagagggccu

SEQ ID NO: 3024753 - RNA, 17 nt, Human
aggccaugggccuccug

SEQ ID NO: 3024754 - RNA, 18 nt, Human
aggccaugggccuccugu

SEQ ID NO: 3024755 - RNA, 23 nt, Human
aggccagagacacaagccuucgg

SEQ ID NO: 3024756 - RNA, 13 nt, Human
uggcagcucagag

SEQ ID NO: 3024757 - RNA, 15 nt, Human
uggcagcucagagag

SEQ ID NO: 3024758 - RNA, 14 nt, Human
uggcagcucagaga

SEQ ID NO: 3024759 - RNA, 18 nt, Human
aggccagagacacaagcc

SEQ ID NO: 3024760 - RNA, 13 nt, Human
aggccagagacac

SEQ ID NO: 3024761 - RNA, 16 nt, Human
uggcagcucagagagg

SEQ ID NO: 3024762 - RNA, 12 nt, Human
aggccagagaca

SEQ ID NO: 3024763 - RNA, 17 nt, Human
uggcaccagcagccugg

SEQ ID NO: 3024764 - RNA, 16 nt, Human
uggcaccagcagccug

SEQ ID NO: 3024765 - RNA, 13 nt, Human
aggccuggccaga

SEQ ID NO: 3024766 - RNA, 12 nt, Human
aggccuggccag

SEQ ID NO: 3024767 - RNA, 14 nt, Human
aggcccggcuccag

SEQ ID NO: 3024768 - RNA, 15 nt, Human
aggcccggcuccagg

SEQ ID NO: 3024769 - RNA, 16 nt, Human
aggcccggcuccaggc

SEQ ID NO: 3024770 - RNA, 13 nt, Human
aggccccugccac

SEQ ID NO: 3024771 - RNA, 15 nt, Human
aggccccugccaccc

SEQ ID NO: 3024772 - RNA, 20 nt, Human
aggcccagagggccugcaag

SEQ ID NO: 3024773 - RNA, 19 nt, Human
aggcccagagggccugcaa

SEQ ID NO: 3024774 - RNA, 17 nt, Human
aggccccugccacccug

SEQ ID NO: 3024775 - RNA, 18 nt, Human
aggccccugccacccugg

SEQ ID NO: 3024776 - RNA, 12 nt, Human
aggccccugcca

SEQ ID NO: 3024777 - RNA, 21 nt, Human
aggccccugccacccugggga

SEQ ID NO: 3024778 - RNA, 12 nt, Human
aggaguuuggcc

SEQ ID NO: 3024779 - RNA, 21 nt, Human
aggaguuugagaccaaccugg

SEQ ID NO: 3024780 - RNA, 15 nt, Human
aggaggccagccuug

SEQ ID NO: 3024781 - RNA, 19 nt, Human
uggaacacucuauaacaaa

SEQ ID NO: 3024782 - RNA, 10 nt, Human
ugcugcccug

SEQ ID NO: 3024783 - RNA, 18 nt, Human
uggaaguacuauaauuua

SEQ ID NO: 3024784 - RNA, 20 nt, Human
uggaaguacuauaauuuacc

SEQ ID NO: 3024785 - RNA, 13 nt, Human
uggaagcuccgcu

SEQ ID NO: 3024786 - RNA, 12 nt, Human
uggaacacucug

SEQ ID NO: 3024787 - RNA, 22 nt, Human
aggauugcuacuguccuaccca

SEQ ID NO: 3024788 - RNA, 18 nt, Human
aggaugcuuguacauaau

SEQ ID NO: 3024789 - RNA, 12 nt, Human
aggaucagucug

SEQ ID NO: 3024790 - RNA, 21 nt, Human
aggauccugagccagauuuca

SEQ ID NO: 3024791 - RNA, 15 nt, Human
aggaugcuuguacau

SEQ ID NO: 3024792 - RNA, 16 nt, Human
aggaugcuuguacaua

SEQ ID NO: 3024793 - RNA, 15 nt, Human
uggacaccggaaaca

SEQ ID NO: 3024794 - RNA, 14 nt, Human
aggcaagcaccucc

SEQ ID NO: 3024795 - RNA, 19 nt, Human
aggcaacugcauuggcuuu

SEQ ID NO: 3024796 - RNA, 15 nt, Human
aggcaaugcuggcug

SEQ ID NO: 3024797 - RNA, 16 nt, Human
aggcaaugcuggcugu

SEQ ID NO: 3024798 - RNA, 22 nt, Human
uggacuuuguuaguuucuccaa

SEQ ID NO: 3024799 - RNA, 11 nt, Human
uggacuuuguu

SEQ ID NO: 3024800 - RNA, 24 nt, Human
uggacuuuguuaguuucuccaagc

SEQ ID NO: 3024801 - RNA, 22 nt, Human
aggcagccccauucugccugcc

SEQ ID NO: 3024802 - RNA, 19 nt, Human
aggcagccccauucugccu

SEQ ID NO: 3024803 - RNA, 20 nt, Human
aggcagccccauucugccug

SEQ ID NO: 3024804 - RNA, 21 nt, Human
aggcagccccauucugccugc

SEQ ID NO: 3024805 - RNA, 12 nt, Human
aggcaggauggc

SEQ ID NO: 3024806 - RNA, 21 nt, Human
aggcaggucuugaacuccugg

SEQ ID NO: 3024807 - RNA, 22 nt, Human
aggcagggucucacucugucgc

SEQ ID NO: 3024808 - RNA, 14 nt, Human
aggcagguccaggg

SEQ ID NO: 3024809 - RNA, 19 nt, Human
aggcagggucucacucugu

SEQ ID NO: 3024810 - RNA, 18 nt, Human
aggcagggucucacucug

SEQ ID NO: 3024811 - RNA, 20 nt, Human
aggcagggucucacucuguc

SEQ ID NO: 3024812 - RNA, 21 nt, Human
aggcagggucucacucugucg

SEQ ID NO: 3024813 - RNA, 20 nt, Human
ugccuuuuuauaacuuuuua

SEQ ID NO: 3024814 - RNA, 13 nt, Human
ugcgaaaggauga

SEQ ID NO: 3024815 - RNA, 19 nt, Human
ugcgaaaggaugaaaguga

SEQ ID NO: 3024816 - RNA, 18 nt, Human
ugcggacagccacggcca

SEQ ID NO: 3024817 - RNA, 17 nt, Human
ugcggacagccacggcc

SEQ ID NO: 3024818 - RNA, 15 nt, Human
ugccuguucagcucc

SEQ ID NO: 3024819 - RNA, 16 nt, Human
ugccuguucagcucca

SEQ ID NO: 3024820 - RNA, 23 nt, Human
agcugggaugauuggagggggga

SEQ ID NO: 3024821 - RNA, 17 nt, Human
agcugggacuacaggug

SEQ ID NO: 3024822 - RNA, 19 nt, Human
agcugggacuacaggugug

SEQ ID NO: 3024823 - RNA, 14 nt, Human
agcugggcagguug

SEQ ID NO: 3024824 - RNA, 22 nt, Human
ugccucugacacacagcucugu

SEQ ID NO: 3024825 - RNA, 19 nt, Human
agcugccugggaucccuca

SEQ ID NO: 3024826 - RNA, 13 nt, Human
agcugccugggau

SEQ ID NO: 3024827 - RNA, 21 nt, Human
agcugccugggaucccucauc

SEQ ID NO: 3024828 - RNA, 20 nt, Human
ugccucugacacacagcucu

SEQ ID NO: 3024829 - RNA, 21 nt, Human
ugccucugacacacagcucug

SEQ ID NO: 3024830 - RNA, 15 nt, Human
ugccucucucaggcc

SEQ ID NO: 3024831 - RNA, 14 nt, Human
ugccucucucaggc

SEQ ID NO: 3024832 - RNA, 13 nt, Human
ugccucucucagg

SEQ ID NO: 3024833 - RNA, 19 nt, Human
ugccucccaucacccgcua

SEQ ID NO: 3024834 - RNA, 14 nt, Human
ugccucccaucacc

SEQ ID NO: 3024835 - RNA, 13 nt, Human
ugccucccaucac

SEQ ID NO: 3024836 - RNA, 18 nt, Human
agcugcauacaguuugca

SEQ ID NO: 3024837 - RNA, 13 nt, Human
agcugccaccugc

SEQ ID NO: 3024838 - RNA, 17 nt, Human
agcugcacccucaggca

SEQ ID NO: 3024839 - RNA, 13 nt, Human
agcugcacccuca

SEQ ID NO: 3024840 - RNA, 22 nt, Human
agcugcacccucaggcaggugg

SEQ ID NO: 3024841 - RNA, 20 nt, Human
agcugcacccucaggcaggu

SEQ ID NO: 3024842 - RNA, 19 nt, Human
agcugcacccucaggcagg

SEQ ID NO: 3024843 - RNA, 18 nt, Human
agcugcacccucaggcag

SEQ ID NO: 3024844 - RNA, 18 nt, Human
agcucuucuccaggcugu

SEQ ID NO: 3024845 - RNA, 17 nt, Human
agcucuucuccaggcug

SEQ ID NO: 3024846 - RNA, 12 nt, Human
agcucuguccug

SEQ ID NO: 3024847 - RNA, 12 nt, Human
agcucugcuccu

SEQ ID NO: 3024848 - RNA, 22 nt, Human
agcucugcuccucuccccagca

SEQ ID NO: 3024849 - RNA, 20 nt, Human
agcucugguccauagagagc

SEQ ID NO: 3024850 - RNA, 22 nt, Human
ugcccuccaagaccuucuccuu

SEQ ID NO: 3024851 - RNA, 20 nt, Human
ugcccuccaagaccuucucc

SEQ ID NO: 3024852 - RNA, 19 nt, Human
ugcccuccaagaccuucuc

SEQ ID NO: 3024853 - RNA, 22 nt, Human
ugcugccaauauccuaauaaaa

SEQ ID NO: 3024854 - RNA, 23 nt, Human
ugcugccaauauccuaauaaaaa

SEQ ID NO: 3024855 - RNA, 11 nt, Human
ugcugccaucc

SEQ ID NO: 3024856 - RNA, 21 nt, Human
ugcugccauccagguucagcu

SEQ ID NO: 3024857 - RNA, 22 nt, Human
ugcugccauccagguucagcuu

SEQ ID NO: 3024858 - RNA, 12 nt, Human
ugcugccaucca

SEQ ID NO: 3024859 - RNA, 13 nt, Human
ugcugccauccag

SEQ ID NO: 3024860 - RNA, 14 nt, Human
ugcugccauccagg

SEQ ID NO: 3024861 - RNA, 15 nt, Human
ugcugccauccaggu

SEQ ID NO: 3024862 - RNA, 17 nt, Human
aggaagcucagggccug

SEQ ID NO: 3024863 - RNA, 22 nt, Human
aggaagcucagggccuggcuca

SEQ ID NO: 3024864 - RNA, 18 nt, Human
aggaagcucagggccugg

SEQ ID NO: 3024865 - RNA, 14 nt, Human
aggaagagaaaaaa

SEQ ID NO: 3024866 - RNA, 15 nt, Human
aggaagacuuuggaa

SEQ ID NO: 3024867 - RNA, 23 nt, Human
aggaauccagacccggcugcgug

SEQ ID NO: 3024868 - RNA, 16 nt, Human
aggaagcucagggccu

SEQ ID NO: 3024869 - RNA, 23 nt, Human
aggaaagcaaaucaguuugguug

SEQ ID NO: 3024870 - RNA, 19 nt, Human
aggaaagcaaaggagauug

SEQ ID NO: 3024871 - RNA, 16 nt, Human
ugcugacuguuuucuc

SEQ ID NO: 3024872 - RNA, 24 nt, Human
ugcugacuguuuucucuugagagg

SEQ ID NO: 3024873 - RNA, 21 nt, Human
ugcugacuguuuucucuugag

SEQ ID NO: 3024874 - RNA, 20 nt, Human
aggaaaggcuccaggagcag

SEQ ID NO: 3024875 - RNA, 18 nt, Human
aggaaaggcuccaggagc

SEQ ID NO: 3024876 - RNA, 16 nt, Human
aggaaaggcuccagga

SEQ ID NO: 3024877 - RNA, 22 nt, Human
aggaaaggcuccaggagcagcc

SEQ ID NO: 3024878 - RNA, 19 nt, Human
ugcucugaucauccacugu

SEQ ID NO: 3024879 - RNA, 22 nt, Human
ugcucugaucauccacugugcc

SEQ ID NO: 3024880 - RNA, 17 nt, Human
ugcugacuguuuucucu

SEQ ID NO: 3024881 - RNA, 17 nt, Human
ugcucuggacaggcaug

SEQ ID NO: 3024882 - RNA, 15 nt, Human
ugcucugcauguuac

SEQ ID NO: 3024883 - RNA, 18 nt, Human
ugcucugcauguuacaua

SEQ ID NO: 3024884 - RNA, 15 nt, Human
agcuuaucucagggg

SEQ ID NO: 3024885 - RNA, 14 nt, Human
agcuuaucucaggg

SEQ ID NO: 3024886 - RNA, 12 nt, Human
agcuuaucucag

SEQ ID NO: 3024887 - RNA, 20 nt, Human
ugcggacagccacggccagg

SEQ ID NO: 3024888 - RNA, 21 nt, Human
ugcggacagccacggccaggc

SEQ ID NO: 3024889 - RNA, 18 nt, Human
agcuuguaaauagcucag

SEQ ID NO: 3024890 - RNA, 19 nt, Human
agcuuguaaauagcucagg

SEQ ID NO: 3024891 - RNA, 20 nt, Human
agcuuguaaauagcucaggu

SEQ ID NO: 3024892 - RNA, 21 nt, Human
agcuuguaaauagcucaggug

SEQ ID NO: 3024893 - RNA, 21 nt, Human
aggaaacccagcucuggucca

SEQ ID NO: 3024894 - RNA, 20 nt, Human
aggaaacccagcucuggucc

SEQ ID NO: 3024895 - RNA, 18 nt, Human
aggaaacccagcucuggu

SEQ ID NO: 3024896 - RNA, 15 nt, Human
aggaaacccagcucu

SEQ ID NO: 3024897 - RNA, 17 nt, Human
aggaaacccagcucugg

SEQ ID NO: 3024898 - RNA, 16 nt, Human
aggaaacccagcucug

SEQ ID NO: 3024899 - RNA, 19 nt, Human
agcuuugaaaauucagugg

SEQ ID NO: 3024900 - RNA, 18 nt, Human
agcuuugaaaauucagug

SEQ ID NO: 3024901 - RNA, 16 nt, Human
agcuuugaaaauucag

SEQ ID NO: 3024902 - RNA, 12 nt, Human
agcuuugaaaau

SEQ ID NO: 3024903 - RNA, 13 nt, Human
aggaaagaggcuc

SEQ ID NO: 3024904 - RNA, 12 nt, Human
aggaaagaggcu

SEQ ID NO: 3024905 - RNA, 17 nt, Human
aggaaagcaaaggagau

SEQ ID NO: 3024906 - RNA, 16 nt, Human
aggaaagaggcucugg

SEQ ID NO: 3024907 - RNA, 15 nt, Human
ugccaauauccuaau

SEQ ID NO: 3024908 - RNA, 16 nt, Human
ugccaauauccuaaua

SEQ ID NO: 3024909 - RNA, 17 nt, Human
ugccaauauccuaauaa

SEQ ID NO: 3024910 - RNA, 18 nt, Human
ugccaauauccuaauaaa

SEQ ID NO: 3024911 - RNA, 19 nt, Human
ugccaauauccuaauaaaa

SEQ ID NO: 3024912 - RNA, 21 nt, Human
ugccaauauccuaauaaaaag

SEQ ID NO: 3024913 - RNA, 23 nt, Human
ugccaauauccuaauaaaaaggu

SEQ ID NO: 3024914 - RNA, 19 nt, Human
ugcauuugaaaauuuugau

SEQ ID NO: 3024915 - RNA, 23 nt, Human
ugcauuugaaaauuuugauguuu

SEQ ID NO: 3024916 - RNA, 14 nt, Human
agcgcccaguuggg

SEQ ID NO: 3024917 - RNA, 22 nt, Human
agcgcccaguuggguggaugcc

SEQ ID NO: 3024918 - RNA, 23 nt, Human
ugccagucaccccggccaccugc

SEQ ID NO: 3024919 - RNA, 22 nt, Human
ugccagucaccccggccaccug

SEQ ID NO: 3024920 - RNA, 16 nt, Human
ugccauauucuguugg

SEQ ID NO: 3024921 - RNA, 17 nt, Human
ugccauauucuguuggc

SEQ ID NO: 3024922 - RNA, 15 nt, Human
ugccauauucuguug

SEQ ID NO: 3024923 - RNA, 20 nt, Human
ugccagucaccccggccacc

SEQ ID NO: 3024924 - RNA, 18 nt, Human
ugccagucaccccggcca

SEQ ID NO: 3024925 - RNA, 16 nt, Human
ugccagucaccccggc

SEQ ID NO: 3024926 - RNA, 15 nt, Human
ugccagucaccccgg

SEQ ID NO: 3024927 - RNA, 13 nt, Human
agcgugagccacu

SEQ ID NO: 3024928 - RNA, 15 nt, Human
agcgugagccacugc

SEQ ID NO: 3024929 - RNA, 16 nt, Human
agcggggacagcuccu

SEQ ID NO: 3024930 - RNA, 17 nt, Human
agcggggacagcuccuu

SEQ ID NO: 3024931 - RNA, 15 nt, Human
agcggggacagcucc

SEQ ID NO: 3024932 - RNA, 20 nt, Human
ugccauauucuguuggccag

SEQ ID NO: 3024933 - RNA, 21 nt, Human
ugccauauucuguuggccagu

SEQ ID NO: 3024934 - RNA, 16 nt, Human
agcgugagccacugca

SEQ ID NO: 3024935 - RNA, 17 nt, Human
agcgugagccacugcac

SEQ ID NO: 3024936 - RNA, 20 nt, Human
agcgugguggacaugcacag

SEQ ID NO: 3024937 - RNA, 23 nt, Human
agcgugguggacaugcacagcua

SEQ ID NO: 3024938 - RNA, 21 nt, Human
ugccauguuggccaggcuggu

SEQ ID NO: 3024939 - RNA, 20 nt, Human
ugccauguuggccaggcugg

SEQ ID NO: 3024940 - RNA, 17 nt, Human
ugccauguuggccaggc

SEQ ID NO: 3024941 - RNA, 17 nt, Human
agcucagggccuggcuc

SEQ ID NO: 3024942 - RNA, 18 nt, Human
ugccauguuggccaggcu

SEQ ID NO: 3024943 - RNA, 19 nt, Human
ugccauguuggccaggcug

SEQ ID NO: 3024944 - RNA, 16 nt, Human
agcucagggccuggcu

SEQ ID NO: 3024945 - RNA, 15 nt, Human
agcucagggccuggc

SEQ ID NO: 3024946 - RNA, 14 nt, Human
agcucagggccugg

SEQ ID NO: 3024947 - RNA, 12 nt, Human
ugcccaggcccc

SEQ ID NO: 3024948 - RNA, 20 nt, Human
ugcccaggccccugccaccc

SEQ ID NO: 3024949 - RNA, 22 nt, Human
ugcccaggccccugccacccug

SEQ ID NO: 3024950 - RNA, 14 nt, Human
ugcccacaggauca

SEQ ID NO: 3024951 - RNA, 15 nt, Human
ugcccaggcaggucu

SEQ ID NO: 3024952 - RNA, 16 nt, Human
ugcccaggcaggucuu

SEQ ID NO: 3024953 - RNA, 17 nt, Human
ugcccaggcaggucuug

SEQ ID NO: 3024954 - RNA, 20 nt, Human
ugcccaggcaggucuugaac

SEQ ID NO: 3024955 - RNA, 11 nt, Human
ugcccaggccc

SEQ ID NO: 3024956 - RNA, 17 nt, Human
ugcacaucuguuuugua

SEQ ID NO: 3024957 - RNA, 15 nt, Human
ugcacacaccagagc

SEQ ID NO: 3024958 - RNA, 16 nt, Human
ugcacaagcuccaagc

SEQ ID NO: 3024959 - RNA, 15 nt, Human
ugcacaagcuccaag

SEQ ID NO: 3024960 - RNA, 23 nt, Human
ugcacaagcuccaagcucccagg

SEQ ID NO: 3024961 - RNA, 22 nt, Human
ugcacaagcuccaagcucccag

SEQ ID NO: 3024962 - RNA, 20 nt, Human
ugcacaagcuccaagcuccc

SEQ ID NO: 3024963 - RNA, 18 nt, Human
ugcacaagcuccaagcuc

SEQ ID NO: 3024964 - RNA, 14 nt, Human
ugcaccacugcacu

SEQ ID NO: 3024965 - RNA, 19 nt, Human
ugcacguacacacacauac

SEQ ID NO: 3024966 - RNA, 13 nt, Human
ugcacuccccugc

SEQ ID NO: 3024967 - RNA, 12 nt, Human
ugcacuccccug

SEQ ID NO: 3024968 - RNA, 19 nt, Human
ugcagacucuacagaggcc

SEQ ID NO: 3024969 - RNA, 20 nt, Human
ugcagacucuacagaggcca

SEQ ID NO: 3024970 - RNA, 18 nt, Human
ugcagacucuacagaggc

SEQ ID NO: 3024971 - RNA, 15 nt, Human
ugcacuccccugcug

SEQ ID NO: 3024972 - RNA, 22 nt, Human
ugcagacucuacagaggccaug

SEQ ID NO: 3024973 - RNA, 15 nt, Human
agccucaaccuccug

SEQ ID NO: 3024974 - RNA, 15 nt, Human
agccuaggugacaga

SEQ ID NO: 3024975 - RNA, 17 nt, Human
agccuaggugacagagu

SEQ ID NO: 3024976 - RNA, 16 nt, Human
ugcauacuauuaaaca

SEQ ID NO: 3024977 - RNA, 15 nt, Human
ugcauacuauuaaac

SEQ ID NO: 3024978 - RNA, 12 nt, Human
ugcauacuauua

SEQ ID NO: 3024979 - RNA, 22 nt, Human
ugcauaccacuuuuguucuugg

SEQ ID NO: 3024980 - RNA, 21 nt, Human
ugcauaccacuuuuguucuug

SEQ ID NO: 3024981 - RNA, 20 nt, Human
ugcauacuauuaaacaugcu

SEQ ID NO: 3024982 - RNA, 18 nt, Human
ugcauacuauuaaacaug

SEQ ID NO: 3024983 - RNA, 17 nt, Human
ugcauacuauuaaacau

SEQ ID NO: 3024984 - RNA, 13 nt, Human
ugcaugcuguccc

SEQ ID NO: 3024985 - RNA, 15 nt, Human
ugcaugcugucccuu

SEQ ID NO: 3024986 - RNA, 14 nt, Human
ugcaugcugucccu

SEQ ID NO: 3024987 - RNA, 21 nt, Human
ugcaugaggcuaguguggugu

SEQ ID NO: 3024988 - RNA, 22 nt, Human
ugcaugaaguaauaugcacaca

SEQ ID NO: 3024989 - RNA, 20 nt, Human
ugcaugaaguaauaugcaca

SEQ ID NO: 3024990 - RNA, 23 nt, Human
agccugcaguuauuaacacuaac

SEQ ID NO: 3024991 - RNA, 19 nt, Human
agccugccucuucucuacu

SEQ ID NO: 3024992 - RNA, 16 nt, Human
agccugccucuucucu

SEQ ID NO: 3024993 - RNA, 16 nt, Human
ugcaugcugucccuua

SEQ ID NO: 3024994 - RNA, 14 nt, Human
ugcagugagccgag

SEQ ID NO: 3024995 - RNA, 18 nt, Human
ugcagccucaaccuccug

SEQ ID NO: 3024996 - RNA, 19 nt, Human
ugcagccucaaccuccugg

SEQ ID NO: 3024997 - RNA, 17 nt, Human
agccucaaccuccuggg

SEQ ID NO: 3024998 - RNA, 18 nt, Human
agccucaaccuccugggc

SEQ ID NO: 3024999 - RNA, 13 nt, Human
agccucagcaucc

SEQ ID NO: 3025000 - RNA, 14 nt, Human
agccucagcauccu

SEQ ID NO: 3025001 - RNA, 15 nt, Human
agccucagcauccug

SEQ ID NO: 3025002 - RNA, 16 nt, Human
ucugucuuuuaaacuc

SEQ ID NO: 3025003 - RNA, 12 nt, Human
ucugucuuuuaa

SEQ ID NO: 3025004 - RNA, 21 nt, Human
ucugugaaaggaaagagggag

SEQ ID NO: 3025005 - RNA, 15 nt, Human
ucugugaaaggaaag

SEQ ID NO: 3025006 - RNA, 18 nt, Human
ucugucuuuuaaacucug

SEQ ID NO: 3025007 - RNA, 18 nt, Human
ucuguuggccagugugac

SEQ ID NO: 3025008 - RNA, 19 nt, Human
ucuguuggccagugugaca

SEQ ID NO: 3025009 - RNA, 20 nt, Human
ucuguuggccagugugacaa

SEQ ID NO: 3025010 - RNA, 18 nt, Human
agaauuucccaaagcagu

SEQ ID NO: 3025011 - RNA, 17 nt, Human
agaauuucccaaagcag

SEQ ID NO: 3025012 - RNA, 23 nt, Human
agaauuucccaaagcagugcaug

SEQ ID NO: 3025013 - RNA, 11 nt, Human
ucuggggcugu

SEQ ID NO: 3025014 - RNA, 14 nt, Human
ucuggguucacugc

SEQ ID NO: 3025015 - RNA, 16 nt, Human
ucuggguucacugcaa

SEQ ID NO: 3025016 - RNA, 18 nt, Human
ucugguccauagagagca

SEQ ID NO: 3025017 - RNA, 20 nt, Human
ucugucauuugagcagggcu

SEQ ID NO: 3025018 - RNA, 23 nt, Human
ucugucauuugagcagggcucag

SEQ ID NO: 3025019 - RNA, 15 nt, Human
ucugucauuugagca

SEQ ID NO: 3025020 - RNA, 16 nt, Human
ucuucccucaaaugug

SEQ ID NO: 3025021 - RNA, 22 nt, Human
ucuuccaggcugggagagccuu

SEQ ID NO: 3025022 - RNA, 14 nt, Human
ucuuauugcccacg

SEQ ID NO: 3025023 - RNA, 18 nt, Human
ucuuauugcccacgcugg

SEQ ID NO: 3025024 - RNA, 22 nt, Human
ucuuauugcccacgcuggagug

SEQ ID NO: 3025025 - RNA, 14 nt, Human
ucuuaugggcuggg

SEQ ID NO: 3025026 - RNA, 13 nt, Human
ucuuaugggcugg

SEQ ID NO: 3025027 - RNA, 16 nt, Human
ucuuaugggcuggguu

SEQ ID NO: 3025028 - RNA, 15 nt, Human
ucuuaugggcugggu

SEQ ID NO: 3025029 - RNA, 14 nt, Human
agacagucccugcc

SEQ ID NO: 3025030 - RNA, 15 nt, Human
agacagucccugcca

SEQ ID NO: 3025031 - RNA, 17 nt, Human
agacagucccugccaau

SEQ ID NO: 3025032 - RNA, 16 nt, Human
agacagucccugccaa

SEQ ID NO: 3025033 - RNA, 23 nt, Human
agacaggcaagcaccuccugccu

SEQ ID NO: 3025034 - RNA, 22 nt, Human
agacaggcaagcaccuccugcc

SEQ ID NO: 3025035 - RNA, 15 nt, Human
agacaggaccaggga

SEQ ID NO: 3025036 - RNA, 21 nt, Human
agacaggguuuugccauguug

SEQ ID NO: 3025037 - RNA, 20 nt, Human
agacuggauaguccgucucu

SEQ ID NO: 3025038 - RNA, 19 nt, Human
agacucuacagaggccaug

SEQ ID NO: 3025039 - RNA, 17 nt, Human
agacucuacagaggcca

SEQ ID NO: 3025040 - RNA, 21 nt, Human
agacucgcgacaaugcaaacc

SEQ ID NO: 3025041 - RNA, 23 nt, Human
agacuccugcaggcagccaggcc

SEQ ID NO: 3025042 - RNA, 20 nt, Human
agacuccugcaggcagccag

SEQ ID NO: 3025043 - RNA, 19 nt, Human
agacuccugcaggcagcca

SEQ ID NO: 3025044 - RNA, 18 nt, Human
agacuccugcaggcagcc

SEQ ID NO: 3025045 - RNA, 17 nt, Human
agacuccugcaggcagc

SEQ ID NO: 3025046 - RNA, 16 nt, Human
agacuccugcaggcag

SEQ ID NO: 3025047 - RNA, 15 nt, Human
agacuccugcaggca

SEQ ID NO: 3025048 - RNA, 14 nt, Human
agacuccugcaggc

SEQ ID NO: 3025049 - RNA, 12 nt, Human
ucuuuccugagg

SEQ ID NO: 3025050 - RNA, 15 nt, Human
ucuuuccugaggcug

SEQ ID NO: 3025051 - RNA, 14 nt, Human
ucuuuccugaggcu

SEQ ID NO: 3025052 - RNA, 13 nt, Human
ucuuuccugaggc

SEQ ID NO: 3025053 - RNA, 15 nt, Human
ucuuuacuucaugga

SEQ ID NO: 3025054 - RNA, 21 nt, Human
agacuggauaguccgucucug

SEQ ID NO: 3025055 - RNA, 17 nt, Human
agacuucaucccucugg

SEQ ID NO: 3025056 - RNA, 14 nt, Human
agacuucaucccuc

SEQ ID NO: 3025057 - RNA, 18 nt, Human
agagaaugaaagggccca

SEQ ID NO: 3025058 - RNA, 14 nt, Human
agacuuuggaaaga

SEQ ID NO: 3025059 - RNA, 12 nt, Human
agacuuuggaaa

SEQ ID NO: 3025060 - RNA, 15 nt, Human
agagaccaucccuga

SEQ ID NO: 3025061 - RNA, 14 nt, Human
agagaccaucccug

SEQ ID NO: 3025062 - RNA, 13 nt, Human
agagaccaucccu

SEQ ID NO: 3025063 - RNA, 16 nt, Human
agacccucucaaacua

SEQ ID NO: 3025064 - RNA, 24 nt, Human
agacccucaugcugccaauauccu

SEQ ID NO: 3025065 - RNA, 20 nt, Human
agacccucaugcugccaaua

SEQ ID NO: 3025066 - RNA, 21 nt, Human
agacccucaugcugccaauau

SEQ ID NO: 3025067 - RNA, 18 nt, Human
agacccucaugcugccaa

SEQ ID NO: 3025068 - RNA, 19 nt, Human
agacccucaugcugccaau

SEQ ID NO: 3025069 - RNA, 17 nt, Human
agacccucaugcugcca

SEQ ID NO: 3025070 - RNA, 12 nt, Human
agacccugcccu

SEQ ID NO: 3025071 - RNA, 14 nt, Human
agacccugcccugu

SEQ ID NO: 3025072 - RNA, 13 nt, Human
agacccugcccug

SEQ ID NO: 3025073 - RNA, 15 nt, Human
agacccuuguggucc

SEQ ID NO: 3025074 - RNA, 13 nt, Human
agacccuuguggu

SEQ ID NO: 3025075 - RNA, 23 nt, Human
agacccugcccugugggccccca

SEQ ID NO: 3025076 - RNA, 21 nt, Human
agacccugcccugugggcccc

SEQ ID NO: 3025077 - RNA, 19 nt, Human
agacccugcccugugggcc

SEQ ID NO: 3025078 - RNA, 16 nt, Human
agacccugcccugugg

SEQ ID NO: 3025079 - RNA, 23 nt, Human
agacccuuguggucccaccccac

SEQ ID NO: 3025080 - RNA, 22 nt, Human
agacccuuguggucccacccca

SEQ ID NO: 3025081 - RNA, 20 nt, Human
agacccuuguggucccaccc

SEQ ID NO: 3025082 - RNA, 19 nt, Human
agacccuuguggucccacc

SEQ ID NO: 3025083 - RNA, 17 nt, Human
ucuugcaauggcagccu

SEQ ID NO: 3025084 - RNA, 13 nt, Human
ucuugcaauggca

SEQ ID NO: 3025085 - RNA, 16 nt, Human
ucuugcaauggcagcc

SEQ ID NO: 3025086 - RNA, 15 nt, Human
agacucauucuucug

SEQ ID NO: 3025087 - RNA, 15 nt, Human
agacuaucuaaaugu

SEQ ID NO: 3025088 - RNA, 19 nt, Human
agacuaucuaaauguugaa

SEQ ID NO: 3025089 - RNA, 17 nt, Human
agacuaucuaaauguug

SEQ ID NO: 3025090 - RNA, 18 nt, Human
agacuaucuaaauguuga

SEQ ID NO: 3025091 - RNA, 18 nt, Human
agacucauucuucuguac

SEQ ID NO: 3025092 - RNA, 17 nt, Human
agacucauucuucugua

SEQ ID NO: 3025093 - RNA, 15 nt, Human
ucuggcagcucagag

SEQ ID NO: 3025094 - RNA, 14 nt, Human
ucuggcagcucaga

SEQ ID NO: 3025095 - RNA, 18 nt, Human
ucuggagguacgaaaaga

SEQ ID NO: 3025096 - RNA, 23 nt, Human
ucugcuuuuuaaagaaugcucuu

SEQ ID NO: 3025097 - RNA, 16 nt, Human
agaagcggcuggcagc

SEQ ID NO: 3025098 - RNA, 15 nt, Human
agaagcggcuggcag

SEQ ID NO: 3025099 - RNA, 23 nt, Human
ucugccgcagcccugcagagggc

SEQ ID NO: 3025100 - RNA, 14 nt, Human
ucugcccuccaaga

SEQ ID NO: 3025101 - RNA, 16 nt, Human
ucugcucacauaucug

SEQ ID NO: 3025102 - RNA, 17 nt, Human
agaacuaaaauguucua

SEQ ID NO: 3025103 - RNA, 20 nt, Human
agaacaaaggggcuuaauua

SEQ ID NO: 3025104 - RNA, 11 nt, Human
agaaauguguu

SEQ ID NO: 3025105 - RNA, 17 nt, Human
agaaauguacagcaagg

SEQ ID NO: 3025106 - RNA, 16 nt, Human
agaaauguacagcaag

SEQ ID NO: 3025107 - RNA, 19 nt, Human
ucugacccugcuucaaaua

SEQ ID NO: 3025108 - RNA, 18 nt, Human
ucugauucccaagcucug

SEQ ID NO: 3025109 - RNA, 19 nt, Human
ucugauucccaagcucugc

SEQ ID NO: 3025110 - RNA, 20 nt, Human
ucugauucccaagcucugcu

SEQ ID NO: 3025111 - RNA, 21 nt, Human
ucugauucccaagcucugcuc

SEQ ID NO: 3025112 - RNA, 22 nt, Human
ucugcacuccccugcugggugu

SEQ ID NO: 3025113 - RNA, 15 nt, Human
ucuccucucucugua

SEQ ID NO: 3025114 - RNA, 12 nt, Human
ucuccucugcug

SEQ ID NO: 3025115 - RNA, 19 nt, Human
ucucccuuggauugucccc

SEQ ID NO: 3025116 - RNA, 20 nt, Human
acuuguugaggguauguuuu

SEQ ID NO: 3025117 - RNA, 14 nt, Human
ucuccucugcugcu

SEQ ID NO: 3025118 - RNA, 13 nt, Human
ucuccucugcugc

SEQ ID NO: 3025119 - RNA, 18 nt, Human
ucucccuuggauuguccc

SEQ ID NO: 3025120 - RNA, 11 nt, Human
ucucccuugga

SEQ ID NO: 3025121 - RNA, 23 nt, Human
acuuugaccucugcagcaauaaa

SEQ ID NO: 3025122 - RNA, 19 nt, Human
acuuugaccucugcagcaa

SEQ ID NO: 3025123 - RNA, 19 nt, Human
acuuuaccuuuuuuauaca

SEQ ID NO: 3025124 - RNA, 22 nt, Human
acuuuaccuuuuuuauacauaa

SEQ ID NO: 3025125 - RNA, 18 nt, Human
acuuuaccuuuuuuauac

SEQ ID NO: 3025126 - RNA, 12 nt, Human
acuuuggaaaga

SEQ ID NO: 3025127 - RNA, 14 nt, Human
acuuuggaaagacu

SEQ ID NO: 3025128 - RNA, 13 nt, Human
acuuuggaaagac

SEQ ID NO: 3025129 - RNA, 17 nt, Human
acuuuggaaagacuuuu

SEQ ID NO: 3025130 - RNA, 17 nt, Human
ucucuccuguaccucuu

SEQ ID NO: 3025131 - RNA, 15 nt, Human
ucucuccagccccug

SEQ ID NO: 3025132 - RNA, 20 nt, Human
ucucuccuguaccucuugag

SEQ ID NO: 3025133 - RNA, 22 nt, Human
ucucuccuguaccucuugagcc

SEQ ID NO: 3025134 - RNA, 18 nt, Human
ucuccuucaccuuugucc

SEQ ID NO: 3025135 - RNA, 20 nt, Human
ucuccuucaccuuugucccc

SEQ ID NO: 3025136 - RNA, 14 nt, Human
ucucuccagccccu

SEQ ID NO: 3025137 - RNA, 13 nt, Human
ucucuccagcccc

SEQ ID NO: 3025138 - RNA, 14 nt, Human
ucucuugagagggu

SEQ ID NO: 3025139 - RNA, 15 nt, Human
ucucuugagccuggg

SEQ ID NO: 3025140 - RNA, 14 nt, Human
ucucuugagccugg

SEQ ID NO: 3025141 - RNA, 13 nt, Human
ucucuugagccug

SEQ ID NO: 3025142 - RNA, 22 nt, Human
ucucuuuaaugucacaggcagg

SEQ ID NO: 3025143 - RNA, 18 nt, Human
agaaaaaggaugcacaga

SEQ ID NO: 3025144 - RNA, 18 nt, Human
agcaacacaaagcuuuug

SEQ ID NO: 3025145 - RNA, 16 nt, Human
agcaacacaaagcuuu

SEQ ID NO: 3025146 - RNA, 21 nt, Human
agcaacacaaagcuuuugcau

SEQ ID NO: 3025147 - RNA, 15 nt, Human
agcaacacaaagcuu

SEQ ID NO: 3025148 - RNA, 14 nt, Human
agauuucacucucc

SEQ ID NO: 3025149 - RNA, 13 nt, Human
agauuucacucuc

SEQ ID NO: 3025150 - RNA, 15 nt, Human
ugaccugaggcccuu

SEQ ID NO: 3025151 - RNA, 14 nt, Human
ugaccugaggcccu

SEQ ID NO: 3025152 - RNA, 19 nt, Human
ugacuccagaauuucccaa

SEQ ID NO: 3025153 - RNA, 17 nt, Human
ugacuccagaauuuccc

SEQ ID NO: 3025154 - RNA, 23 nt, Human
ugacuccagaauuucccaaagca

SEQ ID NO: 3025155 - RNA, 20 nt, Human
ugacuccagaauuucccaaa

SEQ ID NO: 3025156 - RNA, 16 nt, Human
ugacauugacuauuuu

SEQ ID NO: 3025157 - RNA, 14 nt, Human
ugacauugacuauu

SEQ ID NO: 3025158 - RNA, 17 nt, Human
ugacauugcaccuggau

SEQ ID NO: 3025159 - RNA, 14 nt, Human
ugacauugcaccug

SEQ ID NO: 3025160 - RNA, 12 nt, Human
ugaccugaggcc

SEQ ID NO: 3025161 - RNA, 14 nt, Human
ugaccucugccuga

SEQ ID NO: 3025162 - RNA, 13 nt, Human
ugaccucugccug

SEQ ID NO: 3025163 - RNA, 16 nt, Human
agaugcuucucacugc

SEQ ID NO: 3025164 - RNA, 18 nt, Human
agaugcuucucacugcca

SEQ ID NO: 3025165 - RNA, 21 nt, Human
ugaagauucuauguuaauauu

SEQ ID NO: 3025166 - RNA, 17 nt, Human
ugaagcagaguggcagu

SEQ ID NO: 3025167 - RNA, 20 nt, Human
agagggagggagggcuccag

SEQ ID NO: 3025168 - RNA, 21 nt, Human
agagggagggagggcuccaga

SEQ ID NO: 3025169 - RNA, 22 nt, Human
agagggagggagggcuccagac

SEQ ID NO: 3025170 - RNA, 19 nt, Human
agagcugggugucaagagg

SEQ ID NO: 3025171 - RNA, 19 nt, Human
agaggaaagcaaaggagau

SEQ ID NO: 3025172 - RNA, 18 nt, Human
agaggaaagcaaaggaga

SEQ ID NO: 3025173 - RNA, 16 nt, Human
agaggaaagcaaagga

SEQ ID NO: 3025174 - RNA, 12 nt, Human
agaggaaagcaa

SEQ ID NO: 3025175 - RNA, 12 nt, Human
agaggaaaucac

SEQ ID NO: 3025176 - RNA, 11 nt, Human
agaggaaauca

SEQ ID NO: 3025177 - RNA, 18 nt, Human
agaggcaacugcauuggc

SEQ ID NO: 3025178 - RNA, 21 nt, Human
ucuuuggucuacacugugcug

SEQ ID NO: 3025179 - RNA, 14 nt, Human
ucuuuggucuacac

SEQ ID NO: 3025180 - RNA, 11 nt, Human
ugaacuuugac

SEQ ID NO: 3025181 - RNA, 16 nt, Human
ugaacuuugaccucug

SEQ ID NO: 3025182 - RNA, 13 nt, Human
ugaagacaaugac

SEQ ID NO: 3025183 - RNA, 17 nt, Human
ugaagacaaugacuuac

SEQ ID NO: 3025184 - RNA, 11 nt, Human
ugaagacaaug

SEQ ID NO: 3025185 - RNA, 17 nt, Human
agauaaggguaucuggu

SEQ ID NO: 3025186 - RNA, 19 nt, Human
agauaaggguaucugguga

SEQ ID NO: 3025187 - RNA, 19 nt, Human
agagugagacucugucuca

SEQ ID NO: 3025188 - RNA, 22 nt, Human
agauauuuugcuuugugauuuu

SEQ ID NO: 3025189 - RNA, 19 nt, Human
agauacaggaaaagcugcu

SEQ ID NO: 3025190 - RNA, 14 nt, Human
agaucaaccccuuc

SEQ ID NO: 3025191 - RNA, 19 nt, Human
agaucaaccccuucgcucc

SEQ ID NO: 3025192 - RNA, 21 nt, Human
agaucaaccccuucgcuccug

SEQ ID NO: 3025193 - RNA, 14 nt, Human
ugaaugucagugug

SEQ ID NO: 3025194 - RNA, 18 nt, Human
ugaaugucagugugacug

SEQ ID NO: 3025195 - RNA, 15 nt, Human
ugaaugucaguguga

SEQ ID NO: 3025196 - RNA, 20 nt, Human
agagucucacuguugcccag

SEQ ID NO: 3025197 - RNA, 22 nt, Human
agagucucacuguugcccaggc

SEQ ID NO: 3025198 - RNA, 15 nt, Human
agagugagacucugu

SEQ ID NO: 3025199 - RNA, 16 nt, Human
agagugagacucuguc

SEQ ID NO: 3025200 - RNA, 13 nt, Human
agcagagugcuuu

SEQ ID NO: 3025201 - RNA, 10 nt, Human
agcagagugc

SEQ ID NO: 3025202 - RNA, 17 nt, Human
agcagaggaaggagagg

SEQ ID NO: 3025203 - RNA, 19 nt, Human
agcagauggagaccccuug

SEQ ID NO: 3025204 - RNA, 20 nt, Human
agcagagaccaucccugaag

SEQ ID NO: 3025205 - RNA, 20 nt, Human
agcagagcaccuuagacagu

SEQ ID NO: 3025206 - RNA, 17 nt, Human
ugaggucagagccugca

SEQ ID NO: 3025207 - RNA, 17 nt, Human
agcagagaccaucccug

SEQ ID NO: 3025208 - RNA, 19 nt, Human
agcagagaccaucccugaa

SEQ ID NO: 3025209 - RNA, 18 nt, Human
agcagagaccaucccuga

SEQ ID NO: 3025210 - RNA, 20 nt, Human
ugaggguugggcugguguca

SEQ ID NO: 3025211 - RNA, 14 nt, Human
ugaggucagagccu

SEQ ID NO: 3025212 - RNA, 16 nt, Human
ugaggucagagccugc

SEQ ID NO: 3025213 - RNA, 13 nt, Human
ugaggucagagcc

SEQ ID NO: 3025214 - RNA, 19 nt, Human
ugagggauacccaucccau

SEQ ID NO: 3025215 - RNA, 16 nt, Human
ugaggcccuucucucc

SEQ ID NO: 3025216 - RNA, 19 nt, Human
ugaggcccuucucuccagc

SEQ ID NO: 3025217 - RNA, 18 nt, Human
ugaggcccuucucuccag

SEQ ID NO: 3025218 - RNA, 24 nt, Human
ugaggcccuucucuccagccccug

SEQ ID NO: 3025219 - RNA, 23 nt, Human
ugaggcccuucucuccagccccu

SEQ ID NO: 3025220 - RNA, 22 nt, Human
ugaggcccuucucuccagcccc

SEQ ID NO: 3025221 - RNA, 20 nt, Human
ugaggcccuucucuccagcc

SEQ ID NO: 3025222 - RNA, 12 nt, Human
ugaggggccucu

SEQ ID NO: 3025223 - RNA, 13 nt, Human
ugaggggccucuu

SEQ ID NO: 3025224 - RNA, 21 nt, Human
ugaggaagccgcuggggccag

SEQ ID NO: 3025225 - RNA, 19 nt, Human
ugaggaagccgcuggggcc

SEQ ID NO: 3025226 - RNA, 18 nt, Human
ugaggaagccgcuggggc

SEQ ID NO: 3025227 - RNA, 17 nt, Human
ugaggaagccgcugggg

SEQ ID NO: 3025228 - RNA, 14 nt, Human
ugaggaagccgcug

SEQ ID NO: 3025229 - RNA, 22 nt, Human
ugaggaagcaaaagcaucuaug

SEQ ID NO: 3025230 - RNA, 15 nt, Human
ugaggaagcaaaagc

SEQ ID NO: 3025231 - RNA, 13 nt, Human
ugaggcccagagg

SEQ ID NO: 3025232 - RNA, 12 nt, Human
ugaggcccagag

SEQ ID NO: 3025233 - RNA, 16 nt, Human
ugaggccagagacaca

SEQ ID NO: 3025234 - RNA, 14 nt, Human
ugaggccagagaca

SEQ ID NO: 3025235 - RNA, 20 nt, Human
ugaggccagagacacaagcc

SEQ ID NO: 3025236 - RNA, 20 nt, Human
ugaggcccagagggccugca

SEQ ID NO: 3025237 - RNA, 18 nt, Human
ugaggcccagagggccug

SEQ ID NO: 3025238 - RNA, 17 nt, Human
ugaggcccagagggccu

SEQ ID NO: 3025239 - RNA, 15 nt, Human
ugaggcccagagggc

SEQ ID NO: 3025240 - RNA, 22 nt, Human
ugaggcccagagggccugcaag

SEQ ID NO: 3025241 - RNA, 21 nt, Human
ugaggcccagagggccugcaa

SEQ ID NO: 3025242 - RNA, 23 nt, Human
ugaggcccagagggccugcaagg

SEQ ID NO: 3025243 - RNA, 21 nt, Human
ugaggaauccagacccggcug

SEQ ID NO: 3025244 - RNA, 22 nt, Human
ugaggaauccagacccggcugc

SEQ ID NO: 3025245 - RNA, 12 nt, Human
ugaggccagaga

SEQ ID NO: 3025246 - RNA, 23 nt, Human
ugaggcauuuguuugaacugaua

SEQ ID NO: 3025247 - RNA, 21 nt, Human
ugaggacacuaaccacgcugg

SEQ ID NO: 3025248 - RNA, 23 nt, Human
ugagcaucgcuuaggagaagucu

SEQ ID NO: 3025249 - RNA, 24 nt, Human
ugagcaucaggccaggcccucugc

SEQ ID NO: 3025250 - RNA, 22 nt, Human
ugagcaucaggccaggcccucu

SEQ ID NO: 3025251 - RNA, 21 nt, Human
ugagcaucaggccaggcccuc

SEQ ID NO: 3025252 - RNA, 21 nt, Human
ugagccacugcaccgggccac

SEQ ID NO: 3025253 - RNA, 18 nt, Human
ugagccacugcaccgggc

SEQ ID NO: 3025254 - RNA, 23 nt, Human
ugagccacugcaccgggccacag

SEQ ID NO: 3025255 - RNA, 13 nt, Human
ugagccagauuuc

SEQ ID NO: 3025256 - RNA, 16 nt, Human
ugagccagauuucacu

SEQ ID NO: 3025257 - RNA, 14 nt, Human
ugagccagauuuca

SEQ ID NO: 3025258 - RNA, 20 nt, Human
ugagcacuaaggugugcucu

SEQ ID NO: 3025259 - RNA, 21 nt, Human
ugagcacuaaggugugcucug

SEQ ID NO: 3025260 - RNA, 22 nt, Human
ugagcacuaaggugugcucuga

SEQ ID NO: 3025261 - RNA, 23 nt, Human
ugagcacuaaggugugcucugau

SEQ ID NO: 3025262 - RNA, 15 nt, Human
ugagcaauccugcaa

SEQ ID NO: 3025263 - RNA, 16 nt, Human
agcacagcuucauuuc

SEQ ID NO: 3025264 - RNA, 22 nt, Human
agcaccaaaagcuuaccaaggg

SEQ ID NO: 3025265 - RNA, 14 nt, Human
agcacaugccucuc

SEQ ID NO: 3025266 - RNA, 13 nt, Human
agcacaugccucu

SEQ ID NO: 3025267 - RNA, 22 nt, Human
agcaagugagagcuggguguca

SEQ ID NO: 3025268 - RNA, 18 nt, Human
agcaagugagagcugggu

SEQ ID NO: 3025269 - RNA, 14 nt, Human
agcaagugagagcu

SEQ ID NO: 3025270 - RNA, 20 nt, Human
agcaagugagacccugucuc

SEQ ID NO: 3025271 - RNA, 13 nt, Human
agcaagugagagc

SEQ ID NO: 3025272 - RNA, 22 nt, Human
ugagccagauuucacucuccuu

SEQ ID NO: 3025273 - RNA, 17 nt, Human
ugagccagauuucacuc

SEQ ID NO: 3025274 - RNA, 10 nt, Human
ugagccuggc

SEQ ID NO: 3025275 - RNA, 16 nt, Human
agcagagaccaucccu

SEQ ID NO: 3025276 - RNA, 15 nt, Human
agcagagaccauccc

SEQ ID NO: 3025277 - RNA, 22 nt, Human
agcagagaaugaaagggcccag

SEQ ID NO: 3025278 - RNA, 23 nt, Human
agcagagaaugaaagggcccaga

SEQ ID NO: 3025279 - RNA, 14 nt, Human
agcagagaauucuc

SEQ ID NO: 3025280 - RNA, 21 nt, Human
agcagagaauucucuuaucca

SEQ ID NO: 3025281 - RNA, 21 nt, Human
agcagagaaugaaagggccca

SEQ ID NO: 3025282 - RNA, 14 nt, Human
ugagccugggaggu

SEQ ID NO: 3025283 - RNA, 16 nt, Human
ugagccuggcaagaau

SEQ ID NO: 3025284 - RNA, 11 nt, Human
ugagccuggca

SEQ ID NO: 3025285 - RNA, 14 nt, Human
ugagccuugaacuu

SEQ ID NO: 3025286 - RNA, 22 nt, Human
ugagccugggaggucaaggcug

SEQ ID NO: 3025287 - RNA, 19 nt, Human
ugagccugggaggucaagg

SEQ ID NO: 3025288 - RNA, 15 nt, Human
ugagccuugaacuuu

SEQ ID NO: 3025289 - RNA, 17 nt, Human
ugagccuugaacuuuga

SEQ ID NO: 3025290 - RNA, 18 nt, Human
ugagccuugaacuuugac

SEQ ID NO: 3025291 - RNA, 19 nt, Human
ugagccuugaacuuugacc

SEQ ID NO: 3025292 - RNA, 22 nt, Human
agcaccuuagacagucccugcc

SEQ ID NO: 3025293 - RNA, 21 nt, Human
agcaccuuagacagucccugc

SEQ ID NO: 3025294 - RNA, 20 nt, Human
agcaccuuagacagucccug

SEQ ID NO: 3025295 - RNA, 19 nt, Human
agcaccuuagacagucccu

SEQ ID NO: 3025296 - RNA, 13 nt, Human
agcacgauuucug

SEQ ID NO: 3025297 - RNA, 23 nt, Human
agcaccuuagacagucccugcca

SEQ ID NO: 3025298 - RNA, 16 nt, Human
agcacgauuucuguuu

SEQ ID NO: 3025299 - RNA, 14 nt, Human
agcacgauuucugu

SEQ ID NO: 3025300 - RNA, 15 nt, Human
agcacgauuucuguu

SEQ ID NO: 3025301 - RNA, 22 nt, Human
agcacuuugggaggccaaggug

SEQ ID NO: 3025302 - RNA, 23 nt, Human
agcacuuugggaggccaaggugg

SEQ ID NO: 3025303 - RNA, 12 nt, Human
agcagaaaugcc

SEQ ID NO: 3025304 - RNA, 13 nt, Human
agcagaaaugccu

SEQ ID NO: 3025305 - RNA, 19 nt, Human
agcagaaaugccuuacccu

SEQ ID NO: 3025306 - RNA, 18 nt, Human
ucagaugcacaugagcug

SEQ ID NO: 3025307 - RNA, 16 nt, Human
ucagaacuauguuuuu

SEQ ID NO: 3025308 - RNA, 19 nt, Human
ucagaacuauguuuuuguu

SEQ ID NO: 3025309 - RNA, 13 nt, Human
ucagaucuucugu

SEQ ID NO: 3025310 - RNA, 13 nt, Human
ucagaagacacug

SEQ ID NO: 3025311 - RNA, 15 nt, Human
acccagcucuggucc

SEQ ID NO: 3025312 - RNA, 13 nt, Human
acccagcucuggu

SEQ ID NO: 3025313 - RNA, 15 nt, Human
acccccagccugcua

SEQ ID NO: 3025314 - RNA, 14 nt, Human
acccccagccugcu

SEQ ID NO: 3025315 - RNA, 12 nt, Human
ucagccugggca

SEQ ID NO: 3025316 - RNA, 10 nt, Human
ucagccuggg

SEQ ID NO: 3025317 - RNA, 14 nt, Human
acccucuuagaaaa

SEQ ID NO: 3025318 - RNA, 13 nt, Human
acccugcccugug

SEQ ID NO: 3025319 - RNA, 12 nt, Human
acccugcccugu

SEQ ID NO: 3025320 - RNA, 11 nt, Human
acccugcccug

SEQ ID NO: 3025321 - RNA, 15 nt, Human
acccuugugguccca

SEQ ID NO: 3025322 - RNA, 19 nt, Human
acccuuguggucccacccc

SEQ ID NO: 3025323 - RNA, 17 nt, Human
acccuuguggucccacc

SEQ ID NO: 3025324 - RNA, 16 nt, Human
acccuuguggucccac

SEQ ID NO: 3025325 - RNA, 23 nt, Human
ucaggguuggccccugcccggcu

SEQ ID NO: 3025326 - RNA, 20 nt, Human
accccuucgcuccugugucu

SEQ ID NO: 3025327 - RNA, 13 nt, Human
ucagggucccugg

SEQ ID NO: 3025328 - RNA, 23 nt, Human
ucaggggugugcggccuuuggcu

SEQ ID NO: 3025329 - RNA, 18 nt, Human
ucagggucccugguggca

SEQ ID NO: 3025330 - RNA, 14 nt, Human
ucagggucccuggu

SEQ ID NO: 3025331 - RNA, 13 nt, Human
ucagguaacaggc

SEQ ID NO: 3025332 - RNA, 15 nt, Human
ucagguaacaggcag

SEQ ID NO: 3025333 - RNA, 16 nt, Human
ucagguaacaggcaga

SEQ ID NO: 3025334 - RNA, 19 nt, Human
accccuucgcuccuguguc

SEQ ID NO: 3025335 - RNA, 14 nt, Human
ucaggccagcugcu

SEQ ID NO: 3025336 - RNA, 11 nt, Human
ucaggccaggc

SEQ ID NO: 3025337 - RNA, 20 nt, Human
ucaggccagcugcuugggcu

SEQ ID NO: 3025338 - RNA, 15 nt, Human
ucaggccagcugcuu

SEQ ID NO: 3025339 - RNA, 15 nt, Human
ucagcggggacagcu

SEQ ID NO: 3025340 - RNA, 16 nt, Human
ucagcggggacagcuc

SEQ ID NO: 3025341 - RNA, 17 nt, Human
ucagcggggacagcucc

SEQ ID NO: 3025342 - RNA, 20 nt, Human
ucaggaagcucagggccugg

SEQ ID NO: 3025343 - RNA, 19 nt, Human
ucaggaagcucagggccug

SEQ ID NO: 3025344 - RNA, 17 nt, Human
ucaggaagcucagggcc

SEQ ID NO: 3025345 - RNA, 16 nt, Human
ucaggaagcucagggc

SEQ ID NO: 3025346 - RNA, 23 nt, Human
ucaggccaaacucaccugccccu

SEQ ID NO: 3025347 - RNA, 20 nt, Human
ucaggccaaacucaccugcc

SEQ ID NO: 3025348 - RNA, 12 nt, Human
ucacugcagccu

SEQ ID NO: 3025349 - RNA, 16 nt, Human
ucacuguugcccaggc

SEQ ID NO: 3025350 - RNA, 13 nt, Human
ucacugagacagc

SEQ ID NO: 3025351 - RNA, 15 nt, Human
ucacugagacagccc

SEQ ID NO: 3025352 - RNA, 14 nt, Human
ucacugagacagcc

SEQ ID NO: 3025353 - RNA, 16 nt, Human
ucaccugccccucaac

SEQ ID NO: 3025354 - RNA, 17 nt, Human
ucacuguugcccaggcu

SEQ ID NO: 3025355 - RNA, 18 nt, Human
ucacuguugcccaggcug

SEQ ID NO: 3025356 - RNA, 21 nt, Human
accaguguuguggauuuaaca

SEQ ID NO: 3025357 - RNA, 18 nt, Human
accaguguuguggauuua

SEQ ID NO: 3025358 - RNA, 16 nt, Human
acccagcccacuucug

SEQ ID NO: 3025359 - RNA, 17 nt, Human
acccagcccacuucugc

SEQ ID NO: 3025360 - RNA, 18 nt, Human
acccagcccacuucugcc

SEQ ID NO: 3025361 - RNA, 16 nt, Human
acccagaagaaaauag

SEQ ID NO: 3025362 - RNA, 23 nt, Human
accaugauuaaccacuucagcug

SEQ ID NO: 3025363 - RNA, 22 nt, Human
accaugauuaaccacuucagcu

SEQ ID NO: 3025364 - RNA, 18 nt, Human
accauucuccaccugcca

SEQ ID NO: 3025365 - RNA, 16 nt, Human
accauucuccaccugc

SEQ ID NO: 3025366 - RNA, 13 nt, Human
accauucuccacc

SEQ ID NO: 3025367 - RNA, 22 nt, Human
accauuuugggguacccacugc

SEQ ID NO: 3025368 - RNA, 23 nt, Human
accauuuugggguacccacugcu

SEQ ID NO: 3025369 - RNA, 19 nt, Human
accagagcccaccuuggcu

SEQ ID NO: 3025370 - RNA, 22 nt, Human
accagagcccaccuuggcucaa

SEQ ID NO: 3025371 - RNA, 17 nt, Human
accagagcccaccuugg

SEQ ID NO: 3025372 - RNA, 22 nt, Human
accagacaccuugacagggcac

SEQ ID NO: 3025373 - RNA, 23 nt, Human
accagacaccuugacagggcaca

SEQ ID NO: 3025374 - RNA, 17 nt, Human
accagacaccuugacag

SEQ ID NO: 3025375 - RNA, 12 nt, Human
accacuuuuguu

SEQ ID NO: 3025376 - RNA, 23 nt, Human
ucaccugaagacucauucuucug

SEQ ID NO: 3025377 - RNA, 16 nt, Human
ucaccugaagacucau

SEQ ID NO: 3025378 - RNA, 19 nt, Human
ucaccugaagacucauucu

SEQ ID NO: 3025379 - RNA, 20 nt, Human
accacucuaucaaguauuau

SEQ ID NO: 3025380 - RNA, 20 nt, Human
accacaucuugcucugcuga

SEQ ID NO: 3025381 - RNA, 21 nt, Human
accacaucuugcucugcugac

SEQ ID NO: 3025382 - RNA, 24 nt, Human
accacaucuugcucugcugacaga

SEQ ID NO: 3025383 - RNA, 15 nt, Human
accacuucagcugac

SEQ ID NO: 3025384 - RNA, 14 nt, Human
accacuucagcuga

SEQ ID NO: 3025385 - RNA, 13 nt, Human
accacuucagcug

SEQ ID NO: 3025386 - RNA, 21 nt, Human
accacagacauacuaaccagc

SEQ ID NO: 3025387 - RNA, 22 nt, Human
accacagacauacuaaccagca

SEQ ID NO: 3025388 - RNA, 14 nt, Human
accacaucuugcuc

SEQ ID NO: 3025389 - RNA, 21 nt, Human
uccacauuuguuuugccaauu

SEQ ID NO: 3025390 - RNA, 11 nt, Human
uccaagcuggu

SEQ ID NO: 3025391 - RNA, 16 nt, Human
uccaagcucccaggca

SEQ ID NO: 3025392 - RNA, 15 nt, Human
uccaagcucccaggc

SEQ ID NO: 3025393 - RNA, 14 nt, Human
uccaagcucccagg

SEQ ID NO: 3025394 - RNA, 13 nt, Human
uccaagcucccag

SEQ ID NO: 3025395 - RNA, 12 nt, Human
uccaagcuccca

SEQ ID NO: 3025396 - RNA, 18 nt, Human
accugcggugcuaucucc

SEQ ID NO: 3025397 - RNA, 22 nt, Human
accugaagucuuuguacagaca

SEQ ID NO: 3025398 - RNA, 15 nt, Human
accugaagucuuugu

SEQ ID NO: 3025399 - RNA, 23 nt, Human
accugcggugcuaucucccccag

SEQ ID NO: 3025400 - RNA, 22 nt, Human
accugcggugcuaucuccccca

SEQ ID NO: 3025401 - RNA, 19 nt, Human
accugcggugcuaucuccc

SEQ ID NO: 3025402 - RNA, 19 nt, Human
ucauuugagcagggcucag

SEQ ID NO: 3025403 - RNA, 14 nt, Human
accuggaauauaua

SEQ ID NO: 3025404 - RNA, 17 nt, Human
accuggaauauauaacc

SEQ ID NO: 3025405 - RNA, 21 nt, Human
ucauuugagcagggcucagcg

SEQ ID NO: 3025406 - RNA, 13 nt, Human
ucauuuuuuuuaa

SEQ ID NO: 3025407 - RNA, 23 nt, Human
accuuuguauucucuccuguacc

SEQ ID NO: 3025408 - RNA, 15 nt, Human
accuuuguauucucu

SEQ ID NO: 3025409 - RNA, 19 nt, Human
accuuuguauucucuccug

SEQ ID NO: 3025410 - RNA, 22 nt, Human
uccagaaguuugagaucagccu

SEQ ID NO: 3025411 - RNA, 14 nt, Human
uccagccccuggau

SEQ ID NO: 3025412 - RNA, 15 nt, Human
uccagccccuggaug

SEQ ID NO: 3025413 - RNA, 21 nt, Human
uccagccccuggaugcagccu

SEQ ID NO: 3025414 - RNA, 19 nt, Human
uccagccccuggaugcagc

SEQ ID NO: 3025415 - RNA, 17 nt, Human
uccagccccuggaugca

SEQ ID NO: 3025416 - RNA, 16 nt, Human
uccagccccuggaugc

SEQ ID NO: 3025417 - RNA, 11 nt, Human
uccagccuggg

SEQ ID NO: 3025418 - RNA, 22 nt, Human
uccagccccuggaugcagccuc

SEQ ID NO: 3025419 - RNA, 15 nt, Human
accuugacagggcac

SEQ ID NO: 3025420 - RNA, 14 nt, Human
accuugacagggca

SEQ ID NO: 3025421 - RNA, 15 nt, Human
accuugaaugaugcc

SEQ ID NO: 3025422 - RNA, 13 nt, Human
accuucuccuuca

SEQ ID NO: 3025423 - RNA, 12 nt, Human
accuucuccuuc

SEQ ID NO: 3025424 - RNA, 15 nt, Human
uccaccaucaagcca

SEQ ID NO: 3025425 - RNA, 17 nt, Human
accuuagacagucccug

SEQ ID NO: 3025426 - RNA, 13 nt, Human
accuagccuuaga

SEQ ID NO: 3025427 - RNA, 18 nt, Human
ucauccacugugccaugu

SEQ ID NO: 3025428 - RNA, 20 nt, Human
accuccgccucuuggguuca

SEQ ID NO: 3025429 - RNA, 10 nt, Human
acccuuuucu

SEQ ID NO: 3025430 - RNA, 20 nt, Human
ucauauuuacuucuuauaca

SEQ ID NO: 3025431 - RNA, 21 nt, Human
ucauauuuacuucuuauacau

SEQ ID NO: 3025432 - RNA, 22 nt, Human
ucauauuuacuucuuauacauu

SEQ ID NO: 3025433 - RNA, 16 nt, Human
ucauauuuacuucuua

SEQ ID NO: 3025434 - RNA, 17 nt, Human
accgcagacaggaccag

SEQ ID NO: 3025435 - RNA, 17 nt, Human
accgccaaggcuggggg

SEQ ID NO: 3025436 - RNA, 20 nt, Human
accgcagacaggaccaggga

SEQ ID NO: 3025437 - RNA, 12 nt, Human
accucugcacaa

SEQ ID NO: 3025438 - RNA, 19 nt, Human
accucucucacuccuugaa

SEQ ID NO: 3025439 - RNA, 14 nt, Human
accucucucacucc

SEQ ID NO: 3025440 - RNA, 23 nt, Human
accucucccuuggauuguccccg

SEQ ID NO: 3025441 - RNA, 15 nt, Human
accucucccuuggau

SEQ ID NO: 3025442 - RNA, 14 nt, Human
accucucccuugga

SEQ ID NO: 3025443 - RNA, 13 nt, Human
accucucccuugg

SEQ ID NO: 3025444 - RNA, 17 nt, Human
accucggugccuuccuc

SEQ ID NO: 3025445 - RNA, 19 nt, Human
ucauugaccugaggcccuu

SEQ ID NO: 3025446 - RNA, 21 nt, Human
ucauucuccuuguguuacuaa

SEQ ID NO: 3025447 - RNA, 22 nt, Human
ucauugaccugaggcccuucuc

SEQ ID NO: 3025448 - RNA, 11 nt, Human
ucauguucuua

SEQ ID NO: 3025449 - RNA, 17 nt, Human
ucauguucuuaauucuu

SEQ ID NO: 3025450 - RNA, 13 nt, Human
ucaugucuggcua

SEQ ID NO: 3025451 - RNA, 19 nt, Human
ucaugacaaagacugagua

SEQ ID NO: 3025452 - RNA, 19 nt, Human
ucauccacugugccaugug

SEQ ID NO: 3025453 - RNA, 21 nt, Human
ucauccacugugccaugugcc

SEQ ID NO: 3025454 - RNA, 23 nt, Human
ucauccacugugccaugugccag

SEQ ID NO: 3025455 - RNA, 20 nt, Human
uccuguuuuuauuauuaaca

SEQ ID NO: 3025456 - RNA, 16 nt, Human
uccuguuuuuauuauu

SEQ ID NO: 3025457 - RNA, 21 nt, Human
uccuguuuuuauuauuaacaa

SEQ ID NO: 3025458 - RNA, 15 nt, Human
uccuguuuuuauuau

SEQ ID NO: 3025459 - RNA, 19 nt, Human
uccuguucccaugagauga

SEQ ID NO: 3025460 - RNA, 18 nt, Human
uccugugugugcgccuac

SEQ ID NO: 3025461 - RNA, 13 nt, Human
uccugugugugcg

SEQ ID NO: 3025462 - RNA, 14 nt, Human
uccugugugugcgc

SEQ ID NO: 3025463 - RNA, 23 nt, Human
uccugugucuugcaauggcagcc

SEQ ID NO: 3025464 - RNA, 24 nt, Human
uccugugucuugcaauggcagccu

SEQ ID NO: 3025465 - RNA, 19 nt, Human
acugcagccucaaccuccu

SEQ ID NO: 3025466 - RNA, 21 nt, Human
acugcagccucaaccuccugg

SEQ ID NO: 3025467 - RNA, 22 nt, Human
acugcagccucaaccuccuggg

SEQ ID NO: 3025468 - RNA, 13 nt, Human
acugcacuguuuu

SEQ ID NO: 3025469 - RNA, 23 nt, Human
acugcagccucaaccuccugggc

SEQ ID NO: 3025470 - RNA, 13 nt, Human
uccugcugcaguu

SEQ ID NO: 3025471 - RNA, 17 nt, Human
uccugccucagccuccc

SEQ ID NO: 3025472 - RNA, 20 nt, Human
uccugccucgaacuggcugc

SEQ ID NO: 3025473 - RNA, 22 nt, Human
uccugcaggcagccaggccaca

SEQ ID NO: 3025474 - RNA, 19 nt, Human
uccugccucagccucccaa

SEQ ID NO: 3025475 - RNA, 20 nt, Human
uccugcaggcagccaggcca

SEQ ID NO: 3025476 - RNA, 19 nt, Human
uccugcaggcagccaggcc

SEQ ID NO: 3025477 - RNA, 17 nt, Human
uccugcaggcagccagg

SEQ ID NO: 3025478 - RNA, 16 nt, Human
uccugcaggcagccag

SEQ ID NO: 3025479 - RNA, 15 nt, Human
uccugcaggcagcca

SEQ ID NO: 3025480 - RNA, 22 nt, Human
acugaguacguugugcauuugg

SEQ ID NO: 3025481 - RNA, 23 nt, Human
acugaguacguugugcauuuggu

SEQ ID NO: 3025482 - RNA, 18 nt, Human
acugaguacguugugcau

SEQ ID NO: 3025483 - RNA, 19 nt, Human
acugaguacguugugcauu

SEQ ID NO: 3025484 - RNA, 21 nt, Human
acugaguacguugugcauuug

SEQ ID NO: 3025485 - RNA, 13 nt, Human
acugcaaccuccg

SEQ ID NO: 3025486 - RNA, 14 nt, Human
acugcaaccuccgc

SEQ ID NO: 3025487 - RNA, 16 nt, Human
acugcaaccuccgccu

SEQ ID NO: 3025488 - RNA, 22 nt, Human
acugcaaccuccgccucuuggg

SEQ ID NO: 3025489 - RNA, 15 nt, Human
uccucuccccagcaa

SEQ ID NO: 3025490 - RNA, 12 nt, Human
uccuucagugcc

SEQ ID NO: 3025491 - RNA, 11 nt, Human
uccuucagugc

SEQ ID NO: 3025492 - RNA, 22 nt, Human
uccuucagugccuuauggaaca

SEQ ID NO: 3025493 - RNA, 20 nt, Human
uccuucagugccuuauggaa

SEQ ID NO: 3025494 - RNA, 13 nt, Human
uccuucagugccu

SEQ ID NO: 3025495 - RNA, 22 nt, Human
acuggcugcaaaggguaucagg

SEQ ID NO: 3025496 - RNA, 23 nt, Human
acugcuuccagugaggcucugcc

SEQ ID NO: 3025497 - RNA, 22 nt, Human
acugcuuccagugaggcucugc

SEQ ID NO: 3025498 - RNA, 21 nt, Human
acugcuuccagugaggcucug

SEQ ID NO: 3025499 - RNA, 18 nt, Human
acugcuuccagugaggcu

SEQ ID NO: 3025500 - RNA, 22 nt, Human
acuggauuaaacuuaaucuaaa

SEQ ID NO: 3025501 - RNA, 14 nt, Human
ucgaggacagggag

SEQ ID NO: 3025502 - RNA, 17 nt, Human
ucgaggacagggaggug

SEQ ID NO: 3025503 - RNA, 13 nt, Human
ucgcgacaaugca

SEQ ID NO: 3025504 - RNA, 13 nt, Human
ucgaggacaggga

SEQ ID NO: 3025505 - RNA, 14 nt, Human
ucgagcaugccugg

SEQ ID NO: 3025506 - RNA, 15 nt, Human
uccuuucaccacaug

SEQ ID NO: 3025507 - RNA, 23 nt, Human
uccuuuagcgcccaguugggugg

SEQ ID NO: 3025508 - RNA, 15 nt, Human
ucgaacuggcugcaa

SEQ ID NO: 3025509 - RNA, 14 nt, Human
ucgaacuggcugca

SEQ ID NO: 3025510 - RNA, 13 nt, Human
ucgaacuggcugc

SEQ ID NO: 3025511 - RNA, 18 nt, Human
acuggguacuuguggaca

SEQ ID NO: 3025512 - RNA, 20 nt, Human
acuggguacuuguggacaca

SEQ ID NO: 3025513 - RNA, 23 nt, Human
acuggguacuuguggacacagcu

SEQ ID NO: 3025514 - RNA, 19 nt, Human
acuggguacuuguggacac

SEQ ID NO: 3025515 - RNA, 12 nt, Human
ucgcuccugugu

SEQ ID NO: 3025516 - RNA, 13 nt, Human
ucgcuccuguguc

SEQ ID NO: 3025517 - RNA, 22 nt, Human
acugggcuuggggaccagagcu

SEQ ID NO: 3025518 - RNA, 23 nt, Human
acuguacaugaaaacacauuuuu

SEQ ID NO: 3025519 - RNA, 13 nt, Human
acuguacaugaaa

SEQ ID NO: 3025520 - RNA, 14 nt, Human
acuguacaugaaaa

SEQ ID NO: 3025521 - RNA, 19 nt, Human
acuguaauuugugauacaa

SEQ ID NO: 3025522 - RNA, 13 nt, Human
acuguacaaagua

SEQ ID NO: 3025523 - RNA, 14 nt, Human
acuguacaaaguag

SEQ ID NO: 3025524 - RNA, 15 nt, Human
acuguacaaaguaga

SEQ ID NO: 3025525 - RNA, 14 nt, Human
acuaaaauguucua

SEQ ID NO: 3025526 - RNA, 15 nt, Human
acuacaguccuccca

SEQ ID NO: 3025527 - RNA, 23 nt, Human
acuacaggugugagucaccaagc

SEQ ID NO: 3025528 - RNA, 17 nt, Human
acuaaccagcagaaaug

SEQ ID NO: 3025529 - RNA, 13 nt, Human
acuaaccacgcug

SEQ ID NO: 3025530 - RNA, 16 nt, Human
acuaaccagcagaaau

SEQ ID NO: 3025531 - RNA, 12 nt, Human
acuaaccacgcu

SEQ ID NO: 3025532 - RNA, 13 nt, Human
uccagccugggug

SEQ ID NO: 3025533 - RNA, 24 nt, Human
uccagccugggugacagagcaagu

SEQ ID NO: 3025534 - RNA, 14 nt, Human
uccagcucaccagc

SEQ ID NO: 3025535 - RNA, 12 nt, Human
acguuucuaaag

SEQ ID NO: 3025536 - RNA, 14 nt, Human
acguuucuaaaggc

SEQ ID NO: 3025537 - RNA, 20 nt, Human
acuacauuagguugugaaug

SEQ ID NO: 3025538 - RNA, 19 nt, Human
acuacauuagguugugaau

SEQ ID NO: 3025539 - RNA, 18 nt, Human
acuacauuagguugugaa

SEQ ID NO: 3025540 - RNA, 16 nt, Human
acuacaguccucccau

SEQ ID NO: 3025541 - RNA, 22 nt, Human
ucccagugccgagaaggaagcc

SEQ ID NO: 3025542 - RNA, 19 nt, Human
ucccagugccgagaaggaa

SEQ ID NO: 3025543 - RNA, 22 nt, Human
uccccaccgcagacaggaccag

SEQ ID NO: 3025544 - RNA, 15 nt, Human
ucccauaugccuggg

SEQ ID NO: 3025545 - RNA, 13 nt, Human
ucccaucucacac

SEQ ID NO: 3025546 - RNA, 19 nt, Human
ucccaucucacacaugagc

SEQ ID NO: 3025547 - RNA, 14 nt, Human
ucccaucucacaca

SEQ ID NO: 3025548 - RNA, 20 nt, Human
acuauguuuuuguucaguuu

SEQ ID NO: 3025549 - RNA, 23 nt, Human
acuauguugcccaggcaggucuu

SEQ ID NO: 3025550 - RNA, 19 nt, Human
acuauguugcccaggcagg

SEQ ID NO: 3025551 - RNA, 20 nt, Human
acuauguugcccaggcaggu

SEQ ID NO: 3025552 - RNA, 21 nt, Human
acuauuaaacaugcuguacau

SEQ ID NO: 3025553 - RNA, 17 nt, Human
acuauguugcccaggca

SEQ ID NO: 3025554 - RNA, 18 nt, Human
acuauguugcccaggcag

SEQ ID NO: 3025555 - RNA, 17 nt, Human
acuaucacugguuuggu

SEQ ID NO: 3025556 - RNA, 17 nt, Human
acuauagccuaggugac

SEQ ID NO: 3025557 - RNA, 21 nt, Human
acuauaauguaagcucuacug

SEQ ID NO: 3025558 - RNA, 23 nt, Human
acuauaauuuaccugaagucuuu

SEQ ID NO: 3025559 - RNA, 24 nt, Human
uccccaccgcagacaggaccaggg

SEQ ID NO: 3025560 - RNA, 23 nt, Human
uccccaggaggccagccuugacc

SEQ ID NO: 3025561 - RNA, 18 nt, Human
ucccuauuagagaagaga

SEQ ID NO: 3025562 - RNA, 20 nt, Human
ucccgaguagcugggacuac

SEQ ID NO: 3025563 - RNA, 18 nt, Human
ucccgaauagcugggacu

SEQ ID NO: 3025564 - RNA, 15 nt, Human
ucccgaauagcuggg

SEQ ID NO: 3025565 - RNA, 16 nt, Human
ucccgaauagcuggga

SEQ ID NO: 3025566 - RNA, 19 nt, Human
acucuccucugcugcuggc

SEQ ID NO: 3025567 - RNA, 18 nt, Human
acucuccucugcugcugg

SEQ ID NO: 3025568 - RNA, 17 nt, Human
acucgcgacaaugcaaa

SEQ ID NO: 3025569 - RNA, 23 nt, Human
acucgcgacaaugcaaaccauca

SEQ ID NO: 3025570 - RNA, 20 nt, Human
acucgcgacaaugcaaacca

SEQ ID NO: 3025571 - RNA, 19 nt, Human
uccuaggcauuugcugaau

SEQ ID NO: 3025572 - RNA, 18 nt, Human
acucgcgacaaugcaaac

SEQ ID NO: 3025573 - RNA, 17 nt, Human
acucuccucugcugcug

SEQ ID NO: 3025574 - RNA, 18 nt, Human
uccucauacccaccccca

SEQ ID NO: 3025575 - RNA, 14 nt, Human
uccucauacccacc

SEQ ID NO: 3025576 - RNA, 12 nt, Human
uccucuccccag

SEQ ID NO: 3025577 - RNA, 19 nt, Human
uccucccucccucuuuccc

SEQ ID NO: 3025578 - RNA, 17 nt, Human
uccucccucccucuuuc

SEQ ID NO: 3025579 - RNA, 15 nt, Human
uccucccucccucuu

SEQ ID NO: 3025580 - RNA, 20 nt, Human
uccucagaucuucugugggu

SEQ ID NO: 3025581 - RNA, 16 nt, Human
acucuuauugcccacg

SEQ ID NO: 3025582 - RNA, 19 nt, Human
acucuuauugcccacgcug

SEQ ID NO: 3025583 - RNA, 21 nt, Human
ucccucagucuggcccuuccu

SEQ ID NO: 3025584 - RNA, 22 nt, Human
ucccucauccucauacccaccc

SEQ ID NO: 3025585 - RNA, 14 nt, Human
uccuaggcauuugc

SEQ ID NO: 3025586 - RNA, 21 nt, Human
ucccuuugacgccaucccagc

SEQ ID NO: 3025587 - RNA, 23 nt, Human
ucccuuugacgccaucccagccc

SEQ ID NO: 3025588 - RNA, 22 nt, Human
ucccuuugacgccaucccagcc

SEQ ID NO: 3025589 - RNA, 23 nt, Human
ucccugguggcagcucaccucuc

SEQ ID NO: 3025590 - RNA, 22 nt, Human
ucccuuacgugaguccuggcau

SEQ ID NO: 3025591 - RNA, 18 nt, Human
ucccuuacgugaguccug

SEQ ID NO: 3025592 - RNA, 22 nt, Human
ucccuuuccaaaugcccagcuu

SEQ ID NO: 3025593 - RNA, 14 nt, Human
uagucauucuuccc

SEQ ID NO: 3025594 - RNA, 15 nt, Human
uagucauucuucccu

SEQ ID NO: 3025595 - RNA, 21 nt, Human
uagucaggugccucaagagaa

SEQ ID NO: 3025596 - RNA, 23 nt, Human
acaagcugcacccucaggcaggu

SEQ ID NO: 3025597 - RNA, 22 nt, Human
acaagcugcacccucaggcagg

SEQ ID NO: 3025598 - RNA, 21 nt, Human
acaagcugcacccucaggcag

SEQ ID NO: 3025599 - RNA, 19 nt, Human
acaagcugcacccucaggc

SEQ ID NO: 3025600 - RNA, 20 nt, Human
uaguuccucauuagcauuuu

SEQ ID NO: 3025601 - RNA, 18 nt, Human
acacaugcaaggucauuu

SEQ ID NO: 3025602 - RNA, 19 nt, Human
acacaugcaaggucauuuu

SEQ ID NO: 3025603 - RNA, 20 nt, Human
acacaugcaaggucauuuuu

SEQ ID NO: 3025604 - RNA, 11 nt, Human
acacccuguga

SEQ ID NO: 3025605 - RNA, 18 nt, Human
acacccugugauggggcc

SEQ ID NO: 3025606 - RNA, 12 nt, Human
acacccugugau

SEQ ID NO: 3025607 - RNA, 19 nt, Human
acacccagcccacuucugc

SEQ ID NO: 3025608 - RNA, 20 nt, Human
acacccagcccacuucugcc

SEQ ID NO: 3025609 - RNA, 21 nt, Human
acacccagcccacuucugcca

SEQ ID NO: 3025610 - RNA, 21 nt, Human
acacaugcaaggucauuuuuu

SEQ ID NO: 3025611 - RNA, 13 nt, Human
uauagcaagacau

SEQ ID NO: 3025612 - RNA, 20 nt, Human
uauagccuaggugacagagu

SEQ ID NO: 3025613 - RNA, 19 nt, Human
acacucauugaccugaggc

SEQ ID NO: 3025614 - RNA, 23 nt, Human
acacucauugaccugaggcccuu

SEQ ID NO: 3025615 - RNA, 21 nt, Human
acacucauugaccugaggccc

SEQ ID NO: 3025616 - RNA, 20 nt, Human
uauaaccaguguuguggauu

SEQ ID NO: 3025617 - RNA, 21 nt, Human
uauaauuuaccugaagucuuu

SEQ ID NO: 3025618 - RNA, 13 nt, Human
uauacauaaacaa

SEQ ID NO: 3025619 - RNA, 14 nt, Human
uauacauaaacaag

SEQ ID NO: 3025620 - RNA, 14 nt, Human
uauacauuugauaa

SEQ ID NO: 3025621 - RNA, 15 nt, Human
uaugaugacuguuuu

SEQ ID NO: 3025622 - RNA, 14 nt, Human
uaugaugacuguuu

SEQ ID NO: 3025623 - RNA, 18 nt, Human
uaugcucugcauguuaca

SEQ ID NO: 3025624 - RNA, 14 nt, Human
uaugcucugcaugu

SEQ ID NO: 3025625 - RNA, 19 nt, Human
uaugcucugcauguuacau

SEQ ID NO: 3025626 - RNA, 22 nt, Human
uauggcccuggccuagcauacg

SEQ ID NO: 3025627 - RNA, 10 nt, Human
uaugggagag

SEQ ID NO: 3025628 - RNA, 16 nt, Human
uauggcuuuugugcau

SEQ ID NO: 3025629 - RNA, 17 nt, Human
acagcuaacauggaagu

SEQ ID NO: 3025630 - RNA, 15 nt, Human
acagcuaacauggaa

SEQ ID NO: 3025631 - RNA, 14 nt, Human
acagcuaacaugga

SEQ ID NO: 3025632 - RNA, 14 nt, Human
uaucuugaagacuu

SEQ ID NO: 3025633 - RNA, 20 nt, Human
acagaguuuucacucuuauu

SEQ ID NO: 3025634 - RNA, 18 nt, Human
acagaguuuucacucuua

SEQ ID NO: 3025635 - RNA, 23 nt, Human
uaugaggcauuuguuugaacuga

SEQ ID NO: 3025636 - RNA, 13 nt, Human
uaugaggcauuug

SEQ ID NO: 3025637 - RNA, 15 nt, Human
uaucuugaagacuuu

SEQ ID NO: 3025638 - RNA, 14 nt, Human
uaugaucacggcuc

SEQ ID NO: 3025639 - RNA, 21 nt, Human
uaugaucacggcucacugcag

SEQ ID NO: 3025640 - RNA, 23 nt, Human
uaugaucacggcucacugcagcc

SEQ ID NO: 3025641 - RNA, 20 nt, Human
uaucagaacuauguuuuugu

SEQ ID NO: 3025642 - RNA, 14 nt, Human
uaucagaacuaugu

SEQ ID NO: 3025643 - RNA, 15 nt, Human
uaucuagauacugua

SEQ ID NO: 3025644 - RNA, 16 nt, Human
uaucuagauacuguau

SEQ ID NO: 3025645 - RNA, 17 nt, Human
uaucucccccagcccca

SEQ ID NO: 3025646 - RNA, 18 nt, Human
uaucucccccagccccau

SEQ ID NO: 3025647 - RNA, 16 nt, Human
uaucucccccagcccc

SEQ ID NO: 3025648 - RNA, 19 nt, Human
uaucuagauacuguaucau

SEQ ID NO: 3025649 - RNA, 22 nt, Human
acagacuggaagcacagcuuca

SEQ ID NO: 3025650 - RNA, 21 nt, Human
acagagugagacucugucuca

SEQ ID NO: 3025651 - RNA, 20 nt, Human
acagagcccacgcccccacu

SEQ ID NO: 3025652 - RNA, 16 nt, Human
acagagcuacacaggg

SEQ ID NO: 3025653 - RNA, 17 nt, Human
uauauucucagcagagu

SEQ ID NO: 3025654 - RNA, 14 nt, Human
acagacuggaagca

SEQ ID NO: 3025655 - RNA, 19 nt, Human
uauauucucagcagagugc

SEQ ID NO: 3025656 - RNA, 20 nt, Human
acagacccugcccugugggc

SEQ ID NO: 3025657 - RNA, 18 nt, Human
acagacccugcccugugg

SEQ ID NO: 3025658 - RNA, 16 nt, Human
acagacccugcccugu

SEQ ID NO: 3025659 - RNA, 17 nt, Human
acagacccugcccugug

SEQ ID NO: 3025660 - RNA, 23 nt, Human
acagacacaggcccggcuccagg

SEQ ID NO: 3025661 - RNA, 11 nt, Human
acacuccuuca

SEQ ID NO: 3025662 - RNA, 20 nt, Human
uaucacuuccaugacauaag

SEQ ID NO: 3025663 - RNA, 18 nt, Human
uaucacccagaagaaaau

SEQ ID NO: 3025664 - RNA, 21 nt, Human
uaucaaguauuauaccuuuuu

SEQ ID NO: 3025665 - RNA, 18 nt, Human
uaucaaguauuauaccuu

SEQ ID NO: 3025666 - RNA, 21 nt, Human
acaguaacauagcugugauuu

SEQ ID NO: 3025667 - RNA, 22 nt, Human
acagggcacaccgggcacucag

SEQ ID NO: 3025668 - RNA, 22 nt, Human
acagguuuuccugaagaauuga

SEQ ID NO: 3025669 - RNA, 12 nt, Human
acaggcugggcu

SEQ ID NO: 3025670 - RNA, 20 nt, Human
acagggcacaccgggcacuc

SEQ ID NO: 3025671 - RNA, 21 nt, Human
acaggcugggcuucaguggca

SEQ ID NO: 3025672 - RNA, 14 nt, Human
acaggcugggcuuc

SEQ ID NO: 3025673 - RNA, 17 nt, Human
acaggcugggcuucagu

SEQ ID NO: 3025674 - RNA, 13 nt, Human
acagucccugcca

SEQ ID NO: 3025675 - RNA, 12 nt, Human
acagucccugcc

SEQ ID NO: 3025676 - RNA, 15 nt, Human
acaguauuacuucug

SEQ ID NO: 3025677 - RNA, 16 nt, Human
acaguauuacuucugc

SEQ ID NO: 3025678 - RNA, 17 nt, Human
acaguauuacuucugcu

SEQ ID NO: 3025679 - RNA, 19 nt, Human
acaguauuacuucugcuac

SEQ ID NO: 3025680 - RNA, 17 nt, Human
acaguccucccaucuca

SEQ ID NO: 3025681 - RNA, 20 nt, Human
acaguccuuaccagcagagc

SEQ ID NO: 3025682 - RNA, 18 nt, Human
acaguccuuaccagcaga

SEQ ID NO: 3025683 - RNA, 15 nt, Human
acaguccucccaucu

SEQ ID NO: 3025684 - RNA, 14 nt, Human
acaguccucccauc

SEQ ID NO: 3025685 - RNA, 13 nt, Human
acaguccucccau

SEQ ID NO: 3025686 - RNA, 15 nt, Human
acagucccugccaau

SEQ ID NO: 3025687 - RNA, 22 nt, Human
acaguguguggucaacauuucu

SEQ ID NO: 3025688 - RNA, 15 nt, Human
acaguuaagagaaau

SEQ ID NO: 3025689 - RNA, 22 nt, Human
acaguccuuaccagcagagcac

SEQ ID NO: 3025690 - RNA, 21 nt, Human
acaguccuuaccagcagagca

SEQ ID NO: 3025691 - RNA, 15 nt, Human
uauguuuuauauagc

SEQ ID NO: 3025692 - RNA, 17 nt, Human
uauguuuuaagaggcag

SEQ ID NO: 3025693 - RNA, 19 nt, Human
uauguuuuaagaggcaggg

SEQ ID NO: 3025694 - RNA, 16 nt, Human
uauuaaaaaucucaaa

SEQ ID NO: 3025695 - RNA, 18 nt, Human
uauuaaaaaucucaaauu

SEQ ID NO: 3025696 - RNA, 20 nt, Human
uauuaaaaaucucaaauuuc

SEQ ID NO: 3025697 - RNA, 22 nt, Human
uauuaaaaaucucaaauuucua

SEQ ID NO: 3025698 - RNA, 19 nt, Human
uauuaaacaugcuguacau

SEQ ID NO: 3025699 - RNA, 15 nt, Human
uauuaaacaugcugu

SEQ ID NO: 3025700 - RNA, 17 nt, Human
uauuaaacaugcuguac

SEQ ID NO: 3025701 - RNA, 23 nt, Human
uauuaaaaaucucaaauuucuaa

SEQ ID NO: 3025702 - RNA, 12 nt, Human
uauuagagaaga

SEQ ID NO: 3025703 - RNA, 16 nt, Human
uauuaccacagacaua

SEQ ID NO: 3025704 - RNA, 16 nt, Human
uauucaggaagcucag

SEQ ID NO: 3025705 - RNA, 22 nt, Human
uauucaggaagcucagggccug

SEQ ID NO: 3025706 - RNA, 18 nt, Human
uauucaggaagcucaggg

SEQ ID NO: 3025707 - RNA, 15 nt, Human
uauucugagaugacu

SEQ ID NO: 3025708 - RNA, 15 nt, Human
uauucuuauuuaaug

SEQ ID NO: 3025709 - RNA, 16 nt, Human
uauucuguuggccagu

SEQ ID NO: 3025710 - RNA, 17 nt, Human
acaguucucuccuucuu

SEQ ID NO: 3025711 - RNA, 18 nt, Human
uauucucuccuguaccuc

SEQ ID NO: 3025712 - RNA, 20 nt, Human
uauucucuccuguaccucuu

SEQ ID NO: 3025713 - RNA, 24 nt, Human
uauucucuccuguaccucuugagc

SEQ ID NO: 3025714 - RNA, 13 nt, Human
acaguuacucaga

SEQ ID NO: 3025715 - RNA, 20 nt, Human
acaguuacucagaauucucu

SEQ ID NO: 3025716 - RNA, 20 nt, Human
acaguucaauucucauuugu

SEQ ID NO: 3025717 - RNA, 16 nt, Human
acaguucucuccuucu

SEQ ID NO: 3025718 - RNA, 20 nt, Human
uauugaagcagaguggcagu

SEQ ID NO: 3025719 - RNA, 16 nt, Human
uauugaagcagagugg

SEQ ID NO: 3025720 - RNA, 14 nt, Human
uauugaagcagagu

SEQ ID NO: 3025721 - RNA, 16 nt, Human
uauugaaaugauuuca

SEQ ID NO: 3025722 - RNA, 15 nt, Human
uauuuaaucuuuuau

SEQ ID NO: 3025723 - RNA, 13 nt, Human
uauuuaaucuuuu

SEQ ID NO: 3025724 - RNA, 15 nt, Human
uauuuaaugaaagac

SEQ ID NO: 3025725 - RNA, 21 nt, Human
uauuuaaugaaagacuguaca

SEQ ID NO: 3025726 - RNA, 17 nt, Human
uauugucaaagugguga

SEQ ID NO: 3025727 - RNA, 13 nt, Human
uauugucaaagug

SEQ ID NO: 3025728 - RNA, 16 nt, Human
uauuuaauuugaaggu

SEQ ID NO: 3025729 - RNA, 23 nt, Human
uauuuaauuugaagguagaaugu

SEQ ID NO: 3025730 - RNA, 13 nt, Human
uauuuaauuugaa

SEQ ID NO: 3025731 - RNA, 23 nt, Human
uauuuaauuuuuuugagacagag

SEQ ID NO: 3025732 - RNA, 18 nt, Human
uauuuacuucuuauacau

SEQ ID NO: 3025733 - RNA, 13 nt, Human
uauuuauuuguga

SEQ ID NO: 3025734 - RNA, 14 nt, Human
uauuuauuuauuua

SEQ ID NO: 3025735 - RNA, 13 nt, Human
uauuuauuuaaau

SEQ ID NO: 3025736 - RNA, 14 nt, Human
uauuuauuuaaauu

SEQ ID NO: 3025737 - RNA, 13 nt, Human
uacuauuaaacau

SEQ ID NO: 3025738 - RNA, 16 nt, Human
uacuauguaucaauga

SEQ ID NO: 3025739 - RNA, 16 nt, Human
uacuauaauuuaccug

SEQ ID NO: 3025740 - RNA, 16 nt, Human
uacuauuaaacaugcu

SEQ ID NO: 3025741 - RNA, 15 nt, Human
uacuauuaaacaugc

SEQ ID NO: 3025742 - RNA, 14 nt, Human
uacuauuaaacaug

SEQ ID NO: 3025743 - RNA, 18 nt, Human
uacuauuaaacaugcugu

SEQ ID NO: 3025744 - RNA, 13 nt, Human
uacguugugcauu

SEQ ID NO: 3025745 - RNA, 14 nt, Human
uacguugugcauuu

SEQ ID NO: 3025746 - RNA, 14 nt, Human
uacgucugacaggc

SEQ ID NO: 3025747 - RNA, 21 nt, Human
uacucugugucagguggggca

SEQ ID NO: 3025748 - RNA, 15 nt, Human
uacguacacauuuua

SEQ ID NO: 3025749 - RNA, 14 nt, Human
uacguacacauuuu

SEQ ID NO: 3025750 - RNA, 13 nt, Human
aauucuuaaauau

SEQ ID NO: 3025751 - RNA, 22 nt, Human
aauucuucuccacuuucuagcc

SEQ ID NO: 3025752 - RNA, 14 nt, Human
aauucuugcaaagu

SEQ ID NO: 3025753 - RNA, 20 nt, Human
aauucuugcaaaguaucccu

SEQ ID NO: 3025754 - RNA, 15 nt, Human
aauuuacauacucug

SEQ ID NO: 3025755 - RNA, 19 nt, Human
aauuuacauacucugcuua

SEQ ID NO: 3025756 - RNA, 13 nt, Human
aauuuaaaagucu

SEQ ID NO: 3025757 - RNA, 22 nt, Human
aauuguuuggggaugagaaagg

SEQ ID NO: 3025758 - RNA, 17 nt, Human
aauuuagaaauauaauu

SEQ ID NO: 3025759 - RNA, 13 nt, Human
aauuucuaaaucu

SEQ ID NO: 3025760 - RNA, 21 nt, Human
aauuucuaaaucuccaaaaua

SEQ ID NO: 3025761 - RNA, 22 nt, Human
aauuuuuuuaucgucacugcuu

SEQ ID NO: 3025762 - RNA, 17 nt, Human
aauuuuuuugagacaga

SEQ ID NO: 3025763 - RNA, 13 nt, Human
acaaaaacauggc

SEQ ID NO: 3025764 - RNA, 14 nt, Human
uagacagucccugc

SEQ ID NO: 3025765 - RNA, 12 nt, Human
uagacagucccu

SEQ ID NO: 3025766 - RNA, 17 nt, Human
aauuuuuauuaaauuau

SEQ ID NO: 3025767 - RNA, 18 nt, Human
aauuuuuauuaaauuaug

SEQ ID NO: 3025768 - RNA, 21 nt, Human
uagacagagucucacuguugc

SEQ ID NO: 3025769 - RNA, 16 nt, Human
uagacaauuuauuaug

SEQ ID NO: 3025770 - RNA, 16 nt, Human
uagaagucacacagua

SEQ ID NO: 3025771 - RNA, 16 nt, Human
uagaagucuuagaugu

SEQ ID NO: 3025772 - RNA, 17 nt, Human
uagaagucuuagaugua

SEQ ID NO: 3025773 - RNA, 18 nt, Human
uagaagucuuagauguau

SEQ ID NO: 3025774 - RNA, 19 nt, Human
uagaagucuuagauguaua

SEQ ID NO: 3025775 - RNA, 15 nt, Human
uagaagucacacagu

SEQ ID NO: 3025776 - RNA, 12 nt, Human
acaacacucaca

SEQ ID NO: 3025777 - RNA, 15 nt, Human
acaacaacaaaauga

SEQ ID NO: 3025778 - RNA, 18 nt, Human
acaagcgugagccacugc

SEQ ID NO: 3025779 - RNA, 13 nt, Human
acaagcugcaccc

SEQ ID NO: 3025780 - RNA, 20 nt, Human
acaagcgugagccacugcac

SEQ ID NO: 3025781 - RNA, 21 nt, Human
acaagcgugagccacugcacc

SEQ ID NO: 3025782 - RNA, 12 nt, Human
acaagccacccc

SEQ ID NO: 3025783 - RNA, 17 nt, Human
acaagagcccaggccuc

SEQ ID NO: 3025784 - RNA, 22 nt, Human
uagauuuuagacccuauugcug

SEQ ID NO: 3025785 - RNA, 19 nt, Human
uagcacagacccugcccug

SEQ ID NO: 3025786 - RNA, 18 nt, Human
uagcacagacccugcccu

SEQ ID NO: 3025787 - RNA, 17 nt, Human
uagcacagacccugccc

SEQ ID NO: 3025788 - RNA, 16 nt, Human
uagcacagacccugcc

SEQ ID NO: 3025789 - RNA, 24 nt, Human
uagcacagacccugcccugugggc

SEQ ID NO: 3025790 - RNA, 12 nt, Human
uacauacuuuuu

SEQ ID NO: 3025791 - RNA, 15 nt, Human
uacauacuuuuuggg

SEQ ID NO: 3025792 - RNA, 14 nt, Human
uacauacuuuuugg

SEQ ID NO: 3025793 - RNA, 13 nt, Human
aaugucacaggca

SEQ ID NO: 3025794 - RNA, 14 nt, Human
aaugucacaggcag

SEQ ID NO: 3025795 - RNA, 22 nt, Human
aaugugaaacuggauuaaacuu

SEQ ID NO: 3025796 - RNA, 18 nt, Human
uacaguccucccaucuca

SEQ ID NO: 3025797 - RNA, 17 nt, Human
uacaguccucccaucuc

SEQ ID NO: 3025798 - RNA, 15 nt, Human
uacaguccucccauc

SEQ ID NO: 3025799 - RNA, 12 nt, Human
uacaguccuccc

SEQ ID NO: 3025800 - RNA, 18 nt, Human
uacaguaucucagggccu

SEQ ID NO: 3025801 - RNA, 21 nt, Human
aauguacagcaaggagauuua

SEQ ID NO: 3025802 - RNA, 23 nt, Human
aauguacagcaaggagauuuaca

SEQ ID NO: 3025803 - RNA, 22 nt, Human
uacagcaaggagauuuacaacu

SEQ ID NO: 3025804 - RNA, 22 nt, Human
aaugguuuucuuguguguuuau

SEQ ID NO: 3025805 - RNA, 18 nt, Human
aaugguuuucuugugugu

SEQ ID NO: 3025806 - RNA, 17 nt, Human
aaugguuuucuugugug

SEQ ID NO: 3025807 - RNA, 13 nt, Human
aauguaagcucua

SEQ ID NO: 3025808 - RNA, 15 nt, Human
aauguaagcucuacu

SEQ ID NO: 3025809 - RNA, 20 nt, Human
uacccgggaagggggcuggg

SEQ ID NO: 3025810 - RNA, 15 nt, Human
uacccucauguucuu

SEQ ID NO: 3025811 - RNA, 16 nt, Human
uacccucauguucuua

SEQ ID NO: 3025812 - RNA, 20 nt, Human
uacccuggcacuauaaugua

SEQ ID NO: 3025813 - RNA, 22 nt, Human
uacccuggcacuauaauguaag

SEQ ID NO: 3025814 - RNA, 17 nt, Human
uaccacuuuuguucuug

SEQ ID NO: 3025815 - RNA, 17 nt, Human
uaccauccccuguagag

SEQ ID NO: 3025816 - RNA, 18 nt, Human
aauuaacuuuuauaaacu

SEQ ID NO: 3025817 - RNA, 20 nt, Human
aauuaacuuuuauaaacuuu

SEQ ID NO: 3025818 - RNA, 22 nt, Human
aauuaacuuuuauaaacuuuac

SEQ ID NO: 3025819 - RNA, 13 nt, Human
aauuaaguacuau

SEQ ID NO: 3025820 - RNA, 16 nt, Human
aauuaacuuuuauaaa

SEQ ID NO: 3025821 - RNA, 23 nt, Human
uaauuaguuccucauuagcauuu

SEQ ID NO: 3025822 - RNA, 20 nt, Human
aaugcacuuuguucuggcuc

SEQ ID NO: 3025823 - RNA, 19 nt, Human
aaugcacuuuguucuggcu

SEQ ID NO: 3025824 - RNA, 16 nt, Human
aaugcacuuuguucug

SEQ ID NO: 3025825 - RNA, 13 nt, Human
aaugcacuuuguu

SEQ ID NO: 3025826 - RNA, 20 nt, Human
aaugcacaaacagaggccgc

SEQ ID NO: 3025827 - RNA, 19 nt, Human
aaugcacaaacagaggccg

SEQ ID NO: 3025828 - RNA, 12 nt, Human
aaugcaaagaug

SEQ ID NO: 3025829 - RNA, 18 nt, Human
aaugcaaagaugaagguc

SEQ ID NO: 3025830 - RNA, 14 nt, Human
aaugcaaagaugaa

SEQ ID NO: 3025831 - RNA, 21 nt, Human
aaugcaaagaugaaggucugu

SEQ ID NO: 3025832 - RNA, 23 nt, Human
aaugcaaaccaucauugaaaucu

SEQ ID NO: 3025833 - RNA, 22 nt, Human
aaugcaaaccaucauugaaauc

SEQ ID NO: 3025834 - RNA, 18 nt, Human
aaugcacaaacagaggcc

SEQ ID NO: 3025835 - RNA, 21 nt, Human
aaugaaugucagugugacuga

SEQ ID NO: 3025836 - RNA, 20 nt, Human
aaugaaugucagugugacug

SEQ ID NO: 3025837 - RNA, 16 nt, Human
aaugcaaaccaucauu

SEQ ID NO: 3025838 - RNA, 14 nt, Human
aaugcaaaccauca

SEQ ID NO: 3025839 - RNA, 14 nt, Human
aaugaccuuucaau

SEQ ID NO: 3025840 - RNA, 13 nt, Human
aaugaccuuucaa

SEQ ID NO: 3025841 - RNA, 20 nt, Human
uaauuugaagguagaauguu

SEQ ID NO: 3025842 - RNA, 18 nt, Human
uaauuuaccugaagucuu

SEQ ID NO: 3025843 - RNA, 17 nt, Human
uaauuuaccugaagucu

SEQ ID NO: 3025844 - RNA, 21 nt, Human
uacaagcgugagccacugcac

SEQ ID NO: 3025845 - RNA, 16 nt, Human
uacaagcgugagccac

SEQ ID NO: 3025846 - RNA, 18 nt, Human
uacaagcgugagccacug

SEQ ID NO: 3025847 - RNA, 19 nt, Human
uacaagcgugagccacugc

SEQ ID NO: 3025848 - RNA, 20 nt, Human
uacaagcgugagccacugca

SEQ ID NO: 3025849 - RNA, 16 nt, Human
uacaaaaacauggccu

SEQ ID NO: 3025850 - RNA, 19 nt, Human
aaucuuuuaugauugccuu

SEQ ID NO: 3025851 - RNA, 23 nt, Human
aaucuucugaacuuggcgcugcc

SEQ ID NO: 3025852 - RNA, 14 nt, Human
aaugaaugaaacau

SEQ ID NO: 3025853 - RNA, 14 nt, Human
aaugaaugucagug

SEQ ID NO: 3025854 - RNA, 15 nt, Human
aaugaaugucagugu

SEQ ID NO: 3025855 - RNA, 16 nt, Human
uaauguaagcucuacu

SEQ ID NO: 3025856 - RNA, 17 nt, Human
uaauguaagcucuacug

SEQ ID NO: 3025857 - RNA, 16 nt, Human
uaaugucacaggcagg

SEQ ID NO: 3025858 - RNA, 17 nt, Human
uaaugucacaggcaggu

SEQ ID NO: 3025859 - RNA, 15 nt, Human
uaaugucacaggcag

SEQ ID NO: 3025860 - RNA, 12 nt, Human
uaaugugaaacu

SEQ ID NO: 3025861 - RNA, 20 nt, Human
uaaugugaaacuggauuaaa

SEQ ID NO: 3025862 - RNA, 22 nt, Human
uaaugugaaacuggauuaaacu

SEQ ID NO: 3025863 - RNA, 23 nt, Human
uaaugugaaacuggauuaaacuu

SEQ ID NO: 3025864 - RNA, 21 nt, Human
uaauauugauaugcuuauaca

SEQ ID NO: 3025865 - RNA, 20 nt, Human
aauacaguaucucagggccu

SEQ ID NO: 3025866 - RNA, 23 nt, Human
uaauacaccacuacauucuguua

SEQ ID NO: 3025867 - RNA, 22 nt, Human
uaauacaccacuacauucuguu

SEQ ID NO: 3025868 - RNA, 21 nt, Human
uaauacaccacuacauucugu

SEQ ID NO: 3025869 - RNA, 13 nt, Human
aacucuguaauuc

SEQ ID NO: 3025870 - RNA, 20 nt, Human
gugaguccuggcaugggaau

SEQ ID NO: 3025871 - RNA, 17 nt, Human
gugaguccuggcauggg

SEQ ID NO: 3025872 - RNA, 19 nt, Human
gugaguacuacaguccucc

SEQ ID NO: 3025873 - RNA, 12 nt, Human
gugagagcuggg

SEQ ID NO: 3025874 - RNA, 12 nt, Human
gugaccccaggu

SEQ ID NO: 3025875 - RNA, 17 nt, Human
gugaguacuacaguccu

SEQ ID NO: 3025876 - RNA, 21 nt, Human
gugagcacuaaggugugcucu

SEQ ID NO: 3025877 - RNA, 15 nt, Human
gugagcaauccugca

SEQ ID NO: 3025878 - RNA, 13 nt, Human
gugagagcugggu

SEQ ID NO: 3025879 - RNA, 16 nt, Human
gugagaggggaacaga

SEQ ID NO: 3025880 - RNA, 14 nt, Human
gugaagugaagaca

SEQ ID NO: 3025881 - RNA, 23 nt, Human
gugaagacaaugacuuacuguac

SEQ ID NO: 3025882 - RNA, 16 nt, Human
gugacagaggcagccc

SEQ ID NO: 3025883 - RNA, 18 nt, Human
gugacagaggcagcccca

SEQ ID NO: 3025884 - RNA, 19 nt, Human
gugacagaggcagccccau

SEQ ID NO: 3025885 - RNA, 14 nt, Human
gugacaugucuuuu

SEQ ID NO: 3025886 - RNA, 18 nt, Human
gugaccauguuuuguuua

SEQ ID NO: 3025887 - RNA, 21 nt, Human
gugaccagcaccaucucuccu

SEQ ID NO: 3025888 - RNA, 18 nt, Human
gugaccagcaccaucucu

SEQ ID NO: 3025889 - RNA, 17 nt, Human
gugaccaaugaugguca

SEQ ID NO: 3025890 - RNA, 18 nt, Human
aacuaacaggcuuaguga

SEQ ID NO: 3025891 - RNA, 22 nt, Human
aacuaacaggcuuagugaugua

SEQ ID NO: 3025892 - RNA, 23 nt, Human
aacguggcugcuucaaggauccu

SEQ ID NO: 3025893 - RNA, 18 nt, Human
aaccugauugugucucuu

SEQ ID NO: 3025894 - RNA, 19 nt, Human
aaccugauugugucucuug

SEQ ID NO: 3025895 - RNA, 12 nt, Human
aaccugugucuc

SEQ ID NO: 3025896 - RNA, 16 nt, Human
gucuucaguaagccgu

SEQ ID NO: 3025897 - RNA, 16 nt, Human
gucuuuguacagacaa

SEQ ID NO: 3025898 - RNA, 15 nt, Human
gucuuuguacagaca

SEQ ID NO: 3025899 - RNA, 18 nt, Human
gucucuuuaaugucacag

SEQ ID NO: 3025900 - RNA, 19 nt, Human
gucucuuuaaugucacagg

SEQ ID NO: 3025901 - RNA, 20 nt, Human
gucucuuuaaugucacaggc

SEQ ID NO: 3025902 - RNA, 14 nt, Human
gucugaaggcuggg

SEQ ID NO: 3025903 - RNA, 19 nt, Human
gucugaaggcuggguucug

SEQ ID NO: 3025904 - RNA, 22 nt, Human
gucucuuuaaugucacaggcag

SEQ ID NO: 3025905 - RNA, 17 nt, Human
gucucuugguccugcug

SEQ ID NO: 3025906 - RNA, 19 nt, Human
gucucuugguccugcugca

SEQ ID NO: 3025907 - RNA, 18 nt, Human
gucucuugguccugcugc

SEQ ID NO: 3025908 - RNA, 20 nt, Human
gucucuugguccugcugcag

SEQ ID NO: 3025909 - RNA, 13 nt, Human
gucucuugguccu

SEQ ID NO: 3025910 - RNA, 18 nt, Human
gucuggaaugcaguggua

SEQ ID NO: 3025911 - RNA, 21 nt, Human
gucugacaggcaaugcuggcu

SEQ ID NO: 3025912 - RNA, 22 nt, Human
gucugacaggcaaugcuggcug

SEQ ID NO: 3025913 - RNA, 23 nt, Human
gucugacaggcaaugcuggcugu

SEQ ID NO: 3025914 - RNA, 13 nt, Human
guccuacccaccc

SEQ ID NO: 3025915 - RNA, 20 nt, Human
aacagacuggaagcacagcu

SEQ ID NO: 3025916 - RNA, 20 nt, Human
aacauacucccaucugugaa

SEQ ID NO: 3025917 - RNA, 16 nt, Human
aacauacucccaucug

SEQ ID NO: 3025918 - RNA, 18 nt, Human
aacauacucccaucugug

SEQ ID NO: 3025919 - RNA, 14 nt, Human
aacaucaacaucuu

SEQ ID NO: 3025920 - RNA, 22 nt, Human
aacauguuuuucuucucccuca

SEQ ID NO: 3025921 - RNA, 23 nt, Human
guccccuguuuguuucugaaagg

SEQ ID NO: 3025922 - RNA, 16 nt, Human
guccccgcacugggcu

SEQ ID NO: 3025923 - RNA, 15 nt, Human
guccccgcacugggc

SEQ ID NO: 3025924 - RNA, 13 nt, Human
gucccccugacaa

SEQ ID NO: 3025925 - RNA, 22 nt, Human
guccgaaagggacuuggaagcu

SEQ ID NO: 3025926 - RNA, 21 nt, Human
guccgaaagggacuuggaagc

SEQ ID NO: 3025927 - RNA, 13 nt, Human
gucccuuuuccuu

SEQ ID NO: 3025928 - RNA, 19 nt, Human
gucccaccuuggcugcagg

SEQ ID NO: 3025929 - RNA, 17 nt, Human
gucccaccuuggcugca

SEQ ID NO: 3025930 - RNA, 18 nt, Human
gucccaccuuggcugcag

SEQ ID NO: 3025931 - RNA, 22 nt, Human
guagcucuaggagggcuggcaa

SEQ ID NO: 3025932 - RNA, 16 nt, Human
guccugcugcaguugc

SEQ ID NO: 3025933 - RNA, 13 nt, Human
guccugcugcagu

SEQ ID NO: 3025934 - RNA, 20 nt, Human
gucuaccugaggggccucuu

SEQ ID NO: 3025935 - RNA, 23 nt, Human
gucgcccagucuggaaugcagug

SEQ ID NO: 3025936 - RNA, 14 nt, Human
gucgaggacaggga

SEQ ID NO: 3025937 - RNA, 13 nt, Human
gucgcccagucug

SEQ ID NO: 3025938 - RNA, 14 nt, Human
gucgcccagucugg

SEQ ID NO: 3025939 - RNA, 23 nt, Human
aaccaucauugaaaucuuuuugc

SEQ ID NO: 3025940 - RNA, 13 nt, Human
aaccacaucuugc

SEQ ID NO: 3025941 - RNA, 19 nt, Human
gucucaaaaaaagaaaaag

SEQ ID NO: 3025942 - RNA, 22 nt, Human
gucucaaacucuugaccucagg

SEQ ID NO: 3025943 - RNA, 14 nt, Human
gucuaugggacuca

SEQ ID NO: 3025944 - RNA, 23 nt, Human
guguguggucaacauuucucaug

SEQ ID NO: 3025945 - RNA, 19 nt, Human
gugugguguuuccuggcac

SEQ ID NO: 3025946 - RNA, 21 nt, Human
gugucuugcaauggcagccuu

SEQ ID NO: 3025947 - RNA, 13 nt, Human
gugugagucacca

SEQ ID NO: 3025948 - RNA, 18 nt, Human
gugugagucaccaagccc

SEQ ID NO: 3025949 - RNA, 15 nt, Human
gugugguguuuccug

SEQ ID NO: 3025950 - RNA, 19 nt, Human
gugucuugcaauggcagcc

SEQ ID NO: 3025951 - RNA, 20 nt, Human
gugucccaaaaagaaaggag

SEQ ID NO: 3025952 - RNA, 22 nt, Human
aagauauuuugcuuugugauuu

SEQ ID NO: 3025953 - RNA, 17 nt, Human
aagauauuuugcuuugu

SEQ ID NO: 3025954 - RNA, 20 nt, Human
aagauauuuugcuuugugau

SEQ ID NO: 3025955 - RNA, 14 nt, Human
aagaguaggaagac

SEQ ID NO: 3025956 - RNA, 19 nt, Human
gugguguuuccuggcacug

SEQ ID NO: 3025957 - RNA, 18 nt, Human
gugguuauggagagggug

SEQ ID NO: 3025958 - RNA, 15 nt, Human
aagauauuuugcuuu

SEQ ID NO: 3025959 - RNA, 19 nt, Human
aagaguaggaagacuuugg

SEQ ID NO: 3025960 - RNA, 18 nt, Human
aagaguaggaagacuuug

SEQ ID NO: 3025961 - RNA, 16 nt, Human
aagaguaggaagacuu

SEQ ID NO: 3025962 - RNA, 20 nt, Human
guggugguuuucuguucuuu

SEQ ID NO: 3025963 - RNA, 16 nt, Human
gugguguuuccuggca

SEQ ID NO: 3025964 - RNA, 15 nt, Human
gugguguuuccuggc

SEQ ID NO: 3025965 - RNA, 12 nt, Human
gugggagcugag

SEQ ID NO: 3025966 - RNA, 18 nt, Human
gugggauccuccaggugc

SEQ ID NO: 3025967 - RNA, 15 nt, Human
gugggauccuccagg

SEQ ID NO: 3025968 - RNA, 14 nt, Human
guggccucccaacu

SEQ ID NO: 3025969 - RNA, 13 nt, Human
guggccucccaac

SEQ ID NO: 3025970 - RNA, 15 nt, Human
guggccucccaacuc

SEQ ID NO: 3025971 - RNA, 16 nt, Human
aagagcccaggccucc

SEQ ID NO: 3025972 - RNA, 14 nt, Human
aagagcccaggccu

SEQ ID NO: 3025973 - RNA, 12 nt, Human
aagagcccaggc

SEQ ID NO: 3025974 - RNA, 19 nt, Human
aagagauugugguuucauu

SEQ ID NO: 3025975 - RNA, 16 nt, Human
aagagauugugguuuc

SEQ ID NO: 3025976 - RNA, 17 nt, Human
aagacucauucuucugu

SEQ ID NO: 3025977 - RNA, 22 nt, Human
aagacgcugugcugcccugccc

SEQ ID NO: 3025978 - RNA, 21 nt, Human
aagacgcugugcugcccugcc

SEQ ID NO: 3025979 - RNA, 20 nt, Human
aagacgcugugcugcccugc

SEQ ID NO: 3025980 - RNA, 23 nt, Human
aagacgcugugcugcccugccca

SEQ ID NO: 3025981 - RNA, 18 nt, Human
gugcacgcacacugucug

SEQ ID NO: 3025982 - RNA, 23 nt, Human
gugcacaagcuccaagcucccag

SEQ ID NO: 3025983 - RNA, 17 nt, Human
gugcacacaccagagcc

SEQ ID NO: 3025984 - RNA, 18 nt, Human
gugcacguacacacacau

SEQ ID NO: 3025985 - RNA, 12 nt, Human
gugcacacacca

SEQ ID NO: 3025986 - RNA, 14 nt, Human
gugcacacaccaga

SEQ ID NO: 3025987 - RNA, 14 nt, Human
gugccaagcagagg

SEQ ID NO: 3025988 - RNA, 15 nt, Human
gugcauuuggugguu

SEQ ID NO: 3025989 - RNA, 20 nt, Human
gugcauuugaggucuguucu

SEQ ID NO: 3025990 - RNA, 21 nt, Human
gugcauuugaggucuguucuu

SEQ ID NO: 3025991 - RNA, 22 nt, Human
gugcauuugaggucuguucuuu

SEQ ID NO: 3025992 - RNA, 14 nt, Human
gugccucugggacu

SEQ ID NO: 3025993 - RNA, 15 nt, Human
gugccucugggacug

SEQ ID NO: 3025994 - RNA, 14 nt, Human
aacuuggcgcugcc

SEQ ID NO: 3025995 - RNA, 22 nt, Human
aacuugucuuuggacccugagg

SEQ ID NO: 3025996 - RNA, 23 nt, Human
aacuugguucccauuugcuccuu

SEQ ID NO: 3025997 - RNA, 22 nt, Human
aagaaaaaggaugcacagaguu

SEQ ID NO: 3025998 - RNA, 19 nt, Human
aagaaaaaggaugcacaga

SEQ ID NO: 3025999 - RNA, 20 nt, Human
aagaaaaaggaugcacagag

SEQ ID NO: 3026000 - RNA, 15 nt, Human
aagaagcucucuccu

SEQ ID NO: 3026001 - RNA, 14 nt, Human
aagaagcucucucc

SEQ ID NO: 3026002 - RNA, 17 nt, Human
aagaagcccaggaaagg

SEQ ID NO: 3026003 - RNA, 16 nt, Human
aagaagcccaggaaag

SEQ ID NO: 3026004 - RNA, 14 nt, Human
guggacacagcucu

SEQ ID NO: 3026005 - RNA, 15 nt, Human
guggacacagcucuu

SEQ ID NO: 3026006 - RNA, 24 nt, Human
guggacacagcucuucuccaggcu

SEQ ID NO: 3026007 - RNA, 18 nt, Human
gugcugcccugcccaccu

SEQ ID NO: 3026008 - RNA, 20 nt, Human
gugcugcccugcccaccugg

SEQ ID NO: 3026009 - RNA, 19 nt, Human
gugcugcccugcccaccug

SEQ ID NO: 3026010 - RNA, 21 nt, Human
gugcugcccugcccaccuggc

SEQ ID NO: 3026011 - RNA, 21 nt, Human
guggauuuaacagaaauguac

SEQ ID NO: 3026012 - RNA, 20 nt, Human
guggauuuaacagaaaugua

SEQ ID NO: 3026013 - RNA, 23 nt, Human
guggauuuaacagaaauguacag

SEQ ID NO: 3026014 - RNA, 14 nt, Human
guggcaccagcagc

SEQ ID NO: 3026015 - RNA, 13 nt, Human
guggcaccagcag

SEQ ID NO: 3026016 - RNA, 14 nt, Human
guggcagcugcggu

SEQ ID NO: 3026017 - RNA, 22 nt, Human
guggcagcucaccucucccuug

SEQ ID NO: 3026018 - RNA, 17 nt, Human
guggcagcugcggucca

SEQ ID NO: 3026019 - RNA, 12 nt, Human
guuuggccagaa

SEQ ID NO: 3026020 - RNA, 18 nt, Human
guuuggccagaagucaag

SEQ ID NO: 3026021 - RNA, 23 nt, Human
guuuggccagaagucaaggcuua

SEQ ID NO: 3026022 - RNA, 11 nt, Human
guuuggccaga

SEQ ID NO: 3026023 - RNA, 14 nt, Human
guuuuaagaggcag

SEQ ID NO: 3026024 - RNA, 16 nt, Human
guuuuaagaggcaggg

SEQ ID NO: 3026025 - RNA, 15 nt, Human
guuuuacugcagcuu

SEQ ID NO: 3026026 - RNA, 18 nt, Human
guuuuacugcagcuuugu

SEQ ID NO: 3026027 - RNA, 16 nt, Human
guuuuacugcagcuuu

SEQ ID NO: 3026028 - RNA, 22 nt, Human
guuucugccgcagcccugcaga

SEQ ID NO: 3026029 - RNA, 18 nt, Human
guuucugccgcagcccug

SEQ ID NO: 3026030 - RNA, 17 nt, Human
guuugccucugccucug

SEQ ID NO: 3026031 - RNA, 13 nt, Human
guuugcuaaguga

SEQ ID NO: 3026032 - RNA, 16 nt, Human
aagggcccuuuuucaa

SEQ ID NO: 3026033 - RNA, 22 nt, Human
aagggcccuuuuucaauaacug

SEQ ID NO: 3026034 - RNA, 17 nt, Human
aaggguaucaggugcug

SEQ ID NO: 3026035 - RNA, 14 nt, Human
aaggggcaguggug

SEQ ID NO: 3026036 - RNA, 19 nt, Human
aaggguaucaggugcugcc

SEQ ID NO: 3026037 - RNA, 16 nt, Human
aaggguaucuggugac

SEQ ID NO: 3026038 - RNA, 15 nt, Human
aagggcccagagagg

SEQ ID NO: 3026039 - RNA, 13 nt, Human
aagggcccagaga

SEQ ID NO: 3026040 - RNA, 21 nt, Human
guuucuagcaugaagacagag

SEQ ID NO: 3026041 - RNA, 13 nt, Human
aagucaaggcuua

SEQ ID NO: 3026042 - RNA, 22 nt, Human
aagucaaggcuuagacccucau

SEQ ID NO: 3026043 - RNA, 21 nt, Human
aagucaagugaaaaaggagga

SEQ ID NO: 3026044 - RNA, 24 nt, Human
aagucacacaguauuacuucugcu

SEQ ID NO: 3026045 - RNA, 18 nt, Human
aaguauucuuauuuaaug

SEQ ID NO: 3026046 - RNA, 13 nt, Human
aagucacacagug

SEQ ID NO: 3026047 - RNA, 21 nt, Human
aaguacuucuccacccugcuc

SEQ ID NO: 3026048 - RNA, 15 nt, Human
aaguacuggagaaaa

SEQ ID NO: 3026049 - RNA, 16 nt, Human
aaguacuauguaucaa

SEQ ID NO: 3026050 - RNA, 15 nt, Human
aaguacuauguauca

SEQ ID NO: 3026051 - RNA, 20 nt, Human
aaguacuucuccacccugcu

SEQ ID NO: 3026052 - RNA, 22 nt, Human
aaguacuucuccacccugcucu

SEQ ID NO: 3026053 - RNA, 23 nt, Human
aaguacuucuccacccugcucuc

SEQ ID NO: 3026054 - RNA, 23 nt, Human
guuuuuuaagggcccuuuuucaa

SEQ ID NO: 3026055 - RNA, 16 nt, Human
guuuuugucuuaaaaa

SEQ ID NO: 3026056 - RNA, 18 nt, Human
guuuuucuaggccugggg

SEQ ID NO: 3026057 - RNA, 18 nt, Human
aagucuuagauguauaua

SEQ ID NO: 3026058 - RNA, 19 nt, Human
aagucuuagauguauauau

SEQ ID NO: 3026059 - RNA, 17 nt, Human
aagucuuagauguauau

SEQ ID NO: 3026060 - RNA, 23 nt, Human
guugcuaacagcaacacaaagcu

SEQ ID NO: 3026061 - RNA, 14 nt, Human
guugcuaacagcaa

SEQ ID NO: 3026062 - RNA, 16 nt, Human
guugcccaggcuggcg

SEQ ID NO: 3026063 - RNA, 15 nt, Human
guugcccaggcuggc

SEQ ID NO: 3026064 - RNA, 23 nt, Human
guuggcugggggccucagugcca

SEQ ID NO: 3026065 - RNA, 15 nt, Human
guugggcugguguca

SEQ ID NO: 3026066 - RNA, 17 nt, Human
guugggcuggugucacc

SEQ ID NO: 3026067 - RNA, 13 nt, Human
aaggcuaccuuug

SEQ ID NO: 3026068 - RNA, 14 nt, Human
guugcccaggcugg

SEQ ID NO: 3026069 - RNA, 15 nt, Human
aaggcuaccuuugua

SEQ ID NO: 3026070 - RNA, 19 nt, Human
aaggccccgcccaggcuua

SEQ ID NO: 3026071 - RNA, 16 nt, Human
aaggccccgcccaggc

SEQ ID NO: 3026072 - RNA, 14 nt, Human
aaggccccgcccag

SEQ ID NO: 3026073 - RNA, 24 nt, Human
aaggaugcacagaguuguuacauu

SEQ ID NO: 3026074 - RNA, 22 nt, Human
aaggaugcacagaguuguuaca

SEQ ID NO: 3026075 - RNA, 14 nt, Human
aaggaugcccaaag

SEQ ID NO: 3026076 - RNA, 15 nt, Human
aaggaaacccagcuc

SEQ ID NO: 3026077 - RNA, 18 nt, Human
aaggagauuuacaacugg

SEQ ID NO: 3026078 - RNA, 17 nt, Human
aaggagauuuacaacug

SEQ ID NO: 3026079 - RNA, 12 nt, Human
aaggauccugag

SEQ ID NO: 3026080 - RNA, 11 nt, Human
aaggauccuga

SEQ ID NO: 3026081 - RNA, 22 nt, Human
aaggauccugagccagauuuca

SEQ ID NO: 3026082 - RNA, 20 nt, Human
aaggauccugagccagauuu

SEQ ID NO: 3026083 - RNA, 20 nt, Human
aaggaggaagagaaaaaaua

SEQ ID NO: 3026084 - RNA, 18 nt, Human
guucuccagucauuaugu

SEQ ID NO: 3026085 - RNA, 20 nt, Human
guucuccagucauuauguua

SEQ ID NO: 3026086 - RNA, 14 nt, Human
guucucugaggaca

SEQ ID NO: 3026087 - RNA, 16 nt, Human
guucucugaggacacu

SEQ ID NO: 3026088 - RNA, 11 nt, Human
guucucugccc

SEQ ID NO: 3026089 - RNA, 12 nt, Human
guucucugcccu

SEQ ID NO: 3026090 - RNA, 22 nt, Human
guugauagcacagacccugccc

SEQ ID NO: 3026091 - RNA, 23 nt, Human
guugauagcacagacccugcccu

SEQ ID NO: 3026092 - RNA, 13 nt, Human
guguuuauuguca

SEQ ID NO: 3026093 - RNA, 11 nt, Human
aagcucccagg

SEQ ID NO: 3026094 - RNA, 21 nt, Human
aagcucuacugaggugcuaug

SEQ ID NO: 3026095 - RNA, 23 nt, Human
aagcucccaggcauuccccagga

SEQ ID NO: 3026096 - RNA, 22 nt, Human
aagcucccaggcauuccccagg

SEQ ID NO: 3026097 - RNA, 12 nt, Human
aagcucccaggc

SEQ ID NO: 3026098 - RNA, 13 nt, Human
aagcucugcuccu

SEQ ID NO: 3026099 - RNA, 18 nt, Human
aagcuguuacugucuuca

SEQ ID NO: 3026100 - RNA, 20 nt, Human
uaaacucugagugcaaacuu

SEQ ID NO: 3026101 - RNA, 12 nt, Human
uaaacucauuuc

SEQ ID NO: 3026102 - RNA, 17 nt, Human
uaaacucauuucuagca

SEQ ID NO: 3026103 - RNA, 22 nt, Human
uaaacuacauuagguugugaau

SEQ ID NO: 3026104 - RNA, 18 nt, Human
uaaaccgccaaggcuggg

SEQ ID NO: 3026105 - RNA, 16 nt, Human
uaaaccgccaaggcug

SEQ ID NO: 3026106 - RNA, 19 nt, Human
uaaaggcuaccuuuguauu

SEQ ID NO: 3026107 - RNA, 21 nt, Human
uaaaggcuaccuuuguauucu

SEQ ID NO: 3026108 - RNA, 13 nt, Human
aaguuuugagaaa

SEQ ID NO: 3026109 - RNA, 12 nt, Human
aaguuaaauaaa

SEQ ID NO: 3026110 - RNA, 14 nt, Human
aaguuaaauaaauc

SEQ ID NO: 3026111 - RNA, 16 nt, Human
uaaaugacucuucccu

SEQ ID NO: 3026112 - RNA, 20 nt, Human
uaaaucuccaaaauaaaacu

SEQ ID NO: 3026113 - RNA, 21 nt, Human
uaaaucuccaaaauaaaacuu

SEQ ID NO: 3026114 - RNA, 22 nt, Human
uaaauuaacuuuuauaaacuuu

SEQ ID NO: 3026115 - RNA, 13 nt, Human
uaacaagccaccc

SEQ ID NO: 3026116 - RNA, 19 nt, Human
uaaaucuccaaaauaaaac

SEQ ID NO: 3026117 - RNA, 16 nt, Human
aauacaccacuacauu

SEQ ID NO: 3026118 - RNA, 18 nt, Human
aauacaccacuacauucu

SEQ ID NO: 3026119 - RNA, 20 nt, Human
aauacaccacuacauucugu

SEQ ID NO: 3026120 - RNA, 15 nt, Human
aauacaccacuacau

SEQ ID NO: 3026121 - RNA, 15 nt, Human
aauaacuaaaaggua

SEQ ID NO: 3026122 - RNA, 12 nt, Human
aauaaauuauuu

SEQ ID NO: 3026123 - RNA, 12 nt, Human
aauaacauguaa

SEQ ID NO: 3026124 - RNA, 19 nt, Human
aauaacauguaauuaagua

SEQ ID NO: 3026125 - RNA, 13 nt, Human
uaaagucaggggu

SEQ ID NO: 3026126 - RNA, 14 nt, Human
uaaaguguauuuuu

SEQ ID NO: 3026127 - RNA, 15 nt, Human
uaaaguguauuuuuu

SEQ ID NO: 3026128 - RNA, 19 nt, Human
uaaaguguauuuuuuuacu

SEQ ID NO: 3026129 - RNA, 14 nt, Human
aauaaaguaauuau

SEQ ID NO: 3026130 - RNA, 14 nt, Human
augcugccaauauc

SEQ ID NO: 3026131 - RNA, 17 nt, Human
augcugccaauauccua

SEQ ID NO: 3026132 - RNA, 18 nt, Human
augcugccaauauccuaa

SEQ ID NO: 3026133 - RNA, 19 nt, Human
augcugccaauauccuaau

SEQ ID NO: 3026134 - RNA, 13 nt, Human
augcugccaauau

SEQ ID NO: 3026135 - RNA, 20 nt, Human
augcugccaauauccuaaua

SEQ ID NO: 3026136 - RNA, 21 nt, Human
augcugccaauauccuaauaa

SEQ ID NO: 3026137 - RNA, 22 nt, Human
augcugccaauauccuaauaaa

SEQ ID NO: 3026138 - RNA, 23 nt, Human
augcugccaauauccuaauaaaa

SEQ ID NO: 3026139 - RNA, 11 nt, Human
augcugcccug

SEQ ID NO: 3026140 - RNA, 16 nt, Human
augcucuuuacuucau

SEQ ID NO: 3026141 - RNA, 23 nt, Human
augcuugcugcugauuuaaacac

SEQ ID NO: 3026142 - RNA, 12 nt, Human
augcuuguacau

SEQ ID NO: 3026143 - RNA, 13 nt, Human
augcuuguacaua

SEQ ID NO: 3026144 - RNA, 14 nt, Human
augcuuguacauaa

SEQ ID NO: 3026145 - RNA, 15 nt, Human
auggauuuccagcca

SEQ ID NO: 3026146 - RNA, 15 nt, Human
augcacaaacagagg

SEQ ID NO: 3026147 - RNA, 24 nt, Human
augauguuuuccaugaguccccug

SEQ ID NO: 3026148 - RNA, 17 nt, Human
augaugccaugaggaac

SEQ ID NO: 3026149 - RNA, 16 nt, Human
augaugccaugaggaa

SEQ ID NO: 3026150 - RNA, 19 nt, Human
augccucucucaggccaaa

SEQ ID NO: 3026151 - RNA, 16 nt, Human
augcaugaaguaauau

SEQ ID NO: 3026152 - RNA, 17 nt, Human
augccucucucaggcca

SEQ ID NO: 3026153 - RNA, 23 nt, Human
augcacacauuuuuuaaaugcac

SEQ ID NO: 3026154 - RNA, 16 nt, Human
augcacagaguuguua

SEQ ID NO: 3026155 - RNA, 17 nt, Human
augcacaaacagaggcc

SEQ ID NO: 3026156 - RNA, 16 nt, Human
augcacaaacagaggc

SEQ ID NO: 3026157 - RNA, 17 nt, Human
augcacagaguuguuac

SEQ ID NO: 3026158 - RNA, 18 nt, Human
augcacagaguuguuaca

SEQ ID NO: 3026159 - RNA, 20 nt, Human
auguucuccagucauuaugu

SEQ ID NO: 3026160 - RNA, 11 nt, Human
auguucuggga

SEQ ID NO: 3026161 - RNA, 12 nt, Human
auguucugggac

SEQ ID NO: 3026162 - RNA, 12 nt, Human
auguuuucaaau

SEQ ID NO: 3026163 - RNA, 15 nt, Human
auguuuucaaauguu

SEQ ID NO: 3026164 - RNA, 17 nt, Human
auguuuuauauagcaag

SEQ ID NO: 3026165 - RNA, 18 nt, Human
auguuuucaaauguucuc

SEQ ID NO: 3026166 - RNA, 19 nt, Human
auguuugccucugccucug

SEQ ID NO: 3026167 - RNA, 22 nt, Human
auguuugccucugccucugaca

SEQ ID NO: 3026168 - RNA, 18 nt, Human
auguuugccucugccucu

SEQ ID NO: 3026169 - RNA, 13 nt, Human
auguucugggaca

SEQ ID NO: 3026170 - RNA, 14 nt, Human
augucuuuucuugc

SEQ ID NO: 3026171 - RNA, 22 nt, Human
augugaaacuggauuaaacuua

SEQ ID NO: 3026172 - RNA, 19 nt, Human
auggucaccaaaucagcug

SEQ ID NO: 3026173 - RNA, 22 nt, Human
augguaguuuuacaguguuucu

SEQ ID NO: 3026174 - RNA, 15 nt, Human
auguaauuaaguacu

SEQ ID NO: 3026175 - RNA, 17 nt, Human
auguaauuaaguacuau

SEQ ID NO: 3026176 - RNA, 23 nt, Human
aucagcacgauuucuguuuagau

SEQ ID NO: 3026177 - RNA, 19 nt, Human
aucagcacgauuucuguuu

SEQ ID NO: 3026178 - RNA, 20 nt, Human
aucagcacgauuucuguuua

SEQ ID NO: 3026179 - RNA, 14 nt, Human
aucaccgaaaacgu

SEQ ID NO: 3026180 - RNA, 21 nt, Human
aucaccgaaaacguggcugcu

SEQ ID NO: 3026181 - RNA, 19 nt, Human
aucaccgaaaacguggcug

SEQ ID NO: 3026182 - RNA, 18 nt, Human
aucagccugcuccagcug

SEQ ID NO: 3026183 - RNA, 17 nt, Human
aucagccugcuccagcu

SEQ ID NO: 3026184 - RNA, 19 nt, Human
aucagccugcuccagcugu

SEQ ID NO: 3026185 - RNA, 21 nt, Human
aucacagccucugaaaaccaa

SEQ ID NO: 3026186 - RNA, 18 nt, Human
aucaccaacgucugugcc

SEQ ID NO: 3026187 - RNA, 23 nt, Human
aucacccgcuaagagggagggag

SEQ ID NO: 3026188 - RNA, 19 nt, Human
aucaccaacgucugugcca

SEQ ID NO: 3026189 - RNA, 20 nt, Human
auccucccaccucagccucc

SEQ ID NO: 3026190 - RNA, 18 nt, Human
auccucccaccucagccu

SEQ ID NO: 3026191 - RNA, 19 nt, Human
auccucccaccucagccuc

SEQ ID NO: 3026192 - RNA, 15 nt, Human
aucccauuuaaaaaa

SEQ ID NO: 3026193 - RNA, 14 nt, Human
aucccauuuaaaaa

SEQ ID NO: 3026194 - RNA, 15 nt, Human
auccagacccggcug

SEQ ID NO: 3026195 - RNA, 15 nt, Human
auccccuguagagug

SEQ ID NO: 3026196 - RNA, 15 nt, Human
auccucccaccucag

SEQ ID NO: 3026197 - RNA, 23 nt, Human
auccuccaggugcacaagcucca

SEQ ID NO: 3026198 - RNA, 23 nt, Human
auccucauacccacccccaccca

SEQ ID NO: 3026199 - RNA, 11 nt, Human
auccuccaggu

SEQ ID NO: 3026200 - RNA, 23 nt, Human
augaccuuucaauaggaaaaacu

SEQ ID NO: 3026201 - RNA, 22 nt, Human
augaccuuucaauaggaaaaac

SEQ ID NO: 3026202 - RNA, 18 nt, Human
augaccuuucaauaggaa

SEQ ID NO: 3026203 - RNA, 21 nt, Human
augaccuuucaauaggaaaaa

SEQ ID NO: 3026204 - RNA, 13 nt, Human
augaaagacugua

SEQ ID NO: 3026205 - RNA, 16 nt, Human
augaaagacuguacaa

SEQ ID NO: 3026206 - RNA, 17 nt, Human
augaaagacuguacaaa

SEQ ID NO: 3026207 - RNA, 14 nt, Human
aucuucuuuauaau

SEQ ID NO: 3026208 - RNA, 18 nt, Human
aucuugaagacuuuucuu

SEQ ID NO: 3026209 - RNA, 22 nt, Human
aucuucugaacuuggcgcugcc

SEQ ID NO: 3026210 - RNA, 22 nt, Human
aucugcuuuuuaaagaaugcuc

SEQ ID NO: 3026211 - RNA, 21 nt, Human
aucucccccagccccauccuc

SEQ ID NO: 3026212 - RNA, 20 nt, Human
auaacaaaggauacuuauuu

SEQ ID NO: 3026213 - RNA, 21 nt, Human
auaacaaaggauacuuauuua

SEQ ID NO: 3026214 - RNA, 17 nt, Human
auaaaacuuuuuaaaau

SEQ ID NO: 3026215 - RNA, 21 nt, Human
auaaacuuuaccuuuuuuaua

SEQ ID NO: 3026216 - RNA, 16 nt, Human
auaaacuuuaccuuuu

SEQ ID NO: 3026217 - RNA, 24 nt, Human
auaaacuuuaccuuuuuuauacau

SEQ ID NO: 3026218 - RNA, 15 nt, Human
auaaaacuuuuuaaa

SEQ ID NO: 3026219 - RNA, 11 nt, Human
auaaaacuuuu

SEQ ID NO: 3026220 - RNA, 13 nt, Human
auaaagcagcguu

SEQ ID NO: 3026221 - RNA, 14 nt, Human
auaaagcagcguuu

SEQ ID NO: 3026222 - RNA, 18 nt, Human
auaaagcagcguuucuau

SEQ ID NO: 3026223 - RNA, 19 nt, Human
auaaagcagcguuucuaug

SEQ ID NO: 3026224 - RNA, 20 nt, Human
auaaagcagcguuucuauga

SEQ ID NO: 3026225 - RNA, 15 nt, Human
auaaugucccuucac

SEQ ID NO: 3026226 - RNA, 15 nt, Human
auaauguaagcucua

SEQ ID NO: 3026227 - RNA, 21 nt, Human
auacaccacuacauucuguua

SEQ ID NO: 3026228 - RNA, 19 nt, Human
auacaccacuacauucugu

SEQ ID NO: 3026229 - RNA, 20 nt, Human
auacaccacuacauucuguu

SEQ ID NO: 3026230 - RNA, 18 nt, Human
auacaccacuacauucug

SEQ ID NO: 3026231 - RNA, 14 nt, Human
auaauguaagcucu

SEQ ID NO: 3026232 - RNA, 21 nt, Human
auaaugcgugcauaccacuuu

SEQ ID NO: 3026233 - RNA, 20 nt, Human
auaaugcgugcauaccacuu

SEQ ID NO: 3026234 - RNA, 17 nt, Human
auaccugucccccugac

SEQ ID NO: 3026235 - RNA, 18 nt, Human
auaccugucccccugaca

SEQ ID NO: 3026236 - RNA, 11 nt, Human
auacccacccc

SEQ ID NO: 3026237 - RNA, 12 nt, Human
auacccaccccc

SEQ ID NO: 3026238 - RNA, 15 nt, Human
auagcaguaaaaaau

SEQ ID NO: 3026239 - RNA, 21 nt, Human
auagcaguaaaaaaugguguu

SEQ ID NO: 3026240 - RNA, 21 nt, Human
auagccaaggccaaaggaagc

SEQ ID NO: 3026241 - RNA, 15 nt, Human
auagccaaggccaaa

SEQ ID NO: 3026242 - RNA, 17 nt, Human
auaguaugguggcuggg

SEQ ID NO: 3026243 - RNA, 18 nt, Human
auaguaugguggcugggu

SEQ ID NO: 3026244 - RNA, 16 nt, Human
auauccuaauaaaaag

SEQ ID NO: 3026245 - RNA, 18 nt, Human
auauccuaauaaaaaggu

SEQ ID NO: 3026246 - RNA, 22 nt, Human
auaucccuuggacauuuuaugu

SEQ ID NO: 3026247 - RNA, 23 nt, Human
auaucccuuggacauuuuauguc

SEQ ID NO: 3026248 - RNA, 12 nt, Human
auauccuaauaa

SEQ ID NO: 3026249 - RNA, 13 nt, Human
auauccuaauaaa

SEQ ID NO: 3026250 - RNA, 14 nt, Human
auauccuaauaaaa

SEQ ID NO: 3026251 - RNA, 20 nt, Human
auaucccuuggacauuuuau

SEQ ID NO: 3026252 - RNA, 19 nt, Human
auaucccuuggacauuuua

SEQ ID NO: 3026253 - RNA, 19 nt, Human
auauuaccacagacauacu

SEQ ID NO: 3026254 - RNA, 22 nt, Human
auauuaccacagacauacuaac

SEQ ID NO: 3026255 - RNA, 21 nt, Human
auaugcuuauacacuuacacu

SEQ ID NO: 3026256 - RNA, 19 nt, Human
auauuuacuucuuauacau

SEQ ID NO: 3026257 - RNA, 23 nt, Human
aguggcuuaaaacaacacucaca

SEQ ID NO: 3026258 - RNA, 15 nt, Human
agugggagcugccug

SEQ ID NO: 3026259 - RNA, 14 nt, Human
agugggagcugccu

SEQ ID NO: 3026260 - RNA, 17 nt, Human
aguguauuuuuuuacua

SEQ ID NO: 3026261 - RNA, 18 nt, Human
aguguauuuuuuuacuaa

SEQ ID NO: 3026262 - RNA, 14 nt, Human
aguugaagacagag

SEQ ID NO: 3026263 - RNA, 20 nt, Human
aguuguuugauucagacagc

SEQ ID NO: 3026264 - RNA, 12 nt, Human
aguuaaauaaau

SEQ ID NO: 3026265 - RNA, 18 nt, Human
aguuacacuaaaagguga

SEQ ID NO: 3026266 - RNA, 16 nt, Human
aguuacagacaaagcg

SEQ ID NO: 3026267 - RNA, 14 nt, Human
aguuacagacaaag

SEQ ID NO: 3026268 - RNA, 20 nt, Human
aguucagguaacaggcagau

SEQ ID NO: 3026269 - RNA, 18 nt, Human
aguucagguaacaggcag

SEQ ID NO: 3026270 - RNA, 19 nt, Human
aguucagguaacaggcaga

SEQ ID NO: 3026271 - RNA, 22 nt, Human
aguucaucuugaauuguaagga

SEQ ID NO: 3026272 - RNA, 14 nt, Human
agugaagacaauga

SEQ ID NO: 3026273 - RNA, 16 nt, Human
agugaagacaaugacu

SEQ ID NO: 3026274 - RNA, 16 nt, Human
agucugauucccaagc

SEQ ID NO: 3026275 - RNA, 18 nt, Human
agucugauucccaagcuc

SEQ ID NO: 3026276 - RNA, 17 nt, Human
agucuggaaugcagugg

SEQ ID NO: 3026277 - RNA, 20 nt, Human
agugaacuugggccacugug

SEQ ID NO: 3026278 - RNA, 22 nt, Human
aguccuggcaugggaaugaaug

SEQ ID NO: 3026279 - RNA, 21 nt, Human
aguccuggcaugggaaugaau

SEQ ID NO: 3026280 - RNA, 20 nt, Human
aguccuggcaugggaaugaa

SEQ ID NO: 3026281 - RNA, 15 nt, Human
agucugaaggcuggg

SEQ ID NO: 3026282 - RNA, 13 nt, Human
agucugaaggcug

SEQ ID NO: 3026283 - RNA, 16 nt, Human
agucugaaggcugggu

SEQ ID NO: 3026284 - RNA, 12 nt, Human
agucugaaggcu

SEQ ID NO: 3026285 - RNA, 15 nt, Human
aguaugaggcauuug

SEQ ID NO: 3026286 - RNA, 16 nt, Human
aguaugaggcauuugu

SEQ ID NO: 3026287 - RNA, 15 nt, Human
aguaucucagggccu

SEQ ID NO: 3026288 - RNA, 15 nt, Human
aguaucuugaagacu

SEQ ID NO: 3026289 - RNA, 12 nt, Human
aguaucuugaag

SEQ ID NO: 3026290 - RNA, 11 nt, Human
aguaucuugaa

SEQ ID NO: 3026291 - RNA, 22 nt, Human
aggucuguuuuguguacuuuua

SEQ ID NO: 3026292 - RNA, 22 nt, Human
aggucuguucuuuccaaaguac

SEQ ID NO: 3026293 - RNA, 23 nt, Human
aggucuguucuuuccaaaguaca

SEQ ID NO: 3026294 - RNA, 18 nt, Human
aggucuguucuuuccaaa

SEQ ID NO: 3026295 - RNA, 23 nt, Human
aggugcuaggaacacuccuucac

SEQ ID NO: 3026296 - RNA, 22 nt, Human
aggugcuaggaacacuccuuca

SEQ ID NO: 3026297 - RNA, 19 nt, Human
aggugcuaggaacacuccu

SEQ ID NO: 3026298 - RNA, 23 nt, Human
agguucccuuugacgccauccca

SEQ ID NO: 3026299 - RNA, 14 nt, Human
agguucaaagauau

SEQ ID NO: 3026300 - RNA, 13 nt, Human
agguucccuuuga

SEQ ID NO: 3026301 - RNA, 22 nt, Human
agguucccuuugacgccauccc

SEQ ID NO: 3026302 - RNA, 11 nt, Human
agggucccugg

SEQ ID NO: 3026303 - RNA, 19 nt, Human
aggguaucaggugcugcca

SEQ ID NO: 3026304 - RNA, 18 nt, Human
aggguaucaggugcugcc

SEQ ID NO: 3026305 - RNA, 21 nt, Human
aggguaucaggugcugccauc

SEQ ID NO: 3026306 - RNA, 15 nt, Human
aggguaucuggugac

SEQ ID NO: 3026307 - RNA, 21 nt, Human
aggggccucuuaugggcuggg

SEQ ID NO: 3026308 - RNA, 20 nt, Human
aggggccucuuaugggcugg

SEQ ID NO: 3026309 - RNA, 19 nt, Human
aggggccucuuaugggcug

SEQ ID NO: 3026310 - RNA, 23 nt, Human
agggacagaggggguggccuccc

SEQ ID NO: 3026311 - RNA, 21 nt, Human
aggcugucaauuacaggaagu

SEQ ID NO: 3026312 - RNA, 22 nt, Human
agggacagaggggguggccucc

SEQ ID NO: 3026313 - RNA, 13 nt, Human
aggcuguauccca

SEQ ID NO: 3026314 - RNA, 18 nt, Human
aggcuguaucccaugagc

SEQ ID NO: 3026315 - RNA, 19 nt, Human
aggcugucaauuacaggaa

SEQ ID NO: 3026316 - RNA, 20 nt, Human
aggcugucaauuacaggaag

SEQ ID NO: 3026317 - RNA, 23 nt, Human
aggcccuucucuccagccccugg

SEQ ID NO: 3026318 - RNA, 22 nt, Human
aggcccuucucuccagccccug

SEQ ID NO: 3026319 - RNA, 21 nt, Human
aggcccuucucuccagccccu

SEQ ID NO: 3026320 - RNA, 20 nt, Human
aggcccuucucuccagcccc

SEQ ID NO: 3026321 - RNA, 23 nt, Human
aggagaagucuucuauuuauuua

SEQ ID NO: 3026322 - RNA, 22 nt, Human
aggagaagucuucuauuuauuu

SEQ ID NO: 3026323 - RNA, 13 nt, Human
aggaccucaggug

SEQ ID NO: 3026324 - RNA, 21 nt, Human
aggaugcuuguacauaaugcg

SEQ ID NO: 3026325 - RNA, 23 nt, Human
aggaugcuuguacauaaugcgug

SEQ ID NO: 3026326 - RNA, 14 nt, Human
aggauuauuggaaa

SEQ ID NO: 3026327 - RNA, 15 nt, Human
aggauguucugggac

SEQ ID NO: 3026328 - RNA, 16 nt, Human
aggauguucugggaca

SEQ ID NO: 3026329 - RNA, 22 nt, Human
aggauguucuagcauggcugcc

SEQ ID NO: 3026330 - RNA, 12 nt, Human
agcuuuugcaua

SEQ ID NO: 3026331 - RNA, 20 nt, Human
aggaauccagacccggcugc

SEQ ID NO: 3026332 - RNA, 17 nt, Human
aggaauccagacccggc

SEQ ID NO: 3026333 - RNA, 21 nt, Human
aggaaucaugugccaagcaga

SEQ ID NO: 3026334 - RNA, 23 nt, Human
agcugcgguccacccaggagccc

SEQ ID NO: 3026335 - RNA, 23 nt, Human
agcuccgcuuucuacccagcgag

SEQ ID NO: 3026336 - RNA, 20 nt, Human
agcuccgcuuucuacccagc

SEQ ID NO: 3026337 - RNA, 21 nt, Human
agcuccgcuuucuacccagcg

SEQ ID NO: 3026338 - RNA, 12 nt, Human
agcuccuucugu

SEQ ID NO: 3026339 - RNA, 13 nt, Human
agcuccuucuguc

SEQ ID NO: 3026340 - RNA, 21 nt, Human
agcugcgguccacccaggagc

SEQ ID NO: 3026341 - RNA, 21 nt, Human
agacgugcacgcacacugucu

SEQ ID NO: 3026342 - RNA, 22 nt, Human
agacgugcacgcacacugucug

SEQ ID NO: 3026343 - RNA, 18 nt, Human
agacggagucccaccuug

SEQ ID NO: 3026344 - RNA, 22 nt, Human
agacgcugugcugcccugccca

SEQ ID NO: 3026345 - RNA, 20 nt, Human
agacgcugugcugcccugcc

SEQ ID NO: 3026346 - RNA, 12 nt, Human
agacagcugccu

SEQ ID NO: 3026347 - RNA, 12 nt, Human
agacagcucuua

SEQ ID NO: 3026348 - RNA, 11 nt, Human
agacagcucuu

SEQ ID NO: 3026349 - RNA, 21 nt, Human
agacgcugugcugcccugccc

SEQ ID NO: 3026350 - RNA, 23 nt, Human
agacagagucucacuguugccca

SEQ ID NO: 3026351 - RNA, 21 nt, Human
agacagauacuccuccaaggu

SEQ ID NO: 3026352 - RNA, 15 nt, Human
agacagauacuccuc

SEQ ID NO: 3026353 - RNA, 15 nt, Human
agacagcccgggcuc

SEQ ID NO: 3026354 - RNA, 14 nt, Human
agacagcccgggcu

SEQ ID NO: 3026355 - RNA, 19 nt, Human
agagcccaccuuggcucaa

SEQ ID NO: 3026356 - RNA, 13 nt, Human
agagcccacgccc

SEQ ID NO: 3026357 - RNA, 16 nt, Human
agagcccacgccccca

SEQ ID NO: 3026358 - RNA, 22 nt, Human
agagaggguggugaccucugcc

SEQ ID NO: 3026359 - RNA, 20 nt, Human
agagaggguggugaccucug

SEQ ID NO: 3026360 - RNA, 21 nt, Human
agagaggguggugaccucugc

SEQ ID NO: 3026361 - RNA, 19 nt, Human
agacuggaagcacagcuuc

SEQ ID NO: 3026362 - RNA, 17 nt, Human
agacuggaagcacagcu

SEQ ID NO: 3026363 - RNA, 16 nt, Human
agacuggaagcacagc

SEQ ID NO: 3026364 - RNA, 19 nt, Human
agauauaugcucugcaugu

SEQ ID NO: 3026365 - RNA, 14 nt, Human
agaucuucuguggg

SEQ ID NO: 3026366 - RNA, 16 nt, Human
agaggaaggagaggag

SEQ ID NO: 3026367 - RNA, 21 nt, Human
agaggaaaucaccgaaaacgu

SEQ ID NO: 3026368 - RNA, 23 nt, Human
agaggacuuuucuuuguggcuuc

SEQ ID NO: 3026369 - RNA, 16 nt, Human
agaggagagaggaccc

SEQ ID NO: 3026370 - RNA, 15 nt, Human
agaggagagaggacc

SEQ ID NO: 3026371 - RNA, 19 nt, Human
agaggguggugaccucugc

SEQ ID NO: 3026372 - RNA, 20 nt, Human
agaggguggugaccucugcc

SEQ ID NO: 3026373 - RNA, 22 nt, Human
agaggguggugaccucugccug

SEQ ID NO: 3026374 - RNA, 12 nt, Human
agagggcacaga

SEQ ID NO: 3026375 - RNA, 11 nt, Human
agagugggagc

SEQ ID NO: 3026376 - RNA, 19 nt, Human
agaguggggauaugauuua

SEQ ID NO: 3026377 - RNA, 14 nt, Human
agagugugccugaa

SEQ ID NO: 3026378 - RNA, 14 nt, Human
agagcccaggccuc

SEQ ID NO: 3026379 - RNA, 13 nt, Human
agagcccaggccu

SEQ ID NO: 3026380 - RNA, 15 nt, Human
agagcccaggccucc

SEQ ID NO: 3026381 - RNA, 16 nt, Human
agcccucaauugugaa

SEQ ID NO: 3026382 - RNA, 17 nt, Human
agcccucaauugugaaa

SEQ ID NO: 3026383 - RNA, 13 nt, Human
agccccauucugc

SEQ ID NO: 3026384 - RNA, 16 nt, Human
agccccauucugccug

SEQ ID NO: 3026385 - RNA, 13 nt, Human
agccccagugccc

SEQ ID NO: 3026386 - RNA, 14 nt, Human
agccccagugccca

SEQ ID NO: 3026387 - RNA, 15 nt, Human
agccccagugcccac

SEQ ID NO: 3026388 - RNA, 20 nt, Human
agccagcaggcucucaggcc

SEQ ID NO: 3026389 - RNA, 17 nt, Human
agccagcaggcucucag

SEQ ID NO: 3026390 - RNA, 19 nt, Human
agccagcaggcucucaggc

SEQ ID NO: 3026391 - RNA, 18 nt, Human
agccagcaggcucucagg

SEQ ID NO: 3026392 - RNA, 22 nt, Human
agccucccacgacugcccggca

SEQ ID NO: 3026393 - RNA, 21 nt, Human
agccucccaaagugcugggau

SEQ ID NO: 3026394 - RNA, 20 nt, Human
agccucccaaagugcuggga

SEQ ID NO: 3026395 - RNA, 14 nt, Human
agccuccuccagcc

SEQ ID NO: 3026396 - RNA, 20 nt, Human
agccucccgaguagcuggga

SEQ ID NO: 3026397 - RNA, 18 nt, Human
agccucccgaguagcugg

SEQ ID NO: 3026398 - RNA, 19 nt, Human
agccucccgaguagcuggg

SEQ ID NO: 3026399 - RNA, 21 nt, Human
agccgccaugcuccuggccca

SEQ ID NO: 3026400 - RNA, 13 nt, Human
agccgcuggggcc

SEQ ID NO: 3026401 - RNA, 15 nt, Human
agcaugaagacagag

SEQ ID NO: 3026402 - RNA, 18 nt, Human
agcauccuggcacccggc

SEQ ID NO: 3026403 - RNA, 22 nt, Human
agcauccuggcacccggccccu

SEQ ID NO: 3026404 - RNA, 23 nt, Human
agcauccuggcacccggccccug

SEQ ID NO: 3026405 - RNA, 23 nt, Human
agcaugccuggauggggcugcac

SEQ ID NO: 3026406 - RNA, 20 nt, Human
agcaugccuggauggggcug

SEQ ID NO: 3026407 - RNA, 23 nt, Human
agccaagugugguagagugugcc

SEQ ID NO: 3026408 - RNA, 13 nt, Human
agcagcguuucua

SEQ ID NO: 3026409 - RNA, 20 nt, Human
agcagugcaugcugucccuu

SEQ ID NO: 3026410 - RNA, 19 nt, Human
agcagugcaugcugucccu

SEQ ID NO: 3026411 - RNA, 18 nt, Human
agcagugcaugcuguccc

SEQ ID NO: 3026412 - RNA, 23 nt, Human
agcacacuugacaucaacugcau

SEQ ID NO: 3026413 - RNA, 17 nt, Human
agcacagacccugcccu

SEQ ID NO: 3026414 - RNA, 20 nt, Human
agcacagacccugcccugug

SEQ ID NO: 3026415 - RNA, 19 nt, Human
agcacagacccugcccugu

SEQ ID NO: 3026416 - RNA, 18 nt, Human
agcacagacccugcccug

SEQ ID NO: 3026417 - RNA, 11 nt, Human
aagauucuaug

SEQ ID NO: 3026418 - RNA, 17 nt, Human
aagcagcguuucuauga

SEQ ID NO: 3026419 - RNA, 20 nt, Human
aagcagcguuucuaugacac

SEQ ID NO: 3026420 - RNA, 14 nt, Human
aagcagcguuucua

SEQ ID NO: 3026421 - RNA, 21 nt, Human
aagcagcguuucuaugacaca

SEQ ID NO: 3026422 - RNA, 22 nt, Human
aagcagcguuucuaugacacau

SEQ ID NO: 3026423 - RNA, 19 nt, Human
aagccagcaggcucucagg

SEQ ID NO: 3026424 - RNA, 23 nt, Human
aagccagcaggcucucaggccag

SEQ ID NO: 3026425 - RNA, 20 nt, Human
aagccagcaggcucucaggc

SEQ ID NO: 3026426 - RNA, 12 nt, Human
aagauaaaugug

SEQ ID NO: 3026427 - RNA, 23 nt, Human
aagauacaguuacucagaauucu

SEQ ID NO: 3026428 - RNA, 13 nt, Human
aagauaaaugugc

SEQ ID NO: 3026429 - RNA, 15 nt, Human
aagcugggcagguug

SEQ ID NO: 3026430 - RNA, 18 nt, Human
aagcuggucccacucagu

SEQ ID NO: 3026431 - RNA, 21 nt, Human
aagcuggucccacucagucca

SEQ ID NO: 3026432 - RNA, 13 nt, Human
aaggacacuagaa

SEQ ID NO: 3026433 - RNA, 15 nt, Human
aaggauguucuagca

SEQ ID NO: 3026434 - RNA, 15 nt, Human
aaggauugcuacugu

SEQ ID NO: 3026435 - RNA, 21 nt, Human
aagcgauucuucugcuucagc

SEQ ID NO: 3026436 - RNA, 17 nt, Human
aagcgauucuucugcuu

SEQ ID NO: 3026437 - RNA, 12 nt, Human
aaggugcaucug

SEQ ID NO: 3026438 - RNA, 19 nt, Human
aaguagaagucuuagaugu

SEQ ID NO: 3026439 - RNA, 20 nt, Human
aaguagaagucuuagaugua

SEQ ID NO: 3026440 - RNA, 17 nt, Human
aaguaucccuacuguaa

SEQ ID NO: 3026441 - RNA, 18 nt, Human
aaguaucccuacuguaau

SEQ ID NO: 3026442 - RNA, 23 nt, Human
aaguaucccuacuguaauuugug

SEQ ID NO: 3026443 - RNA, 21 nt, Human
aaguagaagucuuagauguau

SEQ ID NO: 3026444 - RNA, 22 nt, Human
aaguccucuuuucugagaggac

SEQ ID NO: 3026445 - RNA, 18 nt, Human
aaguccucuuuucugaga

SEQ ID NO: 3026446 - RNA, 18 nt, Human
aaggucauuuuuuuuaag

SEQ ID NO: 3026447 - RNA, 19 nt, Human
aaggucauuuuuuuuaaga

SEQ ID NO: 3026448 - RNA, 21 nt, Human
aaguggaaaaauagccugccu

SEQ ID NO: 3026449 - RNA, 19 nt, Human
aaguggaaaaauagccugc

SEQ ID NO: 3026450 - RNA, 22 nt, Human
aaugucaguuguuauuuauuga

SEQ ID NO: 3026451 - RNA, 15 nt, Human
aaugugaaaagaaaa

SEQ ID NO: 3026452 - RNA, 15 nt, Human
aauguuugccucugc

SEQ ID NO: 3026453 - RNA, 16 nt, Human
aauguuugccucugcc

SEQ ID NO: 3026454 - RNA, 19 nt, Human
aaugcgugcauaccacuuu

SEQ ID NO: 3026455 - RNA, 18 nt, Human
aaugcgugcauaccacuu

SEQ ID NO: 3026456 - RNA, 23 nt, Human
aaugccuuacccucauguucuua

SEQ ID NO: 3026457 - RNA, 22 nt, Human
aauacucuacccucuuagaaaa

SEQ ID NO: 3026458 - RNA, 20 nt, Human
aauacucuacccucuuagaa

SEQ ID NO: 3026459 - RNA, 13 nt, Human
aauagacaauuua

SEQ ID NO: 3026460 - RNA, 14 nt, Human
aaucaccgaaaacg

SEQ ID NO: 3026461 - RNA, 15 nt, Human
aaucaccgaaaacgu

SEQ ID NO: 3026462 - RNA, 19 nt, Human
aauccagacccggcugcgu

SEQ ID NO: 3026463 - RNA, 17 nt, Human
aauccagacccggcugc

SEQ ID NO: 3026464 - RNA, 16 nt, Human
aaucucaaauuucuaa

SEQ ID NO: 3026465 - RNA, 15 nt, Human
aaucucaaauuucua

SEQ ID NO: 3026466 - RNA, 17 nt, Human
aaucucaaauuucuaaa

SEQ ID NO: 3026467 - RNA, 18 nt, Human
aaucucaaauuucuaaau

SEQ ID NO: 3026468 - RNA, 16 nt, Human
aaugauuaauuaaaac

SEQ ID NO: 3026469 - RNA, 22 nt, Human
aacagcaacacaaagcuuuugc

SEQ ID NO: 3026470 - RNA, 18 nt, Human
aacagcaacacaaagcuu

SEQ ID NO: 3026471 - RNA, 13 nt, Human
aaccacgcuggac

SEQ ID NO: 3026472 - RNA, 15 nt, Human
aaccacuucagcuga

SEQ ID NO: 3026473 - RNA, 15 nt, Human
aacacauuaaaggua

SEQ ID NO: 3026474 - RNA, 20 nt, Human
aacacauuaaagguacuuug

SEQ ID NO: 3026475 - RNA, 21 nt, Human
aaauucuugcaaaguaucccu

SEQ ID NO: 3026476 - RNA, 18 nt, Human
aaauucuugcaaaguauc

SEQ ID NO: 3026477 - RNA, 23 nt, Human
aaaugccuuacccucauguucuu

SEQ ID NO: 3026478 - RNA, 14 nt, Human
aacugauaaagaug

SEQ ID NO: 3026479 - RNA, 19 nt, Human
aacuuaaauaaugugaaac

SEQ ID NO: 3026480 - RNA, 18 nt, Human
aacuuaaucuaaauggaa

SEQ ID NO: 3026481 - RNA, 15 nt, Human
aacuuaaucuaaaug

SEQ ID NO: 3026482 - RNA, 16 nt, Human
aacuuaaucuaaaugg

SEQ ID NO: 3026483 - RNA, 19 nt, Human
aaacacugguuuuaaauau

SEQ ID NO: 3026484 - RNA, 16 nt, Human
aaacacuguucucugc

SEQ ID NO: 3026485 - RNA, 19 nt, Human
aaaaucucaaauuucuaaa

SEQ ID NO: 3026486 - RNA, 22 nt, Human
aaaaucucaaauuucuaaaucu

SEQ ID NO: 3026487 - RNA, 22 nt, Human
aaaaucccuuaccucggugccu

SEQ ID NO: 3026488 - RNA, 17 nt, Human
aaaauaaaacuuuuuaa

SEQ ID NO: 3026489 - RNA, 15 nt, Human
aaaaagaaaggaggg

SEQ ID NO: 3026490 - RNA, 13 nt, Human
aaacucugagugc

SEQ ID NO: 3026491 - RNA, 15 nt, Human
aaacucugagugcaa

SEQ ID NO: 3026492 - RNA, 14 nt, Human
aaagaguaggaaga

SEQ ID NO: 3026493 - RNA, 12 nt, Human
aaagauauuuug

SEQ ID NO: 3026494 - RNA, 16 nt, Human
aaagauauuuugcuuu

SEQ ID NO: 3026495 - RNA, 17 nt, Human
aaagauauuuugcuuug

SEQ ID NO: 3026496 - RNA, 13 nt, Human
aaacucuccucug

SEQ ID NO: 3026497 - RNA, 18 nt, Human
aaacucuccucugcugcu

SEQ ID NO: 3026498 - RNA, 18 nt, Human
aaaccaucauugaaaucu

SEQ ID NO: 3026499 - RNA, 16 nt, Human
aaaggcuccaggagca

SEQ ID NO: 3026500 - RNA, 15 nt, Human
aaaggcuccaggagc

SEQ ID NO: 3026501 - RNA, 20 nt, Human
aaaggcuccaggagcagcca

SEQ ID NO: 3026502 - RNA, 19 nt, Human
aaaggcuccaggagcagcc

SEQ ID NO: 3026503 - RNA, 13 nt, Human
aaaguggaaaaau

SEQ ID NO: 3026504 - RNA, 13 nt, Human
aaauaaaacuuuu

SEQ ID NO: 3026505 - RNA, 16 nt, Human
aaauaaaacuuuuuaa

SEQ ID NO: 3026506 - RNA, 19 nt, Human
aaauaaaacuuuuuaaaau

SEQ ID NO: 3026507 - RNA, 19 nt, Human
aaauaguggugugauuugg

SEQ ID NO: 3026508 - RNA, 24 nt, Human
aaauagcucaggugucccugcacu

SEQ ID NO: 3026509 - RNA, 18 nt, Human
aaaucugcuuuuuaaaga

SEQ ID NO: 3026510 - RNA, 22 nt, Human
acccaguguuuuaggagcauga

SEQ ID NO: 3026511 - RNA, 19 nt, Human
acccaguguuuuaggagca

SEQ ID NO: 3026512 - RNA, 16 nt, Human
acccaccucagccucc

SEQ ID NO: 3026513 - RNA, 11 nt, Human
acccccugaau

SEQ ID NO: 3026514 - RNA, 20 nt, Human
accauauuaccacagacaua

SEQ ID NO: 3026515 - RNA, 18 nt, Human
acccaagggccuggccug

SEQ ID NO: 3026516 - RNA, 22 nt, Human
acccaagggccuggccugagcu

SEQ ID NO: 3026517 - RNA, 19 nt, Human
acccaagggccuggccuga

SEQ ID NO: 3026518 - RNA, 13 nt, Human
acccaccucagcc

SEQ ID NO: 3026519 - RNA, 14 nt, Human
acccaccucagccu

SEQ ID NO: 3026520 - RNA, 15 nt, Human
acccaccucagccuc

SEQ ID NO: 3026521 - RNA, 23 nt, Human
acccaagggccuggccugagcug

SEQ ID NO: 3026522 - RNA, 14 nt, Human
accauauuaccaca

SEQ ID NO: 3026523 - RNA, 16 nt, Human
accauauuaccacaga

SEQ ID NO: 3026524 - RNA, 16 nt, Human
accccuccaugugggc

SEQ ID NO: 3026525 - RNA, 19 nt, Human
accccuccaugugggcuag

SEQ ID NO: 3026526 - RNA, 20 nt, Human
accccucaacaccucugcac

SEQ ID NO: 3026527 - RNA, 19 nt, Human
accagagcugccaccugcc

SEQ ID NO: 3026528 - RNA, 13 nt, Human
accagcagaaaug

SEQ ID NO: 3026529 - RNA, 17 nt, Human
accagccaguaaauggg

SEQ ID NO: 3026530 - RNA, 15 nt, Human
acauuuauucugcuc

SEQ ID NO: 3026531 - RNA, 14 nt, Human
acauuuauucugcu

SEQ ID NO: 3026532 - RNA, 16 nt, Human
acaugugcacaugcac

SEQ ID NO: 3026533 - RNA, 18 nt, Human
acaugugcacaugcacgu

SEQ ID NO: 3026534 - RNA, 19 nt, Human
acaugaucuucuuuauaau

SEQ ID NO: 3026535 - RNA, 18 nt, Human
acaucagcacgauuucug

SEQ ID NO: 3026536 - RNA, 15 nt, Human
acaucagcacgauuu

SEQ ID NO: 3026537 - RNA, 17 nt, Human
acaucagcacgauuucu

SEQ ID NO: 3026538 - RNA, 23 nt, Human
acauaaugcgugcauaccacuuu

SEQ ID NO: 3026539 - RNA, 22 nt, Human
acauaaugcgugcauaccacuu

SEQ ID NO: 3026540 - RNA, 21 nt, Human
acauaaugcgugcauaccacu

SEQ ID NO: 3026541 - RNA, 19 nt, Human
acaggguuuugccauguug

SEQ ID NO: 3026542 - RNA, 19 nt, Human
acaggcaaugcuggcuguu

SEQ ID NO: 3026543 - RNA, 23 nt, Human
acaggcaaugcuggcuguuggcu

SEQ ID NO: 3026544 - RNA, 20 nt, Human
acacagcucuguccugggag

SEQ ID NO: 3026545 - RNA, 14 nt, Human
acacagcucugucc

SEQ ID NO: 3026546 - RNA, 19 nt, Human
acacagaggcugccucucc

SEQ ID NO: 3026547 - RNA, 21 nt, Human
acacauuuuauuuuauuaugc

SEQ ID NO: 3026548 - RNA, 22 nt, Human
acacauuuuauuuuauuaugca

SEQ ID NO: 3026549 - RNA, 11 nt, Human
acacagcucuu

SEQ ID NO: 3026550 - RNA, 13 nt, Human
acacagcucuucu

SEQ ID NO: 3026551 - RNA, 20 nt, Human
acacauuuuuuaaaugcacc

SEQ ID NO: 3026552 - RNA, 22 nt, Human
acacauuuuuuaaaugcaccug

SEQ ID NO: 3026553 - RNA, 12 nt, Human
acacauuuuucu

SEQ ID NO: 3026554 - RNA, 19 nt, Human
acacauuuuuuaaaugcac

SEQ ID NO: 3026555 - RNA, 15 nt, Human
acacgcgugcacaca

SEQ ID NO: 3026556 - RNA, 17 nt, Human
acacgcgugcacacacc

SEQ ID NO: 3026557 - RNA, 20 nt, Human
acaaggcaaggcugucaauu

SEQ ID NO: 3026558 - RNA, 17 nt, Human
acaaggauugcuacugu

SEQ ID NO: 3026559 - RNA, 14 nt, Human
acaaggcaaggcug

SEQ ID NO: 3026560 - RNA, 12 nt, Human
acaaggcaaggc

SEQ ID NO: 3026561 - RNA, 22 nt, Human
acaaaauguaggguuauaauaa

SEQ ID NO: 3026562 - RNA, 18 nt, Human
acagccacggccaggcca

SEQ ID NO: 3026563 - RNA, 15 nt, Human
acagccacggccagg

SEQ ID NO: 3026564 - RNA, 16 nt, Human
acagccacggccaggc

SEQ ID NO: 3026565 - RNA, 17 nt, Human
acagccacggccaggcc

SEQ ID NO: 3026566 - RNA, 16 nt, Human
acagcucuucuccagg

SEQ ID NO: 3026567 - RNA, 17 nt, Human
acagcucuucuccaggc

SEQ ID NO: 3026568 - RNA, 15 nt, Human
acaggaucagucuga

SEQ ID NO: 3026569 - RNA, 14 nt, Human
acaggauuauugga

SEQ ID NO: 3026570 - RNA, 18 nt, Human
acaggcaaugcuggcugu

SEQ ID NO: 3026571 - RNA, 12 nt, Human
acaggcaagcac

SEQ ID NO: 3026572 - RNA, 14 nt, Human
acacugcauguuug

SEQ ID NO: 3026573 - RNA, 15 nt, Human
acacugcauguuugu

SEQ ID NO: 3026574 - RNA, 19 nt, Human
acagaggcagccccauucu

SEQ ID NO: 3026575 - RNA, 23 nt, Human
acagaggccaugggccuccugug

SEQ ID NO: 3026576 - RNA, 13 nt, Human
acagacacaggcc

SEQ ID NO: 3026577 - RNA, 14 nt, Human
acagacacaggccc

SEQ ID NO: 3026578 - RNA, 14 nt, Human
acagaggcagcccc

SEQ ID NO: 3026579 - RNA, 15 nt, Human
acagaggcagcccca

SEQ ID NO: 3026580 - RNA, 15 nt, Human
acacuguacugcaau

SEQ ID NO: 3026581 - RNA, 11 nt, Human
acagacacagg

SEQ ID NO: 3026582 - RNA, 23 nt, Human
acagagucucacuguugcccagg

SEQ ID NO: 3026583 - RNA, 15 nt, Human
acagagugagacucu

SEQ ID NO: 3026584 - RNA, 19 nt, Human
acagagugagacucugucu

SEQ ID NO: 3026585 - RNA, 16 nt, Human
acuuuauuucucucau

SEQ ID NO: 3026586 - RNA, 17 nt, Human
acuuuguucuggcucuu

SEQ ID NO: 3026587 - RNA, 16 nt, Human
acuuuguucuggcucu

SEQ ID NO: 3026588 - RNA, 13 nt, Human
acuuuuaagacuu

SEQ ID NO: 3026589 - RNA, 12 nt, Human
acuuuuaagacu

SEQ ID NO: 3026590 - RNA, 19 nt, Human
acuuuguucuggcucuucc

SEQ ID NO: 3026591 - RNA, 13 nt, Human
acuuuuauaaacu

SEQ ID NO: 3026592 - RNA, 20 nt, Human
acuuuucauaaccuagccuu

SEQ ID NO: 3026593 - RNA, 16 nt, Human
acuuuucuuucagcca

SEQ ID NO: 3026594 - RNA, 14 nt, Human
acuuuucuuugugg

SEQ ID NO: 3026595 - RNA, 19 nt, Human
agaaaauaguggugugauu

SEQ ID NO: 3026596 - RNA, 15 nt, Human
agaaaauaccaagga

SEQ ID NO: 3026597 - RNA, 22 nt, Human
agaaaguacuucuccacccugc

SEQ ID NO: 3026598 - RNA, 23 nt, Human
agaaaguacuucuccacccugcu

SEQ ID NO: 3026599 - RNA, 16 nt, Human
acuucacgcccuuggc

SEQ ID NO: 3026600 - RNA, 23 nt, Human
acuucacauauugauuuccguua

SEQ ID NO: 3026601 - RNA, 16 nt, Human
acuugguuuuuaaaaa

SEQ ID NO: 3026602 - RNA, 15 nt, Human
acuugggccacugug

SEQ ID NO: 3026603 - RNA, 14 nt, Human
acuugggccacugu

SEQ ID NO: 3026604 - RNA, 22 nt, Human
acugugcugagucugaaggcug

SEQ ID NO: 3026605 - RNA, 20 nt, Human
acugugcugagucugaaggc

SEQ ID NO: 3026606 - RNA, 14 nt, Human
acugguuuuaaaua

SEQ ID NO: 3026607 - RNA, 17 nt, Human
acugguuuguucccugu

SEQ ID NO: 3026608 - RNA, 18 nt, Human
acugguuccauggccucu

SEQ ID NO: 3026609 - RNA, 16 nt, Human
acugugaagagaacca

SEQ ID NO: 3026610 - RNA, 16 nt, Human
acuggaagcacagcuu

SEQ ID NO: 3026611 - RNA, 19 nt, Human
acuggaagcacagcuucau

SEQ ID NO: 3026612 - RNA, 17 nt, Human
acuggaagcacagcuuc

SEQ ID NO: 3026613 - RNA, 15 nt, Human
acuggagaaaaugga

SEQ ID NO: 3026614 - RNA, 22 nt, Human
acuauuuuuguuuuuauuaaaa

SEQ ID NO: 3026615 - RNA, 21 nt, Human
acuauuuuuguuuuuauuaaa

SEQ ID NO: 3026616 - RNA, 19 nt, Human
acucaguccauagcagaga

SEQ ID NO: 3026617 - RNA, 18 nt, Human
acuauucugagaugacua

SEQ ID NO: 3026618 - RNA, 19 nt, Human
acuauucugagaugacuau

SEQ ID NO: 3026619 - RNA, 20 nt, Human
acuauuuuuguuuuuauuaa

SEQ ID NO: 3026620 - RNA, 13 nt, Human
acucaaaagcugg

SEQ ID NO: 3026621 - RNA, 19 nt, Human
acucugucgcccagucugg

SEQ ID NO: 3026622 - RNA, 21 nt, Human
acucuaucaaguauuauaccu

SEQ ID NO: 3026623 - RNA, 23 nt, Human
acucuaucaaguauuauaccuuu

SEQ ID NO: 3026624 - RNA, 17 nt, Human
acucuagggaaaaacca

SEQ ID NO: 3026625 - RNA, 15 nt, Human
acucuagggaaaaac

SEQ ID NO: 3026626 - RNA, 11 nt, Human
acgugaguccu

SEQ ID NO: 3026627 - RNA, 13 nt, Human
acgucugacaggc

SEQ ID NO: 3026628 - RNA, 14 nt, Human
acgucugacaggca

SEQ ID NO: 3026629 - RNA, 11 nt, Human
acgcugugcug

SEQ ID NO: 3026630 - RNA, 14 nt, Human
acgcugugcugccc

SEQ ID NO: 3026631 - RNA, 12 nt, Human
acgcugugcugc

SEQ ID NO: 3026632 - RNA, 18 nt, Human
accuuggcugcagggagu

SEQ ID NO: 3026633 - RNA, 17 nt, Human
accuuggcugcagggag

SEQ ID NO: 3026634 - RNA, 13 nt, Human
accuuucccaucu

SEQ ID NO: 3026635 - RNA, 18 nt, Human
accuuucccaucuuccaa

SEQ ID NO: 3026636 - RNA, 15 nt, Human
accuuuaagagaaau

SEQ ID NO: 3026637 - RNA, 16 nt, Human
accugucccccugaca

SEQ ID NO: 3026638 - RNA, 15 nt, Human
accugucccccugac

SEQ ID NO: 3026639 - RNA, 12 nt, Human
accugucccccu

SEQ ID NO: 3026640 - RNA, 21 nt, Human
accucugcagcaauaaagcag

SEQ ID NO: 3026641 - RNA, 23 nt, Human
accucugccugaagucacacagu

SEQ ID NO: 3026642 - RNA, 18 nt, Human
accucugcagcaauaaag

SEQ ID NO: 3026643 - RNA, 20 nt, Human
accucugcagcaauaaagca

SEQ ID NO: 3026644 - RNA, 15 nt, Human
accucugcagcaaua

SEQ ID NO: 3026645 - RNA, 15 nt, Human
aaaaaauauuuuccu

SEQ ID NO: 3026646 - RNA, 15 nt, Human
cacaaagcagauccu

SEQ ID NO: 3026647 - RNA, 23 nt, Human
cacaaagaaccaccaggaaagca

SEQ ID NO: 3026648 - RNA, 16 nt, Human
cacaaaaguuucucuu

SEQ ID NO: 3026649 - RNA, 18 nt, Human
cacaaaaguuucucuuuu

SEQ ID NO: 3026650 - RNA, 18 nt, Human
caauaggaaaaacugauu

SEQ ID NO: 3026651 - RNA, 20 nt, Human
caauaggaaaaacugauuuu

SEQ ID NO: 3026652 - RNA, 21 nt, Human
caauaggaaaaacugauuuuu

SEQ ID NO: 3026653 - RNA, 18 nt, Human
caaugcaaaccaucauug

SEQ ID NO: 3026654 - RNA, 17 nt, Human
caaugcaaaccaucauu

SEQ ID NO: 3026655 - RNA, 14 nt, Human
caaugcaaaccauc

SEQ ID NO: 3026656 - RNA, 23 nt, Human
caaugcacuuuguucuggcucuu

SEQ ID NO: 3026657 - RNA, 22 nt, Human
caaugcacuuuguucuggcucu

SEQ ID NO: 3026658 - RNA, 19 nt, Human
caaugcaaaccaucauuga

SEQ ID NO: 3026659 - RNA, 15 nt, Human
cacaccagagcccac

SEQ ID NO: 3026660 - RNA, 12 nt, Human
cacaccagagcc

SEQ ID NO: 3026661 - RNA, 13 nt, Human
cacaccagagccc

SEQ ID NO: 3026662 - RNA, 12 nt, Human
cacacagcucug

SEQ ID NO: 3026663 - RNA, 19 nt, Human
cacacagaggcugccucuc

SEQ ID NO: 3026664 - RNA, 14 nt, Human
cacacaccagagcc

SEQ ID NO: 3026665 - RNA, 21 nt, Human
cacacuugacaucaacugcau

SEQ ID NO: 3026666 - RNA, 22 nt, Human
cacagacccugcccugugggcc

SEQ ID NO: 3026667 - RNA, 21 nt, Human
cacagagaaaguacuucucca

SEQ ID NO: 3026668 - RNA, 16 nt, Human
cacagaguuguuacau

SEQ ID NO: 3026669 - RNA, 17 nt, Human
cacagaguuguuacauu

SEQ ID NO: 3026670 - RNA, 15 nt, Human
cacauuaaaugacuc

SEQ ID NO: 3026671 - RNA, 13 nt, Human
cacauuaaaugac

SEQ ID NO: 3026672 - RNA, 17 nt, Human
cacauuaaagguacuuu

SEQ ID NO: 3026673 - RNA, 16 nt, Human
cacauuccugaugcuu

SEQ ID NO: 3026674 - RNA, 17 nt, Human
cacaugugcacaugcac

SEQ ID NO: 3026675 - RNA, 14 nt, Human
cacaugugcacaug

SEQ ID NO: 3026676 - RNA, 15 nt, Human
cacaugugcacaugc

SEQ ID NO: 3026677 - RNA, 20 nt, Human
cacauauugauuuccguuaa

SEQ ID NO: 3026678 - RNA, 12 nt, Human
cacauaucuguc

SEQ ID NO: 3026679 - RNA, 18 nt, Human
cacaucagcacgauuucu

SEQ ID NO: 3026680 - RNA, 18 nt, Human
cacaugccucucucaggc

SEQ ID NO: 3026681 - RNA, 17 nt, Human
cacaugccucucucagg

SEQ ID NO: 3026682 - RNA, 13 nt, Human
cacaugccucucu

SEQ ID NO: 3026683 - RNA, 19 nt, Human
cacaucagcacgauuucug

SEQ ID NO: 3026684 - RNA, 23 nt, Human
cacauguccaagaagcccaggaa

SEQ ID NO: 3026685 - RNA, 19 nt, Human
cacaugccucucucaggcc

SEQ ID NO: 3026686 - RNA, 19 nt, Human
caccacaugugcacaugca

SEQ ID NO: 3026687 - RNA, 15 nt, Human
caccacaugugcaca

SEQ ID NO: 3026688 - RNA, 18 nt, Human
caccacaugugcacaugc

SEQ ID NO: 3026689 - RNA, 19 nt, Human
caccacuacauucuguuaa

SEQ ID NO: 3026690 - RNA, 20 nt, Human
caccacuacauucuguuaau

SEQ ID NO: 3026691 - RNA, 14 nt, Human
caccaccucuuugg

SEQ ID NO: 3026692 - RNA, 16 nt, Human
caccacuacauucugu

SEQ ID NO: 3026693 - RNA, 17 nt, Human
caccacuacauucuguu

SEQ ID NO: 3026694 - RNA, 18 nt, Human
caccacuacauucuguua

SEQ ID NO: 3026695 - RNA, 17 nt, Human
caccacacccagcccac

SEQ ID NO: 3026696 - RNA, 13 nt, Human
caccacacccagc

SEQ ID NO: 3026697 - RNA, 15 nt, Human
caccacacccagccc

SEQ ID NO: 3026698 - RNA, 15 nt, Human
caccaagcccaguua

SEQ ID NO: 3026699 - RNA, 19 nt, Human
cacagugagucgaggacag

SEQ ID NO: 3026700 - RNA, 20 nt, Human
cacagugagucgaggacagg

SEQ ID NO: 3026701 - RNA, 18 nt, Human
cacagugagucgaggaca

SEQ ID NO: 3026702 - RNA, 20 nt, Human
cacaggcccggcuccaggcu

SEQ ID NO: 3026703 - RNA, 23 nt, Human
cacaggcccggcuccaggcuccu

SEQ ID NO: 3026704 - RNA, 17 nt, Human
cacauacacacacacgc

SEQ ID NO: 3026705 - RNA, 16 nt, Human
cacaggcccggcucca

SEQ ID NO: 3026706 - RNA, 17 nt, Human
cacaggcccggcuccag

SEQ ID NO: 3026707 - RNA, 18 nt, Human
cacaggcccggcuccagg

SEQ ID NO: 3026708 - RNA, 19 nt, Human
cacaggcccggcuccaggc

SEQ ID NO: 3026709 - RNA, 10 nt, Human
cacaggcagg

SEQ ID NO: 3026710 - RNA, 12 nt, Human
cacaggaucagu

SEQ ID NO: 3026711 - RNA, 15 nt, Human
cacaggaucagucug

SEQ ID NO: 3026712 - RNA, 16 nt, Human
cacaggaucagucuga

SEQ ID NO: 3026713 - RNA, 20 nt, Human
cacagaguuguuacauuuuu

SEQ ID NO: 3026714 - RNA, 18 nt, Human
cacagaugggugcuugga

SEQ ID NO: 3026715 - RNA, 14 nt, Human
cacagaugggugcu

SEQ ID NO: 3026716 - RNA, 20 nt, Human
cacagaugggugcuuggagg

SEQ ID NO: 3026717 - RNA, 22 nt, Human
caacauuucucauguugaaacu

SEQ ID NO: 3026718 - RNA, 21 nt, Human
caaccccuucgcuccuguguc

SEQ ID NO: 3026719 - RNA, 18 nt, Human
caaccccuucgcuccugu

SEQ ID NO: 3026720 - RNA, 19 nt, Human
caaccccuucgcuccugug

SEQ ID NO: 3026721 - RNA, 23 nt, Human
caacaugccagccacugugauag

SEQ ID NO: 3026722 - RNA, 22 nt, Human
caacaucuuggucagauuugaa

SEQ ID NO: 3026723 - RNA, 15 nt, Human
caacagguuuuccug

SEQ ID NO: 3026724 - RNA, 18 nt, Human
caacaggguuuuuuucca

SEQ ID NO: 3026725 - RNA, 19 nt, Human
caacagguuuuccugaaga

SEQ ID NO: 3026726 - RNA, 24 nt, Human
caacaggcugggcuucaguggcag

SEQ ID NO: 3026727 - RNA, 23 nt, Human
caacaggcugggcuucaguggca

SEQ ID NO: 3026728 - RNA, 19 nt, Human
caacucuccuccagaguca

SEQ ID NO: 3026729 - RNA, 16 nt, Human
caaccugauugugucu

SEQ ID NO: 3026730 - RNA, 15 nt, Human
caacccucaucacca

SEQ ID NO: 3026731 - RNA, 12 nt, Human
caacccucauca

SEQ ID NO: 3026732 - RNA, 16 nt, Human
caacugcauuggcuuu

SEQ ID NO: 3026733 - RNA, 20 nt, Human
caacucuccuccagagucag

SEQ ID NO: 3026734 - RNA, 15 nt, Human
caaggauugcuacug

SEQ ID NO: 3026735 - RNA, 16 nt, Human
caagggccuggccuga

SEQ ID NO: 3026736 - RNA, 19 nt, Human
caagggccuggccugagcu

SEQ ID NO: 3026737 - RNA, 12 nt, Human
caaggugggagg

SEQ ID NO: 3026738 - RNA, 23 nt, Human
caaggugggaggauugcuugagc

SEQ ID NO: 3026739 - RNA, 22 nt, Human
caagugugguagagugugccug

SEQ ID NO: 3026740 - RNA, 22 nt, Human
caagugauucuccugccucagc

SEQ ID NO: 3026741 - RNA, 21 nt, Human
caagugauucuccugccucag

SEQ ID NO: 3026742 - RNA, 19 nt, Human
caagugaaaaaggaggaag

SEQ ID NO: 3026743 - RNA, 16 nt, Human
caagugauucuccugc

SEQ ID NO: 3026744 - RNA, 17 nt, Human
caagugauucuccugcc

SEQ ID NO: 3026745 - RNA, 17 nt, Human
caagcgugagccacugc

SEQ ID NO: 3026746 - RNA, 22 nt, Human
caaggauccugagccagauuuc

SEQ ID NO: 3026747 - RNA, 21 nt, Human
caaggaugaucuaggaagacu

SEQ ID NO: 3026748 - RNA, 13 nt, Human
caaggauccugag

SEQ ID NO: 3026749 - RNA, 16 nt, Human
caagcgugagccacug

SEQ ID NO: 3026750 - RNA, 21 nt, Human
caagccaccaacauacuccca

SEQ ID NO: 3026751 - RNA, 18 nt, Human
caagcaccuccugccucg

SEQ ID NO: 3026752 - RNA, 17 nt, Human
caaagcuuuugcauauu

SEQ ID NO: 3026753 - RNA, 16 nt, Human
caaagcuuguuaagau

SEQ ID NO: 3026754 - RNA, 18 nt, Human
caaagcuaggccuggcca

SEQ ID NO: 3026755 - RNA, 16 nt, Human
caaagcuaggccuggc

SEQ ID NO: 3026756 - RNA, 17 nt, Human
caaagcuaggccuggcc

SEQ ID NO: 3026757 - RNA, 20 nt, Human
caaagccaaagcuaggccug

SEQ ID NO: 3026758 - RNA, 21 nt, Human
caaagccaaagcuaggccugg

SEQ ID NO: 3026759 - RNA, 15 nt, Human
caaagcuaggccugg

SEQ ID NO: 3026760 - RNA, 18 nt, Human
auuuuuuuacuaauagac

SEQ ID NO: 3026761 - RNA, 16 nt, Human
caaaggauacuuauuu

SEQ ID NO: 3026762 - RNA, 21 nt, Human
caaaggauacuuauuuaaaua

SEQ ID NO: 3026763 - RNA, 21 nt, Human
caaaggaugcccaaagaugca

SEQ ID NO: 3026764 - RNA, 22 nt, Human
caaauucugcuugcuugcuuuu

SEQ ID NO: 3026765 - RNA, 16 nt, Human
caaaucagcugcuacu

SEQ ID NO: 3026766 - RNA, 13 nt, Human
caaaucagcugcu

SEQ ID NO: 3026767 - RNA, 13 nt, Human
caccccagcccca

SEQ ID NO: 3026768 - RNA, 12 nt, Human
caccccagcccc

SEQ ID NO: 3026769 - RNA, 12 nt, Human
cacccaccucag

SEQ ID NO: 3026770 - RNA, 13 nt, Human
cacccaccucagc

SEQ ID NO: 3026771 - RNA, 14 nt, Human
cacccaccucagcc

SEQ ID NO: 3026772 - RNA, 16 nt, Human
cacccaccucagccuc

SEQ ID NO: 3026773 - RNA, 20 nt, Human
cacccaccaucaugucuggc

SEQ ID NO: 3026774 - RNA, 22 nt, Human
cacccaccaucaugucuggcua

SEQ ID NO: 3026775 - RNA, 23 nt, Human
cacccaagggccuggccugagcu

SEQ ID NO: 3026776 - RNA, 21 nt, Human
cacccaagggccuggccugag

SEQ ID NO: 3026777 - RNA, 20 nt, Human
cacccaagggccuggccuga

SEQ ID NO: 3026778 - RNA, 19 nt, Human
cacccaagggccuggccug

SEQ ID NO: 3026779 - RNA, 18 nt, Human
cacccaagggccuggccu

SEQ ID NO: 3026780 - RNA, 17 nt, Human
cacccaagggccuggcc

SEQ ID NO: 3026781 - RNA, 16 nt, Human
cacccaagggccuggc

SEQ ID NO: 3026782 - RNA, 17 nt, Human
caccccggccaccugcg

SEQ ID NO: 3026783 - RNA, 16 nt, Human
caccccggccaccugc

SEQ ID NO: 3026784 - RNA, 15 nt, Human
caccccggccaccug

SEQ ID NO: 3026785 - RNA, 14 nt, Human
caccccggccaccu

SEQ ID NO: 3026786 - RNA, 22 nt, Human
cacccccacccaagggccuggc

SEQ ID NO: 3026787 - RNA, 14 nt, Human
uuuguguacuuuua

SEQ ID NO: 3026788 - RNA, 13 nt, Human
uuuguguacuuuu

SEQ ID NO: 3026789 - RNA, 17 nt, Human
uuuguguacuuuuaaga

SEQ ID NO: 3026790 - RNA, 23 nt, Human
uugcuaacagcaacacaaagcuu

SEQ ID NO: 3026791 - RNA, 20 nt, Human
uugcuaacagcaacacaaag

SEQ ID NO: 3026792 - RNA, 19 nt, Human
uugcugcugauuuaaacac

SEQ ID NO: 3026793 - RNA, 17 nt, Human
uugcugcugauuuaaac

SEQ ID NO: 3026794 - RNA, 21 nt, Human
uugcugcugauuuaaacacau

SEQ ID NO: 3026795 - RNA, 16 nt, Human
uugcugcuugaggcaa

SEQ ID NO: 3026796 - RNA, 14 nt, Human
uugcugcuugaggc

SEQ ID NO: 3026797 - RNA, 16 nt, Human
uugcugcuuguacacu

SEQ ID NO: 3026798 - RNA, 16 nt, Human
uugcugucccuuuucc

SEQ ID NO: 3026799 - RNA, 18 nt, Human
uugcugucccuuuuccuu

SEQ ID NO: 3026800 - RNA, 18 nt, Human
uugccuuggcugcaguuu

SEQ ID NO: 3026801 - RNA, 20 nt, Human
uugccauguuggccaggcug

SEQ ID NO: 3026802 - RNA, 21 nt, Human
uugccauguuggccaggcugg

SEQ ID NO: 3026803 - RNA, 17 nt, Human
uugccuuuuuauaacuu

SEQ ID NO: 3026804 - RNA, 19 nt, Human
uuggaagcuccgcuuucua

SEQ ID NO: 3026805 - RNA, 21 nt, Human
uuggacccugaggcccagagg

SEQ ID NO: 3026806 - RNA, 19 nt, Human
uuggacccugaggcccaga

SEQ ID NO: 3026807 - RNA, 18 nt, Human
uuggacccugaggcccag

SEQ ID NO: 3026808 - RNA, 15 nt, Human
uuggacccugaggcc

SEQ ID NO: 3026809 - RNA, 15 nt, Human
uuggauuguccccga

SEQ ID NO: 3026810 - RNA, 20 nt, Human
uugggcacaucauuucaaga

SEQ ID NO: 3026811 - RNA, 18 nt, Human
uugguaacucuguaauuc

SEQ ID NO: 3026812 - RNA, 13 nt, Human
uugguccugcugc

SEQ ID NO: 3026813 - RNA, 20 nt, Human
uuggucugacccacugcuuu

SEQ ID NO: 3026814 - RNA, 23 nt, Human
uuggcuucacggaagagccuugc

SEQ ID NO: 3026815 - RNA, 20 nt, Human
uuguauuuuacuaauaaaau

SEQ ID NO: 3026816 - RNA, 14 nt, Human
uugucuaugggacu

SEQ ID NO: 3026817 - RNA, 22 nt, Human
uugucaaaguggugagaggcau

SEQ ID NO: 3026818 - RNA, 22 nt, Human
uugucuuaaaaaguggaaaaau

SEQ ID NO: 3026819 - RNA, 20 nt, Human
uugucuaugggacucaaugc

SEQ ID NO: 3026820 - RNA, 23 nt, Human
uugcagcucuccccuucucugua

SEQ ID NO: 3026821 - RNA, 23 nt, Human
uugcagacaggcaagcaccuccu

SEQ ID NO: 3026822 - RNA, 22 nt, Human
uugcagacaggcaagcaccucc

SEQ ID NO: 3026823 - RNA, 17 nt, Human
uugauucauaaugacuu

SEQ ID NO: 3026824 - RNA, 13 nt, Human
uugauucauaaug

SEQ ID NO: 3026825 - RNA, 16 nt, Human
uugccauguuggccag

SEQ ID NO: 3026826 - RNA, 17 nt, Human
uugccauguuggccagg

SEQ ID NO: 3026827 - RNA, 18 nt, Human
uugccauguuggccaggc

SEQ ID NO: 3026828 - RNA, 19 nt, Human
uugccauguuggccaggcu

SEQ ID NO: 3026829 - RNA, 19 nt, Human
uugagccuugaacuuugac

SEQ ID NO: 3026830 - RNA, 15 nt, Human
uugagccuugaacuu

SEQ ID NO: 3026831 - RNA, 16 nt, Human
uugagccuugaacuuu

SEQ ID NO: 3026832 - RNA, 14 nt, Human
uugagccuugaacu

SEQ ID NO: 3026833 - RNA, 14 nt, Human
uugagccugggagg

SEQ ID NO: 3026834 - RNA, 21 nt, Human
uugauucagacagcugccugg

SEQ ID NO: 3026835 - RNA, 17 nt, Human
uugauucagacagcugc

SEQ ID NO: 3026836 - RNA, 23 nt, Human
uugauucagacagcugccuggga

SEQ ID NO: 3026837 - RNA, 16 nt, Human
uugauucagcucugca

SEQ ID NO: 3026838 - RNA, 16 nt, Human
uugauaugcuuauaca

SEQ ID NO: 3026839 - RNA, 15 nt, Human
uugaaacacugguuu

SEQ ID NO: 3026840 - RNA, 15 nt, Human
uugaacuuugaccuc

SEQ ID NO: 3026841 - RNA, 21 nt, Human
uucuuuccugaggcugggcuc

SEQ ID NO: 3026842 - RNA, 22 nt, Human
uugaagauucuauguuaauauu

SEQ ID NO: 3026843 - RNA, 23 nt, Human
uugaagauucuauguuaauauuu

SEQ ID NO: 3026844 - RNA, 13 nt, Human
uugaagauucuau

SEQ ID NO: 3026845 - RNA, 12 nt, Human
uugaagcagagu

SEQ ID NO: 3026846 - RNA, 14 nt, Human
uugaagcagagugg

SEQ ID NO: 3026847 - RNA, 17 nt, Human
uugaacuuugaccucug

SEQ ID NO: 3026848 - RNA, 18 nt, Human
uugaacuuugaccucugc

SEQ ID NO: 3026849 - RNA, 16 nt, Human
uugaaugaugccauga

SEQ ID NO: 3026850 - RNA, 12 nt, Human
uugaaugaugcc

SEQ ID NO: 3026851 - RNA, 13 nt, Human
uucuuguauuuau

SEQ ID NO: 3026852 - RNA, 13 nt, Human
uucuucagagacu

SEQ ID NO: 3026853 - RNA, 17 nt, Human
uucuuagggaaggauac

SEQ ID NO: 3026854 - RNA, 20 nt, Human
uucuggcagaguugaagaca

SEQ ID NO: 3026855 - RNA, 22 nt, Human
uuucacaguguguggucaacau

SEQ ID NO: 3026856 - RNA, 17 nt, Human
uuucagccaagaauucu

SEQ ID NO: 3026857 - RNA, 16 nt, Human
uuucagccaagaauuc

SEQ ID NO: 3026858 - RNA, 19 nt, Human
uuucuaaaucuccaaaaua

SEQ ID NO: 3026859 - RNA, 23 nt, Human
uuuccuggcacugcuuccaguga

SEQ ID NO: 3026860 - RNA, 19 nt, Human
uuuccuggcacugcuucca

SEQ ID NO: 3026861 - RNA, 14 nt, Human
uuucugaaauaaca

SEQ ID NO: 3026862 - RNA, 22 nt, Human
uuucuacccagcgagcccuggu

SEQ ID NO: 3026863 - RNA, 15 nt, Human
uuucuacccagcgag

SEQ ID NO: 3026864 - RNA, 18 nt, Human
uuucuacccagcgagccc

SEQ ID NO: 3026865 - RNA, 17 nt, Human
uuuggguuuauuuggaa

SEQ ID NO: 3026866 - RNA, 14 nt, Human
uuugguuauuuuac

SEQ ID NO: 3026867 - RNA, 13 nt, Human
uuugguuauuuua

SEQ ID NO: 3026868 - RNA, 22 nt, Human
uuugguugguaacucuguaauu

SEQ ID NO: 3026869 - RNA, 15 nt, Human
uuugccaauuugcac

SEQ ID NO: 3026870 - RNA, 20 nt, Human
uuugccaauuugcacauuaa

SEQ ID NO: 3026871 - RNA, 16 nt, Human
uuugcuugaaagaaaa

SEQ ID NO: 3026872 - RNA, 14 nt, Human
uuugcuugaaagaa

SEQ ID NO: 3026873 - RNA, 19 nt, Human
uuuggacccugaggcccag

SEQ ID NO: 3026874 - RNA, 15 nt, Human
uuuggacccugaggc

SEQ ID NO: 3026875 - RNA, 21 nt, Human
uuugaagguagaauguuuuca

SEQ ID NO: 3026876 - RNA, 17 nt, Human
uuugagaucagccuggg

SEQ ID NO: 3026877 - RNA, 16 nt, Human
uuugagaucagccugg

SEQ ID NO: 3026878 - RNA, 19 nt, Human
uuucuuguguguuuauugu

SEQ ID NO: 3026879 - RNA, 15 nt, Human
uuuaaacuacauuag

SEQ ID NO: 3026880 - RNA, 13 nt, Human
uuuaacagaaaug

SEQ ID NO: 3026881 - RNA, 15 nt, Human
uuuaaacacauuaaa

SEQ ID NO: 3026882 - RNA, 14 nt, Human
uuuaaacacauuaa

SEQ ID NO: 3026883 - RNA, 13 nt, Human
uuuaaaagauaca

SEQ ID NO: 3026884 - RNA, 20 nt, Human
uuguuauuuauugaaaugau

SEQ ID NO: 3026885 - RNA, 15 nt, Human
uuguuauuuauugaa

SEQ ID NO: 3026886 - RNA, 12 nt, Human
uuguuuaauggu

SEQ ID NO: 3026887 - RNA, 23 nt, Human
uuguuuaaugguaguuuuacagu

SEQ ID NO: 3026888 - RNA, 24 nt, Human
uugucuuuggacccugaggcccag

SEQ ID NO: 3026889 - RNA, 20 nt, Human
uugucuuuggacccugaggc

SEQ ID NO: 3026890 - RNA, 15 nt, Human
uugucuuuggacccu

SEQ ID NO: 3026891 - RNA, 20 nt, Human
uuguuuggggaugagaaagg

SEQ ID NO: 3026892 - RNA, 22 nt, Human
uuuauccuagucauucuucccu

SEQ ID NO: 3026893 - RNA, 12 nt, Human
uuuauacauaaa

SEQ ID NO: 3026894 - RNA, 20 nt, Human
uuuauacauaaacaagacca

SEQ ID NO: 3026895 - RNA, 16 nt, Human
uuuaucuguucauaug

SEQ ID NO: 3026896 - RNA, 15 nt, Human
uuuaucuguucauau

SEQ ID NO: 3026897 - RNA, 23 nt, Human
uuuauccuagucauucuucccua

SEQ ID NO: 3026898 - RNA, 19 nt, Human
uuuagacccuauugcugcu

SEQ ID NO: 3026899 - RNA, 22 nt, Human
uuuagacccuauugcugcuuga

SEQ ID NO: 3026900 - RNA, 18 nt, Human
uuuauaaacuuuaccuuu

SEQ ID NO: 3026901 - RNA, 17 nt, Human
uuuacaguguuucuggc

SEQ ID NO: 3026902 - RNA, 19 nt, Human
uuuacaguguuucuggcuu

SEQ ID NO: 3026903 - RNA, 14 nt, Human
uuuaacagaaaugu

SEQ ID NO: 3026904 - RNA, 15 nt, Human
uuuaacagaaaugua

SEQ ID NO: 3026905 - RNA, 12 nt, Human
uuauugaagcag

SEQ ID NO: 3026906 - RNA, 11 nt, Human
uuauucugcuc

SEQ ID NO: 3026907 - RNA, 17 nt, Human
uuauugaagcagagugg

SEQ ID NO: 3026908 - RNA, 16 nt, Human
uuauugaagcagagug

SEQ ID NO: 3026909 - RNA, 15 nt, Human
uuauugaagcagagu

SEQ ID NO: 3026910 - RNA, 13 nt, Human
uuauugaagcaga

SEQ ID NO: 3026911 - RNA, 15 nt, Human
uuauugauguuuuca

SEQ ID NO: 3026912 - RNA, 15 nt, Human
uuauugcccacgcug

SEQ ID NO: 3026913 - RNA, 23 nt, Human
uuauuaaaaaucucaaauuucua

SEQ ID NO: 3026914 - RNA, 14 nt, Human
uuaguuccuugagu

SEQ ID NO: 3026915 - RNA, 16 nt, Human
uuaguuccucauuagc

SEQ ID NO: 3026916 - RNA, 14 nt, Human
uuaucuagauacug

SEQ ID NO: 3026917 - RNA, 16 nt, Human
uuaucuagauacugua

SEQ ID NO: 3026918 - RNA, 17 nt, Human
uuaucuagauacuguau

SEQ ID NO: 3026919 - RNA, 16 nt, Human
uuaugcaugaaguaau

SEQ ID NO: 3026920 - RNA, 22 nt, Human
uuaugcaugaaguaauaugcac

SEQ ID NO: 3026921 - RNA, 16 nt, Human
uuauggaacacucuga

SEQ ID NO: 3026922 - RNA, 13 nt, Human
uuauuuuacuuuu

SEQ ID NO: 3026923 - RNA, 15 nt, Human
uuauuuuacuuuuug

SEQ ID NO: 3026924 - RNA, 17 nt, Human
uuauuuuaauucaguug

SEQ ID NO: 3026925 - RNA, 17 nt, Human
uuauugucaaaguggug

SEQ ID NO: 3026926 - RNA, 18 nt, Human
uuauugucaaagugguga

SEQ ID NO: 3026927 - RNA, 20 nt, Human
uucaauaggaaaaacugauu

SEQ ID NO: 3026928 - RNA, 18 nt, Human
uucaauaggaaaaacuga

SEQ ID NO: 3026929 - RNA, 15 nt, Human
uucaauaggaaaaac

SEQ ID NO: 3026930 - RNA, 13 nt, Human
uucaauaggaaaa

SEQ ID NO: 3026931 - RNA, 18 nt, Human
uucacggaagagccuugc

SEQ ID NO: 3026932 - RNA, 15 nt, Human
uucacgugguccuaa

SEQ ID NO: 3026933 - RNA, 13 nt, Human
uucacucuccuug

SEQ ID NO: 3026934 - RNA, 19 nt, Human
uucagagacuccugcaggc

SEQ ID NO: 3026935 - RNA, 21 nt, Human
uucagacagcugccugggauc

SEQ ID NO: 3026936 - RNA, 13 nt, Human
uuccucauuagca

SEQ ID NO: 3026937 - RNA, 22 nt, Human
uucccuuugacgccaucccagc

SEQ ID NO: 3026938 - RNA, 21 nt, Human
uucccuuugacgccaucccag

SEQ ID NO: 3026939 - RNA, 20 nt, Human
uucccuuugacgccauccca

SEQ ID NO: 3026940 - RNA, 14 nt, Human
uuccuggcacugcu

SEQ ID NO: 3026941 - RNA, 17 nt, Human
uuccugccaggcauggu

SEQ ID NO: 3026942 - RNA, 15 nt, Human
uuccugaugcuucuu

SEQ ID NO: 3026943 - RNA, 19 nt, Human
uuccugaugcuucuucaga

SEQ ID NO: 3026944 - RNA, 18 nt, Human
uuccugaugcuucuucag

SEQ ID NO: 3026945 - RNA, 17 nt, Human
uucuaaagcugccagcc

SEQ ID NO: 3026946 - RNA, 13 nt, Human
uucuaaagcugcc

SEQ ID NO: 3026947 - RNA, 20 nt, Human
uucgggaggucgaggcagga

SEQ ID NO: 3026948 - RNA, 15 nt, Human
uuccaaauucugcuu

SEQ ID NO: 3026949 - RNA, 21 nt, Human
uucaucuugaauuguaaggaa

SEQ ID NO: 3026950 - RNA, 17 nt, Human
uucaucuugaauuguaa

SEQ ID NO: 3026951 - RNA, 13 nt, Human
uucaggaagcuca

SEQ ID NO: 3026952 - RNA, 11 nt, Human
uucaggaagcu

SEQ ID NO: 3026953 - RNA, 15 nt, Human
uucauuuccuguguc

SEQ ID NO: 3026954 - RNA, 16 nt, Human
uucauuuccugugucu

SEQ ID NO: 3026955 - RNA, 16 nt, Human
uuccccaggaggccag

SEQ ID NO: 3026956 - RNA, 15 nt, Human
uuccccaggaggcca

SEQ ID NO: 3026957 - RNA, 16 nt, Human
uucccauuugcuccuu

SEQ ID NO: 3026958 - RNA, 11 nt, Human
uucccucccuu

SEQ ID NO: 3026959 - RNA, 17 nt, Human
uucccucccuuccucuu

SEQ ID NO: 3026960 - RNA, 20 nt, Human
uucccucccuuccucuuucc

SEQ ID NO: 3026961 - RNA, 21 nt, Human
uuccccaggaggccagccuug

SEQ ID NO: 3026962 - RNA, 20 nt, Human
uuccccaggaggccagccuu

SEQ ID NO: 3026963 - RNA, 19 nt, Human
uuccccaggaggccagccu

SEQ ID NO: 3026964 - RNA, 18 nt, Human
uuccccaggaggccagcc

SEQ ID NO: 3026965 - RNA, 17 nt, Human
uuccccaggaggccagc

SEQ ID NO: 3026966 - RNA, 13 nt, Human
uuacuuuaaacua

SEQ ID NO: 3026967 - RNA, 17 nt, Human
uuacuuuaaaaggagcc

SEQ ID NO: 3026968 - RNA, 18 nt, Human
uuacuuuaaaaggagcca

SEQ ID NO: 3026969 - RNA, 14 nt, Human
uuacuuuguguuca

SEQ ID NO: 3026970 - RNA, 15 nt, Human
uuagacagucccugc

SEQ ID NO: 3026971 - RNA, 19 nt, Human
uuagacccucaugcugcca

SEQ ID NO: 3026972 - RNA, 20 nt, Human
uuagacccucaugcugccaa

SEQ ID NO: 3026973 - RNA, 14 nt, Human
uuagacagucccug

SEQ ID NO: 3026974 - RNA, 18 nt, Human
uuagacagucccugccaa

SEQ ID NO: 3026975 - RNA, 17 nt, Human
uuagacagucccugcca

SEQ ID NO: 3026976 - RNA, 16 nt, Human
uuagacagucccugcc

SEQ ID NO: 3026977 - RNA, 21 nt, Human
uuacuuaaaccgccaaggcug

SEQ ID NO: 3026978 - RNA, 18 nt, Human
uuacuuagguguggggga

SEQ ID NO: 3026979 - RNA, 11 nt, Human
uuacuucugcu

SEQ ID NO: 3026980 - RNA, 12 nt, Human
uuacuucugcua

SEQ ID NO: 3026981 - RNA, 23 nt, Human
uuacuucuuauacauuugauaaa

SEQ ID NO: 3026982 - RNA, 13 nt, Human
uuacuaaguuuuu

SEQ ID NO: 3026983 - RNA, 14 nt, Human
uuacuaaguuuuua

SEQ ID NO: 3026984 - RNA, 16 nt, Human
uuacuaauagacaauu

SEQ ID NO: 3026985 - RNA, 20 nt, Human
uuaggagaagucuucuauuu

SEQ ID NO: 3026986 - RNA, 23 nt, Human
uuaguagagguacacuugugaau

SEQ ID NO: 3026987 - RNA, 22 nt, Human
uuaguagagguacacuugugaa

SEQ ID NO: 3026988 - RNA, 17 nt, Human
uuaguagagacaggguu

SEQ ID NO: 3026989 - RNA, 18 nt, Human
uuaguaugaggcauuugu

SEQ ID NO: 3026990 - RNA, 16 nt, Human
uuaguaugaggcauuu

SEQ ID NO: 3026991 - RNA, 14 nt, Human
uuagaguugauacu

SEQ ID NO: 3026992 - RNA, 22 nt, Human
uuagauaauacaccacuacauu

SEQ ID NO: 3026993 - RNA, 14 nt, Human
uuagcggagacgga

SEQ ID NO: 3026994 - RNA, 19 nt, Human
uuaaugguaguuuuacagu

SEQ ID NO: 3026995 - RNA, 21 nt, Human
uuacaagcgugagccacugca

SEQ ID NO: 3026996 - RNA, 20 nt, Human
uuacaagcgugagccacugc

SEQ ID NO: 3026997 - RNA, 17 nt, Human
uuaagcuguuacugucu

SEQ ID NO: 3026998 - RNA, 18 nt, Human
uuaauauugauaugcuua

SEQ ID NO: 3026999 - RNA, 22 nt, Human
uuaauauugauaugcuuauaca

SEQ ID NO: 3027000 - RNA, 17 nt, Human
uuaaccacuucagcuga

SEQ ID NO: 3027001 - RNA, 16 nt, Human
uuaacuuuuauaaacu

SEQ ID NO: 3027002 - RNA, 17 nt, Human
uuaacuuuuauaaacuu

SEQ ID NO: 3027003 - RNA, 15 nt, Human
uuaacuuuuauaaac

SEQ ID NO: 3027004 - RNA, 16 nt, Human
uuaacuucacauauug

SEQ ID NO: 3027005 - RNA, 21 nt, Human
uuaaacucugagugcaaacuu

SEQ ID NO: 3027006 - RNA, 21 nt, Human
uuaaaauaccagccaguaaau

SEQ ID NO: 3027007 - RNA, 22 nt, Human
uguuuuaagaggcagggucuca

SEQ ID NO: 3027008 - RNA, 18 nt, Human
uguuuuaaggaugcuugu

SEQ ID NO: 3027009 - RNA, 14 nt, Human
uuaaaagauacagu

SEQ ID NO: 3027010 - RNA, 17 nt, Human
uuaaaagauacaguuac

SEQ ID NO: 3027011 - RNA, 19 nt, Human
uguuuggggaugagaaagg

SEQ ID NO: 3027012 - RNA, 23 nt, Human
uguuuccuggcacugcuuccagu

SEQ ID NO: 3027013 - RNA, 13 nt, Human
uguuugugauuga

SEQ ID NO: 3027014 - RNA, 20 nt, Human
uguuuuaagaggcagggucu

SEQ ID NO: 3027015 - RNA, 15 nt, Human
uguuucaaacuuuac

SEQ ID NO: 3027016 - RNA, 16 nt, Human
uguuuagauaauacac

SEQ ID NO: 3027017 - RNA, 15 nt, Human
ugguauuugaaacac

SEQ ID NO: 3027018 - RNA, 18 nt, Human
ugguaugaucacggcuca

SEQ ID NO: 3027019 - RNA, 14 nt, Human
uggucaacauuucu

SEQ ID NO: 3027020 - RNA, 13 nt, Human
uggucccacucag

SEQ ID NO: 3027021 - RNA, 14 nt, Human
uggucccccuucca

SEQ ID NO: 3027022 - RNA, 19 nt, Human
ugguccuaaucuucugaac

SEQ ID NO: 3027023 - RNA, 17 nt, Human
ugguccuaaucuucuga

SEQ ID NO: 3027024 - RNA, 23 nt, Human
ugguccugcugcaguugccaguc

SEQ ID NO: 3027025 - RNA, 15 nt, Human
ugguccugcugcagu

SEQ ID NO: 3027026 - RNA, 13 nt, Human
ugguccugcugca

SEQ ID NO: 3027027 - RNA, 23 nt, Human
uggucccccuuccauggacuuug

SEQ ID NO: 3027028 - RNA, 18 nt, Human
uggucccccuuccaugga

SEQ ID NO: 3027029 - RNA, 16 nt, Human
uggucccccuuccaug

SEQ ID NO: 3027030 - RNA, 15 nt, Human
uggucccccuuccau

SEQ ID NO: 3027031 - RNA, 16 nt, Human
uggugauuuagcagga

SEQ ID NO: 3027032 - RNA, 22 nt, Human
uggugauuuagcaggaagcugu

SEQ ID NO: 3027033 - RNA, 20 nt, Human
uggugcaaugaccuuucaau

SEQ ID NO: 3027034 - RNA, 21 nt, Human
uggugcaaugaccuuucaaua

SEQ ID NO: 3027035 - RNA, 15 nt, Human
uggugaccucugccu

SEQ ID NO: 3027036 - RNA, 16 nt, Human
uggugaccucugccug

SEQ ID NO: 3027037 - RNA, 17 nt, Human
uggugaccucugccuga

SEQ ID NO: 3027038 - RNA, 22 nt, Human
uggugaccucugccugaaguca

SEQ ID NO: 3027039 - RNA, 19 nt, Human
uggugacuuuccucuuugg

SEQ ID NO: 3027040 - RNA, 14 nt, Human
uggucggaaaacau

SEQ ID NO: 3027041 - RNA, 17 nt, Human
uggucggaaaacaugcu

SEQ ID NO: 3027042 - RNA, 13 nt, Human
uggugaccucugc

SEQ ID NO: 3027043 - RNA, 14 nt, Human
uggugaccucugcc

SEQ ID NO: 3027044 - RNA, 19 nt, Human
uggucuacacugugcugag

SEQ ID NO: 3027045 - RNA, 18 nt, Human
uggucuacacugugcuga

SEQ ID NO: 3027046 - RNA, 17 nt, Human
uggucuacacugugcug

SEQ ID NO: 3027047 - RNA, 16 nt, Human
uggucuacacugugcu

SEQ ID NO: 3027048 - RNA, 15 nt, Human
uggucuacacugugc

SEQ ID NO: 3027049 - RNA, 14 nt, Human
uggguauagauguu

SEQ ID NO: 3027050 - RNA, 18 nt, Human
uggguauagauguugcua

SEQ ID NO: 3027051 - RNA, 17 nt, Human
uggguacuuguggacac

SEQ ID NO: 3027052 - RNA, 18 nt, Human
uggguacuuguggacaca

SEQ ID NO: 3027053 - RNA, 16 nt, Human
ugggggaguggccaca

SEQ ID NO: 3027054 - RNA, 22 nt, Human
ugggcuucauccuccucagauc

SEQ ID NO: 3027055 - RNA, 15 nt, Human
uggggaugagaaagg

SEQ ID NO: 3027056 - RNA, 23 nt, Human
uggggaugagaaagguugaagca

SEQ ID NO: 3027057 - RNA, 20 nt, Human
uggggccaguuggucccccu

SEQ ID NO: 3027058 - RNA, 16 nt, Human
ugggagugggcccaau

SEQ ID NO: 3027059 - RNA, 14 nt, Human
ugggagugggccca

SEQ ID NO: 3027060 - RNA, 20 nt, Human
uggcugggggccucagugcc

SEQ ID NO: 3027061 - RNA, 16 nt, Human
uggcugggggccucag

SEQ ID NO: 3027062 - RNA, 17 nt, Human
uggcugggggccucagu

SEQ ID NO: 3027063 - RNA, 13 nt, Human
ugggauccuccag

SEQ ID NO: 3027064 - RNA, 12 nt, Human
ugggauccucca

SEQ ID NO: 3027065 - RNA, 22 nt, Human
ugggauuacaagcgugagccac

SEQ ID NO: 3027066 - RNA, 18 nt, Human
ugggcagagcagagacca

SEQ ID NO: 3027067 - RNA, 22 nt, Human
ugggcagagcagagaccauccc

SEQ ID NO: 3027068 - RNA, 14 nt, Human
ugggccuggcuccc

SEQ ID NO: 3027069 - RNA, 23 nt, Human
ugggcagagcagagaccaucccu

SEQ ID NO: 3027070 - RNA, 19 nt, Human
uggaucuguauguguucua

SEQ ID NO: 3027071 - RNA, 23 nt, Human
uggaggaaggaaacccagcucug

SEQ ID NO: 3027072 - RNA, 21 nt, Human
uggaggaaggaaacccagcuc

SEQ ID NO: 3027073 - RNA, 16 nt, Human
uggcaaaaaggcagga

SEQ ID NO: 3027074 - RNA, 12 nt, Human
uggcaaaaaggc

SEQ ID NO: 3027075 - RNA, 15 nt, Human
uggcacuauaaugua

SEQ ID NO: 3027076 - RNA, 16 nt, Human
uggcacuauaauguaa

SEQ ID NO: 3027077 - RNA, 23 nt, Human
uggacaggcauguucucugagga

SEQ ID NO: 3027078 - RNA, 11 nt, Human
uggcugcuuca

SEQ ID NO: 3027079 - RNA, 15 nt, Human
uggcugggggccuca

SEQ ID NO: 3027080 - RNA, 15 nt, Human
uggcugcuucaagga

SEQ ID NO: 3027081 - RNA, 23 nt, Human
uggccucccaacucaccccagcc

SEQ ID NO: 3027082 - RNA, 23 nt, Human
uggcgcagcauauucaggaagcu

SEQ ID NO: 3027083 - RNA, 22 nt, Human
uggcgcagcauauucaggaagc

SEQ ID NO: 3027084 - RNA, 16 nt, Human
uggcgcugccccuggc

SEQ ID NO: 3027085 - RNA, 23 nt, Human
uggcgcugccccuggcagccccu

SEQ ID NO: 3027086 - RNA, 15 nt, Human
uggcgcugccccugg

SEQ ID NO: 3027087 - RNA, 14 nt, Human
uggccccugcccgg

SEQ ID NO: 3027088 - RNA, 15 nt, Human
uggccccugcccggc

SEQ ID NO: 3027089 - RNA, 16 nt, Human
uggccccugcccggcu

SEQ ID NO: 3027090 - RNA, 13 nt, Human
uggccaggcuggu

SEQ ID NO: 3027091 - RNA, 17 nt, Human
uggccagaugcaccagc

SEQ ID NO: 3027092 - RNA, 18 nt, Human
uggccagaugcaccagcc

SEQ ID NO: 3027093 - RNA, 19 nt, Human
uggcagaguugaagacaga

SEQ ID NO: 3027094 - RNA, 17 nt, Human
uggcagaguugaagaca

SEQ ID NO: 3027095 - RNA, 21 nt, Human
uggcagaguggauucuugaac

SEQ ID NO: 3027096 - RNA, 15 nt, Human
uggcagaguugaaga

SEQ ID NO: 3027097 - RNA, 19 nt, Human
uggccagaugcaccagccc

SEQ ID NO: 3027098 - RNA, 16 nt, Human
ugcagggacagagcau

SEQ ID NO: 3027099 - RNA, 13 nt, Human
ugcagggaguccg

SEQ ID NO: 3027100 - RNA, 20 nt, Human
ugcaguggugcgaucugggu

SEQ ID NO: 3027101 - RNA, 21 nt, Human
ugcaguggugcgaucuggguu

SEQ ID NO: 3027102 - RNA, 21 nt, Human
ugcaguuacacuaaaagguga

SEQ ID NO: 3027103 - RNA, 23 nt, Human
ugcauauugcauacuauuaaaca

SEQ ID NO: 3027104 - RNA, 15 nt, Human
ugcauauugcauacu

SEQ ID NO: 3027105 - RNA, 19 nt, Human
ugcaucaagaugugacaug

SEQ ID NO: 3027106 - RNA, 16 nt, Human
ugcaguugccagucac

SEQ ID NO: 3027107 - RNA, 20 nt, Human
ugccacccuggggagaaagu

SEQ ID NO: 3027108 - RNA, 14 nt, Human
ugccaggcauggug

SEQ ID NO: 3027109 - RNA, 10 nt, Human
ugccaggcau

SEQ ID NO: 3027110 - RNA, 22 nt, Human
ugccaggaagccagcaggcucu

SEQ ID NO: 3027111 - RNA, 20 nt, Human
ugccaggaagccagcaggcu

SEQ ID NO: 3027112 - RNA, 23 nt, Human
ugcauuuggugguuucagaaaug

SEQ ID NO: 3027113 - RNA, 21 nt, Human
ugcauuuggugguuucagaaa

SEQ ID NO: 3027114 - RNA, 16 nt, Human
ugccccuggcagcccc

SEQ ID NO: 3027115 - RNA, 12 nt, Human
ugcccggcugcg

SEQ ID NO: 3027116 - RNA, 14 nt, Human
ugcccggcugcgga

SEQ ID NO: 3027117 - RNA, 18 nt, Human
ugcccaggcuggcgugca

SEQ ID NO: 3027118 - RNA, 19 nt, Human
ugcccaggcuggcgugcag

SEQ ID NO: 3027119 - RNA, 13 nt, Human
ugcccaggcuggc

SEQ ID NO: 3027120 - RNA, 20 nt, Human
ugcccaggcuggcgugcagu

SEQ ID NO: 3027121 - RNA, 14 nt, Human
ugcccugcccaccu

SEQ ID NO: 3027122 - RNA, 15 nt, Human
ugcccugcccaccug

SEQ ID NO: 3027123 - RNA, 20 nt, Human
ugcccugcccaccuggccuc

SEQ ID NO: 3027124 - RNA, 16 nt, Human
ugcccugcccaccugg

SEQ ID NO: 3027125 - RNA, 14 nt, Human
ugccucaagagaag

SEQ ID NO: 3027126 - RNA, 15 nt, Human
ugccucaagagaagg

SEQ ID NO: 3027127 - RNA, 21 nt, Human
ugcugccaauauccuaauaaa

SEQ ID NO: 3027128 - RNA, 15 nt, Human
ugcugccaauauccu

SEQ ID NO: 3027129 - RNA, 14 nt, Human
ugcugcauuuaaaa

SEQ ID NO: 3027130 - RNA, 23 nt, Human
ugcugcauuuaaaagauacaguu

SEQ ID NO: 3027131 - RNA, 16 nt, Human
ugcugccaauauccua

SEQ ID NO: 3027132 - RNA, 17 nt, Human
ugcugccaauauccuaa

SEQ ID NO: 3027133 - RNA, 18 nt, Human
ugcugccaauauccuaau

SEQ ID NO: 3027134 - RNA, 19 nt, Human
ugcugccaauauccuaaua

SEQ ID NO: 3027135 - RNA, 17 nt, Human
ugcugcauuuaaaagau

SEQ ID NO: 3027136 - RNA, 18 nt, Human
ugcugcauuuaaaagaua

SEQ ID NO: 3027137 - RNA, 19 nt, Human
ugcugcauuuaaaagauac

SEQ ID NO: 3027138 - RNA, 12 nt, Human
ugcugcuugagg

SEQ ID NO: 3027139 - RNA, 20 nt, Human
ugcugggauuacagguguga

SEQ ID NO: 3027140 - RNA, 19 nt, Human
ugcugcuugaggcaacuca

SEQ ID NO: 3027141 - RNA, 21 nt, Human
ugcuguucacuggacacuuca

SEQ ID NO: 3027142 - RNA, 13 nt, Human
ugcuggguguggc

SEQ ID NO: 3027143 - RNA, 17 nt, Human
ugcugggcuugucugua

SEQ ID NO: 3027144 - RNA, 21 nt, Human
ugcuacuguccuacccacccu

SEQ ID NO: 3027145 - RNA, 22 nt, Human
ugcuacuguccuacccacccuc

SEQ ID NO: 3027146 - RNA, 23 nt, Human
ugcucuccgaccagacaccuuga

SEQ ID NO: 3027147 - RNA, 17 nt, Human
ugcucacauaucuguca

SEQ ID NO: 3027148 - RNA, 22 nt, Human
ugcuaggaacacuccuucacag

SEQ ID NO: 3027149 - RNA, 20 nt, Human
ugcuaggaacacuccuucac

SEQ ID NO: 3027150 - RNA, 21 nt, Human
ugcuaggaacacuccuucaca

SEQ ID NO: 3027151 - RNA, 17 nt, Human
ugauugggcacaucauu

SEQ ID NO: 3027152 - RNA, 21 nt, Human
ugauugggcacaucauuucaa

SEQ ID NO: 3027153 - RNA, 20 nt, Human
ugauugggcacaucauuuca

SEQ ID NO: 3027154 - RNA, 18 nt, Human
ugauugggcacaucauuu

SEQ ID NO: 3027155 - RNA, 21 nt, Human
ugauuggaggggggagguggg

SEQ ID NO: 3027156 - RNA, 13 nt, Human
ugauuggaggggg

SEQ ID NO: 3027157 - RNA, 23 nt, Human
ugauugggcacaucauuucaaga

SEQ ID NO: 3027158 - RNA, 17 nt, Human
ugauuuaaacacauuaa

SEQ ID NO: 3027159 - RNA, 16 nt, Human
ugauuuaaacacauua

SEQ ID NO: 3027160 - RNA, 18 nt, Human
ugauuuaaacacauuaaa

SEQ ID NO: 3027161 - RNA, 15 nt, Human
ugauuuaaacacauu

SEQ ID NO: 3027162 - RNA, 16 nt, Human
ugauugugucucuugg

SEQ ID NO: 3027163 - RNA, 17 nt, Human
ugauugccuuuuuauaa

SEQ ID NO: 3027164 - RNA, 22 nt, Human
ugauugccuuuuuauaacuuuu

SEQ ID NO: 3027165 - RNA, 21 nt, Human
ugauucuccugccucagccuc

SEQ ID NO: 3027166 - RNA, 23 nt, Human
ugauucagacagcugccugggau

SEQ ID NO: 3027167 - RNA, 21 nt, Human
ugauucagacagcugccuggg

SEQ ID NO: 3027168 - RNA, 20 nt, Human
ugauucagacagcugccugg

SEQ ID NO: 3027169 - RNA, 19 nt, Human
ugauucagacagcugccug

SEQ ID NO: 3027170 - RNA, 18 nt, Human
ugauucagacagcugccu

SEQ ID NO: 3027171 - RNA, 16 nt, Human
ugauucagacagcugc

SEQ ID NO: 3027172 - RNA, 15 nt, Human
ugauucagacagcug

SEQ ID NO: 3027173 - RNA, 14 nt, Human
ugauucagacagcu

SEQ ID NO: 3027174 - RNA, 13 nt, Human
ugauucagacagc

SEQ ID NO: 3027175 - RNA, 20 nt, Human
ugauucaacagguuuuccug

SEQ ID NO: 3027176 - RNA, 20 nt, Human
ugauguucuuucacccuuuu

SEQ ID NO: 3027177 - RNA, 14 nt, Human
ugauagcacagacc

SEQ ID NO: 3027178 - RNA, 13 nt, Human
ugauagcacagac

SEQ ID NO: 3027179 - RNA, 13 nt, Human
ugauccaagcugg

SEQ ID NO: 3027180 - RNA, 14 nt, Human
ugauccaagcuggu

SEQ ID NO: 3027181 - RNA, 15 nt, Human
ugauccaagcugguc

SEQ ID NO: 3027182 - RNA, 16 nt, Human
ugauccacccaccuca

SEQ ID NO: 3027183 - RNA, 17 nt, Human
ugauccacccaccucag

SEQ ID NO: 3027184 - RNA, 18 nt, Human
ugauccacccaccucagc

SEQ ID NO: 3027185 - RNA, 19 nt, Human
ugauccacccaccucagcc

SEQ ID NO: 3027186 - RNA, 20 nt, Human
ugaucuucuuuauaauucua

SEQ ID NO: 3027187 - RNA, 16 nt, Human
ugaucuuugcagacag

SEQ ID NO: 3027188 - RNA, 16 nt, Human
ugauguguuaucucuu

SEQ ID NO: 3027189 - RNA, 17 nt, Human
ugaugcuucuucagaga

SEQ ID NO: 3027190 - RNA, 16 nt, Human
ugaugcuucuucagag

SEQ ID NO: 3027191 - RNA, 14 nt, Human
ugagugagcaugcc

SEQ ID NO: 3027192 - RNA, 20 nt, Human
ugaguugauagcacagaccc

SEQ ID NO: 3027193 - RNA, 16 nt, Human
ugaguugauagcacag

SEQ ID NO: 3027194 - RNA, 19 nt, Human
ugaguccagaaguuugaga

SEQ ID NO: 3027195 - RNA, 13 nt, Human
ugaguccagaagu

SEQ ID NO: 3027196 - RNA, 18 nt, Human
ugagucgaggacagggag

SEQ ID NO: 3027197 - RNA, 19 nt, Human
ugagucgaggacagggagg

SEQ ID NO: 3027198 - RNA, 18 nt, Human
ugagucugaaggcugggu

SEQ ID NO: 3027199 - RNA, 17 nt, Human
ugagucugaaggcuggg

SEQ ID NO: 3027200 - RNA, 15 nt, Human
ugagucugaaggcug

SEQ ID NO: 3027201 - RNA, 13 nt, Human
ugagucugaaggc

SEQ ID NO: 3027202 - RNA, 13 nt, Human
ugagcugggauga

SEQ ID NO: 3027203 - RNA, 12 nt, Human
ugaggcauuugu

SEQ ID NO: 3027204 - RNA, 19 nt, Human
ugaggcauuuguuugaacu

SEQ ID NO: 3027205 - RNA, 20 nt, Human
ugaggcauuuguuugaacug

SEQ ID NO: 3027206 - RNA, 23 nt, Human
ugaggcuagugugguguuuccug

SEQ ID NO: 3027207 - RNA, 17 nt, Human
ugaggcuaguguggugu

SEQ ID NO: 3027208 - RNA, 21 nt, Human
ugaggcauuuguuugaacuga

SEQ ID NO: 3027209 - RNA, 13 nt, Human
ugaggugggagga

SEQ ID NO: 3027210 - RNA, 12 nt, Human
ugaggugggagg

SEQ ID NO: 3027211 - RNA, 17 nt, Human
ugagggaacagagaggu

SEQ ID NO: 3027212 - RNA, 14 nt, Human
ugaggcucugcccu

SEQ ID NO: 3027213 - RNA, 13 nt, Human
ugaggcucugccc

SEQ ID NO: 3027214 - RNA, 22 nt, Human
ugagccucagcauccuggcacc

SEQ ID NO: 3027215 - RNA, 18 nt, Human
ugagccucagcauccugg

SEQ ID NO: 3027216 - RNA, 21 nt, Human
ugagccucagcauccuggcac

SEQ ID NO: 3027217 - RNA, 19 nt, Human
ugagccgagaucacgccac

SEQ ID NO: 3027218 - RNA, 21 nt, Human
ugagccgagaucacgccacug

SEQ ID NO: 3027219 - RNA, 17 nt, Human
ugagccucagcauccug

SEQ ID NO: 3027220 - RNA, 19 nt, Human
ugagcagggcucagcgggg

SEQ ID NO: 3027221 - RNA, 16 nt, Human
ugagcagggcucagcg

SEQ ID NO: 3027222 - RNA, 17 nt, Human
ugagcagggcucagcgg

SEQ ID NO: 3027223 - RNA, 16 nt, Human
ugagcaucaggccagg

SEQ ID NO: 3027224 - RNA, 20 nt, Human
ugagcaucaggccaggcccu

SEQ ID NO: 3027225 - RNA, 19 nt, Human
ugagcaucaggccaggccc

SEQ ID NO: 3027226 - RNA, 18 nt, Human
ugagcaucaggccaggcc

SEQ ID NO: 3027227 - RNA, 19 nt, Human
ugagacucgcgacaaugca

SEQ ID NO: 3027228 - RNA, 20 nt, Human
ugaccucaggugauccaccc

SEQ ID NO: 3027229 - RNA, 21 nt, Human
ugaccucaggugauccaccca

SEQ ID NO: 3027230 - RNA, 12 nt, Human
ugagcagggcuc

SEQ ID NO: 3027231 - RNA, 13 nt, Human
ugagcagggcuca

SEQ ID NO: 3027232 - RNA, 14 nt, Human
ugagcagggcucag

SEQ ID NO: 3027233 - RNA, 15 nt, Human
ugagcagggcucagc

SEQ ID NO: 3027234 - RNA, 14 nt, Human
ugagaucagccugg

SEQ ID NO: 3027235 - RNA, 15 nt, Human
ugagaucaaaacggu

SEQ ID NO: 3027236 - RNA, 23 nt, Human
ugagacucgcgacaaugcaaacc

SEQ ID NO: 3027237 - RNA, 22 nt, Human
ugagacucgcgacaaugcaaac

SEQ ID NO: 3027238 - RNA, 21 nt, Human
ugagacucgcgacaaugcaaa

SEQ ID NO: 3027239 - RNA, 20 nt, Human
ugagacucgcgacaaugcaa

SEQ ID NO: 3027240 - RNA, 17 nt, Human
ugaacaguaacauagcu

SEQ ID NO: 3027241 - RNA, 22 nt, Human
ugaaccaagaacuuuccaggaa

SEQ ID NO: 3027242 - RNA, 23 nt, Human
ugaaccacaucuugcucugcuga

SEQ ID NO: 3027243 - RNA, 17 nt, Human
ugaaccaccacacccag

SEQ ID NO: 3027244 - RNA, 20 nt, Human
ugaaccaccacacccagccc

SEQ ID NO: 3027245 - RNA, 16 nt, Human
ugaacuccuggccuca

SEQ ID NO: 3027246 - RNA, 13 nt, Human
ugaaaugucaacc

SEQ ID NO: 3027247 - RNA, 13 nt, Human
ugaaagggcccag

SEQ ID NO: 3027248 - RNA, 23 nt, Human
ugaaagggaguauuacaaaaaca

SEQ ID NO: 3027249 - RNA, 18 nt, Human
ugaaagggcccagagagg

SEQ ID NO: 3027250 - RNA, 18 nt, Human
ugaaagcccugagcuuuc

SEQ ID NO: 3027251 - RNA, 19 nt, Human
ugaaaauuuugauguuuua

SEQ ID NO: 3027252 - RNA, 21 nt, Human
ugaaaauuuugauguuuuaag

SEQ ID NO: 3027253 - RNA, 13 nt, Human
ugaaaauuuugau

SEQ ID NO: 3027254 - RNA, 14 nt, Human
ugaaacauuuuguc

SEQ ID NO: 3027255 - RNA, 23 nt, Human
ucuuucacccuuuucuguuugcu

SEQ ID NO: 3027256 - RNA, 21 nt, Human
ucuuguguguuuauugucaaa

SEQ ID NO: 3027257 - RNA, 16 nt, Human
ucuuguguguuuauug

SEQ ID NO: 3027258 - RNA, 23 nt, Human
ucuugcaauggcagccuuggcaa

SEQ ID NO: 3027259 - RNA, 20 nt, Human
ucuccucugcugcuggcugg

SEQ ID NO: 3027260 - RNA, 16 nt, Human
ucucccuucauccuuc

SEQ ID NO: 3027261 - RNA, 17 nt, Human
ucuuuggacacucacac

SEQ ID NO: 3027262 - RNA, 13 nt, Human
ucuuuccaaagua

SEQ ID NO: 3027263 - RNA, 14 nt, Human
ucuuuccaaaguac

SEQ ID NO: 3027264 - RNA, 21 nt, Human
ucuuucagccaagaauucuua

SEQ ID NO: 3027265 - RNA, 20 nt, Human
ucuuucagccaagaauucuu

SEQ ID NO: 3027266 - RNA, 19 nt, Human
ucuuucagccaagaauucu

SEQ ID NO: 3027267 - RNA, 16 nt, Human
ucuuucagccaagaau

SEQ ID NO: 3027268 - RNA, 17 nt, Human
ugaaggccccgcccagg

SEQ ID NO: 3027269 - RNA, 17 nt, Human
ugaacuccuggccucaa

SEQ ID NO: 3027270 - RNA, 16 nt, Human
ugaaggccccgcccag

SEQ ID NO: 3027271 - RNA, 15 nt, Human
ugaaggccccgccca

SEQ ID NO: 3027272 - RNA, 22 nt, Human
ugaaggacauugcggacagcca

SEQ ID NO: 3027273 - RNA, 19 nt, Human
ugaaggacauugcggacag

SEQ ID NO: 3027274 - RNA, 20 nt, Human
ugaaggacauugcggacagc

SEQ ID NO: 3027275 - RNA, 16 nt, Human
ugaccauucuccaccu

SEQ ID NO: 3027276 - RNA, 18 nt, Human
ugaccauucuccaccugc

SEQ ID NO: 3027277 - RNA, 17 nt, Human
ugaccauucuccaccug

SEQ ID NO: 3027278 - RNA, 20 nt, Human
ugaccgugaggccagagaca

SEQ ID NO: 3027279 - RNA, 16 nt, Human
ugaccgugaggccaga

SEQ ID NO: 3027280 - RNA, 14 nt, Human
ugaccgugaggcca

SEQ ID NO: 3027281 - RNA, 13 nt, Human
ugaccgugaggcc

SEQ ID NO: 3027282 - RNA, 13 nt, Human
ugacaugucuuuu

SEQ ID NO: 3027283 - RNA, 15 nt, Human
ugacaugucuuuucu

SEQ ID NO: 3027284 - RNA, 19 nt, Human
ugaccagcaccaucucucc

SEQ ID NO: 3027285 - RNA, 19 nt, Human
ugacagagugagacucugu

SEQ ID NO: 3027286 - RNA, 18 nt, Human
ugacagaggcagccccau

SEQ ID NO: 3027287 - RNA, 23 nt, Human
ugacagaggcagccccauucugc

SEQ ID NO: 3027288 - RNA, 14 nt, Human
ugacagagugagac

SEQ ID NO: 3027289 - RNA, 17 nt, Human
ugacagagugagacucu

SEQ ID NO: 3027290 - RNA, 13 nt, Human
ugacagaggcagc

SEQ ID NO: 3027291 - RNA, 20 nt, Human
ugacagacacaggcccggcu

SEQ ID NO: 3027292 - RNA, 23 nt, Human
ugacagacacaggcccggcucca

SEQ ID NO: 3027293 - RNA, 14 nt, Human
ugacagaggcagcc

SEQ ID NO: 3027294 - RNA, 15 nt, Human
ugacagaggcagccc

SEQ ID NO: 3027295 - RNA, 16 nt, Human
ugacagaggcagcccc

SEQ ID NO: 3027296 - RNA, 17 nt, Human
ugacagaggcagcccca

SEQ ID NO: 3027297 - RNA, 18 nt, Human
ugacaaggauugcuacug

SEQ ID NO: 3027298 - RNA, 22 nt, Human
uccugucggagcccugucuccu

SEQ ID NO: 3027299 - RNA, 22 nt, Human
uccuguaccucuugagccuuga

SEQ ID NO: 3027300 - RNA, 11 nt, Human
uccuguagccc

SEQ ID NO: 3027301 - RNA, 13 nt, Human
uccuguagcccua

SEQ ID NO: 3027302 - RNA, 23 nt, Human
uccuggcacccggccccugcugg

SEQ ID NO: 3027303 - RNA, 22 nt, Human
uccuggcacccggccccugcug

SEQ ID NO: 3027304 - RNA, 16 nt, Human
uccuggcacugcuucc

SEQ ID NO: 3027305 - RNA, 13 nt, Human
uccuggcacugcu

SEQ ID NO: 3027306 - RNA, 12 nt, Human
uccuggccucaa

SEQ ID NO: 3027307 - RNA, 20 nt, Human
uccugcccuuaccugccagg

SEQ ID NO: 3027308 - RNA, 17 nt, Human
uccugcccuuaccugcc

SEQ ID NO: 3027309 - RNA, 14 nt, Human
uccuggaguucugg

SEQ ID NO: 3027310 - RNA, 21 nt, Human
uccugagccagauuucacucu

SEQ ID NO: 3027311 - RNA, 14 nt, Human
uccugccaggcaug

SEQ ID NO: 3027312 - RNA, 13 nt, Human
uccugccaggcau

SEQ ID NO: 3027313 - RNA, 20 nt, Human
ucccuucacaaacccagugu

SEQ ID NO: 3027314 - RNA, 15 nt, Human
ucccccuuccaugga

SEQ ID NO: 3027315 - RNA, 15 nt, Human
ucccuuccucuuucc

SEQ ID NO: 3027316 - RNA, 16 nt, Human
ucccuuccucuuucca

SEQ ID NO: 3027317 - RNA, 16 nt, Human
ucccuuggacauuuua

SEQ ID NO: 3027318 - RNA, 18 nt, Human
ucccuuggacauuuuaug

SEQ ID NO: 3027319 - RNA, 19 nt, Human
ucccuuggacauuuuaugu

SEQ ID NO: 3027320 - RNA, 21 nt, Human
ucccuuggacauuuuaugucu

SEQ ID NO: 3027321 - RNA, 15 nt, Human
ucccuuggacauuuu

SEQ ID NO: 3027322 - RNA, 14 nt, Human
uccgccucuugggu

SEQ ID NO: 3027323 - RNA, 16 nt, Human
uccgcuuucuacccag

SEQ ID NO: 3027324 - RNA, 18 nt, Human
uccgcuuucuacccagcg

SEQ ID NO: 3027325 - RNA, 20 nt, Human
uccgcuuucuacccagcgag

SEQ ID NO: 3027326 - RNA, 20 nt, Human
uccuaagcuauucaguaaua

SEQ ID NO: 3027327 - RNA, 21 nt, Human
uccuaagcuauucaguaauaa

SEQ ID NO: 3027328 - RNA, 17 nt, Human
uccuagucauucuuccc

SEQ ID NO: 3027329 - RNA, 23 nt, Human
uccuauauuguuuucaguguaca

SEQ ID NO: 3027330 - RNA, 21 nt, Human
uccuauauuguuuucagugua

SEQ ID NO: 3027331 - RNA, 22 nt, Human
uccucauuuuuauaaugucccu

SEQ ID NO: 3027332 - RNA, 18 nt, Human
uccucauuagcauuuugc

SEQ ID NO: 3027333 - RNA, 13 nt, Human
uccuccacauuug

SEQ ID NO: 3027334 - RNA, 16 nt, Human
uccuccacauuuguuu

SEQ ID NO: 3027335 - RNA, 12 nt, Human
uccucccaccuc

SEQ ID NO: 3027336 - RNA, 10 nt, Human
uccuccaggu

SEQ ID NO: 3027337 - RNA, 13 nt, Human
ucgugacaacacu

SEQ ID NO: 3027338 - RNA, 18 nt, Human
ucuaaaggcuaccuuugu

SEQ ID NO: 3027339 - RNA, 17 nt, Human
ucuaaaggcuaccuuug

SEQ ID NO: 3027340 - RNA, 19 nt, Human
ucuaaaggcuaccuuugua

SEQ ID NO: 3027341 - RNA, 20 nt, Human
ucuaaaggcuaccuuuguau

SEQ ID NO: 3027342 - RNA, 21 nt, Human
ucuacacugugcugagucuga

SEQ ID NO: 3027343 - RNA, 15 nt, Human
ucuacagaggccaug

SEQ ID NO: 3027344 - RNA, 14 nt, Human
ucuaccuuccugca

SEQ ID NO: 3027345 - RNA, 16 nt, Human
ucuaggaagacuuugg

SEQ ID NO: 3027346 - RNA, 15 nt, Human
ucuaggaagacuuug

SEQ ID NO: 3027347 - RNA, 19 nt, Human
ucuaggaagacuuuggaaa

SEQ ID NO: 3027348 - RNA, 14 nt, Human
ucuaugacacaugc

SEQ ID NO: 3027349 - RNA, 17 nt, Human
ucuaugacacaugcaag

SEQ ID NO: 3027350 - RNA, 16 nt, Human
ucucauacucaccuca

SEQ ID NO: 3027351 - RNA, 18 nt, Human
ucucauacucaccucacc

SEQ ID NO: 3027352 - RNA, 19 nt, Human
ucuaugggacucaaugcac

SEQ ID NO: 3027353 - RNA, 12 nt, Human
ucuaugggacuc

SEQ ID NO: 3027354 - RNA, 13 nt, Human
ucuaugggacuca

SEQ ID NO: 3027355 - RNA, 13 nt, Human
ucuccacccugcu

SEQ ID NO: 3027356 - RNA, 12 nt, Human
ucuccacccugc

SEQ ID NO: 3027357 - RNA, 17 nt, Human
ucuccacccugcucucc

SEQ ID NO: 3027358 - RNA, 14 nt, Human
ucuccacccugcuc

SEQ ID NO: 3027359 - RNA, 16 nt, Human
ucuccacccugcucuc

SEQ ID NO: 3027360 - RNA, 22 nt, Human
ucuccaccugccagggacagag

SEQ ID NO: 3027361 - RNA, 19 nt, Human
ucuccaccugccagggaca

SEQ ID NO: 3027362 - RNA, 17 nt, Human
ucuccaccugccaggga

SEQ ID NO: 3027363 - RNA, 16 nt, Human
ucuccaccugccaggg

SEQ ID NO: 3027364 - RNA, 15 nt, Human
ucuccaccugccagg

SEQ ID NO: 3027365 - RNA, 14 nt, Human
ucuccaccugccag

SEQ ID NO: 3027366 - RNA, 18 nt, Human
ucucccucagucuggccc

SEQ ID NO: 3027367 - RNA, 23 nt, Human
ucucccucagucuggcccuuccu

SEQ ID NO: 3027368 - RNA, 12 nt, Human
ucucccccagcc

SEQ ID NO: 3027369 - RNA, 15 nt, Human
ucuccagccccugga

SEQ ID NO: 3027370 - RNA, 14 nt, Human
ucuccagccccugg

SEQ ID NO: 3027371 - RNA, 13 nt, Human
ucuccagccccug

SEQ ID NO: 3027372 - RNA, 12 nt, Human
ucuccagccccu

SEQ ID NO: 3027373 - RNA, 18 nt, Human
ucuccagccccuggaugc

SEQ ID NO: 3027374 - RNA, 16 nt, Human
ucuccagccccuggau

SEQ ID NO: 3027375 - RNA, 22 nt, Human
ucuccagccccuggaugcagcc

SEQ ID NO: 3027376 - RNA, 14 nt, Human
ucauccacugugcc

SEQ ID NO: 3027377 - RNA, 17 nt, Human
ucauccacugugccaug

SEQ ID NO: 3027378 - RNA, 19 nt, Human
ucaucuugaauuguaagga

SEQ ID NO: 3027379 - RNA, 14 nt, Human
ucaucauccuaagc

SEQ ID NO: 3027380 - RNA, 20 nt, Human
ucaguguacauggaauaaca

SEQ ID NO: 3027381 - RNA, 13 nt, Human
uccaaaguacacu

SEQ ID NO: 3027382 - RNA, 20 nt, Human
ucagguggggcagcuugagg

SEQ ID NO: 3027383 - RNA, 19 nt, Human
ucagucugauucccaagcu

SEQ ID NO: 3027384 - RNA, 21 nt, Human
ucagucugauucccaagcucu

SEQ ID NO: 3027385 - RNA, 22 nt, Human
ucagucugauucccaagcucug

SEQ ID NO: 3027386 - RNA, 23 nt, Human
ucagucugauucccaagcucugc

SEQ ID NO: 3027387 - RNA, 16 nt, Human
ucaggugauccaccca

SEQ ID NO: 3027388 - RNA, 23 nt, Human
ucaggugagaagcagaggaagga

SEQ ID NO: 3027389 - RNA, 23 nt, Human
ucaggugauccacccaccucagc

SEQ ID NO: 3027390 - RNA, 18 nt, Human
ucagguggggcagcuuga

SEQ ID NO: 3027391 - RNA, 19 nt, Human
ucagguggggcagcuugag

SEQ ID NO: 3027392 - RNA, 21 nt, Human
ucaggccugggggcugggcag

SEQ ID NO: 3027393 - RNA, 23 nt, Human
ucagcuccagcucaccagcccca

SEQ ID NO: 3027394 - RNA, 24 nt, Human
ucagcuccagcucaccagccccag

SEQ ID NO: 3027395 - RNA, 23 nt, Human
ucagcucugcaagaauugaagca

SEQ ID NO: 3027396 - RNA, 23 nt, Human
ucaggaagcucagggccuggcuc

SEQ ID NO: 3027397 - RNA, 15 nt, Human
uccauagagagcaag

SEQ ID NO: 3027398 - RNA, 14 nt, Human
uccauagagagcaa

SEQ ID NO: 3027399 - RNA, 18 nt, Human
uccagguuuaagcuguua

SEQ ID NO: 3027400 - RNA, 20 nt, Human
uccagguuuaagcuguuacu

SEQ ID NO: 3027401 - RNA, 20 nt, Human
uccaggggugggacacccug

SEQ ID NO: 3027402 - RNA, 19 nt, Human
uccaggggugggacacccu

SEQ ID NO: 3027403 - RNA, 15 nt, Human
uccaggagcagccac

SEQ ID NO: 3027404 - RNA, 14 nt, Human
uccaggagcagcca

SEQ ID NO: 3027405 - RNA, 13 nt, Human
uccaggagcagcc

SEQ ID NO: 3027406 - RNA, 12 nt, Human
uccaggagcagc

SEQ ID NO: 3027407 - RNA, 19 nt, Human
uccacuuucuagccagagg

SEQ ID NO: 3027408 - RNA, 21 nt, Human
uccacuuucuagccagaggag

SEQ ID NO: 3027409 - RNA, 20 nt, Human
uccacuuucuagccagagga

SEQ ID NO: 3027410 - RNA, 14 nt, Human
uccaaaguacacug

SEQ ID NO: 3027411 - RNA, 16 nt, Human
uccaaaguacacuguu

SEQ ID NO: 3027412 - RNA, 13 nt, Human
ucccaccuuggcu

SEQ ID NO: 3027413 - RNA, 16 nt, Human
ucccaccuuggcugca

SEQ ID NO: 3027414 - RNA, 17 nt, Human
ucccaccuuggcugcag

SEQ ID NO: 3027415 - RNA, 20 nt, Human
ucccagcugugcucuggaca

SEQ ID NO: 3027416 - RNA, 22 nt, Human
ucccaccucucucacuccuuga

SEQ ID NO: 3027417 - RNA, 20 nt, Human
uccaugugggcuaguugggc

SEQ ID NO: 3027418 - RNA, 24 nt, Human
ucccaggcauuccccaggaggcca

SEQ ID NO: 3027419 - RNA, 23 nt, Human
ucccaggcauuccccaggaggcc

SEQ ID NO: 3027420 - RNA, 23 nt, Human
ucccagcugugcucuggacaggc

SEQ ID NO: 3027421 - RNA, 21 nt, Human
ucccagcugugcucuggacag

SEQ ID NO: 3027422 - RNA, 22 nt, Human
ucccagcugugcucuggacagg

SEQ ID NO: 3027423 - RNA, 15 nt, Human
ucccaucuuccaagg

SEQ ID NO: 3027424 - RNA, 21 nt, Human
ucccaucugugaaaggaaaga

SEQ ID NO: 3027425 - RNA, 18 nt, Human
ucccaugagccucagcau

SEQ ID NO: 3027426 - RNA, 19 nt, Human
ucccaugagccucagcauc

SEQ ID NO: 3027427 - RNA, 14 nt, Human
uccccaggaggcca

SEQ ID NO: 3027428 - RNA, 22 nt, Human
ucccccagccccauccucugua

SEQ ID NO: 3027429 - RNA, 21 nt, Human
ucccccagccccauccucugu

SEQ ID NO: 3027430 - RNA, 20 nt, Human
ucccccagccccauccucug

SEQ ID NO: 3027431 - RNA, 16 nt, Human
uccccaggaggccagc

SEQ ID NO: 3027432 - RNA, 15 nt, Human
uccccaggaggccag

SEQ ID NO: 3027433 - RNA, 17 nt, Human
ucccccagccccauccu

SEQ ID NO: 3027434 - RNA, 13 nt, Human
uccccaggaggcc

SEQ ID NO: 3027435 - RNA, 19 nt, Human
uccccagauugcaacaggc

SEQ ID NO: 3027436 - RNA, 20 nt, Human
uccccagauugcaacaggcu

SEQ ID NO: 3027437 - RNA, 22 nt, Human
uccccagauugcaacaggcugg

SEQ ID NO: 3027438 - RNA, 23 nt, Human
uccccagauugcaacaggcuggg

SEQ ID NO: 3027439 - RNA, 20 nt, Human
uccccagcaagugagagcug

SEQ ID NO: 3027440 - RNA, 21 nt, Human
uccccagcaagugagagcugg

SEQ ID NO: 3027441 - RNA, 22 nt, Human
uccccagcaagugagagcuggg

SEQ ID NO: 3027442 - RNA, 17 nt, Human
ucccaugagccucagca

SEQ ID NO: 3027443 - RNA, 20 nt, Human
ucccaugagccucagcaucc

SEQ ID NO: 3027444 - RNA, 13 nt, Human
uccccagauugca

SEQ ID NO: 3027445 - RNA, 18 nt, Human
uccccagauugcaacagg

SEQ ID NO: 3027446 - RNA, 20 nt, Human
uaugauugccuuuuuauaac

SEQ ID NO: 3027447 - RNA, 23 nt, Human
uaugauugccuuuuuauaacuuu

SEQ ID NO: 3027448 - RNA, 23 nt, Human
uaugacuccagaauuucccaaag

SEQ ID NO: 3027449 - RNA, 17 nt, Human
uaugacuccagaauuuc

SEQ ID NO: 3027450 - RNA, 16 nt, Human
uaugacuccagaauuu

SEQ ID NO: 3027451 - RNA, 13 nt, Human
uaugcacacauuu

SEQ ID NO: 3027452 - RNA, 14 nt, Human
uaugcacacauuuu

SEQ ID NO: 3027453 - RNA, 18 nt, Human
uaugcaaucaaaucugcu

SEQ ID NO: 3027454 - RNA, 13 nt, Human
uaugcaugaagua

SEQ ID NO: 3027455 - RNA, 18 nt, Human
uaugcaugaaguaauaug

SEQ ID NO: 3027456 - RNA, 22 nt, Human
uaugcuuauacacuuacacuuu

SEQ ID NO: 3027457 - RNA, 17 nt, Human
uauggacaaugacccag

SEQ ID NO: 3027458 - RNA, 19 nt, Human
uauggaacacucugagacu

SEQ ID NO: 3027459 - RNA, 18 nt, Human
uauggaacacucugagac

SEQ ID NO: 3027460 - RNA, 17 nt, Human
uauggaacacucugaga

SEQ ID NO: 3027461 - RNA, 16 nt, Human
uauggaacacucugag

SEQ ID NO: 3027462 - RNA, 13 nt, Human
uauggaacacucu

SEQ ID NO: 3027463 - RNA, 18 nt, Human
uaucuguucauauggaua

SEQ ID NO: 3027464 - RNA, 20 nt, Human
uaucugucauuugagcaggg

SEQ ID NO: 3027465 - RNA, 21 nt, Human
uaucugucauuugagcagggc

SEQ ID NO: 3027466 - RNA, 23 nt, Human
uaucugucauuugagcagggcuc

SEQ ID NO: 3027467 - RNA, 12 nt, Human
uaugacacaugc

SEQ ID NO: 3027468 - RNA, 22 nt, Human
uaugacacaugcaaggucauuu

SEQ ID NO: 3027469 - RNA, 19 nt, Human
uauauguuuuaagaggcag

SEQ ID NO: 3027470 - RNA, 16 nt, Human
uaucuaaauguugaaa

SEQ ID NO: 3027471 - RNA, 21 nt, Human
uaucuaauauguaacaagcca

SEQ ID NO: 3027472 - RNA, 11 nt, Human
uagggaaaaac

SEQ ID NO: 3027473 - RNA, 19 nt, Human
uagggaaaaaccagcgugu

SEQ ID NO: 3027474 - RNA, 21 nt, Human
uagggaaaaaccagcguguga

SEQ ID NO: 3027475 - RNA, 20 nt, Human
uagggaaaaaccagcgugug

SEQ ID NO: 3027476 - RNA, 18 nt, Human
uaggccuggccagaugca

SEQ ID NO: 3027477 - RNA, 15 nt, Human
uaggccuggccagau

SEQ ID NO: 3027478 - RNA, 23 nt, Human
uaggugacagagugagacucugu

SEQ ID NO: 3027479 - RNA, 18 nt, Human
uauaaacuuuaccuuuuu

SEQ ID NO: 3027480 - RNA, 20 nt, Human
uauaugcucugcauguuaca

SEQ ID NO: 3027481 - RNA, 21 nt, Human
uauaugcucugcauguuacau

SEQ ID NO: 3027482 - RNA, 13 nt, Human
uauguuaauauuu

SEQ ID NO: 3027483 - RNA, 16 nt, Human
uauguuaauauuucug

SEQ ID NO: 3027484 - RNA, 14 nt, Human
uauguuaauauuuu

SEQ ID NO: 3027485 - RNA, 13 nt, Human
uauguguucuauu

SEQ ID NO: 3027486 - RNA, 15 nt, Human
uauuaaaugcccagc

SEQ ID NO: 3027487 - RNA, 19 nt, Human
uauuaaaugcccagccccu

SEQ ID NO: 3027488 - RNA, 17 nt, Human
uauuaaaugcccagccc

SEQ ID NO: 3027489 - RNA, 16 nt, Human
uauuaagaaagacuau

SEQ ID NO: 3027490 - RNA, 21 nt, Human
uauguugcccaggcaggucuu

SEQ ID NO: 3027491 - RNA, 22 nt, Human
uauguucuuaguggauguucug

SEQ ID NO: 3027492 - RNA, 13 nt, Human
uauuauauucauu

SEQ ID NO: 3027493 - RNA, 17 nt, Human
uauuauauucauucuuu

SEQ ID NO: 3027494 - RNA, 23 nt, Human
uauuauauucauucuuuuugaaa

SEQ ID NO: 3027495 - RNA, 14 nt, Human
uauuauaccuuuuu

SEQ ID NO: 3027496 - RNA, 12 nt, Human
uauuauaccuuu

SEQ ID NO: 3027497 - RNA, 13 nt, Human
uauuauaccuuuu

SEQ ID NO: 3027498 - RNA, 14 nt, Human
uauuaaggaagaca

SEQ ID NO: 3027499 - RNA, 18 nt, Human
uauucauucuuuuugaaa

SEQ ID NO: 3027500 - RNA, 23 nt, Human
uauucauucuuuuugaaauguca

SEQ ID NO: 3027501 - RNA, 20 nt, Human
uauugauaugcuuauacacu

SEQ ID NO: 3027502 - RNA, 19 nt, Human
uauugcauacuauuaaaca

SEQ ID NO: 3027503 - RNA, 23 nt, Human
uauugcauacuauuaaacaugcu

SEQ ID NO: 3027504 - RNA, 22 nt, Human
uauugcugauggugcaaugacc

SEQ ID NO: 3027505 - RNA, 23 nt, Human
uauugcugauggugcaaugaccu

SEQ ID NO: 3027506 - RNA, 13 nt, Human
uauugcccacgcu

SEQ ID NO: 3027507 - RNA, 14 nt, Human
uauugcccacgcug

SEQ ID NO: 3027508 - RNA, 15 nt, Human
uauugcccacgcugg

SEQ ID NO: 3027509 - RNA, 18 nt, Human
uauuugaaacacugguuu

SEQ ID NO: 3027510 - RNA, 22 nt, Human
uauuuauuaaaugcccagcccc

SEQ ID NO: 3027511 - RNA, 17 nt, Human
uauuuaaauagaugaca

SEQ ID NO: 3027512 - RNA, 15 nt, Human
uauuuaaauagauga

SEQ ID NO: 3027513 - RNA, 17 nt, Human
uauuuaugggauccugg

SEQ ID NO: 3027514 - RNA, 12 nt, Human
ucaaauguguac

SEQ ID NO: 3027515 - RNA, 23 nt, Human
ucaaagagguuuuaaaaaaaucc

SEQ ID NO: 3027516 - RNA, 12 nt, Human
ucaaagagguuu

SEQ ID NO: 3027517 - RNA, 17 nt, Human
ucaagcgauucuucugc

SEQ ID NO: 3027518 - RNA, 20 nt, Human
ucaagccaccaacauacucc

SEQ ID NO: 3027519 - RNA, 12 nt, Human
ucaagccaccaa

SEQ ID NO: 3027520 - RNA, 21 nt, Human
ucaagcgauucuucugcuuca

SEQ ID NO: 3027521 - RNA, 18 nt, Human
ucaagcgauucuucugcu

SEQ ID NO: 3027522 - RNA, 19 nt, Human
ucaagcgauucuucugcuu

SEQ ID NO: 3027523 - RNA, 14 nt, Human
ucaaggauccugag

SEQ ID NO: 3027524 - RNA, 13 nt, Human
ucaaggauccuga

SEQ ID NO: 3027525 - RNA, 16 nt, Human
ucaaggauccugagcc

SEQ ID NO: 3027526 - RNA, 15 nt, Human
ucaaggauccugagc

SEQ ID NO: 3027527 - RNA, 16 nt, Human
ucaaccuccugggcua

SEQ ID NO: 3027528 - RNA, 20 nt, Human
ucaaccccuucgcuccugug

SEQ ID NO: 3027529 - RNA, 15 nt, Human
ucaaccuccugggcu

SEQ ID NO: 3027530 - RNA, 18 nt, Human
ucaaccccuucgcuccug

SEQ ID NO: 3027531 - RNA, 19 nt, Human
ucaaccccuucgcuccugu

SEQ ID NO: 3027532 - RNA, 20 nt, Human
ucaacucuccuccagaguca

SEQ ID NO: 3027533 - RNA, 15 nt, Human
ucacacacuuuggcu

SEQ ID NO: 3027534 - RNA, 23 nt, Human
ucacacaugagcaucaggccagg

SEQ ID NO: 3027535 - RNA, 22 nt, Human
ucacacaugagcaucaggccag

SEQ ID NO: 3027536 - RNA, 23 nt, Human
ucaccgaaaacguggcugcuuca

SEQ ID NO: 3027537 - RNA, 22 nt, Human
ucaccgaaaacguggcugcuuc

SEQ ID NO: 3027538 - RNA, 21 nt, Human
ucaccgaaaacguggcugcuu

SEQ ID NO: 3027539 - RNA, 20 nt, Human
ucaccgaaaacguggcugcu

SEQ ID NO: 3027540 - RNA, 19 nt, Human
ucaccgaaaacguggcugc

SEQ ID NO: 3027541 - RNA, 15 nt, Human
ucaccgaaaacgugg

SEQ ID NO: 3027542 - RNA, 19 nt, Human
ucacccgcuaagagggagg

SEQ ID NO: 3027543 - RNA, 14 nt, Human
ucaccgaaaacgug

SEQ ID NO: 3027544 - RNA, 12 nt, Human
ucacccuuuucu

SEQ ID NO: 3027545 - RNA, 18 nt, Human
ucacccgcuaagagggag

SEQ ID NO: 3027546 - RNA, 16 nt, Human
ucaccacaugugcaca

SEQ ID NO: 3027547 - RNA, 13 nt, Human
ucaccaagcccag

SEQ ID NO: 3027548 - RNA, 14 nt, Human
ucacauuuauucug

SEQ ID NO: 3027549 - RNA, 21 nt, Human
ucaccaaaucagcugcuacua

SEQ ID NO: 3027550 - RNA, 18 nt, Human
ucaccaacgucugugcca

SEQ ID NO: 3027551 - RNA, 17 nt, Human
ucaccaacgucugugcc

SEQ ID NO: 3027552 - RNA, 14 nt, Human
guggaaaauaacuc

SEQ ID NO: 3027553 - RNA, 18 nt, Human
guggaaaaauagccugcc

SEQ ID NO: 3027554 - RNA, 13 nt, Human
gugcuuggcccag

SEQ ID NO: 3027555 - RNA, 14 nt, Human
gugcuuggcccagg

SEQ ID NO: 3027556 - RNA, 15 nt, Human
gugcuuggcccagga

SEQ ID NO: 3027557 - RNA, 16 nt, Human
gugcuuggcccaggag

SEQ ID NO: 3027558 - RNA, 17 nt, Human
gugcuuggcccaggagu

SEQ ID NO: 3027559 - RNA, 19 nt, Human
gugcuuggcccaggaguuu

SEQ ID NO: 3027560 - RNA, 24 nt, Human
gugcuuggcccaggaguuuggcca

SEQ ID NO: 3027561 - RNA, 22 nt, Human
gugcugccauccagguucagcu

SEQ ID NO: 3027562 - RNA, 11 nt, Human
gugcugcccug

SEQ ID NO: 3027563 - RNA, 12 nt, Human
gugcuuggagga

SEQ ID NO: 3027564 - RNA, 15 nt, Human
gugcuuggaggaagg

SEQ ID NO: 3027565 - RNA, 13 nt, Human
gugcuuggaggaa

SEQ ID NO: 3027566 - RNA, 12 nt, Human
gugcugcauuua

SEQ ID NO: 3027567 - RNA, 19 nt, Human
gugcugcauuuaaaagaua

SEQ ID NO: 3027568 - RNA, 20 nt, Human
gugcugcauuuaaaagauac

SEQ ID NO: 3027569 - RNA, 15 nt, Human
gugcugccauccagg

SEQ ID NO: 3027570 - RNA, 18 nt, Human
gugcugccauccagguuc

SEQ ID NO: 3027571 - RNA, 19 nt, Human
gugcugccauccagguuca

SEQ ID NO: 3027572 - RNA, 12 nt, Human
gugcugagucug

SEQ ID NO: 3027573 - RNA, 19 nt, Human
gugcugagucugaaggcug

SEQ ID NO: 3027574 - RNA, 18 nt, Human
gugcugagucugaaggcu

SEQ ID NO: 3027575 - RNA, 17 nt, Human
gugcugagucugaaggc

SEQ ID NO: 3027576 - RNA, 16 nt, Human
gugcugagucugaagg

SEQ ID NO: 3027577 - RNA, 15 nt, Human
gugcucuggacaggc

SEQ ID NO: 3027578 - RNA, 16 nt, Human
gugcucuggacaggca

SEQ ID NO: 3027579 - RNA, 21 nt, Human
gugccuuggggacaagagcag

SEQ ID NO: 3027580 - RNA, 17 nt, Human
gugcucuggacaggcau

SEQ ID NO: 3027581 - RNA, 18 nt, Human
gugcucuggacaggcaug

SEQ ID NO: 3027582 - RNA, 19 nt, Human
gugcugaaugguuuucaaa

SEQ ID NO: 3027583 - RNA, 20 nt, Human
gugcugaaugguuuucaaaa

SEQ ID NO: 3027584 - RNA, 23 nt, Human
gugcugaaugguuuucaaaauaa

SEQ ID NO: 3027585 - RNA, 20 nt, Human
guggagaagcggcuggcagc

SEQ ID NO: 3027586 - RNA, 16 nt, Human
guggaugccugguggc

SEQ ID NO: 3027587 - RNA, 18 nt, Human
guggaugccugguggcag

SEQ ID NO: 3027588 - RNA, 17 nt, Human
guggaguucaucuugaa

SEQ ID NO: 3027589 - RNA, 15 nt, Human
guggcagugggagcu

SEQ ID NO: 3027590 - RNA, 16 nt, Human
guggcagugggagcug

SEQ ID NO: 3027591 - RNA, 17 nt, Human
guggcagugggagcugc

SEQ ID NO: 3027592 - RNA, 19 nt, Human
guggcagcugcgguccacc

SEQ ID NO: 3027593 - RNA, 20 nt, Human
guggaugccugguggcagcu

SEQ ID NO: 3027594 - RNA, 21 nt, Human
guggcagcugcgguccaccca

SEQ ID NO: 3027595 - RNA, 22 nt, Human
guggcagcugcgguccacccag

SEQ ID NO: 3027596 - RNA, 23 nt, Human
guggcagcugcgguccacccagg

SEQ ID NO: 3027597 - RNA, 12 nt, Human
guggcagcugcu

SEQ ID NO: 3027598 - RNA, 13 nt, Human
guggcagcugcuu

SEQ ID NO: 3027599 - RNA, 19 nt, Human
guggcagcugcuuuugucu

SEQ ID NO: 3027600 - RNA, 19 nt, Human
guggcagugggagcugccu

SEQ ID NO: 3027601 - RNA, 21 nt, Human
guggcagugggagcugccugu

SEQ ID NO: 3027602 - RNA, 19 nt, Human
gugaaaggaaagagggagg

SEQ ID NO: 3027603 - RNA, 23 nt, Human
gugaaaagaaaaaugagccuggc

SEQ ID NO: 3027604 - RNA, 14 nt, Human
gugaaaagaaaaau

SEQ ID NO: 3027605 - RNA, 12 nt, Human
gugaaacuggau

SEQ ID NO: 3027606 - RNA, 15 nt, Human
gugaccucugccuga

SEQ ID NO: 3027607 - RNA, 16 nt, Human
gugacaacacuugugu

SEQ ID NO: 3027608 - RNA, 16 nt, Human
gugacugaauuucuuu

SEQ ID NO: 3027609 - RNA, 18 nt, Human
gugacugaauuucuuuug

SEQ ID NO: 3027610 - RNA, 15 nt, Human
gugacugaauuucuu

SEQ ID NO: 3027611 - RNA, 11 nt, Human
gugaggaagcc

SEQ ID NO: 3027612 - RNA, 19 nt, Human
gugaggaagccgcuggggc

SEQ ID NO: 3027613 - RNA, 16 nt, Human
gugaggaagccgcugg

SEQ ID NO: 3027614 - RNA, 13 nt, Human
gugagccacugca

SEQ ID NO: 3027615 - RNA, 17 nt, Human
gugacugaucucucgug

SEQ ID NO: 3027616 - RNA, 23 nt, Human
gugauucuccugccucagccucc

SEQ ID NO: 3027617 - RNA, 12 nt, Human
gugauuuucauu

SEQ ID NO: 3027618 - RNA, 14 nt, Human
gugauucuccugcc

SEQ ID NO: 3027619 - RNA, 16 nt, Human
gugauucuccugccuc

SEQ ID NO: 3027620 - RNA, 17 nt, Human
gugauucuccugccuca

SEQ ID NO: 3027621 - RNA, 18 nt, Human
gugauucuccugccucag

SEQ ID NO: 3027622 - RNA, 19 nt, Human
gugauucuccugccucagc

SEQ ID NO: 3027623 - RNA, 20 nt, Human
gugauucuccugccucagcc

SEQ ID NO: 3027624 - RNA, 22 nt, Human
gugauucuccugccucagccuc

SEQ ID NO: 3027625 - RNA, 20 nt, Human
gugauccucccaccucagcc

SEQ ID NO: 3027626 - RNA, 22 nt, Human
gugauccucccaccucagccuc

SEQ ID NO: 3027627 - RNA, 14 nt, Human
gugauccucccacc

SEQ ID NO: 3027628 - RNA, 15 nt, Human
gugauccucccaccu

SEQ ID NO: 3027629 - RNA, 18 nt, Human
gugauccucccaccucag

SEQ ID NO: 3027630 - RNA, 11 nt, Human
gugaggccaga

SEQ ID NO: 3027631 - RNA, 15 nt, Human
gugauccacccaccu

SEQ ID NO: 3027632 - RNA, 13 nt, Human
gugaggccagaga

SEQ ID NO: 3027633 - RNA, 18 nt, Human
gugauccacccaccucag

SEQ ID NO: 3027634 - RNA, 20 nt, Human
gugauccacccaccucagcc

SEQ ID NO: 3027635 - RNA, 20 nt, Human
gugcccacaggaucagucug

SEQ ID NO: 3027636 - RNA, 20 nt, Human
gugccagguuuuuggucuga

SEQ ID NO: 3027637 - RNA, 22 nt, Human
gugccagguuuuuggucugacc

SEQ ID NO: 3027638 - RNA, 21 nt, Human
gugcauaccacuuuuguucuu

SEQ ID NO: 3027639 - RNA, 13 nt, Human
gugcauaccacuu

SEQ ID NO: 3027640 - RNA, 14 nt, Human
gugcauaccacuuu

SEQ ID NO: 3027641 - RNA, 19 nt, Human
gugcauaaguuaacuucca

SEQ ID NO: 3027642 - RNA, 18 nt, Human
guccugucggagcccugu

SEQ ID NO: 3027643 - RNA, 20 nt, Human
guccugucggagcccugucu

SEQ ID NO: 3027644 - RNA, 21 nt, Human
guccugucggagcccugucuc

SEQ ID NO: 3027645 - RNA, 19 nt, Human
guccugggagugagcuggu

SEQ ID NO: 3027646 - RNA, 17 nt, Human
guccugggagugagcug

SEQ ID NO: 3027647 - RNA, 18 nt, Human
guccugggagugagcugg

SEQ ID NO: 3027648 - RNA, 15 nt, Human
guccugggagugagc

SEQ ID NO: 3027649 - RNA, 16 nt, Human
guccugggagugagcu

SEQ ID NO: 3027650 - RNA, 17 nt, Human
guccuggcaugggaaug

SEQ ID NO: 3027651 - RNA, 12 nt, Human
guccucccaucu

SEQ ID NO: 3027652 - RNA, 14 nt, Human
guccucccaucuca

SEQ ID NO: 3027653 - RNA, 13 nt, Human
guccucccaucuc

SEQ ID NO: 3027654 - RNA, 23 nt, Human
guccucccaucucacacaugagc

SEQ ID NO: 3027655 - RNA, 21 nt, Human
guccuauuauauucauucuuu

SEQ ID NO: 3027656 - RNA, 19 nt, Human
guccuauuauauucauucu

SEQ ID NO: 3027657 - RNA, 12 nt, Human
gucccagugccg

SEQ ID NO: 3027658 - RNA, 13 nt, Human
guccuacucugug

SEQ ID NO: 3027659 - RNA, 17 nt, Human
gucccugguggcagcuc

SEQ ID NO: 3027660 - RNA, 16 nt, Human
gucccugguggcagcu

SEQ ID NO: 3027661 - RNA, 15 nt, Human
guccuacucuguguc

SEQ ID NO: 3027662 - RNA, 23 nt, Human
guccuacucugugucaggugggg

SEQ ID NO: 3027663 - RNA, 23 nt, Human
guccuagaaauuccccacccuga

SEQ ID NO: 3027664 - RNA, 17 nt, Human
gucugauucccaagcuc

SEQ ID NO: 3027665 - RNA, 18 nt, Human
gucugauucccaagcucu

SEQ ID NO: 3027666 - RNA, 19 nt, Human
gucugauucccaagcucug

SEQ ID NO: 3027667 - RNA, 21 nt, Human
gucugaggaauccagacccgg

SEQ ID NO: 3027668 - RNA, 20 nt, Human
gucugauucccaagcucugc

SEQ ID NO: 3027669 - RNA, 21 nt, Human
gucugauucccaagcucugcu

SEQ ID NO: 3027670 - RNA, 13 nt, Human
gucugacccacug

SEQ ID NO: 3027671 - RNA, 14 nt, Human
gucugacccacugc

SEQ ID NO: 3027672 - RNA, 15 nt, Human
gucugacccacugcu

SEQ ID NO: 3027673 - RNA, 18 nt, Human
gucugaggaauccagacc

SEQ ID NO: 3027674 - RNA, 19 nt, Human
gucugaggaauccagaccc

SEQ ID NO: 3027675 - RNA, 20 nt, Human
gucucacuauguugcccagg

SEQ ID NO: 3027676 - RNA, 21 nt, Human
gucucacuauguugcccaggc

SEQ ID NO: 3027677 - RNA, 13 nt, Human
gucucacuguugc

SEQ ID NO: 3027678 - RNA, 23 nt, Human
gucucacuauguugcccaggcag

SEQ ID NO: 3027679 - RNA, 16 nt, Human
gucucacuguugccca

SEQ ID NO: 3027680 - RNA, 17 nt, Human
gucucacuguugcccag

SEQ ID NO: 3027681 - RNA, 18 nt, Human
gucucacuguugcccagg

SEQ ID NO: 3027682 - RNA, 19 nt, Human
gucucacuguugcccaggc

SEQ ID NO: 3027683 - RNA, 20 nt, Human
gucucacuguugcccaggcu

SEQ ID NO: 3027684 - RNA, 21 nt, Human
gucucacuguugcccaggcug

SEQ ID NO: 3027685 - RNA, 22 nt, Human
gucucacuguugcccaggcugg

SEQ ID NO: 3027686 - RNA, 23 nt, Human
gucucacuguugcccaggcuggc

SEQ ID NO: 3027687 - RNA, 15 nt, Human
guccuuaccagcaga

SEQ ID NO: 3027688 - RNA, 17 nt, Human
guccuuaccagcagagc

SEQ ID NO: 3027689 - RNA, 16 nt, Human
guccuuaccagcagag

SEQ ID NO: 3027690 - RNA, 15 nt, Human
gucuacacugugcug

SEQ ID NO: 3027691 - RNA, 20 nt, Human
guagagguacacuugugaau

SEQ ID NO: 3027692 - RNA, 13 nt, Human
guagagugggagc

SEQ ID NO: 3027693 - RNA, 15 nt, Human
guagagugggagcug

SEQ ID NO: 3027694 - RNA, 13 nt, Human
guauuacuucugc

SEQ ID NO: 3027695 - RNA, 14 nt, Human
guauuacuucugcu

SEQ ID NO: 3027696 - RNA, 15 nt, Human
guauuacuucugcua

SEQ ID NO: 3027697 - RNA, 14 nt, Human
guauuauaccuuuu

SEQ ID NO: 3027698 - RNA, 13 nt, Human
gucaaggcuuaga

SEQ ID NO: 3027699 - RNA, 19 nt, Human
gucaagugaaaaaggagga

SEQ ID NO: 3027700 - RNA, 18 nt, Human
gucaagugaaaaaggagg

SEQ ID NO: 3027701 - RNA, 16 nt, Human
gucaagugaaaaagga

SEQ ID NO: 3027702 - RNA, 18 nt, Human
gucaagagggucugagga

SEQ ID NO: 3027703 - RNA, 19 nt, Human
gucaagagggucugaggaa

SEQ ID NO: 3027704 - RNA, 16 nt, Human
gucaauuacaggaagu

SEQ ID NO: 3027705 - RNA, 15 nt, Human
gucaauuacaggaag

SEQ ID NO: 3027706 - RNA, 13 nt, Human
gucaauuacagga

SEQ ID NO: 3027707 - RNA, 13 nt, Human
gucaccccggcca

SEQ ID NO: 3027708 - RNA, 20 nt, Human
gucaccugaagacucauucu

SEQ ID NO: 3027709 - RNA, 14 nt, Human
guccacccaggagc

SEQ ID NO: 3027710 - RNA, 13 nt, Human
guccacccaggag

SEQ ID NO: 3027711 - RNA, 15 nt, Human
guccacccaggagcc

SEQ ID NO: 3027712 - RNA, 16 nt, Human
guccacccaggagccc

SEQ ID NO: 3027713 - RNA, 15 nt, Human
gucccacucagucca

SEQ ID NO: 3027714 - RNA, 14 nt, Human
gucccacucagucc

SEQ ID NO: 3027715 - RNA, 17 nt, Human
gucccagauacuugggg

SEQ ID NO: 3027716 - RNA, 21 nt, Human
gucauauaagauucauauuua

SEQ ID NO: 3027717 - RNA, 23 nt, Human
gguagaauguuuucaaauguucu

SEQ ID NO: 3027718 - RNA, 12 nt, Human
ggucacucuggc

SEQ ID NO: 3027719 - RNA, 12 nt, Human
ggucagagccug

SEQ ID NO: 3027720 - RNA, 22 nt, Human
ggucacucuggcagcucagaga

SEQ ID NO: 3027721 - RNA, 20 nt, Human
ggucacucuggcagcucaga

SEQ ID NO: 3027722 - RNA, 16 nt, Human
ggucacucuggcagcu

SEQ ID NO: 3027723 - RNA, 13 nt, Human
ggucagagccugc

SEQ ID NO: 3027724 - RNA, 14 nt, Human
ggucagagccugca

SEQ ID NO: 3027725 - RNA, 15 nt, Human
ggucagagccugcag

SEQ ID NO: 3027726 - RNA, 16 nt, Human
ggucagagccugcagu

SEQ ID NO: 3027727 - RNA, 22 nt, Human
ggucccaccccacacacgccag

SEQ ID NO: 3027728 - RNA, 22 nt, Human
ggucccacucaguccauagcag

SEQ ID NO: 3027729 - RNA, 12 nt, Human
ggucccacucag

SEQ ID NO: 3027730 - RNA, 14 nt, Human
ggucccacucaguc

SEQ ID NO: 3027731 - RNA, 13 nt, Human
ggucccccuucca

SEQ ID NO: 3027732 - RNA, 23 nt, Human
ggucccccuuccauggacuuugu

SEQ ID NO: 3027733 - RNA, 18 nt, Human
ggucccccuuccauggac

SEQ ID NO: 3027734 - RNA, 21 nt, Human
ggguagccacuggacugacga

SEQ ID NO: 3027735 - RNA, 23 nt, Human
ggguucccuuuuuuggcugcuga

SEQ ID NO: 3027736 - RNA, 22 nt, Human
ggguucuacccaggugcuagga

SEQ ID NO: 3027737 - RNA, 17 nt, Human
ggguucuacccaggugc

SEQ ID NO: 3027738 - RNA, 16 nt, Human
ggguuggccccugccc

SEQ ID NO: 3027739 - RNA, 19 nt, Human
ggguuggccccugcccggc

SEQ ID NO: 3027740 - RNA, 17 nt, Human
gguacccacugcucugg

SEQ ID NO: 3027741 - RNA, 16 nt, Human
gguacccacugcucug

SEQ ID NO: 3027742 - RNA, 15 nt, Human
ggguugggcuggugu

SEQ ID NO: 3027743 - RNA, 20 nt, Human
gguacuuguggacacagcuc

SEQ ID NO: 3027744 - RNA, 22 nt, Human
gguacuuguggacacagcucuu

SEQ ID NO: 3027745 - RNA, 21 nt, Human
gguacuuguggacacagcucu

SEQ ID NO: 3027746 - RNA, 14 nt, Human
ggucccugguggca

SEQ ID NO: 3027747 - RNA, 22 nt, Human
ggucucacuauguugcccaggc

SEQ ID NO: 3027748 - RNA, 22 nt, Human
ggucccugguggcagcucaccu

SEQ ID NO: 3027749 - RNA, 15 nt, Human
ggucugacccacugc

SEQ ID NO: 3027750 - RNA, 16 nt, Human
ggucugacccacugcu

SEQ ID NO: 3027751 - RNA, 21 nt, Human
ggucucacuauguugcccagg

SEQ ID NO: 3027752 - RNA, 12 nt, Human
ggucucacucug

SEQ ID NO: 3027753 - RNA, 19 nt, Human
ggucugaggaauccagacc

SEQ ID NO: 3027754 - RNA, 16 nt, Human
ggugaacuugguuccc

SEQ ID NO: 3027755 - RNA, 18 nt, Human
ggugaagugaagacaaug

SEQ ID NO: 3027756 - RNA, 16 nt, Human
ggugaccucugccuga

SEQ ID NO: 3027757 - RNA, 14 nt, Human
ggugaccucugccu

SEQ ID NO: 3027758 - RNA, 15 nt, Human
gguggcagcugcggu

SEQ ID NO: 3027759 - RNA, 23 nt, Human
gguggcagcugcgguccacccag

SEQ ID NO: 3027760 - RNA, 11 nt, Human
gguggcagcug

SEQ ID NO: 3027761 - RNA, 13 nt, Human
gguggcagcucac

SEQ ID NO: 3027762 - RNA, 12 nt, Human
gguggcagcugc

SEQ ID NO: 3027763 - RNA, 13 nt, Human
gguggcagcugcg

SEQ ID NO: 3027764 - RNA, 22 nt, Human
ggugcuaucucccccagcccca

SEQ ID NO: 3027765 - RNA, 21 nt, Human
ggugcuaucucccccagcccc

SEQ ID NO: 3027766 - RNA, 23 nt, Human
ggugcuaucucccccagccccau

SEQ ID NO: 3027767 - RNA, 15 nt, Human
ggugcgaucuggguu

SEQ ID NO: 3027768 - RNA, 14 nt, Human
gggcuucaguggca

SEQ ID NO: 3027769 - RNA, 14 nt, Human
gggcugcaccggcu

SEQ ID NO: 3027770 - RNA, 16 nt, Human
gggcugaggugggagg

SEQ ID NO: 3027771 - RNA, 13 nt, Human
gggcucugccucc

SEQ ID NO: 3027772 - RNA, 20 nt, Human
gggcucugccucccaucacc

SEQ ID NO: 3027773 - RNA, 17 nt, Human
gggcucugccucccauc

SEQ ID NO: 3027774 - RNA, 16 nt, Human
gggcucugccucccau

SEQ ID NO: 3027775 - RNA, 15 nt, Human
gggcucugccuccca

SEQ ID NO: 3027776 - RNA, 19 nt, Human
gggccuggccugagcuggg

SEQ ID NO: 3027777 - RNA, 12 nt, Human
gggccuggcuca

SEQ ID NO: 3027778 - RNA, 16 nt, Human
gggccuggcucaggug

SEQ ID NO: 3027779 - RNA, 14 nt, Human
gggccuggcucagg

SEQ ID NO: 3027780 - RNA, 18 nt, Human
gggccuggucguuuucaa

SEQ ID NO: 3027781 - RNA, 16 nt, Human
gggcgcgguggcucac

SEQ ID NO: 3027782 - RNA, 13 nt, Human
gggcucccuuccc

SEQ ID NO: 3027783 - RNA, 23 nt, Human
gggcucccuucccaccucucuca

SEQ ID NO: 3027784 - RNA, 18 nt, Human
gggcucccuucccaccuc

SEQ ID NO: 3027785 - RNA, 17 nt, Human
gggcucccuucccaccu

SEQ ID NO: 3027786 - RNA, 14 nt, Human
gggcucccuuccca

SEQ ID NO: 3027787 - RNA, 20 nt, Human
gggcuucauccuccucagau

SEQ ID NO: 3027788 - RNA, 20 nt, Human
gggcuuggggaccagagcug

SEQ ID NO: 3027789 - RNA, 19 nt, Human
gggcuucaguggcagcugc

SEQ ID NO: 3027790 - RNA, 20 nt, Human
gggcuucaguggcagcugcu

SEQ ID NO: 3027791 - RNA, 19 nt, Human
gggcuucauccuccucaga

SEQ ID NO: 3027792 - RNA, 15 nt, Human
gggcuucaguggcag

SEQ ID NO: 3027793 - RNA, 16 nt, Human
gggcuucaguggcagc

SEQ ID NO: 3027794 - RNA, 17 nt, Human
gggcuucaguggcagcu

SEQ ID NO: 3027795 - RNA, 18 nt, Human
gggcuucaguggcagcug

SEQ ID NO: 3027796 - RNA, 11 nt, Human
ggggagaaagu

SEQ ID NO: 3027797 - RNA, 21 nt, Human
gggcuuggggaccagagcugc

SEQ ID NO: 3027798 - RNA, 13 nt, Human
ggggaguggccac

SEQ ID NO: 3027799 - RNA, 17 nt, Human
ggggaucacagccucug

SEQ ID NO: 3027800 - RNA, 17 nt, Human
ggggcugggcagaggaa

SEQ ID NO: 3027801 - RNA, 16 nt, Human
ggggcugggcagagga

SEQ ID NO: 3027802 - RNA, 13 nt, Human
ggggcugggacau

SEQ ID NO: 3027803 - RNA, 23 nt, Human
gggguucccuuuuuuggcugcug

SEQ ID NO: 3027804 - RNA, 19 nt, Human
ggguacuuguggacacagc

SEQ ID NO: 3027805 - RNA, 22 nt, Human
ggguacuuguggacacagcucu

SEQ ID NO: 3027806 - RNA, 23 nt, Human
ggguacuuguggacacagcucuu

SEQ ID NO: 3027807 - RNA, 23 nt, Human
ggguagagcggagaaaggaaggg

SEQ ID NO: 3027808 - RNA, 13 nt, Human
ggguacccacugc

SEQ ID NO: 3027809 - RNA, 15 nt, Human
ggguacccacugcuc

SEQ ID NO: 3027810 - RNA, 18 nt, Human
ggguacccacugcucugg

SEQ ID NO: 3027811 - RNA, 14 nt, Human
guacacuugugaau

SEQ ID NO: 3027812 - RNA, 21 nt, Human
guacacuguuucaaacuuuac

SEQ ID NO: 3027813 - RNA, 19 nt, Human
guacacuguuucaaacuuu

SEQ ID NO: 3027814 - RNA, 20 nt, Human
guacacuguuucaaacuuua

SEQ ID NO: 3027815 - RNA, 15 nt, Human
guacacuugugaaua

SEQ ID NO: 3027816 - RNA, 16 nt, Human
guacagacaacaaacc

SEQ ID NO: 3027817 - RNA, 20 nt, Human
guacagcaaggagauuuaca

SEQ ID NO: 3027818 - RNA, 22 nt, Human
guacagagcccacgcccccacu

SEQ ID NO: 3027819 - RNA, 18 nt, Human
guacagagcccacgcccc

SEQ ID NO: 3027820 - RNA, 12 nt, Human
guacagagccca

SEQ ID NO: 3027821 - RNA, 14 nt, Human
guacauacuuuuug

SEQ ID NO: 3027822 - RNA, 13 nt, Human
guacauacuuuuu

SEQ ID NO: 3027823 - RNA, 19 nt, Human
guacauacuuuuuggguuu

SEQ ID NO: 3027824 - RNA, 15 nt, Human
guacccacugcucug

SEQ ID NO: 3027825 - RNA, 20 nt, Human
guacauaaugcgugcauacc

SEQ ID NO: 3027826 - RNA, 14 nt, Human
guaauuaaguacua

SEQ ID NO: 3027827 - RNA, 17 nt, Human
guaauuaaguacuaugu

SEQ ID NO: 3027828 - RNA, 20 nt, Human
guaauuaaguacuauguauc

SEQ ID NO: 3027829 - RNA, 21 nt, Human
guaauuaaguacuauguauca

SEQ ID NO: 3027830 - RNA, 18 nt, Human
guacacuguuucaaacuu

SEQ ID NO: 3027831 - RNA, 18 nt, Human
guacuaacauuuauuuga

SEQ ID NO: 3027832 - RNA, 14 nt, Human
guacuucuccaccc

SEQ ID NO: 3027833 - RNA, 15 nt, Human
guacuucuccacccu

SEQ ID NO: 3027834 - RNA, 17 nt, Human
guacguugugcauuugg

SEQ ID NO: 3027835 - RNA, 15 nt, Human
guacuaaggaaucuu

SEQ ID NO: 3027836 - RNA, 23 nt, Human
guacuaaggaaucuuucugcuuu

SEQ ID NO: 3027837 - RNA, 14 nt, Human
guacgucugacagg

SEQ ID NO: 3027838 - RNA, 15 nt, Human
guacgucugacaggc

SEQ ID NO: 3027839 - RNA, 17 nt, Human
guacgucugacaggcaa

SEQ ID NO: 3027840 - RNA, 14 nt, Human
guacguugugcauu

SEQ ID NO: 3027841 - RNA, 15 nt, Human
guacguugugcauuu

SEQ ID NO: 3027842 - RNA, 16 nt, Human
guacguugugcauuug

SEQ ID NO: 3027843 - RNA, 13 nt, Human
guaccucuugagc

SEQ ID NO: 3027844 - RNA, 21 nt, Human
guaccucuugagccuugaacu

SEQ ID NO: 3027845 - RNA, 22 nt, Human
guaccucuugagccuugaacuu

SEQ ID NO: 3027846 - RNA, 16 nt, Human
guacccacugcucugg

SEQ ID NO: 3027847 - RNA, 19 nt, Human
guagagguacacuugugaa

SEQ ID NO: 3027848 - RNA, 17 nt, Human
guagagguacacuugug

SEQ ID NO: 3027849 - RNA, 15 nt, Human
guagagguacacuug

SEQ ID NO: 3027850 - RNA, 16 nt, Human
guagagcggagaaagg

SEQ ID NO: 3027851 - RNA, 18 nt, Human
guagagccagggucucac

SEQ ID NO: 3027852 - RNA, 14 nt, Human
guacuuuuaagacu

SEQ ID NO: 3027853 - RNA, 21 nt, Human
guacuuguggacacagcucuu

SEQ ID NO: 3027854 - RNA, 16 nt, Human
guacuuguggacacag

SEQ ID NO: 3027855 - RNA, 20 nt, Human
guacuuguggacacagcucu

SEQ ID NO: 3027856 - RNA, 20 nt, Human
guacuucuccacccugcucu

SEQ ID NO: 3027857 - RNA, 21 nt, Human
guacuucuccacccugcucuc

SEQ ID NO: 3027858 - RNA, 16 nt, Human
guacuucuccacccug

SEQ ID NO: 3027859 - RNA, 17 nt, Human
guacuucuccacccugc

SEQ ID NO: 3027860 - RNA, 18 nt, Human
guacuucuccacccugcu

SEQ ID NO: 3027861 - RNA, 19 nt, Human
guacuucuccacccugcuc

SEQ ID NO: 3027862 - RNA, 16 nt, Human
guaaaaaaugguguuu

SEQ ID NO: 3027863 - RNA, 18 nt, Human
guaaaaaaugguguuuua

SEQ ID NO: 3027864 - RNA, 23 nt, Human
gguuuugccauguuggccaggcu

SEQ ID NO: 3027865 - RNA, 15 nt, Human
gguuuucuguucuuu

SEQ ID NO: 3027866 - RNA, 12 nt, Human
gguuuucuguuc

SEQ ID NO: 3027867 - RNA, 13 nt, Human
gguuuucuguucu

SEQ ID NO: 3027868 - RNA, 10 nt, Human
gguugugaau

SEQ ID NO: 3027869 - RNA, 13 nt, Human
gguuggugggggc

SEQ ID NO: 3027870 - RNA, 13 nt, Human
gguuuaagcuguu

SEQ ID NO: 3027871 - RNA, 14 nt, Human
gguugggcuggugu

SEQ ID NO: 3027872 - RNA, 13 nt, Human
gguggccucccaa

SEQ ID NO: 3027873 - RNA, 21 nt, Human
gguucaagcgauucuucugcu

SEQ ID NO: 3027874 - RNA, 17 nt, Human
gguggccucccaacuca

SEQ ID NO: 3027875 - RNA, 20 nt, Human
gguucacugcaaccuccgcc

SEQ ID NO: 3027876 - RNA, 22 nt, Human
gguucaagcgauucuucugcuu

SEQ ID NO: 3027877 - RNA, 23 nt, Human
gguucaagcgauucuucugcuuc

SEQ ID NO: 3027878 - RNA, 14 nt, Human
gguugaagcaccaa

SEQ ID NO: 3027879 - RNA, 22 nt, Human
guaacuguuuagaugaauguca

SEQ ID NO: 3027880 - RNA, 23 nt, Human
guaaauuaacuuuuauaaacuuu

SEQ ID NO: 3027881 - RNA, 18 nt, Human
guaaggaauaccuguccc

SEQ ID NO: 3027882 - RNA, 13 nt, Human
guaaggaaugauu

SEQ ID NO: 3027883 - RNA, 23 nt, Human
guaaggaauaccugucccccuga

SEQ ID NO: 3027884 - RNA, 21 nt, Human
guaaggaauaccugucccccu

SEQ ID NO: 3027885 - RNA, 20 nt, Human
guaaggaauaccuguccccc

SEQ ID NO: 3027886 - RNA, 22 nt, Human
guaaguauucuuauuuaaugaa

SEQ ID NO: 3027887 - RNA, 15 nt, Human
guaaauuaacuuuua

SEQ ID NO: 3027888 - RNA, 16 nt, Human
guaaauuaacuuuuau

SEQ ID NO: 3027889 - RNA, 17 nt, Human
guaaauuaacuuuuaua

SEQ ID NO: 3027890 - RNA, 21 nt, Human
guaaauuaacuuuuauaaacu

SEQ ID NO: 3027891 - RNA, 22 nt, Human
guaaauuaacuuuuauaaacuu

SEQ ID NO: 3027892 - RNA, 18 nt, Human
guaaaugggggugcauuu

SEQ ID NO: 3027893 - RNA, 19 nt, Human
guaaaugggggugcauuug

SEQ ID NO: 3027894 - RNA, 20 nt, Human
guaaaugggggugcauuuga

SEQ ID NO: 3027895 - RNA, 16 nt, Human
gcugccaauauccuaa

SEQ ID NO: 3027896 - RNA, 17 nt, Human
gcugccaauauccuaau

SEQ ID NO: 3027897 - RNA, 18 nt, Human
gcugccaauauccuaaua

SEQ ID NO: 3027898 - RNA, 19 nt, Human
gcugccaauauccuaauaa

SEQ ID NO: 3027899 - RNA, 14 nt, Human
gcugccaauauccu

SEQ ID NO: 3027900 - RNA, 15 nt, Human
gcugccaauauccua

SEQ ID NO: 3027901 - RNA, 13 nt, Human
gcugcaguuuuuu

SEQ ID NO: 3027902 - RNA, 17 nt, Human
gcugcaguugccaguca

SEQ ID NO: 3027903 - RNA, 21 nt, Human
gcugcaguugccagucacccc

SEQ ID NO: 3027904 - RNA, 20 nt, Human
gcugcaguugccagucaccc

SEQ ID NO: 3027905 - RNA, 18 nt, Human
gcugcaguugccagucac

SEQ ID NO: 3027906 - RNA, 21 nt, Human
gcugauggugcaaugaccuuu

SEQ ID NO: 3027907 - RNA, 18 nt, Human
gcugauggugcaaugacc

SEQ ID NO: 3027908 - RNA, 23 nt, Human
gcugagugggggaucacagccuc

SEQ ID NO: 3027909 - RNA, 22 nt, Human
gcugagugggggaucacagccu

SEQ ID NO: 3027910 - RNA, 16 nt, Human
gcugauggugcaauga

SEQ ID NO: 3027911 - RNA, 15 nt, Human
gcugauggugcaaug

SEQ ID NO: 3027912 - RNA, 15 nt, Human
gcugagucugaaggc

SEQ ID NO: 3027913 - RNA, 18 nt, Human
gcugagucugaaggcugg

SEQ ID NO: 3027914 - RNA, 16 nt, Human
gcugagucugaaggcu

SEQ ID NO: 3027915 - RNA, 19 nt, Human
gcugagucugaaggcuggg

SEQ ID NO: 3027916 - RNA, 21 nt, Human
gcugacagacacaggcccggc

SEQ ID NO: 3027917 - RNA, 20 nt, Human
gcugacagacacaggcccgg

SEQ ID NO: 3027918 - RNA, 22 nt, Human
gcucuuccaggcugggagagcc

SEQ ID NO: 3027919 - RNA, 12 nt, Human
gcucuucuccag

SEQ ID NO: 3027920 - RNA, 18 nt, Human
gcucuuccaggcugggag

SEQ ID NO: 3027921 - RNA, 19 nt, Human
gcucuuccaggcugggaga

SEQ ID NO: 3027922 - RNA, 14 nt, Human
gcucuucuccaggc

SEQ ID NO: 3027923 - RNA, 16 nt, Human
gcucuucuccaggcug

SEQ ID NO: 3027924 - RNA, 14 nt, Human
gcucuggacaggca

SEQ ID NO: 3027925 - RNA, 15 nt, Human
gcucuggacaggcau

SEQ ID NO: 3027926 - RNA, 16 nt, Human
gcucuggacaggcaug

SEQ ID NO: 3027927 - RNA, 21 nt, Human
gcucuggacaggcauguucuc

SEQ ID NO: 3027928 - RNA, 22 nt, Human
gcucuggacaggcauguucucu

SEQ ID NO: 3027929 - RNA, 19 nt, Human
gcucugcuccucuccccag

SEQ ID NO: 3027930 - RNA, 21 nt, Human
gcucugcuccucuccccagca

SEQ ID NO: 3027931 - RNA, 13 nt, Human
gcucugcugacag

SEQ ID NO: 3027932 - RNA, 14 nt, Human
gcucugcugacaga

SEQ ID NO: 3027933 - RNA, 18 nt, Human
gcucugcugacagacaca

SEQ ID NO: 3027934 - RNA, 19 nt, Human
gcucugcugacagacacag

SEQ ID NO: 3027935 - RNA, 20 nt, Human
gcucugcugacagacacagg

SEQ ID NO: 3027936 - RNA, 23 nt, Human
gcucugcugacagacacaggccc

SEQ ID NO: 3027937 - RNA, 13 nt, Human
gcucugcuccucu

SEQ ID NO: 3027938 - RNA, 14 nt, Human
gcucugcuccucuc

SEQ ID NO: 3027939 - RNA, 22 nt, Human
gcucugccucccaucacccgcu

SEQ ID NO: 3027940 - RNA, 15 nt, Human
gcucugccucccauc

SEQ ID NO: 3027941 - RNA, 14 nt, Human
gcucugccucccau

SEQ ID NO: 3027942 - RNA, 13 nt, Human
gcucugccuccca

SEQ ID NO: 3027943 - RNA, 14 nt, Human
gcucugcccuuggu

SEQ ID NO: 3027944 - RNA, 13 nt, Human
gcucugcccuugg

SEQ ID NO: 3027945 - RNA, 11 nt, Human
gcucugccucc

SEQ ID NO: 3027946 - RNA, 23 nt, Human
gcucugcccuugguuaggcauug

SEQ ID NO: 3027947 - RNA, 16 nt, Human
gcucgagcaugccugg

SEQ ID NO: 3027948 - RNA, 15 nt, Human
gcucccuucccaccu

SEQ ID NO: 3027949 - RNA, 18 nt, Human
gcucccuucccaccucuc

SEQ ID NO: 3027950 - RNA, 16 nt, Human
gcucccuucccaccuc

SEQ ID NO: 3027951 - RNA, 15 nt, Human
gcuccuucuguccua

SEQ ID NO: 3027952 - RNA, 21 nt, Human
gcuccuucuguccuacucugu

SEQ ID NO: 3027953 - RNA, 19 nt, Human
gcucuccgaccagacaccu

SEQ ID NO: 3027954 - RNA, 13 nt, Human
gcucuccgaccag

SEQ ID NO: 3027955 - RNA, 17 nt, Human
gcucuccgaccagacac

SEQ ID NO: 3027956 - RNA, 19 nt, Human
gcucaccccaucaucccuu

SEQ ID NO: 3027957 - RNA, 17 nt, Human
gcucaccccaucauccc

SEQ ID NO: 3027958 - RNA, 20 nt, Human
gcucaccagccccagugccc

SEQ ID NO: 3027959 - RNA, 23 nt, Human
gcucaccagccccagugcccaca

SEQ ID NO: 3027960 - RNA, 18 nt, Human
gcucaccagccccagugc

SEQ ID NO: 3027961 - RNA, 19 nt, Human
gcucaccagccccagugcc

SEQ ID NO: 3027962 - RNA, 23 nt, Human
gcucagcaaaagaugcuucucac

SEQ ID NO: 3027963 - RNA, 22 nt, Human
gcucagcaaaagaugcuucuca

SEQ ID NO: 3027964 - RNA, 20 nt, Human
gcucagcaaaagaugcuucu

SEQ ID NO: 3027965 - RNA, 17 nt, Human
gcucagcaaaagaugcu

SEQ ID NO: 3027966 - RNA, 19 nt, Human
gcucaggugucccugcacu

SEQ ID NO: 3027967 - RNA, 21 nt, Human
gcucagcggggacagcuccuu

SEQ ID NO: 3027968 - RNA, 22 nt, Human
gcucagcggggacagcuccuuc

SEQ ID NO: 3027969 - RNA, 18 nt, Human
gcucaggugucccugcac

SEQ ID NO: 3027970 - RNA, 17 nt, Human
gcucaggugucccugca

SEQ ID NO: 3027971 - RNA, 20 nt, Human
gcucagcggggacagcuccu

SEQ ID NO: 3027972 - RNA, 19 nt, Human
gcucagcggggacagcucc

SEQ ID NO: 3027973 - RNA, 15 nt, Human
gcucagcggggacag

SEQ ID NO: 3027974 - RNA, 13 nt, Human
gcuccaagcuccc

SEQ ID NO: 3027975 - RNA, 15 nt, Human
gcuccaagcucccag

SEQ ID NO: 3027976 - RNA, 14 nt, Human
gcuccaagcuccca

SEQ ID NO: 3027977 - RNA, 21 nt, Human
gcuccaagcucccaggcauuc

SEQ ID NO: 3027978 - RNA, 19 nt, Human
gcuccaagcucccaggcau

SEQ ID NO: 3027979 - RNA, 18 nt, Human
gcuccaagcucccaggca

SEQ ID NO: 3027980 - RNA, 17 nt, Human
gcuccaagcucccaggc

SEQ ID NO: 3027981 - RNA, 16 nt, Human
gcuccaagcucccagg

SEQ ID NO: 3027982 - RNA, 13 nt, Human
gcuccaggcuccu

SEQ ID NO: 3027983 - RNA, 11 nt, Human
gcuccagcugu

SEQ ID NO: 3027984 - RNA, 16 nt, Human
gcuccaggcuccuuua

SEQ ID NO: 3027985 - RNA, 23 nt, Human
gcuccaggcuccuuuagcgccca

SEQ ID NO: 3027986 - RNA, 16 nt, Human
gcuaaaugugaaugau

SEQ ID NO: 3027987 - RNA, 13 nt, Human
gcuaaaugugaau

SEQ ID NO: 3027988 - RNA, 22 nt, Human
gcuaagagggagggagggcucc

SEQ ID NO: 3027989 - RNA, 21 nt, Human
gcuaagagggagggagggcuc

SEQ ID NO: 3027990 - RNA, 16 nt, Human
gcgugagccacugcac

SEQ ID NO: 3027991 - RNA, 18 nt, Human
gcgugagccacugcaccg

SEQ ID NO: 3027992 - RNA, 23 nt, Human
gcgugagccacugcaccgggcca

SEQ ID NO: 3027993 - RNA, 18 nt, Human
gcgguccacccaggagcc

SEQ ID NO: 3027994 - RNA, 19 nt, Human
gcgguccacccaggagccc

SEQ ID NO: 3027995 - RNA, 12 nt, Human
gcggggacagcu

SEQ ID NO: 3027996 - RNA, 15 nt, Human
gcgggcuuccuccug

SEQ ID NO: 3027997 - RNA, 13 nt, Human
gcggggacagcuc

SEQ ID NO: 3027998 - RNA, 16 nt, Human
gcgguccacccaggag

SEQ ID NO: 3027999 - RNA, 15 nt, Human
gcuaucucccccagc

SEQ ID NO: 3028000 - RNA, 23 nt, Human
gcuaucucccccagccccauccu

SEQ ID NO: 3028001 - RNA, 22 nt, Human
gcuaucucccccagccccaucc

SEQ ID NO: 3028002 - RNA, 21 nt, Human
gcuaucucccccagccccauc

SEQ ID NO: 3028003 - RNA, 20 nt, Human
gcuaucucccccagccccau

SEQ ID NO: 3028004 - RNA, 19 nt, Human
gcuaucucccccagcccca

SEQ ID NO: 3028005 - RNA, 22 nt, Human
gcuagcagcagggagggcuucu

SEQ ID NO: 3028006 - RNA, 18 nt, Human
gcuaucucccccagcccc

SEQ ID NO: 3028007 - RNA, 17 nt, Human
gcuaucucccccagccc

SEQ ID NO: 3028008 - RNA, 16 nt, Human
gcuaucucccccagcc

SEQ ID NO: 3028009 - RNA, 20 nt, Human
gcuaccuuuguauucucucc

SEQ ID NO: 3028010 - RNA, 21 nt, Human
gcuacccgggaagggggcugg

SEQ ID NO: 3028011 - RNA, 19 nt, Human
gcuagagguucaaagauau

SEQ ID NO: 3028012 - RNA, 21 nt, Human
gcuagagguucaaagauauuu

SEQ ID NO: 3028013 - RNA, 18 nt, Human
gcuagagguucaaagaua

SEQ ID NO: 3028014 - RNA, 15 nt, Human
gcuacccgggaaggg

SEQ ID NO: 3028015 - RNA, 14 nt, Human
gcuacccgggaagg

SEQ ID NO: 3028016 - RNA, 23 nt, Human
gcuaagagggagggagggcucca

SEQ ID NO: 3028017 - RNA, 18 nt, Human
gccuaauaugaugacugu

SEQ ID NO: 3028018 - RNA, 19 nt, Human
gccgagauagccaaggcca

SEQ ID NO: 3028019 - RNA, 14 nt, Human
gccucaaccuccug

SEQ ID NO: 3028020 - RNA, 16 nt, Human
gccucaaccuccuggg

SEQ ID NO: 3028021 - RNA, 19 nt, Human
gccucaagugauucuccug

SEQ ID NO: 3028022 - RNA, 20 nt, Human
gccucaagugauucuccugc

SEQ ID NO: 3028023 - RNA, 21 nt, Human
gccucaagugauucuccugcc

SEQ ID NO: 3028024 - RNA, 12 nt, Human
gccucagugcca

SEQ ID NO: 3028025 - RNA, 14 nt, Human
gccucagugccacu

SEQ ID NO: 3028026 - RNA, 23 nt, Human
gccucagccucccaaagugcugg

SEQ ID NO: 3028027 - RNA, 21 nt, Human
gccucacaguccuuaccagca

SEQ ID NO: 3028028 - RNA, 23 nt, Human
gccucccgaauagcugggacuac

SEQ ID NO: 3028029 - RNA, 15 nt, Human
gccucccgaguagcu

SEQ ID NO: 3028030 - RNA, 15 nt, Human
gccucagugccacua

SEQ ID NO: 3028031 - RNA, 21 nt, Human
gccucccaacucaccccagcc

SEQ ID NO: 3028032 - RNA, 23 nt, Human
gccucccaacucaccccagcccc

SEQ ID NO: 3028033 - RNA, 22 nt, Human
gccucccaacucaccccagccc

SEQ ID NO: 3028034 - RNA, 21 nt, Human
gccucccgaauagcugggacu

SEQ ID NO: 3028035 - RNA, 14 nt, Human
gccucccacgacug

SEQ ID NO: 3028036 - RNA, 21 nt, Human
gccucccacgacugcccggca

SEQ ID NO: 3028037 - RNA, 20 nt, Human
gccugggggcugggcagagg

SEQ ID NO: 3028038 - RNA, 17 nt, Human
gccugggcagaaggaag

SEQ ID NO: 3028039 - RNA, 16 nt, Human
gccugggcagaaggaa

SEQ ID NO: 3028040 - RNA, 18 nt, Human
gccugggcagaaggaaga

SEQ ID NO: 3028041 - RNA, 15 nt, Human
gccugggcagaagga

SEQ ID NO: 3028042 - RNA, 14 nt, Human
gccuggccagaugc

SEQ ID NO: 3028043 - RNA, 15 nt, Human
gccuggccagaugca

SEQ ID NO: 3028044 - RNA, 22 nt, Human
gccuggccagaugcaccagccc

SEQ ID NO: 3028045 - RNA, 14 nt, Human
gccuggauggggcu

SEQ ID NO: 3028046 - RNA, 15 nt, Human
gccuggauggggcug

SEQ ID NO: 3028047 - RNA, 22 nt, Human
gccugaagucacacagugaguc

SEQ ID NO: 3028048 - RNA, 18 nt, Human
gccucugccucugacaca

SEQ ID NO: 3028049 - RNA, 18 nt, Human
gccugcuccagcuguuca

SEQ ID NO: 3028050 - RNA, 16 nt, Human
gccugcuccagcuguu

SEQ ID NO: 3028051 - RNA, 15 nt, Human
gccugcuccagcugu

SEQ ID NO: 3028052 - RNA, 14 nt, Human
gcccuuuuucaaua

SEQ ID NO: 3028053 - RNA, 16 nt, Human
gccgagaucacgccac

SEQ ID NO: 3028054 - RNA, 18 nt, Human
gccgagaucacgccacug

SEQ ID NO: 3028055 - RNA, 19 nt, Human
gccgagaucacgccacugc

SEQ ID NO: 3028056 - RNA, 17 nt, Human
gccgagauugcaccacu

SEQ ID NO: 3028057 - RNA, 18 nt, Human
gccgagauugcaccacug

SEQ ID NO: 3028058 - RNA, 22 nt, Human
gcccuucucuccagccccugga

SEQ ID NO: 3028059 - RNA, 21 nt, Human
gcccuucucuccagccccugg

SEQ ID NO: 3028060 - RNA, 19 nt, Human
gcccuucucuccagccccu

SEQ ID NO: 3028061 - RNA, 14 nt, Human
gcccugguggcagu

SEQ ID NO: 3028062 - RNA, 17 nt, Human
gcccugguggcaguggg

SEQ ID NO: 3028063 - RNA, 18 nt, Human
gcccugguggcaguggga

SEQ ID NO: 3028064 - RNA, 19 nt, Human
gcccugguggcagugggag

SEQ ID NO: 3028065 - RNA, 20 nt, Human
gcccugguggcagugggagc

SEQ ID NO: 3028066 - RNA, 21 nt, Human
gcccugguggcagugggagcu

SEQ ID NO: 3028067 - RNA, 22 nt, Human
gcccugguggcagugggagcug

SEQ ID NO: 3028068 - RNA, 23 nt, Human
gcccugguggcagugggagcugc

SEQ ID NO: 3028069 - RNA, 16 nt, Human
gcccggcuccaggcuc

SEQ ID NO: 3028070 - RNA, 13 nt, Human
gccccugccaccc

SEQ ID NO: 3028071 - RNA, 14 nt, Human
gccccugccacccu

SEQ ID NO: 3028072 - RNA, 15 nt, Human
gccccugccacccug

SEQ ID NO: 3028073 - RNA, 17 nt, Human
gccccuguucuggcaga

SEQ ID NO: 3028074 - RNA, 21 nt, Human
gccccuguucuggcagaguug

SEQ ID NO: 3028075 - RNA, 15 nt, Human
gcagacucuacagag

SEQ ID NO: 3028076 - RNA, 17 nt, Human
gcccggcuccaggcucc

SEQ ID NO: 3028077 - RNA, 18 nt, Human
gcccggcuccaggcuccu

SEQ ID NO: 3028078 - RNA, 14 nt, Human
gcccugagcuuucu

SEQ ID NO: 3028079 - RNA, 16 nt, Human
gcccugagcuuucugc

SEQ ID NO: 3028080 - RNA, 12 nt, Human
gcccucugccca

SEQ ID NO: 3028081 - RNA, 20 nt, Human
gcugccaauauccuaauaaa

SEQ ID NO: 3028082 - RNA, 21 nt, Human
gcugccaauauccuaauaaaa

SEQ ID NO: 3028083 - RNA, 15 nt, Human
gcugccaaugggagc

SEQ ID NO: 3028084 - RNA, 19 nt, Human
gcugccaaugggagcucau

SEQ ID NO: 3028085 - RNA, 16 nt, Human
gcugccaaugggagcu

SEQ ID NO: 3028086 - RNA, 23 nt, Human
gcugccaauauccuaauaaaaag

SEQ ID NO: 3028087 - RNA, 13 nt, Human
gcuguucagcugg

SEQ ID NO: 3028088 - RNA, 14 nt, Human
gcuguucagcuggu

SEQ ID NO: 3028089 - RNA, 21 nt, Human
gcuuaggagaagucuucuauu

SEQ ID NO: 3028090 - RNA, 17 nt, Human
gcuuagucacugagaca

SEQ ID NO: 3028091 - RNA, 15 nt, Human
gcuuagucacugaga

SEQ ID NO: 3028092 - RNA, 20 nt, Human
gcuuagucacugagacagcc

SEQ ID NO: 3028093 - RNA, 19 nt, Human
gcuuagucacugagacagc

SEQ ID NO: 3028094 - RNA, 21 nt, Human
gcuuagucacugagacagccc

SEQ ID NO: 3028095 - RNA, 16 nt, Human
gcuucaguggcagcug

SEQ ID NO: 3028096 - RNA, 15 nt, Human
gcuucaguggcagcu

SEQ ID NO: 3028097 - RNA, 19 nt, Human
gcuuaucucaggggugugc

SEQ ID NO: 3028098 - RNA, 13 nt, Human
gcuuaucucaggg

SEQ ID NO: 3028099 - RNA, 12 nt, Human
gcuuauacacuu

SEQ ID NO: 3028100 - RNA, 17 nt, Human
gcuucaguggcagcugc

SEQ ID NO: 3028101 - RNA, 18 nt, Human
gcuucaguggcagcugcu

SEQ ID NO: 3028102 - RNA, 13 nt, Human
gcuucauuuccug

SEQ ID NO: 3028103 - RNA, 16 nt, Human
gcuucauuuccugugu

SEQ ID NO: 3028104 - RNA, 15 nt, Human
gcuucauccuccuca

SEQ ID NO: 3028105 - RNA, 12 nt, Human
gcuucauccucc

SEQ ID NO: 3028106 - RNA, 16 nt, Human
gcuugaggguugggcu

SEQ ID NO: 3028107 - RNA, 15 nt, Human
gcuuccagugaggcu

SEQ ID NO: 3028108 - RNA, 17 nt, Human
gcuucauuuccuguguc

SEQ ID NO: 3028109 - RNA, 16 nt, Human
gcuuccagugaggcuc

SEQ ID NO: 3028110 - RNA, 23 nt, Human
ggaaagggauuuucagcccucag

SEQ ID NO: 3028111 - RNA, 22 nt, Human
ggaaaggcuccaggagcagcca

SEQ ID NO: 3028112 - RNA, 21 nt, Human
ggaaaggcuccaggagcagcc

SEQ ID NO: 3028113 - RNA, 20 nt, Human
ggaaaggcuccaggagcagc

SEQ ID NO: 3028114 - RNA, 19 nt, Human
ggaaaggcuccaggagcag

SEQ ID NO: 3028115 - RNA, 17 nt, Human
ggaaaggcuccaggagc

SEQ ID NO: 3028116 - RNA, 12 nt, Human
ggaaaggcucca

SEQ ID NO: 3028117 - RNA, 14 nt, Human
ggaaaggcuccagg

SEQ ID NO: 3028118 - RNA, 13 nt, Human
ggaaaggcuccag

SEQ ID NO: 3028119 - RNA, 19 nt, Human
ggaaaaucagccugcucca

SEQ ID NO: 3028120 - RNA, 23 nt, Human
ggaaaaucagccugcuccagcug

SEQ ID NO: 3028121 - RNA, 21 nt, Human
ggaaaucaccgaaaacguggc

SEQ ID NO: 3028122 - RNA, 14 nt, Human
ggaaaucaccgaaa

SEQ ID NO: 3028123 - RNA, 16 nt, Human
ggaacaggaaacugau

SEQ ID NO: 3028124 - RNA, 18 nt, Human
gcuugaggguugggcugg

SEQ ID NO: 3028125 - RNA, 20 nt, Human
gcuugaggguugggcuggug

SEQ ID NO: 3028126 - RNA, 15 nt, Human
gcuuugugauuuuug

SEQ ID NO: 3028127 - RNA, 21 nt, Human
gcuuuguuuguugucagcuga

SEQ ID NO: 3028128 - RNA, 18 nt, Human
ggaaaacaugcuacacac

SEQ ID NO: 3028129 - RNA, 14 nt, Human
ggaaaagcugcuga

SEQ ID NO: 3028130 - RNA, 18 nt, Human
ggaaaagcugcugacagu

SEQ ID NO: 3028131 - RNA, 20 nt, Human
ggaaaagcugcugacagugu

SEQ ID NO: 3028132 - RNA, 13 nt, Human
ggaaugcaaagau

SEQ ID NO: 3028133 - RNA, 12 nt, Human
ggaaugcagugg

SEQ ID NO: 3028134 - RNA, 24 nt, Human
ggaaugauuaauuaaaacacaaca

SEQ ID NO: 3028135 - RNA, 19 nt, Human
ggaauguuugccucugccu

SEQ ID NO: 3028136 - RNA, 23 nt, Human
ggaaggggagauaaggguaucug

SEQ ID NO: 3028137 - RNA, 18 nt, Human
ggaaguacuggagaaaau

SEQ ID NO: 3028138 - RNA, 16 nt, Human
ggaaguacuggagaaa

SEQ ID NO: 3028139 - RNA, 12 nt, Human
ggaaguacugga

SEQ ID NO: 3028140 - RNA, 14 nt, Human
ggaaugauuaauua

SEQ ID NO: 3028141 - RNA, 18 nt, Human
ggagaagcggcuggcagc

SEQ ID NO: 3028142 - RNA, 17 nt, Human
ggagaagcggcuggcag

SEQ ID NO: 3028143 - RNA, 13 nt, Human
ggaccagagcugc

SEQ ID NO: 3028144 - RNA, 23 nt, Human
ggaccucaggugagaagcagagg

SEQ ID NO: 3028145 - RNA, 20 nt, Human
ggaccucaggccugggggcu

SEQ ID NO: 3028146 - RNA, 19 nt, Human
ggaccucaggugagaagca

SEQ ID NO: 3028147 - RNA, 15 nt, Human
ggaccuugaacuggg

SEQ ID NO: 3028148 - RNA, 17 nt, Human
ggaccuugaacugggua

SEQ ID NO: 3028149 - RNA, 17 nt, Human
ggacgcuacccgggaag

SEQ ID NO: 3028150 - RNA, 20 nt, Human
ggacgcuacccgggaagggg

SEQ ID NO: 3028151 - RNA, 19 nt, Human
ggacgcuacccgggaaggg

SEQ ID NO: 3028152 - RNA, 17 nt, Human
ggacacucaaaagcugg

SEQ ID NO: 3028153 - RNA, 15 nt, Human
ggacagccacggcca

SEQ ID NO: 3028154 - RNA, 19 nt, Human
ggacagccacggccaggcc

SEQ ID NO: 3028155 - RNA, 20 nt, Human
ggacagccacggccaggcca

SEQ ID NO: 3028156 - RNA, 21 nt, Human
ggacagccacggccaggccag

SEQ ID NO: 3028157 - RNA, 14 nt, Human
ggacauggacaagg

SEQ ID NO: 3028158 - RNA, 20 nt, Human
ggacauugcggacagccacg

SEQ ID NO: 3028159 - RNA, 13 nt, Human
ggauacuuauuua

SEQ ID NO: 3028160 - RNA, 18 nt, Human
ggauacaaaagcauguga

SEQ ID NO: 3028161 - RNA, 14 nt, Human
ggagugcagugagc

SEQ ID NO: 3028162 - RNA, 12 nt, Human
ggagugcaguga

SEQ ID NO: 3028163 - RNA, 23 nt, Human
ggagugaguugauagcacagacc

SEQ ID NO: 3028164 - RNA, 17 nt, Human
ggaucccucauccucau

SEQ ID NO: 3028165 - RNA, 13 nt, Human
ggaucccucaucc

SEQ ID NO: 3028166 - RNA, 22 nt, Human
ggaucccucauccucauaccca

SEQ ID NO: 3028167 - RNA, 19 nt, Human
ggaugcagccucacagucc

SEQ ID NO: 3028168 - RNA, 15 nt, Human
ggaugcuuguacaua

SEQ ID NO: 3028169 - RNA, 19 nt, Human
ggauuacaagcgugagcca

SEQ ID NO: 3028170 - RNA, 17 nt, Human
ggaugcagccucacagu

SEQ ID NO: 3028171 - RNA, 16 nt, Human
ggaugcagccucacag

SEQ ID NO: 3028172 - RNA, 21 nt, Human
ggaugauuggaggggggaggu

SEQ ID NO: 3028173 - RNA, 23 nt, Human
ggaugcacagaguuguuacauuu

SEQ ID NO: 3028174 - RNA, 13 nt, Human
ggauccuccaggu

SEQ ID NO: 3028175 - RNA, 12 nt, Human
ggauccuccagg

SEQ ID NO: 3028176 - RNA, 16 nt, Human
ggauucuuauggacaa

SEQ ID NO: 3028177 - RNA, 23 nt, Human
ggauuacaagcgugagccacugc

SEQ ID NO: 3028178 - RNA, 17 nt, Human
ggauugcuacuguccua

SEQ ID NO: 3028179 - RNA, 16 nt, Human
ggcaacccccagccug

SEQ ID NO: 3028180 - RNA, 17 nt, Human
ggcaacccccagccugc

SEQ ID NO: 3028181 - RNA, 14 nt, Human
ggcaaugcuggcug

SEQ ID NO: 3028182 - RNA, 15 nt, Human
ggcaaugcuggcugu

SEQ ID NO: 3028183 - RNA, 23 nt, Human
ggcaaugcuggcuguuggcuggg

SEQ ID NO: 3028184 - RNA, 18 nt, Human
ggcaacccccagccugcu

SEQ ID NO: 3028185 - RNA, 20 nt, Human
ggcacccaccaucaugucug

SEQ ID NO: 3028186 - RNA, 23 nt, Human
ggcacccaccaucaugucuggcu

SEQ ID NO: 3028187 - RNA, 22 nt, Human
ggcacccggccccugcugguuc

SEQ ID NO: 3028188 - RNA, 15 nt, Human
ggcaugaagacagau

SEQ ID NO: 3028189 - RNA, 18 nt, Human
ggcaugacacgaauauug

SEQ ID NO: 3028190 - RNA, 19 nt, Human
ggcagggucucacucuguc

SEQ ID NO: 3028191 - RNA, 20 nt, Human
ggcagggucucacucugucg

SEQ ID NO: 3028192 - RNA, 13 nt, Human
ggcagugggagcu

SEQ ID NO: 3028193 - RNA, 14 nt, Human
ggcagugggagcug

SEQ ID NO: 3028194 - RNA, 16 nt, Human
ggcagugggagcugcc

SEQ ID NO: 3028195 - RNA, 21 nt, Human
ggcagcucagagaggguggga

SEQ ID NO: 3028196 - RNA, 13 nt, Human
ggcagcucagaga

SEQ ID NO: 3028197 - RNA, 22 nt, Human
ggcagcugcuuuugucuauggg

SEQ ID NO: 3028198 - RNA, 17 nt, Human
ggcagcuugaggguugg

SEQ ID NO: 3028199 - RNA, 14 nt, Human
ggcagcucaccucu

SEQ ID NO: 3028200 - RNA, 12 nt, Human
ggcagcucaccu

SEQ ID NO: 3028201 - RNA, 20 nt, Human
ggccagccuugaccauucuc

SEQ ID NO: 3028202 - RNA, 17 nt, Human
ggccagcugcuugggcu

SEQ ID NO: 3028203 - RNA, 22 nt, Human
ggccagccuugaccauucucca

SEQ ID NO: 3028204 - RNA, 18 nt, Human
ggccaggcccucugccca

SEQ ID NO: 3028205 - RNA, 23 nt, Human
ggccagcugcuugggcuucaucc

SEQ ID NO: 3028206 - RNA, 16 nt, Human
ggccaugggccuccug

SEQ ID NO: 3028207 - RNA, 16 nt, Human
ggcauuccccaggagg

SEQ ID NO: 3028208 - RNA, 19 nt, Human
ggcauuccccaggaggcca

SEQ ID NO: 3028209 - RNA, 18 nt, Human
ggcauuccccaggaggcc

SEQ ID NO: 3028210 - RNA, 18 nt, Human
ggcaugggaaugaauguc

SEQ ID NO: 3028211 - RNA, 17 nt, Human
ggcauuccccaggaggc

SEQ ID NO: 3028212 - RNA, 22 nt, Human
ggcaugggaaugaaugucagug

SEQ ID NO: 3028213 - RNA, 23 nt, Human
ggccuagcauacguacacauuuu

SEQ ID NO: 3028214 - RNA, 17 nt, Human
ggccucuuaugggcugg

SEQ ID NO: 3028215 - RNA, 18 nt, Human
ggccucuuaugggcuggg

SEQ ID NO: 3028216 - RNA, 15 nt, Human
ggccucugcacuccc

SEQ ID NO: 3028217 - RNA, 14 nt, Human
ggccucugcacucc

SEQ ID NO: 3028218 - RNA, 13 nt, Human
ggccucugcacuc

SEQ ID NO: 3028219 - RNA, 11 nt, Human
ggcccagagag

SEQ ID NO: 3028220 - RNA, 17 nt, Human
ggcccucugcccacucc

SEQ ID NO: 3028221 - RNA, 16 nt, Human
ggcccucugcccacuc

SEQ ID NO: 3028222 - RNA, 15 nt, Human
ggcccucugcccacu

SEQ ID NO: 3028223 - RNA, 13 nt, Human
ggcccucugccca

SEQ ID NO: 3028224 - RNA, 20 nt, Human
ggcccucugcccacucccug

SEQ ID NO: 3028225 - RNA, 19 nt, Human
ggcccucugcccacucccu

SEQ ID NO: 3028226 - RNA, 21 nt, Human
ggcccucugcccacucccugc

SEQ ID NO: 3028227 - RNA, 15 nt, Human
ggcccugccuccuuu

SEQ ID NO: 3028228 - RNA, 14 nt, Human
ggcccugccuccuu

SEQ ID NO: 3028229 - RNA, 13 nt, Human
ggcccugccuccu

SEQ ID NO: 3028230 - RNA, 15 nt, Human
ggcuaugcauuugaa

SEQ ID NO: 3028231 - RNA, 14 nt, Human
ggcuaugcauuuga

SEQ ID NO: 3028232 - RNA, 16 nt, Human
ggcuaguugggcuucc

SEQ ID NO: 3028233 - RNA, 15 nt, Human
ggcuaguugggcuuc

SEQ ID NO: 3028234 - RNA, 23 nt, Human
ggcuagugugguguuuccuggca

SEQ ID NO: 3028235 - RNA, 22 nt, Human
ggcuaggaccccuccauguggg

SEQ ID NO: 3028236 - RNA, 16 nt, Human
ggcuaggaccccucca

SEQ ID NO: 3028237 - RNA, 22 nt, Human
ggcuagagguucaaagauauuu

SEQ ID NO: 3028238 - RNA, 17 nt, Human
ggcuagagguucaaaga

SEQ ID NO: 3028239 - RNA, 16 nt, Human
ggcuagagguucaaag

SEQ ID NO: 3028240 - RNA, 15 nt, Human
ggcucaaguccucuu

SEQ ID NO: 3028241 - RNA, 21 nt, Human
ggcucaaguccucuuuucuga

SEQ ID NO: 3028242 - RNA, 12 nt, Human
ggcuccaggagc

SEQ ID NO: 3028243 - RNA, 19 nt, Human
ggcuccaggagcagccaca

SEQ ID NO: 3028244 - RNA, 13 nt, Human
ggcuccaggagca

SEQ ID NO: 3028245 - RNA, 15 nt, Human
ggcuccaggcuccuu

SEQ ID NO: 3028246 - RNA, 11 nt, Human
ggcuccaggcu

SEQ ID NO: 3028247 - RNA, 18 nt, Human
ggcuccaggagcagccac

SEQ ID NO: 3028248 - RNA, 16 nt, Human
ggcuccaggcuccuuu

SEQ ID NO: 3028249 - RNA, 23 nt, Human
ggcgcugccccuggcagccccug

SEQ ID NO: 3028250 - RNA, 21 nt, Human
ggcgcugccccuggcagcccc

SEQ ID NO: 3028251 - RNA, 19 nt, Human
ggcgcugccccuggcagcc

SEQ ID NO: 3028252 - RNA, 18 nt, Human
ggcgcugccccuggcagc

SEQ ID NO: 3028253 - RNA, 19 nt, Human
ggccuggccugagcuggga

SEQ ID NO: 3028254 - RNA, 14 nt, Human
ggccugggggcugg

SEQ ID NO: 3028255 - RNA, 22 nt, Human
ggccugggggcugggcagagga

SEQ ID NO: 3028256 - RNA, 20 nt, Human
ggccugggggcugggcagag

SEQ ID NO: 3028257 - RNA, 22 nt, Human
gauugccuuuuuauaacuuuuu

SEQ ID NO: 3028258 - RNA, 21 nt, Human
gauugccuuuuuauaacuuuu

SEQ ID NO: 3028259 - RNA, 15 nt, Human
gauugccuuuuuaua

SEQ ID NO: 3028260 - RNA, 20 nt, Human
gauucuauguuaauauuuua

SEQ ID NO: 3028261 - RNA, 12 nt, Human
gauuuaaaucag

SEQ ID NO: 3028262 - RNA, 13 nt, Human
gauuuaacagaaa

SEQ ID NO: 3028263 - RNA, 14 nt, Human
gauuuaacagaaau

SEQ ID NO: 3028264 - RNA, 15 nt, Human
gauuuaacagaaaug

SEQ ID NO: 3028265 - RNA, 22 nt, Human
gauuuccguuaaaauaccagcc

SEQ ID NO: 3028266 - RNA, 14 nt, Human
gcaaagaugaaggu

SEQ ID NO: 3028267 - RNA, 18 nt, Human
gcaaagaugaaggucugu

SEQ ID NO: 3028268 - RNA, 15 nt, Human
gcaaaccaucauuga

SEQ ID NO: 3028269 - RNA, 19 nt, Human
gauuuugauccaagcuggu

SEQ ID NO: 3028270 - RNA, 21 nt, Human
gauuuugaaauuuuuauuaaa

SEQ ID NO: 3028271 - RNA, 12 nt, Human
gcaaaccaucau

SEQ ID NO: 3028272 - RNA, 16 nt, Human
gauguugcuaacagca

SEQ ID NO: 3028273 - RNA, 22 nt, Human
gauuacaagcgugagccacugc

SEQ ID NO: 3028274 - RNA, 15 nt, Human
gauuaaacuuaaucu

SEQ ID NO: 3028275 - RNA, 23 nt, Human
gauuacaagcgugagccacugca

SEQ ID NO: 3028276 - RNA, 14 nt, Human
gauggugcaaugac

SEQ ID NO: 3028277 - RNA, 12 nt, Human
gauggugcaaug

SEQ ID NO: 3028278 - RNA, 16 nt, Human
gauggugcaaugaccu

SEQ ID NO: 3028279 - RNA, 15 nt, Human
gauggugcaaugacc

SEQ ID NO: 3028280 - RNA, 17 nt, Human
gauggugcaaugaccuu

SEQ ID NO: 3028281 - RNA, 19 nt, Human
gaugcccaaagaugcagcc

SEQ ID NO: 3028282 - RNA, 20 nt, Human
gaugcccaaagaugcagccg

SEQ ID NO: 3028283 - RNA, 19 nt, Human
gaugggugcuuggaggaag

SEQ ID NO: 3028284 - RNA, 13 nt, Human
gauggggcugcac

SEQ ID NO: 3028285 - RNA, 15 nt, Human
gauggggcugcaccg

SEQ ID NO: 3028286 - RNA, 22 nt, Human
gauggccgggcgcgguggcuca

SEQ ID NO: 3028287 - RNA, 20 nt, Human
gaugggcaacccccagccug

SEQ ID NO: 3028288 - RNA, 21 nt, Human
gaugggcaacccccagccugc

SEQ ID NO: 3028289 - RNA, 24 nt, Human
gauggggcccugccuccuuuguga

SEQ ID NO: 3028290 - RNA, 13 nt, Human
gcacacugucugc

SEQ ID NO: 3028291 - RNA, 20 nt, Human
gcacagaaaauggaagacag

SEQ ID NO: 3028292 - RNA, 20 nt, Human
gcacaccgggcacucagaag

SEQ ID NO: 3028293 - RNA, 17 nt, Human
gcacaagcuccaagcuc

SEQ ID NO: 3028294 - RNA, 15 nt, Human
gcacaagcuccaagc

SEQ ID NO: 3028295 - RNA, 18 nt, Human
gcacaagcuccaagcucc

SEQ ID NO: 3028296 - RNA, 23 nt, Human
gcacagaaaauggaagacagcuc

SEQ ID NO: 3028297 - RNA, 22 nt, Human
gcacagaaaauggaagacagcu

SEQ ID NO: 3028298 - RNA, 21 nt, Human
gcacagaaaauggaagacagc

SEQ ID NO: 3028299 - RNA, 17 nt, Human
gcacagacccugcccug

SEQ ID NO: 3028300 - RNA, 16 nt, Human
gcacagacccugcccu

SEQ ID NO: 3028301 - RNA, 15 nt, Human
gcacagacccugccc

SEQ ID NO: 3028302 - RNA, 14 nt, Human
gcacagacccugcc

SEQ ID NO: 3028303 - RNA, 22 nt, Human
gcacagacccugcccugugggc

SEQ ID NO: 3028304 - RNA, 15 nt, Human
gcacagaguuguuac

SEQ ID NO: 3028305 - RNA, 21 nt, Human
gcacagacccugcccuguggg

SEQ ID NO: 3028306 - RNA, 20 nt, Human
gcacagacccugcccugugg

SEQ ID NO: 3028307 - RNA, 19 nt, Human
gcacagacccugcccugug

SEQ ID NO: 3028308 - RNA, 18 nt, Human
gcacagacccugcccugu

SEQ ID NO: 3028309 - RNA, 15 nt, Human
gcaauggcagccuug

SEQ ID NO: 3028310 - RNA, 14 nt, Human
gcaacucaucuuag

SEQ ID NO: 3028311 - RNA, 14 nt, Human
gcaaugugauaaaa

SEQ ID NO: 3028312 - RNA, 16 nt, Human
gcacaaacagaggccg

SEQ ID NO: 3028313 - RNA, 15 nt, Human
gcacaaacagaggcc

SEQ ID NO: 3028314 - RNA, 14 nt, Human
gcacaaacagaggc

SEQ ID NO: 3028315 - RNA, 14 nt, Human
gcacauuaaaugac

SEQ ID NO: 3028316 - RNA, 12 nt, Human
gcacauuaaaug

SEQ ID NO: 3028317 - RNA, 21 nt, Human
gcacauuaaaugacucuuccc

SEQ ID NO: 3028318 - RNA, 16 nt, Human
gcacauuaaaugacuc

SEQ ID NO: 3028319 - RNA, 22 nt, Human
gcacagaguuguuacauuuuua

SEQ ID NO: 3028320 - RNA, 16 nt, Human
gcacagaguuguuaca

SEQ ID NO: 3028321 - RNA, 18 nt, Human
gcacagaguuguuacauu

SEQ ID NO: 3028322 - RNA, 19 nt, Human
gcacagaguuguuacauuu

SEQ ID NO: 3028323 - RNA, 21 nt, Human
gcacagaguuguuacauuuuu

SEQ ID NO: 3028324 - RNA, 12 nt, Human
gcaccauaacuu

SEQ ID NO: 3028325 - RNA, 19 nt, Human
gcaccuuagacagucccug

SEQ ID NO: 3028326 - RNA, 13 nt, Human
gcacgauuucugu

SEQ ID NO: 3028327 - RNA, 15 nt, Human
gcacgauuucuguuu

SEQ ID NO: 3028328 - RNA, 21 nt, Human
gcaccuuagacagucccugcc

SEQ ID NO: 3028329 - RNA, 20 nt, Human
gcaccuuagacagucccugc

SEQ ID NO: 3028330 - RNA, 18 nt, Human
gcagaaggaagacuucau

SEQ ID NO: 3028331 - RNA, 13 nt, Human
gcagacaggcaag

SEQ ID NO: 3028332 - RNA, 14 nt, Human
gcagacaggcaagc

SEQ ID NO: 3028333 - RNA, 12 nt, Human
gcagacaggcaa

SEQ ID NO: 3028334 - RNA, 18 nt, Human
gcagacaggaccagggau

SEQ ID NO: 3028335 - RNA, 22 nt, Human
gcacugcuuccagugaggcucu

SEQ ID NO: 3028336 - RNA, 23 nt, Human
gcacugcuuccagugaggcucug

SEQ ID NO: 3028337 - RNA, 16 nt, Human
gcacgauuucuguuua

SEQ ID NO: 3028338 - RNA, 12 nt, Human
gagcccugucuc

SEQ ID NO: 3028339 - RNA, 13 nt, Human
gaggaucucuuga

SEQ ID NO: 3028340 - RNA, 22 nt, Human
gaggaucucuugagccugggag

SEQ ID NO: 3028341 - RNA, 19 nt, Human
gaggaucucuugagccugg

SEQ ID NO: 3028342 - RNA, 16 nt, Human
gaggaucucuugagcc

SEQ ID NO: 3028343 - RNA, 20 nt, Human
gaggauugcuugagcucagg

SEQ ID NO: 3028344 - RNA, 20 nt, Human
gaggcagccccauucugccu

SEQ ID NO: 3028345 - RNA, 9 nt, Human
gaggcaggg

SEQ ID NO: 3028346 - RNA, 19 nt, Human
gaggcagccccauucugcc

SEQ ID NO: 3028347 - RNA, 18 nt, Human
gaggcagccccauucugc

SEQ ID NO: 3028348 - RNA, 14 nt, Human
gaggccaugggccu

SEQ ID NO: 3028349 - RNA, 17 nt, Human
gaggccaugggccuccu

SEQ ID NO: 3028350 - RNA, 18 nt, Human
gaggccaugggccuccug

SEQ ID NO: 3028351 - RNA, 20 nt, Human
gaggccaugggccuccugug

SEQ ID NO: 3028352 - RNA, 21 nt, Human
gaggccaugggccuccugugu

SEQ ID NO: 3028353 - RNA, 23 nt, Human
gaggccaugggccuccugugugu

SEQ ID NO: 3028354 - RNA, 20 nt, Human
gaggcccuucucuccagccc

SEQ ID NO: 3028355 - RNA, 15 nt, Human
gaggcccuucucucc

SEQ ID NO: 3028356 - RNA, 21 nt, Human
gaggcccuucucuccagcccc

SEQ ID NO: 3028357 - RNA, 16 nt, Human
gaggcccagagggccu

SEQ ID NO: 3028358 - RNA, 15 nt, Human
gaggcccagagggcc

SEQ ID NO: 3028359 - RNA, 19 nt, Human
gaggcccagagggccugca

SEQ ID NO: 3028360 - RNA, 14 nt, Human
gaggcccagagggc

SEQ ID NO: 3028361 - RNA, 13 nt, Human
gaggcccagaggg

SEQ ID NO: 3028362 - RNA, 11 nt, Human
gaggcccagag

SEQ ID NO: 3028363 - RNA, 16 nt, Human
gaggcugggcucccuu

SEQ ID NO: 3028364 - RNA, 14 nt, Human
gaggcugccucucc

SEQ ID NO: 3028365 - RNA, 16 nt, Human
gaggccuucucugaag

SEQ ID NO: 3028366 - RNA, 18 nt, Human
gaggccuucucugaagga

SEQ ID NO: 3028367 - RNA, 19 nt, Human
gaggccuucucugaaggac

SEQ ID NO: 3028368 - RNA, 18 nt, Human
gagguacacuugugaaua

SEQ ID NO: 3028369 - RNA, 24 nt, Human
gagguaaggaauaccugucccccu

SEQ ID NO: 3028370 - RNA, 21 nt, Human
gagguaaggaauaccuguccc

SEQ ID NO: 3028371 - RNA, 15 nt, Human
gaggguugggcuggu

SEQ ID NO: 3028372 - RNA, 14 nt, Human
gaggguugggcugg

SEQ ID NO: 3028373 - RNA, 12 nt, Human
gaggucagagcc

SEQ ID NO: 3028374 - RNA, 13 nt, Human
gaggucagagccu

SEQ ID NO: 3028375 - RNA, 17 nt, Human
gaggucaaggcugcagu

SEQ ID NO: 3028376 - RNA, 13 nt, Human
gagggucugagga

SEQ ID NO: 3028377 - RNA, 14 nt, Human
gagggucugaggaa

SEQ ID NO: 3028378 - RNA, 12 nt, Human
gaggguggaaua

SEQ ID NO: 3028379 - RNA, 21 nt, Human
gagggugaagugaagacaaug

SEQ ID NO: 3028380 - RNA, 14 nt, Human
gaggguggugaccu

SEQ ID NO: 3028381 - RNA, 15 nt, Human
gagggugggaguggg

SEQ ID NO: 3028382 - RNA, 21 nt, Human
gaggguggugaccucugccug

SEQ ID NO: 3028383 - RNA, 22 nt, Human
gagggugucccaaaaagaaagg

SEQ ID NO: 3028384 - RNA, 17 nt, Human
gaggggguggccuccca

SEQ ID NO: 3028385 - RNA, 13 nt, Human
gaggguaaggcug

SEQ ID NO: 3028386 - RNA, 21 nt, Human
gagggagugacagaggcagcc

SEQ ID NO: 3028387 - RNA, 22 nt, Human
gagggagugacagaggcagccc

SEQ ID NO: 3028388 - RNA, 18 nt, Human
gagggagugacagaggca

SEQ ID NO: 3028389 - RNA, 16 nt, Human
gagggagugacagagg

SEQ ID NO: 3028390 - RNA, 16 nt, Human
gagggagggcuccaga

SEQ ID NO: 3028391 - RNA, 20 nt, Human
gagggagggcuccagacaca

SEQ ID NO: 3028392 - RNA, 20 nt, Human
gaggcugggcucccuuccca

SEQ ID NO: 3028393 - RNA, 19 nt, Human
gagggagggcuccagacac

SEQ ID NO: 3028394 - RNA, 14 nt, Human
gaguugaagacaga

SEQ ID NO: 3028395 - RNA, 21 nt, Human
gaguugaagacagagcuacac

SEQ ID NO: 3028396 - RNA, 17 nt, Human
gaguugaagacagagcu

SEQ ID NO: 3028397 - RNA, 15 nt, Human
gaguugaagacagag

SEQ ID NO: 3028398 - RNA, 20 nt, Human
gaguucauacccuguuacca

SEQ ID NO: 3028399 - RNA, 14 nt, Human
gaguucaucuugaa

SEQ ID NO: 3028400 - RNA, 20 nt, Human
gaguucaucuugaauuguaa

SEQ ID NO: 3028401 - RNA, 19 nt, Human
gaguucaucuugaauugua

SEQ ID NO: 3028402 - RNA, 15 nt, Human
gaguuacagacaaag

SEQ ID NO: 3028403 - RNA, 13 nt, Human
gaguuacagacaa

SEQ ID NO: 3028404 - RNA, 13 nt, Human
gagugggugaaua

SEQ ID NO: 3028405 - RNA, 17 nt, Human
gagugacagaggcagcc

SEQ ID NO: 3028406 - RNA, 20 nt, Human
gagugugccugaagucccag

SEQ ID NO: 3028407 - RNA, 12 nt, Human
gaguuacagaca

SEQ ID NO: 3028408 - RNA, 15 nt, Human
gauagcacagacccu

SEQ ID NO: 3028409 - RNA, 14 nt, Human
gauagccaaggcca

SEQ ID NO: 3028410 - RNA, 22 nt, Human
gauagccaaggccaaaggaagc

SEQ ID NO: 3028411 - RNA, 20 nt, Human
gauacaggaaaagcugcuga

SEQ ID NO: 3028412 - RNA, 22 nt, Human
gauaagaaccuuuugagugccu

SEQ ID NO: 3028413 - RNA, 19 nt, Human
gauacaggaaaagcugcug

SEQ ID NO: 3028414 - RNA, 21 nt, Human
gauacaggaaaagcugcugac

SEQ ID NO: 3028415 - RNA, 23 nt, Human
gauacaggaaaagcugcugacag

SEQ ID NO: 3028416 - RNA, 18 nt, Human
gaucacggcucacugcag

SEQ ID NO: 3028417 - RNA, 15 nt, Human
gaucacggcucacug

SEQ ID NO: 3028418 - RNA, 16 nt, Human
gaucacggcucacugc

SEQ ID NO: 3028419 - RNA, 17 nt, Human
gaggucagagccugcag

SEQ ID NO: 3028420 - RNA, 20 nt, Human
gaggucagagccugcaguua

SEQ ID NO: 3028421 - RNA, 17 nt, Human
gagguugggaggccauu

SEQ ID NO: 3028422 - RNA, 15 nt, Human
gagguugggaggcca

SEQ ID NO: 3028423 - RNA, 16 nt, Human
gagguuucaaaccucc

SEQ ID NO: 3028424 - RNA, 19 nt, Human
gaguagcugggacuacagg

SEQ ID NO: 3028425 - RNA, 22 nt, Human
gaguagcugggacuacaggcac

SEQ ID NO: 3028426 - RNA, 12 nt, Human
gaguaggaagac

SEQ ID NO: 3028427 - RNA, 17 nt, Human
gaguaggaagacuuugg

SEQ ID NO: 3028428 - RNA, 13 nt, Human
gaguaggaagacu

SEQ ID NO: 3028429 - RNA, 20 nt, Human
gaguacuacaguccucccau

SEQ ID NO: 3028430 - RNA, 23 nt, Human
gaguacuacaguccucccaucuc

SEQ ID NO: 3028431 - RNA, 21 nt, Human
gaguacuacaguccucccauc

SEQ ID NO: 3028432 - RNA, 19 nt, Human
gaguaggaagacuuuggaa

SEQ ID NO: 3028433 - RNA, 18 nt, Human
gaguaggaagacuuugga

SEQ ID NO: 3028434 - RNA, 11 nt, Human
gaguauauguc

SEQ ID NO: 3028435 - RNA, 15 nt, Human
gagucgaggacaggg

SEQ ID NO: 3028436 - RNA, 19 nt, Human
gaguccgaaagggacuugg

SEQ ID NO: 3028437 - RNA, 14 nt, Human
gagucgaggacagg

SEQ ID NO: 3028438 - RNA, 14 nt, Human
gagucugaaggcug

SEQ ID NO: 3028439 - RNA, 13 nt, Human
gagucugaaggcu

SEQ ID NO: 3028440 - RNA, 12 nt, Human
gagucugaaggc

SEQ ID NO: 3028441 - RNA, 14 nt, Human
gagugacagaggca

SEQ ID NO: 3028442 - RNA, 15 nt, Human
gagugacagaggcag

SEQ ID NO: 3028443 - RNA, 16 nt, Human
gagugacagaggcagc

SEQ ID NO: 3028444 - RNA, 17 nt, Human
gagugaagcugggagaa

SEQ ID NO: 3028445 - RNA, 19 nt, Human
gacagagccccacccucag

SEQ ID NO: 3028446 - RNA, 12 nt, Human
gacagaggcagc

SEQ ID NO: 3028447 - RNA, 14 nt, Human
gacagaggcagccc

SEQ ID NO: 3028448 - RNA, 16 nt, Human
gacagaggcagcccca

SEQ ID NO: 3028449 - RNA, 21 nt, Human
gacagagcaagugagacccug

SEQ ID NO: 3028450 - RNA, 17 nt, Human
gacagaggcagccccau

SEQ ID NO: 3028451 - RNA, 15 nt, Human
gacagaggggguggc

SEQ ID NO: 3028452 - RNA, 19 nt, Human
gacagaggggguggccucc

SEQ ID NO: 3028453 - RNA, 18 nt, Human
gacagaggggguggccuc

SEQ ID NO: 3028454 - RNA, 23 nt, Human
gacagaggggguggccucccaac

SEQ ID NO: 3028455 - RNA, 19 nt, Human
gacagagugagacucuguc

SEQ ID NO: 3028456 - RNA, 22 nt, Human
gacagaggggguggccucccaa

SEQ ID NO: 3028457 - RNA, 21 nt, Human
gacagaggggguggccuccca

SEQ ID NO: 3028458 - RNA, 13 nt, Human
gacagccacggcc

SEQ ID NO: 3028459 - RNA, 13 nt, Human
gacagagggggug

SEQ ID NO: 3028460 - RNA, 20 nt, Human
gacagagugagacucugucu

SEQ ID NO: 3028461 - RNA, 22 nt, Human
gacagagugagacucugucuca

SEQ ID NO: 3028462 - RNA, 14 nt, Human
gacagccacggcca

SEQ ID NO: 3028463 - RNA, 17 nt, Human
gacagccacggccaggc

SEQ ID NO: 3028464 - RNA, 18 nt, Human
gacagccacggccaggcc

SEQ ID NO: 3028465 - RNA, 19 nt, Human
gacagccacggccaggcca

SEQ ID NO: 3028466 - RNA, 21 nt, Human
gacagcugccugggaucccuc

SEQ ID NO: 3028467 - RNA, 18 nt, Human
gacagcugccugggaucc

SEQ ID NO: 3028468 - RNA, 20 nt, Human
gacagccacggccaggccag

SEQ ID NO: 3028469 - RNA, 21 nt, Human
gacagccacggccaggccaga

SEQ ID NO: 3028470 - RNA, 17 nt, Human
gacagcugccugggauc

SEQ ID NO: 3028471 - RNA, 16 nt, Human
gacagcugccugggau

SEQ ID NO: 3028472 - RNA, 23 nt, Human
gacagggcacaccgggcacucag

SEQ ID NO: 3028473 - RNA, 16 nt, Human
gacagggaggugaccc

SEQ ID NO: 3028474 - RNA, 14 nt, Human
gacaguuaagagaa

SEQ ID NO: 3028475 - RNA, 24 nt, Human
gacagggcacaccgggcacucaga

SEQ ID NO: 3028476 - RNA, 14 nt, Human
gacaggaccaggga

SEQ ID NO: 3028477 - RNA, 23 nt, Human
gacaggaccagggauuuccauga

SEQ ID NO: 3028478 - RNA, 15 nt, Human
gacaggaccagggau

SEQ ID NO: 3028479 - RNA, 14 nt, Human
gacaugggaaaggg

SEQ ID NO: 3028480 - RNA, 14 nt, Human
gacaugaucuucuu

SEQ ID NO: 3028481 - RNA, 20 nt, Human
gaccauucuccaccugccag

SEQ ID NO: 3028482 - RNA, 19 nt, Human
gaccauucuccaccugcca

SEQ ID NO: 3028483 - RNA, 17 nt, Human
gaccauucuccaccugc

SEQ ID NO: 3028484 - RNA, 22 nt, Human
gaccauucuccaccugccaggg

SEQ ID NO: 3028485 - RNA, 21 nt, Human
gaccauucuccaccugccagg

SEQ ID NO: 3028486 - RNA, 19 nt, Human
gaccagagcugccaccugc

SEQ ID NO: 3028487 - RNA, 18 nt, Human
gaccagagcugccaccug

SEQ ID NO: 3028488 - RNA, 17 nt, Human
gaccagagcugccaccu

SEQ ID NO: 3028489 - RNA, 15 nt, Human
gaccagagcugccac

SEQ ID NO: 3028490 - RNA, 14 nt, Human
gaccagagcugcca

SEQ ID NO: 3028491 - RNA, 13 nt, Human
gaccagagcugcc

SEQ ID NO: 3028492 - RNA, 18 nt, Human
gacaugggaaaggggaag

SEQ ID NO: 3028493 - RNA, 24 nt, Human
gaccagacaccuugacagggcaca

SEQ ID NO: 3028494 - RNA, 11 nt, Human
gaccagagcug

SEQ ID NO: 3028495 - RNA, 14 nt, Human
gaccacguuucuaa

SEQ ID NO: 3028496 - RNA, 12 nt, Human
gacccugucuca

SEQ ID NO: 3028497 - RNA, 20 nt, Human
gacccuuguggucccacccc

SEQ ID NO: 3028498 - RNA, 19 nt, Human
gacccuuguggucccaccc

SEQ ID NO: 3028499 - RNA, 21 nt, Human
gacccuuguggucccacccca

SEQ ID NO: 3028500 - RNA, 15 nt, Human
gacccuugugguccc

SEQ ID NO: 3028501 - RNA, 17 nt, Human
gaccgugaggccagaga

SEQ ID NO: 3028502 - RNA, 16 nt, Human
gaccgugaggccagag

SEQ ID NO: 3028503 - RNA, 18 nt, Human
gaccgugaggccagagac

SEQ ID NO: 3028504 - RNA, 15 nt, Human
gaccgugaggccaga

SEQ ID NO: 3028505 - RNA, 23 nt, Human
gacccugaggcccagagggccug

SEQ ID NO: 3028506 - RNA, 14 nt, Human
gaccccuccaugug

SEQ ID NO: 3028507 - RNA, 18 nt, Human
gaccccuccaugugggcu

SEQ ID NO: 3028508 - RNA, 21 nt, Human
gaccccuccaugugggcuagu

SEQ ID NO: 3028509 - RNA, 22 nt, Human
gacccugaggcccagagggccu

SEQ ID NO: 3028510 - RNA, 21 nt, Human
gaaugucaguuguuauuuauu

SEQ ID NO: 3028511 - RNA, 22 nt, Human
gaaugucaguuguuauuuauug

SEQ ID NO: 3028512 - RNA, 13 nt, Human
gaaugucagugug

SEQ ID NO: 3028513 - RNA, 14 nt, Human
gaauugaagcagga

SEQ ID NO: 3028514 - RNA, 18 nt, Human
gaauccagacccggcugc

SEQ ID NO: 3028515 - RNA, 20 nt, Human
gaauccagacccggcugcgu

SEQ ID NO: 3028516 - RNA, 20 nt, Human
gaaugcacaaacagaggccg

SEQ ID NO: 3028517 - RNA, 21 nt, Human
gaaugaaagggcccagagagg

SEQ ID NO: 3028518 - RNA, 21 nt, Human
gaaugcacaaacagaggccgc

SEQ ID NO: 3028519 - RNA, 23 nt, Human
gacaacacucauugaccugaggc

SEQ ID NO: 3028520 - RNA, 22 nt, Human
gacaacacucauugaccugagg

SEQ ID NO: 3028521 - RNA, 15 nt, Human
gaauuguaaggaaug

SEQ ID NO: 3028522 - RNA, 22 nt, Human
gaauuucuuuugccguuauuaa

SEQ ID NO: 3028523 - RNA, 20 nt, Human
gacaaugugaaaagaaaaau

SEQ ID NO: 3028524 - RNA, 19 nt, Human
gacaaugugaaaagaaaaa

SEQ ID NO: 3028525 - RNA, 22 nt, Human
gacaaugcaaaccaucauugaa

SEQ ID NO: 3028526 - RNA, 18 nt, Human
gacaaugugaaaagaaaa

SEQ ID NO: 3028527 - RNA, 12 nt, Human
gacaaugugaaa

SEQ ID NO: 3028528 - RNA, 18 nt, Human
gacaaggauugcuacugu

SEQ ID NO: 3028529 - RNA, 21 nt, Human
gacaaggaugaucuaggaaga

SEQ ID NO: 3028530 - RNA, 19 nt, Human
gacaaggauugcuacuguc

SEQ ID NO: 3028531 - RNA, 23 nt, Human
gacacauguccaagaagcccagg

SEQ ID NO: 3028532 - RNA, 20 nt, Human
gacacauguccaagaagccc

SEQ ID NO: 3028533 - RNA, 15 nt, Human
gacacauguccaaga

SEQ ID NO: 3028534 - RNA, 19 nt, Human
gacacaugcaaggucauuu

SEQ ID NO: 3028535 - RNA, 14 nt, Human
gacacaugcaaggu

SEQ ID NO: 3028536 - RNA, 20 nt, Human
gacacaggcccggcuccagg

SEQ ID NO: 3028537 - RNA, 21 nt, Human
gacacaggcccggcuccaggc

SEQ ID NO: 3028538 - RNA, 19 nt, Human
gacacaggcccggcuccag

SEQ ID NO: 3028539 - RNA, 16 nt, Human
gacacaagccuucggc

SEQ ID NO: 3028540 - RNA, 14 nt, Human
gagaagagaaugca

SEQ ID NO: 3028541 - RNA, 16 nt, Human
gagaagcagaggaagg

SEQ ID NO: 3028542 - RNA, 16 nt, Human
gagaagagaaugcaca

SEQ ID NO: 3028543 - RNA, 14 nt, Human
gagaaaugagcuug

SEQ ID NO: 3028544 - RNA, 16 nt, Human
gagaaagguugaagca

SEQ ID NO: 3028545 - RNA, 19 nt, Human
gacuuaagcacacuugaca

SEQ ID NO: 3028546 - RNA, 13 nt, Human
gacuacaggugug

SEQ ID NO: 3028547 - RNA, 18 nt, Human
gacuacaggugugaguca

SEQ ID NO: 3028548 - RNA, 21 nt, Human
gacuacaggugugagucacca

SEQ ID NO: 3028549 - RNA, 14 nt, Human
gacucauucuucug

SEQ ID NO: 3028550 - RNA, 15 nt, Human
gacucauucuucugu

SEQ ID NO: 3028551 - RNA, 13 nt, Human
gacucgcgacaau

SEQ ID NO: 3028552 - RNA, 13 nt, Human
gacuccugcaggc

SEQ ID NO: 3028553 - RNA, 12 nt, Human
gacuccugcagg

SEQ ID NO: 3028554 - RNA, 14 nt, Human
gacuggaagcacag

SEQ ID NO: 3028555 - RNA, 15 nt, Human
gacuggaagcacagc

SEQ ID NO: 3028556 - RNA, 16 nt, Human
gacuggaagcacagcu

SEQ ID NO: 3028557 - RNA, 18 nt, Human
gacuggaagcacagcuuc

SEQ ID NO: 3028558 - RNA, 17 nt, Human
gacucgcgacaaugcaa

SEQ ID NO: 3028559 - RNA, 21 nt, Human
gacugaguacguugugcauuu

SEQ ID NO: 3028560 - RNA, 22 nt, Human
gacugaguacguugugcauuug

SEQ ID NO: 3028561 - RNA, 18 nt, Human
gacugaguacguugugca

SEQ ID NO: 3028562 - RNA, 13 nt, Human
gacugcccggcag

SEQ ID NO: 3028563 - RNA, 15 nt, Human
gacugcccggcaggg

SEQ ID NO: 3028564 - RNA, 23 nt, Human
gacugaguacguugugcauuugg

SEQ ID NO: 3028565 - RNA, 19 nt, Human
gagaucacgccacugcacu

SEQ ID NO: 3028566 - RNA, 18 nt, Human
gagaucacgccacugcac

SEQ ID NO: 3028567 - RNA, 14 nt, Human
gagauagccaaggc

SEQ ID NO: 3028568 - RNA, 23 nt, Human
gagaucaaccccuucgcuccugu

SEQ ID NO: 3028569 - RNA, 16 nt, Human
gagauagccaaggcca

SEQ ID NO: 3028570 - RNA, 20 nt, Human
gagcaccuuagacagucccu

SEQ ID NO: 3028571 - RNA, 21 nt, Human
gagcacuaaggugugcucuga

SEQ ID NO: 3028572 - RNA, 19 nt, Human
gagcaccuuagacaguccc

SEQ ID NO: 3028573 - RNA, 15 nt, Human
gagcacuaaggugug

SEQ ID NO: 3028574 - RNA, 22 nt, Human
gagcaccuuagacagucccugc

SEQ ID NO: 3028575 - RNA, 21 nt, Human
gagcaccuuagacagucccug

SEQ ID NO: 3028576 - RNA, 18 nt, Human
gagcccugguggcagugg

SEQ ID NO: 3028577 - RNA, 19 nt, Human
gagccagggucucacuaug

SEQ ID NO: 3028578 - RNA, 14 nt, Human
gagccagggucuca

SEQ ID NO: 3028579 - RNA, 23 nt, Human
gagccagauuucacucuccuugg

SEQ ID NO: 3028580 - RNA, 16 nt, Human
gagcagagaauucucu

SEQ ID NO: 3028581 - RNA, 12 nt, Human
gagcagagacca

SEQ ID NO: 3028582 - RNA, 19 nt, Human
gagccaauuuaaagaaaac

SEQ ID NO: 3028583 - RNA, 20 nt, Human
gagccagauuucacucuccu

SEQ ID NO: 3028584 - RNA, 19 nt, Human
gagaggggaacagacugga

SEQ ID NO: 3028585 - RNA, 13 nt, Human
gagaggggcacag

SEQ ID NO: 3028586 - RNA, 16 nt, Human
gagagggugggagugg

SEQ ID NO: 3028587 - RNA, 14 nt, Human
gagagggugggagu

SEQ ID NO: 3028588 - RNA, 18 nt, Human
gagacuccugcaggcagc

SEQ ID NO: 3028589 - RNA, 19 nt, Human
gagacuccugcaggcagcc

SEQ ID NO: 3028590 - RNA, 21 nt, Human
gagacuccugcaggcagccag

SEQ ID NO: 3028591 - RNA, 20 nt, Human
gagacuccugcaggcagcca

SEQ ID NO: 3028592 - RNA, 21 nt, Human
gagacucgcgacaaugcaaac

SEQ ID NO: 3028593 - RNA, 20 nt, Human
gagacucgcgacaaugcaaa

SEQ ID NO: 3028594 - RNA, 22 nt, Human
gagacaggguuuugccauguug

SEQ ID NO: 3028595 - RNA, 12 nt, Human
gagaccaucccu

SEQ ID NO: 3028596 - RNA, 14 nt, Human
gagaccaucccuga

SEQ ID NO: 3028597 - RNA, 21 nt, Human
gagaccaucccugaaggcccc

SEQ ID NO: 3028598 - RNA, 18 nt, Human
gagaccaucccugaaggc

SEQ ID NO: 3028599 - RNA, 23 nt, Human
gagaaugcacaaacagaggccgc

SEQ ID NO: 3028600 - RNA, 21 nt, Human
cugugcaucuagccucaagcu

SEQ ID NO: 3028601 - RNA, 20 nt, Human
cugugauggggcccugccuc

SEQ ID NO: 3028602 - RNA, 19 nt, Human
cugugauggggcccugccu

SEQ ID NO: 3028603 - RNA, 14 nt, Human
cugugccauuuugu

SEQ ID NO: 3028604 - RNA, 16 nt, Human
cugugccaugugccag

SEQ ID NO: 3028605 - RNA, 18 nt, Human
cugugccaugugccaggu

SEQ ID NO: 3028606 - RNA, 18 nt, Human
cugucuccauguuugaug

SEQ ID NO: 3028607 - RNA, 23 nt, Human
cugugaguacuacaguccuccca

SEQ ID NO: 3028608 - RNA, 21 nt, Human
cugugaguacuacaguccucc

SEQ ID NO: 3028609 - RNA, 20 nt, Human
cugugaguacuacaguccuc

SEQ ID NO: 3028610 - RNA, 17 nt, Human
cugugauggggcccugc

SEQ ID NO: 3028611 - RNA, 18 nt, Human
cugugauggggcccugcc

SEQ ID NO: 3028612 - RNA, 17 nt, Human
cuguggaugauaaaaca

SEQ ID NO: 3028613 - RNA, 14 nt, Human
cugugggcccccaa

SEQ ID NO: 3028614 - RNA, 22 nt, Human
cugugcugcccugcccaccugg

SEQ ID NO: 3028615 - RNA, 17 nt, Human
cugugccucugggacug

SEQ ID NO: 3028616 - RNA, 21 nt, Human
cugugcugcccugcccaccug

SEQ ID NO: 3028617 - RNA, 14 nt, Human
cugugccucuggga

SEQ ID NO: 3028618 - RNA, 16 nt, Human
cugugccucugggacu

SEQ ID NO: 3028619 - RNA, 13 nt, Human
cuguucucugccc

SEQ ID NO: 3028620 - RNA, 20 nt, Human
cuguucucugcccuccaaga

SEQ ID NO: 3028621 - RNA, 19 nt, Human
cuguucucugcccuccaag

SEQ ID NO: 3028622 - RNA, 18 nt, Human
cuguucucugcccuccaa

SEQ ID NO: 3028623 - RNA, 17 nt, Human
cuguucucugcccucca

SEQ ID NO: 3028624 - RNA, 16 nt, Human
cuguucucugcccucc

SEQ ID NO: 3028625 - RNA, 15 nt, Human
cuguucucugcccuc

SEQ ID NO: 3028626 - RNA, 14 nt, Human
cuguucucugcccu

SEQ ID NO: 3028627 - RNA, 21 nt, Human
cuguucagcugguugagguuu

SEQ ID NO: 3028628 - RNA, 19 nt, Human
cuguucagcugguugaggu

SEQ ID NO: 3028629 - RNA, 18 nt, Human
cuguucagcugguugagg

SEQ ID NO: 3028630 - RNA, 21 nt, Human
cugugucuugcaauggcagcc

SEQ ID NO: 3028631 - RNA, 20 nt, Human
cugugucuugcaauggcagc

SEQ ID NO: 3028632 - RNA, 22 nt, Human
cugugucuugcaauggcagccu

SEQ ID NO: 3028633 - RNA, 18 nt, Human
cugugugugcgccuacag

SEQ ID NO: 3028634 - RNA, 20 nt, Human
cugugugugcgccuacagga

SEQ ID NO: 3028635 - RNA, 22 nt, Human
cuguaauaaacucauuucuagc

SEQ ID NO: 3028636 - RNA, 16 nt, Human
cugguuccauggccuc

SEQ ID NO: 3028637 - RNA, 20 nt, Human
cuguaauccuagcacuuugg

SEQ ID NO: 3028638 - RNA, 15 nt, Human
cuguacaaaguagaa

SEQ ID NO: 3028639 - RNA, 13 nt, Human
cuguacaaaguag

SEQ ID NO: 3028640 - RNA, 23 nt, Human
cugguggcagcucaccucucccu

SEQ ID NO: 3028641 - RNA, 21 nt, Human
cugguggcagcucaccucucc

SEQ ID NO: 3028642 - RNA, 13 nt, Human
cugguggcagcug

SEQ ID NO: 3028643 - RNA, 14 nt, Human
cugguggcagcugc

SEQ ID NO: 3028644 - RNA, 17 nt, Human
cuggguucuacccaggu

SEQ ID NO: 3028645 - RNA, 16 nt, Human
cuggguucuacccagg

SEQ ID NO: 3028646 - RNA, 15 nt, Human
cuggguucuacccag

SEQ ID NO: 3028647 - RNA, 14 nt, Human
cuggguucuaccca

SEQ ID NO: 3028648 - RNA, 20 nt, Human
cuggguaacuagggaagaua

SEQ ID NO: 3028649 - RNA, 22 nt, Human
cuggguaacuagggaagauaau

SEQ ID NO: 3028650 - RNA, 13 nt, Human
cugggggaagaag

SEQ ID NO: 3028651 - RNA, 24 nt, Human
cugggcuucaguggcagcugcuuu

SEQ ID NO: 3028652 - RNA, 15 nt, Human
cugggggaagaagcu

SEQ ID NO: 3028653 - RNA, 19 nt, Human
cugggggcugggcagagga

SEQ ID NO: 3028654 - RNA, 18 nt, Human
cugggggcugggcagagg

SEQ ID NO: 3028655 - RNA, 23 nt, Human
cuguaucccaugagccucagcau

SEQ ID NO: 3028656 - RNA, 13 nt, Human
cuguacagagccc

SEQ ID NO: 3028657 - RNA, 20 nt, Human
cugucccuuacgugaguccu

SEQ ID NO: 3028658 - RNA, 14 nt, Human
cuguccgagcuuug

SEQ ID NO: 3028659 - RNA, 22 nt, Human
cuguccccgcacugggcuuggg

SEQ ID NO: 3028660 - RNA, 19 nt, Human
cuguccccgcacugggcuu

SEQ ID NO: 3028661 - RNA, 18 nt, Human
cuguccccgcacugggcu

SEQ ID NO: 3028662 - RNA, 17 nt, Human
cuguccccgcacugggc

SEQ ID NO: 3028663 - RNA, 23 nt, Human
cugucucaaaaaaacacaaaagu

SEQ ID NO: 3028664 - RNA, 16 nt, Human
cugucucaaaaaaaga

SEQ ID NO: 3028665 - RNA, 18 nt, Human
cugucucaaaaaaagaaa

SEQ ID NO: 3028666 - RNA, 14 nt, Human
cuguccuacccacc

SEQ ID NO: 3028667 - RNA, 15 nt, Human
cuguccgagcuuuga

SEQ ID NO: 3028668 - RNA, 22 nt, Human
cuggcacugguuuguucccugu

SEQ ID NO: 3028669 - RNA, 18 nt, Human
cuggcacugcuuccagug

SEQ ID NO: 3028670 - RNA, 23 nt, Human
cuggcacugcuuccagugaggcu

SEQ ID NO: 3028671 - RNA, 20 nt, Human
cuggcacugcuuccagugag

SEQ ID NO: 3028672 - RNA, 19 nt, Human
cuggcacugcuuccaguga

SEQ ID NO: 3028673 - RNA, 20 nt, Human
cuggcacccggccccugcug

SEQ ID NO: 3028674 - RNA, 21 nt, Human
cuggcacccggccccugcugg

SEQ ID NO: 3028675 - RNA, 19 nt, Human
cuggcacccggccccugcu

SEQ ID NO: 3028676 - RNA, 20 nt, Human
cuggagugcagugagccgag

SEQ ID NO: 3028677 - RNA, 14 nt, Human
cuggccagaugcac

SEQ ID NO: 3028678 - RNA, 15 nt, Human
cuggcccacugcauc

SEQ ID NO: 3028679 - RNA, 24 nt, Human
cuggcucuuccaggcugggagagc

SEQ ID NO: 3028680 - RNA, 22 nt, Human
cuggcucuuccaggcugggaga

SEQ ID NO: 3028681 - RNA, 21 nt, Human
cuggcucuuccaggcugggag

SEQ ID NO: 3028682 - RNA, 14 nt, Human
cuggcgugcagugg

SEQ ID NO: 3028683 - RNA, 15 nt, Human
cuggcgugcaguggu

SEQ ID NO: 3028684 - RNA, 16 nt, Human
cuggccucugcacucc

SEQ ID NO: 3028685 - RNA, 21 nt, Human
cuggccucugcacuccccugc

SEQ ID NO: 3028686 - RNA, 20 nt, Human
cuggccucugcacuccccug

SEQ ID NO: 3028687 - RNA, 18 nt, Human
cuggccucugcacucccc

SEQ ID NO: 3028688 - RNA, 19 nt, Human
cuggccuggccccucaggg

SEQ ID NO: 3028689 - RNA, 24 nt, Human
cuggccuggccccucagggucccu

SEQ ID NO: 3028690 - RNA, 16 nt, Human
cuggaccuugaacugg

SEQ ID NO: 3028691 - RNA, 15 nt, Human
cuggacccuguggau

SEQ ID NO: 3028692 - RNA, 21 nt, Human
cuggaccuugaacuggguacu

SEQ ID NO: 3028693 - RNA, 17 nt, Human
cuggaccuugaacuggg

SEQ ID NO: 3028694 - RNA, 20 nt, Human
cuggaccuugaacuggguac

SEQ ID NO: 3028695 - RNA, 23 nt, Human
cuggacaggcauguucucugagg

SEQ ID NO: 3028696 - RNA, 14 nt, Human
cuggacaggcaugu

SEQ ID NO: 3028697 - RNA, 17 nt, Human
cuggacaggcauguucu

SEQ ID NO: 3028698 - RNA, 22 nt, Human
cuggagguacgaaaagagggga

SEQ ID NO: 3028699 - RNA, 17 nt, Human
cuggagguacgaaaaga

SEQ ID NO: 3028700 - RNA, 14 nt, Human
cuggagugcaguga

SEQ ID NO: 3028701 - RNA, 15 nt, Human
cuggagugcagugag

SEQ ID NO: 3028702 - RNA, 16 nt, Human
cuggagugcagugagc

SEQ ID NO: 3028703 - RNA, 17 nt, Human
cuggagugcagugagcc

SEQ ID NO: 3028704 - RNA, 15 nt, Human
cugcugcuggcuggu

SEQ ID NO: 3028705 - RNA, 14 nt, Human
cugcugcuggcugg

SEQ ID NO: 3028706 - RNA, 15 nt, Human
cugcuuccagugagg

SEQ ID NO: 3028707 - RNA, 18 nt, Human
cugcuuccagugaggcuc

SEQ ID NO: 3028708 - RNA, 16 nt, Human
cugcuuccagugaggc

SEQ ID NO: 3028709 - RNA, 23 nt, Human
cugcuuccagugaggcucugccc

SEQ ID NO: 3028710 - RNA, 21 nt, Human
cugcuuccagugaggcucugc

SEQ ID NO: 3028711 - RNA, 20 nt, Human
cugcuuccagugaggcucug

SEQ ID NO: 3028712 - RNA, 19 nt, Human
cugcuuccagugaggcucu

SEQ ID NO: 3028713 - RNA, 13 nt, Human
cugcugguucagg

SEQ ID NO: 3028714 - RNA, 15 nt, Human
cugcugguucagggu

SEQ ID NO: 3028715 - RNA, 23 nt, Human
cugcugguucaggguuggccccu

SEQ ID NO: 3028716 - RNA, 19 nt, Human
cugcgaccacaagaaggau

SEQ ID NO: 3028717 - RNA, 20 nt, Human
cugcuccagcuguucagcug

SEQ ID NO: 3028718 - RNA, 19 nt, Human
cugcuccagcuguucagcu

SEQ ID NO: 3028719 - RNA, 19 nt, Human
cugcucuccgaccagacac

SEQ ID NO: 3028720 - RNA, 15 nt, Human
cugcugcaguugcca

SEQ ID NO: 3028721 - RNA, 11 nt, Human
cugcugaaggc

SEQ ID NO: 3028722 - RNA, 20 nt, Human
cugccugcccaggccccugc

SEQ ID NO: 3028723 - RNA, 21 nt, Human
cugccugggaucccucauccu

SEQ ID NO: 3028724 - RNA, 15 nt, Human
cugccugaagucaca

SEQ ID NO: 3028725 - RNA, 15 nt, Human
cugccugcccaggcc

SEQ ID NO: 3028726 - RNA, 16 nt, Human
cugccugcccaggccc

SEQ ID NO: 3028727 - RNA, 17 nt, Human
cugccugcccaggcccc

SEQ ID NO: 3028728 - RNA, 14 nt, Human
cugccucuucucua

SEQ ID NO: 3028729 - RNA, 15 nt, Human
cugccucuucucuac

SEQ ID NO: 3028730 - RNA, 11 nt, Human
cugccucccau

SEQ ID NO: 3028731 - RNA, 19 nt, Human
cugccucccaucacccgcu

SEQ ID NO: 3028732 - RNA, 16 nt, Human
cugccucccaucaccc

SEQ ID NO: 3028733 - RNA, 14 nt, Human
cugccucccaucac

SEQ ID NO: 3028734 - RNA, 12 nt, Human
cugccucccauc

SEQ ID NO: 3028735 - RNA, 22 nt, Human
cugccucugacacacagcucug

SEQ ID NO: 3028736 - RNA, 23 nt, Human
cugccucugacacacagcucugu

SEQ ID NO: 3028737 - RNA, 15 nt, Human
cugccgcagcccugc

SEQ ID NO: 3028738 - RNA, 14 nt, Human
cugccgcagcccug

SEQ ID NO: 3028739 - RNA, 18 nt, Human
cugccgcagcccugcaga

SEQ ID NO: 3028740 - RNA, 17 nt, Human
cugccgcagcccugcag

SEQ ID NO: 3028741 - RNA, 12 nt, Human
cugcccuccaag

SEQ ID NO: 3028742 - RNA, 17 nt, Human
cucccuucccaccucuc

SEQ ID NO: 3028743 - RNA, 16 nt, Human
cucccuucccaccucu

SEQ ID NO: 3028744 - RNA, 15 nt, Human
cucccuucccaccuc

SEQ ID NO: 3028745 - RNA, 14 nt, Human
cucccuucccaccu

SEQ ID NO: 3028746 - RNA, 16 nt, Human
cuuagugauguaauua

SEQ ID NO: 3028747 - RNA, 15 nt, Human
cuuagugauguaauu

SEQ ID NO: 3028748 - RNA, 14 nt, Human
cuuagucacugaga

SEQ ID NO: 3028749 - RNA, 19 nt, Human
cuuagucacugagacagcc

SEQ ID NO: 3028750 - RNA, 18 nt, Human
cuuagucacugagacagc

SEQ ID NO: 3028751 - RNA, 16 nt, Human
cuuagucacugagaca

SEQ ID NO: 3028752 - RNA, 13 nt, Human
cuuagauguauau

SEQ ID NO: 3028753 - RNA, 16 nt, Human
cuguucuggcagaguu

SEQ ID NO: 3028754 - RNA, 15 nt, Human
cuuauacauuugaua

SEQ ID NO: 3028755 - RNA, 15 nt, Human
cuuauuuccucauuu

SEQ ID NO: 3028756 - RNA, 17 nt, Human
cuuauuuaaugaaagac

SEQ ID NO: 3028757 - RNA, 18 nt, Human
cuuauuuaaugaaagacu

SEQ ID NO: 3028758 - RNA, 23 nt, Human
cuucacagaugggugcuuggagg

SEQ ID NO: 3028759 - RNA, 10 nt, Human
cuucaaggau

SEQ ID NO: 3028760 - RNA, 16 nt, Human
cuucaaggauccugag

SEQ ID NO: 3028761 - RNA, 15 nt, Human
cuucaaggauccuga

SEQ ID NO: 3028762 - RNA, 13 nt, Human
cuucaaggauccu

SEQ ID NO: 3028763 - RNA, 17 nt, Human
cuucccuacaguugaaa

SEQ ID NO: 3028764 - RNA, 17 nt, Human
cuuccaggggugggaca

SEQ ID NO: 3028765 - RNA, 15 nt, Human
cuuccagggguggga

SEQ ID NO: 3028766 - RNA, 14 nt, Human
cuuccagggguggg

SEQ ID NO: 3028767 - RNA, 19 nt, Human
cuuccaggcugggagagcc

SEQ ID NO: 3028768 - RNA, 16 nt, Human
cuuccaggcugggaga

SEQ ID NO: 3028769 - RNA, 15 nt, Human
cuuccaggcugggag

SEQ ID NO: 3028770 - RNA, 14 nt, Human
cuuccaggcuggga

SEQ ID NO: 3028771 - RNA, 12 nt, Human
cuuccaggcugg

SEQ ID NO: 3028772 - RNA, 16 nt, Human
cuuccacaagagccca

SEQ ID NO: 3028773 - RNA, 17 nt, Human
cuuccacaagagcccag

SEQ ID NO: 3028774 - RNA, 21 nt, Human
cuuccacaagagcccaggccu

SEQ ID NO: 3028775 - RNA, 19 nt, Human
cuuccacaagagcccaggc

SEQ ID NO: 3028776 - RNA, 17 nt, Human
cuucaguggcagcugcu

SEQ ID NO: 3028777 - RNA, 20 nt, Human
cuucauucaacccaccugcg

SEQ ID NO: 3028778 - RNA, 15 nt, Human
cuucaguaagccgug

SEQ ID NO: 3028779 - RNA, 22 nt, Human
cuucagugccuuauggaacacu

SEQ ID NO: 3028780 - RNA, 18 nt, Human
cuucagugccuuauggaa

SEQ ID NO: 3028781 - RNA, 13 nt, Human
cuucaguggcagc

SEQ ID NO: 3028782 - RNA, 14 nt, Human
cuucaguggcagcu

SEQ ID NO: 3028783 - RNA, 15 nt, Human
cuucaguggcagcug

SEQ ID NO: 3028784 - RNA, 16 nt, Human
cuucaguggcagcugc

SEQ ID NO: 3028785 - RNA, 23 nt, Human
cuucaguaagccgugauuuucau

SEQ ID NO: 3028786 - RNA, 16 nt, Human
cuucaguaagccguga

SEQ ID NO: 3028787 - RNA, 17 nt, Human
cuugaacuuugaccucu

SEQ ID NO: 3028788 - RNA, 21 nt, Human
cuugaacuuugaccucugcag

SEQ ID NO: 3028789 - RNA, 13 nt, Human
cuugaacuccugg

SEQ ID NO: 3028790 - RNA, 13 nt, Human
cuugaccucaggu

SEQ ID NO: 3028791 - RNA, 21 nt, Human
cuugaccgugaggccagagac

SEQ ID NO: 3028792 - RNA, 20 nt, Human
cuugaccgugaggccagaga

SEQ ID NO: 3028793 - RNA, 18 nt, Human
cuugaccgugaggccaga

SEQ ID NO: 3028794 - RNA, 23 nt, Human
cuugaccauucuccaccugccag

SEQ ID NO: 3028795 - RNA, 22 nt, Human
cuugaccauucuccaccugcca

SEQ ID NO: 3028796 - RNA, 17 nt, Human
cuugaccgugaggccag

SEQ ID NO: 3028797 - RNA, 16 nt, Human
cuugagccugggaggu

SEQ ID NO: 3028798 - RNA, 15 nt, Human
cuugagccuugaacu

SEQ ID NO: 3028799 - RNA, 17 nt, Human
cuugagccuugaacuuu

SEQ ID NO: 3028800 - RNA, 18 nt, Human
cuugagccuugaacuuug

SEQ ID NO: 3028801 - RNA, 13 nt, Human
cuugagcucagga

SEQ ID NO: 3028802 - RNA, 21 nt, Human
cuugaggguugggcugguguc

SEQ ID NO: 3028803 - RNA, 21 nt, Human
cuugaguugauucagcucugc

SEQ ID NO: 3028804 - RNA, 19 nt, Human
cuugaggguugggcuggug

SEQ ID NO: 3028805 - RNA, 20 nt, Human
cuugaggguugggcuggugu

SEQ ID NO: 3028806 - RNA, 23 nt, Human
cuugaaaacacuguucucugccc

SEQ ID NO: 3028807 - RNA, 14 nt, Human
cuugaaaacacugu

SEQ ID NO: 3028808 - RNA, 13 nt, Human
cuucuguggguuu

SEQ ID NO: 3028809 - RNA, 21 nt, Human
cuucuguggguuucuaaagcu

SEQ ID NO: 3028810 - RNA, 14 nt, Human
cuucuguggguuuc

SEQ ID NO: 3028811 - RNA, 12 nt, Human
cuucuccaggcu

SEQ ID NO: 3028812 - RNA, 13 nt, Human
cuucuccaggcug

SEQ ID NO: 3028813 - RNA, 20 nt, Human
cuucuccacuuucuagccag

SEQ ID NO: 3028814 - RNA, 11 nt, Human
cuucuccacuu

SEQ ID NO: 3028815 - RNA, 12 nt, Human
cuucucuccagc

SEQ ID NO: 3028816 - RNA, 19 nt, Human
cuucucuccagccccugga

SEQ ID NO: 3028817 - RNA, 17 nt, Human
cuucucuccagccccug

SEQ ID NO: 3028818 - RNA, 15 nt, Human
cuucucuccagcccc

SEQ ID NO: 3028819 - RNA, 13 nt, Human
cuucucuccagcc

SEQ ID NO: 3028820 - RNA, 13 nt, Human
cuucucugaagga

SEQ ID NO: 3028821 - RNA, 20 nt, Human
cuucugccauuucugagauc

SEQ ID NO: 3028822 - RNA, 13 nt, Human
cuucugcuucagc

SEQ ID NO: 3028823 - RNA, 21 nt, Human
cuucuguacgucugacaggca

SEQ ID NO: 3028824 - RNA, 14 nt, Human
cuucuguacgucug

SEQ ID NO: 3028825 - RNA, 15 nt, Human
cuucuguacgucuga

SEQ ID NO: 3028826 - RNA, 18 nt, Human
cuucuguacgucugacag

SEQ ID NO: 3028827 - RNA, 20 nt, Human
cuucuguacgucugacaggc

SEQ ID NO: 3028828 - RNA, 16 nt, Human
cuucuguccuacucug

SEQ ID NO: 3028829 - RNA, 17 nt, Human
cuucuguccuacucugu

SEQ ID NO: 3028830 - RNA, 18 nt, Human
cuucuguccuacucugug

SEQ ID NO: 3028831 - RNA, 19 nt, Human
cuucuguccuacucugugu

SEQ ID NO: 3028832 - RNA, 21 nt, Human
cuucuguccuacucuguguca

SEQ ID NO: 3028833 - RNA, 14 nt, Human
cuuugcaggaaauc

SEQ ID NO: 3028834 - RNA, 20 nt, Human
cuuugcagacaggcaagcac

SEQ ID NO: 3028835 - RNA, 16 nt, Human
cuuugcagacaggcaa

SEQ ID NO: 3028836 - RNA, 13 nt, Human
cuuugaccucugc

SEQ ID NO: 3028837 - RNA, 14 nt, Human
cuuugaccucugca

SEQ ID NO: 3028838 - RNA, 15 nt, Human
cuuugaccucugcag

SEQ ID NO: 3028839 - RNA, 17 nt, Human
cuuugaccucugcagca

SEQ ID NO: 3028840 - RNA, 18 nt, Human
cuuugaccucugcagcaa

SEQ ID NO: 3028841 - RNA, 20 nt, Human
cuuugaccucugcagcaaua

SEQ ID NO: 3028842 - RNA, 24 nt, Human
cuuugaccucugcagcaauaaagc

SEQ ID NO: 3028843 - RNA, 14 nt, Human
cuuuguccccaccg

SEQ ID NO: 3028844 - RNA, 19 nt, Human
cuuuggcuauuagagauca

SEQ ID NO: 3028845 - RNA, 15 nt, Human
cuuuguccccaccgc

SEQ ID NO: 3028846 - RNA, 15 nt, Human
cuuugugaggaagcc

SEQ ID NO: 3028847 - RNA, 19 nt, Human
cuuugugauuuuuguaauu

SEQ ID NO: 3028848 - RNA, 15 nt, Human
cuuuccaggaaggcu

SEQ ID NO: 3028849 - RNA, 15 nt, Human
cuuuccaucuacccu

SEQ ID NO: 3028850 - RNA, 16 nt, Human
cuuuccucuuuggucu

SEQ ID NO: 3028851 - RNA, 12 nt, Human
cuuuccugaggc

SEQ ID NO: 3028852 - RNA, 11 nt, Human
cuuucccuccc

SEQ ID NO: 3028853 - RNA, 13 nt, Human
cuuucccucccuu

SEQ ID NO: 3028854 - RNA, 14 nt, Human
cuuucccucccuuc

SEQ ID NO: 3028855 - RNA, 16 nt, Human
cuuucccucccuuccu

SEQ ID NO: 3028856 - RNA, 17 nt, Human
cuuucuggcuaugcauu

SEQ ID NO: 3028857 - RNA, 18 nt, Human
cuuucuggcuaugcauuu

SEQ ID NO: 3028858 - RNA, 19 nt, Human
cuuucuggcuaugcauuug

SEQ ID NO: 3028859 - RNA, 20 nt, Human
cuuucuggcuaugcauuuga

SEQ ID NO: 3028860 - RNA, 15 nt, Human
cuuuccugaggcugg

SEQ ID NO: 3028861 - RNA, 13 nt, Human
cuuuccugaggcu

SEQ ID NO: 3028862 - RNA, 17 nt, Human
cuuguaaauagcucagg

SEQ ID NO: 3028863 - RNA, 18 nt, Human
cuuguaaauagcucaggu

SEQ ID NO: 3028864 - RNA, 15 nt, Human
cuuguacauaaugcg

SEQ ID NO: 3028865 - RNA, 12 nt, Human
cuuguacauaau

SEQ ID NO: 3028866 - RNA, 22 nt, Human
cuuguacauaaugcgugcauac

SEQ ID NO: 3028867 - RNA, 19 nt, Human
cuuguacauaaugcgugca

SEQ ID NO: 3028868 - RNA, 21 nt, Human
cuuguacauaaugcgugcaua

SEQ ID NO: 3028869 - RNA, 16 nt, Human
cuuguaaauagcucag

SEQ ID NO: 3028870 - RNA, 22 nt, Human
cuuggggggcugaggugggagg

SEQ ID NO: 3028871 - RNA, 23 nt, Human
cuuggggggcugaggugggagga

SEQ ID NO: 3028872 - RNA, 13 nt, Human
cuuuacuauggcc

SEQ ID NO: 3028873 - RNA, 22 nt, Human
cuuuaccuuuuuuauacauaaa

SEQ ID NO: 3028874 - RNA, 14 nt, Human
cuuuagcgcccagu

SEQ ID NO: 3028875 - RNA, 13 nt, Human
cuuuauaauucua

SEQ ID NO: 3028876 - RNA, 19 nt, Human
cuuuauaauucuacuuuga

SEQ ID NO: 3028877 - RNA, 15 nt, Human
cuuuaugcacaaaau

SEQ ID NO: 3028878 - RNA, 17 nt, Human
gaaaaggccuucuuccc

SEQ ID NO: 3028879 - RNA, 24 nt, Human
gaaaacacuguucucugcccucca

SEQ ID NO: 3028880 - RNA, 22 nt, Human
gaaaacacuguucucugcccuc

SEQ ID NO: 3028881 - RNA, 19 nt, Human
gaaaagcugcugacagugu

SEQ ID NO: 3028882 - RNA, 19 nt, Human
gaaaacguggcugcuucaa

SEQ ID NO: 3028883 - RNA, 22 nt, Human
gaaaacguggcugcuucaagga

SEQ ID NO: 3028884 - RNA, 20 nt, Human
gaaaacguggcugcuucaag

SEQ ID NO: 3028885 - RNA, 22 nt, Human
gaaaaucagccugcuccagcug

SEQ ID NO: 3028886 - RNA, 20 nt, Human
gaaaaucagccugcuccagc

SEQ ID NO: 3028887 - RNA, 21 nt, Human
cuuuuuggguuuauuuggaaa

SEQ ID NO: 3028888 - RNA, 17 nt, Human
cuuuuuuggcugcugaa

SEQ ID NO: 3028889 - RNA, 22 nt, Human
cuuuuuuggcugcugaaggcuc

SEQ ID NO: 3028890 - RNA, 20 nt, Human
cuuuuuuggcugcugaaggc

SEQ ID NO: 3028891 - RNA, 16 nt, Human
cuuuuuuggcugcuga

SEQ ID NO: 3028892 - RNA, 15 nt, Human
gaaaaaggaggaaga

SEQ ID NO: 3028893 - RNA, 12 nt, Human
gaaaaaggagga

SEQ ID NO: 3028894 - RNA, 14 nt, Human
gaaaacacauuuuu

SEQ ID NO: 3028895 - RNA, 18 nt, Human
gaaaacacauuuuucuua

SEQ ID NO: 3028896 - RNA, 19 nt, Human
gaaaacacauuuuucuuag

SEQ ID NO: 3028897 - RNA, 11 nt, Human
cuuuuguucuu

SEQ ID NO: 3028898 - RNA, 12 nt, Human
cuuuuguucuug

SEQ ID NO: 3028899 - RNA, 18 nt, Human
cuuuguuaguuucuccaa

SEQ ID NO: 3028900 - RNA, 22 nt, Human
cuuuuuauauucucagcagagu

SEQ ID NO: 3028901 - RNA, 17 nt, Human
gaaagcccugagcuuuc

SEQ ID NO: 3028902 - RNA, 22 nt, Human
gaaagcccugagcuuucugcua

SEQ ID NO: 3028903 - RNA, 21 nt, Human
gaaagcccugagcuuucugcu

SEQ ID NO: 3028904 - RNA, 16 nt, Human
gaaagaguaggaagac

SEQ ID NO: 3028905 - RNA, 15 nt, Human
gaaagaguaggaaga

SEQ ID NO: 3028906 - RNA, 17 nt, Human
gaaagacuguacaaagu

SEQ ID NO: 3028907 - RNA, 19 nt, Human
gaaagacuuuuccaacccu

SEQ ID NO: 3028908 - RNA, 23 nt, Human
gaaacccagcucugguccauaga

SEQ ID NO: 3028909 - RNA, 14 nt, Human
gaaacccagcucug

SEQ ID NO: 3028910 - RNA, 13 nt, Human
gaaacccagcucu

SEQ ID NO: 3028911 - RNA, 19 nt, Human
gaaacccagcucuggucca

SEQ ID NO: 3028912 - RNA, 18 nt, Human
gaaacccagcucuggucc

SEQ ID NO: 3028913 - RNA, 16 nt, Human
gaaacccagcucuggu

SEQ ID NO: 3028914 - RNA, 15 nt, Human
gaaacccagcucugg

SEQ ID NO: 3028915 - RNA, 13 nt, Human
cuaccaauauuua

SEQ ID NO: 3028916 - RNA, 15 nt, Human
cuaccaauauuuaau

SEQ ID NO: 3028917 - RNA, 21 nt, Human
cuaccaauauuuaaucuuuua

SEQ ID NO: 3028918 - RNA, 18 nt, Human
cuaccauccccuguagag

SEQ ID NO: 3028919 - RNA, 17 nt, Human
cuacauuagguugugaa

SEQ ID NO: 3028920 - RNA, 18 nt, Human
cuacauuagguugugaau

SEQ ID NO: 3028921 - RNA, 22 nt, Human
cuacauuauaaaugucucuuua

SEQ ID NO: 3028922 - RNA, 17 nt, Human
cuacauugacagauuga

SEQ ID NO: 3028923 - RNA, 13 nt, Human
cuacauucuguua

SEQ ID NO: 3028924 - RNA, 14 nt, Human
cuacauucuguuaa

SEQ ID NO: 3028925 - RNA, 17 nt, Human
cuacccucuuagaaaaa

SEQ ID NO: 3028926 - RNA, 18 nt, Human
cuacccagcgagcccugg

SEQ ID NO: 3028927 - RNA, 13 nt, Human
cuacccaggugcu

SEQ ID NO: 3028928 - RNA, 12 nt, Human
cuacccaggugc

SEQ ID NO: 3028929 - RNA, 15 nt, Human
cuacccagcgagccc

SEQ ID NO: 3028930 - RNA, 17 nt, Human
cuacccagcgagcccug

SEQ ID NO: 3028931 - RNA, 16 nt, Human
cuacaggugugaguca

SEQ ID NO: 3028932 - RNA, 14 nt, Human
cuacaggugugagu

SEQ ID NO: 3028933 - RNA, 13 nt, Human
cuacaguccuccc

SEQ ID NO: 3028934 - RNA, 18 nt, Human
cuacauggaguauauguc

SEQ ID NO: 3028935 - RNA, 20 nt, Human
cuacauggaguauaugucaa

SEQ ID NO: 3028936 - RNA, 15 nt, Human
cuacaggcacccacc

SEQ ID NO: 3028937 - RNA, 17 nt, Human
cuacaggcacccaccau

SEQ ID NO: 3028938 - RNA, 14 nt, Human
cuacaggagugagc

SEQ ID NO: 3028939 - RNA, 15 nt, Human
cuacaggagugagca

SEQ ID NO: 3028940 - RNA, 16 nt, Human
cuacaggagugagcac

SEQ ID NO: 3028941 - RNA, 23 nt, Human
cuacagcuugaccgugaggccag

SEQ ID NO: 3028942 - RNA, 22 nt, Human
cuacagcuugaccgugaggcca

SEQ ID NO: 3028943 - RNA, 19 nt, Human
cuacagcuugaccgugagg

SEQ ID NO: 3028944 - RNA, 22 nt, Human
cuacagaggccaugggccuccu

SEQ ID NO: 3028945 - RNA, 18 nt, Human
cuacagaggccaugggcc

SEQ ID NO: 3028946 - RNA, 20 nt, Human
cuacagaggccaugggccuc

SEQ ID NO: 3028947 - RNA, 17 nt, Human
cuacagaggccaugggc

SEQ ID NO: 3028948 - RNA, 17 nt, Human
cuacacugugcugaguc

SEQ ID NO: 3028949 - RNA, 14 nt, Human
cuacacugugcuga

SEQ ID NO: 3028950 - RNA, 13 nt, Human
cuacacugugcug

SEQ ID NO: 3028951 - RNA, 21 nt, Human
cuaauaugaugacuguuuuua

SEQ ID NO: 3028952 - RNA, 19 nt, Human
cuaauaugaugacuguuuu

SEQ ID NO: 3028953 - RNA, 12 nt, Human
cuaaugggacac

SEQ ID NO: 3028954 - RNA, 13 nt, Human
cuaaugggacacu

SEQ ID NO: 3028955 - RNA, 21 nt, Human
cuacacacugcauguuuguga

SEQ ID NO: 3028956 - RNA, 21 nt, Human
cuacacaggggaaaagaggag

SEQ ID NO: 3028957 - RNA, 22 nt, Human
cuaagcuauucaguaauaacuc

SEQ ID NO: 3028958 - RNA, 17 nt, Human
cuaauagacaauuuauu

SEQ ID NO: 3028959 - RNA, 19 nt, Human
cuaauagacaauuuauuau

SEQ ID NO: 3028960 - RNA, 23 nt, Human
cuaauagacaauuuauuauggca

SEQ ID NO: 3028961 - RNA, 20 nt, Human
cuaacagcaacacaaagcuu

SEQ ID NO: 3028962 - RNA, 12 nt, Human
cuaaccacgcug

SEQ ID NO: 3028963 - RNA, 14 nt, Human
cuaaccacgcugga

SEQ ID NO: 3028964 - RNA, 16 nt, Human
cuaaauucaugcugcu

SEQ ID NO: 3028965 - RNA, 23 nt, Human
cuaagagggagggagggcuccag

SEQ ID NO: 3028966 - RNA, 13 nt, Human
cuaagagggaggg

SEQ ID NO: 3028967 - RNA, 22 nt, Human
cuaagagggagggagggcucca

SEQ ID NO: 3028968 - RNA, 15 nt, Human
cuaagagggagggag

SEQ ID NO: 3028969 - RNA, 22 nt, Human
cuaaaugaaaaucgugacaaca

SEQ ID NO: 3028970 - RNA, 21 nt, Human
cuaaaucuccaaaauaaaacu

SEQ ID NO: 3028971 - RNA, 20 nt, Human
cuaaaucuccaaaauaaaac

SEQ ID NO: 3028972 - RNA, 23 nt, Human
cgggaggauguucugggacacag

SEQ ID NO: 3028973 - RNA, 21 nt, Human
cgggaggauguucugggacac

SEQ ID NO: 3028974 - RNA, 12 nt, Human
cuauuuauuuau

SEQ ID NO: 3028975 - RNA, 19 nt, Human
cuauuuauuuauuuauuca

SEQ ID NO: 3028976 - RNA, 14 nt, Human
cucaaauuucuaaa

SEQ ID NO: 3028977 - RNA, 13 nt, Human
cucaaauuucuaa

SEQ ID NO: 3028978 - RNA, 15 nt, Human
cucaaauuucuaaau

SEQ ID NO: 3028979 - RNA, 17 nt, Human
cucaaauuucuaaaucu

SEQ ID NO: 3028980 - RNA, 14 nt, Human
cucaacucuccucc

SEQ ID NO: 3028981 - RNA, 15 nt, Human
cucacagaagaugaa

SEQ ID NO: 3028982 - RNA, 23 nt, Human
cucacacggacacucaaaagcug

SEQ ID NO: 3028983 - RNA, 18 nt, Human
cucaacucuccuccagag

SEQ ID NO: 3028984 - RNA, 16 nt, Human
cucaacucuccuccag

SEQ ID NO: 3028985 - RNA, 16 nt, Human
cuauugcugcuugagg

SEQ ID NO: 3028986 - RNA, 18 nt, Human
cuauuguuagucucuuga

SEQ ID NO: 3028987 - RNA, 16 nt, Human
cuauucugagaugacu

SEQ ID NO: 3028988 - RNA, 15 nt, Human
cuauucugagaugac

SEQ ID NO: 3028989 - RNA, 18 nt, Human
cuauucugagaugacuau

SEQ ID NO: 3028990 - RNA, 23 nt, Human
cuauucaguaauaacucuacccu

SEQ ID NO: 3028991 - RNA, 23 nt, Human
cuauucagcacaaggaaauaaaa

SEQ ID NO: 3028992 - RNA, 17 nt, Human
cuauucaguaauaacuc

SEQ ID NO: 3028993 - RNA, 13 nt, Human
cuauguaucaaug

SEQ ID NO: 3028994 - RNA, 18 nt, Human
cuauauaauuccuguuuu

SEQ ID NO: 3028995 - RNA, 20 nt, Human
cuauauaauuccuguuuuua

SEQ ID NO: 3028996 - RNA, 21 nt, Human
cuaugcauuugaaaauuuuga

SEQ ID NO: 3028997 - RNA, 19 nt, Human
cuauagccuaggugacaga

SEQ ID NO: 3028998 - RNA, 18 nt, Human
cuauagccuaggugacag

SEQ ID NO: 3028999 - RNA, 20 nt, Human
cuauagccuaggugacagag

SEQ ID NO: 3029000 - RNA, 21 nt, Human
cuauagccuaggugacagagu

SEQ ID NO: 3029001 - RNA, 17 nt, Human
cuaggaagacuuuggaa

SEQ ID NO: 3029002 - RNA, 15 nt, Human
cuaggaagacuuugg

SEQ ID NO: 3029003 - RNA, 20 nt, Human
cuaggaacacuccuucacag

SEQ ID NO: 3029004 - RNA, 22 nt, Human
cuagccuuagaagucacacagu

SEQ ID NO: 3029005 - RNA, 23 nt, Human
cuagccuuagaagucacacagua

SEQ ID NO: 3029006 - RNA, 24 nt, Human
cuagauacuguaucaugacaaaga

SEQ ID NO: 3029007 - RNA, 13 nt, Human
cuagauacuguau

SEQ ID NO: 3029008 - RNA, 16 nt, Human
cuagauacuguaucau

SEQ ID NO: 3029009 - RNA, 21 nt, Human
cuagccuuagaagucacacag

SEQ ID NO: 3029010 - RNA, 22 nt, Human
cuagccugugccucugggacug

SEQ ID NO: 3029011 - RNA, 21 nt, Human
cuagccugugccucugggacu

SEQ ID NO: 3029012 - RNA, 19 nt, Human
cuagccugugccucuggga

SEQ ID NO: 3029013 - RNA, 19 nt, Human
cuacuguccuacccacccu

SEQ ID NO: 3029014 - RNA, 21 nt, Human
cuacuguaauuugugauacaa

SEQ ID NO: 3029015 - RNA, 12 nt, Human
cuacucuguguc

SEQ ID NO: 3029016 - RNA, 15 nt, Human
cuacucgaguuacag

SEQ ID NO: 3029017 - RNA, 19 nt, Human
cuacucgaguuacagacaa

SEQ ID NO: 3029018 - RNA, 16 nt, Human
cuacucgaguuacaga

SEQ ID NO: 3029019 - RNA, 20 nt, Human
cuacuguccuacccacccuc

SEQ ID NO: 3029020 - RNA, 17 nt, Human
cuagagguucaaagaua

SEQ ID NO: 3029021 - RNA, 18 nt, Human
cuagagguucaaagauau

SEQ ID NO: 3029022 - RNA, 21 nt, Human
cuagagguucaaagauauuuu

SEQ ID NO: 3029023 - RNA, 15 nt, Human
cuagagguucaaaga

SEQ ID NO: 3029024 - RNA, 23 nt, Human
cucauuuuuauaaugucccuuca

SEQ ID NO: 3029025 - RNA, 18 nt, Human
cuccaaaauaaaacuuuu

SEQ ID NO: 3029026 - RNA, 17 nt, Human
cuccaagcucccaggca

SEQ ID NO: 3029027 - RNA, 21 nt, Human
cucauuugucacacacuuugg

SEQ ID NO: 3029028 - RNA, 18 nt, Human
cucauuugucacacacuu

SEQ ID NO: 3029029 - RNA, 21 nt, Human
cucauugaccugaggcccuuc

SEQ ID NO: 3029030 - RNA, 19 nt, Human
cucauugaccugaggcccu

SEQ ID NO: 3029031 - RNA, 18 nt, Human
cucauucuccuuguguua

SEQ ID NO: 3029032 - RNA, 22 nt, Human
cucauucuccuuguguuacuaa

SEQ ID NO: 3029033 - RNA, 17 nt, Human
cucauugaccugaggcc

SEQ ID NO: 3029034 - RNA, 14 nt, Human
cuccagcucaccag

SEQ ID NO: 3029035 - RNA, 15 nt, Human
cuccagcucaccagc

SEQ ID NO: 3029036 - RNA, 16 nt, Human
cuccagcucaccagcc

SEQ ID NO: 3029037 - RNA, 18 nt, Human
cuccagcucaccagcccc

SEQ ID NO: 3029038 - RNA, 11 nt, Human
cuccagccccu

SEQ ID NO: 3029039 - RNA, 14 nt, Human
cuccagccccugga

SEQ ID NO: 3029040 - RNA, 13 nt, Human
cuccagccccugg

SEQ ID NO: 3029041 - RNA, 16 nt, Human
cuccagagucagaagu

SEQ ID NO: 3029042 - RNA, 14 nt, Human
cucccaucacccgc

SEQ ID NO: 3029043 - RNA, 16 nt, Human
cucccaucacuucccu

SEQ ID NO: 3029044 - RNA, 15 nt, Human
cucccacaaaggaga

SEQ ID NO: 3029045 - RNA, 15 nt, Human
cucccaacucacccc

SEQ ID NO: 3029046 - RNA, 14 nt, Human
cucccaacucaccc

SEQ ID NO: 3029047 - RNA, 16 nt, Human
cucccaaagugcuggg

SEQ ID NO: 3029048 - RNA, 23 nt, Human
cucccaaagugcugggauuacag

SEQ ID NO: 3029049 - RNA, 20 nt, Human
cucccgaauagcugggacua

SEQ ID NO: 3029050 - RNA, 23 nt, Human
cucccgaauagcugggacuacag

SEQ ID NO: 3029051 - RNA, 19 nt, Human
cucccgaauagcugggacu

SEQ ID NO: 3029052 - RNA, 15 nt, Human
cucccuucauccuuc

SEQ ID NO: 3029053 - RNA, 23 nt, Human
cuccccugcuggguguggcgcag

SEQ ID NO: 3029054 - RNA, 21 nt, Human
cuccccugcuggguguggcgc

SEQ ID NO: 3029055 - RNA, 14 nt, Human
cuccccugcugggu

SEQ ID NO: 3029056 - RNA, 21 nt, Human
cucagaugcacaugagcuggc

SEQ ID NO: 3029057 - RNA, 16 nt, Human
cucagaucuucugugg

SEQ ID NO: 3029058 - RNA, 18 nt, Human
cucagagagggugggagu

SEQ ID NO: 3029059 - RNA, 19 nt, Human
cucagagagggugggagug

SEQ ID NO: 3029060 - RNA, 23 nt, Human
cucagagagggugggagugggcc

SEQ ID NO: 3029061 - RNA, 16 nt, Human
cucacuguugcccagg

SEQ ID NO: 3029062 - RNA, 17 nt, Human
cucacuguugcccaggc

SEQ ID NO: 3029063 - RNA, 18 nt, Human
cucacuguugcccaggcu

SEQ ID NO: 3029064 - RNA, 19 nt, Human
cucacuguugcccaggcug

SEQ ID NO: 3029065 - RNA, 15 nt, Human
cucacugcagccuca

SEQ ID NO: 3029066 - RNA, 16 nt, Human
cucacugcagccucaa

SEQ ID NO: 3029067 - RNA, 14 nt, Human
cucacugcagccuc

SEQ ID NO: 3029068 - RNA, 14 nt, Human
cucacuguugccca

SEQ ID NO: 3029069 - RNA, 15 nt, Human
cucacuguugcccag

SEQ ID NO: 3029070 - RNA, 13 nt, Human
cucagcauccugg

SEQ ID NO: 3029071 - RNA, 21 nt, Human
cucagcauccuggcacccggc

SEQ ID NO: 3029072 - RNA, 22 nt, Human
cucagcauccuggcacccggcc

SEQ ID NO: 3029073 - RNA, 16 nt, Human
cucagcaggggagggu

SEQ ID NO: 3029074 - RNA, 20 nt, Human
cucagcaaaagaugcuucuc

SEQ ID NO: 3029075 - RNA, 19 nt, Human
cucagcaaaagaugcuucu

SEQ ID NO: 3029076 - RNA, 13 nt, Human
cucagcggggaca

SEQ ID NO: 3029077 - RNA, 23 nt, Human
cucagcggggacagcuccuucug

SEQ ID NO: 3029078 - RNA, 14 nt, Human
cucagcggggacag

SEQ ID NO: 3029079 - RNA, 15 nt, Human
cucagcggggacagc

SEQ ID NO: 3029080 - RNA, 16 nt, Human
cucagcggggacagcu

SEQ ID NO: 3029081 - RNA, 18 nt, Human
cucagcggggacagcucc

SEQ ID NO: 3029082 - RNA, 19 nt, Human
cucagcggggacagcuccu

SEQ ID NO: 3029083 - RNA, 20 nt, Human
cucagcggggacagcuccuu

SEQ ID NO: 3029084 - RNA, 21 nt, Human
cucagcggggacagcuccuuc

SEQ ID NO: 3029085 - RNA, 18 nt, Human
cucagggucccugguggc

SEQ ID NO: 3029086 - RNA, 24 nt, Human
cucagggucccugguggcagcuca

SEQ ID NO: 3029087 - RNA, 22 nt, Human
cucagggucccugguggcagcu

SEQ ID NO: 3029088 - RNA, 21 nt, Human
cucagggucccugguggcagc

SEQ ID NO: 3029089 - RNA, 20 nt, Human
cucagggucccugguggcag

SEQ ID NO: 3029090 - RNA, 14 nt, Human
cucagggccugguc

SEQ ID NO: 3029091 - RNA, 21 nt, Human
cucagguggggucacucuggc

SEQ ID NO: 3029092 - RNA, 20 nt, Human
cucagguggggucacucugg

SEQ ID NO: 3029093 - RNA, 19 nt, Human
cucagguggggucacucug

SEQ ID NO: 3029094 - RNA, 22 nt, Human
cucaggugauccacccaccuca

SEQ ID NO: 3029095 - RNA, 23 nt, Human
cucaggugauccacccaccucag

SEQ ID NO: 3029096 - RNA, 15 nt, Human
cucaggcagguggga

SEQ ID NO: 3029097 - RNA, 18 nt, Human
cucaggcaggugggaugg

SEQ ID NO: 3029098 - RNA, 18 nt, Human
cucagggccuggcucagg

SEQ ID NO: 3029099 - RNA, 20 nt, Human
cucagggccuggcucaggug

SEQ ID NO: 3029100 - RNA, 19 nt, Human
cucagggccuggcucaggu

SEQ ID NO: 3029101 - RNA, 20 nt, Human
ccugugccucugggacugga

SEQ ID NO: 3029102 - RNA, 20 nt, Human
ccugugggcccccaaaugga

SEQ ID NO: 3029103 - RNA, 20 nt, Human
ccuguggaugauaaaacaca

SEQ ID NO: 3029104 - RNA, 16 nt, Human
ccuucucuccagcccc

SEQ ID NO: 3029105 - RNA, 15 nt, Human
ccuucucuccagccc

SEQ ID NO: 3029106 - RNA, 13 nt, Human
ccuucucuccagc

SEQ ID NO: 3029107 - RNA, 12 nt, Human
ccuucucuccag

SEQ ID NO: 3029108 - RNA, 13 nt, Human
ccuuccaggggug

SEQ ID NO: 3029109 - RNA, 17 nt, Human
ccuuccauggacuuugu

SEQ ID NO: 3029110 - RNA, 20 nt, Human
ccuuggugucgggcaugaca

SEQ ID NO: 3029111 - RNA, 19 nt, Human
ccuuggugucgggcaugac

SEQ ID NO: 3029112 - RNA, 14 nt, Human
ccuuggcugcaggg

SEQ ID NO: 3029113 - RNA, 16 nt, Human
ccuuggcugcagggag

SEQ ID NO: 3029114 - RNA, 14 nt, Human
ccuuggggagcagg

SEQ ID NO: 3029115 - RNA, 18 nt, Human
ccuugacagggcacaccg

SEQ ID NO: 3029116 - RNA, 21 nt, Human
ccuugacagggcacaccgggc

SEQ ID NO: 3029117 - RNA, 18 nt, Human
ccuucucuccagccccug

SEQ ID NO: 3029118 - RNA, 17 nt, Human
ccuucucuccagccccu

SEQ ID NO: 3029119 - RNA, 22 nt, Human
ccuuggcucaaguccucuuuuc

SEQ ID NO: 3029120 - RNA, 21 nt, Human
ccuuggacauuuuaugucuuu

SEQ ID NO: 3029121 - RNA, 15 nt, Human
ccuuggauugucccc

SEQ ID NO: 3029122 - RNA, 19 nt, Human
ccuucucuccagccccugg

SEQ ID NO: 3029123 - RNA, 23 nt, Human
cgaaagggacuuggaagcuccgc

SEQ ID NO: 3029124 - RNA, 22 nt, Human
ccuuuuuuggcugcugaaggcu

SEQ ID NO: 3029125 - RNA, 20 nt, Human
ccuuuuuuggcugcugaagg

SEQ ID NO: 3029126 - RNA, 18 nt, Human
ccuuuuuuggcugcugaa

SEQ ID NO: 3029127 - RNA, 17 nt, Human
ccuuuuuuggcugcuga

SEQ ID NO: 3029128 - RNA, 21 nt, Human
cgaacauguuuuucuucuccc

SEQ ID NO: 3029129 - RNA, 23 nt, Human
cgaacauguuuuucuucucccuc

SEQ ID NO: 3029130 - RNA, 17 nt, Human
cgaauauugcugauggu

SEQ ID NO: 3029131 - RNA, 15 nt, Human
cgaauauugcugaug

SEQ ID NO: 3029132 - RNA, 15 nt, Human
cgaauagcugggacu

SEQ ID NO: 3029133 - RNA, 16 nt, Human
cgaauagcugggacua

SEQ ID NO: 3029134 - RNA, 11 nt, Human
cgaauauugcu

SEQ ID NO: 3029135 - RNA, 14 nt, Human
cgaauauugcugau

SEQ ID NO: 3029136 - RNA, 12 nt, Human
cgaauauugcug

SEQ ID NO: 3029137 - RNA, 19 nt, Human
ccuuuuuuauacauaaaca

SEQ ID NO: 3029138 - RNA, 15 nt, Human
ccuuuuuuggcugcu

SEQ ID NO: 3029139 - RNA, 14 nt, Human
ccuuugugaggaag

SEQ ID NO: 3029140 - RNA, 23 nt, Human
ccuuuguccccaccgcagacagg

SEQ ID NO: 3029141 - RNA, 22 nt, Human
ccuuuguccccaccgcagacag

SEQ ID NO: 3029142 - RNA, 23 nt, Human
ccuuugugaggaagccgcugggg

SEQ ID NO: 3029143 - RNA, 17 nt, Human
ccuuugugaggaagccg

SEQ ID NO: 3029144 - RNA, 16 nt, Human
ccuuugugaggaagcc

SEQ ID NO: 3029145 - RNA, 15 nt, Human
ccuuugugaggaagc

SEQ ID NO: 3029146 - RNA, 24 nt, Human
ccuuuguauucucuccuguaccuc

SEQ ID NO: 3029147 - RNA, 22 nt, Human
ccuuuguauucucuccuguacc

SEQ ID NO: 3029148 - RNA, 23 nt, Human
ccuuuguauucucuccuguaccu

SEQ ID NO: 3029149 - RNA, 14 nt, Human
ccuuuguccccacc

SEQ ID NO: 3029150 - RNA, 18 nt, Human
ccuuuguccccaccgcag

SEQ ID NO: 3029151 - RNA, 16 nt, Human
ccuuuguccccaccgc

SEQ ID NO: 3029152 - RNA, 16 nt, Human
cgaggacagggaggug

SEQ ID NO: 3029153 - RNA, 18 nt, Human
cgagcccugguggcagug

SEQ ID NO: 3029154 - RNA, 14 nt, Human
cgaggacagggagg

SEQ ID NO: 3029155 - RNA, 19 nt, Human
cgagcccugguggcagugg

SEQ ID NO: 3029156 - RNA, 13 nt, Human
cgcacugggcuug

SEQ ID NO: 3029157 - RNA, 17 nt, Human
cgcacugggcuugggga

SEQ ID NO: 3029158 - RNA, 17 nt, Human
cgcagcccugcagaggg

SEQ ID NO: 3029159 - RNA, 15 nt, Human
cgcagcccugcagag

SEQ ID NO: 3029160 - RNA, 20 nt, Human
cgcagcauauucaggaagcu

SEQ ID NO: 3029161 - RNA, 19 nt, Human
cgcagcauauucaggaagc

SEQ ID NO: 3029162 - RNA, 12 nt, Human
cggccaggccag

SEQ ID NO: 3029163 - RNA, 20 nt, Human
cggccaggccagagggagug

SEQ ID NO: 3029164 - RNA, 11 nt, Human
cggccaggcca

SEQ ID NO: 3029165 - RNA, 14 nt, Human
cggcuggcagccca

SEQ ID NO: 3029166 - RNA, 13 nt, Human
cggcuggccuggc

SEQ ID NO: 3029167 - RNA, 23 nt, Human
cggcuggcagcccaccccucaac

SEQ ID NO: 3029168 - RNA, 16 nt, Human
cgggaagggggcuggg

SEQ ID NO: 3029169 - RNA, 20 nt, Human
cgggaagggggcugggacau

SEQ ID NO: 3029170 - RNA, 19 nt, Human
cgggaagggggcugggaca

SEQ ID NO: 3029171 - RNA, 14 nt, Human
cgcuuucuacccag

SEQ ID NO: 3029172 - RNA, 16 nt, Human
cgcuuucuacccagcg

SEQ ID NO: 3029173 - RNA, 20 nt, Human
cggacagccacggccaggcc

SEQ ID NO: 3029174 - RNA, 14 nt, Human
cggaauaguuggcu

SEQ ID NO: 3029175 - RNA, 16 nt, Human
cggaauaguuggcuag

SEQ ID NO: 3029176 - RNA, 17 nt, Human
cggaauaguuggcuagg

SEQ ID NO: 3029177 - RNA, 15 nt, Human
cggagaaaggaaggg

SEQ ID NO: 3029178 - RNA, 17 nt, Human
cggagaaaggaagggcu

SEQ ID NO: 3029179 - RNA, 21 nt, Human
cggacagccacggccaggcca

SEQ ID NO: 3029180 - RNA, 22 nt, Human
cggacagccacggccaggccag

SEQ ID NO: 3029181 - RNA, 19 nt, Human
cgcugugcugcccugccca

SEQ ID NO: 3029182 - RNA, 23 nt, Human
cgcugugcugcccugcccaccug

SEQ ID NO: 3029183 - RNA, 21 nt, Human
cgcugugcugcccugcccacc

SEQ ID NO: 3029184 - RNA, 11 nt, Human
cgcugugcugc

SEQ ID NO: 3029185 - RNA, 14 nt, Human
cgcugugcugcccu

SEQ ID NO: 3029186 - RNA, 13 nt, Human
cgcugugcugccc

SEQ ID NO: 3029187 - RNA, 19 nt, Human
cgcagcccugcagagggca

SEQ ID NO: 3029188 - RNA, 18 nt, Human
cgcagcccugcagagggc

SEQ ID NO: 3029189 - RNA, 13 nt, Human
cgcccagucugga

SEQ ID NO: 3029190 - RNA, 19 nt, Human
cgcccagucuggaaugcag

SEQ ID NO: 3029191 - RNA, 21 nt, Human
cgcccagucuggaaugcagug

SEQ ID NO: 3029192 - RNA, 12 nt, Human
cgcccagucugg

SEQ ID NO: 3029193 - RNA, 14 nt, Human
cgcgacaaugcaaa

SEQ ID NO: 3029194 - RNA, 19 nt, Human
cgcgguggcucacgccugu

SEQ ID NO: 3029195 - RNA, 24 nt, Human
cgcuacccgggaagggggcuggga

SEQ ID NO: 3029196 - RNA, 21 nt, Human
cgcuacccgggaagggggcug

SEQ ID NO: 3029197 - RNA, 18 nt, Human
cgcuacccgggaaggggg

SEQ ID NO: 3029198 - RNA, 17 nt, Human
cgcuacccgggaagggg

SEQ ID NO: 3029199 - RNA, 17 nt, Human
ccugcuaauuccccaga

SEQ ID NO: 3029200 - RNA, 21 nt, Human
ccugcuaauuccccagauugc

SEQ ID NO: 3029201 - RNA, 20 nt, Human
ccugccuguugggccaggag

SEQ ID NO: 3029202 - RNA, 19 nt, Human
ccugccuguugggccagga

SEQ ID NO: 3029203 - RNA, 18 nt, Human
ccugccuguugggccagg

SEQ ID NO: 3029204 - RNA, 19 nt, Human
ccuggcacccggccccugc

SEQ ID NO: 3029205 - RNA, 20 nt, Human
ccuggcacccggccccugcu

SEQ ID NO: 3029206 - RNA, 21 nt, Human
ccuggcacccggccccugcug

SEQ ID NO: 3029207 - RNA, 18 nt, Human
ccuggcacccggccccug

SEQ ID NO: 3029208 - RNA, 22 nt, Human
ccuggcacuauaauguaagcuc

SEQ ID NO: 3029209 - RNA, 12 nt, Human
ccuggcacugcu

SEQ ID NO: 3029210 - RNA, 14 nt, Human
ccuggcccacugca

SEQ ID NO: 3029211 - RNA, 13 nt, Human
ccuggcccacugc

SEQ ID NO: 3029212 - RNA, 21 nt, Human
ccuggccagaugcaccagccc

SEQ ID NO: 3029213 - RNA, 23 nt, Human
ccuggccagaugcaccagcccuu

SEQ ID NO: 3029214 - RNA, 20 nt, Human
ccuggccagaugcaccagcc

SEQ ID NO: 3029215 - RNA, 23 nt, Human
ccuggcaugggaaugaaugucag

SEQ ID NO: 3029216 - RNA, 13 nt, Human
ccuggcaugggaa

SEQ ID NO: 3029217 - RNA, 16 nt, Human
ccuggcacugcuucca

SEQ ID NO: 3029218 - RNA, 13 nt, Human
ccuggcacugcuu

SEQ ID NO: 3029219 - RNA, 16 nt, Human
ccuggcccacugcauc

SEQ ID NO: 3029220 - RNA, 16 nt, Human
ccugggagugagcugg

SEQ ID NO: 3029221 - RNA, 22 nt, Human
ccugggaggucaaggcugcagu

SEQ ID NO: 3029222 - RNA, 16 nt, Human
ccugggcagaaggaag

SEQ ID NO: 3029223 - RNA, 18 nt, Human
ccugggagugagcugguu

SEQ ID NO: 3029224 - RNA, 15 nt, Human
ccugggcagaaggaa

SEQ ID NO: 3029225 - RNA, 18 nt, Human
ccugggggcugggcagag

SEQ ID NO: 3029226 - RNA, 19 nt, Human
ccugggggcugggcagagg

SEQ ID NO: 3029227 - RNA, 21 nt, Human
ccugggggcugggcagaggaa

SEQ ID NO: 3029228 - RNA, 20 nt, Human
ccugggggcugggcagagga

SEQ ID NO: 3029229 - RNA, 10 nt, Human
ccuguaccuc

SEQ ID NO: 3029230 - RNA, 13 nt, Human
ccugguggcagug

SEQ ID NO: 3029231 - RNA, 14 nt, Human
ccugguggcagugg

SEQ ID NO: 3029232 - RNA, 16 nt, Human
ccuguagagugggagc

SEQ ID NO: 3029233 - RNA, 15 nt, Human
ccuguagagugggag

SEQ ID NO: 3029234 - RNA, 13 nt, Human
ccuguagcccuaa

SEQ ID NO: 3029235 - RNA, 12 nt, Human
ccugucccccug

SEQ ID NO: 3029236 - RNA, 15 nt, Human
ccugucccccugaca

SEQ ID NO: 3029237 - RNA, 14 nt, Human
ccugucccccugac

SEQ ID NO: 3029238 - RNA, 13 nt, Human
ccugucccccuga

SEQ ID NO: 3029239 - RNA, 14 nt, Human
ccugguggcagcug

SEQ ID NO: 3029240 - RNA, 22 nt, Human
ccugguggcagcucaccucucc

SEQ ID NO: 3029241 - RNA, 21 nt, Human
ccugguggcagcucaccucuc

SEQ ID NO: 3029242 - RNA, 19 nt, Human
ccugguggcagcucaccuc

SEQ ID NO: 3029243 - RNA, 15 nt, Human
ccugguggcagcugc

SEQ ID NO: 3029244 - RNA, 16 nt, Human
ccugguggcagcugcg

SEQ ID NO: 3029245 - RNA, 17 nt, Human
ccugguggcagcugcgg

SEQ ID NO: 3029246 - RNA, 18 nt, Human
ccugguggcagcugcggu

SEQ ID NO: 3029247 - RNA, 22 nt, Human
ccugaagucuuuguacagacaa

SEQ ID NO: 3029248 - RNA, 20 nt, Human
ccugaagucacacagugagu

SEQ ID NO: 3029249 - RNA, 19 nt, Human
ccugaagucacacagugag

SEQ ID NO: 3029250 - RNA, 18 nt, Human
ccugagccagauuucacu

SEQ ID NO: 3029251 - RNA, 16 nt, Human
ccugagccagauuuca

SEQ ID NO: 3029252 - RNA, 12 nt, Human
ccugagccagau

SEQ ID NO: 3029253 - RNA, 15 nt, Human
ccugagccagauuuc

SEQ ID NO: 3029254 - RNA, 15 nt, Human
ccugaggcugggcuc

SEQ ID NO: 3029255 - RNA, 14 nt, Human
ccugaggcugggcu

SEQ ID NO: 3029256 - RNA, 13 nt, Human
ccugaggcugggc

SEQ ID NO: 3029257 - RNA, 12 nt, Human
ccugagcuggga

SEQ ID NO: 3029258 - RNA, 18 nt, Human
ccugaggcccagagggcc

SEQ ID NO: 3029259 - RNA, 17 nt, Human
ccugaggcccagagggc

SEQ ID NO: 3029260 - RNA, 16 nt, Human
ccugaggcccagaggg

SEQ ID NO: 3029261 - RNA, 15 nt, Human
ccugaggcccagagg

SEQ ID NO: 3029262 - RNA, 19 nt, Human
ccugccaauggacuaacuu

SEQ ID NO: 3029263 - RNA, 16 nt, Human
ccugccacccugggga

SEQ ID NO: 3029264 - RNA, 22 nt, Human
ccugccacccuggggagaaagu

SEQ ID NO: 3029265 - RNA, 14 nt, Human
ccugccacccuggg

SEQ ID NO: 3029266 - RNA, 12 nt, Human
ccugccacccug

SEQ ID NO: 3029267 - RNA, 13 nt, Human
ccugccacccugg

SEQ ID NO: 3029268 - RNA, 14 nt, Human
ccugaaagcccuga

SEQ ID NO: 3029269 - RNA, 13 nt, Human
ccugaaagcccug

SEQ ID NO: 3029270 - RNA, 18 nt, Human
ccugaaagcccugagcuu

SEQ ID NO: 3029271 - RNA, 21 nt, Human
ccugaagacucauucuucugu

SEQ ID NO: 3029272 - RNA, 14 nt, Human
ccugaaggccccgc

SEQ ID NO: 3029273 - RNA, 19 nt, Human
ccugaaggccccgcccagg

SEQ ID NO: 3029274 - RNA, 18 nt, Human
ccugaaggccccgcccag

SEQ ID NO: 3029275 - RNA, 21 nt, Human
ccugaaggccccgcccaggcu

SEQ ID NO: 3029276 - RNA, 20 nt, Human
ccugaaggccccgcccaggc

SEQ ID NO: 3029277 - RNA, 22 nt, Human
ccugaaggccccgcccaggcuu

SEQ ID NO: 3029278 - RNA, 15 nt, Human
ccugagcugggauga

SEQ ID NO: 3029279 - RNA, 11 nt, Human
ccugcccugug

SEQ ID NO: 3029280 - RNA, 14 nt, Human
ccugcccugugggc

SEQ ID NO: 3029281 - RNA, 12 nt, Human
ccugcccugugg

SEQ ID NO: 3029282 - RNA, 13 nt, Human
ccugccucagccu

SEQ ID NO: 3029283 - RNA, 14 nt, Human
ccugccucagccuc

SEQ ID NO: 3029284 - RNA, 12 nt, Human
ccugccucagcc

SEQ ID NO: 3029285 - RNA, 11 nt, Human
ccugccucagc

SEQ ID NO: 3029286 - RNA, 14 nt, Human
ccugccuguugggc

SEQ ID NO: 3029287 - RNA, 22 nt, Human
ccugcccuuaccugccaggaag

SEQ ID NO: 3029288 - RNA, 21 nt, Human
ccugcccuuaccugccaggaa

SEQ ID NO: 3029289 - RNA, 19 nt, Human
ccugcccuuaccugccagg

SEQ ID NO: 3029290 - RNA, 15 nt, Human
ccugcccugugggcc

SEQ ID NO: 3029291 - RNA, 22 nt, Human
ccugccagggacagagggggug

SEQ ID NO: 3029292 - RNA, 12 nt, Human
ccugccaggcau

SEQ ID NO: 3029293 - RNA, 14 nt, Human
ccugcccggcugcg

SEQ ID NO: 3029294 - RNA, 16 nt, Human
ccugcccggcugcgga

SEQ ID NO: 3029295 - RNA, 22 nt, Human
ccugccuguugggccaggagcc

SEQ ID NO: 3029296 - RNA, 18 nt, Human
ccagugacagucagggaa

SEQ ID NO: 3029297 - RNA, 13 nt, Human
ccagugagacugu

SEQ ID NO: 3029298 - RNA, 16 nt, Human
ccagguuucuaugugu

SEQ ID NO: 3029299 - RNA, 13 nt, Human
ccagguuuaagcu

SEQ ID NO: 3029300 - RNA, 20 nt, Human
ccaguaaaugggggugcauu

SEQ ID NO: 3029301 - RNA, 21 nt, Human
ccaguaaaugggggugcauuu

SEQ ID NO: 3029302 - RNA, 22 nt, Human
ccaguaaaugggggugcauuug

SEQ ID NO: 3029303 - RNA, 21 nt, Human
ccaggugcuaggaacacuccu

SEQ ID NO: 3029304 - RNA, 12 nt, Human
ccaucaugucug

SEQ ID NO: 3029305 - RNA, 13 nt, Human
ccaucaugucugg

SEQ ID NO: 3029306 - RNA, 12 nt, Human
ccaucauugaaa

SEQ ID NO: 3029307 - RNA, 14 nt, Human
ccaucaagccacca

SEQ ID NO: 3029308 - RNA, 13 nt, Human
ccaucaagccacc

SEQ ID NO: 3029309 - RNA, 16 nt, Human
ccaucaagccaccaac

SEQ ID NO: 3029310 - RNA, 15 nt, Human
ccauaugccugggca

SEQ ID NO: 3029311 - RNA, 12 nt, Human
ccaucaagccac

SEQ ID NO: 3029312 - RNA, 13 nt, Human
ccauaugccuggg

SEQ ID NO: 3029313 - RNA, 14 nt, Human
ccagugugacaagg

SEQ ID NO: 3029314 - RNA, 23 nt, Human
ccagugugacaaggauugcuacu

SEQ ID NO: 3029315 - RNA, 15 nt, Human
ccaucucuccuccuu

SEQ ID NO: 3029316 - RNA, 21 nt, Human
ccaucucacacaugagcauca

SEQ ID NO: 3029317 - RNA, 20 nt, Human
ccaucucacacaugagcauc

SEQ ID NO: 3029318 - RNA, 18 nt, Human
ccaucucacacaugagca

SEQ ID NO: 3029319 - RNA, 17 nt, Human
ccaucucacacaugagc

SEQ ID NO: 3029320 - RNA, 15 nt, Human
ccaucucacacauga

SEQ ID NO: 3029321 - RNA, 14 nt, Human
ccaucucacacaug

SEQ ID NO: 3029322 - RNA, 13 nt, Human
ccaucuacccucc

SEQ ID NO: 3029323 - RNA, 17 nt, Human
ccaucauugaaaucuuu

SEQ ID NO: 3029324 - RNA, 16 nt, Human
ccaucauugaaaucuu

SEQ ID NO: 3029325 - RNA, 14 nt, Human
ccaucauugaaauc

SEQ ID NO: 3029326 - RNA, 14 nt, Human
ccaggcccucugcc

SEQ ID NO: 3029327 - RNA, 13 nt, Human
ccaggcccucugc

SEQ ID NO: 3029328 - RNA, 14 nt, Human
ccaggccccugcca

SEQ ID NO: 3029329 - RNA, 15 nt, Human
ccaggccccugccac

SEQ ID NO: 3029330 - RNA, 16 nt, Human
ccaggccccugccacc

SEQ ID NO: 3029331 - RNA, 14 nt, Human
ccaggaggccagcc

SEQ ID NO: 3029332 - RNA, 18 nt, Human
ccaggaggccagccuuga

SEQ ID NO: 3029333 - RNA, 15 nt, Human
ccaggaggccagccu

SEQ ID NO: 3029334 - RNA, 20 nt, Human
ccaggaggccagccuugacc

SEQ ID NO: 3029335 - RNA, 21 nt, Human
ccaggccacaagacccuugug

SEQ ID NO: 3029336 - RNA, 21 nt, Human
ccaggcuuagucacugagaca

SEQ ID NO: 3029337 - RNA, 23 nt, Human
ccaggcuuagucacugagacagc

SEQ ID NO: 3029338 - RNA, 22 nt, Human
ccaggcuuagucacugagacag

SEQ ID NO: 3029339 - RNA, 23 nt, Human
ccaggcugggagagccuuccagg

SEQ ID NO: 3029340 - RNA, 15 nt, Human
ccaggcccucugccc

SEQ ID NO: 3029341 - RNA, 15 nt, Human
ccauucugccugccc

SEQ ID NO: 3029342 - RNA, 13 nt, Human
ccauuugcuccuu

SEQ ID NO: 3029343 - RNA, 18 nt, Human
ccauguuuuguuuacggu

SEQ ID NO: 3029344 - RNA, 14 nt, Human
cccaagggccuggc

SEQ ID NO: 3029345 - RNA, 12 nt, Human
cccaagggccug

SEQ ID NO: 3029346 - RNA, 21 nt, Human
ccauuuuguauuuuacuaaua

SEQ ID NO: 3029347 - RNA, 20 nt, Human
ccauuuugcugucccuuuuc

SEQ ID NO: 3029348 - RNA, 16 nt, Human
cccaagggccuggccu

SEQ ID NO: 3029349 - RNA, 17 nt, Human
cccacaggaucagucug

SEQ ID NO: 3029350 - RNA, 13 nt, Human
cccacaggaucag

SEQ ID NO: 3029351 - RNA, 12 nt, Human
cccaccucagcc

SEQ ID NO: 3029352 - RNA, 14 nt, Human
cccaccucagccuc

SEQ ID NO: 3029353 - RNA, 15 nt, Human
cccaccucagccucc

SEQ ID NO: 3029354 - RNA, 12 nt, Human
cccaccuuggcu

SEQ ID NO: 3029355 - RNA, 21 nt, Human
cccaccucagccucccaaagu

SEQ ID NO: 3029356 - RNA, 13 nt, Human
cccaccucucuca

SEQ ID NO: 3029357 - RNA, 17 nt, Human
cccaccucucucacucc

SEQ ID NO: 3029358 - RNA, 14 nt, Human
cccaccucucucac

SEQ ID NO: 3029359 - RNA, 19 nt, Human
cccacgcccccacugguga

SEQ ID NO: 3029360 - RNA, 17 nt, Human
cccacgcccccacuggu

SEQ ID NO: 3029361 - RNA, 15 nt, Human
cccacgcccccacug

SEQ ID NO: 3029362 - RNA, 15 nt, Human
cccaccuuggcucaa

SEQ ID NO: 3029363 - RNA, 22 nt, Human
cccaccuuggcucaaguccucu

SEQ ID NO: 3029364 - RNA, 14 nt, Human
cccaccuuggcugc

SEQ ID NO: 3029365 - RNA, 15 nt, Human
cccaccuuggcugca

SEQ ID NO: 3029366 - RNA, 14 nt, Human
ccagcacaaagcag

SEQ ID NO: 3029367 - RNA, 17 nt, Human
ccagcaagugagagcug

SEQ ID NO: 3029368 - RNA, 18 nt, Human
ccagcaagugagagcugg

SEQ ID NO: 3029369 - RNA, 19 nt, Human
ccagcaagugagagcuggg

SEQ ID NO: 3029370 - RNA, 18 nt, Human
ccagcaccaucucuccuc

SEQ ID NO: 3029371 - RNA, 17 nt, Human
ccagcaccaucucuccu

SEQ ID NO: 3029372 - RNA, 16 nt, Human
ccagcaggcucucagg

SEQ ID NO: 3029373 - RNA, 18 nt, Human
ccagcaggcucucaggcc

SEQ ID NO: 3029374 - RNA, 17 nt, Human
ccagcaggcucucaggc

SEQ ID NO: 3029375 - RNA, 14 nt, Human
ccagauugcaacag

SEQ ID NO: 3029376 - RNA, 16 nt, Human
ccagauugcaacaggc

SEQ ID NO: 3029377 - RNA, 14 nt, Human
ccagagcccaccuu

SEQ ID NO: 3029378 - RNA, 23 nt, Human
ccagauugcaacaggcugggcuu

SEQ ID NO: 3029379 - RNA, 22 nt, Human
ccagauugcaacaggcugggcu

SEQ ID NO: 3029380 - RNA, 15 nt, Human
ccagauuucacucuc

SEQ ID NO: 3029381 - RNA, 19 nt, Human
ccagauuucacucuccuug

SEQ ID NO: 3029382 - RNA, 18 nt, Human
ccagauuucacucuccuu

SEQ ID NO: 3029383 - RNA, 16 nt, Human
ccagcccacuucugcc

SEQ ID NO: 3029384 - RNA, 17 nt, Human
ccagcccacuucugcca

SEQ ID NO: 3029385 - RNA, 23 nt, Human
ccagcaggcucucaggccagcug

SEQ ID NO: 3029386 - RNA, 21 nt, Human
ccagcaggcucucaggccagc

SEQ ID NO: 3029387 - RNA, 20 nt, Human
ccagcaggcucucaggccag

SEQ ID NO: 3029388 - RNA, 19 nt, Human
ccagcaggcucucaggcca

SEQ ID NO: 3029389 - RNA, 19 nt, Human
ccagccccaaaacucuccu

SEQ ID NO: 3029390 - RNA, 17 nt, Human
ccagccgagauagccaa

SEQ ID NO: 3029391 - RNA, 22 nt, Human
ccagccgagauagccaaggcca

SEQ ID NO: 3029392 - RNA, 20 nt, Human
ccagccgagauagccaaggc

SEQ ID NO: 3029393 - RNA, 13 nt, Human
ccagccuggguga

SEQ ID NO: 3029394 - RNA, 23 nt, Human
ccagccuugaccauucuccaccu

SEQ ID NO: 3029395 - RNA, 15 nt, Human
ccacugugaagagaa

SEQ ID NO: 3029396 - RNA, 14 nt, Human
ccacugugaagaga

SEQ ID NO: 3029397 - RNA, 23 nt, Human
ccacuggugacaugucuuuucuu

SEQ ID NO: 3029398 - RNA, 22 nt, Human
ccacugcuuuuggucuguguga

SEQ ID NO: 3029399 - RNA, 20 nt, Human
ccacugcuuuuggucugugu

SEQ ID NO: 3029400 - RNA, 11 nt, Human
ccacugcucug

SEQ ID NO: 3029401 - RNA, 12 nt, Human
ccacugcucugg

SEQ ID NO: 3029402 - RNA, 13 nt, Human
ccacugcucuggu

SEQ ID NO: 3029403 - RNA, 15 nt, Human
ccacugcucugguua

SEQ ID NO: 3029404 - RNA, 23 nt, Human
ccacugcaucguuucaucuucca

SEQ ID NO: 3029405 - RNA, 21 nt, Human
ccacugcaucguuucaucuuc

SEQ ID NO: 3029406 - RNA, 22 nt, Human
ccacuuuuguucuugguuugua

SEQ ID NO: 3029407 - RNA, 19 nt, Human
ccacugugccaugugccag

SEQ ID NO: 3029408 - RNA, 15 nt, Human
ccacugugccaugug

SEQ ID NO: 3029409 - RNA, 16 nt, Human
ccacugugccaugugc

SEQ ID NO: 3029410 - RNA, 22 nt, Human
ccagaagaaaauagugguguga

SEQ ID NO: 3029411 - RNA, 14 nt, Human
ccagacccggcugc

SEQ ID NO: 3029412 - RNA, 15 nt, Human
ccagacccggcugcg

SEQ ID NO: 3029413 - RNA, 22 nt, Human
ccagacacauguccaagaagcc

SEQ ID NO: 3029414 - RNA, 20 nt, Human
ccagacacauguccaagaag

SEQ ID NO: 3029415 - RNA, 17 nt, Human
ccagacacauguccaag

SEQ ID NO: 3029416 - RNA, 14 nt, Human
ccacccuccuuuca

SEQ ID NO: 3029417 - RNA, 18 nt, Human
ccacccugaaagcccuga

SEQ ID NO: 3029418 - RNA, 19 nt, Human
ccaccccucaacaccucug

SEQ ID NO: 3029419 - RNA, 19 nt, Human
ccacccccacccaagggcc

SEQ ID NO: 3029420 - RNA, 15 nt, Human
ccaccugccagggac

SEQ ID NO: 3029421 - RNA, 12 nt, Human
ccaccugccagg

SEQ ID NO: 3029422 - RNA, 14 nt, Human
ccaccugccaggga

SEQ ID NO: 3029423 - RNA, 13 nt, Human
ccaccugccaggg

SEQ ID NO: 3029424 - RNA, 20 nt, Human
ccaccuggccucugcacucc

SEQ ID NO: 3029425 - RNA, 18 nt, Human
ccaccuggccucugcacu

SEQ ID NO: 3029426 - RNA, 13 nt, Human
ccaccuggccucu

SEQ ID NO: 3029427 - RNA, 20 nt, Human
ccaccucucucacuccuuga

SEQ ID NO: 3029428 - RNA, 19 nt, Human
ccaccucucucacuccuug

SEQ ID NO: 3029429 - RNA, 16 nt, Human
ccaccucucucacucc

SEQ ID NO: 3029430 - RNA, 14 nt, Human
ccaccucucucacu

SEQ ID NO: 3029431 - RNA, 11 nt, Human
ccacccugcuc

SEQ ID NO: 3029432 - RNA, 12 nt, Human
ccacccugcucu

SEQ ID NO: 3029433 - RNA, 14 nt, Human
cccaugagccucag

SEQ ID NO: 3029434 - RNA, 22 nt, Human
cccaugagccucagcauccugg

SEQ ID NO: 3029435 - RNA, 19 nt, Human
cccaucucuacaaaaagca

SEQ ID NO: 3029436 - RNA, 14 nt, Human
cccaguugggugga

SEQ ID NO: 3029437 - RNA, 14 nt, Human
ccccacuggugaca

SEQ ID NO: 3029438 - RNA, 19 nt, Human
ccccaccgcagacaggacc

SEQ ID NO: 3029439 - RNA, 15 nt, Human
ccccaccgcagacag

SEQ ID NO: 3029440 - RNA, 21 nt, Human
ccccacccaagggccuggccu

SEQ ID NO: 3029441 - RNA, 22 nt, Human
cccgaauagcugggacuacagg

SEQ ID NO: 3029442 - RNA, 20 nt, Human
ccccuuccauggacuuuguu

SEQ ID NO: 3029443 - RNA, 13 nt, Human
ccccuuccaugga

SEQ ID NO: 3029444 - RNA, 23 nt, Human
cccgcuaagagggagggagggcu

SEQ ID NO: 3029445 - RNA, 22 nt, Human
cccgcuaagagggagggagggc

SEQ ID NO: 3029446 - RNA, 22 nt, Human
cccgcccaggcuuagucacuga

SEQ ID NO: 3029447 - RNA, 20 nt, Human
cccgcccaggcuuagucacu

SEQ ID NO: 3029448 - RNA, 17 nt, Human
ccccugcccggcugcgg

SEQ ID NO: 3029449 - RNA, 19 nt, Human
ccccugcccggcugcggaa

SEQ ID NO: 3029450 - RNA, 15 nt, Human
ccccuggaugcagcc

SEQ ID NO: 3029451 - RNA, 19 nt, Human
ccccuggaugcagccucac

SEQ ID NO: 3029452 - RNA, 18 nt, Human
ccccuggaugcagccuca

SEQ ID NO: 3029453 - RNA, 17 nt, Human
ccccugcuggguguggc

SEQ ID NO: 3029454 - RNA, 14 nt, Human
ccccugcugggugu

SEQ ID NO: 3029455 - RNA, 11 nt, Human
ccccugcuggu

SEQ ID NO: 3029456 - RNA, 13 nt, Human
ccccugcugguuc

SEQ ID NO: 3029457 - RNA, 15 nt, Human
ccccugcugguucag

SEQ ID NO: 3029458 - RNA, 20 nt, Human
ccccugcugguucaggguug

SEQ ID NO: 3029459 - RNA, 24 nt, Human
cccccacccaagggccuggccuga

SEQ ID NO: 3029460 - RNA, 13 nt, Human
cccccacccaagg

SEQ ID NO: 3029461 - RNA, 14 nt, Human
ccccauccucugua

SEQ ID NO: 3029462 - RNA, 13 nt, Human
cccccacugguga

SEQ ID NO: 3029463 - RNA, 11 nt, Human
cccccacuggu

SEQ ID NO: 3029464 - RNA, 15 nt, Human
cccccacuggugaca

SEQ ID NO: 3029465 - RNA, 14 nt, Human
ccccagugcccaca

SEQ ID NO: 3029466 - RNA, 15 nt, Human
ccccagugcccacag

SEQ ID NO: 3029467 - RNA, 16 nt, Human
ccccagugcccacagg

SEQ ID NO: 3029468 - RNA, 20 nt, Human
ccccagugcccacaggauca

SEQ ID NO: 3029469 - RNA, 17 nt, Human
cccccugacaacacuca

SEQ ID NO: 3029470 - RNA, 19 nt, Human
cccccugacaacacucauu

SEQ ID NO: 3029471 - RNA, 12 nt, Human
cccccagccugc

SEQ ID NO: 3029472 - RNA, 23 nt, Human
ccccucaacucuccuccagaguc

SEQ ID NO: 3029473 - RNA, 16 nt, Human
ccccucaacaccucug

SEQ ID NO: 3029474 - RNA, 15 nt, Human
ccccucaacaccucu

SEQ ID NO: 3029475 - RNA, 12 nt, Human
ccccuccaugug

SEQ ID NO: 3029476 - RNA, 22 nt, Human
ccccucagggucccugguggca

SEQ ID NO: 3029477 - RNA, 16 nt, Human
ccccucagggucccug

SEQ ID NO: 3029478 - RNA, 19 nt, Human
ccgagcuuugaaaauucag

SEQ ID NO: 3029479 - RNA, 14 nt, Human
ccgaguagcuggga

SEQ ID NO: 3029480 - RNA, 19 nt, Human
ccgcacugggcuuggggac

SEQ ID NO: 3029481 - RNA, 23 nt, Human
ccgcacugggcuuggggaccaga

SEQ ID NO: 3029482 - RNA, 21 nt, Human
ccgagauugcaccacugcacu

SEQ ID NO: 3029483 - RNA, 19 nt, Human
ccgagauugcaccacugca

SEQ ID NO: 3029484 - RNA, 15 nt, Human
ccgagauugcaccac

SEQ ID NO: 3029485 - RNA, 18 nt, Human
ccgugaggccagagacac

SEQ ID NO: 3029486 - RNA, 15 nt, Human
ccgggcucugccucc

SEQ ID NO: 3029487 - RNA, 14 nt, Human
ccgggcucugccuc

SEQ ID NO: 3029488 - RNA, 13 nt, Human
ccgggcucugccu

SEQ ID NO: 3029489 - RNA, 18 nt, Human
ccgggcucugccucccau

SEQ ID NO: 3029490 - RNA, 16 nt, Human
ccggcuccaggcuccu

SEQ ID NO: 3029491 - RNA, 21 nt, Human
ccggcuccaggcuccuuuagc

SEQ ID NO: 3029492 - RNA, 20 nt, Human
ccgggcacucagaagacacu

SEQ ID NO: 3029493 - RNA, 22 nt, Human
ccgggcacucagaagacacuga

SEQ ID NO: 3029494 - RNA, 13 nt, Human
ccgggccacagag

SEQ ID NO: 3029495 - RNA, 11 nt, Human
ccgcuggggcc

SEQ ID NO: 3029496 - RNA, 14 nt, Human
ccgcuggggccagu

SEQ ID NO: 3029497 - RNA, 21 nt, Human
ccuacaguugaaaaacagcug

SEQ ID NO: 3029498 - RNA, 23 nt, Human
ccuaggcauuugcugaauacaga

SEQ ID NO: 3029499 - RNA, 18 nt, Human
ccuaggugacagagugag

SEQ ID NO: 3029500 - RNA, 18 nt, Human
ccuacaggagugagcacu

SEQ ID NO: 3029501 - RNA, 20 nt, Human
cccugcagagggcacagaaa

SEQ ID NO: 3029502 - RNA, 12 nt, Human
cccugaggccca

SEQ ID NO: 3029503 - RNA, 11 nt, Human
cccugccuccu

SEQ ID NO: 3029504 - RNA, 22 nt, Human
cccugcucuccgaccagacacc

SEQ ID NO: 3029505 - RNA, 21 nt, Human
cccugcucuccgaccagacac

SEQ ID NO: 3029506 - RNA, 14 nt, Human
cccugguggcagug

SEQ ID NO: 3029507 - RNA, 21 nt, Human
cccuguagagugggagcugag

SEQ ID NO: 3029508 - RNA, 13 nt, Human
cccugguggcagu

SEQ ID NO: 3029509 - RNA, 21 nt, Human
cccugguggcagcucaccucu

SEQ ID NO: 3029510 - RNA, 21 nt, Human
cccuggugaccagcaccaucu

SEQ ID NO: 3029511 - RNA, 14 nt, Human
cccuguucuggcag

SEQ ID NO: 3029512 - RNA, 13 nt, Human
cccuguucuggca

SEQ ID NO: 3029513 - RNA, 16 nt, Human
cccuguuuguuucuga

SEQ ID NO: 3029514 - RNA, 19 nt, Human
cccuguuuguuucugaaag

SEQ ID NO: 3029515 - RNA, 19 nt, Human
cccuuaccucggugccuuc

SEQ ID NO: 3029516 - RNA, 17 nt, Human
cccuuaccugccaggaa

SEQ ID NO: 3029517 - RNA, 23 nt, Human
cccuuaccugccaggaagccagc

SEQ ID NO: 3029518 - RNA, 20 nt, Human
cccuuaccugccaggaagcc

SEQ ID NO: 3029519 - RNA, 23 nt, Human
cccuuagcagggaaacagcuaau

SEQ ID NO: 3029520 - RNA, 14 nt, Human
cccuuagcagggaa

SEQ ID NO: 3029521 - RNA, 17 nt, Human
cccuuacgugaguccug

SEQ ID NO: 3029522 - RNA, 15 nt, Human
cccuuacgugagucc

SEQ ID NO: 3029523 - RNA, 12 nt, Human
cccuuccaugga

SEQ ID NO: 3029524 - RNA, 23 nt, Human
cccucccucuuucccucccuucc

SEQ ID NO: 3029525 - RNA, 12 nt, Human
cccucuuucccu

SEQ ID NO: 3029526 - RNA, 17 nt, Human
cccucuuucccucccuu

SEQ ID NO: 3029527 - RNA, 20 nt, Human
cccucuuucccucccuuccu

SEQ ID NO: 3029528 - RNA, 19 nt, Human
cccucugcccacucccugc

SEQ ID NO: 3029529 - RNA, 11 nt, Human
cccucugccca

SEQ ID NO: 3029530 - RNA, 18 nt, Human
cccucugcccacucccug

SEQ ID NO: 3029531 - RNA, 15 nt, Human
cccucugcccacucc

SEQ ID NO: 3029532 - RNA, 21 nt, Human
cacaguguguggucaacauuu

SEQ ID NO: 3029533 - RNA, 14 nt, Human
cacaguucucuccu

SEQ ID NO: 3029534 - RNA, 15 nt, Human
cacaguucucuccuu

SEQ ID NO: 3029535 - RNA, 22 nt, Human
cacagugagucgaggacaggga

SEQ ID NO: 3029536 - RNA, 21 nt, Human
cacagugagucgaggacaggg

SEQ ID NO: 3029537 - RNA, 22 nt, Human
cacaguccuuaccagcagagca

SEQ ID NO: 3029538 - RNA, 21 nt, Human
cacaguccuuaccagcagagc

SEQ ID NO: 3029539 - RNA, 15 nt, Human
cacaguccuuaccag

SEQ ID NO: 3029540 - RNA, 13 nt, Human
cacaguccuuacc

SEQ ID NO: 3029541 - RNA, 11 nt, Human
cacaggcaggu

SEQ ID NO: 3029542 - RNA, 14 nt, Human
cacaggcaggucca

SEQ ID NO: 3029543 - RNA, 15 nt, Human
cacaggcagguccag

SEQ ID NO: 3029544 - RNA, 23 nt, Human
cacagcugggguggggaccucag

SEQ ID NO: 3029545 - RNA, 22 nt, Human
cacagcugggguggggaccuca

SEQ ID NO: 3029546 - RNA, 21 nt, Human
cacagcuucauuuccuguguc

SEQ ID NO: 3029547 - RNA, 22 nt, Human
cacagcuucauuuccugugucu

SEQ ID NO: 3029548 - RNA, 14 nt, Human
cacauaucugucau

SEQ ID NO: 3029549 - RNA, 20 nt, Human
caaacuaacaggcuuaguga

SEQ ID NO: 3029550 - RNA, 16 nt, Human
caaacuaacaggcuua

SEQ ID NO: 3029551 - RNA, 17 nt, Human
caaacucaccugccccu

SEQ ID NO: 3029552 - RNA, 22 nt, Human
caaagccaaagcuaggccuggc

SEQ ID NO: 3029553 - RNA, 18 nt, Human
caaagccuccuccagccg

SEQ ID NO: 3029554 - RNA, 17 nt, Human
caaagccuccuccagcc

SEQ ID NO: 3029555 - RNA, 13 nt, Human
caaaggaagcaca

SEQ ID NO: 3029556 - RNA, 12 nt, Human
caaaggaagcac

SEQ ID NO: 3029557 - RNA, 13 nt, Human
caaagcuaggccu

SEQ ID NO: 3029558 - RNA, 14 nt, Human
caaagcuaggccug

SEQ ID NO: 3029559 - RNA, 19 nt, Human
caaagcuaggccuggccag

SEQ ID NO: 3029560 - RNA, 14 nt, Human
caaaggaagcacau

SEQ ID NO: 3029561 - RNA, 16 nt, Human
caaaggguaucaggug

SEQ ID NO: 3029562 - RNA, 18 nt, Human
caaaggguaucaggugcu

SEQ ID NO: 3029563 - RNA, 14 nt, Human
caaacuaacaggcu

SEQ ID NO: 3029564 - RNA, 20 nt, Human
caaacccuucagugccaaaa

SEQ ID NO: 3029565 - RNA, 14 nt, Human
caaacccuucagug

SEQ ID NO: 3029566 - RNA, 15 nt, Human
caaacacauacagga

SEQ ID NO: 3029567 - RNA, 12 nt, Human
caaaauaaaacu

SEQ ID NO: 3029568 - RNA, 15 nt, Human
caaaauguaggguua

SEQ ID NO: 3029569 - RNA, 23 nt, Human
caaagugcugggauuacaggugu

SEQ ID NO: 3029570 - RNA, 19 nt, Human
caaagugcugggauuacag

SEQ ID NO: 3029571 - RNA, 19 nt, Human
caaaggguaucaggugcug

SEQ ID NO: 3029572 - RNA, 11 nt, Human
caaauuucuaa

SEQ ID NO: 3029573 - RNA, 12 nt, Human
caaauuucuaaa

SEQ ID NO: 3029574 - RNA, 14 nt, Human
caaauuucuaaauc

SEQ ID NO: 3029575 - RNA, 13 nt, Human
caaaaaggcagga

SEQ ID NO: 3029576 - RNA, 20 nt, Human
caaaaacauggccuuugcuu

SEQ ID NO: 3029577 - RNA, 22 nt, Human
auuuugggguacccacugcucu

SEQ ID NO: 3029578 - RNA, 23 nt, Human
auuuugggguacccacugcucug

SEQ ID NO: 3029579 - RNA, 16 nt, Human
caaaaaaugcuugcuu

SEQ ID NO: 3029580 - RNA, 21 nt, Human
auuuugggguacccacugcuc

SEQ ID NO: 3029581 - RNA, 22 nt, Human
caaaacucuccucugcugcugg

SEQ ID NO: 3029582 - RNA, 21 nt, Human
caaaacucuccucugcugcug

SEQ ID NO: 3029583 - RNA, 20 nt, Human
caaaacucuccucugcugcu

SEQ ID NO: 3029584 - RNA, 17 nt, Human
caaaauaaaaaugaggu

SEQ ID NO: 3029585 - RNA, 19 nt, Human
caaaacucuccucugcugc

SEQ ID NO: 3029586 - RNA, 18 nt, Human
caaggcuuagacccucau

SEQ ID NO: 3029587 - RNA, 15 nt, Human
caaggcugugcaucu

SEQ ID NO: 3029588 - RNA, 21 nt, Human
caaggcugucaauuacaggaa

SEQ ID NO: 3029589 - RNA, 23 nt, Human
caaggcugucaauuacaggaagu

SEQ ID NO: 3029590 - RNA, 15 nt, Human
caaggcugcagugag

SEQ ID NO: 3029591 - RNA, 12 nt, Human
caaggcugcagu

SEQ ID NO: 3029592 - RNA, 15 nt, Human
caaggcuuagacccu

SEQ ID NO: 3029593 - RNA, 18 nt, Human
caaggggcccaaauucuu

SEQ ID NO: 3029594 - RNA, 14 nt, Human
caaggcuuagaccc

SEQ ID NO: 3029595 - RNA, 17 nt, Human
caaggggcccaaauucu

SEQ ID NO: 3029596 - RNA, 13 nt, Human
caaggucauuuuu

SEQ ID NO: 3029597 - RNA, 14 nt, Human
caaggucauuuuuu

SEQ ID NO: 3029598 - RNA, 20 nt, Human
caaggucauuuuuuuuaaga

SEQ ID NO: 3029599 - RNA, 14 nt, Human
caaguccucuuuuc

SEQ ID NO: 3029600 - RNA, 14 nt, Human
caaguuaaauaaau

SEQ ID NO: 3029601 - RNA, 18 nt, Human
caagugagagcugggugu

SEQ ID NO: 3029602 - RNA, 21 nt, Human
caaguccucuuuucugagagg

SEQ ID NO: 3029603 - RNA, 14 nt, Human
caagugagagcugg

SEQ ID NO: 3029604 - RNA, 15 nt, Human
caagugagagcuggg

SEQ ID NO: 3029605 - RNA, 17 nt, Human
caagugagagcugggug

SEQ ID NO: 3029606 - RNA, 20 nt, Human
caagcgauucuucugcuuca

SEQ ID NO: 3029607 - RNA, 22 nt, Human
caagcgauucuucugcuucagc

SEQ ID NO: 3029608 - RNA, 19 nt, Human
caagcgauucuucugcuuc

SEQ ID NO: 3029609 - RNA, 18 nt, Human
caagcaggacauggacaa

SEQ ID NO: 3029610 - RNA, 14 nt, Human
caagcaggacaugg

SEQ ID NO: 3029611 - RNA, 14 nt, Human
caagcaccuccugc

SEQ ID NO: 3029612 - RNA, 22 nt, Human
caagccaccaacauacucccau

SEQ ID NO: 3029613 - RNA, 17 nt, Human
caagcuggucccacuca

SEQ ID NO: 3029614 - RNA, 19 nt, Human
caagcuggucccacucagu

SEQ ID NO: 3029615 - RNA, 18 nt, Human
caagacgcugugcugccc

SEQ ID NO: 3029616 - RNA, 23 nt, Human
caagacgcugugcugcccugccc

SEQ ID NO: 3029617 - RNA, 15 nt, Human
caagagcccaggccu

SEQ ID NO: 3029618 - RNA, 14 nt, Human
caagagcccaggcc

SEQ ID NO: 3029619 - RNA, 13 nt, Human
caagagcccaggc

SEQ ID NO: 3029620 - RNA, 18 nt, Human
caagacucuuuggacacu

SEQ ID NO: 3029621 - RNA, 16 nt, Human
caagagcccaggccuc

SEQ ID NO: 3029622 - RNA, 15 nt, Human
caagcaccuccugcc

SEQ ID NO: 3029623 - RNA, 16 nt, Human
caagcaccuccugccu

SEQ ID NO: 3029624 - RNA, 17 nt, Human
caagcaccuccugccuc

SEQ ID NO: 3029625 - RNA, 20 nt, Human
caagaacuuuccaggaaggc

SEQ ID NO: 3029626 - RNA, 16 nt, Human
caagaccuucuccuuc

SEQ ID NO: 3029627 - RNA, 14 nt, Human
caagaccuucuccu

SEQ ID NO: 3029628 - RNA, 17 nt, Human
caagacgcugugcugcc

SEQ ID NO: 3029629 - RNA, 16 nt, Human
caagacgcugugcugc

SEQ ID NO: 3029630 - RNA, 18 nt, Human
caagaccuucuccuucac

SEQ ID NO: 3029631 - RNA, 17 nt, Human
caagaccuucuccuuca

SEQ ID NO: 3029632 - RNA, 14 nt, Human
caacgucugugcca

SEQ ID NO: 3029633 - RNA, 13 nt, Human
caacgucugugcc

SEQ ID NO: 3029634 - RNA, 15 nt, Human
caaccuccugggcua

SEQ ID NO: 3029635 - RNA, 14 nt, Human
caaccuccugggcu

SEQ ID NO: 3029636 - RNA, 22 nt, Human
caaccccuucgcuccugugucu

SEQ ID NO: 3029637 - RNA, 22 nt, Human
caacacucacauuuauucugcu

SEQ ID NO: 3029638 - RNA, 18 nt, Human
caacacucauugaccuga

SEQ ID NO: 3029639 - RNA, 22 nt, Human
caacacucauugaccugaggcc

SEQ ID NO: 3029640 - RNA, 20 nt, Human
caacacucauugaccugagg

SEQ ID NO: 3029641 - RNA, 19 nt, Human
caaugagaucauugugaag

SEQ ID NO: 3029642 - RNA, 17 nt, Human
caaugcacuuuguucug

SEQ ID NO: 3029643 - RNA, 21 nt, Human
caaugcacuuuguucuggcuc

SEQ ID NO: 3029644 - RNA, 20 nt, Human
caaugcacuuuguucuggcu

SEQ ID NO: 3029645 - RNA, 22 nt, Human
caauuugcacauuaaaugacuc

SEQ ID NO: 3029646 - RNA, 15 nt, Human
caauuugcacauuaa

SEQ ID NO: 3029647 - RNA, 14 nt, Human
caauuugcacauua

SEQ ID NO: 3029648 - RNA, 23 nt, Human
caauucucauuugucacacacuu

SEQ ID NO: 3029649 - RNA, 16 nt, Human
caauuacaggaaguac

SEQ ID NO: 3029650 - RNA, 17 nt, Human
caaugugauaaaacccc

SEQ ID NO: 3029651 - RNA, 15 nt, Human
caaugugauaaaacc

SEQ ID NO: 3029652 - RNA, 16 nt, Human
caaguuaguucaaucu

SEQ ID NO: 3029653 - RNA, 13 nt, Human
caauaggaaaaac

SEQ ID NO: 3029654 - RNA, 12 nt, Human
caauaggaaaaa

SEQ ID NO: 3029655 - RNA, 23 nt, Human
caaucugugaugacauucccugc

SEQ ID NO: 3029656 - RNA, 23 nt, Human
caaugaccuuucaauaggaaaaa

SEQ ID NO: 3029657 - RNA, 20 nt, Human
caaucuggauucauauuuaa

SEQ ID NO: 3029658 - RNA, 16 nt, Human
caaucuggauucauau

SEQ ID NO: 3029659 - RNA, 17 nt, Human
caaugacuuacuguaca

SEQ ID NO: 3029660 - RNA, 18 nt, Human
caaugacuuacuguacau

SEQ ID NO: 3029661 - RNA, 15 nt, Human
caaugacuuacugua

SEQ ID NO: 3029662 - RNA, 21 nt, Human
caaugaccuuucaauaggaaa

SEQ ID NO: 3029663 - RNA, 17 nt, Human
caauauucgcuguguca

SEQ ID NO: 3029664 - RNA, 14 nt, Human
caauaggaaaaacu

SEQ ID NO: 3029665 - RNA, 17 nt, Human
auucucagcagagugcu

SEQ ID NO: 3029666 - RNA, 20 nt, Human
auucuccaccugccagggac

SEQ ID NO: 3029667 - RNA, 19 nt, Human
auucuccaccugccaggga

SEQ ID NO: 3029668 - RNA, 15 nt, Human
auucuauguuaauau

SEQ ID NO: 3029669 - RNA, 18 nt, Human
auucuauguuaauauuuu

SEQ ID NO: 3029670 - RNA, 16 nt, Human
auucuccuuguguuac

SEQ ID NO: 3029671 - RNA, 20 nt, Human
auucuccugccucagccucc

SEQ ID NO: 3029672 - RNA, 19 nt, Human
auucuccugccucagccuc

SEQ ID NO: 3029673 - RNA, 15 nt, Human
auucuccugccucag

SEQ ID NO: 3029674 - RNA, 17 nt, Human
auucuccugccucagcc

SEQ ID NO: 3029675 - RNA, 11 nt, Human
auucuccugcc

SEQ ID NO: 3029676 - RNA, 14 nt, Human
auucuccugccuca

SEQ ID NO: 3029677 - RNA, 13 nt, Human
auucuccugccuc

SEQ ID NO: 3029678 - RNA, 21 nt, Human
auucuccaccugccagggaca

SEQ ID NO: 3029679 - RNA, 18 nt, Human
auucuccaccugccaggg

SEQ ID NO: 3029680 - RNA, 17 nt, Human
auuauauagcaguaaaa

SEQ ID NO: 3029681 - RNA, 14 nt, Human
auucaggaagcuca

SEQ ID NO: 3029682 - RNA, 15 nt, Human
auucaguaauaacuc

SEQ ID NO: 3029683 - RNA, 19 nt, Human
auucaguaauaacucuacc

SEQ ID NO: 3029684 - RNA, 20 nt, Human
auucaggaagcucagggccu

SEQ ID NO: 3029685 - RNA, 19 nt, Human
auucaggaagcucagggcc

SEQ ID NO: 3029686 - RNA, 17 nt, Human
auucaggaagcucaggg

SEQ ID NO: 3029687 - RNA, 16 nt, Human
auucccaagcucugcu

SEQ ID NO: 3029688 - RNA, 14 nt, Human
auucccaagcucug

SEQ ID NO: 3029689 - RNA, 15 nt, Human
auucccaagcucugc

SEQ ID NO: 3029690 - RNA, 16 nt, Human
uuuugccaauuugcac

SEQ ID NO: 3029691 - RNA, 19 nt, Human
uuuugccaauuugcacauu

SEQ ID NO: 3029692 - RNA, 18 nt, Human
uuuugccaauuugcacau

SEQ ID NO: 3029693 - RNA, 23 nt, Human
uuuugccauguuggccaggcugg

SEQ ID NO: 3029694 - RNA, 15 nt, Human
uuuugcauauugcau

SEQ ID NO: 3029695 - RNA, 18 nt, Human
uuuugcauauugcauacu

SEQ ID NO: 3029696 - RNA, 17 nt, Human
uuuugagugccuuacac

SEQ ID NO: 3029697 - RNA, 17 nt, Human
uuuugauccaagcuggu

SEQ ID NO: 3029698 - RNA, 17 nt, Human
uuuugugcauuaucuag

SEQ ID NO: 3029699 - RNA, 20 nt, Human
uuuugugcauuaucuagaua

SEQ ID NO: 3029700 - RNA, 15 nt, Human
uuuuguuccacaagu

SEQ ID NO: 3029701 - RNA, 21 nt, Human
uuuuguuccacaaguuaaaua

SEQ ID NO: 3029702 - RNA, 22 nt, Human
uuuuuagacagagucucacugu

SEQ ID NO: 3029703 - RNA, 11 nt, Human
uuuuuacuaau

SEQ ID NO: 3029704 - RNA, 12 nt, Human
uuuuuauggcuu

SEQ ID NO: 3029705 - RNA, 20 nt, Human
uuuuuaucgucacugcuuaa

SEQ ID NO: 3029706 - RNA, 14 nt, Human
auuaaguacuaugu

SEQ ID NO: 3029707 - RNA, 22 nt, Human
uuuuuauggcuuuugugcauua

SEQ ID NO: 3029708 - RNA, 20 nt, Human
uuuuuauggcuuuugugcau

SEQ ID NO: 3029709 - RNA, 21 nt, Human
uuuuuauggcuuuugugcauu

SEQ ID NO: 3029710 - RNA, 19 nt, Human
uuuuuguagagccaggguc

SEQ ID NO: 3029711 - RNA, 20 nt, Human
uuuuuguagagccagggucu

SEQ ID NO: 3029712 - RNA, 14 nt, Human
auguguucuauuca

SEQ ID NO: 3029713 - RNA, 13 nt, Human
auguuaauauuuc

SEQ ID NO: 3029714 - RNA, 13 nt, Human
auguuaauauuuu

SEQ ID NO: 3029715 - RNA, 22 nt, Human
auguuaauauuuuagguguaaa

SEQ ID NO: 3029716 - RNA, 20 nt, Human
auguugcccaggcaggucuu

SEQ ID NO: 3029717 - RNA, 16 nt, Human
auguugcccaggcagg

SEQ ID NO: 3029718 - RNA, 17 nt, Human
auguugcccaggcaggu

SEQ ID NO: 3029719 - RNA, 12 nt, Human
auguugcccagg

SEQ ID NO: 3029720 - RNA, 21 nt, Human
augugccagguuuuuggucug

SEQ ID NO: 3029721 - RNA, 22 nt, Human
augugccagguuuuuggucuga

SEQ ID NO: 3029722 - RNA, 20 nt, Human
auggggcccugccuccuuug

SEQ ID NO: 3029723 - RNA, 24 nt, Human
auguggaguucaucuugaauugua

SEQ ID NO: 3029724 - RNA, 20 nt, Human
auguggaguucaucuugaau

SEQ ID NO: 3029725 - RNA, 16 nt, Human
auuaaacaugcuguac

SEQ ID NO: 3029726 - RNA, 15 nt, Human
auuaaaaaucucaaa

SEQ ID NO: 3029727 - RNA, 19 nt, Human
auuaaaaaucucaaauuuc

SEQ ID NO: 3029728 - RNA, 23 nt, Human
auuaaaacacaacaucuuuuucu

SEQ ID NO: 3029729 - RNA, 20 nt, Human
auuaaaaaucucaaauuucu

SEQ ID NO: 3029730 - RNA, 22 nt, Human
auuaaaaaucucaaauuucuaa

SEQ ID NO: 3029731 - RNA, 20 nt, Human
uuuucauuuaggugaggaag

SEQ ID NO: 3029732 - RNA, 14 nt, Human
uuuucaguguacau

SEQ ID NO: 3029733 - RNA, 11 nt, Human
uuuuauuuuau

SEQ ID NO: 3029734 - RNA, 13 nt, Human
uuuuauuaugcau

SEQ ID NO: 3029735 - RNA, 14 nt, Human
auuuuacuuuuugg

SEQ ID NO: 3029736 - RNA, 17 nt, Human
auuuuacuuuuuggaaa

SEQ ID NO: 3029737 - RNA, 21 nt, Human
auuuuacuuuaaaaggagcca

SEQ ID NO: 3029738 - RNA, 15 nt, Human
auuuuaauucaguug

SEQ ID NO: 3029739 - RNA, 18 nt, Human
auuugaagguagaauguu

SEQ ID NO: 3029740 - RNA, 23 nt, Human
auuugaagguagaauguuuucaa

SEQ ID NO: 3029741 - RNA, 23 nt, Human
auuuguuuugccaauuugcacau

SEQ ID NO: 3029742 - RNA, 21 nt, Human
auuuguuuugccaauuugcac

SEQ ID NO: 3029743 - RNA, 14 nt, Human
auuugugagacugu

SEQ ID NO: 3029744 - RNA, 14 nt, Human
auuugugauacaau

SEQ ID NO: 3029745 - RNA, 12 nt, Human
auuugugagacu

SEQ ID NO: 3029746 - RNA, 23 nt, Human
auugggcacaucauuucaagaag

SEQ ID NO: 3029747 - RNA, 21 nt, Human
auugggcacaucauuucaaga

SEQ ID NO: 3029748 - RNA, 19 nt, Human
auugggcacaucauuucaa

SEQ ID NO: 3029749 - RNA, 18 nt, Human
auugggcacaucauuuca

SEQ ID NO: 3029750 - RNA, 17 nt, Human
auugggcacaucauuuc

SEQ ID NO: 3029751 - RNA, 18 nt, Human
auugacaggauuauugga

SEQ ID NO: 3029752 - RNA, 15 nt, Human
auugaaaaaccauuu

SEQ ID NO: 3029753 - RNA, 13 nt, Human
auucuuauuuaau

SEQ ID NO: 3029754 - RNA, 14 nt, Human
auucuuauuuaaug

SEQ ID NO: 3029755 - RNA, 18 nt, Human
auucuuauuuaaugaaag

SEQ ID NO: 3029756 - RNA, 13 nt, Human
auucuucuccacu

SEQ ID NO: 3029757 - RNA, 13 nt, Human
auucuuccucccu

SEQ ID NO: 3029758 - RNA, 22 nt, Human
auucuuccucccucccucuuuc

SEQ ID NO: 3029759 - RNA, 20 nt, Human
auuguccccgacccuugccg

SEQ ID NO: 3029760 - RNA, 19 nt, Human
auuguccccgacccuugcc

SEQ ID NO: 3029761 - RNA, 17 nt, Human
auuguccccgacccuug

SEQ ID NO: 3029762 - RNA, 14 nt, Human
auugugucucuugg

SEQ ID NO: 3029763 - RNA, 18 nt, Human
auugugucucuugguccu

SEQ ID NO: 3029764 - RNA, 14 nt, Human
auuuauuuauucau

SEQ ID NO: 3029765 - RNA, 14 nt, Human
auuuauucauuagu

SEQ ID NO: 3029766 - RNA, 13 nt, Human
auuuauucugcuc

SEQ ID NO: 3029767 - RNA, 23 nt, Human
auuucaaacagucucccuuccua

SEQ ID NO: 3029768 - RNA, 17 nt, Human
auuuccagccaaagccu

SEQ ID NO: 3029769 - RNA, 15 nt, Human
auuuccguuaaaaua

SEQ ID NO: 3029770 - RNA, 16 nt, Human
auuuccguuaaaauac

SEQ ID NO: 3029771 - RNA, 14 nt, Human
auuugaaaauuuug

SEQ ID NO: 3029772 - RNA, 22 nt, Human
auuuauuaaaugcccagccccu

SEQ ID NO: 3029773 - RNA, 12 nt, Human
auuuaacagaaa

SEQ ID NO: 3029774 - RNA, 14 nt, Human
auuuaacagaaaug

SEQ ID NO: 3029775 - RNA, 17 nt, Human
auuuacuucuuauacau

SEQ ID NO: 3029776 - RNA, 14 nt, Human
auuuacuucuuaua

SEQ ID NO: 3029777 - RNA, 16 nt, Human
auuuacuucuuauaca

SEQ ID NO: 3029778 - RNA, 15 nt, Human
auuuagaaauauaau

SEQ ID NO: 3029779 - RNA, 14 nt, Human
auuuauucugcuca

SEQ ID NO: 3029780 - RNA, 13 nt, Human
aucuuuuaugauu

SEQ ID NO: 3029781 - RNA, 20 nt, Human
augaaagacuguacaaagua

SEQ ID NO: 3029782 - RNA, 19 nt, Human
augaaagacuguacaaagu

SEQ ID NO: 3029783 - RNA, 23 nt, Human
uuggccugucuuuggauuguuaa

SEQ ID NO: 3029784 - RNA, 18 nt, Human
uuggaaagaguaggaaga

SEQ ID NO: 3029785 - RNA, 21 nt, Human
uuggcuagagguucaaagaua

SEQ ID NO: 3029786 - RNA, 22 nt, Human
uuggcuaggaccccuccaugug

SEQ ID NO: 3029787 - RNA, 22 nt, Human
uuggcuagagguucaaagauau

SEQ ID NO: 3029788 - RNA, 13 nt, Human
uuggcugcaggga

SEQ ID NO: 3029789 - RNA, 14 nt, Human
uuggcugcagggag

SEQ ID NO: 3029790 - RNA, 15 nt, Human
uuggcugcugaaggc

SEQ ID NO: 3029791 - RNA, 11 nt, Human
uuggcugcuga

SEQ ID NO: 3029792 - RNA, 17 nt, Human
uuggaaagaguaggaag

SEQ ID NO: 3029793 - RNA, 18 nt, Human
uugcugauggugcaauga

SEQ ID NO: 3029794 - RNA, 17 nt, Human
uugcugauggugcaaug

SEQ ID NO: 3029795 - RNA, 20 nt, Human
uugcuaagugaggaugaaaa

SEQ ID NO: 3029796 - RNA, 19 nt, Human
uugcugaauacagaggcaa

SEQ ID NO: 3029797 - RNA, 22 nt, Human
uuguaacuguuuagaugaaugu

SEQ ID NO: 3029798 - RNA, 21 nt, Human
uuguaacuguuuagaugaaug

SEQ ID NO: 3029799 - RNA, 14 nt, Human
uuguaaggaaugau

SEQ ID NO: 3029800 - RNA, 22 nt, Human
uugggguacccacugcucuggu

SEQ ID NO: 3029801 - RNA, 19 nt, Human
uugguuaggcauuguggga

SEQ ID NO: 3029802 - RNA, 17 nt, Human
uugggguacccacugcu

SEQ ID NO: 3029803 - RNA, 19 nt, Human
uuggggaagaacgaagcca

SEQ ID NO: 3029804 - RNA, 13 nt, Human
augaaccacaucu

SEQ ID NO: 3029805 - RNA, 20 nt, Human
augaaccacaucuugcucug

SEQ ID NO: 3029806 - RNA, 20 nt, Human
uuguaaggaaugauuaauua

SEQ ID NO: 3029807 - RNA, 20 nt, Human
augacacgaauauugcugau

SEQ ID NO: 3029808 - RNA, 19 nt, Human
augacacgaauauugcuga

SEQ ID NO: 3029809 - RNA, 16 nt, Human
uuguuuuuauuaaaag

SEQ ID NO: 3029810 - RNA, 19 nt, Human
augcaccuggaauauauaa

SEQ ID NO: 3029811 - RNA, 22 nt, Human
augcaaggucauuuuuuuuaag

SEQ ID NO: 3029812 - RNA, 16 nt, Human
augcaccuggaauaua

SEQ ID NO: 3029813 - RNA, 14 nt, Human
augcaccuggaaua

SEQ ID NO: 3029814 - RNA, 14 nt, Human
augcaaggucauuu

SEQ ID NO: 3029815 - RNA, 16 nt, Human
augcaaggucauuuuu

SEQ ID NO: 3029816 - RNA, 22 nt, Human
augcaaaccaucauugaaaucu

SEQ ID NO: 3029817 - RNA, 21 nt, Human
augcaaaccaucauugaaauc

SEQ ID NO: 3029818 - RNA, 20 nt, Human
augcaaaccaucauugaaau

SEQ ID NO: 3029819 - RNA, 19 nt, Human
augcaaaccaucauugaaa

SEQ ID NO: 3029820 - RNA, 18 nt, Human
augcaaaccaucauugaa

SEQ ID NO: 3029821 - RNA, 16 nt, Human
augcaaaccaucauug

SEQ ID NO: 3029822 - RNA, 15 nt, Human
augaucuucuuuaua

SEQ ID NO: 3029823 - RNA, 22 nt, Human
uuguucccugugucauuucaaa

SEQ ID NO: 3029824 - RNA, 19 nt, Human
uuguugaggguauguuuua

SEQ ID NO: 3029825 - RNA, 14 nt, Human
uugugaauaaagag

SEQ ID NO: 3029826 - RNA, 22 nt, Human
uugugaaggcaggggaauguau

SEQ ID NO: 3029827 - RNA, 18 nt, Human
augaucacggcucacugc

SEQ ID NO: 3029828 - RNA, 19 nt, Human
augaucacggcucacugca

SEQ ID NO: 3029829 - RNA, 15 nt, Human
augaucacggcucac

SEQ ID NO: 3029830 - RNA, 23 nt, Human
augaucacggcucacugcagccu

SEQ ID NO: 3029831 - RNA, 16 nt, Human
augauccuaggcauuu

SEQ ID NO: 3029832 - RNA, 14 nt, Human
augaucuucuuuau

SEQ ID NO: 3029833 - RNA, 15 nt, Human
augagcaucaggcca

SEQ ID NO: 3029834 - RNA, 17 nt, Human
augagcaucaggccagg

SEQ ID NO: 3029835 - RNA, 16 nt, Human
augagcaucaggccag

SEQ ID NO: 3029836 - RNA, 21 nt, Human
augagcaucaggccaggcccu

SEQ ID NO: 3029837 - RNA, 20 nt, Human
augagcaucaggccaggccc

SEQ ID NO: 3029838 - RNA, 19 nt, Human
augagcaucaggccaggcc

SEQ ID NO: 3029839 - RNA, 18 nt, Human
augagcaucaggccaggc

SEQ ID NO: 3029840 - RNA, 22 nt, Human
augagcaucaggccaggcccuc

SEQ ID NO: 3029841 - RNA, 12 nt, Human
augagccucagc

SEQ ID NO: 3029842 - RNA, 15 nt, Human
augagccucagcauc

SEQ ID NO: 3029843 - RNA, 16 nt, Human
augagccucagcaucc

SEQ ID NO: 3029844 - RNA, 16 nt, Human
augagaggaaaucacc

SEQ ID NO: 3029845 - RNA, 15 nt, Human
augagaggaaaucac

SEQ ID NO: 3029846 - RNA, 14 nt, Human
augagaggaaauca

SEQ ID NO: 3029847 - RNA, 13 nt, Human
augagaggaaauc

SEQ ID NO: 3029848 - RNA, 12 nt, Human
augagaggaaau

SEQ ID NO: 3029849 - RNA, 22 nt, Human
augaggucagagccugcaguua

SEQ ID NO: 3029850 - RNA, 17 nt, Human
augagccucagcauccu

SEQ ID NO: 3029851 - RNA, 18 nt, Human
augagccucagcauccug

SEQ ID NO: 3029852 - RNA, 15 nt, Human
augauaaaacacaaa

SEQ ID NO: 3029853 - RNA, 18 nt, Human
uugucacacacuuuggcu

SEQ ID NO: 3029854 - RNA, 22 nt, Human
uuuauauagcaagacauuauau

SEQ ID NO: 3029855 - RNA, 18 nt, Human
uuuauauagcaagacauu

SEQ ID NO: 3029856 - RNA, 18 nt, Human
uuuagaguugauacuaca

SEQ ID NO: 3029857 - RNA, 13 nt, Human
uuuagauaauaca

SEQ ID NO: 3029858 - RNA, 15 nt, Human
uuuagauaauacacc

SEQ ID NO: 3029859 - RNA, 19 nt, Human
uuuauuaaaugcccagccc

SEQ ID NO: 3029860 - RNA, 16 nt, Human
augccuaccaauauuu

SEQ ID NO: 3029861 - RNA, 17 nt, Human
augccuaccaauauuua

SEQ ID NO: 3029862 - RNA, 23 nt, Human
augccuaccaauauuuaaucuuu

SEQ ID NO: 3029863 - RNA, 14 nt, Human
uuuaccuuuuuuau

SEQ ID NO: 3029864 - RNA, 19 nt, Human
uuuaccuuuuuuauacaua

SEQ ID NO: 3029865 - RNA, 20 nt, Human
uuuaccuuuuuuauacauaa

SEQ ID NO: 3029866 - RNA, 17 nt, Human
augcuacacacugcaug

SEQ ID NO: 3029867 - RNA, 22 nt, Human
uuuaccugaagucuuuguacag

SEQ ID NO: 3029868 - RNA, 18 nt, Human
augcuacacacugcaugu

SEQ ID NO: 3029869 - RNA, 18 nt, Human
uuuacuaauagacaauuu

SEQ ID NO: 3029870 - RNA, 14 nt, Human
uuuacuaauagaca

SEQ ID NO: 3029871 - RNA, 17 nt, Human
uuuacuaauagacaauu

SEQ ID NO: 3029872 - RNA, 21 nt, Human
uuuaccuuuuuuauacauaaa

SEQ ID NO: 3029873 - RNA, 19 nt, Human
augcugugcccuaaagugu

SEQ ID NO: 3029874 - RNA, 22 nt, Human
augcuggcuguuggcugggggc

SEQ ID NO: 3029875 - RNA, 17 nt, Human
auggaacacucugagac

SEQ ID NO: 3029876 - RNA, 18 nt, Human
auggaacacucugagacu

SEQ ID NO: 3029877 - RNA, 21 nt, Human
auggaaguacuauaauuuacc

SEQ ID NO: 3029878 - RNA, 14 nt, Human
auggaauaacaugu

SEQ ID NO: 3029879 - RNA, 15 nt, Human
auggaauaacaugua

SEQ ID NO: 3029880 - RNA, 14 nt, Human
uuucacucuccuug

SEQ ID NO: 3029881 - RNA, 24 nt, Human
uuucacucuuauugcccacgcugg

SEQ ID NO: 3029882 - RNA, 15 nt, Human
uuucacucuccuugg

SEQ ID NO: 3029883 - RNA, 19 nt, Human
uuuccagguuuaagcuguu

SEQ ID NO: 3029884 - RNA, 23 nt, Human
uuugaaacacugguuuuaaauau

SEQ ID NO: 3029885 - RNA, 13 nt, Human
auggggcccugcc

SEQ ID NO: 3029886 - RNA, 14 nt, Human
auggggcccugccu

SEQ ID NO: 3029887 - RNA, 23 nt, Human
augggcuggguucuacccaggug

SEQ ID NO: 3029888 - RNA, 13 nt, Human
uuucuuuguggcu

SEQ ID NO: 3029889 - RNA, 13 nt, Human
uuucucauguuga

SEQ ID NO: 3029890 - RNA, 15 nt, Human
uuucucauguugaaa

SEQ ID NO: 3029891 - RNA, 16 nt, Human
uuucugccgcagcccu

SEQ ID NO: 3029892 - RNA, 14 nt, Human
uuucugccgcagcc

SEQ ID NO: 3029893 - RNA, 21 nt, Human
uuucugcagccacuauuguua

SEQ ID NO: 3029894 - RNA, 22 nt, Human
uuucucacagaagaugaagcac

SEQ ID NO: 3029895 - RNA, 18 nt, Human
uuucucacagaagaugaa

SEQ ID NO: 3029896 - RNA, 15 nt, Human
uuucuaugacacaug

SEQ ID NO: 3029897 - RNA, 21 nt, Human
uuucuaugacacaugcaaggu

SEQ ID NO: 3029898 - RNA, 20 nt, Human
uuuccuucaagaaugcagua

SEQ ID NO: 3029899 - RNA, 11 nt, Human
uuuccuucagu

SEQ ID NO: 3029900 - RNA, 15 nt, Human
uuuccuucagugccu

SEQ ID NO: 3029901 - RNA, 12 nt, Human
uuuccuucagug

SEQ ID NO: 3029902 - RNA, 12 nt, Human
uuuccugugucu

SEQ ID NO: 3029903 - RNA, 23 nt, Human
uuuccuucauucaacccaccugc

SEQ ID NO: 3029904 - RNA, 21 nt, Human
uuuccuucagugccuuaugga

SEQ ID NO: 3029905 - RNA, 18 nt, Human
uuuccuucagugccuuau

SEQ ID NO: 3029906 - RNA, 22 nt, Human
uuuccuucagugccuuauggaa

SEQ ID NO: 3029907 - RNA, 21 nt, Human
uuuccuucauucaacccaccu

SEQ ID NO: 3029908 - RNA, 22 nt, Human
uuucgcaggauucuuccucccu

SEQ ID NO: 3029909 - RNA, 18 nt, Human
uuucgcaggauucuuccu

SEQ ID NO: 3029910 - RNA, 13 nt, Human
augggagcucaug

SEQ ID NO: 3029911 - RNA, 18 nt, Human
augggcaacccccagccu

SEQ ID NO: 3029912 - RNA, 19 nt, Human
augggcaacccccagccug

SEQ ID NO: 3029913 - RNA, 21 nt, Human
augggcaacccccagccugcu

SEQ ID NO: 3029914 - RNA, 15 nt, Human
augggccuccugugu

SEQ ID NO: 3029915 - RNA, 15 nt, Human
augggcagagcagag

SEQ ID NO: 3029916 - RNA, 14 nt, Human
augggcagagcaga

SEQ ID NO: 3029917 - RNA, 13 nt, Human
augggcagagcag

SEQ ID NO: 3029918 - RNA, 21 nt, Human
auggacccaauauuuaccaga

SEQ ID NO: 3029919 - RNA, 19 nt, Human
auggacaugaucuucuuua

SEQ ID NO: 3029920 - RNA, 18 nt, Human
auggccucuucagaucuc

SEQ ID NO: 3029921 - RNA, 19 nt, Human
uucauuaguuuugaagauu

SEQ ID NO: 3029922 - RNA, 14 nt, Human
uucauuaguuuuga

SEQ ID NO: 3029923 - RNA, 19 nt, Human
uucauucuuuuugaaaugu

SEQ ID NO: 3029924 - RNA, 22 nt, Human
uuccaauuuacauacucugcuu

SEQ ID NO: 3029925 - RNA, 16 nt, Human
uuccaguaaugagcuu

SEQ ID NO: 3029926 - RNA, 17 nt, Human
uuccagguuuaagcugu

SEQ ID NO: 3029927 - RNA, 18 nt, Human
uuccagguuuaagcuguu

SEQ ID NO: 3029928 - RNA, 17 nt, Human
uuccaggcugggagagc

SEQ ID NO: 3029929 - RNA, 15 nt, Human
uuccaggcugggaga

SEQ ID NO: 3029930 - RNA, 13 nt, Human
uuccaggcuggga

SEQ ID NO: 3029931 - RNA, 21 nt, Human
uuccacaagagcccaggccuc

SEQ ID NO: 3029932 - RNA, 21 nt, Human
auauguggaguucaucuugaa

SEQ ID NO: 3029933 - RNA, 20 nt, Human
auauguggaguucaucuuga

SEQ ID NO: 3029934 - RNA, 14 nt, Human
uucaggguuggccc

SEQ ID NO: 3029935 - RNA, 16 nt, Human
uucaggguuggccccu

SEQ ID NO: 3029936 - RNA, 17 nt, Human
uucaggguuggccccug

SEQ ID NO: 3029937 - RNA, 19 nt, Human
uucaggguuggccccugcc

SEQ ID NO: 3029938 - RNA, 22 nt, Human
uucaggguuggccccugcccgg

SEQ ID NO: 3029939 - RNA, 15 nt, Human
uucagguaacaggca

SEQ ID NO: 3029940 - RNA, 16 nt, Human
uucagguaacaggcag

SEQ ID NO: 3029941 - RNA, 16 nt, Human
uucagaaauguguuau

SEQ ID NO: 3029942 - RNA, 21 nt, Human
auauauguuuuaagaggcagg

SEQ ID NO: 3029943 - RNA, 22 nt, Human
auauauguuuuaagaggcaggg

SEQ ID NO: 3029944 - RNA, 17 nt, Human
uucagguaacaggcaga

SEQ ID NO: 3029945 - RNA, 14 nt, Human
uucaguaagccgug

SEQ ID NO: 3029946 - RNA, 22 nt, Human
uuccuguuuuuauuauuaacaa

SEQ ID NO: 3029947 - RNA, 22 nt, Human
uuccuggcacugcuuccaguga

SEQ ID NO: 3029948 - RNA, 20 nt, Human
uuccuggcacugcuuccagu

SEQ ID NO: 3029949 - RNA, 19 nt, Human
uuccuggcacugcuuccag

SEQ ID NO: 3029950 - RNA, 22 nt, Human
uuccucuuuuuauuuaguuccu

SEQ ID NO: 3029951 - RNA, 21 nt, Human
aucaacugcaucaagauguga

SEQ ID NO: 3029952 - RNA, 14 nt, Human
aucacgccacugca

SEQ ID NO: 3029953 - RNA, 15 nt, Human
aucacgccacugcac

SEQ ID NO: 3029954 - RNA, 17 nt, Human
aucacgccacugcacua

SEQ ID NO: 3029955 - RNA, 19 nt, Human
auauugguugggaugacuu

SEQ ID NO: 3029956 - RNA, 22 nt, Human
auauugcugauggugcaaugac

SEQ ID NO: 3029957 - RNA, 20 nt, Human
auauugguugggaugacuug

SEQ ID NO: 3029958 - RNA, 15 nt, Human
auauugauaugcuua

SEQ ID NO: 3029959 - RNA, 13 nt, Human
auauuuaaucuuu

SEQ ID NO: 3029960 - RNA, 13 nt, Human
auauuguuuucag

SEQ ID NO: 3029961 - RNA, 16 nt, Human
uuccagugaggcucug

SEQ ID NO: 3029962 - RNA, 15 nt, Human
uuccagugaggcucu

SEQ ID NO: 3029963 - RNA, 17 nt, Human
auauuaccacagacaua

SEQ ID NO: 3029964 - RNA, 16 nt, Human
auauuaagaaagacua

SEQ ID NO: 3029965 - RNA, 15 nt, Human
auauuaagaaagacu

SEQ ID NO: 3029966 - RNA, 17 nt, Human
auauuaagaaagacuau

SEQ ID NO: 3029967 - RNA, 22 nt, Human
auauuaagaaagacuaucuaaa

SEQ ID NO: 3029968 - RNA, 14 nt, Human
aucacuuccaugac

SEQ ID NO: 3029969 - RNA, 17 nt, Human
aucaggugcugccaucc

SEQ ID NO: 3029970 - RNA, 19 nt, Human
aucaggugcugccauccag

SEQ ID NO: 3029971 - RNA, 15 nt, Human
aucaggugcugccau

SEQ ID NO: 3029972 - RNA, 14 nt, Human
aucaggugcugcca

SEQ ID NO: 3029973 - RNA, 19 nt, Human
aucagucugauucccaagc

SEQ ID NO: 3029974 - RNA, 23 nt, Human
aucauaguggcuuaaaacaacac

SEQ ID NO: 3029975 - RNA, 15 nt, Human
aucauaaaacuugau

SEQ ID NO: 3029976 - RNA, 16 nt, Human
aucauuaggugugacu

SEQ ID NO: 3029977 - RNA, 21 nt, Human
aucauccacugugccaugugc

SEQ ID NO: 3029978 - RNA, 23 nt, Human
aucauccacugugccaugugcca

SEQ ID NO: 3029979 - RNA, 12 nt, Human
aucauugaaauc

SEQ ID NO: 3029980 - RNA, 19 nt, Human
uucugcagccacuauuguu

SEQ ID NO: 3029981 - RNA, 20 nt, Human
uucucuaguuugauuaaauu

SEQ ID NO: 3029982 - RNA, 21 nt, Human
uucucuaguuugauuaaauuc

SEQ ID NO: 3029983 - RNA, 16 nt, Human
auccaauugcugcuug

SEQ ID NO: 3029984 - RNA, 15 nt, Human
uucugccugcccagg

SEQ ID NO: 3029985 - RNA, 16 nt, Human
uucugccugcccaggc

SEQ ID NO: 3029986 - RNA, 17 nt, Human
auccagguucagcuugu

SEQ ID NO: 3029987 - RNA, 14 nt, Human
auccaguaucuuga

SEQ ID NO: 3029988 - RNA, 11 nt, Human
aucccagcccc

SEQ ID NO: 3029989 - RNA, 13 nt, Human
aucccaugagccu

SEQ ID NO: 3029990 - RNA, 16 nt, Human
aucccaugagccucag

SEQ ID NO: 3029991 - RNA, 22 nt, Human
aucccugaaggccccgcccagg

SEQ ID NO: 3029992 - RNA, 17 nt, Human
aucccugaaggccccgc

SEQ ID NO: 3029993 - RNA, 17 nt, Human
aucccaugagccucagc

SEQ ID NO: 3029994 - RNA, 18 nt, Human
aucccaugagccucagca

SEQ ID NO: 3029995 - RNA, 21 nt, Human
uucuguuggccagugugacaa

SEQ ID NO: 3029996 - RNA, 13 nt, Human
uucuguuuagaua

SEQ ID NO: 3029997 - RNA, 18 nt, Human
uucuguuuagauaauaca

SEQ ID NO: 3029998 - RNA, 22 nt, Human
uucuucuccacuuucuagccag

SEQ ID NO: 3029999 - RNA, 13 nt, Human
uucuugcaaagua

SEQ ID NO: 3030000 - RNA, 12 nt, Human
uucuuucuggcu

SEQ ID NO: 3030001 - RNA, 17 nt, Human
uucuuucuggcuaugca

SEQ ID NO: 3030002 - RNA, 20 nt, Human
uucuuucuggcuaugcauuu

SEQ ID NO: 3030003 - RNA, 14 nt, Human
uugaaggaugcugu

SEQ ID NO: 3030004 - RNA, 16 nt, Human
uugaaggaugcugucu

SEQ ID NO: 3030005 - RNA, 14 nt, Human
uugaaguaaaaugu

SEQ ID NO: 3030006 - RNA, 16 nt, Human
uugaagguagaauguu

SEQ ID NO: 3030007 - RNA, 19 nt, Human
uugaagguagaauguuuuc

SEQ ID NO: 3030008 - RNA, 15 nt, Human
uugaagguagaaugu

SEQ ID NO: 3030009 - RNA, 15 nt, Human
aucuaaauguugaaa

SEQ ID NO: 3030010 - RNA, 19 nt, Human
aucuaaauggaaccacucu

SEQ ID NO: 3030011 - RNA, 14 nt, Human
aucgugacaacacu

SEQ ID NO: 3030012 - RNA, 15 nt, Human
aucgugacaacacuu

SEQ ID NO: 3030013 - RNA, 18 nt, Human
aucgucacugcuuaacuu

SEQ ID NO: 3030014 - RNA, 14 nt, Human
aucgucacugcuua

SEQ ID NO: 3030015 - RNA, 24 nt, Human
uugaccauucuccaccugccaggg

SEQ ID NO: 3030016 - RNA, 17 nt, Human
uugaccauucuccaccu

SEQ ID NO: 3030017 - RNA, 19 nt, Human
uugaccauucuccaccugc

SEQ ID NO: 3030018 - RNA, 18 nt, Human
uugaccauucuccaccug

SEQ ID NO: 3030019 - RNA, 19 nt, Human
uugacagggcacaccgggc

SEQ ID NO: 3030020 - RNA, 12 nt, Human
uugauaaaguaa

SEQ ID NO: 3030021 - RNA, 15 nt, Human
uugaggucuguucuu

SEQ ID NO: 3030022 - RNA, 16 nt, Human
uugaggucuguucuuu

SEQ ID NO: 3030023 - RNA, 22 nt, Human
auccuggcacccggccccugcu

SEQ ID NO: 3030024 - RNA, 23 nt, Human
auccuggcacccggccccugcug

SEQ ID NO: 3030025 - RNA, 15 nt, Human
auccuggaguucugg

SEQ ID NO: 3030026 - RNA, 17 nt, Human
auccuggcacccggccc

SEQ ID NO: 3030027 - RNA, 19 nt, Human
auccuggcacccggccccu

SEQ ID NO: 3030028 - RNA, 20 nt, Human
auccuggcacccggccccug

SEQ ID NO: 3030029 - RNA, 21 nt, Human
auccuggcacccggccccugc

SEQ ID NO: 3030030 - RNA, 11 nt, Human
auccugagcca

SEQ ID NO: 3030031 - RNA, 13 nt, Human
auccugagccaga

SEQ ID NO: 3030032 - RNA, 12 nt, Human
auccugagccag

SEQ ID NO: 3030033 - RNA, 17 nt, Human
auccucuuugagugaag

SEQ ID NO: 3030034 - RNA, 20 nt, Human
uucuuuugccguuauuaaaa

SEQ ID NO: 3030035 - RNA, 20 nt, Human
auccucuguacagagcccac

SEQ ID NO: 3030036 - RNA, 18 nt, Human
auccucuguacagagccc

SEQ ID NO: 3030037 - RNA, 21 nt, Human
auccugagccagauuucacuc

SEQ ID NO: 3030038 - RNA, 17 nt, Human
auccugagccagauuuc

SEQ ID NO: 3030039 - RNA, 15 nt, Human
auccugagccagauu

SEQ ID NO: 3030040 - RNA, 14 nt, Human
auccugagccagau

SEQ ID NO: 3030041 - RNA, 22 nt, Human
uggaguuauugaagcagagugg

SEQ ID NO: 3030042 - RNA, 15 nt, Human
aggccacaagacccu

SEQ ID NO: 3030043 - RNA, 15 nt, Human
uggaugccugguggc

SEQ ID NO: 3030044 - RNA, 20 nt, Human
uggaguucaucuugaauugu

SEQ ID NO: 3030045 - RNA, 17 nt, Human
uggaguucaucuugaau

SEQ ID NO: 3030046 - RNA, 16 nt, Human
uggaguucaucuugaa

SEQ ID NO: 3030047 - RNA, 18 nt, Human
uggaugccugguggcagc

SEQ ID NO: 3030048 - RNA, 19 nt, Human
uggaugccugguggcagcu

SEQ ID NO: 3030049 - RNA, 20 nt, Human
uggaguuauugaagcagagu

SEQ ID NO: 3030050 - RNA, 18 nt, Human
aggccaaggugggaggau

SEQ ID NO: 3030051 - RNA, 20 nt, Human
aggccaaaggaagcacaugc

SEQ ID NO: 3030052 - RNA, 23 nt, Human
aggccaaaggaagcacaugccuc

SEQ ID NO: 3030053 - RNA, 20 nt, Human
aggccaaacucaccugcccc

SEQ ID NO: 3030054 - RNA, 14 nt, Human
aggccaaaggaagc

SEQ ID NO: 3030055 - RNA, 18 nt, Human
aggcauuuguuugaacug

SEQ ID NO: 3030056 - RNA, 16 nt, Human
aggccaaacucaccug

SEQ ID NO: 3030057 - RNA, 12 nt, Human
uggcagccccug

SEQ ID NO: 3030058 - RNA, 20 nt, Human
aggccacaagacccuugugg

SEQ ID NO: 3030059 - RNA, 22 nt, Human
uggcagaguugaagacagagcu

SEQ ID NO: 3030060 - RNA, 15 nt, Human
uggcacccggccccu

SEQ ID NO: 3030061 - RNA, 21 nt, Human
uggcagaguugaagacagagc

SEQ ID NO: 3030062 - RNA, 12 nt, Human
uggauguucuga

SEQ ID NO: 3030063 - RNA, 22 nt, Human
uggauuaaacuuaaucuaaaug

SEQ ID NO: 3030064 - RNA, 20 nt, Human
uggcacaucagcacgauuuc

SEQ ID NO: 3030065 - RNA, 18 nt, Human
uggcaccagcagccugga

SEQ ID NO: 3030066 - RNA, 21 nt, Human
uggccccugcccggcugcgga

SEQ ID NO: 3030067 - RNA, 20 nt, Human
uggccccugcccggcugcgg

SEQ ID NO: 3030068 - RNA, 22 nt, Human
aggccuggccagaugcaccagc

SEQ ID NO: 3030069 - RNA, 23 nt, Human
aggccuggccagaugcaccagcc

SEQ ID NO: 3030070 - RNA, 23 nt, Human
aggccugggggcugggcagagga

SEQ ID NO: 3030071 - RNA, 15 nt, Human
aggccuggccagaug

SEQ ID NO: 3030072 - RNA, 16 nt, Human
aggccuggccagaugc

SEQ ID NO: 3030073 - RNA, 17 nt, Human
aggccuggccagaugca

SEQ ID NO: 3030074 - RNA, 21 nt, Human
aggccuggccagaugcaccag

SEQ ID NO: 3030075 - RNA, 13 nt, Human
uggccucugcacu

SEQ ID NO: 3030076 - RNA, 17 nt, Human
uggccucugcacucccc

SEQ ID NO: 3030077 - RNA, 15 nt, Human
uggccucugcacucc

SEQ ID NO: 3030078 - RNA, 14 nt, Human
uggccucugcacuc

SEQ ID NO: 3030079 - RNA, 15 nt, Human
uggccaggcuggucu

SEQ ID NO: 3030080 - RNA, 17 nt, Human
uggccaggcuggucuca

SEQ ID NO: 3030081 - RNA, 15 nt, Human
uggcaugggaaugaa

SEQ ID NO: 3030082 - RNA, 12 nt, Human
uggcaugggaau

SEQ ID NO: 3030083 - RNA, 14 nt, Human
aggcccucugccca

SEQ ID NO: 3030084 - RNA, 13 nt, Human
aggcccucugccc

SEQ ID NO: 3030085 - RNA, 20 nt, Human
ugggaaagggauuuucagcc

SEQ ID NO: 3030086 - RNA, 16 nt, Human
ugggaaaggggaaguu

SEQ ID NO: 3030087 - RNA, 23 nt, Human
uggcuucacggaagagccuugcg

SEQ ID NO: 3030088 - RNA, 22 nt, Human
uggcuucacggaagagccuugc

SEQ ID NO: 3030089 - RNA, 13 nt, Human
uggcuguuggcug

SEQ ID NO: 3030090 - RNA, 14 nt, Human
uggcugugucuccc

SEQ ID NO: 3030091 - RNA, 15 nt, Human
uggcuguuggcuggg

SEQ ID NO: 3030092 - RNA, 17 nt, Human
uggcuuaaaacaacacu

SEQ ID NO: 3030093 - RNA, 22 nt, Human
uggcuauuagagaucaaccccu

SEQ ID NO: 3030094 - RNA, 19 nt, Human
uggcuaugcauuugaaaau

SEQ ID NO: 3030095 - RNA, 15 nt, Human
uggcuaugcauuuga

SEQ ID NO: 3030096 - RNA, 17 nt, Human
uggcuaugcauuugaaa

SEQ ID NO: 3030097 - RNA, 14 nt, Human
uggcuaugcauuug

SEQ ID NO: 3030098 - RNA, 14 nt, Human
aggcugggagagcc

SEQ ID NO: 3030099 - RNA, 22 nt, Human
uggcuagagguucaaagauauu

SEQ ID NO: 3030100 - RNA, 18 nt, Human
aggcuggcgugcaguggu

SEQ ID NO: 3030101 - RNA, 20 nt, Human
aggcuggcgugcaguggugc

SEQ ID NO: 3030102 - RNA, 12 nt, Human
uggcugcaaagg

SEQ ID NO: 3030103 - RNA, 18 nt, Human
uggcucaaguccucuuuu

SEQ ID NO: 3030104 - RNA, 19 nt, Human
uggcucuuccaggcuggga

SEQ ID NO: 3030105 - RNA, 21 nt, Human
uggcucuuccaggcugggaga

SEQ ID NO: 3030106 - RNA, 20 nt, Human
uggcucuuccaggcugggag

SEQ ID NO: 3030107 - RNA, 15 nt, Human
uggcugcagggaguc

SEQ ID NO: 3030108 - RNA, 13 nt, Human
uggcugcagggag

SEQ ID NO: 3030109 - RNA, 14 nt, Human
uggcugcagggagu

SEQ ID NO: 3030110 - RNA, 20 nt, Human
uggcugccaaugggagcuca

SEQ ID NO: 3030111 - RNA, 18 nt, Human
uggcugccaaugggagcu

SEQ ID NO: 3030112 - RNA, 13 nt, Human
aggcuggcgugca

SEQ ID NO: 3030113 - RNA, 17 nt, Human
aggcuggcgugcagugg

SEQ ID NO: 3030114 - RNA, 16 nt, Human
aggcucugcccuuggu

SEQ ID NO: 3030115 - RNA, 21 nt, Human
aggcucucaggccagcugcuu

SEQ ID NO: 3030116 - RNA, 11 nt, Human
aggcucugccc

SEQ ID NO: 3030117 - RNA, 12 nt, Human
aggcucugcccu

SEQ ID NO: 3030118 - RNA, 13 nt, Human
aggcucugcccuu

SEQ ID NO: 3030119 - RNA, 15 nt, Human
aggcucugcccuugg

SEQ ID NO: 3030120 - RNA, 14 nt, Human
aggcucugcccuug

SEQ ID NO: 3030121 - RNA, 20 nt, Human
aggcucucaggccagcugcu

SEQ ID NO: 3030122 - RNA, 19 nt, Human
aggcucucaggccagcugc

SEQ ID NO: 3030123 - RNA, 18 nt, Human
aggcucucaggccagcug

SEQ ID NO: 3030124 - RNA, 16 nt, Human
aggcucucaggccagc

SEQ ID NO: 3030125 - RNA, 15 nt, Human
aggcucucaggccag

SEQ ID NO: 3030126 - RNA, 14 nt, Human
aggcucucaggcca

SEQ ID NO: 3030127 - RNA, 12 nt, Human
aggcucucaggc

SEQ ID NO: 3030128 - RNA, 11 nt, Human
aggcucucagg

SEQ ID NO: 3030129 - RNA, 21 nt, Human
aggcucgagcaugccuggaug

SEQ ID NO: 3030130 - RNA, 19 nt, Human
aggcucgagcaugccugga

SEQ ID NO: 3030131 - RNA, 18 nt, Human
aggcucgagcaugccugg

SEQ ID NO: 3030132 - RNA, 17 nt, Human
aggcucgagcaugccug

SEQ ID NO: 3030133 - RNA, 15 nt, Human
aggcucgagcaugcc

SEQ ID NO: 3030134 - RNA, 19 nt, Human
aggcuccuuuagcgcccag

SEQ ID NO: 3030135 - RNA, 12 nt, Human
aggcucgagcau

SEQ ID NO: 3030136 - RNA, 17 nt, Human
aggaagcuuacaugccu

SEQ ID NO: 3030137 - RNA, 18 nt, Human
aggaagcugugagagcag

SEQ ID NO: 3030138 - RNA, 18 nt, Human
aggaaggaaacccagcuc

SEQ ID NO: 3030139 - RNA, 13 nt, Human
aggaagccagcag

SEQ ID NO: 3030140 - RNA, 17 nt, Human
aggaagccagcaggcuc

SEQ ID NO: 3030141 - RNA, 15 nt, Human
aggaaggagaggaga

SEQ ID NO: 3030142 - RNA, 19 nt, Human
aggaaggaaacccagcucu

SEQ ID NO: 3030143 - RNA, 22 nt, Human
aggaagcacaugccucucucag

SEQ ID NO: 3030144 - RNA, 15 nt, Human
aggaagccagcaggc

SEQ ID NO: 3030145 - RNA, 14 nt, Human
aggaagccagcagg

SEQ ID NO: 3030146 - RNA, 24 nt, Human
aggaagcacaugccucucucaggc

SEQ ID NO: 3030147 - RNA, 23 nt, Human
aggaagcacaugccucucucagg

SEQ ID NO: 3030148 - RNA, 14 nt, Human
aggaagacuuugga

SEQ ID NO: 3030149 - RNA, 13 nt, Human
aggaagacuuugg

SEQ ID NO: 3030150 - RNA, 19 nt, Human
aggaagacuucaucccucu

SEQ ID NO: 3030151 - RNA, 13 nt, Human
aggaagacuucau

SEQ ID NO: 3030152 - RNA, 23 nt, Human
ugcugagucugaaggcuggguuc

SEQ ID NO: 3030153 - RNA, 22 nt, Human
ugcugagucugaaggcuggguu

SEQ ID NO: 3030154 - RNA, 21 nt, Human
ugcugagucugaaggcugggu

SEQ ID NO: 3030155 - RNA, 18 nt, Human
ugcugagucugaaggcug

SEQ ID NO: 3030156 - RNA, 17 nt, Human
ugcugagucugaaggcu

SEQ ID NO: 3030157 - RNA, 16 nt, Human
ugcugagucugaaggc

SEQ ID NO: 3030158 - RNA, 21 nt, Human
ugcucugcugacagacacagg

SEQ ID NO: 3030159 - RNA, 22 nt, Human
ugcucugcugacagacacaggc

SEQ ID NO: 3030160 - RNA, 16 nt, Human
ugcucugcugacagac

SEQ ID NO: 3030161 - RNA, 14 nt, Human
ugcugagucugaag

SEQ ID NO: 3030162 - RNA, 15 nt, Human
ugcugagucugaagg

SEQ ID NO: 3030163 - RNA, 19 nt, Human
ugcuccagcuguucagcug

SEQ ID NO: 3030164 - RNA, 16 nt, Human
ugcuccagcuguucag

SEQ ID NO: 3030165 - RNA, 19 nt, Human
agcugggacuacaggcacc

SEQ ID NO: 3030166 - RNA, 16 nt, Human
agcugggacuacaggc

SEQ ID NO: 3030167 - RNA, 18 nt, Human
agcugggacuacaggcac

SEQ ID NO: 3030168 - RNA, 11 nt, Human
ugcuguacaua

SEQ ID NO: 3030169 - RNA, 18 nt, Human
ugcuguaacuuucugaaa

SEQ ID NO: 3030170 - RNA, 22 nt, Human
ugcuguacauacuuuuuggguu

SEQ ID NO: 3030171 - RNA, 17 nt, Human
ugcuguacauacuuuuu

SEQ ID NO: 3030172 - RNA, 15 nt, Human
ugcuguacauacuuu

SEQ ID NO: 3030173 - RNA, 16 nt, Human
ugcuggcugguuagag

SEQ ID NO: 3030174 - RNA, 12 nt, Human
ugcugcccugug

SEQ ID NO: 3030175 - RNA, 14 nt, Human
ugcugcccugugag

SEQ ID NO: 3030176 - RNA, 13 nt, Human
ugcugcccuguga

SEQ ID NO: 3030177 - RNA, 15 nt, Human
ugcugcccugugagu

SEQ ID NO: 3030178 - RNA, 13 nt, Human
ugcuuauacacuu

SEQ ID NO: 3030179 - RNA, 12 nt, Human
ugcuucaaggau

SEQ ID NO: 3030180 - RNA, 13 nt, Human
ugcuucagccucc

SEQ ID NO: 3030181 - RNA, 14 nt, Human
ugcuucagccuccc

SEQ ID NO: 3030182 - RNA, 19 nt, Human
ugcuucaaggauccugagc

SEQ ID NO: 3030183 - RNA, 18 nt, Human
ugcuucaaggauccugag

SEQ ID NO: 3030184 - RNA, 16 nt, Human
ugcuucaaggauccug

SEQ ID NO: 3030185 - RNA, 22 nt, Human
aggacagggaggugaccccagg

SEQ ID NO: 3030186 - RNA, 23 nt, Human
aggacacuaaccacgcuggaccu

SEQ ID NO: 3030187 - RNA, 19 nt, Human
aggacacuaaccacgcugg

SEQ ID NO: 3030188 - RNA, 18 nt, Human
ugcuuggcccaggaguuu

SEQ ID NO: 3030189 - RNA, 23 nt, Human
ugcuuggcccaggaguuuggcca

SEQ ID NO: 3030190 - RNA, 16 nt, Human
ugcuugggcuucaucc

SEQ ID NO: 3030191 - RNA, 12 nt, Human
ugcuugggcuuc

SEQ ID NO: 3030192 - RNA, 15 nt, Human
ugcuuggcccaggag

SEQ ID NO: 3030193 - RNA, 16 nt, Human
ugcuuggcccaggagu

SEQ ID NO: 3030194 - RNA, 12 nt, Human
ugcuuggcccag

SEQ ID NO: 3030195 - RNA, 21 nt, Human
ugcuuggaggaaggaaaccca

SEQ ID NO: 3030196 - RNA, 22 nt, Human
uggaaaggaaugcaaagaugaa

SEQ ID NO: 3030197 - RNA, 21 nt, Human
uggaaaggaaugcaaagauga

SEQ ID NO: 3030198 - RNA, 15 nt, Human
uggaaaggaaugcaa

SEQ ID NO: 3030199 - RNA, 12 nt, Human
uggaaaggaaug

SEQ ID NO: 3030200 - RNA, 15 nt, Human
uggaaauauuaagaa

SEQ ID NO: 3030201 - RNA, 19 nt, Human
ugcuugggcuucauccucc

SEQ ID NO: 3030202 - RNA, 14 nt, Human
aggagcagccacau

SEQ ID NO: 3030203 - RNA, 22 nt, Human
aggagccccgaggccuucucug

SEQ ID NO: 3030204 - RNA, 17 nt, Human
aggagauuggaaggaac

SEQ ID NO: 3030205 - RNA, 23 nt, Human
aggacuuuucuuuguggcuuccu

SEQ ID NO: 3030206 - RNA, 19 nt, Human
aggacauugcggacagcca

SEQ ID NO: 3030207 - RNA, 23 nt, Human
aggacauugcggacagccacggc

SEQ ID NO: 3030208 - RNA, 15 nt, Human
aggacauugcggaca

SEQ ID NO: 3030209 - RNA, 17 nt, Human
aggacauugcggacagc

SEQ ID NO: 3030210 - RNA, 18 nt, Human
aggacauugcggacagcc

SEQ ID NO: 3030211 - RNA, 15 nt, Human
aggaguuuggccaga

SEQ ID NO: 3030212 - RNA, 16 nt, Human
aggaguuuggccagaa

SEQ ID NO: 3030213 - RNA, 17 nt, Human
aggaguuuggccagaag

SEQ ID NO: 3030214 - RNA, 18 nt, Human
aggaguuuggccagaagu

SEQ ID NO: 3030215 - RNA, 13 nt, Human
aggaguuuggcca

SEQ ID NO: 3030216 - RNA, 14 nt, Human
aggaguuuggccag

SEQ ID NO: 3030217 - RNA, 21 nt, Human
aggauacaaaagcaugugaga

SEQ ID NO: 3030218 - RNA, 16 nt, Human
aggauccugagccaga

SEQ ID NO: 3030219 - RNA, 15 nt, Human
aggauccugagccag

SEQ ID NO: 3030220 - RNA, 17 nt, Human
aggaugaucuaggaaga

SEQ ID NO: 3030221 - RNA, 16 nt, Human
aggaugaucuaggaag

SEQ ID NO: 3030222 - RNA, 18 nt, Human
aggauccugagccagauu

SEQ ID NO: 3030223 - RNA, 17 nt, Human
aggauccugagccagau

SEQ ID NO: 3030224 - RNA, 22 nt, Human
aggaucucuugagccugggagg

SEQ ID NO: 3030225 - RNA, 21 nt, Human
aggaucucuugagccugggag

SEQ ID NO: 3030226 - RNA, 20 nt, Human
uggaaauauuaagaaagacu

SEQ ID NO: 3030227 - RNA, 18 nt, Human
uggaaaugggcagagcag

SEQ ID NO: 3030228 - RNA, 23 nt, Human
uggaaaugggcagagcagagacc

SEQ ID NO: 3030229 - RNA, 18 nt, Human
uggacacagcucuucucc

SEQ ID NO: 3030230 - RNA, 15 nt, Human
uggacacagcucuuc

SEQ ID NO: 3030231 - RNA, 16 nt, Human
uggacacagcucuucu

SEQ ID NO: 3030232 - RNA, 13 nt, Human
uggacccugaggc

SEQ ID NO: 3030233 - RNA, 12 nt, Human
uggacccugagg

SEQ ID NO: 3030234 - RNA, 14 nt, Human
uggacccugaggcc

SEQ ID NO: 3030235 - RNA, 19 nt, Human
aggauuuugauccaagcug

SEQ ID NO: 3030236 - RNA, 19 nt, Human
aggaugcccaaagaugcag

SEQ ID NO: 3030237 - RNA, 14 nt, Human
aggaugcccaaaga

SEQ ID NO: 3030238 - RNA, 20 nt, Human
aggaugaucuaggaagacuu

SEQ ID NO: 3030239 - RNA, 17 nt, Human
aggcaacucaucuuagg

SEQ ID NO: 3030240 - RNA, 13 nt, Human
ugaugacuguuuu

SEQ ID NO: 3030241 - RNA, 15 nt, Human
ugaugacauucccug

SEQ ID NO: 3030242 - RNA, 18 nt, Human
ugaugacauucccugcua

SEQ ID NO: 3030243 - RNA, 22 nt, Human
ugauccucccaccucagccucc

SEQ ID NO: 3030244 - RNA, 21 nt, Human
ugauccucccaccucagccuc

SEQ ID NO: 3030245 - RNA, 15 nt, Human
ugauccucccaccuc

SEQ ID NO: 3030246 - RNA, 16 nt, Human
ugauccuaguuccacc

SEQ ID NO: 3030247 - RNA, 23 nt, Human
ugaugcuucuucagagacuccug

SEQ ID NO: 3030248 - RNA, 16 nt, Human
ugaugagaggaaauca

SEQ ID NO: 3030249 - RNA, 15 nt, Human
ugaugagaggaaauc

SEQ ID NO: 3030250 - RNA, 14 nt, Human
ugaugagaggaaau

SEQ ID NO: 3030251 - RNA, 13 nt, Human
ugaugagaggaaa

SEQ ID NO: 3030252 - RNA, 19 nt, Human
ugauggggcccugccuccu

SEQ ID NO: 3030253 - RNA, 16 nt, Human
ugauggggcccugccu

SEQ ID NO: 3030254 - RNA, 15 nt, Human
ugauggggcccugcc

SEQ ID NO: 3030255 - RNA, 14 nt, Human
ugauggggcccugc

SEQ ID NO: 3030256 - RNA, 18 nt, Human
agccacugcaccgggcca

SEQ ID NO: 3030257 - RNA, 19 nt, Human
agccacugcaccgggccac

SEQ ID NO: 3030258 - RNA, 11 nt, Human
agccagaggag

SEQ ID NO: 3030259 - RNA, 10 nt, Human
agccagagga

SEQ ID NO: 3030260 - RNA, 13 nt, Human
ugauggugcaaug

SEQ ID NO: 3030261 - RNA, 15 nt, Human
ugauggugcaaugac

SEQ ID NO: 3030262 - RNA, 19 nt, Human
ugauuaaauucuugcaaag

SEQ ID NO: 3030263 - RNA, 20 nt, Human
ugauuaaauucuugcaaagu

SEQ ID NO: 3030264 - RNA, 19 nt, Human
ugauuaaccacuucagcug

SEQ ID NO: 3030265 - RNA, 16 nt, Human
agccacugcaccgggc

SEQ ID NO: 3030266 - RNA, 20 nt, Human
ugauuuagcaggaagcugug

SEQ ID NO: 3030267 - RNA, 17 nt, Human
ugauuuagcaggaagcu

SEQ ID NO: 3030268 - RNA, 18 nt, Human
ugauuuccguuaaaauac

SEQ ID NO: 3030269 - RNA, 22 nt, Human
ugauuuccguuaaaauaccagc

SEQ ID NO: 3030270 - RNA, 17 nt, Human
ugauuuggggauauuuu

SEQ ID NO: 3030271 - RNA, 22 nt, Human
ugauucccaagcucugcuccuc

SEQ ID NO: 3030272 - RNA, 23 nt, Human
ugauucccaagcucugcuccucu

SEQ ID NO: 3030273 - RNA, 21 nt, Human
ugauucauaaugacuuaagca

SEQ ID NO: 3030274 - RNA, 16 nt, Human
ugauucauaaugacuu

SEQ ID NO: 3030275 - RNA, 15 nt, Human
ugauucauaaugacu

SEQ ID NO: 3030276 - RNA, 14 nt, Human
agcccaggaaaggc

SEQ ID NO: 3030277 - RNA, 21 nt, Human
agccaguaaaugggggugcau

SEQ ID NO: 3030278 - RNA, 13 nt, Human
agccaguaaaugg

SEQ ID NO: 3030279 - RNA, 13 nt, Human
agcccacuucugc

SEQ ID NO: 3030280 - RNA, 14 nt, Human
agcccacuucugcc

SEQ ID NO: 3030281 - RNA, 15 nt, Human
agcccacuucugcca

SEQ ID NO: 3030282 - RNA, 11 nt, Human
agcccugucuc

SEQ ID NO: 3030283 - RNA, 18 nt, Human
agcccugucuccucucuc

SEQ ID NO: 3030284 - RNA, 16 nt, Human
agcccuuagcagggaa

SEQ ID NO: 3030285 - RNA, 16 nt, Human
ugcagacucuacagag

SEQ ID NO: 3030286 - RNA, 17 nt, Human
ugcagacucuacagagg

SEQ ID NO: 3030287 - RNA, 21 nt, Human
agcccuuagcagggaaacagc

SEQ ID NO: 3030288 - RNA, 17 nt, Human
agccgagaucacgccac

SEQ ID NO: 3030289 - RNA, 21 nt, Human
agccgagauagccaaggccaa

SEQ ID NO: 3030290 - RNA, 20 nt, Human
agccgagauagccaaggcca

SEQ ID NO: 3030291 - RNA, 19 nt, Human
ugcacuccccugcugggug

SEQ ID NO: 3030292 - RNA, 17 nt, Human
ugcacuccccugcuggg

SEQ ID NO: 3030293 - RNA, 16 nt, Human
ugcacuccccugcugg

SEQ ID NO: 3030294 - RNA, 11 nt, Human
ugcacacauuu

SEQ ID NO: 3030295 - RNA, 12 nt, Human
ugcacacauuuu

SEQ ID NO: 3030296 - RNA, 13 nt, Human
ugcacacauuuuu

SEQ ID NO: 3030297 - RNA, 15 nt, Human
ugcacacauuuuuua

SEQ ID NO: 3030298 - RNA, 22 nt, Human
ugcagacaggcaagcaccuccu

SEQ ID NO: 3030299 - RNA, 22 nt, Human
ugcagccucaaccuccugggcu

SEQ ID NO: 3030300 - RNA, 20 nt, Human
ugcagccucaaccuccuggg

SEQ ID NO: 3030301 - RNA, 21 nt, Human
ugcagccucaaccuccugggc

SEQ ID NO: 3030302 - RNA, 23 nt, Human
agccucugaaaaccaauguucuc

SEQ ID NO: 3030303 - RNA, 18 nt, Human
agccucacaguccuuacc

SEQ ID NO: 3030304 - RNA, 17 nt, Human
agccucacaguccuuac

SEQ ID NO: 3030305 - RNA, 20 nt, Human
agccucaaccuccugggcua

SEQ ID NO: 3030306 - RNA, 19 nt, Human
agccucaaccuccugggcu

SEQ ID NO: 3030307 - RNA, 21 nt, Human
ugcaaaccaucauugaaaucu

SEQ ID NO: 3030308 - RNA, 21 nt, Human
agcccaggccuccuacagcuu

SEQ ID NO: 3030309 - RNA, 17 nt, Human
agccccaaaacucuccu

SEQ ID NO: 3030310 - RNA, 16 nt, Human
agccccaaaacucucc

SEQ ID NO: 3030311 - RNA, 20 nt, Human
agccccauucugccugccca

SEQ ID NO: 3030312 - RNA, 18 nt, Human
agccccaaaacucuccuc

SEQ ID NO: 3030313 - RNA, 21 nt, Human
agccccauucugccugcccag

SEQ ID NO: 3030314 - RNA, 22 nt, Human
agccccauucugccugcccagg

SEQ ID NO: 3030315 - RNA, 14 nt, Human
agcccugguggcag

SEQ ID NO: 3030316 - RNA, 15 nt, Human
agcccugguggcagu

SEQ ID NO: 3030317 - RNA, 16 nt, Human
agcccugguggcagug

SEQ ID NO: 3030318 - RNA, 21 nt, Human
ugcacacaccagagcccaccu

SEQ ID NO: 3030319 - RNA, 17 nt, Human
ugcacacaccagagccc

SEQ ID NO: 3030320 - RNA, 18 nt, Human
ugcacacaccagagccca

SEQ ID NO: 3030321 - RNA, 22 nt, Human
ugcagcucuccccuucucugua

SEQ ID NO: 3030322 - RNA, 20 nt, Human
ugcagcucuccccuucucug

SEQ ID NO: 3030323 - RNA, 18 nt, Human
agccuuccagggguggga

SEQ ID NO: 3030324 - RNA, 15 nt, Human
agccuugaacuuuga

SEQ ID NO: 3030325 - RNA, 22 nt, Human
agcgauucuucugcuucagccu

SEQ ID NO: 3030326 - RNA, 23 nt, Human
agccuugaccauucuccaccugc

SEQ ID NO: 3030327 - RNA, 22 nt, Human
agccuugaccauucuccaccug

SEQ ID NO: 3030328 - RNA, 13 nt, Human
agccuugaacuuu

SEQ ID NO: 3030329 - RNA, 16 nt, Human
agccuugaacuuugac

SEQ ID NO: 3030330 - RNA, 22 nt, Human
agccuugaacuuugaccucugc

SEQ ID NO: 3030331 - RNA, 19 nt, Human
ugcauuugaggucuguucu

SEQ ID NO: 3030332 - RNA, 18 nt, Human
ugcauuugaggucuguuc

SEQ ID NO: 3030333 - RNA, 20 nt, Human
ugcauuuaaaagauacaguu

SEQ ID NO: 3030334 - RNA, 17 nt, Human
ugccagccacugugaua

SEQ ID NO: 3030335 - RNA, 20 nt, Human
ugcauuugaggucuguucuu

SEQ ID NO: 3030336 - RNA, 21 nt, Human
ugcauuugaggucuguucuuu

SEQ ID NO: 3030337 - RNA, 18 nt, Human
ugccagcuuaucucaggg

SEQ ID NO: 3030338 - RNA, 13 nt, Human
agcggcuggcagc

SEQ ID NO: 3030339 - RNA, 22 nt, Human
agcggggacagcuccuucuguc

SEQ ID NO: 3030340 - RNA, 23 nt, Human
agcggcuggcagcccaccccuca

SEQ ID NO: 3030341 - RNA, 19 nt, Human
agcggggacagcuccuucu

SEQ ID NO: 3030342 - RNA, 20 nt, Human
agcggggacagcuccuucug

SEQ ID NO: 3030343 - RNA, 21 nt, Human
agcuaggccuggccagaugca

SEQ ID NO: 3030344 - RNA, 16 nt, Human
agcuaggccuggccag

SEQ ID NO: 3030345 - RNA, 19 nt, Human
agcuauucaguaauaacuc

SEQ ID NO: 3030346 - RNA, 13 nt, Human
agcucagggccug

SEQ ID NO: 3030347 - RNA, 12 nt, Human
agcucagggccu

SEQ ID NO: 3030348 - RNA, 19 nt, Human
agcucagggccuggcucag

SEQ ID NO: 3030349 - RNA, 18 nt, Human
agcucagggccuggcuca

SEQ ID NO: 3030350 - RNA, 20 nt, Human
agcucagggccuggcucagg

SEQ ID NO: 3030351 - RNA, 15 nt, Human
agcuccaagcuccca

SEQ ID NO: 3030352 - RNA, 20 nt, Human
ugcccaaagaugcagccggu

SEQ ID NO: 3030353 - RNA, 17 nt, Human
ugcccaaagaugcagcc

SEQ ID NO: 3030354 - RNA, 17 nt, Human
ugcccagccccuucuga

SEQ ID NO: 3030355 - RNA, 16 nt, Human
ugcccagccccuucug

SEQ ID NO: 3030356 - RNA, 12 nt, Human
ugcccagccccu

SEQ ID NO: 3030357 - RNA, 13 nt, Human
ugcccagccccuu

SEQ ID NO: 3030358 - RNA, 14 nt, Human
ugcccaggccccug

SEQ ID NO: 3030359 - RNA, 15 nt, Human
ugcccaggccccugc

SEQ ID NO: 3030360 - RNA, 17 nt, Human
ugcccaggccccugcca

SEQ ID NO: 3030361 - RNA, 18 nt, Human
ugcccaggccccugccac

SEQ ID NO: 3030362 - RNA, 23 nt, Human
ugccccgaacauguuuuucuucu

SEQ ID NO: 3030363 - RNA, 20 nt, Human
ugcccuaaaguguauuuuuu

SEQ ID NO: 3030364 - RNA, 13 nt, Human
agcuccagcucac

SEQ ID NO: 3030365 - RNA, 17 nt, Human
agcuccagcucaccagc

SEQ ID NO: 3030366 - RNA, 19 nt, Human
agcuccaagcucccaggca

SEQ ID NO: 3030367 - RNA, 18 nt, Human
agcuccaagcucccaggc

SEQ ID NO: 3030368 - RNA, 16 nt, Human
agcuccaagcucccag

SEQ ID NO: 3030369 - RNA, 17 nt, Human
agcuccaagcucccagg

SEQ ID NO: 3030370 - RNA, 22 nt, Human
agcuccuucuguccuacucugu

SEQ ID NO: 3030371 - RNA, 23 nt, Human
agcuccuucuguccuacucugug

SEQ ID NO: 3030372 - RNA, 21 nt, Human
agcuccagcucaccagcccca

SEQ ID NO: 3030373 - RNA, 18 nt, Human
agcuccagcucaccagcc

SEQ ID NO: 3030374 - RNA, 19 nt, Human
agcuccagcucaccagccc

SEQ ID NO: 3030375 - RNA, 23 nt, Human
agcucuguccugggagugagcug

SEQ ID NO: 3030376 - RNA, 17 nt, Human
ugccugcccaggccccu

SEQ ID NO: 3030377 - RNA, 18 nt, Human
ugccugcccaggccccug

SEQ ID NO: 3030378 - RNA, 19 nt, Human
ugccugcccaggccccugc

SEQ ID NO: 3030379 - RNA, 14 nt, Human
ugccucugacacac

SEQ ID NO: 3030380 - RNA, 16 nt, Human
ugccucugacacacag

SEQ ID NO: 3030381 - RNA, 11 nt, Human
ugccucugccu

SEQ ID NO: 3030382 - RNA, 15 nt, Human
agcugggacuacagg

SEQ ID NO: 3030383 - RNA, 23 nt, Human
agcugcuuuugucuaugggacuc

SEQ ID NO: 3030384 - RNA, 24 nt, Human
agcugcuuuugucuaugggacuca

SEQ ID NO: 3030385 - RNA, 13 nt, Human
agcugccuguuca

SEQ ID NO: 3030386 - RNA, 22 nt, Human
agcugcuuuugucuaugggacu

SEQ ID NO: 3030387 - RNA, 10 nt, Human
agcugccugu

SEQ ID NO: 3030388 - RNA, 22 nt, Human
ugcccuuaccugccaggaagcc

SEQ ID NO: 3030389 - RNA, 18 nt, Human
ugcccugugggcccccaa

SEQ ID NO: 3030390 - RNA, 15 nt, Human
ugcccugugggcccc

SEQ ID NO: 3030391 - RNA, 15 nt, Human
agcucuucuccaggc

SEQ ID NO: 3030392 - RNA, 16 nt, Human
agcucuucuccaggcu

SEQ ID NO: 3030393 - RNA, 23 nt, Human
ugcccugugaguacuacaguccu

SEQ ID NO: 3030394 - RNA, 19 nt, Human
ugcccuuaccugccaggaa

SEQ ID NO: 3030395 - RNA, 20 nt, Human
ugccgcagcccugcagaggg

SEQ ID NO: 3030396 - RNA, 14 nt, Human
ugccgcagcccugc

SEQ ID NO: 3030397 - RNA, 16 nt, Human
ugccucucucaggcca

SEQ ID NO: 3030398 - RNA, 17 nt, Human
ugccucucucaggccaa

SEQ ID NO: 3030399 - RNA, 22 nt, Human
ugccucccaucacccgcuaaga

SEQ ID NO: 3030400 - RNA, 13 nt, Human
aguuuggccagaa

SEQ ID NO: 3030401 - RNA, 14 nt, Human
aguuuggccagaag

SEQ ID NO: 3030402 - RNA, 16 nt, Human
aguuugguuucuagca

SEQ ID NO: 3030403 - RNA, 11 nt, Human
aguuuggccag

SEQ ID NO: 3030404 - RNA, 22 nt, Human
aguuuucacucuuauugcccac

SEQ ID NO: 3030405 - RNA, 12 nt, Human
aguuuggccaga

SEQ ID NO: 3030406 - RNA, 21 nt, Human
aguuucuccaagcaggacaug

SEQ ID NO: 3030407 - RNA, 15 nt, Human
aguuucuccaagcag

SEQ ID NO: 3030408 - RNA, 13 nt, Human
aguuucuccaagc

SEQ ID NO: 3030409 - RNA, 16 nt, Human
uuaaauucuugcaaag

SEQ ID NO: 3030410 - RNA, 13 nt, Human
uuaaauucuugca

SEQ ID NO: 3030411 - RNA, 18 nt, Human
uuaaaaaguggaaaaaua

SEQ ID NO: 3030412 - RNA, 17 nt, Human
uuaaaacaacacucaca

SEQ ID NO: 3030413 - RNA, 20 nt, Human
aguugccagucaccccggcc

SEQ ID NO: 3030414 - RNA, 13 nt, Human
uuaaauaaaucau

SEQ ID NO: 3030415 - RNA, 15 nt, Human
uuaaauaaaucauaa

SEQ ID NO: 3030416 - RNA, 19 nt, Human
uuaaauaaugugaaacugg

SEQ ID NO: 3030417 - RNA, 22 nt, Human
uuaaauaaugugaaacuggauu

SEQ ID NO: 3030418 - RNA, 20 nt, Human
uuaaauaaugugaaacugga

SEQ ID NO: 3030419 - RNA, 21 nt, Human
uuaaauaaugugaaacuggau

SEQ ID NO: 3030420 - RNA, 17 nt, Human
uuaaaccgccaaggcug

SEQ ID NO: 3030421 - RNA, 13 nt, Human
uguuuucaaaugu

SEQ ID NO: 3030422 - RNA, 14 nt, Human
uguuuucaaauguu

SEQ ID NO: 3030423 - RNA, 15 nt, Human
uguuuucaguguaca

SEQ ID NO: 3030424 - RNA, 17 nt, Human
uguuuuauauagcaaga

SEQ ID NO: 3030425 - RNA, 14 nt, Human
uguuuuaggagcau

SEQ ID NO: 3030426 - RNA, 17 nt, Human
uguuuucaguguacaug

SEQ ID NO: 3030427 - RNA, 15 nt, Human
uguuuucucuugaga

SEQ ID NO: 3030428 - RNA, 12 nt, Human
aguucucuccuu

SEQ ID NO: 3030429 - RNA, 13 nt, Human
aguucucuccuuc

SEQ ID NO: 3030430 - RNA, 16 nt, Human
aguucucuccuucuuc

SEQ ID NO: 3030431 - RNA, 15 nt, Human
uguuuggggaugaga

SEQ ID NO: 3030432 - RNA, 14 nt, Human
uguugucagcugaa

SEQ ID NO: 3030433 - RNA, 14 nt, Human
uguuugccucugcc

SEQ ID NO: 3030434 - RNA, 16 nt, Human
uguuugccucugccuc

SEQ ID NO: 3030435 - RNA, 22 nt, Human
aguucuugccuuggcugcaguu

SEQ ID NO: 3030436 - RNA, 14 nt, Human
aguugauagcacag

SEQ ID NO: 3030437 - RNA, 21 nt, Human
aguugauagcacagacccugc

SEQ ID NO: 3030438 - RNA, 20 nt, Human
aguugauagcacagacccug

SEQ ID NO: 3030439 - RNA, 19 nt, Human
aguugauagcacagacccu

SEQ ID NO: 3030440 - RNA, 15 nt, Human
aguugauagcacaga

SEQ ID NO: 3030441 - RNA, 23 nt, Human
aguugauucagcucugcaagaau

SEQ ID NO: 3030442 - RNA, 18 nt, Human
aguugauucagcucugca

SEQ ID NO: 3030443 - RNA, 17 nt, Human
aguugauucagcucugc

SEQ ID NO: 3030444 - RNA, 15 nt, Human
aguugauucagcucu

SEQ ID NO: 3030445 - RNA, 14 nt, Human
aguugauucagcuc

SEQ ID NO: 3030446 - RNA, 13 nt, Human
aguugauucagcu

SEQ ID NO: 3030447 - RNA, 23 nt, Human
aguugauagcacagacccugccc

SEQ ID NO: 3030448 - RNA, 22 nt, Human
aguugauagcacagacccugcc

SEQ ID NO: 3030449 - RNA, 23 nt, Human
aguggcagucuucaguuugcaga

SEQ ID NO: 3030450 - RNA, 20 nt, Human
agugggggaguggccacaga

SEQ ID NO: 3030451 - RNA, 19 nt, Human
agugggggaguggccacag

SEQ ID NO: 3030452 - RNA, 18 nt, Human
agugggugaauaauacag

SEQ ID NO: 3030453 - RNA, 13 nt, Human
agugggugaauaa

SEQ ID NO: 3030454 - RNA, 11 nt, Human
aguggcagcug

SEQ ID NO: 3030455 - RNA, 12 nt, Human
aguggcagcugc

SEQ ID NO: 3030456 - RNA, 13 nt, Human
aguggcagcugcu

SEQ ID NO: 3030457 - RNA, 14 nt, Human
aguggcagcugcuu

SEQ ID NO: 3030458 - RNA, 20 nt, Human
aguggcagcugcuuuugucu

SEQ ID NO: 3030459 - RNA, 19 nt, Human
agugggugaauaauacagu

SEQ ID NO: 3030460 - RNA, 21 nt, Human
agugguuccuaauccucuagg

SEQ ID NO: 3030461 - RNA, 21 nt, Human
aguguacauggaauaacaugu

SEQ ID NO: 3030462 - RNA, 22 nt, Human
aguguacauggaauaacaugua

SEQ ID NO: 3030463 - RNA, 23 nt, Human
aguguacauggaauaacauguaa

SEQ ID NO: 3030464 - RNA, 19 nt, Human
uguucuugguuuguaaauu

SEQ ID NO: 3030465 - RNA, 13 nt, Human
uguucuuuccaaa

SEQ ID NO: 3030466 - RNA, 14 nt, Human
uguucuuuccaaag

SEQ ID NO: 3030467 - RNA, 17 nt, Human
uguucuugguuuguaaa

SEQ ID NO: 3030468 - RNA, 18 nt, Human
uguucuugguuuguaaau

SEQ ID NO: 3030469 - RNA, 14 nt, Human
uguucugggacaca

SEQ ID NO: 3030470 - RNA, 15 nt, Human
uguucugggacacag

SEQ ID NO: 3030471 - RNA, 14 nt, Human
uguucuuaauucuu

SEQ ID NO: 3030472 - RNA, 16 nt, Human
uguucuuaauucuuag

SEQ ID NO: 3030473 - RNA, 12 nt, Human
uguucugggaca

SEQ ID NO: 3030474 - RNA, 13 nt, Human
uguucugggacac

SEQ ID NO: 3030475 - RNA, 14 nt, Human
aguuauugaagcag

SEQ ID NO: 3030476 - RNA, 18 nt, Human
aguuauugaagcagagug

SEQ ID NO: 3030477 - RNA, 17 nt, Human
aguuauugaagcagagu

SEQ ID NO: 3030478 - RNA, 16 nt, Human
aguuauugaagcagag

SEQ ID NO: 3030479 - RNA, 23 nt, Human
aguuauugaagcagaguggcagu

SEQ ID NO: 3030480 - RNA, 19 nt, Human
aguuauugaagcagagugg

SEQ ID NO: 3030481 - RNA, 18 nt, Human
uguucuuuccaaaguaca

SEQ ID NO: 3030482 - RNA, 21 nt, Human
aguuauuuuuauuuauuuaaa

SEQ ID NO: 3030483 - RNA, 16 nt, Human
uguugggccaggagcc

SEQ ID NO: 3030484 - RNA, 13 nt, Human
uguugggccagga

SEQ ID NO: 3030485 - RNA, 13 nt, Human
uguugucagcuga

SEQ ID NO: 3030486 - RNA, 20 nt, Human
auacuauuaaacaugcugua

SEQ ID NO: 3030487 - RNA, 13 nt, Human
auacuacaguuug

SEQ ID NO: 3030488 - RNA, 15 nt, Human
auacuacaguuuguu

SEQ ID NO: 3030489 - RNA, 16 nt, Human
auacuacaguuuguua

SEQ ID NO: 3030490 - RNA, 20 nt, Human
auacuacaguuuguuaguau

SEQ ID NO: 3030491 - RNA, 21 nt, Human
auacuaaccagcagaaaugcc

SEQ ID NO: 3030492 - RNA, 17 nt, Human
auaccagccaguaaaug

SEQ ID NO: 3030493 - RNA, 19 nt, Human
auaccagccaguaaauggg

SEQ ID NO: 3030494 - RNA, 15 nt, Human
uuaucagaacuaugu

SEQ ID NO: 3030495 - RNA, 14 nt, Human
auacaggaaaagcu

SEQ ID NO: 3030496 - RNA, 19 nt, Human
auacaggaaaagcugcuga

SEQ ID NO: 3030497 - RNA, 20 nt, Human
auacaggaaaagcugcugac

SEQ ID NO: 3030498 - RNA, 16 nt, Human
auacauuugauaaagu

SEQ ID NO: 3030499 - RNA, 13 nt, Human
uuauauagcaaga

SEQ ID NO: 3030500 - RNA, 19 nt, Human
uuauauagcaagacauuau

SEQ ID NO: 3030501 - RNA, 12 nt, Human
auacaaaagcau

SEQ ID NO: 3030502 - RNA, 13 nt, Human
auacaaaagcaug

SEQ ID NO: 3030503 - RNA, 15 nt, Human
auacaaaagcaugug

SEQ ID NO: 3030504 - RNA, 16 nt, Human
uuauaacuuuuuauau

SEQ ID NO: 3030505 - RNA, 14 nt, Human
uuauaacuuuuuau

SEQ ID NO: 3030506 - RNA, 13 nt, Human
uuauacauaaaca

SEQ ID NO: 3030507 - RNA, 21 nt, Human
uuagccguggugauuuagcag

SEQ ID NO: 3030508 - RNA, 15 nt, Human
auaaacucauuucua

SEQ ID NO: 3030509 - RNA, 13 nt, Human
auaaacuuuaccu

SEQ ID NO: 3030510 - RNA, 15 nt, Human
auaaacuuuaccuuu

SEQ ID NO: 3030511 - RNA, 23 nt, Human
auaacuggaacacucuauaacaa

SEQ ID NO: 3030512 - RNA, 21 nt, Human
auaacuggaacacucuauaac

SEQ ID NO: 3030513 - RNA, 16 nt, Human
uuacaggaaguacugg

SEQ ID NO: 3030514 - RNA, 15 nt, Human
uuacaggaaguacug

SEQ ID NO: 3030515 - RNA, 22 nt, Human
uuacaggaaguacuggagaaaa

SEQ ID NO: 3030516 - RNA, 18 nt, Human
uuacaggaaguacuggag

SEQ ID NO: 3030517 - RNA, 23 nt, Human
uuaccauuuugggguacccacug

SEQ ID NO: 3030518 - RNA, 18 nt, Human
auaacuggaacacucuau

SEQ ID NO: 3030519 - RNA, 16 nt, Human
auaacuggaacacucu

SEQ ID NO: 3030520 - RNA, 18 nt, Human
uuagcaggaagcugugag

SEQ ID NO: 3030521 - RNA, 19 nt, Human
auaauacaguaucucaggg

SEQ ID NO: 3030522 - RNA, 14 nt, Human
auaauucuacuuug

SEQ ID NO: 3030523 - RNA, 23 nt, Human
auaagaaccuuuugagugccuua

SEQ ID NO: 3030524 - RNA, 17 nt, Human
auaaguuaacuuccaau

SEQ ID NO: 3030525 - RNA, 22 nt, Human
auaagaaccuuuugagugccuu

SEQ ID NO: 3030526 - RNA, 22 nt, Human
auaaguuaacuuccaauuuaca

SEQ ID NO: 3030527 - RNA, 23 nt, Human
auaauacaccacuacauucuguu

SEQ ID NO: 3030528 - RNA, 21 nt, Human
auaauacaccacuacauucug

SEQ ID NO: 3030529 - RNA, 16 nt, Human
aguccccucuccucca

SEQ ID NO: 3030530 - RNA, 21 nt, Human
aguccccucuccuccacauuu

SEQ ID NO: 3030531 - RNA, 19 nt, Human
aguccccuguuuguuucug

SEQ ID NO: 3030532 - RNA, 14 nt, Human
aguccccuguuugu

SEQ ID NO: 3030533 - RNA, 21 nt, Human
agucccaccuuggcugcaggg

SEQ ID NO: 3030534 - RNA, 23 nt, Human
agucccaccuuggcugcagggag

SEQ ID NO: 3030535 - RNA, 20 nt, Human
agucccaccuuggcugcagg

SEQ ID NO: 3030536 - RNA, 19 nt, Human
agucagggguucccuuuuu

SEQ ID NO: 3030537 - RNA, 12 nt, Human
ugucccuuuucc

SEQ ID NO: 3030538 - RNA, 16 nt, Human
ugucagccauuccugu

SEQ ID NO: 3030539 - RNA, 20 nt, Human
ugucaaccccaaguuaguuc

SEQ ID NO: 3030540 - RNA, 19 nt, Human
ugucaaaguggugagaggc

SEQ ID NO: 3030541 - RNA, 16 nt, Human
ugucaaaguggugaga

SEQ ID NO: 3030542 - RNA, 13 nt, Human
aguagcugggacu

SEQ ID NO: 3030543 - RNA, 14 nt, Human
aguagcugggacua

SEQ ID NO: 3030544 - RNA, 15 nt, Human
ugucaaaguggugag

SEQ ID NO: 3030545 - RNA, 14 nt, Human
ugucaaagugguga

SEQ ID NO: 3030546 - RNA, 12 nt, Human
uguagagccagg

SEQ ID NO: 3030547 - RNA, 15 nt, Human
uguagagccaggguc

SEQ ID NO: 3030548 - RNA, 15 nt, Human
uguaucccaugagcc

SEQ ID NO: 3030549 - RNA, 14 nt, Human
uguauguguaagua

SEQ ID NO: 3030550 - RNA, 16 nt, Human
agucacugagacagcc

SEQ ID NO: 3030551 - RNA, 15 nt, Human
agucacugagacagc

SEQ ID NO: 3030552 - RNA, 17 nt, Human
agucacugagacagccc

SEQ ID NO: 3030553 - RNA, 15 nt, Human
ugucagcauagaagu

SEQ ID NO: 3030554 - RNA, 15 nt, Human
aguauuauaccuuuu

SEQ ID NO: 3030555 - RNA, 14 nt, Human
aguauuauaccuuu

SEQ ID NO: 3030556 - RNA, 22 nt, Human
aguagcugggacuacaggcacc

SEQ ID NO: 3030557 - RNA, 19 nt, Human
aguagcugggacuacaggc

SEQ ID NO: 3030558 - RNA, 21 nt, Human
aguagcugggacuacaggcac

SEQ ID NO: 3030559 - RNA, 22 nt, Human
aguccccucuccuccacauuug

SEQ ID NO: 3030560 - RNA, 15 nt, Human
ugucuccucucucug

SEQ ID NO: 3030561 - RNA, 16 nt, Human
agucccugccaaugga

SEQ ID NO: 3030562 - RNA, 14 nt, Human
agucccugccaaug

SEQ ID NO: 3030563 - RNA, 13 nt, Human
agucccugccaau

SEQ ID NO: 3030564 - RNA, 23 nt, Human
aguccccuguuuguuucugaaag

SEQ ID NO: 3030565 - RNA, 13 nt, Human
ugucucugagagu

SEQ ID NO: 3030566 - RNA, 21 nt, Human
ugucucuugguccugcugcag

SEQ ID NO: 3030567 - RNA, 20 nt, Human
ugucucuugguccugcugca

SEQ ID NO: 3030568 - RNA, 19 nt, Human
ugucucuugguccugcugc

SEQ ID NO: 3030569 - RNA, 18 nt, Human
ugucucuugguccugcug

SEQ ID NO: 3030570 - RNA, 22 nt, Human
ugucucuuuaaugucacaggca

SEQ ID NO: 3030571 - RNA, 21 nt, Human
ugucucuuuaaugucacaggc

SEQ ID NO: 3030572 - RNA, 22 nt, Human
ugucucuugguccugcugcagu

SEQ ID NO: 3030573 - RNA, 15 nt, Human
ugucuugcaauggca

SEQ ID NO: 3030574 - RNA, 17 nt, Human
ugucuugcaauggcagc

SEQ ID NO: 3030575 - RNA, 18 nt, Human
ugucuugcaauggcagcc

SEQ ID NO: 3030576 - RNA, 20 nt, Human
ugucuugcaauggcagccuu

SEQ ID NO: 3030577 - RNA, 21 nt, Human
ugucuugcaauggcagccuug

SEQ ID NO: 3030578 - RNA, 16 nt, Human
ugugaaccaccacacc

SEQ ID NO: 3030579 - RNA, 22 nt, Human
ugugaaccaccacacccagccc

SEQ ID NO: 3030580 - RNA, 23 nt, Human
ugugaaccaccacacccagccca

SEQ ID NO: 3030581 - RNA, 15 nt, Human
ugugaaccaccacac

SEQ ID NO: 3030582 - RNA, 20 nt, Human
ugugauuuuugguauuugaa

SEQ ID NO: 3030583 - RNA, 21 nt, Human
ugugauuuuugguauuugaaa

SEQ ID NO: 3030584 - RNA, 19 nt, Human
ugugauuuuugguauuuga

SEQ ID NO: 3030585 - RNA, 17 nt, Human
ugugauggggcccugcc

SEQ ID NO: 3030586 - RNA, 16 nt, Human
ugugauggggcccugc

SEQ ID NO: 3030587 - RNA, 15 nt, Human
ugugauggggcccug

SEQ ID NO: 3030588 - RNA, 14 nt, Human
agugagagcugggu

SEQ ID NO: 3030589 - RNA, 13 nt, Human
agugagacucugu

SEQ ID NO: 3030590 - RNA, 21 nt, Human
agugagacccugucucaaaaa

SEQ ID NO: 3030591 - RNA, 17 nt, Human
agugagacccugucuca

SEQ ID NO: 3030592 - RNA, 22 nt, Human
agugagacucugucucaaaaaa

SEQ ID NO: 3030593 - RNA, 16 nt, Human
agugagacucugucuc

SEQ ID NO: 3030594 - RNA, 17 nt, Human
agugagacucugucuca

SEQ ID NO: 3030595 - RNA, 14 nt, Human
agucuucuauuuau

SEQ ID NO: 3030596 - RNA, 23 nt, Human
agugaaaaaggaggaagagaaaa

SEQ ID NO: 3030597 - RNA, 20 nt, Human
agugaaaaaggaggaagaga

SEQ ID NO: 3030598 - RNA, 17 nt, Human
agugaaaaaggaggaag

SEQ ID NO: 3030599 - RNA, 11 nt, Human
agugaaaaagg

SEQ ID NO: 3030600 - RNA, 14 nt, Human
ugugaagagaacca

SEQ ID NO: 3030601 - RNA, 19 nt, Human
ugugagcacaaagguagcu

SEQ ID NO: 3030602 - RNA, 14 nt, Human
aggguuuaaagaug

SEQ ID NO: 3030603 - RNA, 17 nt, Human
aggguugggcugguguc

SEQ ID NO: 3030604 - RNA, 18 nt, Human
aggucuugaacuccuggc

SEQ ID NO: 3030605 - RNA, 22 nt, Human
aggucuugaacuccuggccuca

SEQ ID NO: 3030606 - RNA, 20 nt, Human
aggucuugaacuccuggccu

SEQ ID NO: 3030607 - RNA, 21 nt, Human
aggucuugaacuccuggccuc

SEQ ID NO: 3030608 - RNA, 22 nt, Human
aggucauuuuuuuuaagaaaaa

SEQ ID NO: 3030609 - RNA, 23 nt, Human
aggucauuuuuuuuaagaaaaag

SEQ ID NO: 3030610 - RNA, 21 nt, Human
aggucaaggcugcagugagcc

SEQ ID NO: 3030611 - RNA, 13 nt, Human
aggguuggccccu

SEQ ID NO: 3030612 - RNA, 14 nt, Human
aggguuggccccug

SEQ ID NO: 3030613 - RNA, 13 nt, Human
aggguugggcugg

SEQ ID NO: 3030614 - RNA, 15 nt, Human
aggguugggcuggug

SEQ ID NO: 3030615 - RNA, 19 nt, Human
uggugaacagaacaaaagg

SEQ ID NO: 3030616 - RNA, 17 nt, Human
aggguggugaccucugc

SEQ ID NO: 3030617 - RNA, 18 nt, Human
aggguggugaccucugcc

SEQ ID NO: 3030618 - RNA, 19 nt, Human
aggguggugaccucugccu

SEQ ID NO: 3030619 - RNA, 18 nt, Human
uggucugacccacugcuu

SEQ ID NO: 3030620 - RNA, 12 nt, Human
uggucuguguga

SEQ ID NO: 3030621 - RNA, 16 nt, Human
uggucuuauuuguaaa

SEQ ID NO: 3030622 - RNA, 19 nt, Human
ugguccauagagagcaaga

SEQ ID NO: 3030623 - RNA, 21 nt, Human
aggggcuuaauuauugauguu

SEQ ID NO: 3030624 - RNA, 13 nt, Human
agggggcugggac

SEQ ID NO: 3030625 - RNA, 16 nt, Human
aggguaucaggugcug

SEQ ID NO: 3030626 - RNA, 19 nt, Human
aggguacuaaggaaucuuu

SEQ ID NO: 3030627 - RNA, 14 nt, Human
uggguggaugccug

SEQ ID NO: 3030628 - RNA, 23 nt, Human
uggguggaugccugguggcagcu

SEQ ID NO: 3030629 - RNA, 20 nt, Human
uggucaccaaaucagcugcu

SEQ ID NO: 3030630 - RNA, 23 nt, Human
uggucaccaaaucagcugcuacu

SEQ ID NO: 3030631 - RNA, 21 nt, Human
uggucaccaaaucagcugcua

SEQ ID NO: 3030632 - RNA, 16 nt, Human
ugguccauagagagca

SEQ ID NO: 3030633 - RNA, 15 nt, Human
ugguccauagagagc

SEQ ID NO: 3030634 - RNA, 18 nt, Human
ugguuauuuuacuuuuug

SEQ ID NO: 3030635 - RNA, 15 nt, Human
ugguuauuuuacuuu

SEQ ID NO: 3030636 - RNA, 16 nt, Human
ugguuauuuuacuuuu

SEQ ID NO: 3030637 - RNA, 17 nt, Human
ugguguuuccuggcacu

SEQ ID NO: 3030638 - RNA, 15 nt, Human
ugguguuuccuggca

SEQ ID NO: 3030639 - RNA, 20 nt, Human
ugguucaggguuggccccug

SEQ ID NO: 3030640 - RNA, 22 nt, Human
ugguucaggguuggccccugcc

SEQ ID NO: 3030641 - RNA, 23 nt, Human
ugguucaggguuggccccugccc

SEQ ID NO: 3030642 - RNA, 12 nt, Human
ugguggcagcug

SEQ ID NO: 3030643 - RNA, 23 nt, Human
ugguggcagcucaccucucccuu

SEQ ID NO: 3030644 - RNA, 20 nt, Human
ugguggcagcucaccucucc

SEQ ID NO: 3030645 - RNA, 19 nt, Human
ugguggcagcucaccucuc

SEQ ID NO: 3030646 - RNA, 16 nt, Human
ugguggcagcucaccu

SEQ ID NO: 3030647 - RNA, 12 nt, Human
ugguggcagcuc

SEQ ID NO: 3030648 - RNA, 15 nt, Human
ugguggcagagugga

SEQ ID NO: 3030649 - RNA, 15 nt, Human
ugguuucuagcauga

SEQ ID NO: 3030650 - RNA, 14 nt, Human
ugguuucagaaaug

SEQ ID NO: 3030651 - RNA, 15 nt, Human
ugguuucagaaaugu

SEQ ID NO: 3030652 - RNA, 15 nt, Human
ugguuuguucccugu

SEQ ID NO: 3030653 - RNA, 21 nt, Human
ugguuuguaaauuaacuuuua

SEQ ID NO: 3030654 - RNA, 12 nt, Human
ugguuuucuguu

SEQ ID NO: 3030655 - RNA, 13 nt, Human
ugguuuucuguuc

SEQ ID NO: 3030656 - RNA, 15 nt, Human
ugguuuucuguucuu

SEQ ID NO: 3030657 - RNA, 21 nt, Human
aggugauccacccaccucagc

SEQ ID NO: 3030658 - RNA, 23 nt, Human
aggugauccacccaccucagccu

SEQ ID NO: 3030659 - RNA, 12 nt, Human
agguugugaaug

SEQ ID NO: 3030660 - RNA, 13 nt, Human
uguaaggaaugau

SEQ ID NO: 3030661 - RNA, 15 nt, Human
uguaaggaaugauua

SEQ ID NO: 3030662 - RNA, 14 nt, Human
uguaaggaaugauu

SEQ ID NO: 3030663 - RNA, 22 nt, Human
uguaagcucuacugaggugcua

SEQ ID NO: 3030664 - RNA, 14 nt, Human
agguggggcagcuu

SEQ ID NO: 3030665 - RNA, 23 nt, Human
agguggggucacucuggcagcuc

SEQ ID NO: 3030666 - RNA, 13 nt, Human
agguggggcagcu

SEQ ID NO: 3030667 - RNA, 23 nt, Human
aggugugaaccaccacacccagc

SEQ ID NO: 3030668 - RNA, 18 nt, Human
aggugugacugaauuucu

SEQ ID NO: 3030669 - RNA, 22 nt, Human
aggugugaaccaccacacccag

SEQ ID NO: 3030670 - RNA, 20 nt, Human
aggugugacugaauuucuuu

SEQ ID NO: 3030671 - RNA, 14 nt, Human
aggugugagucacc

SEQ ID NO: 3030672 - RNA, 20 nt, Human
aggugugagucaccaagccc

SEQ ID NO: 3030673 - RNA, 17 nt, Human
uguagacaguuggguuu

SEQ ID NO: 3030674 - RNA, 19 nt, Human
uguacaugaaaacacauuu

SEQ ID NO: 3030675 - RNA, 17 nt, Human
uguacaugaaaacacau

SEQ ID NO: 3030676 - RNA, 18 nt, Human
uguacaugaaaacacauu

SEQ ID NO: 3030677 - RNA, 17 nt, Human
uguaauuugugauacaa

SEQ ID NO: 3030678 - RNA, 21 nt, Human
uguaauuugugauacaaugcu

SEQ ID NO: 3030679 - RNA, 16 nt, Human
uguaauuugugauaca

SEQ ID NO: 3030680 - RNA, 18 nt, Human
uguaaggaaugauuaauu

SEQ ID NO: 3030681 - RNA, 19 nt, Human
uguacaaaguagaagucuu

SEQ ID NO: 3030682 - RNA, 23 nt, Human
uguacaaaguagaagucuuagau

SEQ ID NO: 3030683 - RNA, 18 nt, Human
ugaaguaaaauguggcag

SEQ ID NO: 3030684 - RNA, 19 nt, Human
ugaaguaaaauguggcagg

SEQ ID NO: 3030685 - RNA, 15 nt, Human
ugaaguaauaugcac

SEQ ID NO: 3030686 - RNA, 16 nt, Human
ugaaguaauaugcaca

SEQ ID NO: 3030687 - RNA, 20 nt, Human
ugaaguaauaugcacacauu

SEQ ID NO: 3030688 - RNA, 21 nt, Human
ugaaguaauaugcacacauuu

SEQ ID NO: 3030689 - RNA, 22 nt, Human
ugaaguaauaugcacacauuuu

SEQ ID NO: 3030690 - RNA, 13 nt, Human
ugaagucacacag

SEQ ID NO: 3030691 - RNA, 12 nt, Human
ugaauaauacag

SEQ ID NO: 3030692 - RNA, 13 nt, Human
ugaauaauacagu

SEQ ID NO: 3030693 - RNA, 20 nt, Human
agagguucaaagauauuuug

SEQ ID NO: 3030694 - RNA, 16 nt, Human
agagguucaaagauau

SEQ ID NO: 3030695 - RNA, 19 nt, Human
agagguucaaagauauuuu

SEQ ID NO: 3030696 - RNA, 15 nt, Human
agagggagguaagga

SEQ ID NO: 3030697 - RNA, 15 nt, Human
agagggagugacaga

SEQ ID NO: 3030698 - RNA, 20 nt, Human
agagggagugacagaggcag

SEQ ID NO: 3030699 - RNA, 13 nt, Human
agagguucaaaga

SEQ ID NO: 3030700 - RNA, 22 nt, Human
agaggcugccucucccaucacu

SEQ ID NO: 3030701 - RNA, 21 nt, Human
agaggcagccccauucugccu

SEQ ID NO: 3030702 - RNA, 22 nt, Human
agaggcagccccauucugccug

SEQ ID NO: 3030703 - RNA, 21 nt, Human
agaggcagggucucacucugu

SEQ ID NO: 3030704 - RNA, 23 nt, Human
agaggcagccccauucugccugc

SEQ ID NO: 3030705 - RNA, 13 nt, Human
ugaagacagagcu

SEQ ID NO: 3030706 - RNA, 22 nt, Human
ugaagacaaugacuuacuguac

SEQ ID NO: 3030707 - RNA, 23 nt, Human
ugaagacaaugacuuacuguaca

SEQ ID NO: 3030708 - RNA, 21 nt, Human
ugaagacaaugacuuacugua

SEQ ID NO: 3030709 - RNA, 22 nt, Human
ugaaccaccacacccagcccac

SEQ ID NO: 3030710 - RNA, 21 nt, Human
ugaaccaccacacccagccca

SEQ ID NO: 3030711 - RNA, 19 nt, Human
ugaaauuuuuauuaaauua

SEQ ID NO: 3030712 - RNA, 20 nt, Human
ugaaauuuuuauuaaauuau

SEQ ID NO: 3030713 - RNA, 17 nt, Human
ugaaauaacauggccuu

SEQ ID NO: 3030714 - RNA, 16 nt, Human
ugaaauaacauggccu

SEQ ID NO: 3030715 - RNA, 23 nt, Human
agacuuugguuauuuuacuuuuu

SEQ ID NO: 3030716 - RNA, 17 nt, Human
agacuuugguuauuuua

SEQ ID NO: 3030717 - RNA, 15 nt, Human
agagacacaagccuu

SEQ ID NO: 3030718 - RNA, 19 nt, Human
agagacacaagccuucggc

SEQ ID NO: 3030719 - RNA, 16 nt, Human
agagacacaagccuuc

SEQ ID NO: 3030720 - RNA, 19 nt, Human
agacuuuggaaagaguagg

SEQ ID NO: 3030721 - RNA, 15 nt, Human
agacuuuuccaaccc

SEQ ID NO: 3030722 - RNA, 15 nt, Human
agacuuuggaaagac

SEQ ID NO: 3030723 - RNA, 15 nt, Human
agacuuuggaaagag

SEQ ID NO: 3030724 - RNA, 17 nt, Human
agacuuuggaaagacuu

SEQ ID NO: 3030725 - RNA, 20 nt, Human
agacugguuccauggccucu

SEQ ID NO: 3030726 - RNA, 14 nt, Human
ucuuuguggcuucc

SEQ ID NO: 3030727 - RNA, 20 nt, Human
ucuuuguacagacaacaaac

SEQ ID NO: 3030728 - RNA, 15 nt, Human
ucuuuguacagacaa

SEQ ID NO: 3030729 - RNA, 14 nt, Human
ucuuuguacagaca

SEQ ID NO: 3030730 - RNA, 13 nt, Human
agacuccugcagg

SEQ ID NO: 3030731 - RNA, 18 nt, Human
ucuuuaaugucacaggca

SEQ ID NO: 3030732 - RNA, 15 nt, Human
ucuuuaaugucacag

SEQ ID NO: 3030733 - RNA, 20 nt, Human
agacaggcaagcaccuccug

SEQ ID NO: 3030734 - RNA, 14 nt, Human
ugaaaacacauuuu

SEQ ID NO: 3030735 - RNA, 12 nt, Human
ugaaaacacauu

SEQ ID NO: 3030736 - RNA, 13 nt, Human
ugaaaacacauuu

SEQ ID NO: 3030737 - RNA, 15 nt, Human
ugaaaacacauuuuu

SEQ ID NO: 3030738 - RNA, 17 nt, Human
ugaaaacacauuuuucu

SEQ ID NO: 3030739 - RNA, 19 nt, Human
ugaaaacacauuuuucuua

SEQ ID NO: 3030740 - RNA, 17 nt, Human
ugaaacuggauuaaacu

SEQ ID NO: 3030741 - RNA, 18 nt, Human
ugaaacuggauuaaacuu

SEQ ID NO: 3030742 - RNA, 11 nt, Human
agagacuccug

SEQ ID NO: 3030743 - RNA, 12 nt, Human
agagacuccugc

SEQ ID NO: 3030744 - RNA, 14 nt, Human
agagacuccugcag

SEQ ID NO: 3030745 - RNA, 13 nt, Human
agagacuccugca

SEQ ID NO: 3030746 - RNA, 23 nt, Human
agagaccaucccugaaggccccg

SEQ ID NO: 3030747 - RNA, 22 nt, Human
agagaccaucccugaaggcccc

SEQ ID NO: 3030748 - RNA, 18 nt, Human
agagaccaucccugaagg

SEQ ID NO: 3030749 - RNA, 21 nt, Human
agagaccaucccugaaggccc

SEQ ID NO: 3030750 - RNA, 19 nt, Human
agagaccaucccugaaggc

SEQ ID NO: 3030751 - RNA, 22 nt, Human
ugaaagacuguacaaaguagaa

SEQ ID NO: 3030752 - RNA, 18 nt, Human
ugaaagacuguacaaagu

SEQ ID NO: 3030753 - RNA, 19 nt, Human
ugaaagacuguacaaagua

SEQ ID NO: 3030754 - RNA, 16 nt, Human
ugaaagacuguacaaa

SEQ ID NO: 3030755 - RNA, 22 nt, Human
ugaaagaaaauaccaaggaaca

SEQ ID NO: 3030756 - RNA, 21 nt, Human
ugagagcaguuugguuucuag

SEQ ID NO: 3030757 - RNA, 23 nt, Human
ugagagcaguuugguuucuagca

SEQ ID NO: 3030758 - RNA, 14 nt, Human
ugagagcugggugu

SEQ ID NO: 3030759 - RNA, 10 nt, Human
ugagaggaaa

SEQ ID NO: 3030760 - RNA, 14 nt, Human
ugagaggaaaucac

SEQ ID NO: 3030761 - RNA, 13 nt, Human
ugagaggaaauca

SEQ ID NO: 3030762 - RNA, 12 nt, Human
ugagaggaaauc

SEQ ID NO: 3030763 - RNA, 11 nt, Human
ugagaggaaau

SEQ ID NO: 3030764 - RNA, 23 nt, Human
ugagaggacuuuucuuuguggcu

SEQ ID NO: 3030765 - RNA, 17 nt, Human
ugagaggaaaucaccga

SEQ ID NO: 3030766 - RNA, 20 nt, Human
ugagaagcagaggaaggaga

SEQ ID NO: 3030767 - RNA, 11 nt, Human
ugagacagagu

SEQ ID NO: 3030768 - RNA, 21 nt, Human
ugagacagaguuuucacucuu

SEQ ID NO: 3030769 - RNA, 13 nt, Human
ugagacagcccgg

SEQ ID NO: 3030770 - RNA, 20 nt, Human
ugagacucugucucaaaaaa

SEQ ID NO: 3030771 - RNA, 22 nt, Human
ugagacagcccgggcucugccu

SEQ ID NO: 3030772 - RNA, 20 nt, Human
ugagacagcccgggcucugc

SEQ ID NO: 3030773 - RNA, 19 nt, Human
ugagacagcccgggcucug

SEQ ID NO: 3030774 - RNA, 18 nt, Human
ugagacagcccgggcucu

SEQ ID NO: 3030775 - RNA, 17 nt, Human
ugagacagcccgggcuc

SEQ ID NO: 3030776 - RNA, 17 nt, Human
agcaagugagagcuggg

SEQ ID NO: 3030777 - RNA, 21 nt, Human
agcacagcuucauuuccugug

SEQ ID NO: 3030778 - RNA, 16 nt, Human
agcacaugccucucuc

SEQ ID NO: 3030779 - RNA, 18 nt, Human
agcacaugccucucucag

SEQ ID NO: 3030780 - RNA, 22 nt, Human
agcacaugccucucucaggcca

SEQ ID NO: 3030781 - RNA, 21 nt, Human
agcacaugccucucucaggcc

SEQ ID NO: 3030782 - RNA, 20 nt, Human
agcacaugccucucucaggc

SEQ ID NO: 3030783 - RNA, 19 nt, Human
agcacaugccucucucagg

SEQ ID NO: 3030784 - RNA, 23 nt, Human
agcacaugccucucucaggccaa

SEQ ID NO: 3030785 - RNA, 16 nt, Human
agcaccaucucuccuc

SEQ ID NO: 3030786 - RNA, 13 nt, Human
agcaccuccugcc

SEQ ID NO: 3030787 - RNA, 14 nt, Human
agcaccuccugccu

SEQ ID NO: 3030788 - RNA, 16 nt, Human
agcaccuccugccucg

SEQ ID NO: 3030789 - RNA, 12 nt, Human
ugagccacugca

SEQ ID NO: 3030790 - RNA, 13 nt, Human
ugagccacugcac

SEQ ID NO: 3030791 - RNA, 21 nt, Human
ugagccagauuucacucuccu

SEQ ID NO: 3030792 - RNA, 20 nt, Human
ugagccagauuucacucucc

SEQ ID NO: 3030793 - RNA, 14 nt, Human
ugagccacugcacc

SEQ ID NO: 3030794 - RNA, 19 nt, Human
ugagccagauuucacucuc

SEQ ID NO: 3030795 - RNA, 18 nt, Human
ugagccagauuucacucu

SEQ ID NO: 3030796 - RNA, 16 nt, Human
agcaagugagacccug

SEQ ID NO: 3030797 - RNA, 15 nt, Human
agcaagugagagcug

SEQ ID NO: 3030798 - RNA, 16 nt, Human
agcaagugagagcugg

SEQ ID NO: 3030799 - RNA, 14 nt, Human
agcaaggagauuua

SEQ ID NO: 3030800 - RNA, 17 nt, Human
agcaaggagauuuacaa

SEQ ID NO: 3030801 - RNA, 19 nt, Human
agcaaggagauuuacaacu

SEQ ID NO: 3030802 - RNA, 16 nt, Human
agaugcacaugagcug

SEQ ID NO: 3030803 - RNA, 13 nt, Human
agaugcacaugag

SEQ ID NO: 3030804 - RNA, 14 nt, Human
ugacagauugaauu

SEQ ID NO: 3030805 - RNA, 22 nt, Human
ugacagagugagacucugucuc

SEQ ID NO: 3030806 - RNA, 19 nt, Human
ugacacgaauauugcugau

SEQ ID NO: 3030807 - RNA, 20 nt, Human
ugaaugcccagugagacugu

SEQ ID NO: 3030808 - RNA, 16 nt, Human
ugacacgaauauugcu

SEQ ID NO: 3030809 - RNA, 13 nt, Human
ugacauucccugc

SEQ ID NO: 3030810 - RNA, 13 nt, Human
ugacauguuuuau

SEQ ID NO: 3030811 - RNA, 21 nt, Human
ugacagggcacaccgggcacu

SEQ ID NO: 3030812 - RNA, 22 nt, Human
ugacagggcacaccgggcacuc

SEQ ID NO: 3030813 - RNA, 17 nt, Human
ugacaggcaaugcuggc

SEQ ID NO: 3030814 - RNA, 19 nt, Human
ugacaggcaaugcuggcug

SEQ ID NO: 3030815 - RNA, 22 nt, Human
ugacuauucugagaugacuauu

SEQ ID NO: 3030816 - RNA, 21 nt, Human
ugacuauucugagaugacuau

SEQ ID NO: 3030817 - RNA, 19 nt, Human
ugacuauucugagaugacu

SEQ ID NO: 3030818 - RNA, 16 nt, Human
ugacuauaaccuuguu

SEQ ID NO: 3030819 - RNA, 12 nt, Human
ugaccuuucaau

SEQ ID NO: 3030820 - RNA, 11 nt, Human
ugacuguuuuu

SEQ ID NO: 3030821 - RNA, 21 nt, Human
ugacuguuuucucuugagagg

SEQ ID NO: 3030822 - RNA, 22 nt, Human
ugacuauuuuuguuuuuauuaa

SEQ ID NO: 3030823 - RNA, 18 nt, Human
ugacuauuuuuguuuuua

SEQ ID NO: 3030824 - RNA, 15 nt, Human
ugaccuuuaagagaa

SEQ ID NO: 3030825 - RNA, 17 nt, Human
agauuucacucuccuug

SEQ ID NO: 3030826 - RNA, 19 nt, Human
agauuucacucuccuuggu

SEQ ID NO: 3030827 - RNA, 13 nt, Human
agauucauauuua

SEQ ID NO: 3030828 - RNA, 16 nt, Human
agauucauauuuacuu

SEQ ID NO: 3030829 - RNA, 12 nt, Human
ugacuuacugua

SEQ ID NO: 3030830 - RNA, 20 nt, Human
ugacuuacuguacaugaaaa

SEQ ID NO: 3030831 - RNA, 14 nt, Human
ucugagugcaaacu

SEQ ID NO: 3030832 - RNA, 21 nt, Human
ucugagacucgcgacaaugca

SEQ ID NO: 3030833 - RNA, 23 nt, Human
ucugagugcaaacuucagaguuc

SEQ ID NO: 3030834 - RNA, 22 nt, Human
ucugagugcaaacuucagaguu

SEQ ID NO: 3030835 - RNA, 17 nt, Human
ucugaucauccacugug

SEQ ID NO: 3030836 - RNA, 21 nt, Human
ucugaucauccacugugccau

SEQ ID NO: 3030837 - RNA, 14 nt, Human
agaaauguacagca

SEQ ID NO: 3030838 - RNA, 15 nt, Human
agaaauguacagcaa

SEQ ID NO: 3030839 - RNA, 16 nt, Human
ucugcacuccccugcu

SEQ ID NO: 3030840 - RNA, 15 nt, Human
ucugcacuccccugc

SEQ ID NO: 3030841 - RNA, 14 nt, Human
ucugcacuccccug

SEQ ID NO: 3030842 - RNA, 17 nt, Human
ucugcagcaauaaagca

SEQ ID NO: 3030843 - RNA, 15 nt, Human
ucugacacacagcuc

SEQ ID NO: 3030844 - RNA, 12 nt, Human
ucugacacacag

SEQ ID NO: 3030845 - RNA, 13 nt, Human
ucugacacacagc

SEQ ID NO: 3030846 - RNA, 14 nt, Human
ucugacacacagcu

SEQ ID NO: 3030847 - RNA, 21 nt, Human
ucugaaggacauugcggacag

SEQ ID NO: 3030848 - RNA, 15 nt, Human
ucugccgcagcccug

SEQ ID NO: 3030849 - RNA, 14 nt, Human
ucugccgcagcccu

SEQ ID NO: 3030850 - RNA, 19 nt, Human
ucugcccuccaagaccuuc

SEQ ID NO: 3030851 - RNA, 18 nt, Human
ucugcccuccaagaccuu

SEQ ID NO: 3030852 - RNA, 21 nt, Human
ucugcccacucccugcaaccu

SEQ ID NO: 3030853 - RNA, 18 nt, Human
ucugcccacucccugcaa

SEQ ID NO: 3030854 - RNA, 21 nt, Human
ucugccugcccaggccccugc

SEQ ID NO: 3030855 - RNA, 22 nt, Human
ucugccugcccaggccccugcc

SEQ ID NO: 3030856 - RNA, 22 nt, Human
ucugccgcagcccugcagaggg

SEQ ID NO: 3030857 - RNA, 17 nt, Human
ucugcucacauaucugu

SEQ ID NO: 3030858 - RNA, 19 nt, Human
ucugcucacauaucuguca

SEQ ID NO: 3030859 - RNA, 20 nt, Human
ucugcucacauaucugucau

SEQ ID NO: 3030860 - RNA, 13 nt, Human
ucugcuucagccu

SEQ ID NO: 3030861 - RNA, 14 nt, Human
ucugcuucagccuc

SEQ ID NO: 3030862 - RNA, 15 nt, Human
ucugcuucagccucc

SEQ ID NO: 3030863 - RNA, 18 nt, Human
agaagauuuugaaauuuu

SEQ ID NO: 3030864 - RNA, 17 nt, Human
ucugcccacucccugca

SEQ ID NO: 3030865 - RNA, 16 nt, Human
ucugcccacucccugc

SEQ ID NO: 3030866 - RNA, 22 nt, Human
agaagcccaggaaaggcuccag

SEQ ID NO: 3030867 - RNA, 21 nt, Human
agaagcccaggaaaggcucca

SEQ ID NO: 3030868 - RNA, 20 nt, Human
agaagcccaggaaaggcucc

SEQ ID NO: 3030869 - RNA, 18 nt, Human
agaagcccaggaaaggcu

SEQ ID NO: 3030870 - RNA, 16 nt, Human
agaagcccaggaaagg

SEQ ID NO: 3030871 - RNA, 12 nt, Human
agaagcccagga

SEQ ID NO: 3030872 - RNA, 24 nt, Human
agaauugauugggcacaucauuuc

SEQ ID NO: 3030873 - RNA, 23 nt, Human
agaauugauugggcacaucauuu

SEQ ID NO: 3030874 - RNA, 22 nt, Human
agaauugauugggcacaucauu

SEQ ID NO: 3030875 - RNA, 16 nt, Human
agaauugauugggcac

SEQ ID NO: 3030876 - RNA, 12 nt, Human
agacacaggccc

SEQ ID NO: 3030877 - RNA, 13 nt, Human
agacacaggcccg

SEQ ID NO: 3030878 - RNA, 22 nt, Human
agacagagccccacccucagau

SEQ ID NO: 3030879 - RNA, 24 nt, Human
agacagagccccacccucagaugc

SEQ ID NO: 3030880 - RNA, 16 nt, Human
agacaggaccagggau

SEQ ID NO: 3030881 - RNA, 17 nt, Human
agacaccuugacagggc

SEQ ID NO: 3030882 - RNA, 18 nt, Human
agacaccuugacagggca

SEQ ID NO: 3030883 - RNA, 20 nt, Human
agacacauguccaagaagcc

SEQ ID NO: 3030884 - RNA, 16 nt, Human
agacacauguccaaga

SEQ ID NO: 3030885 - RNA, 22 nt, Human
ucugugaaaggaaagagggagg

SEQ ID NO: 3030886 - RNA, 12 nt, Human
ucuguuggccag

SEQ ID NO: 3030887 - RNA, 17 nt, Human
ucuguuggccaguguga

SEQ ID NO: 3030888 - RNA, 22 nt, Human
ucuguucuuuccaaaguacacu

SEQ ID NO: 3030889 - RNA, 13 nt, Human
ucuguucuuucca

SEQ ID NO: 3030890 - RNA, 15 nt, Human
agaauguuuucaaau

SEQ ID NO: 3030891 - RNA, 21 nt, Human
agaauguuuucaaauguucuc

SEQ ID NO: 3030892 - RNA, 12 nt, Human
agaauguuuuca

SEQ ID NO: 3030893 - RNA, 23 nt, Human
agaaguuucugccgcagcccugc

SEQ ID NO: 3030894 - RNA, 22 nt, Human
agaaguuucugccgcagcccug

SEQ ID NO: 3030895 - RNA, 21 nt, Human
agaaguuucugccgcagcccu

SEQ ID NO: 3030896 - RNA, 23 nt, Human
ucuauaacaaaggauacuuauuu

SEQ ID NO: 3030897 - RNA, 22 nt, Human
ucuauaacaaaggauacuuauu

SEQ ID NO: 3030898 - RNA, 23 nt, Human
ucuaguuguuugauucagacagc

SEQ ID NO: 3030899 - RNA, 21 nt, Human
ucuaguuugauuaaauucuug

SEQ ID NO: 3030900 - RNA, 13 nt, Human
ucuagccagagga

SEQ ID NO: 3030901 - RNA, 12 nt, Human
ucuaggaagacu

SEQ ID NO: 3030902 - RNA, 22 nt, Human
ucuaguuguuugauucagacag

SEQ ID NO: 3030903 - RNA, 18 nt, Human
ucuagcauggcugccaau

SEQ ID NO: 3030904 - RNA, 14 nt, Human
ucuauguuaauauu

SEQ ID NO: 3030905 - RNA, 16 nt, Human
ucuauguuaauauuuu

SEQ ID NO: 3030906 - RNA, 23 nt, Human
ucuaugggacucaaugcacugac

SEQ ID NO: 3030907 - RNA, 13 nt, Human
ucuauuuauuuau

SEQ ID NO: 3030908 - RNA, 14 nt, Human
ucuauuuauuuauu

SEQ ID NO: 3030909 - RNA, 21 nt, Human
ucuauuucuggaugaaugccc

SEQ ID NO: 3030910 - RNA, 17 nt, Human
ucucacuauguugccca

SEQ ID NO: 3030911 - RNA, 19 nt, Human
ucucacuauguugcccagg

SEQ ID NO: 3030912 - RNA, 16 nt, Human
ucucacuauguugccc

SEQ ID NO: 3030913 - RNA, 20 nt, Human
acuuaaauaaugugaaacug

SEQ ID NO: 3030914 - RNA, 13 nt, Human
acuuaagcacacu

SEQ ID NO: 3030915 - RNA, 17 nt, Human
acuuaaucuaaauggaa

SEQ ID NO: 3030916 - RNA, 19 nt, Human
acuuaaucuaaauggaacc

SEQ ID NO: 3030917 - RNA, 22 nt, Human
acuuaaucuaaauggaaccacu

SEQ ID NO: 3030918 - RNA, 16 nt, Human
acuuacacuuuaugca

SEQ ID NO: 3030919 - RNA, 15 nt, Human
acuuagguguggggg

SEQ ID NO: 3030920 - RNA, 22 nt, Human
acuuacuguacaugaaaacaca

SEQ ID NO: 3030921 - RNA, 17 nt, Human
acuuacacuuuaugcac

SEQ ID NO: 3030922 - RNA, 21 nt, Human
acuuacuguacaugaaaacac

SEQ ID NO: 3030923 - RNA, 16 nt, Human
acuuacuguacaugaa

SEQ ID NO: 3030924 - RNA, 18 nt, Human
acuguucucugcccucca

SEQ ID NO: 3030925 - RNA, 17 nt, Human
acuguucucugcccucc

SEQ ID NO: 3030926 - RNA, 16 nt, Human
acuguucucugcccuc

SEQ ID NO: 3030927 - RNA, 21 nt, Human
ucuacccuggcacuauaaugu

SEQ ID NO: 3030928 - RNA, 20 nt, Human
ucuacccagcgagcccuggu

SEQ ID NO: 3030929 - RNA, 14 nt, Human
ucuacccaggugcu

SEQ ID NO: 3030930 - RNA, 19 nt, Human
ucuacccuggcacuauaau

SEQ ID NO: 3030931 - RNA, 14 nt, Human
ucuacccuggcacu

SEQ ID NO: 3030932 - RNA, 21 nt, Human
ucuacagaggccaugggccuc

SEQ ID NO: 3030933 - RNA, 19 nt, Human
ucuacccagcgagcccugg

SEQ ID NO: 3030934 - RNA, 16 nt, Human
ucuacagaggccaugg

SEQ ID NO: 3030935 - RNA, 18 nt, Human
uccugggagugagcuggu

SEQ ID NO: 3030936 - RNA, 14 nt, Human
ucucagcagagugc

SEQ ID NO: 3030937 - RNA, 13 nt, Human
ucucagcagagug

SEQ ID NO: 3030938 - RNA, 12 nt, Human
ucucagcagagu

SEQ ID NO: 3030939 - RNA, 10 nt, Human
ucucaggcca

SEQ ID NO: 3030940 - RNA, 12 nt, Human
ucucaggccaaa

SEQ ID NO: 3030941 - RNA, 13 nt, Human
ucucaggccagcu

SEQ ID NO: 3030942 - RNA, 12 nt, Human
ucucaggccagc

SEQ ID NO: 3030943 - RNA, 21 nt, Human
ucucaggccagcugcuugggc

SEQ ID NO: 3030944 - RNA, 18 nt, Human
ucucaggccagcugcuug

SEQ ID NO: 3030945 - RNA, 17 nt, Human
ucucaggccagcugcuu

SEQ ID NO: 3030946 - RNA, 16 nt, Human
ucucauuugucacaca

SEQ ID NO: 3030947 - RNA, 16 nt, Human
ucuccaagcaggacau

SEQ ID NO: 3030948 - RNA, 15 nt, Human
ucuccaagcaggaca

SEQ ID NO: 3030949 - RNA, 14 nt, Human
ucucauuugucaca

SEQ ID NO: 3030950 - RNA, 15 nt, Human
acuugugaauaaaga

SEQ ID NO: 3030951 - RNA, 21 nt, Human
acuugucuuuggacccugagg

SEQ ID NO: 3030952 - RNA, 18 nt, Human
acuugucuuuggacccug

SEQ ID NO: 3030953 - RNA, 20 nt, Human
acuugucuuuggacccugag

SEQ ID NO: 3030954 - RNA, 19 nt, Human
acuuguggacacagcucuu

SEQ ID NO: 3030955 - RNA, 22 nt, Human
acuuguggacacagcucuucuc

SEQ ID NO: 3030956 - RNA, 20 nt, Human
ucucacuauguugcccaggc

SEQ ID NO: 3030957 - RNA, 21 nt, Human
ucucacuauguugcccaggca

SEQ ID NO: 3030958 - RNA, 22 nt, Human
ucucacuauguugcccaggcag

SEQ ID NO: 3030959 - RNA, 23 nt, Human
ucucacuauguugcccaggcagg

SEQ ID NO: 3030960 - RNA, 23 nt, Human
acuugcagacucuacagaggcca

SEQ ID NO: 3030961 - RNA, 19 nt, Human
acuugcagacucuacagag

SEQ ID NO: 3030962 - RNA, 22 nt, Human
acuugcagacucuacagaggcc

SEQ ID NO: 3030963 - RNA, 21 nt, Human
acuuugguuauuuuacuuuuu

SEQ ID NO: 3030964 - RNA, 13 nt, Human
acuuugguuauuu

SEQ ID NO: 3030965 - RNA, 10 nt, Human
acuuugguua

SEQ ID NO: 3030966 - RNA, 12 nt, Human
acuuugaccucu

SEQ ID NO: 3030967 - RNA, 13 nt, Human
acuuugaccucug

SEQ ID NO: 3030968 - RNA, 23 nt, Human
acuuugguuauuuuacuuuuugg

SEQ ID NO: 3030969 - RNA, 22 nt, Human
acuuugguuauuuuacuuuuug

SEQ ID NO: 3030970 - RNA, 18 nt, Human
acuuuguguucaccuugu

SEQ ID NO: 3030971 - RNA, 20 nt, Human
acuuuguuaguuucuccaag

SEQ ID NO: 3030972 - RNA, 14 nt, Human
acuuuguucuggcu

SEQ ID NO: 3030973 - RNA, 21 nt, Human
acuuuguuaguuucuccaagc

SEQ ID NO: 3030974 - RNA, 12 nt, Human
acuuuuguucuu

SEQ ID NO: 3030975 - RNA, 13 nt, Human
acuuuuguucuug

SEQ ID NO: 3030976 - RNA, 16 nt, Human
acuuuuuauauucuca

SEQ ID NO: 3030977 - RNA, 15 nt, Human
acuuuuuauauucuc

SEQ ID NO: 3030978 - RNA, 12 nt, Human
acuuuuuauauu

SEQ ID NO: 3030979 - RNA, 22 nt, Human
acuuuuuauauucucagcagag

SEQ ID NO: 3030980 - RNA, 15 nt, Human
acuuuuguucuuggu

SEQ ID NO: 3030981 - RNA, 23 nt, Human
acuuuuguucuugguuuguaaau

SEQ ID NO: 3030982 - RNA, 17 nt, Human
agaaaaaauauuuuccc

SEQ ID NO: 3030983 - RNA, 15 nt, Human
ucuccuucaccuuug

SEQ ID NO: 3030984 - RNA, 14 nt, Human
ucuccuucaccuuu

SEQ ID NO: 3030985 - RNA, 16 nt, Human
ucuccuucaccuuugu

SEQ ID NO: 3030986 - RNA, 13 nt, Human
ucuccuuguguua

SEQ ID NO: 3030987 - RNA, 21 nt, Human
ucuccuuguguuacuaaguuu

SEQ ID NO: 3030988 - RNA, 15 nt, Human
ucuccuccagaguca

SEQ ID NO: 3030989 - RNA, 16 nt, Human
ucuccucugcugcugg

SEQ ID NO: 3030990 - RNA, 15 nt, Human
ucuccucugcugcug

SEQ ID NO: 3030991 - RNA, 18 nt, Human
ucuccucugcugcuggcu

SEQ ID NO: 3030992 - RNA, 17 nt, Human
ucuccucugcugcuggc

SEQ ID NO: 3030993 - RNA, 14 nt, Human
acuuucugaaauaa

SEQ ID NO: 3030994 - RNA, 20 nt, Human
acuuucugaaauaacauggc

SEQ ID NO: 3030995 - RNA, 12 nt, Human
acuuuaccuuuu

SEQ ID NO: 3030996 - RNA, 19 nt, Human
ucuccaagcaggacaugga

SEQ ID NO: 3030997 - RNA, 18 nt, Human
ucuccaagcaggacaugg

SEQ ID NO: 3030998 - RNA, 23 nt, Human
ucuccccagcaagugagagcugg

SEQ ID NO: 3030999 - RNA, 21 nt, Human
ucucccuuggauuguccccga

SEQ ID NO: 3031000 - RNA, 17 nt, Human
ucuccgaccagacaccu

SEQ ID NO: 3031001 - RNA, 23 nt, Human
ucuccgaccagacaccuugacag

SEQ ID NO: 3031002 - RNA, 14 nt, Human
uccagucauuaugu

SEQ ID NO: 3031003 - RNA, 15 nt, Human
uccagucauuauguu

SEQ ID NO: 3031004 - RNA, 21 nt, Human
uccagucauuauguuaauauu

SEQ ID NO: 3031005 - RNA, 23 nt, Human
uccagucauuauguuaauauuuc

SEQ ID NO: 3031006 - RNA, 18 nt, Human
uccaguaucuugaagacu

SEQ ID NO: 3031007 - RNA, 16 nt, Human
uccaguaucuugaaga

SEQ ID NO: 3031008 - RNA, 23 nt, Human
uccagugaggcucugcccuuggu

SEQ ID NO: 3031009 - RNA, 22 nt, Human
uccagugaggcucugcccuugg

SEQ ID NO: 3031010 - RNA, 16 nt, Human
uccagugaggcucugc

SEQ ID NO: 3031011 - RNA, 15 nt, Human
uccagugaggcucug

SEQ ID NO: 3031012 - RNA, 15 nt, Human
uccaguaucuugaag

SEQ ID NO: 3031013 - RNA, 14 nt, Human
uccaguaucuugaa

SEQ ID NO: 3031014 - RNA, 18 nt, Human
acggcuuuuacuuaaacc

SEQ ID NO: 3031015 - RNA, 16 nt, Human
acggcucacugcagcc

SEQ ID NO: 3031016 - RNA, 15 nt, Human
acggcucacugcagc

SEQ ID NO: 3031017 - RNA, 17 nt, Human
acggcucacugcagccu

SEQ ID NO: 3031018 - RNA, 18 nt, Human
acggcucacugcagccuc

SEQ ID NO: 3031019 - RNA, 12 nt, Human
acggccaggcca

SEQ ID NO: 3031020 - RNA, 21 nt, Human
acgcuacccgggaagggggcu

SEQ ID NO: 3031021 - RNA, 14 nt, Human
acgaauauugcuga

SEQ ID NO: 3031022 - RNA, 21 nt, Human
acgaauauugcugauggugca

SEQ ID NO: 3031023 - RNA, 23 nt, Human
acggagucccaccuuggcugcag

SEQ ID NO: 3031024 - RNA, 21 nt, Human
acggagucccaccuuggcugc

SEQ ID NO: 3031025 - RNA, 17 nt, Human
acgcuggagugcaguga

SEQ ID NO: 3031026 - RNA, 20 nt, Human
acgcuggaccuugaacuggg

SEQ ID NO: 3031027 - RNA, 23 nt, Human
acgcuggaccuugaacuggguac

SEQ ID NO: 3031028 - RNA, 15 nt, Human
acgcuggagugcagu

SEQ ID NO: 3031029 - RNA, 16 nt, Human
acgcuggagugcagug

SEQ ID NO: 3031030 - RNA, 13 nt, Human
acgcuggaccuug

SEQ ID NO: 3031031 - RNA, 21 nt, Human
uccacugugccaugugccagg

SEQ ID NO: 3031032 - RNA, 13 nt, Human
accuuuuuuauac

SEQ ID NO: 3031033 - RNA, 18 nt, Human
accuuuguccccaccgca

SEQ ID NO: 3031034 - RNA, 17 nt, Human
accuuuguccccaccgc

SEQ ID NO: 3031035 - RNA, 20 nt, Human
accuugaacuggguacuugu

SEQ ID NO: 3031036 - RNA, 13 nt, Human
uccagacacaugu

SEQ ID NO: 3031037 - RNA, 15 nt, Human
uccagaauuucccaa

SEQ ID NO: 3031038 - RNA, 14 nt, Human
uccagaauuuccca

SEQ ID NO: 3031039 - RNA, 18 nt, Human
acgaauauugcugauggu

SEQ ID NO: 3031040 - RNA, 15 nt, Human
acgaauauugcugau

SEQ ID NO: 3031041 - RNA, 22 nt, Human
accuuuuuuauacauaaacaag

SEQ ID NO: 3031042 - RNA, 23 nt, Human
uccaggcugggagagccuuccag

SEQ ID NO: 3031043 - RNA, 10 nt, Human
uccaggcucc

SEQ ID NO: 3031044 - RNA, 12 nt, Human
uccaggcuccuu

SEQ ID NO: 3031045 - RNA, 21 nt, Human
uccaggcugggagagccuucc

SEQ ID NO: 3031046 - RNA, 20 nt, Human
uccaggcugggagagccuuc

SEQ ID NO: 3031047 - RNA, 16 nt, Human
ucccccagccccaucc

SEQ ID NO: 3031048 - RNA, 15 nt, Human
ucccccagccccauc

SEQ ID NO: 3031049 - RNA, 13 nt, Human
ucccccagcccca

SEQ ID NO: 3031050 - RNA, 11 nt, Human
ucccccagccc

SEQ ID NO: 3031051 - RNA, 21 nt, Human
uccccaggaggccagccuuga

SEQ ID NO: 3031052 - RNA, 20 nt, Human
uccccaggaggccagccuug

SEQ ID NO: 3031053 - RNA, 17 nt, Human
uccccaggaggccagcc

SEQ ID NO: 3031054 - RNA, 12 nt, Human
uccccacccuga

SEQ ID NO: 3031055 - RNA, 18 nt, Human
uccccaggaggccagccu

SEQ ID NO: 3031056 - RNA, 16 nt, Human
uccccaccgcagacag

SEQ ID NO: 3031057 - RNA, 15 nt, Human
uccccaccgcagaca

SEQ ID NO: 3031058 - RNA, 23 nt, Human
uccccacccugaaagcccugagc

SEQ ID NO: 3031059 - RNA, 14 nt, Human
acuauguugcccag

SEQ ID NO: 3031060 - RNA, 22 nt, Human
acuauggcccuggccuagcaua

SEQ ID NO: 3031061 - RNA, 15 nt, Human
acuauguugcccagg

SEQ ID NO: 3031062 - RNA, 16 nt, Human
acuauguugcccaggc

SEQ ID NO: 3031063 - RNA, 16 nt, Human
acucaaugcacugaca

SEQ ID NO: 3031064 - RNA, 20 nt, Human
acuauagccuaggugacaga

SEQ ID NO: 3031065 - RNA, 22 nt, Human
acuauagccuaggugacagagu

SEQ ID NO: 3031066 - RNA, 18 nt, Human
acuauagccuaggugaca

SEQ ID NO: 3031067 - RNA, 16 nt, Human
acuaucuaaauguuga

SEQ ID NO: 3031068 - RNA, 21 nt, Human
acuaucuaaauguugaaagau

SEQ ID NO: 3031069 - RNA, 18 nt, Human
ucccagauacuugggggg

SEQ ID NO: 3031070 - RNA, 12 nt, Human
ucccagccccaa

SEQ ID NO: 3031071 - RNA, 16 nt, Human
ucccagauacuugggg

SEQ ID NO: 3031072 - RNA, 22 nt, Human
acguuucuaaaggcuaccuuug

SEQ ID NO: 3031073 - RNA, 13 nt, Human
acguugugcauuu

SEQ ID NO: 3031074 - RNA, 15 nt, Human
acguuucuaaaggcu

SEQ ID NO: 3031075 - RNA, 16 nt, Human
acguuucuaaaggcua

SEQ ID NO: 3031076 - RNA, 14 nt, Human
acguugugcauuug

SEQ ID NO: 3031077 - RNA, 15 nt, Human
acguugugcauuugg

SEQ ID NO: 3031078 - RNA, 18 nt, Human
acguggcugcuucaagga

SEQ ID NO: 3031079 - RNA, 17 nt, Human
acguggcugcuucaagg

SEQ ID NO: 3031080 - RNA, 21 nt, Human
acguggcugcuucaaggaucc

SEQ ID NO: 3031081 - RNA, 19 nt, Human
acguggcugcuucaaggau

SEQ ID NO: 3031082 - RNA, 15 nt, Human
acugaacaguaacau

SEQ ID NO: 3031083 - RNA, 21 nt, Human
acugaacaguaacauagcugu

SEQ ID NO: 3031084 - RNA, 19 nt, Human
uccucuuuccaucuacccu

SEQ ID NO: 3031085 - RNA, 21 nt, Human
uccucuuuggucuacacugug

SEQ ID NO: 3031086 - RNA, 19 nt, Human
uccucuuuggucuacacug

SEQ ID NO: 3031087 - RNA, 11 nt, Human
uccucccuccc

SEQ ID NO: 3031088 - RNA, 14 nt, Human
uccucccucccucu

SEQ ID NO: 3031089 - RNA, 11 nt, Human
uccucuuucca

SEQ ID NO: 3031090 - RNA, 12 nt, Human
uccucuuuccau

SEQ ID NO: 3031091 - RNA, 22 nt, Human
uccucuuuggucuacacugugc

SEQ ID NO: 3031092 - RNA, 21 nt, Human
acugagacagcccgggcucug

SEQ ID NO: 3031093 - RNA, 18 nt, Human
acugagacagcccgggcu

SEQ ID NO: 3031094 - RNA, 15 nt, Human
acugagacagcccgg

SEQ ID NO: 3031095 - RNA, 23 nt, Human
acugagacagcccgggcucugcc

SEQ ID NO: 3031096 - RNA, 22 nt, Human
acugagacagcccgggcucugc

SEQ ID NO: 3031097 - RNA, 13 nt, Human
acugauaaagaug

SEQ ID NO: 3031098 - RNA, 21 nt, Human
acugauaaagaugagugagca

SEQ ID NO: 3031099 - RNA, 14 nt, Human
acugcaccgggcca

SEQ ID NO: 3031100 - RNA, 16 nt, Human
acugcaccgggccaca

SEQ ID NO: 3031101 - RNA, 20 nt, Human
acugcacuauagccuaggug

SEQ ID NO: 3031102 - RNA, 19 nt, Human
uccugaugcuucuucagag

SEQ ID NO: 3031103 - RNA, 21 nt, Human
uccugaugcuucuucagagac

SEQ ID NO: 3031104 - RNA, 20 nt, Human
uccugaugcuucuucagaga

SEQ ID NO: 3031105 - RNA, 21 nt, Human
acugcacuauagccuagguga

SEQ ID NO: 3031106 - RNA, 14 nt, Human
acugcacuccagcc

SEQ ID NO: 3031107 - RNA, 17 nt, Human
acugcacuccagccugg

SEQ ID NO: 3031108 - RNA, 18 nt, Human
acugcacuccagccuggg

SEQ ID NO: 3031109 - RNA, 20 nt, Human
acugcacuccagccugggug

SEQ ID NO: 3031110 - RNA, 19 nt, Human
acugcacuccagccugggu

SEQ ID NO: 3031111 - RNA, 21 nt, Human
uccugccucgaacuggcugca

SEQ ID NO: 3031112 - RNA, 14 nt, Human
uccugcaggcagcc

SEQ ID NO: 3031113 - RNA, 13 nt, Human
uccugcaggcagc

SEQ ID NO: 3031114 - RNA, 12 nt, Human
uccugcaggcag

SEQ ID NO: 3031115 - RNA, 21 nt, Human
uccugcugcaguugccaguca

SEQ ID NO: 3031116 - RNA, 12 nt, Human
uccugggaguga

SEQ ID NO: 3031117 - RNA, 14 nt, Human
uccugggagugagc

SEQ ID NO: 3031118 - RNA, 17 nt, Human
uccugggagugagcugg

SEQ ID NO: 3031119 - RNA, 15 nt, Human
uccuggaaauauuaa

SEQ ID NO: 3031120 - RNA, 22 nt, Human
acucugagugcaaacuucagag

SEQ ID NO: 3031121 - RNA, 22 nt, Human
acucugagacucgcgacaaugc

SEQ ID NO: 3031122 - RNA, 11 nt, Human
acucugagacu

SEQ ID NO: 3031123 - RNA, 23 nt, Human
acucuccuuggugucgggcauga

SEQ ID NO: 3031124 - RNA, 16 nt, Human
acucuccuuggugucg

SEQ ID NO: 3031125 - RNA, 17 nt, Human
acucugccacuuuauuu

SEQ ID NO: 3031126 - RNA, 16 nt, Human
acucugccacuuuauu

SEQ ID NO: 3031127 - RNA, 15 nt, Human
acucuggcagcucag

SEQ ID NO: 3031128 - RNA, 13 nt, Human
acucuggcagcuc

SEQ ID NO: 3031129 - RNA, 12 nt, Human
acucuccucugc

SEQ ID NO: 3031130 - RNA, 14 nt, Human
acucuccucugcug

SEQ ID NO: 3031131 - RNA, 13 nt, Human
acucuccucugcu

SEQ ID NO: 3031132 - RNA, 21 nt, Human
acucuccucugcugcuggcug

SEQ ID NO: 3031133 - RNA, 16 nt, Human
acucuccucugcugcu

SEQ ID NO: 3031134 - RNA, 15 nt, Human
acucuccuugguguc

SEQ ID NO: 3031135 - RNA, 18 nt, Human
acucuccuggaaauauua

SEQ ID NO: 3031136 - RNA, 17 nt, Human
acucuccuccagaguca

SEQ ID NO: 3031137 - RNA, 14 nt, Human
acucuccuccagag

SEQ ID NO: 3031138 - RNA, 24 nt, Human
acuccuugaaaacacuguucucug

SEQ ID NO: 3031139 - RNA, 23 nt, Human
acuccuugaaaacacuguucucu

SEQ ID NO: 3031140 - RNA, 14 nt, Human
acucuugaccucag

SEQ ID NO: 3031141 - RNA, 15 nt, Human
acucuugaccucagg

SEQ ID NO: 3031142 - RNA, 16 nt, Human
acucuugaccucaggu

SEQ ID NO: 3031143 - RNA, 23 nt, Human
uccucauacccacccccacccaa

SEQ ID NO: 3031144 - RNA, 22 nt, Human
uccucauaguaugguggcuggg

SEQ ID NO: 3031145 - RNA, 22 nt, Human
uccucauacccacccccaccca

SEQ ID NO: 3031146 - RNA, 18 nt, Human
ucccuuugacgccauccc

SEQ ID NO: 3031147 - RNA, 16 nt, Human
ucccuuugacgccauc

SEQ ID NO: 3031148 - RNA, 20 nt, Human
ucccuuggauuguccccgac

SEQ ID NO: 3031149 - RNA, 19 nt, Human
ucccuuggauuguccccga

SEQ ID NO: 3031150 - RNA, 22 nt, Human
ucccugguggcagcucaccucu

SEQ ID NO: 3031151 - RNA, 19 nt, Human
ucccuuuuuuggcugcuga

SEQ ID NO: 3031152 - RNA, 17 nt, Human
ucccuuuuuuggcugcu

SEQ ID NO: 3031153 - RNA, 19 nt, Human
ucccuuugacgccauccca

SEQ ID NO: 3031154 - RNA, 22 nt, Human
ucccuuuuuuggcugcugaagg

SEQ ID NO: 3031155 - RNA, 20 nt, Human
ucccuuuuuuggcugcugaa

SEQ ID NO: 3031156 - RNA, 23 nt, Human
ucccuuuuuuggcugcugaaggc

SEQ ID NO: 3031157 - RNA, 12 nt, Human
acuccuggccuc

SEQ ID NO: 3031158 - RNA, 13 nt, Human
uccuaggcauuug

SEQ ID NO: 3031159 - RNA, 13 nt, Human
acuccuggccuca

SEQ ID NO: 3031160 - RNA, 14 nt, Human
acuccuggccucaa

SEQ ID NO: 3031161 - RNA, 15 nt, Human
uccuacucuguguca

SEQ ID NO: 3031162 - RNA, 12 nt, Human
uccuacucugug

SEQ ID NO: 3031163 - RNA, 13 nt, Human
uccuacucugugu

SEQ ID NO: 3031164 - RNA, 14 nt, Human
uccuacucuguguc

SEQ ID NO: 3031165 - RNA, 14 nt, Human
acuccugcaggcag

SEQ ID NO: 3031166 - RNA, 12 nt, Human
acuccugcaggc

SEQ ID NO: 3031167 - RNA, 22 nt, Human
acuccugcaggcagccaggcca

SEQ ID NO: 3031168 - RNA, 16 nt, Human
acuccugcaggcagcc

SEQ ID NO: 3031169 - RNA, 15 nt, Human
acuccugcaggcagc

SEQ ID NO: 3031170 - RNA, 11 nt, Human
acuccuggccu

SEQ ID NO: 3031171 - RNA, 17 nt, Human
ucccugguggcagcuca

SEQ ID NO: 3031172 - RNA, 16 nt, Human
ucccugguggcagcuc

SEQ ID NO: 3031173 - RNA, 21 nt, Human
ucccugguggcagcucaccuc

SEQ ID NO: 3031174 - RNA, 20 nt, Human
ucccugguggcagcucaccu

SEQ ID NO: 3031175 - RNA, 19 nt, Human
ucccugguggcagcucacc

SEQ ID NO: 3031176 - RNA, 18 nt, Human
ucccugguggcagcucac

SEQ ID NO: 3031177 - RNA, 13 nt, Human
acucaccccagcc

SEQ ID NO: 3031178 - RNA, 16 nt, Human
acucaccccagcccca

SEQ ID NO: 3031179 - RNA, 15 nt, Human
acucaccccagcccc

SEQ ID NO: 3031180 - RNA, 14 nt, Human
acucaccccagccc

SEQ ID NO: 3031181 - RNA, 14 nt, Human
ucagcccucagaau

SEQ ID NO: 3031182 - RNA, 13 nt, Human
ucagcccucagaa

SEQ ID NO: 3031183 - RNA, 19 nt, Human
acccaggagccccgaggcc

SEQ ID NO: 3031184 - RNA, 23 nt, Human
acccaggagccccgaggccuucu

SEQ ID NO: 3031185 - RNA, 17 nt, Human
accccacacacgccaga

SEQ ID NO: 3031186 - RNA, 22 nt, Human
accccagccccaaaacucuccu

SEQ ID NO: 3031187 - RNA, 13 nt, Human
accccagccccaa

SEQ ID NO: 3031188 - RNA, 12 nt, Human
ucagauuugaac

SEQ ID NO: 3031189 - RNA, 21 nt, Human
ucagauuugaacucuucaauc

SEQ ID NO: 3031190 - RNA, 15 nt, Human
ucagcaaaagaugcu

SEQ ID NO: 3031191 - RNA, 15 nt, Human
accccaucaucccuu

SEQ ID NO: 3031192 - RNA, 18 nt, Human
accccaucucuacaaaaa

SEQ ID NO: 3031193 - RNA, 12 nt, Human
ucagcuccagcu

SEQ ID NO: 3031194 - RNA, 19 nt, Human
ucagcggggacagcuccuu

SEQ ID NO: 3031195 - RNA, 20 nt, Human
ucagcggggacagcuccuuc

SEQ ID NO: 3031196 - RNA, 21 nt, Human
ucagcggggacagcuccuucu

SEQ ID NO: 3031197 - RNA, 23 nt, Human
ucagcggggacagcuccuucugu

SEQ ID NO: 3031198 - RNA, 18 nt, Human
ucagcggggacagcuccu

SEQ ID NO: 3031199 - RNA, 14 nt, Human
acccucucaaacua

SEQ ID NO: 3031200 - RNA, 18 nt, Human
acccugaaagcccugagc

SEQ ID NO: 3031201 - RNA, 16 nt, Human
acccugaaagcccuga

SEQ ID NO: 3031202 - RNA, 14 nt, Human
acccugaggcccag

SEQ ID NO: 3031203 - RNA, 13 nt, Human
acccugaggccca

SEQ ID NO: 3031204 - RNA, 22 nt, Human
acccugcccugugggcccccaa

SEQ ID NO: 3031205 - RNA, 17 nt, Human
acccugcccugugggcc

SEQ ID NO: 3031206 - RNA, 14 nt, Human
acccugcccugugg

SEQ ID NO: 3031207 - RNA, 15 nt, Human
acccugcccuguggg

SEQ ID NO: 3031208 - RNA, 16 nt, Human
acccugaggcccagag

SEQ ID NO: 3031209 - RNA, 15 nt, Human
acccugaggcccaga

SEQ ID NO: 3031210 - RNA, 15 nt, Human
accgaaaacguggcu

SEQ ID NO: 3031211 - RNA, 17 nt, Human
acccuugccgucuaccu

SEQ ID NO: 3031212 - RNA, 23 nt, Human
acccuuguggucccaccccacac

SEQ ID NO: 3031213 - RNA, 20 nt, Human
acccuuguggucccacccca

SEQ ID NO: 3031214 - RNA, 16 nt, Human
ucaggguuggccccug

SEQ ID NO: 3031215 - RNA, 19 nt, Human
ucagggucccugguggcag

SEQ ID NO: 3031216 - RNA, 23 nt, Human
ucaggccaggcccucugcccacu

SEQ ID NO: 3031217 - RNA, 20 nt, Human
ucaggccaggcccucugccc

SEQ ID NO: 3031218 - RNA, 22 nt, Human
ucaggccaggcccucugcccac

SEQ ID NO: 3031219 - RNA, 21 nt, Human
ucaggccaggcccucugccca

SEQ ID NO: 3031220 - RNA, 14 nt, Human
ucagcuccagcuca

SEQ ID NO: 3031221 - RNA, 21 nt, Human
ucagcuuguaaauagcucagg

SEQ ID NO: 3031222 - RNA, 22 nt, Human
ucagcuuguaaauagcucaggu

SEQ ID NO: 3031223 - RNA, 23 nt, Human
ucagguaacaggcagauacagga

SEQ ID NO: 3031224 - RNA, 21 nt, Human
ucagguaacaggcagauacag

SEQ ID NO: 3031225 - RNA, 22 nt, Human
ucagguaacaggcagauacagg

SEQ ID NO: 3031226 - RNA, 14 nt, Human
acccggccccugcu

SEQ ID NO: 3031227 - RNA, 15 nt, Human
acccggccccugcug

SEQ ID NO: 3031228 - RNA, 16 nt, Human
acccggccccugcugg

SEQ ID NO: 3031229 - RNA, 22 nt, Human
acccggccccugcugguucagg

SEQ ID NO: 3031230 - RNA, 17 nt, Human
acccggccccugcuggu

SEQ ID NO: 3031231 - RNA, 20 nt, Human
acccggccccugcugguuca

SEQ ID NO: 3031232 - RNA, 13 nt, Human
acccgggaagggg

SEQ ID NO: 3031233 - RNA, 12 nt, Human
acccgggaaggg

SEQ ID NO: 3031234 - RNA, 15 nt, Human
ucauauggauaaaua

SEQ ID NO: 3031235 - RNA, 15 nt, Human
ucauauuuacuucuu

SEQ ID NO: 3031236 - RNA, 23 nt, Human
ucauauuuacuucuuauacauuu

SEQ ID NO: 3031237 - RNA, 15 nt, Human
ucauaguaugguggc

SEQ ID NO: 3031238 - RNA, 18 nt, Human
ucauaguaugguggcugg

SEQ ID NO: 3031239 - RNA, 19 nt, Human
ucauaguaugguggcuggg

SEQ ID NO: 3031240 - RNA, 14 nt, Human
ucauaaccuagccu

SEQ ID NO: 3031241 - RNA, 18 nt, Human
ucauauaagauucauauu

SEQ ID NO: 3031242 - RNA, 21 nt, Human
ucauaguaugguggcuggguu

SEQ ID NO: 3031243 - RNA, 10 nt, Human
ucagugccuu

SEQ ID NO: 3031244 - RNA, 9 nt, Human
ucagugccu

SEQ ID NO: 3031245 - RNA, 15 nt, Human
ucagugccuuaugga

SEQ ID NO: 3031246 - RNA, 14 nt, Human
ucagugccuuaugg

SEQ ID NO: 3031247 - RNA, 12 nt, Human
ucagugccuuau

SEQ ID NO: 3031248 - RNA, 11 nt, Human
ucagugccuua

SEQ ID NO: 3031249 - RNA, 19 nt, Human
accgaaaacguggcugcuu

SEQ ID NO: 3031250 - RNA, 17 nt, Human
accgaaaacguggcugc

SEQ ID NO: 3031251 - RNA, 12 nt, Human
ucagugccacua

SEQ ID NO: 3031252 - RNA, 16 nt, Human
ucagugccaaaaacaa

SEQ ID NO: 3031253 - RNA, 12 nt, Human
ucaguggcagcu

SEQ ID NO: 3031254 - RNA, 11 nt, Human
ucaguggcagc

SEQ ID NO: 3031255 - RNA, 16 nt, Human
ucagugccuuauggaa

SEQ ID NO: 3031256 - RNA, 16 nt, Human
accgcagacaggacca

SEQ ID NO: 3031257 - RNA, 12 nt, Human
accgcagacagg

SEQ ID NO: 3031258 - RNA, 20 nt, Human
accucccacaaaggagagcu

SEQ ID NO: 3031259 - RNA, 19 nt, Human
ucaaucuggauucauauuu

SEQ ID NO: 3031260 - RNA, 22 nt, Human
ucaaguccucuuuucugagagg

SEQ ID NO: 3031261 - RNA, 14 nt, Human
acauugacuauuuu

SEQ ID NO: 3031262 - RNA, 17 nt, Human
acauugacuauuuuugu

SEQ ID NO: 3031263 - RNA, 18 nt, Human
acauuuuauuuuauuaug

SEQ ID NO: 3031264 - RNA, 14 nt, Human
acauuuuauuuuau

SEQ ID NO: 3031265 - RNA, 19 nt, Human
acauuuuauuuuauuaugc

SEQ ID NO: 3031266 - RNA, 20 nt, Human
acauuuuauuuuauuaugca

SEQ ID NO: 3031267 - RNA, 17 nt, Human
acauuuuuuaaaugcac

SEQ ID NO: 3031268 - RNA, 14 nt, Human
acauuuuuuaaaug

SEQ ID NO: 3031269 - RNA, 16 nt, Human
acauuuuuuaaaugca

SEQ ID NO: 3031270 - RNA, 21 nt, Human
acauuuuuaagugcugcauuu

SEQ ID NO: 3031271 - RNA, 22 nt, Human
acauuuuuaagugcugcauuua

SEQ ID NO: 3031272 - RNA, 23 nt, Human
acauuuuuaagugcugcauuuaa

SEQ ID NO: 3031273 - RNA, 19 nt, Human
acauuuuuaagugcugcau

SEQ ID NO: 3031274 - RNA, 11 nt, Human
acauucccugc

SEQ ID NO: 3031275 - RNA, 15 nt, Human
acauguccaagaagc

SEQ ID NO: 3031276 - RNA, 23 nt, Human
acauguaauuaaguacuauguau

SEQ ID NO: 3031277 - RNA, 14 nt, Human
acauuccugaugcu

SEQ ID NO: 3031278 - RNA, 17 nt, Human
ucaacauuucucauguu

SEQ ID NO: 3031279 - RNA, 13 nt, Human
ucaaauuucuaaa

SEQ ID NO: 3031280 - RNA, 20 nt, Human
ucaacugcaucaagauguga

SEQ ID NO: 3031281 - RNA, 14 nt, Human
ucaaccagcagaug

SEQ ID NO: 3031282 - RNA, 19 nt, Human
acaugcuguacauacuuuu

SEQ ID NO: 3031283 - RNA, 21 nt, Human
acaugcuguacauacuuuuug

SEQ ID NO: 3031284 - RNA, 20 nt, Human
acaugcuguacauacuuuuu

SEQ ID NO: 3031285 - RNA, 15 nt, Human
acaugcuacacacug

SEQ ID NO: 3031286 - RNA, 21 nt, Human
acaugcuacacacugcauguu

SEQ ID NO: 3031287 - RNA, 15 nt, Human
acauguaauuaagua

SEQ ID NO: 3031288 - RNA, 17 nt, Human
acauguaauuaaguacu

SEQ ID NO: 3031289 - RNA, 19 nt, Human
acauguaauuaaguacuau

SEQ ID NO: 3031290 - RNA, 21 nt, Human
acauguaauuaaguacuaugu

SEQ ID NO: 3031291 - RNA, 22 nt, Human
acauguaauuaaguacuaugua

SEQ ID NO: 3031292 - RNA, 16 nt, Human
ucacacugucuucuga

SEQ ID NO: 3031293 - RNA, 20 nt, Human
ucacagaugggugcuuggag

SEQ ID NO: 3031294 - RNA, 13 nt, Human
ucacagccucuga

SEQ ID NO: 3031295 - RNA, 20 nt, Human
ucacaguucucuccuucuuc

SEQ ID NO: 3031296 - RNA, 16 nt, Human
ucacaguucucuccuu

SEQ ID NO: 3031297 - RNA, 12 nt, Human
ucaauugugaaa

SEQ ID NO: 3031298 - RNA, 17 nt, Human
ucacaaaggaugcccaa

SEQ ID NO: 3031299 - RNA, 17 nt, Human
accacaucuugcucugc

SEQ ID NO: 3031300 - RNA, 18 nt, Human
accacaucuugcucugcu

SEQ ID NO: 3031301 - RNA, 19 nt, Human
accacaucuugcucugcug

SEQ ID NO: 3031302 - RNA, 18 nt, Human
accacaugugcacaugca

SEQ ID NO: 3031303 - RNA, 16 nt, Human
accacaucuugcucug

SEQ ID NO: 3031304 - RNA, 15 nt, Human
accaccacacccagc

SEQ ID NO: 3031305 - RNA, 20 nt, Human
accaccacacccagcccacu

SEQ ID NO: 3031306 - RNA, 10 nt, Human
ucacuugagu

SEQ ID NO: 3031307 - RNA, 15 nt, Human
accaguguuguggau

SEQ ID NO: 3031308 - RNA, 17 nt, Human
accaguguuguggauuu

SEQ ID NO: 3031309 - RNA, 23 nt, Human
ucacuguugcccaggcuggcgug

SEQ ID NO: 3031310 - RNA, 19 nt, Human
ucacuguugcccaggcugg

SEQ ID NO: 3031311 - RNA, 15 nt, Human
ucacugcagccucaa

SEQ ID NO: 3031312 - RNA, 13 nt, Human
ucacugcagccuc

SEQ ID NO: 3031313 - RNA, 16 nt, Human
ucacugagacagcccg

SEQ ID NO: 3031314 - RNA, 14 nt, Human
ucacugcagccuca

SEQ ID NO: 3031315 - RNA, 22 nt, Human
ucacugagacagcccgggcucu

SEQ ID NO: 3031316 - RNA, 21 nt, Human
ucacugagacagcccgggcuc

SEQ ID NO: 3031317 - RNA, 17 nt, Human
ucacugagacagcccgg

SEQ ID NO: 3031318 - RNA, 22 nt, Human
accagcgugugacuacuccccc

SEQ ID NO: 3031319 - RNA, 17 nt, Human
accacuacauucuguua

SEQ ID NO: 3031320 - RNA, 16 nt, Human
accacuacauucuguu

SEQ ID NO: 3031321 - RNA, 15 nt, Human
accacuacauucugu

SEQ ID NO: 3031322 - RNA, 16 nt, Human
aaucuggauucauauu

SEQ ID NO: 3031323 - RNA, 17 nt, Human
aaucuggauucauauuu

SEQ ID NO: 3031324 - RNA, 18 nt, Human
aaucuggauucauauuua

SEQ ID NO: 3031325 - RNA, 19 nt, Human
aaucuggauucauauuuaa

SEQ ID NO: 3031326 - RNA, 23 nt, Human
aaucgcuccaccuugcagcucuc

SEQ ID NO: 3031327 - RNA, 15 nt, Human
aaucauuagguguga

SEQ ID NO: 3031328 - RNA, 17 nt, Human
aaucauuaggugugacu

SEQ ID NO: 3031329 - RNA, 23 nt, Human
aaucauuaggugugacugaauuu

SEQ ID NO: 3031330 - RNA, 12 nt, Human
uaauaaacucau

SEQ ID NO: 3031331 - RNA, 19 nt, Human
uaaguauucuuauuuaaug

SEQ ID NO: 3031332 - RNA, 20 nt, Human
uaaguauucuuauuuaauga

SEQ ID NO: 3031333 - RNA, 17 nt, Human
uaaguacuauguaucaa

SEQ ID NO: 3031334 - RNA, 13 nt, Human
uaaguacuaugua

SEQ ID NO: 3031335 - RNA, 16 nt, Human
uaaguacuauguauca

SEQ ID NO: 3031336 - RNA, 11 nt, Human
uaaucuuuuau

SEQ ID NO: 3031337 - RNA, 17 nt, Human
uaaugaaugaaacauuu

SEQ ID NO: 3031338 - RNA, 18 nt, Human
uaauagacaauuuauuau

SEQ ID NO: 3031339 - RNA, 22 nt, Human
uaauagacaauuuauuauggca

SEQ ID NO: 3031340 - RNA, 16 nt, Human
uaauacaccacuacau

SEQ ID NO: 3031341 - RNA, 14 nt, Human
uaauacaccacuac

SEQ ID NO: 3031342 - RNA, 18 nt, Human
uaauacaccacuacauuc

SEQ ID NO: 3031343 - RNA, 19 nt, Human
uaauacaccacuacauucu

SEQ ID NO: 3031344 - RNA, 14 nt, Human
uaauagacaauuua

SEQ ID NO: 3031345 - RNA, 16 nt, Human
uaauagacaauuuauu

SEQ ID NO: 3031346 - RNA, 17 nt, Human
uaaugucaguauuucaa

SEQ ID NO: 3031347 - RNA, 18 nt, Human
uaaugucacaggcagguc

SEQ ID NO: 3031348 - RNA, 13 nt, Human
uaauguacugcau

SEQ ID NO: 3031349 - RNA, 17 nt, Human
aaugaaacauuuuguca

SEQ ID NO: 3031350 - RNA, 17 nt, Human
aaugaaaccugugucuc

SEQ ID NO: 3031351 - RNA, 16 nt, Human
aaugaaagacuguaca

SEQ ID NO: 3031352 - RNA, 17 nt, Human
aaugaaagacuguacaa

SEQ ID NO: 3031353 - RNA, 15 nt, Human
aaugaccuuucaaua

SEQ ID NO: 3031354 - RNA, 22 nt, Human
aaugaaugucagugugacugau

SEQ ID NO: 3031355 - RNA, 13 nt, Human
aaugaaugucagu

SEQ ID NO: 3031356 - RNA, 13 nt, Human
aauauuuaaucuu

SEQ ID NO: 3031357 - RNA, 22 nt, Human
aauaugcacacauuuuuuaaau

SEQ ID NO: 3031358 - RNA, 16 nt, Human
aauaugcacacauuuu

SEQ ID NO: 3031359 - RNA, 17 nt, Human
aauaugcacacauuuuu

SEQ ID NO: 3031360 - RNA, 15 nt, Human
uaagagaaaugagcu

SEQ ID NO: 3031361 - RNA, 18 nt, Human
uaagcacacuugacauca

SEQ ID NO: 3031362 - RNA, 22 nt, Human
uaagcuguuacugucuucagua

SEQ ID NO: 3031363 - RNA, 13 nt, Human
uaacuucacauau

SEQ ID NO: 3031364 - RNA, 21 nt, Human
uaacuucacauauugauuucc

SEQ ID NO: 3031365 - RNA, 14 nt, Human
uaacuucaccauau

SEQ ID NO: 3031366 - RNA, 17 nt, Human
uaacuuccaauuuacau

SEQ ID NO: 3031367 - RNA, 16 nt, Human
uaacuuucugaaauaa

SEQ ID NO: 3031368 - RNA, 21 nt, Human
aauaguucagguaacaggcag

SEQ ID NO: 3031369 - RNA, 13 nt, Human
aauaguuggcuag

SEQ ID NO: 3031370 - RNA, 22 nt, Human
aauaguggugugauuuggggau

SEQ ID NO: 3031371 - RNA, 16 nt, Human
aauaguggugugauuu

SEQ ID NO: 3031372 - RNA, 16 nt, Human
uaacauggaaguacua

SEQ ID NO: 3031373 - RNA, 18 nt, Human
uaacauggacaugaucuu

SEQ ID NO: 3031374 - RNA, 23 nt, Human
uaacauggacaugaucuucuuua

SEQ ID NO: 3031375 - RNA, 21 nt, Human
aauuaaugucaguauuucaac

SEQ ID NO: 3031376 - RNA, 13 nt, Human
uacauucuguuaa

SEQ ID NO: 3031377 - RNA, 12 nt, Human
uacauucuguua

SEQ ID NO: 3031378 - RNA, 21 nt, Human
aauguucucucuucuccaccu

SEQ ID NO: 3031379 - RNA, 11 nt, Human
aauuaacuuuu

SEQ ID NO: 3031380 - RNA, 16 nt, Human
uacaggugugagucac

SEQ ID NO: 3031381 - RNA, 24 nt, Human
uacauaaugcgugcauaccacuuu

SEQ ID NO: 3031382 - RNA, 21 nt, Human
uacauaaugcgugcauaccac

SEQ ID NO: 3031383 - RNA, 23 nt, Human
uacauaaugcgugcauaccacuu

SEQ ID NO: 3031384 - RNA, 15 nt, Human
aaugugaaacuggau

SEQ ID NO: 3031385 - RNA, 14 nt, Human
aaugugaaacugga

SEQ ID NO: 3031386 - RNA, 19 nt, Human
aaugugaaaagaaaaauga

SEQ ID NO: 3031387 - RNA, 19 nt, Human
aauguauguguaaguauuc

SEQ ID NO: 3031388 - RNA, 20 nt, Human
aauguauguguaaguauucu

SEQ ID NO: 3031389 - RNA, 17 nt, Human
aaugugaaaagaaaaau

SEQ ID NO: 3031390 - RNA, 12 nt, Human
aauggcagccuu

SEQ ID NO: 3031391 - RNA, 16 nt, Human
aauggcagccuuggca

SEQ ID NO: 3031392 - RNA, 18 nt, Human
uacagaggccaugggccu

SEQ ID NO: 3031393 - RNA, 19 nt, Human
uacagacaaagcguggugg

SEQ ID NO: 3031394 - RNA, 22 nt, Human
uacagacaacaaaccuguuucu

SEQ ID NO: 3031395 - RNA, 19 nt, Human
uacacauuuuauuuuauua

SEQ ID NO: 3031396 - RNA, 21 nt, Human
uacacauuuuauuuuauuaug

SEQ ID NO: 3031397 - RNA, 22 nt, Human
uacacauuuuauuuuauuaugc

SEQ ID NO: 3031398 - RNA, 23 nt, Human
uacacauuuuauuuuauuaugca

SEQ ID NO: 3031399 - RNA, 15 nt, Human
uacacuaaaagguga

SEQ ID NO: 3031400 - RNA, 21 nt, Human
aaugcacuuuguucuggcucu

SEQ ID NO: 3031401 - RNA, 17 nt, Human
aaugaccuuucaauagg

SEQ ID NO: 3031402 - RNA, 16 nt, Human
aaugaccuuucaauag

SEQ ID NO: 3031403 - RNA, 18 nt, Human
aaugaccuuucaauagga

SEQ ID NO: 3031404 - RNA, 21 nt, Human
uacaaugcugugcccuaaagu

SEQ ID NO: 3031405 - RNA, 22 nt, Human
aaugcacuuuguucuggcucuu

SEQ ID NO: 3031406 - RNA, 21 nt, Human
aauggacguguuaugacucca

SEQ ID NO: 3031407 - RNA, 14 nt, Human
aauggaaccacucu

SEQ ID NO: 3031408 - RNA, 20 nt, Human
aauggacuaacuugucuuug

SEQ ID NO: 3031409 - RNA, 23 nt, Human
aauggacguguuaugacuccaga

SEQ ID NO: 3031410 - RNA, 21 nt, Human
aauggaaaugggcagagcaga

SEQ ID NO: 3031411 - RNA, 20 nt, Human
aauggaaaugggcagagcag

SEQ ID NO: 3031412 - RNA, 12 nt, Human
aaugcccagccc

SEQ ID NO: 3031413 - RNA, 11 nt, Human
aaugcccagcc

SEQ ID NO: 3031414 - RNA, 17 nt, Human
aauuauugauguuuuca

SEQ ID NO: 3031415 - RNA, 12 nt, Human
aauuccccagau

SEQ ID NO: 3031416 - RNA, 14 nt, Human
aauuccccacccug

SEQ ID NO: 3031417 - RNA, 23 nt, Human
uaccugccaggaagccagcaggc

SEQ ID NO: 3031418 - RNA, 20 nt, Human
uaccugccaggaagccagca

SEQ ID NO: 3031419 - RNA, 18 nt, Human
uaccugccaggaagccag

SEQ ID NO: 3031420 - RNA, 10 nt, Human
uaccuguccc

SEQ ID NO: 3031421 - RNA, 17 nt, Human
uaccugucccccugaca

SEQ ID NO: 3031422 - RNA, 16 nt, Human
uaccugucccccugac

SEQ ID NO: 3031423 - RNA, 14 nt, Human
uaccugucccccug

SEQ ID NO: 3031424 - RNA, 13 nt, Human
uaccugucccccu

SEQ ID NO: 3031425 - RNA, 11 nt, Human
aauuacaggaa

SEQ ID NO: 3031426 - RNA, 15 nt, Human
aauuagccaagugug

SEQ ID NO: 3031427 - RNA, 20 nt, Human
uacucugccacuuuauuucu

SEQ ID NO: 3031428 - RNA, 12 nt, Human
uacucuguguca

SEQ ID NO: 3031429 - RNA, 16 nt, Human
uacuggagaaaaugga

SEQ ID NO: 3031430 - RNA, 19 nt, Human
uacuguaauuugugauaca

SEQ ID NO: 3031431 - RNA, 20 nt, Human
uacuguaauuugugauacaa

SEQ ID NO: 3031432 - RNA, 18 nt, Human
uacuguaauuugugauac

SEQ ID NO: 3031433 - RNA, 18 nt, Human
uacuguacaugaaaacac

SEQ ID NO: 3031434 - RNA, 22 nt, Human
uacuguacaugaaaacacauuu

SEQ ID NO: 3031435 - RNA, 21 nt, Human
uacuguacaugaaaacacauu

SEQ ID NO: 3031436 - RNA, 13 nt, Human
uacuacuccugua

SEQ ID NO: 3031437 - RNA, 17 nt, Human
uacuacuccuguaggaa

SEQ ID NO: 3031438 - RNA, 23 nt, Human
uacuauggcccuggccuagcaua

SEQ ID NO: 3031439 - RNA, 12 nt, Human
uacuauguauca

SEQ ID NO: 3031440 - RNA, 13 nt, Human
uacuauguaucaa

SEQ ID NO: 3031441 - RNA, 14 nt, Human
uacuauguaucaau

SEQ ID NO: 3031442 - RNA, 22 nt, Human
uacucuccuggaaauauuaaga

SEQ ID NO: 3031443 - RNA, 23 nt, Human
uacucuccuggaaauauuaagaa

SEQ ID NO: 3031444 - RNA, 18 nt, Human
uacgggaggguaaggcug

SEQ ID NO: 3031445 - RNA, 12 nt, Human
uacguacacauu

SEQ ID NO: 3031446 - RNA, 13 nt, Human
uacguacacauuu

SEQ ID NO: 3031447 - RNA, 15 nt, Human
uacguugugcauuug

SEQ ID NO: 3031448 - RNA, 16 nt, Human
uacguugugcauuugg

SEQ ID NO: 3031449 - RNA, 22 nt, Human
uacgccaggggaaaaucagccu

SEQ ID NO: 3031450 - RNA, 23 nt, Human
uauguuuuuguucaguuuaucug

SEQ ID NO: 3031451 - RNA, 22 nt, Human
acaggcauguucucugaggaca

SEQ ID NO: 3031452 - RNA, 15 nt, Human
acaggcauguucucu

SEQ ID NO: 3031453 - RNA, 18 nt, Human
acaggcauguucucugag

SEQ ID NO: 3031454 - RNA, 19 nt, Human
acaggcauguucucugagg

SEQ ID NO: 3031455 - RNA, 20 nt, Human
acaggcauguucucugagga

SEQ ID NO: 3031456 - RNA, 20 nt, Human
uauguggaguucaucuugaa

SEQ ID NO: 3031457 - RNA, 13 nt, Human
acaggaaguacug

SEQ ID NO: 3031458 - RNA, 15 nt, Human
acaggaaaagcugcu

SEQ ID NO: 3031459 - RNA, 16 nt, Human
acaggaaaagcugcug

SEQ ID NO: 3031460 - RNA, 17 nt, Human
acaggaaaagcugcuga

SEQ ID NO: 3031461 - RNA, 13 nt, Human
acagcuaacaugg

SEQ ID NO: 3031462 - RNA, 14 nt, Human
acaggcauguucuc

SEQ ID NO: 3031463 - RNA, 14 nt, Human
acaggcagguccag

SEQ ID NO: 3031464 - RNA, 16 nt, Human
acaggcagguccaggg

SEQ ID NO: 3031465 - RNA, 16 nt, Human
acaggagugagcacua

SEQ ID NO: 3031466 - RNA, 14 nt, Human
acaggaucagucug

SEQ ID NO: 3031467 - RNA, 13 nt, Human
acaggcaggucca

SEQ ID NO: 3031468 - RNA, 23 nt, Human
acaggaccagggauuuccaugau

SEQ ID NO: 3031469 - RNA, 18 nt, Human
uauucaguggcuaacuug

SEQ ID NO: 3031470 - RNA, 20 nt, Human
uauucaguaauaacucuacc

SEQ ID NO: 3031471 - RNA, 14 nt, Human
uauucaggaagcuc

SEQ ID NO: 3031472 - RNA, 13 nt, Human
uauuacuucugcu

SEQ ID NO: 3031473 - RNA, 14 nt, Human
uauuacuucugcua

SEQ ID NO: 3031474 - RNA, 14 nt, Human
acaggcuuagugau

SEQ ID NO: 3031475 - RNA, 23 nt, Human
acaggcugggcuucaguggcagc

SEQ ID NO: 3031476 - RNA, 22 nt, Human
acaggcugggcuucaguggcag

SEQ ID NO: 3031477 - RNA, 20 nt, Human
acaggcuuagugauguaauu

SEQ ID NO: 3031478 - RNA, 19 nt, Human
acaggcuuagugauguaau

SEQ ID NO: 3031479 - RNA, 12 nt, Human
acagggcacacc

SEQ ID NO: 3031480 - RNA, 12 nt, Human
acagauugaauu

SEQ ID NO: 3031481 - RNA, 18 nt, Human
acagauugaauuugccua

SEQ ID NO: 3031482 - RNA, 17 nt, Human
acagcaaggagauuuac

SEQ ID NO: 3031483 - RNA, 14 nt, Human
acagagcccacgcc

SEQ ID NO: 3031484 - RNA, 15 nt, Human
acagagcccacgccc

SEQ ID NO: 3031485 - RNA, 19 nt, Human
acagagcccacgcccccac

SEQ ID NO: 3031486 - RNA, 18 nt, Human
acagagcccacgccccca

SEQ ID NO: 3031487 - RNA, 16 nt, Human
acagcaaggagauuua

SEQ ID NO: 3031488 - RNA, 21 nt, Human
acagcaaggagauuuacaacu

SEQ ID NO: 3031489 - RNA, 17 nt, Human
acagcccgggcucugcc

SEQ ID NO: 3031490 - RNA, 19 nt, Human
acagcccgggcucugccuc

SEQ ID NO: 3031491 - RNA, 18 nt, Human
acagcccgggcucugccu

SEQ ID NO: 3031492 - RNA, 11 nt, Human
uaugcauuuga

SEQ ID NO: 3031493 - RNA, 23 nt, Human
uaugcauuugaaaauuuugaugu

SEQ ID NO: 3031494 - RNA, 24 nt, Human
uaugcauuugaaaauuuugauguu

SEQ ID NO: 3031495 - RNA, 17 nt, Human
uaugccugggcagaagg

SEQ ID NO: 3031496 - RNA, 15 nt, Human
uaugcuuauacacuu

SEQ ID NO: 3031497 - RNA, 18 nt, Human
uauggcuuuugugcauua

SEQ ID NO: 3031498 - RNA, 21 nt, Human
uauggcuuuugugcauuaucu

SEQ ID NO: 3031499 - RNA, 17 nt, Human
uauggcuuuugugcauu

SEQ ID NO: 3031500 - RNA, 19 nt, Human
uauccuaauaaaaagguga

SEQ ID NO: 3031501 - RNA, 15 nt, Human
uauccuaauaaaaag

SEQ ID NO: 3031502 - RNA, 18 nt, Human
uauccuaauaaaaaggug

SEQ ID NO: 3031503 - RNA, 12 nt, Human
uauccuaauaaa

SEQ ID NO: 3031504 - RNA, 18 nt, Human
uaucccuuggacauuuua

SEQ ID NO: 3031505 - RNA, 19 nt, Human
uaucccuuggacauuuuau

SEQ ID NO: 3031506 - RNA, 17 nt, Human
uaucccuuggacauuuu

SEQ ID NO: 3031507 - RNA, 11 nt, Human
acagagaaagu

SEQ ID NO: 3031508 - RNA, 18 nt, Human
acagagaaaguacuucuc

SEQ ID NO: 3031509 - RNA, 13 nt, Human
uaucucccccagc

SEQ ID NO: 3031510 - RNA, 14 nt, Human
uaucucccccagcc

SEQ ID NO: 3031511 - RNA, 15 nt, Human
acagacccugcccug

SEQ ID NO: 3031512 - RNA, 14 nt, Human
acagacccugcccu

SEQ ID NO: 3031513 - RNA, 13 nt, Human
acagacccugccc

SEQ ID NO: 3031514 - RNA, 17 nt, Human
acagaaauguacagcaa

SEQ ID NO: 3031515 - RNA, 14 nt, Human
acagaaauguacag

SEQ ID NO: 3031516 - RNA, 16 nt, Human
acagaaauguacagca

SEQ ID NO: 3031517 - RNA, 17 nt, Human
acagaaaauucuucucc

SEQ ID NO: 3031518 - RNA, 13 nt, Human
acagaaauguaca

SEQ ID NO: 3031519 - RNA, 20 nt, Human
acagaaaauggaagacagcu

SEQ ID NO: 3031520 - RNA, 17 nt, Human
uauaacuuuuuauauuc

SEQ ID NO: 3031521 - RNA, 12 nt, Human
uauaacuuuuua

SEQ ID NO: 3031522 - RNA, 20 nt, Human
uauaacuuuuuauauucuca

SEQ ID NO: 3031523 - RNA, 20 nt, Human
acacucacauuuauucugcu

SEQ ID NO: 3031524 - RNA, 15 nt, Human
acacucaaaagcugg

SEQ ID NO: 3031525 - RNA, 21 nt, Human
acaccucugcacaagcugcac

SEQ ID NO: 3031526 - RNA, 19 nt, Human
acaccucugcacaagcugc

SEQ ID NO: 3031527 - RNA, 16 nt, Human
acaccgggcacucaga

SEQ ID NO: 3031528 - RNA, 19 nt, Human
acacccugugauggggccc

SEQ ID NO: 3031529 - RNA, 20 nt, Human
acacuaaccacgcuggaccu

SEQ ID NO: 3031530 - RNA, 18 nt, Human
uaguucagguaacaggca

SEQ ID NO: 3031531 - RNA, 20 nt, Human
uaguuccaccaucaagccac

SEQ ID NO: 3031532 - RNA, 21 nt, Human
acacaugagcaucaggccagg

SEQ ID NO: 3031533 - RNA, 13 nt, Human
acacauuuuauuu

SEQ ID NO: 3031534 - RNA, 14 nt, Human
acacauuuuauuuu

SEQ ID NO: 3031535 - RNA, 19 nt, Human
acacauuuuauuuuauuau

SEQ ID NO: 3031536 - RNA, 20 nt, Human
acacauuuuauuuuauuaug

SEQ ID NO: 3031537 - RNA, 17 nt, Human
acaaugugaaaagaaaa

SEQ ID NO: 3031538 - RNA, 19 nt, Human
acaaugugaaaagaaaaau

SEQ ID NO: 3031539 - RNA, 14 nt, Human
acacacacauacac

SEQ ID NO: 3031540 - RNA, 21 nt, Human
acaaugcugugcccuaaagug

SEQ ID NO: 3031541 - RNA, 22 nt, Human
acaaugcugugcccuaaagugu

SEQ ID NO: 3031542 - RNA, 23 nt, Human
acaaugcugugcccuaaagugua

SEQ ID NO: 3031543 - RNA, 24 nt, Human
acaaugcugugcccuaaaguguau

SEQ ID NO: 3031544 - RNA, 22 nt, Human
acacacacgcgugcacacacca

SEQ ID NO: 3031545 - RNA, 17 nt, Human
acacacagcucuguccu

SEQ ID NO: 3031546 - RNA, 13 nt, Human
acacacagcucug

SEQ ID NO: 3031547 - RNA, 14 nt, Human
acacacagcucugu

SEQ ID NO: 3031548 - RNA, 14 nt, Human
acacaccagagccc

SEQ ID NO: 3031549 - RNA, 15 nt, Human
acacaccagagccca

SEQ ID NO: 3031550 - RNA, 20 nt, Human
acacaccagagcccaccuug

SEQ ID NO: 3031551 - RNA, 21 nt, Human
acacacgcgugcacacaccag

SEQ ID NO: 3031552 - RNA, 21 nt, Human
acacacugcauguuugugauu

SEQ ID NO: 3031553 - RNA, 13 nt, Human
acacagugagucg

SEQ ID NO: 3031554 - RNA, 19 nt, Human
acacaguauuacuucugcu

SEQ ID NO: 3031555 - RNA, 18 nt, Human
acacaguauuacuucugc

SEQ ID NO: 3031556 - RNA, 16 nt, Human
acacaguauuacuucu

SEQ ID NO: 3031557 - RNA, 12 nt, Human
uaggagcaugag

SEQ ID NO: 3031558 - RNA, 20 nt, Human
uaggagaagucuucuauuua

SEQ ID NO: 3031559 - RNA, 14 nt, Human
uaggcauuguggga

SEQ ID NO: 3031560 - RNA, 20 nt, Human
uaggcauuugcugaauacag

SEQ ID NO: 3031561 - RNA, 16 nt, Human
uaggcauuugcugaau

SEQ ID NO: 3031562 - RNA, 21 nt, Human
uagggaaggauacaaaagcau

SEQ ID NO: 3031563 - RNA, 12 nt, Human
acaaugacuuac

SEQ ID NO: 3031564 - RNA, 17 nt, Human
acaaugacuuacuguac

SEQ ID NO: 3031565 - RNA, 18 nt, Human
acaaugacuuacuguaca

SEQ ID NO: 3031566 - RNA, 18 nt, Human
acaagaccacguuucuaa

SEQ ID NO: 3031567 - RNA, 18 nt, Human
uagcauguccuaaugcuu

SEQ ID NO: 3031568 - RNA, 16 nt, Human
uagcauuuugcuaaau

SEQ ID NO: 3031569 - RNA, 14 nt, Human
uagccaaggccaaa

SEQ ID NO: 3031570 - RNA, 22 nt, Human
uagcauuuugcuaaaugugaau

SEQ ID NO: 3031571 - RNA, 21 nt, Human
uagccaaggccaaaggaagca

SEQ ID NO: 3031572 - RNA, 19 nt, Human
uagcauggcugccaauggg

SEQ ID NO: 3031573 - RNA, 19 nt, Human
acaagaccacguuucuaaa

SEQ ID NO: 3031574 - RNA, 19 nt, Human
acaagacccuugugguccc

SEQ ID NO: 3031575 - RNA, 21 nt, Human
acaacacucauugaccugagg

SEQ ID NO: 3031576 - RNA, 23 nt, Human
acaacacucauugaccugaggcc

SEQ ID NO: 3031577 - RNA, 15 nt, Human
uagccagaggagaga

SEQ ID NO: 3031578 - RNA, 11 nt, Human
uagccagagga

SEQ ID NO: 3031579 - RNA, 19 nt, Human
uagaugacauugacuauuu

SEQ ID NO: 3031580 - RNA, 20 nt, Human
uagaugaaugucaguuguua

SEQ ID NO: 3031581 - RNA, 18 nt, Human
uagaugacauugacuauu

SEQ ID NO: 3031582 - RNA, 19 nt, Human
uagauauaugcucugcaug

SEQ ID NO: 3031583 - RNA, 15 nt, Human
uagauauaugcucug

SEQ ID NO: 3031584 - RNA, 24 nt, Human
acaaaggauacuuauuuaaauaga

SEQ ID NO: 3031585 - RNA, 22 nt, Human
acaaaggaugcccaaagaugca

SEQ ID NO: 3031586 - RNA, 17 nt, Human
acaaaggggcuuaauua

SEQ ID NO: 3031587 - RNA, 11 nt, Human
acaaaagcaug

SEQ ID NO: 3031588 - RNA, 22 nt, Human
acaaaagcaugugagacugguu

SEQ ID NO: 3031589 - RNA, 14 nt, Human
aacuucagaguucu

SEQ ID NO: 3031590 - RNA, 14 nt, Human
aacuucacauauug

SEQ ID NO: 3031591 - RNA, 13 nt, Human
aacuucacauauu

SEQ ID NO: 3031592 - RNA, 22 nt, Human
aacuucacauauugauuuccgu

SEQ ID NO: 3031593 - RNA, 22 nt, Human
aacuucaccauauuaccacaga

SEQ ID NO: 3031594 - RNA, 17 nt, Human
gugcacaucuguuuugu

SEQ ID NO: 3031595 - RNA, 21 nt, Human
gugcacaugcacgugugugca

SEQ ID NO: 3031596 - RNA, 21 nt, Human
gugcacaagcuccaagcuccc

SEQ ID NO: 3031597 - RNA, 16 nt, Human
gugcacaagcuccaag

SEQ ID NO: 3031598 - RNA, 13 nt, Human
gugcacaagcucc

SEQ ID NO: 3031599 - RNA, 18 nt, Human
gugcaaugaccuuucaau

SEQ ID NO: 3031600 - RNA, 23 nt, Human
gugccaaaaacaacaacaaaaug

SEQ ID NO: 3031601 - RNA, 21 nt, Human
gugcauuuggugguuucagaa

SEQ ID NO: 3031602 - RNA, 17 nt, Human
gugcauuugaggucugu

SEQ ID NO: 3031603 - RNA, 19 nt, Human
gugcauuugaggucuguuc

SEQ ID NO: 3031604 - RNA, 23 nt, Human
gugauccucccaccucagccucc

SEQ ID NO: 3031605 - RNA, 18 nt, Human
aagaaaaaugagccuggc

SEQ ID NO: 3031606 - RNA, 17 nt, Human
aagaaaaaugagccugg

SEQ ID NO: 3031607 - RNA, 19 nt, Human
aagaaaaaauauuuucccu

SEQ ID NO: 3031608 - RNA, 18 nt, Human
aagaaaaagaaaaagaaa

SEQ ID NO: 3031609 - RNA, 13 nt, Human
aagaaaaagaaaa

SEQ ID NO: 3031610 - RNA, 21 nt, Human
aacuuuaccuuuuuuauacau

SEQ ID NO: 3031611 - RNA, 22 nt, Human
aacuuuaccuuuuuuauacaua

SEQ ID NO: 3031612 - RNA, 23 nt, Human
aacuuuaccuuuuuuauacauaa

SEQ ID NO: 3031613 - RNA, 15 nt, Human
aagaaaauaguggug

SEQ ID NO: 3031614 - RNA, 16 nt, Human
aagaaaauaccaagga

SEQ ID NO: 3031615 - RNA, 21 nt, Human
aagaaaauaguggugugauuu

SEQ ID NO: 3031616 - RNA, 22 nt, Human
aagaaaauaguggugugauuug

SEQ ID NO: 3031617 - RNA, 16 nt, Human
gugcucugaucaucca

SEQ ID NO: 3031618 - RNA, 13 nt, Human
gugcucuggacag

SEQ ID NO: 3031619 - RNA, 14 nt, Human
gugcucuggacagg

SEQ ID NO: 3031620 - RNA, 15 nt, Human
gugcugcccugccca

SEQ ID NO: 3031621 - RNA, 14 nt, Human
gugcugcccugccc

SEQ ID NO: 3031622 - RNA, 13 nt, Human
gugcugcccugcc

SEQ ID NO: 3031623 - RNA, 12 nt, Human
gugcugcccugc

SEQ ID NO: 3031624 - RNA, 18 nt, Human
gugcuaucucccccagcc

SEQ ID NO: 3031625 - RNA, 15 nt, Human
gugcuaucuccccca

SEQ ID NO: 3031626 - RNA, 15 nt, Human
aacuaaaauguucua

SEQ ID NO: 3031627 - RNA, 17 nt, Human
aacuagggaagauaaua

SEQ ID NO: 3031628 - RNA, 13 nt, Human
aacguggcugcuu

SEQ ID NO: 3031629 - RNA, 12 nt, Human
aacguggcugcu

SEQ ID NO: 3031630 - RNA, 13 nt, Human
aacgucugugcca

SEQ ID NO: 3031631 - RNA, 14 nt, Human
gucucaaaaaaaca

SEQ ID NO: 3031632 - RNA, 17 nt, Human
gucucaaaaaaagaaaa

SEQ ID NO: 3031633 - RNA, 23 nt, Human
gucucuuuaaugucacaggcagg

SEQ ID NO: 3031634 - RNA, 20 nt, Human
gucugacaggcaaugcuggc

SEQ ID NO: 3031635 - RNA, 15 nt, Human
gucugacaggcaaug

SEQ ID NO: 3031636 - RNA, 18 nt, Human
gucugacaggcaaugcug

SEQ ID NO: 3031637 - RNA, 12 nt, Human
gucugacaggca

SEQ ID NO: 3031638 - RNA, 13 nt, Human
gucugacaggcaa

SEQ ID NO: 3031639 - RNA, 14 nt, Human
gucugacaggcaau

SEQ ID NO: 3031640 - RNA, 15 nt, Human
gucuggaaugcagug

SEQ ID NO: 3031641 - RNA, 16 nt, Human
gucuggaaugcagugg

SEQ ID NO: 3031642 - RNA, 23 nt, Human
gugacagaggcagccccauucug

SEQ ID NO: 3031643 - RNA, 20 nt, Human
gugacagagugagacucugu

SEQ ID NO: 3031644 - RNA, 22 nt, Human
gugacagagugagacucugucu

SEQ ID NO: 3031645 - RNA, 23 nt, Human
gugaauaauacaguaucucaggg

SEQ ID NO: 3031646 - RNA, 22 nt, Human
gugagacccugucucaaaaaaa

SEQ ID NO: 3031647 - RNA, 14 nt, Human
gugagacucugucu

SEQ ID NO: 3031648 - RNA, 16 nt, Human
gugagacucugucuca

SEQ ID NO: 3031649 - RNA, 19 nt, Human
gugacaugucuuuucuugc

SEQ ID NO: 3031650 - RNA, 16 nt, Human
aacugcauuggcuuug

SEQ ID NO: 3031651 - RNA, 23 nt, Human
aacugauuuuuuuuuccuucagu

SEQ ID NO: 3031652 - RNA, 22 nt, Human
aacugauuuuuuuuuccuucag

SEQ ID NO: 3031653 - RNA, 21 nt, Human
aacugauuuuuuuuuccuuca

SEQ ID NO: 3031654 - RNA, 20 nt, Human
aacugauuuuuuuuuccuuc

SEQ ID NO: 3031655 - RNA, 23 nt, Human
aacucuccucugcugcuggcugg

SEQ ID NO: 3031656 - RNA, 22 nt, Human
aacucuccucugcugcuggcug

SEQ ID NO: 3031657 - RNA, 18 nt, Human
gugaggcucugcccuugg

SEQ ID NO: 3031658 - RNA, 17 nt, Human
gugagucaccaagccca

SEQ ID NO: 3031659 - RNA, 23 nt, Human
gugaguacuacaguccucccauc

SEQ ID NO: 3031660 - RNA, 19 nt, Human
gugagucaccaagcccagu

SEQ ID NO: 3031661 - RNA, 17 nt, Human
aacucuccucugcugcu

SEQ ID NO: 3031662 - RNA, 21 nt, Human
gugaguacuacaguccuccca

SEQ ID NO: 3031663 - RNA, 21 nt, Human
aacucuccucugcugcuggcu

SEQ ID NO: 3031664 - RNA, 19 nt, Human
aacucuccucugcugcugg

SEQ ID NO: 3031665 - RNA, 18 nt, Human
gugagacucugucucaaa

SEQ ID NO: 3031666 - RNA, 13 nt, Human
gugaggcucugcc

SEQ ID NO: 3031667 - RNA, 12 nt, Human
gugaggcucugc

SEQ ID NO: 3031668 - RNA, 17 nt, Human
gugaggcucugcccuug

SEQ ID NO: 3031669 - RNA, 16 nt, Human
gugaggcucugcccuu

SEQ ID NO: 3031670 - RNA, 15 nt, Human
gugaggcucugcccu

SEQ ID NO: 3031671 - RNA, 14 nt, Human
gugaggcucugccc

SEQ ID NO: 3031672 - RNA, 20 nt, Human
aacacaaagcuuuugcauau

SEQ ID NO: 3031673 - RNA, 19 nt, Human
aacacaaagcuuuugcaua

SEQ ID NO: 3031674 - RNA, 18 nt, Human
aacacaaagcuuuugcau

SEQ ID NO: 3031675 - RNA, 12 nt, Human
aacacaaagcuu

SEQ ID NO: 3031676 - RNA, 19 nt, Human
aacacaaacgggcucagca

SEQ ID NO: 3031677 - RNA, 19 nt, Human
aaauuucuaaaucuccaaa

SEQ ID NO: 3031678 - RNA, 16 nt, Human
aacacugguuuuaaau

SEQ ID NO: 3031679 - RNA, 16 nt, Human
aacacuguucucugcc

SEQ ID NO: 3031680 - RNA, 18 nt, Human
aacacuguucucugcccu

SEQ ID NO: 3031681 - RNA, 17 nt, Human
aacacuguucucugccc

SEQ ID NO: 3031682 - RNA, 17 nt, Human
gucauuugagcagggcu

SEQ ID NO: 3031683 - RNA, 19 nt, Human
aacacuguucucugcccuc

SEQ ID NO: 3031684 - RNA, 21 nt, Human
aacacucacauuuauucugcu

SEQ ID NO: 3031685 - RNA, 18 nt, Human
guccccuguuuguuucug

SEQ ID NO: 3031686 - RNA, 22 nt, Human
guccccuguuuguuucugaaag

SEQ ID NO: 3031687 - RNA, 19 nt, Human
gucccuuacgugaguccug

SEQ ID NO: 3031688 - RNA, 18 nt, Human
gucccuuacgugaguccu

SEQ ID NO: 3031689 - RNA, 18 nt, Human
gucccugguggcagcuca

SEQ ID NO: 3031690 - RNA, 19 nt, Human
gucccugguggcagcucac

SEQ ID NO: 3031691 - RNA, 15 nt, Human
gucccaccccacaca

SEQ ID NO: 3031692 - RNA, 22 nt, Human
guccccaccgcagacaggacca

SEQ ID NO: 3031693 - RNA, 18 nt, Human
guccccaccgcagacagg

SEQ ID NO: 3031694 - RNA, 19 nt, Human
gucauuugagcagggcuca

SEQ ID NO: 3031695 - RNA, 15 nt, Human
aacauagcugugauu

SEQ ID NO: 3031696 - RNA, 18 nt, Human
aacaguccauugaaaggg

SEQ ID NO: 3031697 - RNA, 23 nt, Human
aacauguaauuaaguacuaugua

SEQ ID NO: 3031698 - RNA, 14 nt, Human
guccucuuuucuga

SEQ ID NO: 3031699 - RNA, 16 nt, Human
guccuggcaugggaau

SEQ ID NO: 3031700 - RNA, 17 nt, Human
guccugcugcaguugcc

SEQ ID NO: 3031701 - RNA, 19 nt, Human
guccugcugcaguugccag

SEQ ID NO: 3031702 - RNA, 12 nt, Human
gucgaggcagga

SEQ ID NO: 3031703 - RNA, 16 nt, Human
gucgaggacagggagg

SEQ ID NO: 3031704 - RNA, 15 nt, Human
gucuaugggacucaa

SEQ ID NO: 3031705 - RNA, 22 nt, Human
gucuaugggacucaaugcacug

SEQ ID NO: 3031706 - RNA, 16 nt, Human
gucuaccugaggggcc

SEQ ID NO: 3031707 - RNA, 15 nt, Human
gucuaccugaggggc

SEQ ID NO: 3031708 - RNA, 13 nt, Human
gucuaccugaggg

SEQ ID NO: 3031709 - RNA, 14 nt, Human
gucuaccugagggg

SEQ ID NO: 3031710 - RNA, 18 nt, Human
guauucucuccuguaccu

SEQ ID NO: 3031711 - RNA, 24 nt, Human
aaaugucuaguuguaacaccauga

SEQ ID NO: 3031712 - RNA, 21 nt, Human
aaaugucucuuuaaugucaca

SEQ ID NO: 3031713 - RNA, 21 nt, Human
gucagaaguuucugccgcagc

SEQ ID NO: 3031714 - RNA, 15 nt, Human
gucacugcuuaacuu

SEQ ID NO: 3031715 - RNA, 21 nt, Human
gucacugcuuaacuucacaua

SEQ ID NO: 3031716 - RNA, 16 nt, Human
gucagguggggcagcu

SEQ ID NO: 3031717 - RNA, 17 nt, Human
gucagguggggcagcuu

SEQ ID NO: 3031718 - RNA, 18 nt, Human
gucagguggggcagcuug

SEQ ID NO: 3031719 - RNA, 22 nt, Human
gucagguggggcagcuugaggg

SEQ ID NO: 3031720 - RNA, 12 nt, Human
aaauuucuaaau

SEQ ID NO: 3031721 - RNA, 13 nt, Human
aaauuucuaaauc

SEQ ID NO: 3031722 - RNA, 15 nt, Human
aaauuucuaaaucuc

SEQ ID NO: 3031723 - RNA, 22 nt, Human
gucaccaaaucagcugcuacua

SEQ ID NO: 3031724 - RNA, 12 nt, Human
gucacaggcagg

SEQ ID NO: 3031725 - RNA, 22 nt, Human
gucaauuacaggaaguacugga

SEQ ID NO: 3031726 - RNA, 12 nt, Human
gucaccaagccc

SEQ ID NO: 3031727 - RNA, 15 nt, Human
gucaccaagcccagu

SEQ ID NO: 3031728 - RNA, 23 nt, Human
gucacucuggcagcucagagagg

SEQ ID NO: 3031729 - RNA, 16 nt, Human
gucacugagacagccc

SEQ ID NO: 3031730 - RNA, 15 nt, Human
gucacugagacagcc

SEQ ID NO: 3031731 - RNA, 14 nt, Human
gucacugagacagc

SEQ ID NO: 3031732 - RNA, 22 nt, Human
gucacucuggcagcucagagag

SEQ ID NO: 3031733 - RNA, 10 nt, Human
gucacugcuu

SEQ ID NO: 3031734 - RNA, 23 nt, Human
gucacugagacagcccgggcucu

SEQ ID NO: 3031735 - RNA, 21 nt, Human
gucacugagacagcccgggcu

SEQ ID NO: 3031736 - RNA, 18 nt, Human
gucacugagacagcccgg

SEQ ID NO: 3031737 - RNA, 17 nt, Human
gucacugagacagcccg

SEQ ID NO: 3031738 - RNA, 19 nt, Human
aagcuuuugcauauugcau

SEQ ID NO: 3031739 - RNA, 15 nt, Human
aagcuuuugcauauu

SEQ ID NO: 3031740 - RNA, 22 nt, Human
aagcuuuugcauauugcauacu

SEQ ID NO: 3031741 - RNA, 13 nt, Human
aagcuuuugcaua

SEQ ID NO: 3031742 - RNA, 22 nt, Human
guucccuuuuuuggcugcugaa

SEQ ID NO: 3031743 - RNA, 21 nt, Human
guucccuuuuuuggcugcuga

SEQ ID NO: 3031744 - RNA, 17 nt, Human
aagcucugcuccucucc

SEQ ID NO: 3031745 - RNA, 19 nt, Human
guugauagcacagacccug

SEQ ID NO: 3031746 - RNA, 14 nt, Human
guugauagcacaga

SEQ ID NO: 3031747 - RNA, 15 nt, Human
guucuugguuuguaa

SEQ ID NO: 3031748 - RNA, 18 nt, Human
guucuugguuuguaaauu

SEQ ID NO: 3031749 - RNA, 14 nt, Human
guucuugguuugua

SEQ ID NO: 3031750 - RNA, 12 nt, Human
guucucugagga

SEQ ID NO: 3031751 - RNA, 15 nt, Human
guucucucuucucca

SEQ ID NO: 3031752 - RNA, 15 nt, Human
guucucugcccucca

SEQ ID NO: 3031753 - RNA, 13 nt, Human
guucucugcccuc

SEQ ID NO: 3031754 - RNA, 13 nt, Human
guucucuccuucu

SEQ ID NO: 3031755 - RNA, 19 nt, Human
guucuagcauggcugccaa

SEQ ID NO: 3031756 - RNA, 14 nt, Human
guucuuaauucuua

SEQ ID NO: 3031757 - RNA, 17 nt, Human
guucuuaauucuuagcu

SEQ ID NO: 3031758 - RNA, 18 nt, Human
guucucugcccuccaaga

SEQ ID NO: 3031759 - RNA, 17 nt, Human
guucucugcccuccaag

SEQ ID NO: 3031760 - RNA, 13 nt, Human
guucuuaauucuu

SEQ ID NO: 3031761 - RNA, 15 nt, Human
guuauuuuacuuuuu

SEQ ID NO: 3031762 - RNA, 16 nt, Human
guuauuuuacuuuuug

SEQ ID NO: 3031763 - RNA, 19 nt, Human
guuagagguucccuuugac

SEQ ID NO: 3031764 - RNA, 23 nt, Human
guucagcuuguaaauagcucagg

SEQ ID NO: 3031765 - RNA, 20 nt, Human
guucaggguuggccccugcc

SEQ ID NO: 3031766 - RNA, 21 nt, Human
guucaggguuggccccugccc

SEQ ID NO: 3031767 - RNA, 22 nt, Human
guucaggguuggccccugcccg

SEQ ID NO: 3031768 - RNA, 21 nt, Human
aagccgugauuuucauugcug

SEQ ID NO: 3031769 - RNA, 17 nt, Human
guucagguaacaggcag

SEQ ID NO: 3031770 - RNA, 18 nt, Human
guucagguaacaggcaga

SEQ ID NO: 3031771 - RNA, 16 nt, Human
aagccucccacgacug

SEQ ID NO: 3031772 - RNA, 15 nt, Human
aagccuccuccagcc

SEQ ID NO: 3031773 - RNA, 22 nt, Human
aagcuaggccuggccagaugca

SEQ ID NO: 3031774 - RNA, 17 nt, Human
aagagggugggugggua

SEQ ID NO: 3031775 - RNA, 22 nt, Human
aagagggucugaggaauccaga

SEQ ID NO: 3031776 - RNA, 14 nt, Human
aagaggcagggucu

SEQ ID NO: 3031777 - RNA, 11 nt, Human
aagaggcaggg

SEQ ID NO: 3031778 - RNA, 22 nt, Human
aagagggagggagggcuccaga

SEQ ID NO: 3031779 - RNA, 21 nt, Human
aagagggagggagggcuccag

SEQ ID NO: 3031780 - RNA, 15 nt, Human
gugguuucagaaaug

SEQ ID NO: 3031781 - RNA, 23 nt, Human
gugcugcccugcccaccuggccu

SEQ ID NO: 3031782 - RNA, 23 nt, Human
aagaucaaaagguuaauaaagua

SEQ ID NO: 3031783 - RNA, 20 nt, Human
aagaucaaaagguuaauaaa

SEQ ID NO: 3031784 - RNA, 22 nt, Human
gugucaccugaagacucauucu

SEQ ID NO: 3031785 - RNA, 14 nt, Human
gugucagguggggc

SEQ ID NO: 3031786 - RNA, 18 nt, Human
gugucagguggggcagcu

SEQ ID NO: 3031787 - RNA, 14 nt, Human
gugucaccugaaga

SEQ ID NO: 3031788 - RNA, 23 nt, Human
gugugaaccaccacacccagccc

SEQ ID NO: 3031789 - RNA, 19 nt, Human
gugucagguggggcagcuu

SEQ ID NO: 3031790 - RNA, 14 nt, Human
aagcacaugccucu

SEQ ID NO: 3031791 - RNA, 20 nt, Human
aagcacaugccucucucagg

SEQ ID NO: 3031792 - RNA, 19 nt, Human
aagcacaugccucucucag

SEQ ID NO: 3031793 - RNA, 16 nt, Human
aagcacaugccucucu

SEQ ID NO: 3031794 - RNA, 15 nt, Human
aagcacaugccucuc

SEQ ID NO: 3031795 - RNA, 16 nt, Human
aagcacacuugacauc

SEQ ID NO: 3031796 - RNA, 21 nt, Human
aagcacaugccucucucaggc

SEQ ID NO: 3031797 - RNA, 13 nt, Human
aagcaccuccugc

SEQ ID NO: 3031798 - RNA, 14 nt, Human
aagcaccuccugcc

SEQ ID NO: 3031799 - RNA, 15 nt, Human
aagcaccuccugccu

SEQ ID NO: 3031800 - RNA, 16 nt, Human
aagcaccuccugccuc

SEQ ID NO: 3031801 - RNA, 17 nt, Human
aagcaccuccugccucg

SEQ ID NO: 3031802 - RNA, 12 nt, Human
aagcaugugaga

SEQ ID NO: 3031803 - RNA, 17 nt, Human
aagccaaagcuaggccu

SEQ ID NO: 3031804 - RNA, 18 nt, Human
aagccaaagcuaggccug

SEQ ID NO: 3031805 - RNA, 13 nt, Human
uaaaaaggugacc

SEQ ID NO: 3031806 - RNA, 15 nt, Human
uaaaaaggugaccau

SEQ ID NO: 3031807 - RNA, 13 nt, Human
uaaaacccaagug

SEQ ID NO: 3031808 - RNA, 12 nt, Human
uaaaacuuuuua

SEQ ID NO: 3031809 - RNA, 15 nt, Human
uaaaacuuuuuaaaa

SEQ ID NO: 3031810 - RNA, 15 nt, Human
uaaaaaugagguacu

SEQ ID NO: 3031811 - RNA, 23 nt, Human
uaaaaaucucaaauuucuaaauc

SEQ ID NO: 3031812 - RNA, 22 nt, Human
uaaaaaugagguacucuccugg

SEQ ID NO: 3031813 - RNA, 23 nt, Human
aagugauccucccaccucagccu

SEQ ID NO: 3031814 - RNA, 20 nt, Human
aagugauucuccugccucag

SEQ ID NO: 3031815 - RNA, 13 nt, Human
aagugauccuccc

SEQ ID NO: 3031816 - RNA, 19 nt, Human
aagugauccucccaccuca

SEQ ID NO: 3031817 - RNA, 20 nt, Human
aagugauccucccaccucag

SEQ ID NO: 3031818 - RNA, 13 nt, Human
uaaaagucuugug

SEQ ID NO: 3031819 - RNA, 19 nt, Human
uaaaaggugaccaaugaug

SEQ ID NO: 3031820 - RNA, 20 nt, Human
aaguuugagaucagccuggg

SEQ ID NO: 3031821 - RNA, 21 nt, Human
aaguuucugccgcagcccugc

SEQ ID NO: 3031822 - RNA, 19 nt, Human
aaguuucugccgcagcccu

SEQ ID NO: 3031823 - RNA, 13 nt, Human
aagugugguagag

SEQ ID NO: 3031824 - RNA, 23 nt, Human
aaguguauuuuuuuacuaauaga

SEQ ID NO: 3031825 - RNA, 14 nt, Human
aagguagaauguuu

SEQ ID NO: 3031826 - RNA, 13 nt, Human
aagguagaauguu

SEQ ID NO: 3031827 - RNA, 13 nt, Human
aaggggagaguaa

SEQ ID NO: 3031828 - RNA, 23 nt, Human
aagggggcugggacaugggaaag

SEQ ID NO: 3031829 - RNA, 12 nt, Human
aagggggcuggg

SEQ ID NO: 3031830 - RNA, 20 nt, Human
aaggcugucaauuacaggaa

SEQ ID NO: 3031831 - RNA, 22 nt, Human
aaggcugggggaagaagcucuc

SEQ ID NO: 3031832 - RNA, 19 nt, Human
aaggcugggggaagaagcu

SEQ ID NO: 3031833 - RNA, 11 nt, Human
guuucagaaau

SEQ ID NO: 3031834 - RNA, 13 nt, Human
guuucagaaaugu

SEQ ID NO: 3031835 - RNA, 14 nt, Human
aaggcugggggaag

SEQ ID NO: 3031836 - RNA, 16 nt, Human
aaggcugggggaagaa

SEQ ID NO: 3031837 - RNA, 16 nt, Human
aaggaaacccagcucu

SEQ ID NO: 3031838 - RNA, 20 nt, Human
guuguuugauucagacagcu

SEQ ID NO: 3031839 - RNA, 23 nt, Human
guuguuugauucagacagcugcc

SEQ ID NO: 3031840 - RNA, 22 nt, Human
aaggaaacccagcucuggucca

SEQ ID NO: 3031841 - RNA, 17 nt, Human
aaggaaacccagcucug

SEQ ID NO: 3031842 - RNA, 21 nt, Human
guuuaagugacugauggcuaa

SEQ ID NO: 3031843 - RNA, 17 nt, Human
guuucaaacuuuacuau

SEQ ID NO: 3031844 - RNA, 21 nt, Human
aaguaauaugcacacauuuuu

SEQ ID NO: 3031845 - RNA, 18 nt, Human
aaguaauaugcacacauu

SEQ ID NO: 3031846 - RNA, 20 nt, Human
aaguaauaugcacacauuuu

SEQ ID NO: 3031847 - RNA, 17 nt, Human
aaguaauaugcacacau

SEQ ID NO: 3031848 - RNA, 12 nt, Human
guuuucuguucu

SEQ ID NO: 3031849 - RNA, 14 nt, Human
guuuucuguucuuu

SEQ ID NO: 3031850 - RNA, 15 nt, Human
guuuucuguucuuuc

SEQ ID NO: 3031851 - RNA, 16 nt, Human
guuuucuguucuuucu

SEQ ID NO: 3031852 - RNA, 18 nt, Human
guuuuaaggaugcuugua

SEQ ID NO: 3031853 - RNA, 22 nt, Human
guuuuaaggaugcuuguacaua

SEQ ID NO: 3031854 - RNA, 23 nt, Human
aaguauucuuauuuaaugaaaga

SEQ ID NO: 3031855 - RNA, 21 nt, Human
aaguauucuuauuuaaugaaa

SEQ ID NO: 3031856 - RNA, 19 nt, Human
aaguauucuuauuuaauga

SEQ ID NO: 3031857 - RNA, 16 nt, Human
aaguauuauaccuuuu

SEQ ID NO: 3031858 - RNA, 19 nt, Human
aaguauuauaccuuuuuua

SEQ ID NO: 3031859 - RNA, 14 nt, Human
aaguacuauaauuu

SEQ ID NO: 3031860 - RNA, 17 nt, Human
aaguacuauaauuuacc

SEQ ID NO: 3031861 - RNA, 13 nt, Human
aaguacuauguau

SEQ ID NO: 3031862 - RNA, 19 nt, Human
aaguacuucuccacccugc

SEQ ID NO: 3031863 - RNA, 18 nt, Human
aaguacuucuccacccug

SEQ ID NO: 3031864 - RNA, 15 nt, Human
aaguauuauaccuuu

SEQ ID NO: 3031865 - RNA, 22 nt, Human
cuucucuguauuccuagaaacu

SEQ ID NO: 3031866 - RNA, 19 nt, Human
cuucugaacuuggcgcugc

SEQ ID NO: 3031867 - RNA, 22 nt, Human
cuucugaacuuggcgcugcccc

SEQ ID NO: 3031868 - RNA, 15 nt, Human
cuucugacccaugcu

SEQ ID NO: 3031869 - RNA, 16 nt, Human
cuucuauuuauuuauu

SEQ ID NO: 3031870 - RNA, 14 nt, Human
cuucuauauaauuc

SEQ ID NO: 3031871 - RNA, 12 nt, Human
cuuccucccucc

SEQ ID NO: 3031872 - RNA, 13 nt, Human
cuuccucccuccc

SEQ ID NO: 3031873 - RNA, 14 nt, Human
cuuccucccucccu

SEQ ID NO: 3031874 - RNA, 13 nt, Human
cuucuuauacauu

SEQ ID NO: 3031875 - RNA, 16 nt, Human
cuucuuauacauuuga

SEQ ID NO: 3031876 - RNA, 17 nt, Human
cuucugacccaugcugc

SEQ ID NO: 3031877 - RNA, 16 nt, Human
cuucugacccaugcug

SEQ ID NO: 3031878 - RNA, 18 nt, Human
cuucugacccaugcugcc

SEQ ID NO: 3031879 - RNA, 15 nt, Human
cuuuaagaacuaaaa

SEQ ID NO: 3031880 - RNA, 22 nt, Human
cuugucuuuggacccugaggcc

SEQ ID NO: 3031881 - RNA, 21 nt, Human
cuugucuuuggacccugaggc

SEQ ID NO: 3031882 - RNA, 22 nt, Human
cuuuaaugucacaggcaggucc

SEQ ID NO: 3031883 - RNA, 15 nt, Human
cuuucaauaggaaaa

SEQ ID NO: 3031884 - RNA, 14 nt, Human
cuuucaauaggaaa

SEQ ID NO: 3031885 - RNA, 17 nt, Human
cuuuaaugucacaggca

SEQ ID NO: 3031886 - RNA, 18 nt, Human
cuuuaaugucacaggcag

SEQ ID NO: 3031887 - RNA, 19 nt, Human
cuuuaaugucacaggcagg

SEQ ID NO: 3031888 - RNA, 20 nt, Human
cuuuaaugucacaggcaggu

SEQ ID NO: 3031889 - RNA, 17 nt, Human
cuuucaauaggaaaaac

SEQ ID NO: 3031890 - RNA, 15 nt, Human
cuugguccugcugca

SEQ ID NO: 3031891 - RNA, 20 nt, Human
cuugguccugcugcaguugc

SEQ ID NO: 3031892 - RNA, 18 nt, Human
cuugguccugcugcaguu

SEQ ID NO: 3031893 - RNA, 17 nt, Human
cuugguccugcugcagu

SEQ ID NO: 3031894 - RNA, 16 nt, Human
cuugguccugcugcag

SEQ ID NO: 3031895 - RNA, 13 nt, Human
cuugucuguagau

SEQ ID NO: 3031896 - RNA, 20 nt, Human
cuugucuuuggacccugagg

SEQ ID NO: 3031897 - RNA, 19 nt, Human
cuugucuuuggacccugag

SEQ ID NO: 3031898 - RNA, 20 nt, Human
cuuggugucgggcaugacac

SEQ ID NO: 3031899 - RNA, 22 nt, Human
cuugguccugcugcaguugcca

SEQ ID NO: 3031900 - RNA, 16 nt, Human
cuugguucccauuugc

SEQ ID NO: 3031901 - RNA, 20 nt, Human
cuugguucccauuugcuccu

SEQ ID NO: 3031902 - RNA, 16 nt, Human
cuuggcccaggaguuu

SEQ ID NO: 3031903 - RNA, 20 nt, Human
cuuggcccaggaguuuggcc

SEQ ID NO: 3031904 - RNA, 22 nt, Human
cuuggcccaggaguuuggccag

SEQ ID NO: 3031905 - RNA, 23 nt, Human
cuuggcccaggaguuuggccaga

SEQ ID NO: 3031906 - RNA, 22 nt, Human
cuuggcgcugccccuggcagcc

SEQ ID NO: 3031907 - RNA, 21 nt, Human
cuuggcgcugccccuggcagc

SEQ ID NO: 3031908 - RNA, 23 nt, Human
cuuggcgcugccccuggcagccc

SEQ ID NO: 3031909 - RNA, 14 nt, Human
cuuggcccaggagu

SEQ ID NO: 3031910 - RNA, 15 nt, Human
cuuggcccaggaguu

SEQ ID NO: 3031911 - RNA, 14 nt, Human
cuuggauugucccc

SEQ ID NO: 3031912 - RNA, 20 nt, Human
cuuggauuguccccgacccu

SEQ ID NO: 3031913 - RNA, 18 nt, Human
cuuggauuguccccgacc

SEQ ID NO: 3031914 - RNA, 15 nt, Human
cuuggauuguccccg

SEQ ID NO: 3031915 - RNA, 19 nt, Human
cuugauucauaaugacuua

SEQ ID NO: 3031916 - RNA, 19 nt, Human
cuugccgucuaccugaggg

SEQ ID NO: 3031917 - RNA, 18 nt, Human
cuugccgucuaccugagg

SEQ ID NO: 3031918 - RNA, 21 nt, Human
gaacaaggcaaggcugucaau

SEQ ID NO: 3031919 - RNA, 18 nt, Human
gaacaaggcaaggcuguc

SEQ ID NO: 3031920 - RNA, 17 nt, Human
gaacaaggcaaggcugu

SEQ ID NO: 3031921 - RNA, 15 nt, Human
gaacaaggcaaggcu

SEQ ID NO: 3031922 - RNA, 14 nt, Human
gaacaaggcaaggc

SEQ ID NO: 3031923 - RNA, 19 nt, Human
gaaauuuuuauuaaauuau

SEQ ID NO: 3031924 - RNA, 18 nt, Human
gaaauuuuuauuaaauua

SEQ ID NO: 3031925 - RNA, 17 nt, Human
gaaaucaccgaaaacgu

SEQ ID NO: 3031926 - RNA, 18 nt, Human
gaaagacuaucuaaaugu

SEQ ID NO: 3031927 - RNA, 16 nt, Human
gaaaggcuccaggagc

SEQ ID NO: 3031928 - RNA, 19 nt, Human
gaaaggcuccaggagcagc

SEQ ID NO: 3031929 - RNA, 18 nt, Human
gaaaggcuccaggagcag

SEQ ID NO: 3031930 - RNA, 17 nt, Human
gaaaggcuccaggagca

SEQ ID NO: 3031931 - RNA, 21 nt, Human
gaaaguacuucuccacccugc

SEQ ID NO: 3031932 - RNA, 18 nt, Human
gaaaauuuugauguuuua

SEQ ID NO: 3031933 - RNA, 14 nt, Human
gaaaauuuuaaaaa

SEQ ID NO: 3031934 - RNA, 18 nt, Human
cuuuugccguuauuaaaa

SEQ ID NO: 3031935 - RNA, 16 nt, Human
cuuuugccguuauuaa

SEQ ID NO: 3031936 - RNA, 15 nt, Human
cuuuuggucugugug

SEQ ID NO: 3031937 - RNA, 16 nt, Human
cuuuuggucuguguga

SEQ ID NO: 3031938 - RNA, 17 nt, Human
cuuuugucuaugggacu

SEQ ID NO: 3031939 - RNA, 14 nt, Human
cuuuugugcauuau

SEQ ID NO: 3031940 - RNA, 18 nt, Human
cuuuugugcauuaucuag

SEQ ID NO: 3031941 - RNA, 21 nt, Human
cuuuuuuuuuuuuuuugacaa

SEQ ID NO: 3031942 - RNA, 19 nt, Human
gaaaaaauauuuuccugcc

SEQ ID NO: 3031943 - RNA, 24 nt, Human
cuggaguuauugaagcagaguggc

SEQ ID NO: 3031944 - RNA, 23 nt, Human
cuggaguuauugaagcagagugg

SEQ ID NO: 3031945 - RNA, 21 nt, Human
cuggaguuauugaagcagagu

SEQ ID NO: 3031946 - RNA, 22 nt, Human
cuggaguuauugaagcagagug

SEQ ID NO: 3031947 - RNA, 21 nt, Human
cuggagaaaauggacguguua

SEQ ID NO: 3031948 - RNA, 16 nt, Human
cugcuucaaggauccu

SEQ ID NO: 3031949 - RNA, 14 nt, Human
cugcuucaaggauc

SEQ ID NO: 3031950 - RNA, 19 nt, Human
cugcuucaaggauccugag

SEQ ID NO: 3031951 - RNA, 23 nt, Human
cugcuucagccucccgaguagcu

SEQ ID NO: 3031952 - RNA, 14 nt, Human
cugcuuccagugag

SEQ ID NO: 3031953 - RNA, 15 nt, Human
cuggaugcagccuca

SEQ ID NO: 3031954 - RNA, 18 nt, Human
cuggaugcagccucacag

SEQ ID NO: 3031955 - RNA, 17 nt, Human
cuggaugcagccucaca

SEQ ID NO: 3031956 - RNA, 16 nt, Human
cuggaugcagccucac

SEQ ID NO: 3031957 - RNA, 13 nt, Human
cuggcucuuccag

SEQ ID NO: 3031958 - RNA, 15 nt, Human
cuggcucuuccaggc

SEQ ID NO: 3031959 - RNA, 14 nt, Human
cuggcucuuccagg

SEQ ID NO: 3031960 - RNA, 16 nt, Human
cugggacuacaggcac

SEQ ID NO: 3031961 - RNA, 17 nt, Human
cugggacuacaggcacc

SEQ ID NO: 3031962 - RNA, 21 nt, Human
cugggacuacaggcacccacc

SEQ ID NO: 3031963 - RNA, 17 nt, Human
cugggacuacaggugug

SEQ ID NO: 3031964 - RNA, 16 nt, Human
cuggcagcucagagag

SEQ ID NO: 3031965 - RNA, 19 nt, Human
cuggcagcucagagagggu

SEQ ID NO: 3031966 - RNA, 17 nt, Human
cuggcagcucagagagg

SEQ ID NO: 3031967 - RNA, 15 nt, Human
cuggcagcucagaga

SEQ ID NO: 3031968 - RNA, 19 nt, Human
cuggcagaguugaagacag

SEQ ID NO: 3031969 - RNA, 21 nt, Human
cuggcagaguugaagacagag

SEQ ID NO: 3031970 - RNA, 20 nt, Human
cuggcagaguugaagacaga

SEQ ID NO: 3031971 - RNA, 23 nt, Human
cuggcagccccuguucuggcaga

SEQ ID NO: 3031972 - RNA, 22 nt, Human
cuggcagaguugaagacagagc

SEQ ID NO: 3031973 - RNA, 13 nt, Human
cuggcagccccug

SEQ ID NO: 3031974 - RNA, 23 nt, Human
cugcccuuaccugccaggaagcc

SEQ ID NO: 3031975 - RNA, 22 nt, Human
cugcccuuaccugccaggaagc

SEQ ID NO: 3031976 - RNA, 11 nt, Human
cugcccugugg

SEQ ID NO: 3031977 - RNA, 12 nt, Human
cugcccuguggg

SEQ ID NO: 3031978 - RNA, 19 nt, Human
cugcccuuaccugccagga

SEQ ID NO: 3031979 - RNA, 24 nt, Human
cugcccugugaguacuacaguccu

SEQ ID NO: 3031980 - RNA, 19 nt, Human
cugccucgaacuggcugca

SEQ ID NO: 3031981 - RNA, 20 nt, Human
cugccucgaacuggcugcaa

SEQ ID NO: 3031982 - RNA, 14 nt, Human
cugccucgaacugg

SEQ ID NO: 3031983 - RNA, 23 nt, Human
cugccuccuuugugaggaagccg

SEQ ID NO: 3031984 - RNA, 21 nt, Human
cugccuccuuugugaggaagc

SEQ ID NO: 3031985 - RNA, 17 nt, Human
cugccuccuuugugagg

SEQ ID NO: 3031986 - RNA, 14 nt, Human
cugccuccuuugug

SEQ ID NO: 3031987 - RNA, 20 nt, Human
cugccuguucagcuccagcu

SEQ ID NO: 3031988 - RNA, 23 nt, Human
cugccuguucagcuccagcucac

SEQ ID NO: 3031989 - RNA, 17 nt, Human
cugcuaucaaagagguu

SEQ ID NO: 3031990 - RNA, 18 nt, Human
cugcugaaggcucgagca

SEQ ID NO: 3031991 - RNA, 23 nt, Human
cugcugaaggcucgagcaugccu

SEQ ID NO: 3031992 - RNA, 24 nt, Human
cugcugaaggcucgagcaugccug

SEQ ID NO: 3031993 - RNA, 23 nt, Human
cugucggagcccugucuccucuc

SEQ ID NO: 3031994 - RNA, 22 nt, Human
cugucuaaugaaaccugugucu

SEQ ID NO: 3031995 - RNA, 20 nt, Human
cuguccugggagugagcugg

SEQ ID NO: 3031996 - RNA, 13 nt, Human
cuguccugggagu

SEQ ID NO: 3031997 - RNA, 14 nt, Human
cuguccugggagug

SEQ ID NO: 3031998 - RNA, 14 nt, Human
cugucauuugagca

SEQ ID NO: 3031999 - RNA, 15 nt, Human
cuguagagugggagc

SEQ ID NO: 3032000 - RNA, 18 nt, Human
cuggucuuauuuguaaag

SEQ ID NO: 3032001 - RNA, 22 nt, Human
cuggugacaugucuuuucuugc

SEQ ID NO: 3032002 - RNA, 12 nt, Human
cuguucagcugg

SEQ ID NO: 3032003 - RNA, 16 nt, Human
cuguucagcuccagcu

SEQ ID NO: 3032004 - RNA, 18 nt, Human
cuguucagcuccagcuca

SEQ ID NO: 3032005 - RNA, 19 nt, Human
cuguucagcuccagcucac

SEQ ID NO: 3032006 - RNA, 22 nt, Human
cuguucagcuccagcucaccag

SEQ ID NO: 3032007 - RNA, 14 nt, Human
cuguucagcuccag

SEQ ID NO: 3032008 - RNA, 15 nt, Human
cuguucagcuccagc

SEQ ID NO: 3032009 - RNA, 18 nt, Human
cugugcucuggacaggca

SEQ ID NO: 3032010 - RNA, 22 nt, Human
cugugucagguggggcagcuug

SEQ ID NO: 3032011 - RNA, 17 nt, Human
cuguuacugucuucagu

SEQ ID NO: 3032012 - RNA, 13 nt, Human
cuguuacugucuu

SEQ ID NO: 3032013 - RNA, 17 nt, Human
cugugcucuggacaggc

SEQ ID NO: 3032014 - RNA, 15 nt, Human
cugugcucuggacag

SEQ ID NO: 3032015 - RNA, 18 nt, Human
cuguugcccaggcuggcg

SEQ ID NO: 3032016 - RNA, 15 nt, Human
cuguuggccagugug

SEQ ID NO: 3032017 - RNA, 12 nt, Human
cuguuggccagu

SEQ ID NO: 3032018 - RNA, 13 nt, Human
cuuaaauaaugug

SEQ ID NO: 3032019 - RNA, 14 nt, Human
cuuaaauaauguga

SEQ ID NO: 3032020 - RNA, 16 nt, Human
cuuaaauaaugugaaa

SEQ ID NO: 3032021 - RNA, 19 nt, Human
cuuaaauaaugugaaacug

SEQ ID NO: 3032022 - RNA, 19 nt, Human
gacacuucacgcccuuggc

SEQ ID NO: 3032023 - RNA, 16 nt, Human
gacagcuccuucuguc

SEQ ID NO: 3032024 - RNA, 16 nt, Human
gacagcccgggcucug

SEQ ID NO: 3032025 - RNA, 17 nt, Human
gacagcuccuucugucc

SEQ ID NO: 3032026 - RNA, 18 nt, Human
gacagcuccuucuguccu

SEQ ID NO: 3032027 - RNA, 14 nt, Human
gacagcccgggcuc

SEQ ID NO: 3032028 - RNA, 20 nt, Human
gacagucccugccaauggac

SEQ ID NO: 3032029 - RNA, 16 nt, Human
gacagucccugccaau

SEQ ID NO: 3032030 - RNA, 15 nt, Human
gacagucccugccaa

SEQ ID NO: 3032031 - RNA, 14 nt, Human
gacagucccugcca

SEQ ID NO: 3032032 - RNA, 12 nt, Human
gacagucccugc

SEQ ID NO: 3032033 - RNA, 11 nt, Human
gacagcucuua

SEQ ID NO: 3032034 - RNA, 10 nt, Human
gacagcucuu

SEQ ID NO: 3032035 - RNA, 19 nt, Human
gacagcuccuucuguccua

SEQ ID NO: 3032036 - RNA, 16 nt, Human
gacauuuuaugucuuu

SEQ ID NO: 3032037 - RNA, 20 nt, Human
gacauuuuaugucuuucuug

SEQ ID NO: 3032038 - RNA, 17 nt, Human
gacauugcggacagcca

SEQ ID NO: 3032039 - RNA, 23 nt, Human
gacauugcggacagccacggcca

SEQ ID NO: 3032040 - RNA, 18 nt, Human
gacccucaugcugccaau

SEQ ID NO: 3032041 - RNA, 21 nt, Human
gacccucaugcugccaauauc

SEQ ID NO: 3032042 - RNA, 22 nt, Human
gacccucaugcugccaauaucc

SEQ ID NO: 3032043 - RNA, 23 nt, Human
gacccucaugcugccaauauccu

SEQ ID NO: 3032044 - RNA, 14 nt, Human
gaccucaggccugg

SEQ ID NO: 3032045 - RNA, 19 nt, Human
gaccucaggugauccaccc

SEQ ID NO: 3032046 - RNA, 21 nt, Human
gaccucaggugagaagcagag

SEQ ID NO: 3032047 - RNA, 20 nt, Human
gaccucaggugauccaccca

SEQ ID NO: 3032048 - RNA, 21 nt, Human
gaccucaggugauccacccac

SEQ ID NO: 3032049 - RNA, 19 nt, Human
gaccucaggccugggggcu

SEQ ID NO: 3032050 - RNA, 19 nt, Human
gaccucaggugagaagcag

SEQ ID NO: 3032051 - RNA, 18 nt, Human
gaccucaggugagaagca

SEQ ID NO: 3032052 - RNA, 12 nt, Human
gacccucaugcu

SEQ ID NO: 3032053 - RNA, 14 nt, Human
gacccucaugcugc

SEQ ID NO: 3032054 - RNA, 16 nt, Human
gacccucaugcugcca

SEQ ID NO: 3032055 - RNA, 17 nt, Human
gacccucaugcugccaa

SEQ ID NO: 3032056 - RNA, 15 nt, Human
gacgcugugcugccc

SEQ ID NO: 3032057 - RNA, 18 nt, Human
gacgcugugcugcccugc

SEQ ID NO: 3032058 - RNA, 17 nt, Human
gacgcugugcugcccug

SEQ ID NO: 3032059 - RNA, 16 nt, Human
gacgcugugcugcccu

SEQ ID NO: 3032060 - RNA, 23 nt, Human
gacgcuacccgggaagggggcug

SEQ ID NO: 3032061 - RNA, 22 nt, Human
gacgcuacccgggaagggggcu

SEQ ID NO: 3032062 - RNA, 21 nt, Human
gacgccaucccagccccaaug

SEQ ID NO: 3032063 - RNA, 19 nt, Human
gacgccaucccagccccaa

SEQ ID NO: 3032064 - RNA, 13 nt, Human
gacgccaucccag

SEQ ID NO: 3032065 - RNA, 12 nt, Human
gacgccauccca

SEQ ID NO: 3032066 - RNA, 16 nt, Human
gaccucugcagcaaua

SEQ ID NO: 3032067 - RNA, 18 nt, Human
gaccucugcagcaauaaa

SEQ ID NO: 3032068 - RNA, 22 nt, Human
gaccucugcagcaauaaagcag

SEQ ID NO: 3032069 - RNA, 17 nt, Human
gaauguuuucaaauguu

SEQ ID NO: 3032070 - RNA, 18 nt, Human
gaauguuugccucugccu

SEQ ID NO: 3032071 - RNA, 19 nt, Human
gaauguuugccucugccuc

SEQ ID NO: 3032072 - RNA, 14 nt, Human
gaaugauuaauuaa

SEQ ID NO: 3032073 - RNA, 14 nt, Human
gaaugaugccauga

SEQ ID NO: 3032074 - RNA, 20 nt, Human
gaaugaugauccuaggcauu

SEQ ID NO: 3032075 - RNA, 15 nt, Human
gaauguuugccucug

SEQ ID NO: 3032076 - RNA, 19 nt, Human
gaaugcacaaacagaggcc

SEQ ID NO: 3032077 - RNA, 16 nt, Human
gaauguuugccucugc

SEQ ID NO: 3032078 - RNA, 17 nt, Human
gaauguuugccucugcc

SEQ ID NO: 3032079 - RNA, 18 nt, Human
gaaugcacaaacagaggc

SEQ ID NO: 3032080 - RNA, 17 nt, Human
gacacagcucuucucca

SEQ ID NO: 3032081 - RNA, 21 nt, Human
gacacagcucuucuccaggcu

SEQ ID NO: 3032082 - RNA, 12 nt, Human
gacacagcucuu

SEQ ID NO: 3032083 - RNA, 19 nt, Human
gacacagcucuucuccagg

SEQ ID NO: 3032084 - RNA, 20 nt, Human
gacacagcucuucuccaggc

SEQ ID NO: 3032085 - RNA, 15 nt, Human
gaauauauaaccagu

SEQ ID NO: 3032086 - RNA, 11 nt, Human
gaauauugcug

SEQ ID NO: 3032087 - RNA, 13 nt, Human
gaauauugcugau

SEQ ID NO: 3032088 - RNA, 12 nt, Human
gaauauugcuga

SEQ ID NO: 3032089 - RNA, 24 nt, Human
gaauauugcugauggugcaaugac

SEQ ID NO: 3032090 - RNA, 23 nt, Human
gaauauugcugauggugcaauga

SEQ ID NO: 3032091 - RNA, 22 nt, Human
gaauauugcugauggugcaaug

SEQ ID NO: 3032092 - RNA, 16 nt, Human
gagccccacccucaga

SEQ ID NO: 3032093 - RNA, 13 nt, Human
gagccccgaggcc

SEQ ID NO: 3032094 - RNA, 14 nt, Human
gagccccgaggccu

SEQ ID NO: 3032095 - RNA, 17 nt, Human
gagccccacccucagau

SEQ ID NO: 3032096 - RNA, 17 nt, Human
gagccccgaggccuucu

SEQ ID NO: 3032097 - RNA, 13 nt, Human
gagcaucaggcca

SEQ ID NO: 3032098 - RNA, 16 nt, Human
gagcaucaggccaggc

SEQ ID NO: 3032099 - RNA, 15 nt, Human
gagcaucaggccagg

SEQ ID NO: 3032100 - RNA, 13 nt, Human
gagcaugccugga

SEQ ID NO: 3032101 - RNA, 21 nt, Human
gagcagggcucagcggggaca

SEQ ID NO: 3032102 - RNA, 14 nt, Human
gagcaucaggccag

SEQ ID NO: 3032103 - RNA, 13 nt, Human
gagcccugguggc

SEQ ID NO: 3032104 - RNA, 14 nt, Human
gagcccugguggca

SEQ ID NO: 3032105 - RNA, 14 nt, Human
gagggccugcaagg

SEQ ID NO: 3032106 - RNA, 21 nt, Human
gagggccugcaagggagugag

SEQ ID NO: 3032107 - RNA, 17 nt, Human
gagggccugcaagggag

SEQ ID NO: 3032108 - RNA, 21 nt, Human
gaggcauuuguuugaacugau

SEQ ID NO: 3032109 - RNA, 21 nt, Human
gaggcaugugaugagaggaaa

SEQ ID NO: 3032110 - RNA, 20 nt, Human
gaggcaugugaugagaggaa

SEQ ID NO: 3032111 - RNA, 22 nt, Human
gaggcaugugaugagaggaaau

SEQ ID NO: 3032112 - RNA, 19 nt, Human
gaggcauuuguuugaacug

SEQ ID NO: 3032113 - RNA, 16 nt, Human
gaggacuuuucuuugu

SEQ ID NO: 3032114 - RNA, 20 nt, Human
gaggacuuuucuuuguggcu

SEQ ID NO: 3032115 - RNA, 23 nt, Human
gaggacuuuucuuuguggcuucc

SEQ ID NO: 3032116 - RNA, 18 nt, Human
gaggcagggucucacucu

SEQ ID NO: 3032117 - RNA, 19 nt, Human
gaggcagggucucacucug

SEQ ID NO: 3032118 - RNA, 20 nt, Human
gaggcagggucucacucugu

SEQ ID NO: 3032119 - RNA, 12 nt, Human
gaggagagagga

SEQ ID NO: 3032120 - RNA, 15 nt, Human
gaggagagaggaccc

SEQ ID NO: 3032121 - RNA, 14 nt, Human
gaggagagaggacc

SEQ ID NO: 3032122 - RNA, 14 nt, Human
gagauuggaaggaa

SEQ ID NO: 3032123 - RNA, 21 nt, Human
gagauugcaccacugcacucc

SEQ ID NO: 3032124 - RNA, 15 nt, Human
gagaggacccccuga

SEQ ID NO: 3032125 - RNA, 12 nt, Human
gagaggaaauca

SEQ ID NO: 3032126 - RNA, 20 nt, Human
gagagcugggugucaagagg

SEQ ID NO: 3032127 - RNA, 13 nt, Human
gagagcugggugu

SEQ ID NO: 3032128 - RNA, 21 nt, Human
gagagcuagcagcagggaggg

SEQ ID NO: 3032129 - RNA, 15 nt, Human
gagagcuagcagcag

SEQ ID NO: 3032130 - RNA, 20 nt, Human
gagagccuuccagggguggg

SEQ ID NO: 3032131 - RNA, 18 nt, Human
gagagccuuccaggggug

SEQ ID NO: 3032132 - RNA, 16 nt, Human
gagagccuuccagggg

SEQ ID NO: 3032133 - RNA, 15 nt, Human
gagagccuuccaggg

SEQ ID NO: 3032134 - RNA, 13 nt, Human
gagacuccugcag

SEQ ID NO: 3032135 - RNA, 14 nt, Human
gacuuuuccaaccc

SEQ ID NO: 3032136 - RNA, 19 nt, Human
gacuuuuccaacccucauc

SEQ ID NO: 3032137 - RNA, 15 nt, Human
gagaaugaaagggcc

SEQ ID NO: 3032138 - RNA, 23 nt, Human
gagaaugaaagggcccagagagg

SEQ ID NO: 3032139 - RNA, 21 nt, Human
gagacccugucucaaaaaaag

SEQ ID NO: 3032140 - RNA, 18 nt, Human
gagacgggggcagagagg

SEQ ID NO: 3032141 - RNA, 16 nt, Human
gagacggagucccacc

SEQ ID NO: 3032142 - RNA, 19 nt, Human
gagacggagucccaccuug

SEQ ID NO: 3032143 - RNA, 14 nt, Human
gagacggaguccca

SEQ ID NO: 3032144 - RNA, 15 nt, Human
gcagcucuccccuuc

SEQ ID NO: 3032145 - RNA, 18 nt, Human
gcagcccaccccucaaca

SEQ ID NO: 3032146 - RNA, 16 nt, Human
gcagccaggccacaag

SEQ ID NO: 3032147 - RNA, 15 nt, Human
gcagccacauuccug

SEQ ID NO: 3032148 - RNA, 20 nt, Human
gcacucagaagacacugaug

SEQ ID NO: 3032149 - RNA, 17 nt, Human
gcacucagaagacacug

SEQ ID NO: 3032150 - RNA, 18 nt, Human
gcaagugagagcugggug

SEQ ID NO: 3032151 - RNA, 14 nt, Human
gcacuccagccugg

SEQ ID NO: 3032152 - RNA, 14 nt, Human
gcacuccccugcug

SEQ ID NO: 3032153 - RNA, 13 nt, Human
gcacuccccugcu

SEQ ID NO: 3032154 - RNA, 19 nt, Human
gcacuuuguucuggcucuu

SEQ ID NO: 3032155 - RNA, 18 nt, Human
gcacuuuguucuggcucu

SEQ ID NO: 3032156 - RNA, 15 nt, Human
gcacuccccugcugg

SEQ ID NO: 3032157 - RNA, 12 nt, Human
gcacuccccugc

SEQ ID NO: 3032158 - RNA, 22 nt, Human
gcacuuuguucuggcucuucca

SEQ ID NO: 3032159 - RNA, 23 nt, Human
gcagcauauucaggaagcucagg

SEQ ID NO: 3032160 - RNA, 19 nt, Human
gcagcauauucaggaagcu

SEQ ID NO: 3032161 - RNA, 18 nt, Human
gcagcauauucaggaagc

SEQ ID NO: 3032162 - RNA, 17 nt, Human
gcagcauauucaggaag

SEQ ID NO: 3032163 - RNA, 14 nt, Human
gcagagggcacaga

SEQ ID NO: 3032164 - RNA, 21 nt, Human
gcagaggaaagcaaaggagau

SEQ ID NO: 3032165 - RNA, 20 nt, Human
gcagaggaaagcaaaggaga

SEQ ID NO: 3032166 - RNA, 18 nt, Human
gcagaggaaagcaaagga

SEQ ID NO: 3032167 - RNA, 14 nt, Human
gcagaggaaagcaa

SEQ ID NO: 3032168 - RNA, 13 nt, Human
gcagaggaaagca

SEQ ID NO: 3032169 - RNA, 14 nt, Human
gcagucuucaguuu

SEQ ID NO: 3032170 - RNA, 15 nt, Human
gcauacguacacauu

SEQ ID NO: 3032171 - RNA, 16 nt, Human
gcauacguacacauuu

SEQ ID NO: 3032172 - RNA, 17 nt, Human
gcauacguacacauuuu

SEQ ID NO: 3032173 - RNA, 18 nt, Human
gcauccaguaucuugaag

SEQ ID NO: 3032174 - RNA, 17 nt, Human
gcauccaguaucuugaa

SEQ ID NO: 3032175 - RNA, 14 nt, Human
gcauccaguaucuu

SEQ ID NO: 3032176 - RNA, 13 nt, Human
gcauccuggcacc

SEQ ID NO: 3032177 - RNA, 21 nt, Human
gcauggcugccaaugggagcu

SEQ ID NO: 3032178 - RNA, 19 nt, Human
gcaugugaugagaggaaau

SEQ ID NO: 3032179 - RNA, 18 nt, Human
gcaugugaugagaggaaa

SEQ ID NO: 3032180 - RNA, 21 nt, Human
gcaugugaugagaggaaauca

SEQ ID NO: 3032181 - RNA, 15 nt, Human
gcauugugggaaggg

SEQ ID NO: 3032182 - RNA, 13 nt, Human
gcauugugggaag

SEQ ID NO: 3032183 - RNA, 15 nt, Human
gcauuuacuuugugu

SEQ ID NO: 3032184 - RNA, 18 nt, Human
gcauuuaaaagauacagu

SEQ ID NO: 3032185 - RNA, 22 nt, Human
gcauuuaaaagauacaguuacu

SEQ ID NO: 3032186 - RNA, 18 nt, Human
gcauugugggaaggggag

SEQ ID NO: 3032187 - RNA, 16 nt, Human
gcauugugggaagggg

SEQ ID NO: 3032188 - RNA, 16 nt, Human
gcauuuaaaagauaca

SEQ ID NO: 3032189 - RNA, 17 nt, Human
gcauuuaaaagauacag

SEQ ID NO: 3032190 - RNA, 19 nt, Human
gaucucuugagccugggag

SEQ ID NO: 3032191 - RNA, 18 nt, Human
gaucucuugagccuggga

SEQ ID NO: 3032192 - RNA, 15 nt, Human
gaucucuaacuucac

SEQ ID NO: 3032193 - RNA, 13 nt, Human
gaugauccuaggc

SEQ ID NO: 3032194 - RNA, 22 nt, Human
gaugauuggaggggggaggugg

SEQ ID NO: 3032195 - RNA, 23 nt, Human
gaugcuucucacugccaugccag

SEQ ID NO: 3032196 - RNA, 21 nt, Human
gaugcuucuucagagacuccu

SEQ ID NO: 3032197 - RNA, 20 nt, Human
gaugcuucuucagagacucc

SEQ ID NO: 3032198 - RNA, 17 nt, Human
gaugcuucuucagagac

SEQ ID NO: 3032199 - RNA, 16 nt, Human
gauacaguuacucaga

SEQ ID NO: 3032200 - RNA, 19 nt, Human
gauacaguuacucagaauu

SEQ ID NO: 3032201 - RNA, 23 nt, Human
gauacaguuacucagaauucucu

SEQ ID NO: 3032202 - RNA, 17 nt, Human
gauacuguaucaugaca

SEQ ID NO: 3032203 - RNA, 21 nt, Human
gauacuguaucaugacaaaga

SEQ ID NO: 3032204 - RNA, 12 nt, Human
gauccaagcugg

SEQ ID NO: 3032205 - RNA, 16 nt, Human
gauccaagcugguccc

SEQ ID NO: 3032206 - RNA, 17 nt, Human
gauccaagcugguccca

SEQ ID NO: 3032207 - RNA, 19 nt, Human
gauccaagcuggucccacu

SEQ ID NO: 3032208 - RNA, 22 nt, Human
gauccacccaccucagccuccc

SEQ ID NO: 3032209 - RNA, 20 nt, Human
gauccacccaccucagccuc

SEQ ID NO: 3032210 - RNA, 21 nt, Human
gauccacccaccucagccucc

SEQ ID NO: 3032211 - RNA, 21 nt, Human
gauccaagcuggucccacuca

SEQ ID NO: 3032212 - RNA, 18 nt, Human
gauccacccaccucagcc

SEQ ID NO: 3032213 - RNA, 19 nt, Human
gauccacccaccucagccu

SEQ ID NO: 3032214 - RNA, 23 nt, Human
gaucaaaagguuaauaaaguaau

SEQ ID NO: 3032215 - RNA, 17 nt, Human
gauauuuuuuucuuuuc

SEQ ID NO: 3032216 - RNA, 20 nt, Human
gaucaaaagguuaauaaagu

SEQ ID NO: 3032217 - RNA, 16 nt, Human
gcaagugagagcuggg

SEQ ID NO: 3032218 - RNA, 15 nt, Human
gcaagugagagcugg

SEQ ID NO: 3032219 - RNA, 20 nt, Human
gcaaccuccgccucuugggu

SEQ ID NO: 3032220 - RNA, 14 nt, Human
gcaacccccagccu

SEQ ID NO: 3032221 - RNA, 15 nt, Human
gcaacccccagccug

SEQ ID NO: 3032222 - RNA, 16 nt, Human
gcaacccccagccugc

SEQ ID NO: 3032223 - RNA, 19 nt, Human
gcaaccuccgccucuuggg

SEQ ID NO: 3032224 - RNA, 13 nt, Human
gcaaccaccacca

SEQ ID NO: 3032225 - RNA, 18 nt, Human
gcaaccaccaccaaccac

SEQ ID NO: 3032226 - RNA, 16 nt, Human
gcaaccaccaccaacc

SEQ ID NO: 3032227 - RNA, 16 nt, Human
gcaacaggcugggcuu

SEQ ID NO: 3032228 - RNA, 19 nt, Human
gcaacaggcugggcuucag

SEQ ID NO: 3032229 - RNA, 14 nt, Human
gcaacaggcugggc

SEQ ID NO: 3032230 - RNA, 15 nt, Human
gcaacaggcugggcu

SEQ ID NO: 3032231 - RNA, 13 nt, Human
gcaacaggcuggg

SEQ ID NO: 3032232 - RNA, 12 nt, Human
gauucuucugcu

SEQ ID NO: 3032233 - RNA, 13 nt, Human
gauucuucugcuu

SEQ ID NO: 3032234 - RNA, 15 nt, Human
gauucuucugcuuca

SEQ ID NO: 3032235 - RNA, 19 nt, Human
gauuuaacagaaauguaca

SEQ ID NO: 3032236 - RNA, 16 nt, Human
gauuuaacagaaaugu

SEQ ID NO: 3032237 - RNA, 17 nt, Human
gauuuaacagaaaugua

SEQ ID NO: 3032238 - RNA, 18 nt, Human
gauuuaacagaaauguac

SEQ ID NO: 3032239 - RNA, 11 nt, Human
gauuucacucu

SEQ ID NO: 3032240 - RNA, 18 nt, Human
gauuuuuuuuuccuucag

SEQ ID NO: 3032241 - RNA, 17 nt, Human
gauuuuuuuuuccuuca

SEQ ID NO: 3032242 - RNA, 12 nt, Human
gauuucacucuc

SEQ ID NO: 3032243 - RNA, 16 nt, Human
gauuuuuuuuuccuuc

SEQ ID NO: 3032244 - RNA, 17 nt, Human
gcaaaagaugcuucuca

SEQ ID NO: 3032245 - RNA, 22 nt, Human
gcaaaagaugcuucucacugcc

SEQ ID NO: 3032246 - RNA, 14 nt, Human
gcaaaaaggcagga

SEQ ID NO: 3032247 - RNA, 21 nt, Human
gauuuuuuuuuccuucagugc

SEQ ID NO: 3032248 - RNA, 20 nt, Human
ggaaugauauaagguuuuuu

SEQ ID NO: 3032249 - RNA, 12 nt, Human
ggacacagcucu

SEQ ID NO: 3032250 - RNA, 19 nt, Human
ggaaugaaugucaguguga

SEQ ID NO: 3032251 - RNA, 13 nt, Human
ggacacagcucuu

SEQ ID NO: 3032252 - RNA, 21 nt, Human
ggacacagcucuucuccaggc

SEQ ID NO: 3032253 - RNA, 12 nt, Human
ggacacccugug

SEQ ID NO: 3032254 - RNA, 16 nt, Human
ggaauauauaaccagu

SEQ ID NO: 3032255 - RNA, 19 nt, Human
ggaauaccugucccccuga

SEQ ID NO: 3032256 - RNA, 16 nt, Human
ggaauaccuguccccc

SEQ ID NO: 3032257 - RNA, 15 nt, Human
ggaauaccugucccc

SEQ ID NO: 3032258 - RNA, 21 nt, Human
ggaagcucagggccuggcuca

SEQ ID NO: 3032259 - RNA, 17 nt, Human
ggaagcucagggccugg

SEQ ID NO: 3032260 - RNA, 16 nt, Human
ggaagcucagggccug

SEQ ID NO: 3032261 - RNA, 13 nt, Human
ggacauggacaag

SEQ ID NO: 3032262 - RNA, 23 nt, Human
ggacacccugugauggggcccug

SEQ ID NO: 3032263 - RNA, 13 nt, Human
ggacacccuguga

SEQ ID NO: 3032264 - RNA, 23 nt, Human
ggacaggcauguucucugaggac

SEQ ID NO: 3032265 - RNA, 17 nt, Human
ggacagggaggugaccc

SEQ ID NO: 3032266 - RNA, 23 nt, Human
ggaaaucaccgaaaacguggcug

SEQ ID NO: 3032267 - RNA, 21 nt, Human
ggaagccagcaggcucucagg

SEQ ID NO: 3032268 - RNA, 23 nt, Human
ggaagccagcaggcucucaggcc

SEQ ID NO: 3032269 - RNA, 22 nt, Human
ggaagccagcaggcucucaggc

SEQ ID NO: 3032270 - RNA, 18 nt, Human
ggaagccgcuggggccag

SEQ ID NO: 3032271 - RNA, 13 nt, Human
ggaaaggaaugca

SEQ ID NO: 3032272 - RNA, 17 nt, Human
ggaaaggaaugcaaaga

SEQ ID NO: 3032273 - RNA, 14 nt, Human
ggaaagaggcucug

SEQ ID NO: 3032274 - RNA, 20 nt, Human
ggaaagacuuuuccaacccu

SEQ ID NO: 3032275 - RNA, 17 nt, Human
ggaaagaguaggaagac

SEQ ID NO: 3032276 - RNA, 16 nt, Human
ggaaagaguaggaaga

SEQ ID NO: 3032277 - RNA, 19 nt, Human
ggaaagcaaaggagauugg

SEQ ID NO: 3032278 - RNA, 20 nt, Human
ggaaacagcuaaugggacac

SEQ ID NO: 3032279 - RNA, 15 nt, Human
ggaaacccagcucug

SEQ ID NO: 3032280 - RNA, 15 nt, Human
gcuuuuuaauauuga

SEQ ID NO: 3032281 - RNA, 13 nt, Human
gcuuuugugcauu

SEQ ID NO: 3032282 - RNA, 19 nt, Human
gcuuuugugcauuaucuag

SEQ ID NO: 3032283 - RNA, 13 nt, Human
gcuuuugcauauu

SEQ ID NO: 3032284 - RNA, 19 nt, Human
gcuugggcuucauccuccu

SEQ ID NO: 3032285 - RNA, 22 nt, Human
gcuuggggaccagagcugccac

SEQ ID NO: 3032286 - RNA, 21 nt, Human
gcuuggggaccagagcugcca

SEQ ID NO: 3032287 - RNA, 20 nt, Human
gcuuggggaccagagcugcc

SEQ ID NO: 3032288 - RNA, 18 nt, Human
gcuuggggaccagagcug

SEQ ID NO: 3032289 - RNA, 17 nt, Human
gcuuggggaccagagcu

SEQ ID NO: 3032290 - RNA, 13 nt, Human
gcuuucuacccag

SEQ ID NO: 3032291 - RNA, 19 nt, Human
gcuuucuacccagcgagcc

SEQ ID NO: 3032292 - RNA, 22 nt, Human
gcuuucuacccagcgagcccug

SEQ ID NO: 3032293 - RNA, 14 nt, Human
gcuuaacuucacau

SEQ ID NO: 3032294 - RNA, 17 nt, Human
gcuuaacuucacauauu

SEQ ID NO: 3032295 - RNA, 16 nt, Human
gcuucuucagagacuc

SEQ ID NO: 3032296 - RNA, 16 nt, Human
gcuuaacuucacauau

SEQ ID NO: 3032297 - RNA, 16 nt, Human
gcuuggggaccagagc

SEQ ID NO: 3032298 - RNA, 23 nt, Human
gcuugggcuucauccuccucaga

SEQ ID NO: 3032299 - RNA, 19 nt, Human
gcuugaccgugaggccaga

SEQ ID NO: 3032300 - RNA, 18 nt, Human
gcuugaccgugaggccag

SEQ ID NO: 3032301 - RNA, 17 nt, Human
gcuugaccgugaggcca

SEQ ID NO: 3032302 - RNA, 16 nt, Human
gcuugaccgugaggcc

SEQ ID NO: 3032303 - RNA, 21 nt, Human
gcuucuucagagacuccugca

SEQ ID NO: 3032304 - RNA, 19 nt, Human
gcuucuucagagacuccug

SEQ ID NO: 3032305 - RNA, 14 nt, Human
gcugaggugggagg

SEQ ID NO: 3032306 - RNA, 23 nt, Human
gcugagggugagugggugaauaa

SEQ ID NO: 3032307 - RNA, 18 nt, Human
gcugagggugagugggug

SEQ ID NO: 3032308 - RNA, 16 nt, Human
gcugcacccucaggca

SEQ ID NO: 3032309 - RNA, 13 nt, Human
gcugcaccggcug

SEQ ID NO: 3032310 - RNA, 19 nt, Human
gcugcacccucaggcaggu

SEQ ID NO: 3032311 - RNA, 18 nt, Human
gcugcacccucaggcagg

SEQ ID NO: 3032312 - RNA, 19 nt, Human
gcugccccuggcagccccu

SEQ ID NO: 3032313 - RNA, 18 nt, Human
gcugccccuggcagcccc

SEQ ID NO: 3032314 - RNA, 20 nt, Human
gcugccccuggcagccccug

SEQ ID NO: 3032315 - RNA, 17 nt, Human
gcugccccuggcagccc

SEQ ID NO: 3032316 - RNA, 21 nt, Human
gcugccugggaucccucaucc

SEQ ID NO: 3032317 - RNA, 17 nt, Human
gcugccuguucagcucc

SEQ ID NO: 3032318 - RNA, 12 nt, Human
gcugccuguuca

SEQ ID NO: 3032319 - RNA, 13 nt, Human
gcugccuguucag

SEQ ID NO: 3032320 - RNA, 20 nt, Human
gcugccugggaucccucauc

SEQ ID NO: 3032321 - RNA, 16 nt, Human
gcugccucucccauca

SEQ ID NO: 3032322 - RNA, 21 nt, Human
gcuggguucuacccaggugcu

SEQ ID NO: 3032323 - RNA, 20 nt, Human
gcuggguucuacccaggugc

SEQ ID NO: 3032324 - RNA, 17 nt, Human
gcuggguucuacccagg

SEQ ID NO: 3032325 - RNA, 18 nt, Human
gcuggguucuacccaggu

SEQ ID NO: 3032326 - RNA, 23 nt, Human
gcugggguggggaccucaggccu

SEQ ID NO: 3032327 - RNA, 22 nt, Human
gcugggguggggaccucaggcc

SEQ ID NO: 3032328 - RNA, 14 nt, Human
gcugggcagguugg

SEQ ID NO: 3032329 - RNA, 17 nt, Human
gcuggcuguuggcuggg

SEQ ID NO: 3032330 - RNA, 20 nt, Human
gcuggcuguuggcugggggc

SEQ ID NO: 3032331 - RNA, 23 nt, Human
gcuggcuguuggcugggggccuc

SEQ ID NO: 3032332 - RNA, 19 nt, Human
gcugggguggggaccucag

SEQ ID NO: 3032333 - RNA, 17 nt, Human
gcugggguggggaccuc

SEQ ID NO: 3032334 - RNA, 14 nt, Human
gcuggcgugcagug

SEQ ID NO: 3032335 - RNA, 15 nt, Human
gcuggcgugcagugg

SEQ ID NO: 3032336 - RNA, 18 nt, Human
gcuggcgugcaguggugc

SEQ ID NO: 3032337 - RNA, 18 nt, Human
gcuggcuguuggcugggg

SEQ ID NO: 3032338 - RNA, 19 nt, Human
gcuggcuguuggcuggggg

SEQ ID NO: 3032339 - RNA, 12 nt, Human
gcugcugaaggc

SEQ ID NO: 3032340 - RNA, 17 nt, Human
gcuguaucccaugagcc

SEQ ID NO: 3032341 - RNA, 13 nt, Human
gcugugcucugga

SEQ ID NO: 3032342 - RNA, 14 nt, Human
gcugugcugcccug

SEQ ID NO: 3032343 - RNA, 15 nt, Human
gcugugcucuggaca

SEQ ID NO: 3032344 - RNA, 16 nt, Human
gcugugcucuggacag

SEQ ID NO: 3032345 - RNA, 14 nt, Human
gcuguuggcugggg

SEQ ID NO: 3032346 - RNA, 16 nt, Human
gcuguuggcugggggc

SEQ ID NO: 3032347 - RNA, 20 nt, Human
gcuguuggcugggggccuca

SEQ ID NO: 3032348 - RNA, 15 nt, Human
gcuguuggcuggggg

SEQ ID NO: 3032349 - RNA, 17 nt, Human
gcugugcugcccugccc

SEQ ID NO: 3032350 - RNA, 16 nt, Human
gcugugcugcccugcc

SEQ ID NO: 3032351 - RNA, 15 nt, Human
gcugugcugcccugc

SEQ ID NO: 3032352 - RNA, 19 nt, Human
gcccaggaguuuggccaga

SEQ ID NO: 3032353 - RNA, 20 nt, Human
gcccaggaguuuggccagaa

SEQ ID NO: 3032354 - RNA, 11 nt, Human
gcccaggcagg

SEQ ID NO: 3032355 - RNA, 18 nt, Human
gcccaggaguuuggccag

SEQ ID NO: 3032356 - RNA, 18 nt, Human
gcccaggccccugccacc

SEQ ID NO: 3032357 - RNA, 20 nt, Human
gcccaggccccugccacccu

SEQ ID NO: 3032358 - RNA, 21 nt, Human
gcccaggccccugccacccug

SEQ ID NO: 3032359 - RNA, 11 nt, Human
gcccaggcccc

SEQ ID NO: 3032360 - RNA, 12 nt, Human
gcccaggccccu

SEQ ID NO: 3032361 - RNA, 23 nt, Human
gcccacgcuggagugcagugagc

SEQ ID NO: 3032362 - RNA, 19 nt, Human
gcccacgcuggagugcagu

SEQ ID NO: 3032363 - RNA, 21 nt, Human
gcccacgcuggagugcaguga

SEQ ID NO: 3032364 - RNA, 13 nt, Human
gcccacuucugcc

SEQ ID NO: 3032365 - RNA, 23 nt, Human
gcccaggaaaggcuccaggagca

SEQ ID NO: 3032366 - RNA, 22 nt, Human
gcccaggaaaggcuccaggagc

SEQ ID NO: 3032367 - RNA, 24 nt, Human
gcccaggaaaggcuccaggagcag

SEQ ID NO: 3032368 - RNA, 21 nt, Human
gcccacgcccccacuggugac

SEQ ID NO: 3032369 - RNA, 17 nt, Human
gcccacgcccccacugg

SEQ ID NO: 3032370 - RNA, 16 nt, Human
gcccacgcccccacug

SEQ ID NO: 3032371 - RNA, 15 nt, Human
gcccacgcccccacu

SEQ ID NO: 3032372 - RNA, 18 nt, Human
gcauuuacuuuguguuca

SEQ ID NO: 3032373 - RNA, 21 nt, Human
gccccaaaacucuccucugcu

SEQ ID NO: 3032374 - RNA, 20 nt, Human
gccccaaaacucuccucugc

SEQ ID NO: 3032375 - RNA, 12 nt, Human
gccccugcuggu

SEQ ID NO: 3032376 - RNA, 15 nt, Human
gccccugcugguuca

SEQ ID NO: 3032377 - RNA, 16 nt, Human
gccccugcugguucag

SEQ ID NO: 3032378 - RNA, 15 nt, Human
gccccuggcagcccc

SEQ ID NO: 3032379 - RNA, 12 nt, Human
gccccuggcagc

SEQ ID NO: 3032380 - RNA, 17 nt, Human
gccccuggcagccccug

SEQ ID NO: 3032381 - RNA, 16 nt, Human
gccccuggcagccccu

SEQ ID NO: 3032382 - RNA, 15 nt, Human
gcccugcccaccugg

SEQ ID NO: 3032383 - RNA, 14 nt, Human
gcccugcccaccug

SEQ ID NO: 3032384 - RNA, 23 nt, Human
gcccuuaccugccaggaagccag

SEQ ID NO: 3032385 - RNA, 22 nt, Human
gcccuuaccugccaggaagcca

SEQ ID NO: 3032386 - RNA, 21 nt, Human
gcccuuaccugccaggaagcc

SEQ ID NO: 3032387 - RNA, 17 nt, Human
gcccugugggcccccaa

SEQ ID NO: 3032388 - RNA, 16 nt, Human
gcccugugggccccca

SEQ ID NO: 3032389 - RNA, 16 nt, Human
gccuacaggagugagc

SEQ ID NO: 3032390 - RNA, 12 nt, Human
gccuagcauacg

SEQ ID NO: 3032391 - RNA, 19 nt, Human
gccuagcauacguacacau

SEQ ID NO: 3032392 - RNA, 17 nt, Human
gccuacaggagugagca

SEQ ID NO: 3032393 - RNA, 14 nt, Human
gccucugggacugg

SEQ ID NO: 3032394 - RNA, 16 nt, Human
gccucgaacuggcugc

SEQ ID NO: 3032395 - RNA, 13 nt, Human
gccucgaacuggc

SEQ ID NO: 3032396 - RNA, 22 nt, Human
gccuccuuugugaggaagccgc

SEQ ID NO: 3032397 - RNA, 16 nt, Human
gcggccuuuggcuuca

SEQ ID NO: 3032398 - RNA, 15 nt, Human
gcggcuggcagccca

SEQ ID NO: 3032399 - RNA, 21 nt, Human
gcgcagcauauucaggaagcu

SEQ ID NO: 3032400 - RNA, 20 nt, Human
gcgcagcauauucaggaagc

SEQ ID NO: 3032401 - RNA, 23 nt, Human
gcgauucuucugcuucagccucc

SEQ ID NO: 3032402 - RNA, 23 nt, Human
gccuugaccauucuccaccugcc

SEQ ID NO: 3032403 - RNA, 22 nt, Human
gcgauucuucugcuucagccuc

SEQ ID NO: 3032404 - RNA, 17 nt, Human
gcgauucuucugcuuca

SEQ ID NO: 3032405 - RNA, 23 nt, Human
gccuugaacuuugaccucugcag

SEQ ID NO: 3032406 - RNA, 22 nt, Human
gccuugaccauucuccaccugc

SEQ ID NO: 3032407 - RNA, 21 nt, Human
gccuugaccauucuccaccug

SEQ ID NO: 3032408 - RNA, 11 nt, Human
gccugggcaga

SEQ ID NO: 3032409 - RNA, 21 nt, Human
gccugggaucccucauccuca

SEQ ID NO: 3032410 - RNA, 23 nt, Human
gccugggaucccucauccucaua

SEQ ID NO: 3032411 - RNA, 19 nt, Human
gccugugccucugggacug

SEQ ID NO: 3032412 - RNA, 14 nt, Human
gccuugaacuuuga

SEQ ID NO: 3032413 - RNA, 15 nt, Human
gccuguucagcucca

SEQ ID NO: 3032414 - RNA, 14 nt, Human
gccuguucagcucc

SEQ ID NO: 3032415 - RNA, 16 nt, Human
gccuguucagcuccag

SEQ ID NO: 3032416 - RNA, 17 nt, Human
gccuguucagcuccagc

SEQ ID NO: 3032417 - RNA, 15 nt, Human
gccuucucugaagga

SEQ ID NO: 3032418 - RNA, 16 nt, Human
gccuucucugaaggac

SEQ ID NO: 3032419 - RNA, 20 nt, Human
gcucagggccuggcucaggu

SEQ ID NO: 3032420 - RNA, 17 nt, Human
gcucagggccuggcuca

SEQ ID NO: 3032421 - RNA, 13 nt, Human
gcucaggaguuug

SEQ ID NO: 3032422 - RNA, 19 nt, Human
gcucagggccuggcucagg

SEQ ID NO: 3032423 - RNA, 18 nt, Human
gcucagggccuggcucag

SEQ ID NO: 3032424 - RNA, 18 nt, Human
gcuaagugauccucccac

SEQ ID NO: 3032425 - RNA, 22 nt, Human
gcuaagugauccucccaccuca

SEQ ID NO: 3032426 - RNA, 20 nt, Human
gcuaggaccccuccaugugg

SEQ ID NO: 3032427 - RNA, 14 nt, Human
gcuaguugggcuuc

SEQ ID NO: 3032428 - RNA, 16 nt, Human
gcuaguugggcuuccu

SEQ ID NO: 3032429 - RNA, 19 nt, Human
aaaauaauuagguauuuuc

SEQ ID NO: 3032430 - RNA, 13 nt, Human
aaaauaccaagga

SEQ ID NO: 3032431 - RNA, 21 nt, Human
aaaaggaagcuuacaugccua

SEQ ID NO: 3032432 - RNA, 22 nt, Human
aaaaggagccaauuuaaagaaa

SEQ ID NO: 3032433 - RNA, 13 nt, Human
aaaaggaugcaca

SEQ ID NO: 3032434 - RNA, 14 nt, Human
aaaaggaugcacag

SEQ ID NO: 3032435 - RNA, 15 nt, Human
aaaaggaugcacaga

SEQ ID NO: 3032436 - RNA, 19 nt, Human
aaaaggaugcacagaguug

SEQ ID NO: 3032437 - RNA, 22 nt, Human
aaaaggaugcacagaguuguua

SEQ ID NO: 3032438 - RNA, 19 nt, Human
aaaagguaugcaaucaaau

SEQ ID NO: 3032439 - RNA, 11 nt, Human
aaaaggcagga

SEQ ID NO: 3032440 - RNA, 17 nt, Human
aaaagguuaauaaagua

SEQ ID NO: 3032441 - RNA, 16 nt, Human
aaaagguuaauaaagu

SEQ ID NO: 3032442 - RNA, 16 nt, Human
aaaauauuuuccugcc

SEQ ID NO: 3032443 - RNA, 20 nt, Human
aaaaugguguuuuaucuucu

SEQ ID NO: 3032444 - RNA, 17 nt, Human
gggcuggguucuaccca

SEQ ID NO: 3032445 - RNA, 21 nt, Human
gggcugcaccggcuggccugg

SEQ ID NO: 3032446 - RNA, 20 nt, Human
gggcugcaccggcuggccug

SEQ ID NO: 3032447 - RNA, 15 nt, Human
gggcugggcagagga

SEQ ID NO: 3032448 - RNA, 12 nt, Human
gggcugggcaga

SEQ ID NO: 3032449 - RNA, 19 nt, Human
gggcugcaccggcuggccu

SEQ ID NO: 3032450 - RNA, 17 nt, Human
gggcugcaccggcuggc

SEQ ID NO: 3032451 - RNA, 21 nt, Human
gggcucagcggggacagcucc

SEQ ID NO: 3032452 - RNA, 13 nt, Human
gggcuccagacac

SEQ ID NO: 3032453 - RNA, 10 nt, Human
gggcuccaga

SEQ ID NO: 3032454 - RNA, 22 nt, Human
gggcucagcaaaagaugcuucu

SEQ ID NO: 3032455 - RNA, 18 nt, Human
gggcucagcaaaagaugc

SEQ ID NO: 3032456 - RNA, 15 nt, Human
gggcuaguugggcuu

SEQ ID NO: 3032457 - RNA, 17 nt, Human
gggcucagcggggacag

SEQ ID NO: 3032458 - RNA, 19 nt, Human
gggcucagcggggacagcu

SEQ ID NO: 3032459 - RNA, 14 nt, Human
gggccaggagccuc

SEQ ID NO: 3032460 - RNA, 13 nt, Human
gggccaggagccu

SEQ ID NO: 3032461 - RNA, 12 nt, Human
gggccaggagcc

SEQ ID NO: 3032462 - RNA, 21 nt, Human
gggcggugagaggggaacaga

SEQ ID NO: 3032463 - RNA, 13 nt, Human
gggccucagugcc

SEQ ID NO: 3032464 - RNA, 14 nt, Human
gggccucagugcca

SEQ ID NO: 3032465 - RNA, 15 nt, Human
gggccucagugccac

SEQ ID NO: 3032466 - RNA, 18 nt, Human
gggccucuuaugggcugg

SEQ ID NO: 3032467 - RNA, 22 nt, Human
gggccucgguguggagaagcgg

SEQ ID NO: 3032468 - RNA, 16 nt, Human
gggguaaggugcaucu

SEQ ID NO: 3032469 - RNA, 13 nt, Human
ggggguggccucc

SEQ ID NO: 3032470 - RNA, 15 nt, Human
gggggcugggcagag

SEQ ID NO: 3032471 - RNA, 21 nt, Human
ggggucacucuggcagcucag

SEQ ID NO: 3032472 - RNA, 17 nt, Human
gggggaucacagccucu

SEQ ID NO: 3032473 - RNA, 11 nt, Human
gggggcuggga

SEQ ID NO: 3032474 - RNA, 13 nt, Human
ggggaccagagcu

SEQ ID NO: 3032475 - RNA, 12 nt, Human
ggggaccagagc

SEQ ID NO: 3032476 - RNA, 18 nt, Human
aaaauguauguguaagua

SEQ ID NO: 3032477 - RNA, 14 nt, Human
ggggaccagagcug

SEQ ID NO: 3032478 - RNA, 19 nt, Human
ggggccaguuggucccccu

SEQ ID NO: 3032479 - RNA, 15 nt, Human
aaacauuucauuucc

SEQ ID NO: 3032480 - RNA, 19 nt, Human
aaacauuuugucauauaag

SEQ ID NO: 3032481 - RNA, 20 nt, Human
gggucacucuggcagcucag

SEQ ID NO: 3032482 - RNA, 14 nt, Human
gggucacucuggca

SEQ ID NO: 3032483 - RNA, 22 nt, Human
aaaccugugucucugagaguag

SEQ ID NO: 3032484 - RNA, 16 nt, Human
gguauagauguugcua

SEQ ID NO: 3032485 - RNA, 20 nt, Human
gguaggguaagugagagagg

SEQ ID NO: 3032486 - RNA, 14 nt, Human
gguaucaggugcug

SEQ ID NO: 3032487 - RNA, 20 nt, Human
gguaaggaauaccugucccc

SEQ ID NO: 3032488 - RNA, 18 nt, Human
aaacuuuacuauggcccu

SEQ ID NO: 3032489 - RNA, 22 nt, Human
aaacuugauguguuaucucuua

SEQ ID NO: 3032490 - RNA, 19 nt, Human
gguaucaggugcugccauc

SEQ ID NO: 3032491 - RNA, 18 nt, Human
gguaacuagggaagauaa

SEQ ID NO: 3032492 - RNA, 23 nt, Human
ggguuuugccauguuggccaggc

SEQ ID NO: 3032493 - RNA, 20 nt, Human
ggguuuugccauguuggcca

SEQ ID NO: 3032494 - RNA, 12 nt, Human
ggguggugaccu

SEQ ID NO: 3032495 - RNA, 21 nt, Human
aaacguggcugcuucaaggau

SEQ ID NO: 3032496 - RNA, 20 nt, Human
aaacguggcugcuucaagga

SEQ ID NO: 3032497 - RNA, 19 nt, Human
aaacuguuaauaguucagg

SEQ ID NO: 3032498 - RNA, 18 nt, Human
gggugggacacccuguga

SEQ ID NO: 3032499 - RNA, 15 nt, Human
gggugggacacccug

SEQ ID NO: 3032500 - RNA, 19 nt, Human
aaacuuaaucuaaauggaa

SEQ ID NO: 3032501 - RNA, 22 nt, Human
aaauaucccuuggacauuuuau

SEQ ID NO: 3032502 - RNA, 23 nt, Human
aaauaucccuuggacauuuuaug

SEQ ID NO: 3032503 - RNA, 15 nt, Human
aaauauaggaacuua

SEQ ID NO: 3032504 - RNA, 16 nt, Human
guacacacacauacac

SEQ ID NO: 3032505 - RNA, 19 nt, Human
aaauaccagccaguaaaug

SEQ ID NO: 3032506 - RNA, 20 nt, Human
aaauaccagccaguaaaugg

SEQ ID NO: 3032507 - RNA, 21 nt, Human
aaauaccagccaguaaauggg

SEQ ID NO: 3032508 - RNA, 21 nt, Human
aaauauugguugggaugacuu

SEQ ID NO: 3032509 - RNA, 23 nt, Human
aaaucagccugcuccagcuguuc

SEQ ID NO: 3032510 - RNA, 21 nt, Human
aaaucagccugcuccagcugu

SEQ ID NO: 3032511 - RNA, 19 nt, Human
aaaucagccugcuccagcu

SEQ ID NO: 3032512 - RNA, 12 nt, Human
aaauaucugaaa

SEQ ID NO: 3032513 - RNA, 14 nt, Human
aaauaucugaaaau

SEQ ID NO: 3032514 - RNA, 17 nt, Human
aaauaucugaaaaugua

SEQ ID NO: 3032515 - RNA, 18 nt, Human
aaauaucugaaaauguau

SEQ ID NO: 3032516 - RNA, 19 nt, Human
aaauaucugaaaauguaug

SEQ ID NO: 3032517 - RNA, 21 nt, Human
aaauaucugaaaauguaugug

SEQ ID NO: 3032518 - RNA, 22 nt, Human
aaauaucugaaaauguaugugu

SEQ ID NO: 3032519 - RNA, 23 nt, Human
aaauaucugaaaauguaugugua

SEQ ID NO: 3032520 - RNA, 17 nt, Human
guaacauagcugugauu

SEQ ID NO: 3032521 - RNA, 19 nt, Human
guaacaggaaaauuuuaaa

SEQ ID NO: 3032522 - RNA, 16 nt, Human
guaacaagccacccca

SEQ ID NO: 3032523 - RNA, 17 nt, Human
aaauaauuagguauuuu

SEQ ID NO: 3032524 - RNA, 14 nt, Human
aaauaaugugaaac

SEQ ID NO: 3032525 - RNA, 22 nt, Human
aaauaaugugaaacuggauuaa

SEQ ID NO: 3032526 - RNA, 22 nt, Human
aaaguguauuuuuuuacuaaua

SEQ ID NO: 3032527 - RNA, 13 nt, Human
guaauaaacucau

SEQ ID NO: 3032528 - RNA, 23 nt, Human
guaauccuagcacuuugggaggc

SEQ ID NO: 3032529 - RNA, 15 nt, Human
guaauuugugauaca

SEQ ID NO: 3032530 - RNA, 17 nt, Human
guaauuugugauacaau

SEQ ID NO: 3032531 - RNA, 20 nt, Human
guaauuugugauacaaugcu

SEQ ID NO: 3032532 - RNA, 21 nt, Human
guaauuuuuuuaucgucacug

SEQ ID NO: 3032533 - RNA, 21 nt, Human
aaagggguaggguuuaaagau

SEQ ID NO: 3032534 - RNA, 20 nt, Human
aaagggcccagagagggugg

SEQ ID NO: 3032535 - RNA, 19 nt, Human
gguggggaccucaggccug

SEQ ID NO: 3032536 - RNA, 16 nt, Human
ggugggacacccugug

SEQ ID NO: 3032537 - RNA, 13 nt, Human
ggugggacacccu

SEQ ID NO: 3032538 - RNA, 17 nt, Human
ggugggacacccuguga

SEQ ID NO: 3032539 - RNA, 18 nt, Human
gguggcuggguuggaggg

SEQ ID NO: 3032540 - RNA, 12 nt, Human
gguggcuggguu

SEQ ID NO: 3032541 - RNA, 20 nt, Human
gguggcaccagcagccugga

SEQ ID NO: 3032542 - RNA, 14 nt, Human
gguggcaccagcag

SEQ ID NO: 3032543 - RNA, 21 nt, Human
ggugcugccauccagguucag

SEQ ID NO: 3032544 - RNA, 14 nt, Human
aaagcuaggccugg

SEQ ID NO: 3032545 - RNA, 16 nt, Human
aaagcuaggccuggcc

SEQ ID NO: 3032546 - RNA, 13 nt, Human
aaagcagugcaug

SEQ ID NO: 3032547 - RNA, 13 nt, Human
aaagcugccagcc

SEQ ID NO: 3032548 - RNA, 12 nt, Human
aaagcugccagc

SEQ ID NO: 3032549 - RNA, 22 nt, Human
aaagcugccagccgagauagcc

SEQ ID NO: 3032550 - RNA, 20 nt, Human
gguuuguaaauuaacuuuua

SEQ ID NO: 3032551 - RNA, 22 nt, Human
gguuucuaaagcugccagccga

SEQ ID NO: 3032552 - RNA, 16 nt, Human
gguuucuaaagcugcc

SEQ ID NO: 3032553 - RNA, 15 nt, Human
gguuucagaaaugug

SEQ ID NO: 3032554 - RNA, 14 nt, Human
aaaguguauuuuuu

SEQ ID NO: 3032555 - RNA, 21 nt, Human
aaaguguauuuuuuuacuaau

SEQ ID NO: 3032556 - RNA, 21 nt, Human
aaaguaucccuacuguaauuu

SEQ ID NO: 3032557 - RNA, 20 nt, Human
aaaguagaagucuuagaugu

SEQ ID NO: 3032558 - RNA, 22 nt, Human
aaaguagaagucuuagauguau

SEQ ID NO: 3032559 - RNA, 18 nt, Human
aaaguacacuguuucaaa

SEQ ID NO: 3032560 - RNA, 19 nt, Human
aaaguacacuguuucaaac

SEQ ID NO: 3032561 - RNA, 22 nt, Human
gguucccuuugacgccauccca

SEQ ID NO: 3032562 - RNA, 23 nt, Human
gguucccuuugacgccaucccag

SEQ ID NO: 3032563 - RNA, 22 nt, Human
gguucccuuuuuuggcugcuga

SEQ ID NO: 3032564 - RNA, 17 nt, Human
gguucccauuugcuccu

SEQ ID NO: 3032565 - RNA, 19 nt, Human
gguguuuccuggcacugcu

SEQ ID NO: 3032566 - RNA, 17 nt, Human
gguguuuccuggcacug

SEQ ID NO: 3032567 - RNA, 13 nt, Human
ggugggggccucg

SEQ ID NO: 3032568 - RNA, 12 nt, Human
gguguggagaag

SEQ ID NO: 3032569 - RNA, 23 nt, Human
gguguggagaagcggcuggcagc

SEQ ID NO: 3032570 - RNA, 14 nt, Human
gguguggagaagcg

SEQ ID NO: 3032571 - RNA, 13 nt, Human
ggugugggggaag

SEQ ID NO: 3032572 - RNA, 11 nt, Human
gguguggggga

SEQ ID NO: 3032573 - RNA, 15 nt, Human
ggcacaucauuucaa

SEQ ID NO: 3032574 - RNA, 14 nt, Human
ggcacaucauuuca

SEQ ID NO: 3032575 - RNA, 18 nt, Human
ggcacaucagcacgauuu

SEQ ID NO: 3032576 - RNA, 16 nt, Human
ggcacugcuuccagug

SEQ ID NO: 3032577 - RNA, 18 nt, Human
ggcacaccgggcacucag

SEQ ID NO: 3032578 - RNA, 15 nt, Human
ggcaaaaaggcagga

SEQ ID NO: 3032579 - RNA, 18 nt, Human
ggcaggaggaucacuuga

SEQ ID NO: 3032580 - RNA, 16 nt, Human
ggcagccccauucugc

SEQ ID NO: 3032581 - RNA, 20 nt, Human
ggcagccccauucugccugc

SEQ ID NO: 3032582 - RNA, 21 nt, Human
ggcagccccauucugccugcc

SEQ ID NO: 3032583 - RNA, 22 nt, Human
ggcagccccauucugccugccc

SEQ ID NO: 3032584 - RNA, 13 nt, Human
ggcagccaggcca

SEQ ID NO: 3032585 - RNA, 20 nt, Human
ggcacugcuuccagugaggc

SEQ ID NO: 3032586 - RNA, 14 nt, Human
ggcauuugcugaau

SEQ ID NO: 3032587 - RNA, 19 nt, Human
ggccaaaggaagcacaugc

SEQ ID NO: 3032588 - RNA, 16 nt, Human
ggccaaaggaagcaca

SEQ ID NO: 3032589 - RNA, 14 nt, Human
ggccaaaggaagca

SEQ ID NO: 3032590 - RNA, 17 nt, Human
ggcauuuguuugaacug

SEQ ID NO: 3032591 - RNA, 13 nt, Human
ggccaaaggaagc

SEQ ID NO: 3032592 - RNA, 17 nt, Human
ggccagagggagugaca

SEQ ID NO: 3032593 - RNA, 19 nt, Human
ggccagagggagugacaga

SEQ ID NO: 3032594 - RNA, 18 nt, Human
ggccagagacacaagccu

SEQ ID NO: 3032595 - RNA, 17 nt, Human
ggccagagacacaagcc

SEQ ID NO: 3032596 - RNA, 23 nt, Human
ggauugugccuaauguguuugag

SEQ ID NO: 3032597 - RNA, 12 nt, Human
ggauuuaacaga

SEQ ID NO: 3032598 - RNA, 20 nt, Human
ggauuguccccgacccuugc

SEQ ID NO: 3032599 - RNA, 16 nt, Human
ggauuguccccgaccc

SEQ ID NO: 3032600 - RNA, 22 nt, Human
ggauuuaacagaaauguacagc

SEQ ID NO: 3032601 - RNA, 16 nt, Human
ggauuuaacagaaaug

SEQ ID NO: 3032602 - RNA, 17 nt, Human
ggauuuaacagaaaugu

SEQ ID NO: 3032603 - RNA, 14 nt, Human
ggaugaaaaaauaa

SEQ ID NO: 3032604 - RNA, 13 nt, Human
ggauuguccccga

SEQ ID NO: 3032605 - RNA, 18 nt, Human
ggaucucuugagccuggg

SEQ ID NO: 3032606 - RNA, 23 nt, Human
ggauccugagccagauuucacuc

SEQ ID NO: 3032607 - RNA, 20 nt, Human
ggauccugagccagauuuca

SEQ ID NO: 3032608 - RNA, 19 nt, Human
ggauccugagccagauuuc

SEQ ID NO: 3032609 - RNA, 18 nt, Human
ggauccugagccagauuu

SEQ ID NO: 3032610 - RNA, 16 nt, Human
ggauccugagccagau

SEQ ID NO: 3032611 - RNA, 15 nt, Human
ggauccugagccaga

SEQ ID NO: 3032612 - RNA, 16 nt, Human
ggaguucaucuugaau

SEQ ID NO: 3032613 - RNA, 19 nt, Human
ggaguuauugaagcagagu

SEQ ID NO: 3032614 - RNA, 15 nt, Human
ggaguggccacagaa

SEQ ID NO: 3032615 - RNA, 22 nt, Human
ggagugggcccaaugcacuuug

SEQ ID NO: 3032616 - RNA, 12 nt, Human
ggagugggccca

SEQ ID NO: 3032617 - RNA, 16 nt, Human
ggaguggccacagaaa

SEQ ID NO: 3032618 - RNA, 22 nt, Human
ggagguaaggaauaccuguccc

SEQ ID NO: 3032619 - RNA, 21 nt, Human
ggagggugacgggggugaacu

SEQ ID NO: 3032620 - RNA, 23 nt, Human
ggaggugggauccuccaggugca

SEQ ID NO: 3032621 - RNA, 22 nt, Human
ggaggugggauccuccaggugc

SEQ ID NO: 3032622 - RNA, 14 nt, Human
ggaggggggaggug

SEQ ID NO: 3032623 - RNA, 13 nt, Human
ggaggggggaggu

SEQ ID NO: 3032624 - RNA, 15 nt, Human
ggcuaacuuggguua

SEQ ID NO: 3032625 - RNA, 20 nt, Human
ggcuaagugauccucccacc

SEQ ID NO: 3032626 - RNA, 16 nt, Human
ggcuaauguacugcau

SEQ ID NO: 3032627 - RNA, 13 nt, Human
ggcuaccuuugua

SEQ ID NO: 3032628 - RNA, 14 nt, Human
ggcuaccuuuguau

SEQ ID NO: 3032629 - RNA, 16 nt, Human
ggccugcaagggagug

SEQ ID NO: 3032630 - RNA, 16 nt, Human
ggccuggccagaugca

SEQ ID NO: 3032631 - RNA, 12 nt, Human
ggccuggccaga

SEQ ID NO: 3032632 - RNA, 15 nt, Human
ggccuggccagaugc

SEQ ID NO: 3032633 - RNA, 23 nt, Human
ggccucccaacucaccccagccc

SEQ ID NO: 3032634 - RNA, 22 nt, Human
ggccucccaacucaccccagcc

SEQ ID NO: 3032635 - RNA, 20 nt, Human
ggccucccaacucaccccag

SEQ ID NO: 3032636 - RNA, 13 nt, Human
ggccucagugcca

SEQ ID NO: 3032637 - RNA, 17 nt, Human
ggccucccaacucaccc

SEQ ID NO: 3032638 - RNA, 19 nt, Human
ggccucccaacucacccca

SEQ ID NO: 3032639 - RNA, 18 nt, Human
ggccucccaacucacccc

SEQ ID NO: 3032640 - RNA, 15 nt, Human
ggccagaugcaccag

SEQ ID NO: 3032641 - RNA, 16 nt, Human
ggccagaugcaccagc

SEQ ID NO: 3032642 - RNA, 13 nt, Human
ggcucacugcagc

SEQ ID NO: 3032643 - RNA, 14 nt, Human
ggcucacugcagcc

SEQ ID NO: 3032644 - RNA, 15 nt, Human
ggcucacugcagccu

SEQ ID NO: 3032645 - RNA, 14 nt, Human
ggcucuuccaggcu

SEQ ID NO: 3032646 - RNA, 15 nt, Human
ggcucuuccaggcug

SEQ ID NO: 3032647 - RNA, 18 nt, Human
ggcucuuccaggcuggga

SEQ ID NO: 3032648 - RNA, 17 nt, Human
ggcucuuccaggcuggg

SEQ ID NO: 3032649 - RNA, 13 nt, Human
ggcucccuuccca

SEQ ID NO: 3032650 - RNA, 13 nt, Human
ggcuggccuggcc

SEQ ID NO: 3032651 - RNA, 15 nt, Human
ggcuggccuggcccc

SEQ ID NO: 3032652 - RNA, 14 nt, Human
ggcuggccuggccc

SEQ ID NO: 3032653 - RNA, 22 nt, Human
aaaaaacugcugacuguuuucu

SEQ ID NO: 3032654 - RNA, 14 nt, Human
aaaaaggaggaaga

SEQ ID NO: 3032655 - RNA, 21 nt, Human
aaaaaggaugcacagaguugu

SEQ ID NO: 3032656 - RNA, 12 nt, Human
aaaaaggcagga

SEQ ID NO: 3032657 - RNA, 14 nt, Human
ggcuggguuggagg

SEQ ID NO: 3032658 - RNA, 22 nt, Human
ggcuggguucuacccaggugcu

SEQ ID NO: 3032659 - RNA, 19 nt, Human
caauaaacauuucauuucc

SEQ ID NO: 3032660 - RNA, 14 nt, Human
cacaagccuucggc

SEQ ID NO: 3032661 - RNA, 16 nt, Human
cacaagacccuugugg

SEQ ID NO: 3032662 - RNA, 14 nt, Human
cacaagacccuugu

SEQ ID NO: 3032663 - RNA, 22 nt, Human
caaugcugugcccuaaagugua

SEQ ID NO: 3032664 - RNA, 22 nt, Human
caaugcuggcuguuggcugggg

SEQ ID NO: 3032665 - RNA, 23 nt, Human
caaugcuggcuguuggcuggggg

SEQ ID NO: 3032666 - RNA, 16 nt, Human
cacaucuugcucugcu

SEQ ID NO: 3032667 - RNA, 17 nt, Human
cacaucuugcucugcug

SEQ ID NO: 3032668 - RNA, 22 nt, Human
cacaucagcacgauuucuguuu

SEQ ID NO: 3032669 - RNA, 20 nt, Human
cacaucagcacgauuucugu

SEQ ID NO: 3032670 - RNA, 21 nt, Human
cacaucagcacgauuucuguu

SEQ ID NO: 3032671 - RNA, 18 nt, Human
cacaucuugcucugcuga

SEQ ID NO: 3032672 - RNA, 15 nt, Human
cacauuuuauuuuau

SEQ ID NO: 3032673 - RNA, 17 nt, Human
caccaacauacucccau

SEQ ID NO: 3032674 - RNA, 21 nt, Human
caccaacauacucccaucugu

SEQ ID NO: 3032675 - RNA, 20 nt, Human
caccaacauacucccaucug

SEQ ID NO: 3032676 - RNA, 13 nt, Human
cacauuuuucuua

SEQ ID NO: 3032677 - RNA, 14 nt, Human
cacauuuuucuuag

SEQ ID NO: 3032678 - RNA, 17 nt, Human
cacauuuuuuaaaugca

SEQ ID NO: 3032679 - RNA, 21 nt, Human
cacauuuuuuaaaugcaccug

SEQ ID NO: 3032680 - RNA, 24 nt, Human
cacccaggagccccgaggccuucu

SEQ ID NO: 3032681 - RNA, 19 nt, Human
cacccagcccacuucugcc

SEQ ID NO: 3032682 - RNA, 20 nt, Human
cacccaggagccccgaggcc

SEQ ID NO: 3032683 - RNA, 23 nt, Human
cacccaggagccccgaggccuuc

SEQ ID NO: 3032684 - RNA, 21 nt, Human
caccagcccuuagcagggaaa

SEQ ID NO: 3032685 - RNA, 15 nt, Human
caccagcagccugga

SEQ ID NO: 3032686 - RNA, 12 nt, Human
caccagcagccu

SEQ ID NO: 3032687 - RNA, 14 nt, Human
caccagcagccugg

SEQ ID NO: 3032688 - RNA, 23 nt, Human
caccaacauacucccaucuguga

SEQ ID NO: 3032689 - RNA, 16 nt, Human
cacccagcccacuucu

SEQ ID NO: 3032690 - RNA, 17 nt, Human
cacccagcccacuucug

SEQ ID NO: 3032691 - RNA, 22 nt, Human
cacagcuaacauggaaguacua

SEQ ID NO: 3032692 - RNA, 20 nt, Human
cacagcucuguccugggagu

SEQ ID NO: 3032693 - RNA, 23 nt, Human
cacagcucuguccugggagugag

SEQ ID NO: 3032694 - RNA, 19 nt, Human
cacagcucuguccugggag

SEQ ID NO: 3032695 - RNA, 16 nt, Human
cacagcuaacauggaa

SEQ ID NO: 3032696 - RNA, 15 nt, Human
cacagcuaacaugga

SEQ ID NO: 3032697 - RNA, 19 nt, Human
cacagacccugcccugugg

SEQ ID NO: 3032698 - RNA, 21 nt, Human
cacagacccugcccugugggc

SEQ ID NO: 3032699 - RNA, 20 nt, Human
cacagacccugcccuguggg

SEQ ID NO: 3032700 - RNA, 16 nt, Human
cacaguauuacuucug

SEQ ID NO: 3032701 - RNA, 18 nt, Human
cacaguauuacuucugcu

SEQ ID NO: 3032702 - RNA, 13 nt, Human
caccuugcagcuc

SEQ ID NO: 3032703 - RNA, 15 nt, Human
caccuugcagcucuc

SEQ ID NO: 3032704 - RNA, 18 nt, Human
caccuugacagggcacac

SEQ ID NO: 3032705 - RNA, 19 nt, Human
caccuugacagggcacacc

SEQ ID NO: 3032706 - RNA, 17 nt, Human
caccugccagggacaga

SEQ ID NO: 3032707 - RNA, 22 nt, Human
caccuugcagcucuccccuucu

SEQ ID NO: 3032708 - RNA, 13 nt, Human
caccuuggcucaa

SEQ ID NO: 3032709 - RNA, 14 nt, Human
caccuuugaagaag

SEQ ID NO: 3032710 - RNA, 17 nt, Human
caccuuuguccccaccg

SEQ ID NO: 3032711 - RNA, 15 nt, Human
caccuuuguccccac

SEQ ID NO: 3032712 - RNA, 14 nt, Human
caccuuugucccca

SEQ ID NO: 3032713 - RNA, 13 nt, Human
caccugccaggga

SEQ ID NO: 3032714 - RNA, 16 nt, Human
caccugccagggacag

SEQ ID NO: 3032715 - RNA, 14 nt, Human
caccugccagggac

SEQ ID NO: 3032716 - RNA, 20 nt, Human
cacggagggugacgggggug

SEQ ID NO: 3032717 - RNA, 14 nt, Human
cacggccaggccag

SEQ ID NO: 3032718 - RNA, 15 nt, Human
cacggccaggccaga

SEQ ID NO: 3032719 - RNA, 16 nt, Human
cacggccaggccagag

SEQ ID NO: 3032720 - RNA, 23 nt, Human
cacuacggaauaguuggcuagga

SEQ ID NO: 3032721 - RNA, 17 nt, Human
cacucuuauugcccacg

SEQ ID NO: 3032722 - RNA, 18 nt, Human
cacucuuauugcccacgc

SEQ ID NO: 3032723 - RNA, 19 nt, Human
cacucuuauugcccacgcu

SEQ ID NO: 3032724 - RNA, 12 nt, Human
cacuugugaaua

SEQ ID NO: 3032725 - RNA, 11 nt, Human
cacuugugaau

SEQ ID NO: 3032726 - RNA, 17 nt, Human
cacuguugcccaggcug

SEQ ID NO: 3032727 - RNA, 19 nt, Human
cacuguuucaaacuuuacu

SEQ ID NO: 3032728 - RNA, 17 nt, Human
cacuggugacaugucuu

SEQ ID NO: 3032729 - RNA, 14 nt, Human
cacuguugcccagg

SEQ ID NO: 3032730 - RNA, 15 nt, Human
cacuguugcccaggc

SEQ ID NO: 3032731 - RNA, 16 nt, Human
cacuguugcccaggcu

SEQ ID NO: 3032732 - RNA, 23 nt, Human
cacugggcuuggggaccagagcu

SEQ ID NO: 3032733 - RNA, 20 nt, Human
cacugggcuuggggaccaga

SEQ ID NO: 3032734 - RNA, 22 nt, Human
cacugggcuuggggaccagagc

SEQ ID NO: 3032735 - RNA, 19 nt, Human
cagaaguuucugccgcagc

SEQ ID NO: 3032736 - RNA, 17 nt, Human
cagaaauguguuaucac

SEQ ID NO: 3032737 - RNA, 21 nt, Human
cagaaguuucugccgcagccc

SEQ ID NO: 3032738 - RNA, 20 nt, Human
cagaaguuucugccgcagcc

SEQ ID NO: 3032739 - RNA, 22 nt, Human
cagaaguuucugccgcagcccu

SEQ ID NO: 3032740 - RNA, 23 nt, Human
cagaaguuugagaucagccuggg

SEQ ID NO: 3032741 - RNA, 20 nt, Human
caagaaguccccucuccucc

SEQ ID NO: 3032742 - RNA, 15 nt, Human
caacucaccccagcc

SEQ ID NO: 3032743 - RNA, 13 nt, Human
caacucaccccag

SEQ ID NO: 3032744 - RNA, 16 nt, Human
caacucaccccagccc

SEQ ID NO: 3032745 - RNA, 22 nt, Human
caagacccuuguggucccaccc

SEQ ID NO: 3032746 - RNA, 19 nt, Human
caagacccuugugguccca

SEQ ID NO: 3032747 - RNA, 18 nt, Human
caagacccuugugguccc

SEQ ID NO: 3032748 - RNA, 15 nt, Human
caacccccagccugc

SEQ ID NO: 3032749 - RNA, 16 nt, Human
caacccccagccugcu

SEQ ID NO: 3032750 - RNA, 17 nt, Human
caacccccagccugcua

SEQ ID NO: 3032751 - RNA, 18 nt, Human
caaccacugcgaccacaa

SEQ ID NO: 3032752 - RNA, 23 nt, Human
caacaaaccuguuucugcagcca

SEQ ID NO: 3032753 - RNA, 14 nt, Human
caaagaugcagccg

SEQ ID NO: 3032754 - RNA, 13 nt, Human
caaagaugcagcc

SEQ ID NO: 3032755 - RNA, 21 nt, Human
caaaguacacuguuucaaacu

SEQ ID NO: 3032756 - RNA, 16 nt, Human
caaaguacacuguuuc

SEQ ID NO: 3032757 - RNA, 20 nt, Human
caaaguacacuguuucaaac

SEQ ID NO: 3032758 - RNA, 17 nt, Human
caaaucagcugcuacua

SEQ ID NO: 3032759 - RNA, 20 nt, Human
caacaccuuguuucccucuc

SEQ ID NO: 3032760 - RNA, 22 nt, Human
caacaccucugcacaagcugca

SEQ ID NO: 3032761 - RNA, 12 nt, Human
auuuuuuuuucc

SEQ ID NO: 3032762 - RNA, 16 nt, Human
auuuuuuuuuccuuca

SEQ ID NO: 3032763 - RNA, 13 nt, Human
auuuuuuuuuccu

SEQ ID NO: 3032764 - RNA, 13 nt, Human
auuuuuaagugcu

SEQ ID NO: 3032765 - RNA, 17 nt, Human
auuuuuuuuuccuucag

SEQ ID NO: 3032766 - RNA, 15 nt, Human
caaaagcugggcagg

SEQ ID NO: 3032767 - RNA, 14 nt, Human
auuuguuugaacug

SEQ ID NO: 3032768 - RNA, 16 nt, Human
auuuguuugaacugau

SEQ ID NO: 3032769 - RNA, 13 nt, Human
auuuguuugaacu

SEQ ID NO: 3032770 - RNA, 19 nt, Human
auucugagaugacuauuca

SEQ ID NO: 3032771 - RNA, 16 nt, Human
auucucuccuguaccu

SEQ ID NO: 3032772 - RNA, 21 nt, Human
auuccugaugcuucuucagag

SEQ ID NO: 3032773 - RNA, 19 nt, Human
auucucuccuguaccucuu

SEQ ID NO: 3032774 - RNA, 21 nt, Human
auucucuccuguaccucuuga

SEQ ID NO: 3032775 - RNA, 13 nt, Human
auucuuuccugag

SEQ ID NO: 3032776 - RNA, 22 nt, Human
auucuuuccugaggcugggcuc

SEQ ID NO: 3032777 - RNA, 17 nt, Human
auucuuuccugaggcug

SEQ ID NO: 3032778 - RNA, 20 nt, Human
auucauauuuacuucuuaua

SEQ ID NO: 3032779 - RNA, 18 nt, Human
auucauauuuacuucuua

SEQ ID NO: 3032780 - RNA, 19 nt, Human
auucauauuuacuucuuau

SEQ ID NO: 3032781 - RNA, 20 nt, Human
auuaaauucuugcaaaguau

SEQ ID NO: 3032782 - RNA, 14 nt, Human
auuaaauucuugca

SEQ ID NO: 3032783 - RNA, 18 nt, Human
auuaaauucuugcaaagu

SEQ ID NO: 3032784 - RNA, 15 nt, Human
auuucucauguugaa

SEQ ID NO: 3032785 - RNA, 14 nt, Human
auuucuguuuagau

SEQ ID NO: 3032786 - RNA, 16 nt, Human
auuucuguuuagauaa

SEQ ID NO: 3032787 - RNA, 12 nt, Human
auuucuguuuag

SEQ ID NO: 3032788 - RNA, 12 nt, Human
auuucaagaagu

SEQ ID NO: 3032789 - RNA, 23 nt, Human
auuucaagaaguccccucuccuc

SEQ ID NO: 3032790 - RNA, 14 nt, Human
auuuaaucuuuuau

SEQ ID NO: 3032791 - RNA, 17 nt, Human
auuuaaucuuuuaugau

SEQ ID NO: 3032792 - RNA, 14 nt, Human
auuuaaugaaagac

SEQ ID NO: 3032793 - RNA, 16 nt, Human
auuguaaggaaugauu

SEQ ID NO: 3032794 - RNA, 15 nt, Human
auuguaaggaaugau

SEQ ID NO: 3032795 - RNA, 19 nt, Human
auuguucuuaguuugcagu

SEQ ID NO: 3032796 - RNA, 20 nt, Human
cauuauauagcaguaaaaaa

SEQ ID NO: 3032797 - RNA, 16 nt, Human
cauuaguuuugaagau

SEQ ID NO: 3032798 - RNA, 17 nt, Human
cauuauauagcaguaaa

SEQ ID NO: 3032799 - RNA, 13 nt, Human
cauuaguuuugaa

SEQ ID NO: 3032800 - RNA, 14 nt, Human
cauuaguuuugaag

SEQ ID NO: 3032801 - RNA, 15 nt, Human
cauuaguuuugaaga

SEQ ID NO: 3032802 - RNA, 13 nt, Human
cauucuccaccug

SEQ ID NO: 3032803 - RNA, 16 nt, Human
cauucuccaccugcca

SEQ ID NO: 3032804 - RNA, 14 nt, Human
cauucuccaccugc

SEQ ID NO: 3032805 - RNA, 19 nt, Human
cauguuggccaggcugguc

SEQ ID NO: 3032806 - RNA, 16 nt, Human
cauguuggccaggcug

SEQ ID NO: 3032807 - RNA, 14 nt, Human
cauguuggccaggc

SEQ ID NO: 3032808 - RNA, 15 nt, Human
cauguuggccaggcu

SEQ ID NO: 3032809 - RNA, 17 nt, Human
caugggaaugaauguca

SEQ ID NO: 3032810 - RNA, 16 nt, Human
caugggaaugaauguc

SEQ ID NO: 3032811 - RNA, 15 nt, Human
caugggaaugaaugu

SEQ ID NO: 3032812 - RNA, 14 nt, Human
caugggaaugaaug

SEQ ID NO: 3032813 - RNA, 20 nt, Human
caugcuccuggcccacugca

SEQ ID NO: 3032814 - RNA, 13 nt, Human
caugauguuuucc

SEQ ID NO: 3032815 - RNA, 14 nt, Human
caugcuacacacug

SEQ ID NO: 3032816 - RNA, 20 nt, Human
caugcuacacacugcauguu

SEQ ID NO: 3032817 - RNA, 23 nt, Human
caugcuacacacugcauguuugu

SEQ ID NO: 3032818 - RNA, 18 nt, Human
caucuguuacacaaagaa

SEQ ID NO: 3032819 - RNA, 22 nt, Human
cauccuggcacccggccccugc

SEQ ID NO: 3032820 - RNA, 21 nt, Human
cauccccuguagagugggagc

SEQ ID NO: 3032821 - RNA, 12 nt, Human
caucacuucccu

SEQ ID NO: 3032822 - RNA, 14 nt, Human
caucacuucccuac

SEQ ID NO: 3032823 - RNA, 15 nt, Human
cauccuggcacccgg

SEQ ID NO: 3032824 - RNA, 14 nt, Human
cauauggauaaaua

SEQ ID NO: 3032825 - RNA, 19 nt, Human
caguggugguuuucuguuc

SEQ ID NO: 3032826 - RNA, 20 nt, Human
caguggugguuuucuguucu

SEQ ID NO: 3032827 - RNA, 21 nt, Human
caguggugguuuucuguucuu

SEQ ID NO: 3032828 - RNA, 22 nt, Human
caguggugguuuucuguucuuu

SEQ ID NO: 3032829 - RNA, 22 nt, Human
cauauucaggaagcucagggcc

SEQ ID NO: 3032830 - RNA, 17 nt, Human
cauauucuguuggccag

SEQ ID NO: 3032831 - RNA, 18 nt, Human
cauauucuguuggccagu

SEQ ID NO: 3032832 - RNA, 21 nt, Human
ccaauauuuaaucuuuuauga

SEQ ID NO: 3032833 - RNA, 17 nt, Human
ccaauauuuaccagacc

SEQ ID NO: 3032834 - RNA, 15 nt, Human
ccaaugauggucacc

SEQ ID NO: 3032835 - RNA, 14 nt, Human
ccaaugcacuuugu

SEQ ID NO: 3032836 - RNA, 18 nt, Human
ccaagcucugcuccucuc

SEQ ID NO: 3032837 - RNA, 12 nt, Human
ccaagcucugcu

SEQ ID NO: 3032838 - RNA, 17 nt, Human
ccaagcucugcuccucu

SEQ ID NO: 3032839 - RNA, 13 nt, Human
ccaagcucugcuc

SEQ ID NO: 3032840 - RNA, 18 nt, Human
ccaacucaccccagcccc

SEQ ID NO: 3032841 - RNA, 17 nt, Human
ccaacucaccccagccc

SEQ ID NO: 3032842 - RNA, 16 nt, Human
ccaacucaccccagcc

SEQ ID NO: 3032843 - RNA, 14 nt, Human
ccaacucaccccag

SEQ ID NO: 3032844 - RNA, 23 nt, Human
ccaaauggaaaugggcagagcag

SEQ ID NO: 3032845 - RNA, 14 nt, Human
ccaaugggagcuca

SEQ ID NO: 3032846 - RNA, 17 nt, Human
ccaaugggagcucaugg

SEQ ID NO: 3032847 - RNA, 21 nt, Human
ccaaaacucuccucugcugcu

SEQ ID NO: 3032848 - RNA, 20 nt, Human
ccaaaacucuccucugcugc

SEQ ID NO: 3032849 - RNA, 17 nt, Human
ccacucccugcaaccug

SEQ ID NO: 3032850 - RNA, 13 nt, Human
ccacgcccccacu

SEQ ID NO: 3032851 - RNA, 19 nt, Human
ccacgcccccacuggugac

SEQ ID NO: 3032852 - RNA, 18 nt, Human
ccacgcccccacugguga

SEQ ID NO: 3032853 - RNA, 17 nt, Human
ccacgcccccacuggug

SEQ ID NO: 3032854 - RNA, 16 nt, Human
ccacgcccccacuggu

SEQ ID NO: 3032855 - RNA, 21 nt, Human
ccaccuuugaagaaguaagga

SEQ ID NO: 3032856 - RNA, 19 nt, Human
ccaccgcagacaggaccag

SEQ ID NO: 3032857 - RNA, 22 nt, Human
ccaccgcagacaggaccaggga

SEQ ID NO: 3032858 - RNA, 15 nt, Human
ccaccaucaagccac

SEQ ID NO: 3032859 - RNA, 17 nt, Human
ccaccacacccagccca

SEQ ID NO: 3032860 - RNA, 14 nt, Human
ccaccaucaagcca

SEQ ID NO: 3032861 - RNA, 13 nt, Human
ccaccaucaagcc

SEQ ID NO: 3032862 - RNA, 21 nt, Human
caggcugggcuucaguggcag

SEQ ID NO: 3032863 - RNA, 22 nt, Human
caggcugggcuucaguggcagc

SEQ ID NO: 3032864 - RNA, 20 nt, Human
caggcugggcuucaguggca

SEQ ID NO: 3032865 - RNA, 15 nt, Human
caggcugggagagcc

SEQ ID NO: 3032866 - RNA, 14 nt, Human
caggcugggagagc

SEQ ID NO: 3032867 - RNA, 12 nt, Human
caggcugggaga

SEQ ID NO: 3032868 - RNA, 20 nt, Human
caggggaaaaucagccugcu

SEQ ID NO: 3032869 - RNA, 17 nt, Human
caggggaaaaucagccu

SEQ ID NO: 3032870 - RNA, 19 nt, Human
caggggaaaaucagccugc

SEQ ID NO: 3032871 - RNA, 21 nt, Human
cagggcucagcggggacagcu

SEQ ID NO: 3032872 - RNA, 23 nt, Human
cagggcucagcggggacagcucc

SEQ ID NO: 3032873 - RNA, 20 nt, Human
cagggcucagcggggacagc

SEQ ID NO: 3032874 - RNA, 18 nt, Human
caggcagauacaggaaaa

SEQ ID NO: 3032875 - RNA, 13 nt, Human
caggccagaggga

SEQ ID NO: 3032876 - RNA, 15 nt, Human
caggccagagggagu

SEQ ID NO: 3032877 - RNA, 23 nt, Human
caggccagcugcuugggcuucau

SEQ ID NO: 3032878 - RNA, 21 nt, Human
caggccagcugcuugggcuuc

SEQ ID NO: 3032879 - RNA, 19 nt, Human
caggccagcugcuugggcu

SEQ ID NO: 3032880 - RNA, 17 nt, Human
caggccagcugcuuggg

SEQ ID NO: 3032881 - RNA, 18 nt, Human
caggccaggcccucugcc

SEQ ID NO: 3032882 - RNA, 17 nt, Human
caggccaggcccucugc

SEQ ID NO: 3032883 - RNA, 19 nt, Human
caggccaggcccucugccc

SEQ ID NO: 3032884 - RNA, 15 nt, Human
caggugcacaagcuc

SEQ ID NO: 3032885 - RNA, 22 nt, Human
caggugauccacccaccucagc

SEQ ID NO: 3032886 - RNA, 23 nt, Human
caggugauccacccaccucagcc

SEQ ID NO: 3032887 - RNA, 20 nt, Human
caggugcacaagcuccaagc

SEQ ID NO: 3032888 - RNA, 19 nt, Human
caggugcacaagcuccaag

SEQ ID NO: 3032889 - RNA, 18 nt, Human
caggugcacaagcuccaa

SEQ ID NO: 3032890 - RNA, 17 nt, Human
caggugcacaagcucca

SEQ ID NO: 3032891 - RNA, 21 nt, Human
caggugauccacccaccucag

SEQ ID NO: 3032892 - RNA, 20 nt, Human
caggugauccacccaccuca

SEQ ID NO: 3032893 - RNA, 16 nt, Human
cagguuuuccugaaga

SEQ ID NO: 3032894 - RNA, 12 nt, Human
cagguuuuccug

SEQ ID NO: 3032895 - RNA, 14 nt, Human
cagguuuaagcugu

SEQ ID NO: 3032896 - RNA, 21 nt, Human
cagguuggugggggccucggu

SEQ ID NO: 3032897 - RNA, 21 nt, Human
caggugcacaagcuccaagcu

SEQ ID NO: 3032898 - RNA, 20 nt, Human
caguggugcgaucuggguuc

SEQ ID NO: 3032899 - RNA, 21 nt, Human
caguggugcgaucuggguuca

SEQ ID NO: 3032900 - RNA, 18 nt, Human
caguggugguuuucuguu

SEQ ID NO: 3032901 - RNA, 13 nt, Human
cagugcccacagg

SEQ ID NO: 3032902 - RNA, 15 nt, Human
cagugcccacaggau

SEQ ID NO: 3032903 - RNA, 17 nt, Human
cagugcaugcugucccu

SEQ ID NO: 3032904 - RNA, 16 nt, Human
cagugcaugcuguccc

SEQ ID NO: 3032905 - RNA, 17 nt, Human
cagugcccacaggauca

SEQ ID NO: 3032906 - RNA, 20 nt, Human
cagugggagcugccuguuca

SEQ ID NO: 3032907 - RNA, 23 nt, Human
cagugggagcugccuguucagcu

SEQ ID NO: 3032908 - RNA, 14 nt, Human
cagugcaugcuguc

SEQ ID NO: 3032909 - RNA, 13 nt, Human
cagugcaugcugu

SEQ ID NO: 3032910 - RNA, 15 nt, Human
cagucuggaaugcag

SEQ ID NO: 3032911 - RNA, 17 nt, Human
cagucuggaaugcagug

SEQ ID NO: 3032912 - RNA, 20 nt, Human
cagcaucauggagguuugaa

SEQ ID NO: 3032913 - RNA, 17 nt, Human
cagauugcaacaggcug

SEQ ID NO: 3032914 - RNA, 22 nt, Human
cagauucuuuccugaggcuggg

SEQ ID NO: 3032915 - RNA, 20 nt, Human
cagauucuuuccugaggcug

SEQ ID NO: 3032916 - RNA, 16 nt, Human
cagcacgauuucuguu

SEQ ID NO: 3032917 - RNA, 18 nt, Human
cagcacgauuucuguuua

SEQ ID NO: 3032918 - RNA, 19 nt, Human
cagcacgauuucuguuuag

SEQ ID NO: 3032919 - RNA, 23 nt, Human
cagaggggguggccucccaacuc

SEQ ID NO: 3032920 - RNA, 22 nt, Human
cagaggggguggccucccaacu

SEQ ID NO: 3032921 - RNA, 19 nt, Human
cagauucuuuccugaggcu

SEQ ID NO: 3032922 - RNA, 18 nt, Human
cagauucuuuccugaggc

SEQ ID NO: 3032923 - RNA, 17 nt, Human
cagauucuuuccugagg

SEQ ID NO: 3032924 - RNA, 15 nt, Human
cagauucuuuccuga

SEQ ID NO: 3032925 - RNA, 18 nt, Human
cagcggggacagcuccuu

SEQ ID NO: 3032926 - RNA, 19 nt, Human
cagcggggacagcuccuuc

SEQ ID NO: 3032927 - RNA, 21 nt, Human
cagcggggacagcuccuucug

SEQ ID NO: 3032928 - RNA, 19 nt, Human
cagccugcuaauuccccag

SEQ ID NO: 3032929 - RNA, 12 nt, Human
cagccugcucca

SEQ ID NO: 3032930 - RNA, 19 nt, Human
cagccgagauagccaaggc

SEQ ID NO: 3032931 - RNA, 17 nt, Human
cagccucugaaaaccaa

SEQ ID NO: 3032932 - RNA, 18 nt, Human
caggaaaagcugcugaca

SEQ ID NO: 3032933 - RNA, 15 nt, Human
caggaaaagcugcug

SEQ ID NO: 3032934 - RNA, 16 nt, Human
caggaaaagcugcuga

SEQ ID NO: 3032935 - RNA, 19 nt, Human
cagcugagggugagugggu

SEQ ID NO: 3032936 - RNA, 12 nt, Human
cagcugccuggg

SEQ ID NO: 3032937 - RNA, 14 nt, Human
cagcugccugggau

SEQ ID NO: 3032938 - RNA, 13 nt, Human
cagcugccuggga

SEQ ID NO: 3032939 - RNA, 19 nt, Human
cagcugugcucuggacagg

SEQ ID NO: 3032940 - RNA, 20 nt, Human
cagcugugcucuggacaggc

SEQ ID NO: 3032941 - RNA, 24 nt, Human
cagcugugcucuggacaggcaugu

SEQ ID NO: 3032942 - RNA, 19 nt, Human
cagcuguucagcugguuga

SEQ ID NO: 3032943 - RNA, 20 nt, Human
ccaggauuauugucaaagaa

SEQ ID NO: 3032944 - RNA, 14 nt, Human
ccaggcugggagag

SEQ ID NO: 3032945 - RNA, 13 nt, Human
ccaggcugggaga

SEQ ID NO: 3032946 - RNA, 21 nt, Human
ccaggcugggagagccuucca

SEQ ID NO: 3032947 - RNA, 18 nt, Human
ccaggcugggagagccuu

SEQ ID NO: 3032948 - RNA, 17 nt, Human
ccaggcugggagagccu

SEQ ID NO: 3032949 - RNA, 15 nt, Human
ccaggcugggagagc

SEQ ID NO: 3032950 - RNA, 22 nt, Human
ccaggcugggagagccuuccag

SEQ ID NO: 3032951 - RNA, 19 nt, Human
ccaggcuggcgugcagugg

SEQ ID NO: 3032952 - RNA, 19 nt, Human
ccagucaccccggccaccu

SEQ ID NO: 3032953 - RNA, 21 nt, Human
ccagucaccccggccaccugc

SEQ ID NO: 3032954 - RNA, 20 nt, Human
ccagucaccccggccaccug

SEQ ID NO: 3032955 - RNA, 13 nt, Human
ccagucaccccgg

SEQ ID NO: 3032956 - RNA, 12 nt, Human
ccagucaccccg

SEQ ID NO: 3032957 - RNA, 19 nt, Human
ccagcagagcaccuuagac

SEQ ID NO: 3032958 - RNA, 23 nt, Human
ccagcagagcaccuuagacaguc

SEQ ID NO: 3032959 - RNA, 16 nt, Human
ccagcuuaucucaggg

SEQ ID NO: 3032960 - RNA, 21 nt, Human
ccaggaaaggcuccaggagca

SEQ ID NO: 3032961 - RNA, 23 nt, Human
ccaggaaaggcuccaggagcagc

SEQ ID NO: 3032962 - RNA, 22 nt, Human
ccaggaaaggcuccaggagcag

SEQ ID NO: 3032963 - RNA, 21 nt, Human
ccagccccuggaugcagccuc

SEQ ID NO: 3032964 - RNA, 10 nt, Human
ccagccccuu

SEQ ID NO: 3032965 - RNA, 14 nt, Human
ccagcagccuggac

SEQ ID NO: 3032966 - RNA, 15 nt, Human
ccagcagccuggacc

SEQ ID NO: 3032967 - RNA, 20 nt, Human
ccagcagccuggacccugug

SEQ ID NO: 3032968 - RNA, 19 nt, Human
ccagcagccuggacccugu

SEQ ID NO: 3032969 - RNA, 16 nt, Human
ccauccccuguagagu

SEQ ID NO: 3032970 - RNA, 13 nt, Human
ccaugagccucag

SEQ ID NO: 3032971 - RNA, 14 nt, Human
ccaugagccucagc

SEQ ID NO: 3032972 - RNA, 18 nt, Human
ccaugagccucagcaucc

SEQ ID NO: 3032973 - RNA, 19 nt, Human
ccaugagccucagcauccu

SEQ ID NO: 3032974 - RNA, 13 nt, Human
ccaugaguccccu

SEQ ID NO: 3032975 - RNA, 13 nt, Human
ccaugggccuccu

SEQ ID NO: 3032976 - RNA, 16 nt, Human
ccaugaguccccuguu

SEQ ID NO: 3032977 - RNA, 15 nt, Human
ccaugaguccccugu

SEQ ID NO: 3032978 - RNA, 14 nt, Human
ccaugaguccccug

SEQ ID NO: 3032979 - RNA, 23 nt, Human
ccaucccaaacccuucagugcca

SEQ ID NO: 3032980 - RNA, 12 nt, Human
ccaucccagccc

SEQ ID NO: 3032981 - RNA, 14 nt, Human
ccaugggccuccug

SEQ ID NO: 3032982 - RNA, 15 nt, Human
ccaugggccuccugu

SEQ ID NO: 3032983 - RNA, 20 nt, Human
cccucaacucuccuccagag

SEQ ID NO: 3032984 - RNA, 17 nt, Human
ccccuucugacccaugc

SEQ ID NO: 3032985 - RNA, 16 nt, Human
ccccuucugacccaug

SEQ ID NO: 3032986 - RNA, 12 nt, Human
cccggcugcgga

SEQ ID NO: 3032987 - RNA, 15 nt, Human
ccccauucugccugc

SEQ ID NO: 3032988 - RNA, 13 nt, Human
ccccauucugccu

SEQ ID NO: 3032989 - RNA, 14 nt, Human
ccccauucugccug

SEQ ID NO: 3032990 - RNA, 19 nt, Human
ccccuucgcuccugugucu

SEQ ID NO: 3032991 - RNA, 14 nt, Human
ccccuucgcuccug

SEQ ID NO: 3032992 - RNA, 15 nt, Human
ccccuucgcuccugu

SEQ ID NO: 3032993 - RNA, 17 nt, Human
ccccuucgcuccugugu

SEQ ID NO: 3032994 - RNA, 21 nt, Human
ccccagauugcaacaggcugg

SEQ ID NO: 3032995 - RNA, 22 nt, Human
ccccagauugcaacaggcuggg

SEQ ID NO: 3032996 - RNA, 23 nt, Human
ccccagauugcaacaggcugggc

SEQ ID NO: 3032997 - RNA, 17 nt, Human
ccccagcaagugagagc

SEQ ID NO: 3032998 - RNA, 19 nt, Human
ccccagcaagugagagcug

SEQ ID NO: 3032999 - RNA, 20 nt, Human
ccccagcaagugagagcugg

SEQ ID NO: 3033000 - RNA, 17 nt, Human
ccccauccucuguacag

SEQ ID NO: 3033001 - RNA, 22 nt, Human
ccccauccucuguacagagccc

SEQ ID NO: 3033002 - RNA, 21 nt, Human
ccccauccucuguacagagcc

SEQ ID NO: 3033003 - RNA, 19 nt, Human
ccccauccucuguacagag

SEQ ID NO: 3033004 - RNA, 20 nt, Human
cccauucugccugcccaggc

SEQ ID NO: 3033005 - RNA, 21 nt, Human
cccauucugccugcccaggcc

SEQ ID NO: 3033006 - RNA, 22 nt, Human
cccauucugccugcccaggccc

SEQ ID NO: 3033007 - RNA, 14 nt, Human
cccagcccacuucu

SEQ ID NO: 3033008 - RNA, 23 nt, Human
cccaggaaaggcuccaggagcag

SEQ ID NO: 3033009 - RNA, 22 nt, Human
cccaggaaaggcuccaggagca

SEQ ID NO: 3033010 - RNA, 21 nt, Human
cccaggaaaggcuccaggagc

SEQ ID NO: 3033011 - RNA, 21 nt, Human
cccagcugugcucuggacagg

SEQ ID NO: 3033012 - RNA, 23 nt, Human
cccagcugugcucuggacaggca

SEQ ID NO: 3033013 - RNA, 19 nt, Human
cccaggaaaggcuccagga

SEQ ID NO: 3033014 - RNA, 15 nt, Human
cccaggcuuagucac

SEQ ID NO: 3033015 - RNA, 21 nt, Human
cccaggcuggcgugcaguggu

SEQ ID NO: 3033016 - RNA, 20 nt, Human
ccucaugcugccaauauccu

SEQ ID NO: 3033017 - RNA, 21 nt, Human
ccucaugcugccaauauccua

SEQ ID NO: 3033018 - RNA, 21 nt, Human
ccucauuuuuauaaugucccu

SEQ ID NO: 3033019 - RNA, 15 nt, Human
ccucccaccucagcc

SEQ ID NO: 3033020 - RNA, 17 nt, Human
ccucccaccucagccuc

SEQ ID NO: 3033021 - RNA, 16 nt, Human
ccucccaucucacaca

SEQ ID NO: 3033022 - RNA, 13 nt, Human
ccucccaucucac

SEQ ID NO: 3033023 - RNA, 14 nt, Human
ccggccccugcugg

SEQ ID NO: 3033024 - RNA, 19 nt, Human
cccugucuccucucucugu

SEQ ID NO: 3033025 - RNA, 17 nt, Human
cccugugauggggcccu

SEQ ID NO: 3033026 - RNA, 13 nt, Human
cccuucgcuccug

SEQ ID NO: 3033027 - RNA, 20 nt, Human
cccugugauggggcccugcc

SEQ ID NO: 3033028 - RNA, 19 nt, Human
cccugugauggggcccugc

SEQ ID NO: 3033029 - RNA, 18 nt, Human
cccugugauggggcccug

SEQ ID NO: 3033030 - RNA, 13 nt, Human
cccugucuaauga

SEQ ID NO: 3033031 - RNA, 16 nt, Human
cccugucuaaugaaac

SEQ ID NO: 3033032 - RNA, 23 nt, Human
cccugucucaaaaaaagaaaaag

SEQ ID NO: 3033033 - RNA, 20 nt, Human
cccugucucaaaaaaagaaa

SEQ ID NO: 3033034 - RNA, 14 nt, Human
cccuucgcuccugu

SEQ ID NO: 3033035 - RNA, 15 nt, Human
cccuucgcuccugug

SEQ ID NO: 3033036 - RNA, 21 nt, Human
cccuucucuccagccccugga

SEQ ID NO: 3033037 - RNA, 22 nt, Human
cccuucucuccagccccuggau

SEQ ID NO: 3033038 - RNA, 13 nt, Human
ccggccccugcug

SEQ ID NO: 3033039 - RNA, 17 nt, Human
ccugucggagcccuguc

SEQ ID NO: 3033040 - RNA, 21 nt, Human
ccugucggagcccugucuccu

SEQ ID NO: 3033041 - RNA, 16 nt, Human
ccugucggagcccugu

SEQ ID NO: 3033042 - RNA, 21 nt, Human
ccugguggcagugggagcugc

SEQ ID NO: 3033043 - RNA, 22 nt, Human
ccugucggagcccugucuccuc

SEQ ID NO: 3033044 - RNA, 15 nt, Human
ccugucuaaugaaac

SEQ ID NO: 3033045 - RNA, 22 nt, Human
ccugucuaaugaaaccuguguc

SEQ ID NO: 3033046 - RNA, 22 nt, Human
ccuggccucugcacuccccugc

SEQ ID NO: 3033047 - RNA, 21 nt, Human
ccuggccucugcacuccccug

SEQ ID NO: 3033048 - RNA, 20 nt, Human
ccuggccucugcacuccccu

SEQ ID NO: 3033049 - RNA, 22 nt, Human
ccuggccuagcauacguacaca

SEQ ID NO: 3033050 - RNA, 16 nt, Human
ccuggccucugcacuc

SEQ ID NO: 3033051 - RNA, 13 nt, Human
ccugcccaggccc

SEQ ID NO: 3033052 - RNA, 13 nt, Human
ccugcccaccugg

SEQ ID NO: 3033053 - RNA, 20 nt, Human
ccugcccaccuggccucugc

SEQ ID NO: 3033054 - RNA, 14 nt, Human
ccugcccaccuggc

SEQ ID NO: 3033055 - RNA, 12 nt, Human
ccugcccaccug

SEQ ID NO: 3033056 - RNA, 20 nt, Human
ccugcugcaguugccaguca

SEQ ID NO: 3033057 - RNA, 19 nt, Human
ccugccucgaacuggcugc

SEQ ID NO: 3033058 - RNA, 21 nt, Human
ccugccucgaacuggcugcaa

SEQ ID NO: 3033059 - RNA, 23 nt, Human
ccugccucgaacuggcugcaaag

SEQ ID NO: 3033060 - RNA, 19 nt, Human
ccugcugcaguugccaguc

SEQ ID NO: 3033061 - RNA, 17 nt, Human
ccugcugcaguugccag

SEQ ID NO: 3033062 - RNA, 18 nt, Human
ccugcacuugcagacucu

SEQ ID NO: 3033063 - RNA, 14 nt, Human
ccugcagagggcac

SEQ ID NO: 3033064 - RNA, 16 nt, Human
ccugcacuugcagacu

SEQ ID NO: 3033065 - RNA, 17 nt, Human
ccugcacuugcagacuc

SEQ ID NO: 3033066 - RNA, 13 nt, Human
ccucuuucccucc

SEQ ID NO: 3033067 - RNA, 11 nt, Human
ccucuuucccu

SEQ ID NO: 3033068 - RNA, 21 nt, Human
cuauuaaacaugcuguacaua

SEQ ID NO: 3033069 - RNA, 17 nt, Human
cuaucucccccagcccc

SEQ ID NO: 3033070 - RNA, 16 nt, Human
cuaucucccccagccc

SEQ ID NO: 3033071 - RNA, 21 nt, Human
cuauuuuuguuuuuauuaaaa

SEQ ID NO: 3033072 - RNA, 15 nt, Human
cuauuuuuguuuuua

SEQ ID NO: 3033073 - RNA, 18 nt, Human
cucaaaagcugggcaggu

SEQ ID NO: 3033074 - RNA, 21 nt, Human
cucaaacuaacaggcuuagug

SEQ ID NO: 3033075 - RNA, 20 nt, Human
cucaaacucuugaccucagg

SEQ ID NO: 3033076 - RNA, 21 nt, Human
cucaauaaacauuucauuucc

SEQ ID NO: 3033077 - RNA, 17 nt, Human
cucaauaaacauuucau

SEQ ID NO: 3033078 - RNA, 13 nt, Human
cucaauugugaaa

SEQ ID NO: 3033079 - RNA, 12 nt, Human
cucaauugugaa

SEQ ID NO: 3033080 - RNA, 13 nt, Human
cucaaugcacuga

SEQ ID NO: 3033081 - RNA, 15 nt, Human
cucaaugcacugaca

SEQ ID NO: 3033082 - RNA, 12 nt, Human
cuagccagagga

SEQ ID NO: 3033083 - RNA, 15 nt, Human
cuagccagaggagag

SEQ ID NO: 3033084 - RNA, 13 nt, Human
cuagccagaggag

SEQ ID NO: 3033085 - RNA, 23 nt, Human
cuaguuguuugauucagacagcu

SEQ ID NO: 3033086 - RNA, 22 nt, Human
cuaguuguuugauucagacagc

SEQ ID NO: 3033087 - RNA, 13 nt, Human
cuaguuugauuaa

SEQ ID NO: 3033088 - RNA, 21 nt, Human
cuaguuugauuaaauucuugc

SEQ ID NO: 3033089 - RNA, 22 nt, Human
cuaguuugauuaaauucuugca

SEQ ID NO: 3033090 - RNA, 15 nt, Human
cuaucucccccagcc

SEQ ID NO: 3033091 - RNA, 14 nt, Human
cuaucuaaauguug

SEQ ID NO: 3033092 - RNA, 20 nt, Human
cgugugugugcguccugucg

SEQ ID NO: 3033093 - RNA, 15 nt, Human
cuaauaaaaagguga

SEQ ID NO: 3033094 - RNA, 14 nt, Human
cuaauaaaaaggug

SEQ ID NO: 3033095 - RNA, 13 nt, Human
cuaauaaaaaggu

SEQ ID NO: 3033096 - RNA, 11 nt, Human
cuaauaaaaag

SEQ ID NO: 3033097 - RNA, 23 nt, Human
cuaaguuuuuauggcuuuugugc

SEQ ID NO: 3033098 - RNA, 23 nt, Human
cuaagugauccucccaccucagc

SEQ ID NO: 3033099 - RNA, 21 nt, Human
cuaagugguacuaacuuuccu

SEQ ID NO: 3033100 - RNA, 20 nt, Human
cuaaguuuuuauggcuuuug

SEQ ID NO: 3033101 - RNA, 17 nt, Human
cuaccuuuguauucucu

SEQ ID NO: 3033102 - RNA, 20 nt, Human
cuacaguccucccaucucac

SEQ ID NO: 3033103 - RNA, 21 nt, Human
cuacaguugaaaaacagcuga

SEQ ID NO: 3033104 - RNA, 19 nt, Human
cuacaguugaaaaacagcu

SEQ ID NO: 3033105 - RNA, 18 nt, Human
cuacauacaauuccaaac

SEQ ID NO: 3033106 - RNA, 22 nt, Human
cuacaguugaaaaacagcugag

SEQ ID NO: 3033107 - RNA, 19 nt, Human
cuacaguccucccaucuca

SEQ ID NO: 3033108 - RNA, 21 nt, Human
cuagcauacguacacauuuua

SEQ ID NO: 3033109 - RNA, 23 nt, Human
cuagcauacguacacauuuuauu

SEQ ID NO: 3033110 - RNA, 22 nt, Human
cuagaagauuuugaaauuuuua

SEQ ID NO: 3033111 - RNA, 16 nt, Human
ccuuuuucaauaacug

SEQ ID NO: 3033112 - RNA, 21 nt, Human
ccuuuuuauaacuuuuuauau

SEQ ID NO: 3033113 - RNA, 15 nt, Human
ccuuuuuauaacuuu

SEQ ID NO: 3033114 - RNA, 12 nt, Human
ccuuuuuauaac

SEQ ID NO: 3033115 - RNA, 21 nt, Human
ccuuuuuuagaguugauacua

SEQ ID NO: 3033116 - RNA, 13 nt, Human
cgacaaugcaaac

SEQ ID NO: 3033117 - RNA, 12 nt, Human
cgacaaugcaaa

SEQ ID NO: 3033118 - RNA, 17 nt, Human
cgacugcccggcagggu

SEQ ID NO: 3033119 - RNA, 20 nt, Human
cgacccuugccgucuaccug

SEQ ID NO: 3033120 - RNA, 19 nt, Human
cgacccuugccgucuaccu

SEQ ID NO: 3033121 - RNA, 18 nt, Human
ccuuucaauaggaaaaac

SEQ ID NO: 3033122 - RNA, 21 nt, Human
ccuuucaauaggaaaaacuga

SEQ ID NO: 3033123 - RNA, 17 nt, Human
ccuuuugagugccuuac

SEQ ID NO: 3033124 - RNA, 15 nt, Human
ccuuuugagugccuu

SEQ ID NO: 3033125 - RNA, 16 nt, Human
ccuugccgucuaccug

SEQ ID NO: 3033126 - RNA, 14 nt, Human
ccuuuaagagaaau

SEQ ID NO: 3033127 - RNA, 14 nt, Human
cgccuacaggagug

SEQ ID NO: 3033128 - RNA, 16 nt, Human
cgaguagcugggacua

SEQ ID NO: 3033129 - RNA, 14 nt, Human
cgauagugguggug

SEQ ID NO: 3033130 - RNA, 22 nt, Human
cgcaggauucuuccucccuccc

SEQ ID NO: 3033131 - RNA, 22 nt, Human
cguggugauuuagcaggaagcu

SEQ ID NO: 3033132 - RNA, 15 nt, Human
cguggugauuuagca

SEQ ID NO: 3033133 - RNA, 20 nt, Human
cguguaaccauggacccaau

SEQ ID NO: 3033134 - RNA, 16 nt, Human
cgugaggccagagaca

SEQ ID NO: 3033135 - RNA, 17 nt, Human
cgugaguccuggcaugg

SEQ ID NO: 3033136 - RNA, 16 nt, Human
cgugaguccuggcaug

SEQ ID NO: 3033137 - RNA, 17 nt, Human
cgugaggccagagacac

SEQ ID NO: 3033138 - RNA, 16 nt, Human
cgguuuuacugcagcu

SEQ ID NO: 3033139 - RNA, 16 nt, Human
cggagucccaccuugg

SEQ ID NO: 3033140 - RNA, 12 nt, Human
cgggccacagag

SEQ ID NO: 3033141 - RNA, 14 nt, Human
cgggccacagagaa

SEQ ID NO: 3033142 - RNA, 13 nt, Human
cggcuccaggcuc

SEQ ID NO: 3033143 - RNA, 14 nt, Human
cggcuccaggcucc

SEQ ID NO: 3033144 - RNA, 15 nt, Human
cggcuccaggcuccu

SEQ ID NO: 3033145 - RNA, 16 nt, Human
cggcuccaggcuccuu

SEQ ID NO: 3033146 - RNA, 12 nt, Human
cggcuccaggcu

SEQ ID NO: 3033147 - RNA, 14 nt, Human
cggagucccaccuu

SEQ ID NO: 3033148 - RNA, 16 nt, Human
cggcucacugcagccu

SEQ ID NO: 3033149 - RNA, 18 nt, Human
cggagucccaccuuggcu

SEQ ID NO: 3033150 - RNA, 20 nt, Human
cggagucccaccuuggcugc

SEQ ID NO: 3033151 - RNA, 15 nt, Human
cggcucacugcagcc

SEQ ID NO: 3033152 - RNA, 14 nt, Human
cggcucacugcagc

SEQ ID NO: 3033153 - RNA, 15 nt, Human
cggggacagcuccuu

SEQ ID NO: 3033154 - RNA, 13 nt, Human
cgguguggagaag

SEQ ID NO: 3033155 - RNA, 18 nt, Human
cgguguggagaagcggcu

SEQ ID NO: 3033156 - RNA, 14 nt, Human
cggggacagcuccu

SEQ ID NO: 3033157 - RNA, 17 nt, Human
cgggcucugccucccau

SEQ ID NO: 3033158 - RNA, 13 nt, Human
cgggcucugccuc

SEQ ID NO: 3033159 - RNA, 15 nt, Human
cgggcucagcaaaag

SEQ ID NO: 3033160 - RNA, 16 nt, Human
cgggcucugccuccca

SEQ ID NO: 3033161 - RNA, 14 nt, Human
cgggcucugccucc

SEQ ID NO: 3033162 - RNA, 11 nt, Human
cgggcucagca

SEQ ID NO: 3033163 - RNA, 16 nt, Human
cucuccccuucucugu

SEQ ID NO: 3033164 - RNA, 18 nt, Human
cucugcacuccccugcug

SEQ ID NO: 3033165 - RNA, 20 nt, Human
cucugcacuccccugcuggg

SEQ ID NO: 3033166 - RNA, 21 nt, Human
cucugcacuccccugcugggu

SEQ ID NO: 3033167 - RNA, 13 nt, Human
cucugcuccucuc

SEQ ID NO: 3033168 - RNA, 18 nt, Human
cucugcuccucuccccag

SEQ ID NO: 3033169 - RNA, 13 nt, Human
cucugcugacaga

SEQ ID NO: 3033170 - RNA, 14 nt, Human
cucugcugacagac

SEQ ID NO: 3033171 - RNA, 16 nt, Human
cucugcugacagacac

SEQ ID NO: 3033172 - RNA, 14 nt, Human
cucugguccauaga

SEQ ID NO: 3033173 - RNA, 14 nt, Human
cucuucaaucucuu

SEQ ID NO: 3033174 - RNA, 18 nt, Human
cucuucagaucucuaacu

SEQ ID NO: 3033175 - RNA, 19 nt, Human
cucuucagaucucuaacuu

SEQ ID NO: 3033176 - RNA, 14 nt, Human
cucuuauugcccac

SEQ ID NO: 3033177 - RNA, 15 nt, Human
cucuuauugcccacg

SEQ ID NO: 3033178 - RNA, 19 nt, Human
cucuuauugcccacgcugg

SEQ ID NO: 3033179 - RNA, 20 nt, Human
cucuuauugcccacgcugga

SEQ ID NO: 3033180 - RNA, 13 nt, Human
cucuuauugccca

SEQ ID NO: 3033181 - RNA, 18 nt, Human
cucuugagccuugaacuu

SEQ ID NO: 3033182 - RNA, 16 nt, Human
cucuugagccuugaac

SEQ ID NO: 3033183 - RNA, 17 nt, Human
cucuugagccuugaacu

SEQ ID NO: 3033184 - RNA, 23 nt, Human
cugacaacacucauugaccugag

SEQ ID NO: 3033185 - RNA, 22 nt, Human
cugacaacacucauugaccuga

SEQ ID NO: 3033186 - RNA, 21 nt, Human
cugaaggccccgcccaggcuu

SEQ ID NO: 3033187 - RNA, 19 nt, Human
cugaaggccccgcccaggc

SEQ ID NO: 3033188 - RNA, 18 nt, Human
cugaaggccccgcccagg

SEQ ID NO: 3033189 - RNA, 23 nt, Human
cugaaggacauugcggacagcca

SEQ ID NO: 3033190 - RNA, 21 nt, Human
cugaaggacauugcggacagc

SEQ ID NO: 3033191 - RNA, 21 nt, Human
cugagaucaaaacgguuuuac

SEQ ID NO: 3033192 - RNA, 15 nt, Human
cugagcuuucugcua

SEQ ID NO: 3033193 - RNA, 14 nt, Human
cugagcuuucugcu

SEQ ID NO: 3033194 - RNA, 23 nt, Human
cugaggacacuaaccacgcugga

SEQ ID NO: 3033195 - RNA, 20 nt, Human
cugaggacacuaaccacgcu

SEQ ID NO: 3033196 - RNA, 17 nt, Human
cugaggaauccagaccc

SEQ ID NO: 3033197 - RNA, 20 nt, Human
cugaggaauccagacccggc

SEQ ID NO: 3033198 - RNA, 14 nt, Human
cugaggaauccaga

SEQ ID NO: 3033199 - RNA, 21 nt, Human
cugaguacguugugcauuugg

SEQ ID NO: 3033200 - RNA, 18 nt, Human
cugaguacguugugcauu

SEQ ID NO: 3033201 - RNA, 17 nt, Human
cugaguacguugugcau

SEQ ID NO: 3033202 - RNA, 19 nt, Human
cugaguacguugugcauuu

SEQ ID NO: 3033203 - RNA, 20 nt, Human
cugaguacguugugcauuug

SEQ ID NO: 3033204 - RNA, 21 nt, Human
cugagaggacuuuucuuugug

SEQ ID NO: 3033205 - RNA, 22 nt, Human
cugagaggacuuuucuuugugg

SEQ ID NO: 3033206 - RNA, 17 nt, Human
cugagaguagagucacu

SEQ ID NO: 3033207 - RNA, 22 nt, Human
cugagacucgcgacaaugcaaa

SEQ ID NO: 3033208 - RNA, 22 nt, Human
cugacccaugcugcccugugag

SEQ ID NO: 3033209 - RNA, 21 nt, Human
cugacccaugcugcccuguga

SEQ ID NO: 3033210 - RNA, 20 nt, Human
cugagacucgcgacaaugca

SEQ ID NO: 3033211 - RNA, 21 nt, Human
cugagacucgcgacaaugcaa

SEQ ID NO: 3033212 - RNA, 23 nt, Human
cugagacagcccgggcucugccu

SEQ ID NO: 3033213 - RNA, 15 nt, Human
cucgaacuggcugca

SEQ ID NO: 3033214 - RNA, 13 nt, Human
cucgaacuggcug

SEQ ID NO: 3033215 - RNA, 14 nt, Human
cucgaacuggcugc

SEQ ID NO: 3033216 - RNA, 16 nt, Human
cuccucugcugcuggc

SEQ ID NO: 3033217 - RNA, 15 nt, Human
cuccucugcugcugg

SEQ ID NO: 3033218 - RNA, 18 nt, Human
cuccucugcugcuggcug

SEQ ID NO: 3033219 - RNA, 18 nt, Human
cuccuggcccacugcauc

SEQ ID NO: 3033220 - RNA, 16 nt, Human
cuccuggcccacugca

SEQ ID NO: 3033221 - RNA, 22 nt, Human
cucccccagccccauccucugu

SEQ ID NO: 3033222 - RNA, 20 nt, Human
cucccccagccccauccucu

SEQ ID NO: 3033223 - RNA, 15 nt, Human
cucccccagccccau

SEQ ID NO: 3033224 - RNA, 21 nt, Human
cuccaagaccuucuccuucac

SEQ ID NO: 3033225 - RNA, 22 nt, Human
cuccaagaccuucuccuucacc

SEQ ID NO: 3033226 - RNA, 24 nt, Human
cuccaagcaggacauggacaagga

SEQ ID NO: 3033227 - RNA, 22 nt, Human
cuccaagcaggacauggacaag

SEQ ID NO: 3033228 - RNA, 14 nt, Human
cuccaagcaggaca

SEQ ID NO: 3033229 - RNA, 13 nt, Human
cuccaagcaggac

SEQ ID NO: 3033230 - RNA, 16 nt, Human
cuccaagcucccaggc

SEQ ID NO: 3033231 - RNA, 15 nt, Human
cuccaagcucccagg

SEQ ID NO: 3033232 - RNA, 14 nt, Human
cuccaagcucccag

SEQ ID NO: 3033233 - RNA, 13 nt, Human
cuccaagcuccca

SEQ ID NO: 3033234 - RNA, 19 nt, Human
cuccacuuucuagccagag

SEQ ID NO: 3033235 - RNA, 16 nt, Human
cuccacuuucuagcca

SEQ ID NO: 3033236 - RNA, 19 nt, Human
agccccacccucagaugca

SEQ ID NO: 3033237 - RNA, 16 nt, Human
agccccagugcccaca

SEQ ID NO: 3033238 - RNA, 11 nt, Human
agccccauccu

SEQ ID NO: 3033239 - RNA, 20 nt, Human
agccccaucccaaacccuuc

SEQ ID NO: 3033240 - RNA, 15 nt, Human
agcccugagcuuucu

SEQ ID NO: 3033241 - RNA, 19 nt, Human
agccgagaucacgccacug

SEQ ID NO: 3033242 - RNA, 20 nt, Human
agccgagaucacgccacugc

SEQ ID NO: 3033243 - RNA, 22 nt, Human
agccucccgaguagcugggacu

SEQ ID NO: 3033244 - RNA, 17 nt, Human
agccucccaaagugcug

SEQ ID NO: 3033245 - RNA, 18 nt, Human
agccucccgaauagcugg

SEQ ID NO: 3033246 - RNA, 19 nt, Human
agccucccgaauagcuggg

SEQ ID NO: 3033247 - RNA, 20 nt, Human
agccucccgaauagcuggga

SEQ ID NO: 3033248 - RNA, 22 nt, Human
agccucccgaauagcugggacu

SEQ ID NO: 3033249 - RNA, 17 nt, Human
agccucccgaguagcug

SEQ ID NO: 3033250 - RNA, 21 nt, Human
agccgagaucacgccacugca

SEQ ID NO: 3033251 - RNA, 19 nt, Human
agccgagauugcaccacug

SEQ ID NO: 3033252 - RNA, 20 nt, Human
agccgagauugcaccacugc

SEQ ID NO: 3033253 - RNA, 18 nt, Human
agccgagaucacgccacu

SEQ ID NO: 3033254 - RNA, 22 nt, Human
agccgcuggggccaguuggucc

SEQ ID NO: 3033255 - RNA, 14 nt, Human
agccgcuggggcca

SEQ ID NO: 3033256 - RNA, 18 nt, Human
agccucccaaagugcugg

SEQ ID NO: 3033257 - RNA, 19 nt, Human
agccucccaaagugcuggg

SEQ ID NO: 3033258 - RNA, 20 nt, Human
agauguagacaguuggguuu

SEQ ID NO: 3033259 - RNA, 20 nt, Human
agcagcccucaauugugaaa

SEQ ID NO: 3033260 - RNA, 15 nt, Human
agcagccacauuccu

SEQ ID NO: 3033261 - RNA, 21 nt, Human
agcagccacauuccugaugcu

SEQ ID NO: 3033262 - RNA, 19 nt, Human
agcacuaaggugugcucug

SEQ ID NO: 3033263 - RNA, 12 nt, Human
agcaugaagaca

SEQ ID NO: 3033264 - RNA, 12 nt, Human
agcaugccugga

SEQ ID NO: 3033265 - RNA, 18 nt, Human
agccaaagcuaggccugg

SEQ ID NO: 3033266 - RNA, 19 nt, Human
agccaaagcuaggccuggc

SEQ ID NO: 3033267 - RNA, 20 nt, Human
agccaaagcuaggccuggcc

SEQ ID NO: 3033268 - RNA, 23 nt, Human
agccaaagcuaggccuggccaga

SEQ ID NO: 3033269 - RNA, 20 nt, Human
agccagaggagagaggaccc

SEQ ID NO: 3033270 - RNA, 20 nt, Human
agccaaggccaaaggaagca

SEQ ID NO: 3033271 - RNA, 22 nt, Human
agccaaggccaaaggaagcaca

SEQ ID NO: 3033272 - RNA, 23 nt, Human
agccaaggccaaaggaagcacau

SEQ ID NO: 3033273 - RNA, 16 nt, Human
agagguacacuuguga

SEQ ID NO: 3033274 - RNA, 17 nt, Human
agagguacacuugugaa

SEQ ID NO: 3033275 - RNA, 23 nt, Human
agaggguggugaccucugccuga

SEQ ID NO: 3033276 - RNA, 13 nt, Human
agauagccaaggc

SEQ ID NO: 3033277 - RNA, 22 nt, Human
agauacuuggggggcugaggug

SEQ ID NO: 3033278 - RNA, 13 nt, Human
agaggagaggggc

SEQ ID NO: 3033279 - RNA, 22 nt, Human
agaggggaacagacuggaagca

SEQ ID NO: 3033280 - RNA, 16 nt, Human
agaggggaagagacuu

SEQ ID NO: 3033281 - RNA, 16 nt, Human
agauagccaaggccaa

SEQ ID NO: 3033282 - RNA, 15 nt, Human
agauagccaaggcca

SEQ ID NO: 3033283 - RNA, 13 nt, Human
agacaaugacuua

SEQ ID NO: 3033284 - RNA, 17 nt, Human
agacaaugacuuacugu

SEQ ID NO: 3033285 - RNA, 21 nt, Human
agacaauuuauuauggcacau

SEQ ID NO: 3033286 - RNA, 19 nt, Human
agacaaugacuuacuguac

SEQ ID NO: 3033287 - RNA, 15 nt, Human
agacaauuuauuaug

SEQ ID NO: 3033288 - RNA, 13 nt, Human
agaccaucccuga

SEQ ID NO: 3033289 - RNA, 21 nt, Human
agaccaucccugaaggccccg

SEQ ID NO: 3033290 - RNA, 18 nt, Human
agaccaucccugaaggcc

SEQ ID NO: 3033291 - RNA, 17 nt, Human
agaccaucccugaaggc

SEQ ID NO: 3033292 - RNA, 14 nt, Human
agaccaucccugaa

SEQ ID NO: 3033293 - RNA, 16 nt, Human
agacagcccgggcucu

SEQ ID NO: 3033294 - RNA, 17 nt, Human
agacagcccgggcucug

SEQ ID NO: 3033295 - RNA, 20 nt, Human
agacagcccgggcucugccu

SEQ ID NO: 3033296 - RNA, 18 nt, Human
agacagcccgggcucugc

SEQ ID NO: 3033297 - RNA, 18 nt, Human
agacgggggcagagaggg

SEQ ID NO: 3033298 - RNA, 19 nt, Human
agacggagucccaccuugg

SEQ ID NO: 3033299 - RNA, 23 nt, Human
agacugaguacguugugcauuug

SEQ ID NO: 3033300 - RNA, 23 nt, Human
agagaggguggugaccucugccu

SEQ ID NO: 3033301 - RNA, 21 nt, Human
agagaagagauugugguuuca

SEQ ID NO: 3033302 - RNA, 10 nt, Human
agagaagaga

SEQ ID NO: 3033303 - RNA, 14 nt, Human
agguacacuuguga

SEQ ID NO: 3033304 - RNA, 17 nt, Human
agguaaggaauaccugu

SEQ ID NO: 3033305 - RNA, 16 nt, Human
agguacacuugugaau

SEQ ID NO: 3033306 - RNA, 17 nt, Human
agguacacuugugaaua

SEQ ID NO: 3033307 - RNA, 15 nt, Human
agguucaaagauauu

SEQ ID NO: 3033308 - RNA, 17 nt, Human
agguucaaagauauuuu

SEQ ID NO: 3033309 - RNA, 14 nt, Human
agguuaauguucau

SEQ ID NO: 3033310 - RNA, 15 nt, Human
agguuaauaaaguaa

SEQ ID NO: 3033311 - RNA, 13 nt, Human
agguucagcuugu

SEQ ID NO: 3033312 - RNA, 17 nt, Human
aggugcugccauccagg

SEQ ID NO: 3033313 - RNA, 16 nt, Human
aggugcugccauccag

SEQ ID NO: 3033314 - RNA, 14 nt, Human
aggucgaggcagga

SEQ ID NO: 3033315 - RNA, 17 nt, Human
agggcacaccgggcacu

SEQ ID NO: 3033316 - RNA, 20 nt, Human
agggcacaccgggcacucag

SEQ ID NO: 3033317 - RNA, 21 nt, Human
agggcacaccgggcacucaga

SEQ ID NO: 3033318 - RNA, 22 nt, Human
agggcacagaaaauggaagaca

SEQ ID NO: 3033319 - RNA, 17 nt, Human
agggccuggccugagcu

SEQ ID NO: 3033320 - RNA, 16 nt, Human
agggccuggccugagc

SEQ ID NO: 3033321 - RNA, 15 nt, Human
agggccuggccugag

SEQ ID NO: 3033322 - RNA, 19 nt, Human
agggcgggaggauguucug

SEQ ID NO: 3033323 - RNA, 16 nt, Human
aggggauagagagaga

SEQ ID NO: 3033324 - RNA, 21 nt, Human
aggggauagagagagaccacu

SEQ ID NO: 3033325 - RNA, 15 nt, Human
aggggcacagggucu

SEQ ID NO: 3033326 - RNA, 23 nt, Human
aggcuagugugguguuuccuggc

SEQ ID NO: 3033327 - RNA, 18 nt, Human
aggcugccucucccauca

SEQ ID NO: 3033328 - RNA, 17 nt, Human
agggacgcuacccggga

SEQ ID NO: 3033329 - RNA, 21 nt, Human
agggacgcuacccgggaaggg

SEQ ID NO: 3033330 - RNA, 20 nt, Human
agggacagaggggguggccu

SEQ ID NO: 3033331 - RNA, 13 nt, Human
agggacagagggg

SEQ ID NO: 3033332 - RNA, 12 nt, Human
agggacagaggg

SEQ ID NO: 3033333 - RNA, 15 nt, Human
aggaaaaacugauuu

SEQ ID NO: 3033334 - RNA, 13 nt, Human
aggaaaaacugau

SEQ ID NO: 3033335 - RNA, 17 nt, Human
agcugggugucaagagg

SEQ ID NO: 3033336 - RNA, 22 nt, Human
agcugggugucaagagggucug

SEQ ID NO: 3033337 - RNA, 21 nt, Human
agcuggucccacucaguccau

SEQ ID NO: 3033338 - RNA, 19 nt, Human
agcuggucccacucagucc

SEQ ID NO: 3033339 - RNA, 17 nt, Human
aggaggggauagagaga

SEQ ID NO: 3033340 - RNA, 18 nt, Human
aggauguucugggacaca

SEQ ID NO: 3033341 - RNA, 20 nt, Human
aggauguucugggacacagu

SEQ ID NO: 3033342 - RNA, 12 nt, Human
aggauucuuccu

SEQ ID NO: 3033343 - RNA, 18 nt, Human
aggagaggggcacagggu

SEQ ID NO: 3033344 - RNA, 16 nt, Human
aggagaggggcacagg

SEQ ID NO: 3033345 - RNA, 14 nt, Human
aggagaggggcaca

SEQ ID NO: 3033346 - RNA, 15 nt, Human
aggagagcuagcagc

SEQ ID NO: 3033347 - RNA, 20 nt, Human
aggaccucaggugagaagca

SEQ ID NO: 3033348 - RNA, 14 nt, Human
aggaccucagguga

SEQ ID NO: 3033349 - RNA, 20 nt, Human
aggaccccuccaugugggcu

SEQ ID NO: 3033350 - RNA, 22 nt, Human
augcuugcugcugauuuaaaca

SEQ ID NO: 3033351 - RNA, 16 nt, Human
augcuugcugcugauu

SEQ ID NO: 3033352 - RNA, 20 nt, Human
auggaaaugggcagagcaga

SEQ ID NO: 3033353 - RNA, 19 nt, Human
auggaaaugggcagagcag

SEQ ID NO: 3033354 - RNA, 22 nt, Human
augcuucuucagagacuccugc

SEQ ID NO: 3033355 - RNA, 15 nt, Human
augggaaugaauguc

SEQ ID NO: 3033356 - RNA, 23 nt, Human
auggcugccaaugggagcucaug

SEQ ID NO: 3033357 - RNA, 21 nt, Human
augcacagcuaacauggaagu

SEQ ID NO: 3033358 - RNA, 14 nt, Human
augcacagcuaaca

SEQ ID NO: 3033359 - RNA, 23 nt, Human
augcacagaguuguuacauuuuu

SEQ ID NO: 3033360 - RNA, 17 nt, Human
augcacacauuuuuuaa

SEQ ID NO: 3033361 - RNA, 19 nt, Human
augcacacauuuuuuaaau

SEQ ID NO: 3033362 - RNA, 22 nt, Human
augcacacauuuuuuaaaugca

SEQ ID NO: 3033363 - RNA, 20 nt, Human
augcaugaaguaauaugcac

SEQ ID NO: 3033364 - RNA, 23 nt, Human
augcaugaaguaauaugcacaca

SEQ ID NO: 3033365 - RNA, 18 nt, Human
augcauuugaaaauuuug

SEQ ID NO: 3033366 - RNA, 10 nt, Human
augcauuuga

SEQ ID NO: 3033367 - RNA, 12 nt, Human
augcauuugaaa

SEQ ID NO: 3033368 - RNA, 15 nt, Human
augccugguggcagc

SEQ ID NO: 3033369 - RNA, 16 nt, Human
augccugguggcagcu

SEQ ID NO: 3033370 - RNA, 17 nt, Human
augccugguggcagcug

SEQ ID NO: 3033371 - RNA, 17 nt, Human
augccugggcagaagga

SEQ ID NO: 3033372 - RNA, 14 nt, Human
augccugguggcag

SEQ ID NO: 3033373 - RNA, 23 nt, Human
augccuggauggggcugcaccgg

SEQ ID NO: 3033374 - RNA, 21 nt, Human
augccuggauggggcugcacc

SEQ ID NO: 3033375 - RNA, 21 nt, Human
auuaaaugacucuucccucaa

SEQ ID NO: 3033376 - RNA, 11 nt, Human
auuaaauuaug

SEQ ID NO: 3033377 - RNA, 16 nt, Human
auuaaaugcccagccc

SEQ ID NO: 3033378 - RNA, 13 nt, Human
auuaaauucuugc

SEQ ID NO: 3033379 - RNA, 14 nt, Human
auuaaaugacucuu

SEQ ID NO: 3033380 - RNA, 17 nt, Human
auuaaaugacucuuccc

SEQ ID NO: 3033381 - RNA, 15 nt, Human
auuaaaugcccagcc

SEQ ID NO: 3033382 - RNA, 14 nt, Human
auuaaaugcccagc

SEQ ID NO: 3033383 - RNA, 16 nt, Human
auguuuuaagaggcag

SEQ ID NO: 3033384 - RNA, 18 nt, Human
auguuuuaagaggcaggg

SEQ ID NO: 3033385 - RNA, 18 nt, Human
auguucucugaggacacu

SEQ ID NO: 3033386 - RNA, 17 nt, Human
auguucucugaggacac

SEQ ID NO: 3033387 - RNA, 15 nt, Human
auguucuuaauucuu

SEQ ID NO: 3033388 - RNA, 20 nt, Human
auguucuuaguggauguucu

SEQ ID NO: 3033389 - RNA, 22 nt, Human
auguucugacccugcuucaaau

SEQ ID NO: 3033390 - RNA, 14 nt, Human
auguucuuaauucu

SEQ ID NO: 3033391 - RNA, 14 nt, Human
auguguaaguauuc

SEQ ID NO: 3033392 - RNA, 20 nt, Human
augugggcuaguugggcuuc

SEQ ID NO: 3033393 - RNA, 15 nt, Human
augucacaggcaggu

SEQ ID NO: 3033394 - RNA, 14 nt, Human
augucacaggcagg

SEQ ID NO: 3033395 - RNA, 16 nt, Human
augucacaggcagguc

SEQ ID NO: 3033396 - RNA, 15 nt, Human
auggucggaaaacau

SEQ ID NO: 3033397 - RNA, 17 nt, Human
auguaagcucuacugag

SEQ ID NO: 3033398 - RNA, 18 nt, Human
augacucuucccucaaau

SEQ ID NO: 3033399 - RNA, 12 nt, Human
augagccuggca

SEQ ID NO: 3033400 - RNA, 17 nt, Human
augacuccagaauuucc

SEQ ID NO: 3033401 - RNA, 16 nt, Human
augacuccagaauuuc

SEQ ID NO: 3033402 - RNA, 12 nt, Human
augacuccagaa

SEQ ID NO: 3033403 - RNA, 18 nt, Human
augacuauucaguggcua

SEQ ID NO: 3033404 - RNA, 12 nt, Human
augacccagugg

SEQ ID NO: 3033405 - RNA, 14 nt, Human
augagccuggcaag

SEQ ID NO: 3033406 - RNA, 13 nt, Human
augagccuggcaa

SEQ ID NO: 3033407 - RNA, 23 nt, Human
aucuucuauauaauuccuguuuu

SEQ ID NO: 3033408 - RNA, 19 nt, Human
aucuuccaacucaaacucu

SEQ ID NO: 3033409 - RNA, 22 nt, Human
aucucucgugauugauaagaac

SEQ ID NO: 3033410 - RNA, 17 nt, Human
aucuucuuuauaauucu

SEQ ID NO: 3033411 - RNA, 17 nt, Human
aucuugaagacuuuucu

SEQ ID NO: 3033412 - RNA, 13 nt, Human
aucgaugcagugc

SEQ ID NO: 3033413 - RNA, 14 nt, Human
auccuccucagauc

SEQ ID NO: 3033414 - RNA, 11 nt, Human
auccuccucag

SEQ ID NO: 3033415 - RNA, 22 nt, Human
auccuccaggugcacaagcucc

SEQ ID NO: 3033416 - RNA, 19 nt, Human
auccuccaggugcacaagc

SEQ ID NO: 3033417 - RNA, 14 nt, Human
auccuccaggugca

SEQ ID NO: 3033418 - RNA, 13 nt, Human
auccuccaggugc

SEQ ID NO: 3033419 - RNA, 15 nt, Human
aucccuacuguaauu

SEQ ID NO: 3033420 - RNA, 22 nt, Human
auccucauacccacccccaccc

SEQ ID NO: 3033421 - RNA, 19 nt, Human
auccucauacccaccccca

SEQ ID NO: 3033422 - RNA, 18 nt, Human
auccucauacccaccccc

SEQ ID NO: 3033423 - RNA, 18 nt, Human
auccacccaccucagccu

SEQ ID NO: 3033424 - RNA, 20 nt, Human
auccacccaccucagccucc

SEQ ID NO: 3033425 - RNA, 16 nt, Human
auccacccaccucagc

SEQ ID NO: 3033426 - RNA, 12 nt, Human
aucagcugcuac

SEQ ID NO: 3033427 - RNA, 21 nt, Human
aucagccugggcaaugugaua

SEQ ID NO: 3033428 - RNA, 20 nt, Human
aucagccugggcaaugugau

SEQ ID NO: 3033429 - RNA, 11 nt, Human
aucagccuggg

SEQ ID NO: 3033430 - RNA, 19 nt, Human
aucauggagguuugaagau

SEQ ID NO: 3033431 - RNA, 20 nt, Human
aucagccugcuccagcuguu

SEQ ID NO: 3033432 - RNA, 13 nt, Human
aucagcugcuacu

SEQ ID NO: 3033433 - RNA, 23 nt, Human
aucagcugcuacuacuccuguag

SEQ ID NO: 3033434 - RNA, 14 nt, Human
agucaaggcuuaga

SEQ ID NO: 3033435 - RNA, 16 nt, Human
agucaaggcuuagacc

SEQ ID NO: 3033436 - RNA, 16 nt, Human
agucaagugaaaaagg

SEQ ID NO: 3033437 - RNA, 20 nt, Human
agucaagugaaaaaggagga

SEQ ID NO: 3033438 - RNA, 14 nt, Human
agucauucuucccu

SEQ ID NO: 3033439 - RNA, 13 nt, Human
agucauucuuuaa

SEQ ID NO: 3033440 - RNA, 18 nt, Human
agucauuauguuaauauu

SEQ ID NO: 3033441 - RNA, 12 nt, Human
agucauuauguu

SEQ ID NO: 3033442 - RNA, 13 nt, Human
agugauccuccca

SEQ ID NO: 3033443 - RNA, 23 nt, Human
agugugacaaggauugcuacugu

SEQ ID NO: 3033444 - RNA, 18 nt, Human
aguuacagacaaagcgug

SEQ ID NO: 3033445 - RNA, 17 nt, Human
aguuacagacaaagcgu

SEQ ID NO: 3033446 - RNA, 13 nt, Human
aguuguuacauuu

SEQ ID NO: 3033447 - RNA, 15 nt, Human
aguuguuacauuuuu

SEQ ID NO: 3033448 - RNA, 16 nt, Human
aguuguuacauuuuua

SEQ ID NO: 3033449 - RNA, 16 nt, Human
auauaauuccuguuuu

SEQ ID NO: 3033450 - RNA, 22 nt, Human
auauaauuccuguuuuuauuau

SEQ ID NO: 3033451 - RNA, 16 nt, Human
auaguaugguggcugg

SEQ ID NO: 3033452 - RNA, 21 nt, Human
auacuuauuuaaauagaugac

SEQ ID NO: 3033453 - RNA, 15 nt, Human
auacuuauuuaaaua

SEQ ID NO: 3033454 - RNA, 22 nt, Human
auacuuauuuaaauagaugaca

SEQ ID NO: 3033455 - RNA, 15 nt, Human
auaguaugguggcug

SEQ ID NO: 3033456 - RNA, 17 nt, Human
auauagcaagacauuau

SEQ ID NO: 3033457 - RNA, 16 nt, Human
auauaggaacuuaaau

SEQ ID NO: 3033458 - RNA, 11 nt, Human
auaucacuucc

SEQ ID NO: 3033459 - RNA, 20 nt, Human
auauccuaauaaaaagguga

SEQ ID NO: 3033460 - RNA, 23 nt, Human
auauccuaauaaaaaggugacca

SEQ ID NO: 3033461 - RNA, 22 nt, Human
auaugccugggcagaaggaaga

SEQ ID NO: 3033462 - RNA, 19 nt, Human
auaugcuuauacacuuaca

SEQ ID NO: 3033463 - RNA, 14 nt, Human
auaugcuuauacac

SEQ ID NO: 3033464 - RNA, 16 nt, Human
auaugcuuauacacuu

SEQ ID NO: 3033465 - RNA, 13 nt, Human
auauucaggaagc

SEQ ID NO: 3033466 - RNA, 16 nt, Human
auauucaggaagcuca

SEQ ID NO: 3033467 - RNA, 14 nt, Human
auauucaggaagcu

SEQ ID NO: 3033468 - RNA, 13 nt, Human
auacuuauuuaaa

SEQ ID NO: 3033469 - RNA, 12 nt, Human
auaccugucccc

SEQ ID NO: 3033470 - RNA, 19 nt, Human
auaaugugaaacuggauua

SEQ ID NO: 3033471 - RNA, 21 nt, Human
auaaugugaaacuggauuaaa

SEQ ID NO: 3033472 - RNA, 18 nt, Human
auaaugugaaacuggauu

SEQ ID NO: 3033473 - RNA, 16 nt, Human
acgugcacgcacacug

SEQ ID NO: 3033474 - RNA, 18 nt, Human
acgcugugcugcccugcc

SEQ ID NO: 3033475 - RNA, 17 nt, Human
acgcugugcugcccugc

SEQ ID NO: 3033476 - RNA, 16 nt, Human
acgcugugcugcccug

SEQ ID NO: 3033477 - RNA, 15 nt, Human
acgcugugcugcccu

SEQ ID NO: 3033478 - RNA, 11 nt, Human
acguggcugcu

SEQ ID NO: 3033479 - RNA, 15 nt, Human
acguggcugcuucaa

SEQ ID NO: 3033480 - RNA, 14 nt, Human
acguggcugcuuca

SEQ ID NO: 3033481 - RNA, 13 nt, Human
acguggcugcuuc

SEQ ID NO: 3033482 - RNA, 15 nt, Human
acuaaguuuuuaugg

SEQ ID NO: 3033483 - RNA, 22 nt, Human
acuaaguuuuuauggcuuuugu

SEQ ID NO: 3033484 - RNA, 12 nt, Human
acgauuucuguu

SEQ ID NO: 3033485 - RNA, 13 nt, Human
acgauuucuguuu

SEQ ID NO: 3033486 - RNA, 18 nt, Human
acgccacugcacuauagc

SEQ ID NO: 3033487 - RNA, 14 nt, Human
acgauuucuguuua

SEQ ID NO: 3033488 - RNA, 17 nt, Human
acgauuucuguuuagau

SEQ ID NO: 3033489 - RNA, 20 nt, Human
accugccccucaacucuccu

SEQ ID NO: 3033490 - RNA, 23 nt, Human
accugccccucaacucuccucca

SEQ ID NO: 3033491 - RNA, 21 nt, Human
accucugcacaagcugcaccc

SEQ ID NO: 3033492 - RNA, 18 nt, Human
accucugcacaagcugca

SEQ ID NO: 3033493 - RNA, 16 nt, Human
accucugcacaagcug

SEQ ID NO: 3033494 - RNA, 23 nt, Human
accuuucaauaggaaaaacugau

SEQ ID NO: 3033495 - RNA, 21 nt, Human
accuuucaauaggaaaaacug

SEQ ID NO: 3033496 - RNA, 17 nt, Human
accuuucaauaggaaaa

SEQ ID NO: 3033497 - RNA, 14 nt, Human
accuuggcugcagg

SEQ ID NO: 3033498 - RNA, 16 nt, Human
accuuucaauaggaaa

SEQ ID NO: 3033499 - RNA, 12 nt, Human
accuuggcucaa

SEQ ID NO: 3033500 - RNA, 14 nt, Human
accuuggcucaagu

SEQ ID NO: 3033501 - RNA, 12 nt, Human
accuuggcugca

SEQ ID NO: 3033502 - RNA, 21 nt, Human
acucuacccucuuagaaaaac

SEQ ID NO: 3033503 - RNA, 18 nt, Human
acucuacccucuuagaaa

SEQ ID NO: 3033504 - RNA, 13 nt, Human
acucuacccucuu

SEQ ID NO: 3033505 - RNA, 22 nt, Human
acucuauaacaaaggauacuua

SEQ ID NO: 3033506 - RNA, 14 nt, Human
acucuaucaaguau

SEQ ID NO: 3033507 - RNA, 16 nt, Human
acucuaucaaguauua

SEQ ID NO: 3033508 - RNA, 18 nt, Human
acucuuaaaacccaagug

SEQ ID NO: 3033509 - RNA, 11 nt, Human
acucuuaaaac

SEQ ID NO: 3033510 - RNA, 16 nt, Human
acucugugucaggugg

SEQ ID NO: 3033511 - RNA, 18 nt, Human
acucaaaagcugggcagg

SEQ ID NO: 3033512 - RNA, 11 nt, Human
acuauaaugua

SEQ ID NO: 3033513 - RNA, 16 nt, Human
acucaaacucuuaaaa

SEQ ID NO: 3033514 - RNA, 17 nt, Human
acucaaacucuuaaaac

SEQ ID NO: 3033515 - RNA, 14 nt, Human
acucccccaggugg

SEQ ID NO: 3033516 - RNA, 17 nt, Human
acuccccugcugggugu

SEQ ID NO: 3033517 - RNA, 13 nt, Human
acuccccugcugg

SEQ ID NO: 3033518 - RNA, 13 nt, Human
acuuauuuaaaua

SEQ ID NO: 3033519 - RNA, 18 nt, Human
acuuauuuaaauagauga

SEQ ID NO: 3033520 - RNA, 19 nt, Human
acuucacauauugauuucc

SEQ ID NO: 3033521 - RNA, 14 nt, Human
acuguuuagaugaa

SEQ ID NO: 3033522 - RNA, 18 nt, Human
acuucugccauauucugu

SEQ ID NO: 3033523 - RNA, 14 nt, Human
acuggagaaaaugg

SEQ ID NO: 3033524 - RNA, 15 nt, Human
acuggaagcacagcu

SEQ ID NO: 3033525 - RNA, 14 nt, Human
acuggaagcacagc

SEQ ID NO: 3033526 - RNA, 12 nt, Human
acugucuucagu

SEQ ID NO: 3033527 - RNA, 20 nt, Human
agaaaggaggggauagagag

SEQ ID NO: 3033528 - RNA, 23 nt, Human
agaaaggaggggauagagagaga

SEQ ID NO: 3033529 - RNA, 15 nt, Human
agaaauaaaguuucu

SEQ ID NO: 3033530 - RNA, 18 nt, Human
agaaauaaaguuucuguu

SEQ ID NO: 3033531 - RNA, 23 nt, Human
acuuuguucuggcucuuccaggc

SEQ ID NO: 3033532 - RNA, 20 nt, Human
acuuuguucuggcucuucca

SEQ ID NO: 3033533 - RNA, 23 nt, Human
acuuuccuucauucaacccaccu

SEQ ID NO: 3033534 - RNA, 23 nt, Human
agaaaauggaagacagcucuuau

SEQ ID NO: 3033535 - RNA, 20 nt, Human
agaaaauggacguguuauga

SEQ ID NO: 3033536 - RNA, 15 nt, Human
agaaaauggacgugu

SEQ ID NO: 3033537 - RNA, 23 nt, Human
agaaaauggacguguuaugacuc

SEQ ID NO: 3033538 - RNA, 22 nt, Human
agaaaauggacguguuaugacu

SEQ ID NO: 3033539 - RNA, 15 nt, Human
acuuuuauaaacuuu

SEQ ID NO: 3033540 - RNA, 19 nt, Human
acuuuuauaaacuuuaccu

SEQ ID NO: 3033541 - RNA, 22 nt, Human
acuuuuauaaacuuuaccuuuu

SEQ ID NO: 3033542 - RNA, 11 nt, Human
acauuaaauga

SEQ ID NO: 3033543 - RNA, 12 nt, Human
acauuaaaugac

SEQ ID NO: 3033544 - RNA, 13 nt, Human
acauuaaagguac

SEQ ID NO: 3033545 - RNA, 20 nt, Human
acaugcacagcuaacaugga

SEQ ID NO: 3033546 - RNA, 19 nt, Human
acaugcaaggucauuuuuu

SEQ ID NO: 3033547 - RNA, 18 nt, Human
acaugcaaggucauuuuu

SEQ ID NO: 3033548 - RNA, 21 nt, Human
acauguuuuucuucucccuca

SEQ ID NO: 3033549 - RNA, 22 nt, Human
acaucagcacgauuucuguuua

SEQ ID NO: 3033550 - RNA, 20 nt, Human
acaucagcacgauuucuguu

SEQ ID NO: 3033551 - RNA, 21 nt, Human
acaucagcacgauuucuguuu

SEQ ID NO: 3033552 - RNA, 19 nt, Human
acaucagcacgauuucugu

SEQ ID NO: 3033553 - RNA, 23 nt, Human
acauaaacaagaccacguuucua

SEQ ID NO: 3033554 - RNA, 17 nt, Human
accagcagccuggaccc

SEQ ID NO: 3033555 - RNA, 14 nt, Human
accagcagccugga

SEQ ID NO: 3033556 - RNA, 13 nt, Human
accagcagccugg

SEQ ID NO: 3033557 - RNA, 15 nt, Human
accacguuucuaaag

SEQ ID NO: 3033558 - RNA, 19 nt, Human
accacguuucuaaaggcua

SEQ ID NO: 3033559 - RNA, 14 nt, Human
accacuacauucug

SEQ ID NO: 3033560 - RNA, 21 nt, Human
accaacgucugugccauuuug

SEQ ID NO: 3033561 - RNA, 22 nt, Human
accaucccugaaggccccgccc

SEQ ID NO: 3033562 - RNA, 21 nt, Human
accaucccugaaggccccgcc

SEQ ID NO: 3033563 - RNA, 16 nt, Human
accaucaugucuggcu

SEQ ID NO: 3033564 - RNA, 17 nt, Human
accaucaugucuggcua

SEQ ID NO: 3033565 - RNA, 16 nt, Human
accaucccugaaggcc

SEQ ID NO: 3033566 - RNA, 18 nt, Human
accaucccugaaggcccc

SEQ ID NO: 3033567 - RNA, 14 nt, Human
accaucaugucugg

SEQ ID NO: 3033568 - RNA, 15 nt, Human
accccggccaccugc

SEQ ID NO: 3033569 - RNA, 16 nt, Human
acccaugcugcccugu

SEQ ID NO: 3033570 - RNA, 19 nt, Human
acccaugcugcccugugag

SEQ ID NO: 3033571 - RNA, 18 nt, Human
acccaugcugcccuguga

SEQ ID NO: 3033572 - RNA, 17 nt, Human
acccaugcugcccugug

SEQ ID NO: 3033573 - RNA, 16 nt, Human
acccaagggccuggcc

SEQ ID NO: 3033574 - RNA, 13 nt, Human
acccaagggccug

SEQ ID NO: 3033575 - RNA, 18 nt, Human
acacuguccuauuauauu

SEQ ID NO: 3033576 - RNA, 21 nt, Human
acagaggggguggccucccaa

SEQ ID NO: 3033577 - RNA, 22 nt, Human
acagaggggguggccucccaac

SEQ ID NO: 3033578 - RNA, 12 nt, Human
acagagucucac

SEQ ID NO: 3033579 - RNA, 14 nt, Human
acagagucucacug

SEQ ID NO: 3033580 - RNA, 17 nt, Human
acagagucucacuguug

SEQ ID NO: 3033581 - RNA, 19 nt, Human
acagagucucacuguugcc

SEQ ID NO: 3033582 - RNA, 15 nt, Human
acagccaugauucuu

SEQ ID NO: 3033583 - RNA, 19 nt, Human
acagccacggccaggccag

SEQ ID NO: 3033584 - RNA, 20 nt, Human
acaggugugaaccaccacac

SEQ ID NO: 3033585 - RNA, 23 nt, Human
acaggugugaaccaccacaccca

SEQ ID NO: 3033586 - RNA, 18 nt, Human
acaggcaagcaccuccug

SEQ ID NO: 3033587 - RNA, 15 nt, Human
acaggcaagcaccuc

SEQ ID NO: 3033588 - RNA, 16 nt, Human
acaggcaagcaccucc

SEQ ID NO: 3033589 - RNA, 12 nt, Human
acagcuccuucu

SEQ ID NO: 3033590 - RNA, 13 nt, Human
acagcuccuucug

SEQ ID NO: 3033591 - RNA, 14 nt, Human
acagcuccuucugu

SEQ ID NO: 3033592 - RNA, 23 nt, Human
acagcugccugggaucccucauc

SEQ ID NO: 3033593 - RNA, 13 nt, Human
acagcugccuggg

SEQ ID NO: 3033594 - RNA, 14 nt, Human
acagcugccuggga

SEQ ID NO: 3033595 - RNA, 13 nt, Human
acacaaagcuuuu

SEQ ID NO: 3033596 - RNA, 18 nt, Human
acacaaacgggcucagca

SEQ ID NO: 3033597 - RNA, 16 nt, Human
acaauuuauuauggca

SEQ ID NO: 3033598 - RNA, 14 nt, Human
acaauuuauuaugg

SEQ ID NO: 3033599 - RNA, 15 nt, Human
acaauuuauuauggc

SEQ ID NO: 3033600 - RNA, 15 nt, Human
acacggacacucaaa

SEQ ID NO: 3033601 - RNA, 14 nt, Human
acacuaaccacgcu

SEQ ID NO: 3033602 - RNA, 15 nt, Human
acacuaaccacgcug

SEQ ID NO: 3033603 - RNA, 11 nt, Human
acacagcucug

SEQ ID NO: 3033604 - RNA, 12 nt, Human
acacagcucugu

SEQ ID NO: 3033605 - RNA, 21 nt, Human
acaccacuacauucuguuaau

SEQ ID NO: 3033606 - RNA, 12 nt, Human
acaccagagccc

SEQ ID NO: 3033607 - RNA, 13 nt, Human
acaaagacugagu

SEQ ID NO: 3033608 - RNA, 21 nt, Human
acaaaccuguuucugcagcca

SEQ ID NO: 3033609 - RNA, 15 nt, Human
acaaacgggcucagc

SEQ ID NO: 3033610 - RNA, 20 nt, Human
acaaaauguaggguuauaau

SEQ ID NO: 3033611 - RNA, 18 nt, Human
aaagaugaaggucuguuu

SEQ ID NO: 3033612 - RNA, 11 nt, Human
aaagagguuuu

SEQ ID NO: 3033613 - RNA, 22 nt, Human
aaacacuguucucugcccucca

SEQ ID NO: 3033614 - RNA, 19 nt, Human
aaacacuguucucugcccu

SEQ ID NO: 3033615 - RNA, 13 nt, Human
aaaacacauuuuu

SEQ ID NO: 3033616 - RNA, 15 nt, Human
aaaacacauuuuucu

SEQ ID NO: 3033617 - RNA, 13 nt, Human
aaaauucagugga

SEQ ID NO: 3033618 - RNA, 18 nt, Human
aaacacuguucucugccc

SEQ ID NO: 3033619 - RNA, 14 nt, Human
aaagugcugggauu

SEQ ID NO: 3033620 - RNA, 11 nt, Human
aaagugcuggg

SEQ ID NO: 3033621 - RNA, 18 nt, Human
aaauggaagacagcucuu

SEQ ID NO: 3033622 - RNA, 16 nt, Human
aaauggaaaugggcag

SEQ ID NO: 3033623 - RNA, 20 nt, Human
aaauggacguguuaugacuc

SEQ ID NO: 3033624 - RNA, 22 nt, Human
aaauggacguguuaugacucca

SEQ ID NO: 3033625 - RNA, 21 nt, Human
aaauggacguguuaugacucc

SEQ ID NO: 3033626 - RNA, 15 nt, Human
aacaaaggauacuua

SEQ ID NO: 3033627 - RNA, 19 nt, Human
aacaaaggauacuuauuua

SEQ ID NO: 3033628 - RNA, 19 nt, Human
aacacauuuuucuuaggga

SEQ ID NO: 3033629 - RNA, 19 nt, Human
aacaccucugcacaagcug

SEQ ID NO: 3033630 - RNA, 22 nt, Human
aaccacucuaucaaguauuaua

SEQ ID NO: 3033631 - RNA, 14 nt, Human
aacauguaauuaag

SEQ ID NO: 3033632 - RNA, 21 nt, Human
aacauguaauuaaguacuaug

SEQ ID NO: 3033633 - RNA, 14 nt, Human
aacccuggugacca

SEQ ID NO: 3033634 - RNA, 16 nt, Human
aacuuuuuauauucuc

SEQ ID NO: 3033635 - RNA, 16 nt, Human
aacuuuuauaaacuuu

SEQ ID NO: 3033636 - RNA, 19 nt, Human
aacuuuuauaaacuuuacc

SEQ ID NO: 3033637 - RNA, 12 nt, Human
aacuuuuauaaa

SEQ ID NO: 3033638 - RNA, 15 nt, Human
aacuuuuauaaacuu

SEQ ID NO: 3033639 - RNA, 19 nt, Human
aacuuugaccucugcagca

SEQ ID NO: 3033640 - RNA, 20 nt, Human
aacuuugaccucugcagcaa

SEQ ID NO: 3033641 - RNA, 13 nt, Human
aacuuugaccucu

SEQ ID NO: 3033642 - RNA, 14 nt, Human
aacuuugaccucug

SEQ ID NO: 3033643 - RNA, 17 nt, Human
aacuuugaccucugcag

SEQ ID NO: 3033644 - RNA, 23 nt, Human
aacugacacaugcugaacaucac

SEQ ID NO: 3033645 - RNA, 19 nt, Human
aacugauuuuuuuuuccuu

SEQ ID NO: 3033646 - RNA, 17 nt, Human
aacugauuuuuuuuucc

SEQ ID NO: 3033647 - RNA, 19 nt, Human
aacuuauggggccaaaaua

SEQ ID NO: 3033648 - RNA, 17 nt, Human
aacuuaaauaaugugaa

SEQ ID NO: 3033649 - RNA, 20 nt, Human
aacucaccuggcaucuuaca

SEQ ID NO: 3033650 - RNA, 16 nt, Human
aacucaccugccccuc

SEQ ID NO: 3033651 - RNA, 15 nt, Human
aacucaccugccccu

SEQ ID NO: 3033652 - RNA, 12 nt, Human
aacucaccccag

SEQ ID NO: 3033653 - RNA, 15 nt, Human
aacugaacuucagag

SEQ ID NO: 3033654 - RNA, 19 nt, Human
aaucacacugucuucugau

SEQ ID NO: 3033655 - RNA, 18 nt, Human
aauauaggaacuuaaaua

SEQ ID NO: 3033656 - RNA, 20 nt, Human
aauauaggaacuuaaauaau

SEQ ID NO: 3033657 - RNA, 21 nt, Human
aauauaggaacuuaaauaaug

SEQ ID NO: 3033658 - RNA, 16 nt, Human
aauauaggaacuuaaa

SEQ ID NO: 3033659 - RNA, 19 nt, Human
aaugaugccaugaggaaca

SEQ ID NO: 3033660 - RNA, 14 nt, Human
aaucuccaaaauaa

SEQ ID NO: 3033661 - RNA, 13 nt, Human
aaucuccaaaaua

SEQ ID NO: 3033662 - RNA, 22 nt, Human
aaucugcuuuuuaaagaaugcu

SEQ ID NO: 3033663 - RNA, 16 nt, Human
aaugaaccacaucuug

SEQ ID NO: 3033664 - RNA, 17 nt, Human
aaugaaccacaucuugc

SEQ ID NO: 3033665 - RNA, 23 nt, Human
aaugaaccacaucuugcucugcu

SEQ ID NO: 3033666 - RNA, 21 nt, Human
aaugaugauccuaggcauuug

SEQ ID NO: 3033667 - RNA, 19 nt, Human
aaugucaguuguuauuuau

SEQ ID NO: 3033668 - RNA, 20 nt, Human
aaugucaguuguuauuuauu

SEQ ID NO: 3033669 - RNA, 22 nt, Human
aaugucuaguuguaacaccaug

SEQ ID NO: 3033670 - RNA, 21 nt, Human
aaugucagugugacugaucuc

SEQ ID NO: 3033671 - RNA, 17 nt, Human
aaugucagugugacuga

SEQ ID NO: 3033672 - RNA, 20 nt, Human
aaugucucuuuaaugucaca

SEQ ID NO: 3033673 - RNA, 13 nt, Human
aaugucaguguga

SEQ ID NO: 3033674 - RNA, 16 nt, Human
aaugucagugugacug

SEQ ID NO: 3033675 - RNA, 15 nt, Human
aaugucagugugacu

SEQ ID NO: 3033676 - RNA, 14 nt, Human
aaugguaguuuuac

SEQ ID NO: 3033677 - RNA, 13 nt, Human
aaugggcagagca

SEQ ID NO: 3033678 - RNA, 15 nt, Human
aaugggcagagcaga

SEQ ID NO: 3033679 - RNA, 18 nt, Human
aauuaaaacacaacaucu

SEQ ID NO: 3033680 - RNA, 19 nt, Human
aauguuugccucugccucu

SEQ ID NO: 3033681 - RNA, 18 nt, Human
aauguuugccucugccuc

SEQ ID NO: 3033682 - RNA, 18 nt, Human
aauuaguggcacuugcuu

SEQ ID NO: 3033683 - RNA, 20 nt, Human
aaguccccucuccuccacau

SEQ ID NO: 3033684 - RNA, 21 nt, Human
aaguccccucuccuccacauu

SEQ ID NO: 3033685 - RNA, 16 nt, Human
aagucuuagauguaua

SEQ ID NO: 3033686 - RNA, 20 nt, Human
aagguuaauguucaucaucc

SEQ ID NO: 3033687 - RNA, 15 nt, Human
aagguuaauaaagua

SEQ ID NO: 3033688 - RNA, 16 nt, Human
aagguuaauaaaguaa

SEQ ID NO: 3033689 - RNA, 11 nt, Human
aaggugggagg

SEQ ID NO: 3033690 - RNA, 11 nt, Human
aaguacuucuu

SEQ ID NO: 3033691 - RNA, 16 nt, Human
aaguaucccuacugua

SEQ ID NO: 3033692 - RNA, 16 nt, Human
aauaaugugaaacugg

SEQ ID NO: 3033693 - RNA, 22 nt, Human
aaguuguaggcauaaagucagg

SEQ ID NO: 3033694 - RNA, 22 nt, Human
aagugcugggauuacaggugug

SEQ ID NO: 3033695 - RNA, 13 nt, Human
aagaaauuugugg

SEQ ID NO: 3033696 - RNA, 14 nt, Human
aagcagaggaagga

SEQ ID NO: 3033697 - RNA, 18 nt, Human
aagccauaauuguucuua

SEQ ID NO: 3033698 - RNA, 16 nt, Human
aaggcaaggcugucaa

SEQ ID NO: 3033699 - RNA, 18 nt, Human
aaggcaaggcugucaauu

SEQ ID NO: 3033700 - RNA, 17 nt, Human
aaggcaaggcugucaau

SEQ ID NO: 3033701 - RNA, 11 nt, Human
aagcugggcag

SEQ ID NO: 3033702 - RNA, 13 nt, Human
aagcugggcaggu

SEQ ID NO: 3033703 - RNA, 18 nt, Human
aaggacauugcggacagc

SEQ ID NO: 3033704 - RNA, 20 nt, Human
aagcugcacccucaggcagg

SEQ ID NO: 3033705 - RNA, 21 nt, Human
aagcugcacccucaggcaggu

SEQ ID NO: 3033706 - RNA, 22 nt, Human
aagcugcacccucaggcaggug

SEQ ID NO: 3033707 - RNA, 12 nt, Human
aagcguggugga

SEQ ID NO: 3033708 - RNA, 19 nt, Human
aaaaauuuacuuuaaacua

SEQ ID NO: 3033709 - RNA, 18 nt, Human
aaaaauuuacuuuaaacu

SEQ ID NO: 3033710 - RNA, 13 nt, Human
aaaaauuuacuuu

SEQ ID NO: 3033711 - RNA, 12 nt, Human
aaaacacauuuu

SEQ ID NO: 3033712 - RNA, 15 nt, Human
aaaaacugauuuuuu

SEQ ID NO: 3033713 - RNA, 14 nt, Human
aaaaacauggccuu

SEQ ID NO: 3033714 - RNA, 13 nt, Human
aaaaacugauuuu

SEQ ID NO: 3033715 - RNA, 12 nt, Human
aaaaagaggcua

SEQ ID NO: 3033716 - RNA, 14 nt, Human
aaaaacacaaaagu

SEQ ID NO: 3033717 - RNA, 20 nt, Human
uucuucccaauagcaaggcu

SEQ ID NO: 3033718 - RNA, 21 nt, Human
uucuuauacauuugauaaagu

SEQ ID NO: 3033719 - RNA, 21 nt, Human
uucuuccacaagagcccaggc

SEQ ID NO: 3033720 - RNA, 12 nt, Human
uucuuucagcca

SEQ ID NO: 3033721 - RNA, 14 nt, Human
uucuuuccaaagua

SEQ ID NO: 3033722 - RNA, 21 nt, Human
uucuuguguguuuauugucaa

SEQ ID NO: 3033723 - RNA, 13 nt, Human
uucuuccucccuc

SEQ ID NO: 3033724 - RNA, 14 nt, Human
uucuuguguguuua

SEQ ID NO: 3033725 - RNA, 15 nt, Human
uugaacuccuggccu

SEQ ID NO: 3033726 - RNA, 16 nt, Human
uugaacuccuggccuc

SEQ ID NO: 3033727 - RNA, 21 nt, Human
uucuuuccaaaguacacuguu

SEQ ID NO: 3033728 - RNA, 20 nt, Human
uugaaaaaccauuuugcugu

SEQ ID NO: 3033729 - RNA, 23 nt, Human
uugaaaacacuguucucugcccu

SEQ ID NO: 3033730 - RNA, 22 nt, Human
uugaaaacacuguucucugccc

SEQ ID NO: 3033731 - RNA, 15 nt, Human
uucuggacuaaaacu

SEQ ID NO: 3033732 - RNA, 19 nt, Human
uucugcuucagccucccga

SEQ ID NO: 3033733 - RNA, 15 nt, Human
uucugcuucagccuc

SEQ ID NO: 3033734 - RNA, 16 nt, Human
uucugcuucagccucc

SEQ ID NO: 3033735 - RNA, 14 nt, Human
uucugcuucagccu

SEQ ID NO: 3033736 - RNA, 19 nt, Human
uucuguccuacucuguguc

SEQ ID NO: 3033737 - RNA, 18 nt, Human
uucuguauuuuguuuuug

SEQ ID NO: 3033738 - RNA, 17 nt, Human
uugauugggcacaucau

SEQ ID NO: 3033739 - RNA, 16 nt, Human
uugauugggcacauca

SEQ ID NO: 3033740 - RNA, 16 nt, Human
uugaugaucuuugcag

SEQ ID NO: 3033741 - RNA, 21 nt, Human
uugcaaaguaucccuacugua

SEQ ID NO: 3033742 - RNA, 18 nt, Human
uugaggguauguuuuaua

SEQ ID NO: 3033743 - RNA, 13 nt, Human
uugaggguugggc

SEQ ID NO: 3033744 - RNA, 16 nt, Human
uugaggguugggcugg

SEQ ID NO: 3033745 - RNA, 11 nt, Human
uugagccuggg

SEQ ID NO: 3033746 - RNA, 23 nt, Human
uugauagcacagacccugcccug

SEQ ID NO: 3033747 - RNA, 23 nt, Human
uugauauccucuuugagugaagc

SEQ ID NO: 3033748 - RNA, 19 nt, Human
uugacuauuuuuguuuuua

SEQ ID NO: 3033749 - RNA, 15 nt, Human
uugacgccaucccag

SEQ ID NO: 3033750 - RNA, 21 nt, Human
uugacuauuuuuguuuuuauu

SEQ ID NO: 3033751 - RNA, 19 nt, Human
uugacgccaucccagcccc

SEQ ID NO: 3033752 - RNA, 18 nt, Human
uugacgccaucccagccc

SEQ ID NO: 3033753 - RNA, 17 nt, Human
uugacgccaucccagcc

SEQ ID NO: 3033754 - RNA, 16 nt, Human
uugaccucugcagcaa

SEQ ID NO: 3033755 - RNA, 21 nt, Human
uugaccucaggugauccaccc

SEQ ID NO: 3033756 - RNA, 14 nt, Human
uugaccucugcagc

SEQ ID NO: 3033757 - RNA, 15 nt, Human
uugaccucugcagca

SEQ ID NO: 3033758 - RNA, 17 nt, Human
uugaccgugaggccaga

SEQ ID NO: 3033759 - RNA, 18 nt, Human
uugaacuggguacuugug

SEQ ID NO: 3033760 - RNA, 13 nt, Human
uugaacuuugacc

SEQ ID NO: 3033761 - RNA, 14 nt, Human
uugaauuguaagga

SEQ ID NO: 3033762 - RNA, 22 nt, Human
uucucauguugaaacuuuaaga

SEQ ID NO: 3033763 - RNA, 16 nt, Human
uucuccacccugcucu

SEQ ID NO: 3033764 - RNA, 20 nt, Human
uucuccaccugccagggaca

SEQ ID NO: 3033765 - RNA, 18 nt, Human
uucuccaccugccaggga

SEQ ID NO: 3033766 - RNA, 16 nt, Human
uucuccaccugccagg

SEQ ID NO: 3033767 - RNA, 15 nt, Human
uucuccaccugccag

SEQ ID NO: 3033768 - RNA, 14 nt, Human
uucuccaccugcca

SEQ ID NO: 3033769 - RNA, 12 nt, Human
uucuccaccugc

SEQ ID NO: 3033770 - RNA, 21 nt, Human
uucuccaccucccacaaagga

SEQ ID NO: 3033771 - RNA, 14 nt, Human
uucucucaucuguu

SEQ ID NO: 3033772 - RNA, 19 nt, Human
uucucuccuguaccucuug

SEQ ID NO: 3033773 - RNA, 14 nt, Human
uucucugaggacac

SEQ ID NO: 3033774 - RNA, 20 nt, Human
uucucugaggacacuaacca

SEQ ID NO: 3033775 - RNA, 12 nt, Human
uucucugcccuc

SEQ ID NO: 3033776 - RNA, 11 nt, Human
uucucugcccu

SEQ ID NO: 3033777 - RNA, 14 nt, Human
uucucuccagcccc

SEQ ID NO: 3033778 - RNA, 13 nt, Human
uucucuccagccc

SEQ ID NO: 3033779 - RNA, 16 nt, Human
uucucuccagccccug

SEQ ID NO: 3033780 - RNA, 15 nt, Human
uucucuccagccccu

SEQ ID NO: 3033781 - RNA, 14 nt, Human
uucucuccuguacc

SEQ ID NO: 3033782 - RNA, 18 nt, Human
uucucuccuguaccucuu

SEQ ID NO: 3033783 - RNA, 19 nt, Human
uucugauccuaguuccacc

SEQ ID NO: 3033784 - RNA, 19 nt, Human
uucugcucacauaucuguc

SEQ ID NO: 3033785 - RNA, 18 nt, Human
uucugacccugcuucaaa

SEQ ID NO: 3033786 - RNA, 22 nt, Human
uucugacccaugcugcccugug

SEQ ID NO: 3033787 - RNA, 23 nt, Human
uucugacccaugcugcccuguga

SEQ ID NO: 3033788 - RNA, 17 nt, Human
uucucugcccuccaaga

SEQ ID NO: 3033789 - RNA, 16 nt, Human
uucucugcccuccaag

SEQ ID NO: 3033790 - RNA, 21 nt, Human
uucuauauaauuccuguuuuu

SEQ ID NO: 3033791 - RNA, 22 nt, Human
uucuacucgaguuacagacaaa

SEQ ID NO: 3033792 - RNA, 13 nt, Human
uucuacgccaggg

SEQ ID NO: 3033793 - RNA, 20 nt, Human
uucuacccagcgagcccugg

SEQ ID NO: 3033794 - RNA, 21 nt, Human
uucuacccagcgagcccuggu

SEQ ID NO: 3033795 - RNA, 14 nt, Human
uucuacccaggugc

SEQ ID NO: 3033796 - RNA, 12 nt, Human
uucuacccagcg

SEQ ID NO: 3033797 - RNA, 19 nt, Human
uucuacccagcgagcccug

SEQ ID NO: 3033798 - RNA, 18 nt, Human
uuccugaagaauugaaaa

SEQ ID NO: 3033799 - RNA, 16 nt, Human
uuccauggccucuuca

SEQ ID NO: 3033800 - RNA, 12 nt, Human
uuccauggccuc

SEQ ID NO: 3033801 - RNA, 15 nt, Human
uuccugaggcugggc

SEQ ID NO: 3033802 - RNA, 20 nt, Human
uuccugaggcugggcucccu

SEQ ID NO: 3033803 - RNA, 23 nt, Human
uuccugaugcuucuucagagacu

SEQ ID NO: 3033804 - RNA, 21 nt, Human
uuccuugaguugauucagcuc

SEQ ID NO: 3033805 - RNA, 20 nt, Human
uuccuugaguugauucagcu

SEQ ID NO: 3033806 - RNA, 14 nt, Human
uucacgcccuuggc

SEQ ID NO: 3033807 - RNA, 13 nt, Human
uucacggaagagc

SEQ ID NO: 3033808 - RNA, 22 nt, Human
uucaccuuuguccccaccgcag

SEQ ID NO: 3033809 - RNA, 16 nt, Human
uucagacagcugccug

SEQ ID NO: 3033810 - RNA, 15 nt, Human
uucagacagcugccu

SEQ ID NO: 3033811 - RNA, 14 nt, Human
uucagacagcugcc

SEQ ID NO: 3033812 - RNA, 17 nt, Human
uucacggaagagccuug

SEQ ID NO: 3033813 - RNA, 17 nt, Human
uucagacagcugccugg

SEQ ID NO: 3033814 - RNA, 13 nt, Human
uucacccuuuucu

SEQ ID NO: 3033815 - RNA, 14 nt, Human
uucaccuuuguccc

SEQ ID NO: 3033816 - RNA, 20 nt, Human
uucaccuuuguccccaccgc

SEQ ID NO: 3033817 - RNA, 19 nt, Human
uucaccuuuguccccaccg

SEQ ID NO: 3033818 - RNA, 21 nt, Human
uucaauaggaaaaacugauuu

SEQ ID NO: 3033819 - RNA, 22 nt, Human
uucaauaggaaaaacugauuuu

SEQ ID NO: 3033820 - RNA, 16 nt, Human
uuauuuggaaaggaau

SEQ ID NO: 3033821 - RNA, 22 nt, Human
uuauuugaguggaguuacugaa

SEQ ID NO: 3033822 - RNA, 20 nt, Human
uuauuuggaaaggaaugcaa

SEQ ID NO: 3033823 - RNA, 18 nt, Human
uuauuuuauuaugcauga

SEQ ID NO: 3033824 - RNA, 22 nt, Human
uucaauaacuggaacacucuau

SEQ ID NO: 3033825 - RNA, 16 nt, Human
uucaauaacuggaaca

SEQ ID NO: 3033826 - RNA, 12 nt, Human
uucaauaacugg

SEQ ID NO: 3033827 - RNA, 21 nt, Human
uucaacagguuuuccugaaga

SEQ ID NO: 3033828 - RNA, 22 nt, Human
uuauuuuggaaaauaaauuauu

SEQ ID NO: 3033829 - RNA, 18 nt, Human
uucaaaugcuguaacuuu

SEQ ID NO: 3033830 - RNA, 16 nt, Human
uuccaaaguacacugu

SEQ ID NO: 3033831 - RNA, 13 nt, Human
uuccaaaguacac

SEQ ID NO: 3033832 - RNA, 15 nt, Human
uuccauggacuuugu

SEQ ID NO: 3033833 - RNA, 14 nt, Human
uuccauggacuuug

SEQ ID NO: 3033834 - RNA, 19 nt, Human
uuccaacccucaucaccaa

SEQ ID NO: 3033835 - RNA, 21 nt, Human
uucagcugguugagguuucaa

SEQ ID NO: 3033836 - RNA, 12 nt, Human
uucagcuccagc

SEQ ID NO: 3033837 - RNA, 15 nt, Human
uucagcuccagcuca

SEQ ID NO: 3033838 - RNA, 22 nt, Human
uucagcuuguaaauagcucagg

SEQ ID NO: 3033839 - RNA, 14 nt, Human
uucaguggcagcug

SEQ ID NO: 3033840 - RNA, 13 nt, Human
uucaguggcagcu

SEQ ID NO: 3033841 - RNA, 13 nt, Human
uucaguguacaug

SEQ ID NO: 3033842 - RNA, 12 nt, Human
uucaguguacau

SEQ ID NO: 3033843 - RNA, 17 nt, Human
uucaguggcagcugcuu

SEQ ID NO: 3033844 - RNA, 15 nt, Human
uucaguggcagcugc

SEQ ID NO: 3033845 - RNA, 16 nt, Human
uucaguggcagcugcu

SEQ ID NO: 3033846 - RNA, 15 nt, Human
uucauaaccuagccu

SEQ ID NO: 3033847 - RNA, 19 nt, Human
uucauccuccucagaucuu

SEQ ID NO: 3033848 - RNA, 15 nt, Human
uucauccuccucaga

SEQ ID NO: 3033849 - RNA, 14 nt, Human
uuagugauguaauu

SEQ ID NO: 3033850 - RNA, 17 nt, Human
ugugaaaagaaaaauga

SEQ ID NO: 3033851 - RNA, 15 nt, Human
ugugaaaagaaaaau

SEQ ID NO: 3033852 - RNA, 13 nt, Human
ugugaaaagaaaa

SEQ ID NO: 3033853 - RNA, 17 nt, Human
uuauaacuuuuuauauu

SEQ ID NO: 3033854 - RNA, 18 nt, Human
uuauaauaauguuaacau

SEQ ID NO: 3033855 - RNA, 15 nt, Human
uuauaauaauguuaa

SEQ ID NO: 3033856 - RNA, 15 nt, Human
uuauaaugaaugaaa

SEQ ID NO: 3033857 - RNA, 21 nt, Human
uuauauucucagcagagugcu

SEQ ID NO: 3033858 - RNA, 20 nt, Human
uuauauucucagcagagugc

SEQ ID NO: 3033859 - RNA, 19 nt, Human
uuauauucucagcagagug

SEQ ID NO: 3033860 - RNA, 18 nt, Human
uuauauucucagcagagu

SEQ ID NO: 3033861 - RNA, 16 nt, Human
uuauauucucagcaga

SEQ ID NO: 3033862 - RNA, 11 nt, Human
uuauacauaaa

SEQ ID NO: 3033863 - RNA, 15 nt, Human
uuaugauugccuuuu

SEQ ID NO: 3033864 - RNA, 21 nt, Human
uuaugauugccuuuuuauaac

SEQ ID NO: 3033865 - RNA, 17 nt, Human
uuauggaacacucugag

SEQ ID NO: 3033866 - RNA, 21 nt, Human
uuauggacaaugacccagugg

SEQ ID NO: 3033867 - RNA, 20 nt, Human
uuauggaacacucugagacu

SEQ ID NO: 3033868 - RNA, 18 nt, Human
uuauggaacacucugaga

SEQ ID NO: 3033869 - RNA, 17 nt, Human
uuauggcuuuugugcau

SEQ ID NO: 3033870 - RNA, 14 nt, Human
uuauggcacaucag

SEQ ID NO: 3033871 - RNA, 16 nt, Human
uuauggcuuuugugca

SEQ ID NO: 3033872 - RNA, 16 nt, Human
uuauuaacaaaacagu

SEQ ID NO: 3033873 - RNA, 21 nt, Human
uuauuaaaugcccagccccuu

SEQ ID NO: 3033874 - RNA, 19 nt, Human
uuauuaaaugcccagcccc

SEQ ID NO: 3033875 - RNA, 20 nt, Human
uugugaaaaaauuuacuuua

SEQ ID NO: 3033876 - RNA, 20 nt, Human
uugugaaaggaaagaggcuc

SEQ ID NO: 3033877 - RNA, 12 nt, Human
uugugauuuuug

SEQ ID NO: 3033878 - RNA, 16 nt, Human
uugugauuuuuguaau

SEQ ID NO: 3033879 - RNA, 17 nt, Human
uugugauuuuuguaauu

SEQ ID NO: 3033880 - RNA, 15 nt, Human
uugucuuaaaaagug

SEQ ID NO: 3033881 - RNA, 15 nt, Human
uuguauucucuccug

SEQ ID NO: 3033882 - RNA, 16 nt, Human
uuguauucucuccugu

SEQ ID NO: 3033883 - RNA, 19 nt, Human
uuguauucucuccuguacc

SEQ ID NO: 3033884 - RNA, 15 nt, Human
uugguauuugaaaca

SEQ ID NO: 3033885 - RNA, 13 nt, Human
uuggucuguguga

SEQ ID NO: 3033886 - RNA, 22 nt, Human
uuggguucaagcgauucuucug

SEQ ID NO: 3033887 - RNA, 18 nt, Human
uuguacauaaugcgugca

SEQ ID NO: 3033888 - RNA, 14 nt, Human
uuguacauaaugcg

SEQ ID NO: 3033889 - RNA, 15 nt, Human
uuguaaauuaacuuu

SEQ ID NO: 3033890 - RNA, 16 nt, Human
uuguaaauuaacuuuu

SEQ ID NO: 3033891 - RNA, 18 nt, Human
uuguaaauuaacuuuuau

SEQ ID NO: 3033892 - RNA, 23 nt, Human
uuguaaauuaacuuuuauaaacu

SEQ ID NO: 3033893 - RNA, 17 nt, Human
uuguaaauagcucaggu

SEQ ID NO: 3033894 - RNA, 15 nt, Human
uugugccuaaugugu

SEQ ID NO: 3033895 - RNA, 18 nt, Human
uugugccuaauguguuug

SEQ ID NO: 3033896 - RNA, 17 nt, Human
uugugcauuaucuagau

SEQ ID NO: 3033897 - RNA, 12 nt, Human
uugugcauuugg

SEQ ID NO: 3033898 - RNA, 22 nt, Human
uugugcauuaucuagauacugu

SEQ ID NO: 3033899 - RNA, 23 nt, Human
uugugcauuaucuagauacugua

SEQ ID NO: 3033900 - RNA, 13 nt, Human
uuguguucaccuu

SEQ ID NO: 3033901 - RNA, 22 nt, Human
uuguggauuuaacagaaaugua

SEQ ID NO: 3033902 - RNA, 23 nt, Human
uuguggauuuaacagaaauguac

SEQ ID NO: 3033903 - RNA, 21 nt, Human
uuguguuuauauauaagccaa

SEQ ID NO: 3033904 - RNA, 20 nt, Human
uuguggauuuaacagaaaug

SEQ ID NO: 3033905 - RNA, 21 nt, Human
uuguggauuuaacagaaaugu

SEQ ID NO: 3033906 - RNA, 17 nt, Human
uuguggacacagcucuu

SEQ ID NO: 3033907 - RNA, 16 nt, Human
uuguggacacagcucu

SEQ ID NO: 3033908 - RNA, 20 nt, Human
uuguuagugugucuuagugu

SEQ ID NO: 3033909 - RNA, 22 nt, Human
uuguuaguaugaggcauuuguu

SEQ ID NO: 3033910 - RNA, 14 nt, Human
uuguuacauuuuua

SEQ ID NO: 3033911 - RNA, 19 nt, Human
uuguuaguaugaggcauuu

SEQ ID NO: 3033912 - RNA, 21 nt, Human
uuguuaguaugaggcauuugu

SEQ ID NO: 3033913 - RNA, 13 nt, Human
uuuauaacuuuuu

SEQ ID NO: 3033914 - RNA, 16 nt, Human
uuuauaacuuuuuaua

SEQ ID NO: 3033915 - RNA, 13 nt, Human
uuuauuaugcaug

SEQ ID NO: 3033916 - RNA, 13 nt, Human
uuuauuauggcac

SEQ ID NO: 3033917 - RNA, 14 nt, Human
uuuauggcuuuugu

SEQ ID NO: 3033918 - RNA, 16 nt, Human
uuuauggcuuuugugc

SEQ ID NO: 3033919 - RNA, 14 nt, Human
uuucauuuagguga

SEQ ID NO: 3033920 - RNA, 18 nt, Human
uuucauuuaggugaggaa

SEQ ID NO: 3033921 - RNA, 13 nt, Human
uuucaguguacau

SEQ ID NO: 3033922 - RNA, 14 nt, Human
uuucaguguacaug

SEQ ID NO: 3033923 - RNA, 14 nt, Human
uuucaauaggaaaa

SEQ ID NO: 3033924 - RNA, 12 nt, Human
uuucaauaggaa

SEQ ID NO: 3033925 - RNA, 17 nt, Human
uuucaauaggaaaaacu

SEQ ID NO: 3033926 - RNA, 14 nt, Human
uuuacuuuaaacua

SEQ ID NO: 3033927 - RNA, 15 nt, Human
uuuacuucuuauaca

SEQ ID NO: 3033928 - RNA, 19 nt, Human
uuuacuucuuauacauuug

SEQ ID NO: 3033929 - RNA, 22 nt, Human
uuuacuucuuauacauuugaua

SEQ ID NO: 3033930 - RNA, 14 nt, Human
uuuagaaauauaau

SEQ ID NO: 3033931 - RNA, 12 nt, Human
uuuagacagagu

SEQ ID NO: 3033932 - RNA, 17 nt, Human
uuuaagaacuaaaaugu

SEQ ID NO: 3033933 - RNA, 16 nt, Human
uuuaagacccucucaa

SEQ ID NO: 3033934 - RNA, 22 nt, Human
uuuaagaaaaaggaugcacaga

SEQ ID NO: 3033935 - RNA, 18 nt, Human
uuuaagaaaaaggaugca

SEQ ID NO: 3033936 - RNA, 18 nt, Human
uuuaacagaaauguacag

SEQ ID NO: 3033937 - RNA, 21 nt, Human
uuuugaagauucuauguuaau

SEQ ID NO: 3033938 - RNA, 11 nt, Human
uuuuuaaaugc

SEQ ID NO: 3033939 - RNA, 12 nt, Human
uuuuuaagaaaa

SEQ ID NO: 3033940 - RNA, 16 nt, Human
uuuuuaagugcugcau

SEQ ID NO: 3033941 - RNA, 17 nt, Human
uuuuuaagugcugcauu

SEQ ID NO: 3033942 - RNA, 18 nt, Human
uuuuuaagugcugcauuu

SEQ ID NO: 3033943 - RNA, 19 nt, Human
uuuuuaagugcugcauuua

SEQ ID NO: 3033944 - RNA, 22 nt, Human
uuuuuaagugcugcauuuaaaa

SEQ ID NO: 3033945 - RNA, 23 nt, Human
uuuuuaagugcugcauuuaaaag

SEQ ID NO: 3033946 - RNA, 11 nt, Human
uuuuuuuacua

SEQ ID NO: 3033947 - RNA, 12 nt, Human
uuuuuuuuaaga

SEQ ID NO: 3033948 - RNA, 13 nt, Human
uuugguauuugaa

SEQ ID NO: 3033949 - RNA, 15 nt, Human
uuuguauucucuccu

SEQ ID NO: 3033950 - RNA, 15 nt, Human
uuuguugucagcuga

SEQ ID NO: 3033951 - RNA, 22 nt, Human
uuuguuaguaugaggcauuugu

SEQ ID NO: 3033952 - RNA, 18 nt, Human
uuuggaaaggaaugcaaa

SEQ ID NO: 3033953 - RNA, 17 nt, Human
uuuggaaaggaaugcaa

SEQ ID NO: 3033954 - RNA, 16 nt, Human
uuuggaaaggaaugca

SEQ ID NO: 3033955 - RNA, 19 nt, Human
uuuggaaaggaaugcaaag

SEQ ID NO: 3033956 - RNA, 12 nt, Human
uuuggaaaauaa

SEQ ID NO: 3033957 - RNA, 13 nt, Human
uuuggacccugag

SEQ ID NO: 3033958 - RNA, 15 nt, Human
uuugcaggaaauccu

SEQ ID NO: 3033959 - RNA, 22 nt, Human
uuugaguggaguuacugaacag

SEQ ID NO: 3033960 - RNA, 21 nt, Human
uuugagugccuuacacaaugg

SEQ ID NO: 3033961 - RNA, 17 nt, Human
uuuccguuaaaauacca

SEQ ID NO: 3033962 - RNA, 13 nt, Human
uuugagugccuua

SEQ ID NO: 3033963 - RNA, 15 nt, Human
uuuccguuaaaauac

SEQ ID NO: 3033964 - RNA, 13 nt, Human
uuuugaaauguca

SEQ ID NO: 3033965 - RNA, 16 nt, Human
uuuucuuucagccaag

SEQ ID NO: 3033966 - RNA, 13 nt, Human
uuuucuucucccu

SEQ ID NO: 3033967 - RNA, 22 nt, Human
uuuucuuguguguuuauuguca

SEQ ID NO: 3033968 - RNA, 13 nt, Human
uuuucuacucgag

SEQ ID NO: 3033969 - RNA, 22 nt, Human
uuuucuacucgaguuacagaca

SEQ ID NO: 3033970 - RNA, 20 nt, Human
uuuucuacucgaguuacaga

SEQ ID NO: 3033971 - RNA, 15 nt, Human
uuuucaaauguucuc

SEQ ID NO: 3033972 - RNA, 22 nt, Human
uuuucccuauuagagaagagau

SEQ ID NO: 3033973 - RNA, 18 nt, Human
uuuucccuauuagagaag

SEQ ID NO: 3033974 - RNA, 13 nt, Human
uuuuaucuucuau

SEQ ID NO: 3033975 - RNA, 19 nt, Human
uuuuaucgucacugcuuaa

SEQ ID NO: 3033976 - RNA, 17 nt, Human
uuuucaaaauaaaaaug

SEQ ID NO: 3033977 - RNA, 18 nt, Human
uuuuauuuuuagacagag

SEQ ID NO: 3033978 - RNA, 13 nt, Human
uuuuauacauaaa

SEQ ID NO: 3033979 - RNA, 21 nt, Human
uuuuauacauaaacaagacca

SEQ ID NO: 3033980 - RNA, 15 nt, Human
uuuuacuaauagaca

SEQ ID NO: 3033981 - RNA, 13 nt, Human
uuuuuuuugacaa

SEQ ID NO: 3033982 - RNA, 16 nt, Human
ugcacgcacacugucu

SEQ ID NO: 3033983 - RNA, 21 nt, Human
ugcaccggcuggccuggcccc

SEQ ID NO: 3033984 - RNA, 17 nt, Human
ugcaccuggaauauaua

SEQ ID NO: 3033985 - RNA, 20 nt, Human
ugcaccuggaauauauaacc

SEQ ID NO: 3033986 - RNA, 22 nt, Human
ugcaccuggaauauauaaccag

SEQ ID NO: 3033987 - RNA, 18 nt, Human
ugcaccggcuggccuggc

SEQ ID NO: 3033988 - RNA, 20 nt, Human
ugcaccggcuggccuggccc

SEQ ID NO: 3033989 - RNA, 19 nt, Human
ugcaccggcuggccuggcc

SEQ ID NO: 3033990 - RNA, 18 nt, Human
ugcacugacauuguuggc

SEQ ID NO: 3033991 - RNA, 21 nt, Human
ugcacugacauuguuggccaa

SEQ ID NO: 3033992 - RNA, 13 nt, Human
ugcaauggcagcc

SEQ ID NO: 3033993 - RNA, 14 nt, Human
ugcaauggcagccu

SEQ ID NO: 3033994 - RNA, 15 nt, Human
ugcaauggcagccuu

SEQ ID NO: 3033995 - RNA, 16 nt, Human
ugcaauggcagccuug

SEQ ID NO: 3033996 - RNA, 16 nt, Human
ugcaaugaccuuucaa

SEQ ID NO: 3033997 - RNA, 13 nt, Human
ugcaaugaccuuu

SEQ ID NO: 3033998 - RNA, 23 nt, Human
ugcaaugaccuuucaauaggaaa

SEQ ID NO: 3033999 - RNA, 22 nt, Human
ugcaaugaccuuucaauaggaa

SEQ ID NO: 3034000 - RNA, 19 nt, Human
ugcaaugaccuuucaauag

SEQ ID NO: 3034001 - RNA, 17 nt, Human
ugcaaugaccuuucaau

SEQ ID NO: 3034002 - RNA, 17 nt, Human
ugcacagaguuguuaca

SEQ ID NO: 3034003 - RNA, 18 nt, Human
ugcacagaguuguuacau

SEQ ID NO: 3034004 - RNA, 19 nt, Human
ugcacagaguuguuacauu

SEQ ID NO: 3034005 - RNA, 20 nt, Human
ugcacaaacagaggccgcca

SEQ ID NO: 3034006 - RNA, 19 nt, Human
ugcacaaacagaggccgcc

SEQ ID NO: 3034007 - RNA, 17 nt, Human
ugcacaaacagaggccg

SEQ ID NO: 3034008 - RNA, 16 nt, Human
ugcacaaacagaggcc

SEQ ID NO: 3034009 - RNA, 15 nt, Human
ugcacaaacagaggc

SEQ ID NO: 3034010 - RNA, 15 nt, Human
ugauuuucauugcug

SEQ ID NO: 3034011 - RNA, 13 nt, Human
ugauuuucauugc

SEQ ID NO: 3034012 - RNA, 23 nt, Human
ugauuuuuuuuuccuucagugcc

SEQ ID NO: 3034013 - RNA, 22 nt, Human
ugauuuuuuuuuccuucagugc

SEQ ID NO: 3034014 - RNA, 20 nt, Human
ugauuuuuuuuuccuucagu

SEQ ID NO: 3034015 - RNA, 19 nt, Human
ugauuuuuuuuuccuucag

SEQ ID NO: 3034016 - RNA, 17 nt, Human
ugauuuuuuuuuccuuc

SEQ ID NO: 3034017 - RNA, 16 nt, Human
ugauuuuuuuuuccuu

SEQ ID NO: 3034018 - RNA, 22 nt, Human
ugcaaccugauugugucucuug

SEQ ID NO: 3034019 - RNA, 20 nt, Human
ugcaaccugauugugucucu

SEQ ID NO: 3034020 - RNA, 19 nt, Human
ugcaaccugauugugucuc

SEQ ID NO: 3034021 - RNA, 18 nt, Human
ugcaaccuccgccucuug

SEQ ID NO: 3034022 - RNA, 20 nt, Human
ugcaaccuccgccucuuggg

SEQ ID NO: 3034023 - RNA, 21 nt, Human
ugcaaccuccgccucuugggu

SEQ ID NO: 3034024 - RNA, 14 nt, Human
ugcaacaggcuggg

SEQ ID NO: 3034025 - RNA, 15 nt, Human
ugcaacaggcugggc

SEQ ID NO: 3034026 - RNA, 16 nt, Human
ugcaacaggcugggcu

SEQ ID NO: 3034027 - RNA, 17 nt, Human
ugcaacaggcugggcuu

SEQ ID NO: 3034028 - RNA, 19 nt, Human
ugcaacaggcugggcuuca

SEQ ID NO: 3034029 - RNA, 20 nt, Human
ugcaacaggcugggcuucag

SEQ ID NO: 3034030 - RNA, 13 nt, Human
ugcaaccuccgcc

SEQ ID NO: 3034031 - RNA, 14 nt, Human
ugcaaccuccgccu

SEQ ID NO: 3034032 - RNA, 22 nt, Human
ugcagaguaggggucugucuuu

SEQ ID NO: 3034033 - RNA, 15 nt, Human
ugcauguuugugauu

SEQ ID NO: 3034034 - RNA, 12 nt, Human
ugcauuaucuag

SEQ ID NO: 3034035 - RNA, 17 nt, Human
ugcauuaucuagauacu

SEQ ID NO: 3034036 - RNA, 12 nt, Human
ugccauccaggu

SEQ ID NO: 3034037 - RNA, 15 nt, Human
ugccauccagguuca

SEQ ID NO: 3034038 - RNA, 17 nt, Human
ugccagguuuuuggucu

SEQ ID NO: 3034039 - RNA, 19 nt, Human
ugccaggaagccagcaggc

SEQ ID NO: 3034040 - RNA, 18 nt, Human
ugccaggaagccagcagg

SEQ ID NO: 3034041 - RNA, 16 nt, Human
ugccaggaagccagca

SEQ ID NO: 3034042 - RNA, 12 nt, Human
ugccaggaagcc

SEQ ID NO: 3034043 - RNA, 15 nt, Human
ugccauguuggccag

SEQ ID NO: 3034044 - RNA, 12 nt, Human
ugccauguuggc

SEQ ID NO: 3034045 - RNA, 16 nt, Human
ugccauguuggccagg

SEQ ID NO: 3034046 - RNA, 20 nt, Human
ugcccaccuggccucugcac

SEQ ID NO: 3034047 - RNA, 18 nt, Human
ugcccacgcuggagugca

SEQ ID NO: 3034048 - RNA, 19 nt, Human
ugcccaccuggccucugca

SEQ ID NO: 3034049 - RNA, 21 nt, Human
ugcccacucccugcaaccuga

SEQ ID NO: 3034050 - RNA, 15 nt, Human
ugccaugugccaggu

SEQ ID NO: 3034051 - RNA, 14 nt, Human
ugccaugugccagg

SEQ ID NO: 3034052 - RNA, 23 nt, Human
ugccaugaggaacaaggcaaggc

SEQ ID NO: 3034053 - RNA, 20 nt, Human
ugccaugaggaacaaggcaa

SEQ ID NO: 3034054 - RNA, 17 nt, Human
ugccugguggcagcugc

SEQ ID NO: 3034055 - RNA, 18 nt, Human
ugccugguggcagcugcg

SEQ ID NO: 3034056 - RNA, 19 nt, Human
ugccugguggcagcugcgg

SEQ ID NO: 3034057 - RNA, 21 nt, Human
ugccucuucucuacucuaggg

SEQ ID NO: 3034058 - RNA, 13 nt, Human
ugccucugggacu

SEQ ID NO: 3034059 - RNA, 22 nt, Human
ugccuccuuugugaggaagccg

SEQ ID NO: 3034060 - RNA, 20 nt, Human
ugccuccuuugugaggaagc

SEQ ID NO: 3034061 - RNA, 21 nt, Human
ugccuccuuugugaggaagcc

SEQ ID NO: 3034062 - RNA, 21 nt, Human
ugcccugcccaccuggccucu

SEQ ID NO: 3034063 - RNA, 23 nt, Human
ugcccugcccaccuggccucugc

SEQ ID NO: 3034064 - RNA, 22 nt, Human
ugcccugcccaccuggccucug

SEQ ID NO: 3034065 - RNA, 17 nt, Human
ugcccuaaaguguauuu

SEQ ID NO: 3034066 - RNA, 19 nt, Human
ugcccuaaaguguauuuuu

SEQ ID NO: 3034067 - RNA, 19 nt, Human
ugccgucuaccugaggggc

SEQ ID NO: 3034068 - RNA, 17 nt, Human
ugccgucuaccugaggg

SEQ ID NO: 3034069 - RNA, 16 nt, Human
ugccgucuaccugagg

SEQ ID NO: 3034070 - RNA, 15 nt, Human
ugccgucuaccugag

SEQ ID NO: 3034071 - RNA, 16 nt, Human
ugauguaauuaugguu

SEQ ID NO: 3034072 - RNA, 22 nt, Human
ugaugcuucuucagagacuccu

SEQ ID NO: 3034073 - RNA, 21 nt, Human
ugaugcuucuucagagacucc

SEQ ID NO: 3034074 - RNA, 19 nt, Human
ugaugcuucuucagagacu

SEQ ID NO: 3034075 - RNA, 18 nt, Human
ugaugcuucuucagagac

SEQ ID NO: 3034076 - RNA, 14 nt, Human
ugaugccaugagga

SEQ ID NO: 3034077 - RNA, 22 nt, Human
ugaugaucuuugcagacaggca

SEQ ID NO: 3034078 - RNA, 23 nt, Human
ugaugaucuuugcagacaggcaa

SEQ ID NO: 3034079 - RNA, 20 nt, Human
ugaugaugaaaugaggucag

SEQ ID NO: 3034080 - RNA, 18 nt, Human
ugaucuuugcagacaggc

SEQ ID NO: 3034081 - RNA, 21 nt, Human
ugaucuuugcagacaggcaag

SEQ ID NO: 3034082 - RNA, 23 nt, Human
ugaucuuugcagacaggcaagca

SEQ ID NO: 3034083 - RNA, 19 nt, Human
ugaucuuugcagacaggca

SEQ ID NO: 3034084 - RNA, 20 nt, Human
ugaucuuugcagacaggcaa

SEQ ID NO: 3034085 - RNA, 22 nt, Human
ugaucacggcucacugcagccu

SEQ ID NO: 3034086 - RNA, 21 nt, Human
ugauccacccaccucagccuc

SEQ ID NO: 3034087 - RNA, 22 nt, Human
ugauccacccaccucagccucc

SEQ ID NO: 3034088 - RNA, 21 nt, Human
ugaucuaggaagacuuuggaa

SEQ ID NO: 3034089 - RNA, 19 nt, Human
ugaucuaggaagacuuugg

SEQ ID NO: 3034090 - RNA, 17 nt, Human
ugaucucucgugauuga

SEQ ID NO: 3034091 - RNA, 13 nt, Human
ugaucauccacug

SEQ ID NO: 3034092 - RNA, 24 nt, Human
ugaucauccacugugccaugugcc

SEQ ID NO: 3034093 - RNA, 17 nt, Human
ugauccaagcugguccc

SEQ ID NO: 3034094 - RNA, 21 nt, Human
ugauccaagcuggucccacuc

SEQ ID NO: 3034095 - RNA, 15 nt, Human
ugauccacccaccuc

SEQ ID NO: 3034096 - RNA, 20 nt, Human
ugauccacccaccucagccu

SEQ ID NO: 3034097 - RNA, 23 nt, Human
ugauagcacagacccugcccugu

SEQ ID NO: 3034098 - RNA, 22 nt, Human
ugauagcacagacccugcccug

SEQ ID NO: 3034099 - RNA, 16 nt, Human
ugauagcacagacccu

SEQ ID NO: 3034100 - RNA, 15 nt, Human
ugauagcacagaccc

SEQ ID NO: 3034101 - RNA, 21 nt, Human
ugauagcacagacccugcccu

SEQ ID NO: 3034102 - RNA, 20 nt, Human
ugauagcacagacccugccc

SEQ ID NO: 3034103 - RNA, 18 nt, Human
ugauagcacagacccugc

SEQ ID NO: 3034104 - RNA, 17 nt, Human
ugauagcacagacccug

SEQ ID NO: 3034105 - RNA, 19 nt, Human
ugaguugauucagcucugc

SEQ ID NO: 3034106 - RNA, 16 nt, Human
ugaguugauucagcuc

SEQ ID NO: 3034107 - RNA, 15 nt, Human
ugagucgaggacagg

SEQ ID NO: 3034108 - RNA, 16 nt, Human
ugagucgaggacaggg

SEQ ID NO: 3034109 - RNA, 23 nt, Human
ugaguugauagcacagacccugc

SEQ ID NO: 3034110 - RNA, 21 nt, Human
ugaguugauagcacagacccu

SEQ ID NO: 3034111 - RNA, 21 nt, Human
ugaguccccuguuuguuucug

SEQ ID NO: 3034112 - RNA, 19 nt, Human
ugagguuucaaaccucccu

SEQ ID NO: 3034113 - RNA, 16 nt, Human
ugaggugcuauguucu

SEQ ID NO: 3034114 - RNA, 15 nt, Human
ugaggugcuauguuc

SEQ ID NO: 3034115 - RNA, 20 nt, Human
ugaguccccuguuuguuucu

SEQ ID NO: 3034116 - RNA, 18 nt, Human
ugaguccuggcaugggaa

SEQ ID NO: 3034117 - RNA, 11 nt, Human
ugaguccuggc

SEQ ID NO: 3034118 - RNA, 14 nt, Human
ugagucgaggacag

SEQ ID NO: 3034119 - RNA, 22 nt, Human
ugaguccuggcaugggaaugaa

SEQ ID NO: 3034120 - RNA, 19 nt, Human
ugaguccuggcaugggaau

SEQ ID NO: 3034121 - RNA, 20 nt, Human
ugaggucuguucuuuccaaa

SEQ ID NO: 3034122 - RNA, 14 nt, Human
ugaggucuguucuu

SEQ ID NO: 3034123 - RNA, 15 nt, Human
ugaggucuguucuuu

SEQ ID NO: 3034124 - RNA, 11 nt, Human
ugaggcugggc

SEQ ID NO: 3034125 - RNA, 20 nt, Human
ugacgccaucccagccccaa

SEQ ID NO: 3034126 - RNA, 19 nt, Human
ugacgccaucccagcccca

SEQ ID NO: 3034127 - RNA, 18 nt, Human
ugacgccaucccagcccc

SEQ ID NO: 3034128 - RNA, 17 nt, Human
ugacgccaucccagccc

SEQ ID NO: 3034129 - RNA, 22 nt, Human
ugaccuuucaauaggaaaaacu

SEQ ID NO: 3034130 - RNA, 18 nt, Human
ugaccuuucaauaggaaa

SEQ ID NO: 3034131 - RNA, 16 nt, Human
ugacgccaucccagcc

SEQ ID NO: 3034132 - RNA, 15 nt, Human
ugacgccaucccagc

SEQ ID NO: 3034133 - RNA, 14 nt, Human
ugacgccaucccag

SEQ ID NO: 3034134 - RNA, 13 nt, Human
ugacgccauccca

SEQ ID NO: 3034135 - RNA, 14 nt, Human
ugacugaauuucuu

SEQ ID NO: 3034136 - RNA, 15 nt, Human
ugacugaauuucuuu

SEQ ID NO: 3034137 - RNA, 13 nt, Human
ugacugaauuucu

SEQ ID NO: 3034138 - RNA, 19 nt, Human
ugaccauucuccaccugcc

SEQ ID NO: 3034139 - RNA, 15 nt, Human
ucuugaacuccuggc

SEQ ID NO: 3034140 - RNA, 22 nt, Human
ugaccauucuccaccugccagg

SEQ ID NO: 3034141 - RNA, 21 nt, Human
ugaccauucuccaccugccag

SEQ ID NO: 3034142 - RNA, 20 nt, Human
ugaccauucuccaccugcca

SEQ ID NO: 3034143 - RNA, 17 nt, Human
ucuugaauuguaaggaa

SEQ ID NO: 3034144 - RNA, 13 nt, Human
ugaccucugcagc

SEQ ID NO: 3034145 - RNA, 16 nt, Human
ugaccucugcagcaau

SEQ ID NO: 3034146 - RNA, 22 nt, Human
ugaccucaggugauccacccac

SEQ ID NO: 3034147 - RNA, 13 nt, Human
ugaccuuucaaua

SEQ ID NO: 3034148 - RNA, 14 nt, Human
ugaccuuucaauag

SEQ ID NO: 3034149 - RNA, 16 nt, Human
ugaccuuucaauagga

SEQ ID NO: 3034150 - RNA, 15 nt, Human
ugaccuuucaauagg

SEQ ID NO: 3034151 - RNA, 12 nt, Human
ugaccucugccu

SEQ ID NO: 3034152 - RNA, 23 nt, Human
ugaccucugcagcaauaaagcag

SEQ ID NO: 3034153 - RNA, 18 nt, Human
ugaccucugcagcaauaa

SEQ ID NO: 3034154 - RNA, 21 nt, Human
ugaccucugcagcaauaaagc

SEQ ID NO: 3034155 - RNA, 13 nt, Human
ugagccucagcau

SEQ ID NO: 3034156 - RNA, 15 nt, Human
ugagccucagcaucc

SEQ ID NO: 3034157 - RNA, 15 nt, Human
ugagcaucaggccag

SEQ ID NO: 3034158 - RNA, 14 nt, Human
ugagcaucaggcca

SEQ ID NO: 3034159 - RNA, 13 nt, Human
ugagcaucaggcc

SEQ ID NO: 3034160 - RNA, 12 nt, Human
ugagacucuguc

SEQ ID NO: 3034161 - RNA, 13 nt, Human
ugagacucugucu

SEQ ID NO: 3034162 - RNA, 14 nt, Human
ugagacucugucuc

SEQ ID NO: 3034163 - RNA, 22 nt, Human
ugagaggcauccaguaucuuga

SEQ ID NO: 3034164 - RNA, 23 nt, Human
ugagaggcauccaguaucuugaa

SEQ ID NO: 3034165 - RNA, 15 nt, Human
ugagaucagccuggg

SEQ ID NO: 3034166 - RNA, 19 nt, Human
ugagaggggaacagacugg

SEQ ID NO: 3034167 - RNA, 17 nt, Human
ugagaguagagucacug

SEQ ID NO: 3034168 - RNA, 12 nt, Human
ugagacccuguc

SEQ ID NO: 3034169 - RNA, 16 nt, Human
uggacauuuuaugucu

SEQ ID NO: 3034170 - RNA, 17 nt, Human
uggacauuuuaugucuu

SEQ ID NO: 3034171 - RNA, 11 nt, Human
uggacauuuua

SEQ ID NO: 3034172 - RNA, 13 nt, Human
uggacauuuuaug

SEQ ID NO: 3034173 - RNA, 17 nt, Human
uggacaggcauguucuc

SEQ ID NO: 3034174 - RNA, 18 nt, Human
uggacaggcauguucucu

SEQ ID NO: 3034175 - RNA, 22 nt, Human
uggacaggcauguucucugagg

SEQ ID NO: 3034176 - RNA, 23 nt, Human
uggacguguuaugacuccagaau

SEQ ID NO: 3034177 - RNA, 19 nt, Human
uggacguguuaugacucca

SEQ ID NO: 3034178 - RNA, 20 nt, Human
uggacuaacuugucuuugga

SEQ ID NO: 3034179 - RNA, 19 nt, Human
uggacuaacuugucuuugg

SEQ ID NO: 3034180 - RNA, 20 nt, Human
uggauugugccuaauguguu

SEQ ID NO: 3034181 - RNA, 23 nt, Human
uggauugugccuaauguguuuga

SEQ ID NO: 3034182 - RNA, 19 nt, Human
uggauugugccuaaugugu

SEQ ID NO: 3034183 - RNA, 15 nt, Human
uggauuuaacagaaa

SEQ ID NO: 3034184 - RNA, 17 nt, Human
uggauuuaacagaaaug

SEQ ID NO: 3034185 - RNA, 21 nt, Human
uggcacuauaauguaagcucu

SEQ ID NO: 3034186 - RNA, 22 nt, Human
uggcacuauaauguaagcucua

SEQ ID NO: 3034187 - RNA, 19 nt, Human
uggcacugcuuccagugag

SEQ ID NO: 3034188 - RNA, 22 nt, Human
uggcacugcuuccagugaggcu

SEQ ID NO: 3034189 - RNA, 18 nt, Human
uggcagcucagagagggu

SEQ ID NO: 3034190 - RNA, 21 nt, Human
uggauuguccccgacccuugc

SEQ ID NO: 3034191 - RNA, 22 nt, Human
uggaugcagccucacaguccuu

SEQ ID NO: 3034192 - RNA, 21 nt, Human
uggaugcagccucacaguccu

SEQ ID NO: 3034193 - RNA, 13 nt, Human
uggaugcagccuc

SEQ ID NO: 3034194 - RNA, 23 nt, Human
uggaggggggaggugggauccuc

SEQ ID NO: 3034195 - RNA, 14 nt, Human
uggaaaagaauaaa

SEQ ID NO: 3034196 - RNA, 18 nt, Human
ugcuugugaaaggaaaga

SEQ ID NO: 3034197 - RNA, 13 nt, Human
ugcuucuucagag

SEQ ID NO: 3034198 - RNA, 14 nt, Human
uggaacacucugag

SEQ ID NO: 3034199 - RNA, 17 nt, Human
uggaacacucugagacu

SEQ ID NO: 3034200 - RNA, 15 nt, Human
uggaacacucugaga

SEQ ID NO: 3034201 - RNA, 12 nt, Human
ugcuucucacug

SEQ ID NO: 3034202 - RNA, 21 nt, Human
ugcuuccagugaggcucugcc

SEQ ID NO: 3034203 - RNA, 23 nt, Human
ugcuuccagugaggcucugcccu

SEQ ID NO: 3034204 - RNA, 22 nt, Human
ugcuuccagugaggcucugccc

SEQ ID NO: 3034205 - RNA, 19 nt, Human
ugcuuaacuucacauauug

SEQ ID NO: 3034206 - RNA, 13 nt, Human
ugcuuaacuucac

SEQ ID NO: 3034207 - RNA, 14 nt, Human
ugcuuaacuucaca

SEQ ID NO: 3034208 - RNA, 17 nt, Human
ugcuuaacuucacauau

SEQ ID NO: 3034209 - RNA, 18 nt, Human
ugcuuaacuucacauauu

SEQ ID NO: 3034210 - RNA, 16 nt, Human
uggcugcugaaggcuc

SEQ ID NO: 3034211 - RNA, 14 nt, Human
uggcugcugaaggc

SEQ ID NO: 3034212 - RNA, 13 nt, Human
uggcugcugaagg

SEQ ID NO: 3034213 - RNA, 11 nt, Human
uggcugcugaa

SEQ ID NO: 3034214 - RNA, 22 nt, Human
uggccucccaacucaccccagc

SEQ ID NO: 3034215 - RNA, 21 nt, Human
uggccucccaacucaccccag

SEQ ID NO: 3034216 - RNA, 20 nt, Human
uggccucccaacucacccca

SEQ ID NO: 3034217 - RNA, 19 nt, Human
uggccucccaacucacccc

SEQ ID NO: 3034218 - RNA, 14 nt, Human
uggccucccaacuc

SEQ ID NO: 3034219 - RNA, 11 nt, Human
uggccucccaa

SEQ ID NO: 3034220 - RNA, 18 nt, Human
uggccucaagugauucuc

SEQ ID NO: 3034221 - RNA, 23 nt, Human
uggccucaagugauucuccugcc

SEQ ID NO: 3034222 - RNA, 23 nt, Human
uggccuagcauacguacacauuu

SEQ ID NO: 3034223 - RNA, 17 nt, Human
uggcagcugcgguccac

SEQ ID NO: 3034224 - RNA, 20 nt, Human
uggccccucagggucccugg

SEQ ID NO: 3034225 - RNA, 13 nt, Human
uggccccucaggg

SEQ ID NO: 3034226 - RNA, 22 nt, Human
uggccccucagggucccuggug

SEQ ID NO: 3034227 - RNA, 21 nt, Human
uggccccucagggucccuggu

SEQ ID NO: 3034228 - RNA, 20 nt, Human
uggccuagcauacguacaca

SEQ ID NO: 3034229 - RNA, 16 nt, Human
ugggaggaucucuuga

SEQ ID NO: 3034230 - RNA, 15 nt, Human
ugggacacccuguga

SEQ ID NO: 3034231 - RNA, 14 nt, Human
ugggacacccugug

SEQ ID NO: 3034232 - RNA, 13 nt, Human
ugggacacccugu

SEQ ID NO: 3034233 - RNA, 16 nt, Human
ugggaaugaaugucag

SEQ ID NO: 3034234 - RNA, 18 nt, Human
ugggaugauuggaggggg

SEQ ID NO: 3034235 - RNA, 13 nt, Human
ugggcagagcaga

SEQ ID NO: 3034236 - RNA, 14 nt, Human
ugggcagagcagag

SEQ ID NO: 3034237 - RNA, 17 nt, Human
ugggcagagcagagacc

SEQ ID NO: 3034238 - RNA, 15 nt, Human
ugggcagagcagaga

SEQ ID NO: 3034239 - RNA, 22 nt, Human
ugggcuucaguggcagcugcuu

SEQ ID NO: 3034240 - RNA, 21 nt, Human
ugggcuucaguggcagcugcu

SEQ ID NO: 3034241 - RNA, 15 nt, Human
ugggcuucauccucc

SEQ ID NO: 3034242 - RNA, 22 nt, Human
ugggcuuggggaccagagcugc

SEQ ID NO: 3034243 - RNA, 21 nt, Human
ugggcuugucuguagauuuua

SEQ ID NO: 3034244 - RNA, 23 nt, Human
ugggcuuggggaccagagcugcc

SEQ ID NO: 3034245 - RNA, 17 nt, Human
ugggcuugucuguagau

SEQ ID NO: 3034246 - RNA, 16 nt, Human
ugggggccucagugcc

SEQ ID NO: 3034247 - RNA, 19 nt, Human
ugggggcugggcagaggaa

SEQ ID NO: 3034248 - RNA, 19 nt, Human
uggggggcugaggugggag

SEQ ID NO: 3034249 - RNA, 14 nt, Human
ugucuuuuaaacuc

SEQ ID NO: 3034250 - RNA, 16 nt, Human
ugucuuuucuugcaug

SEQ ID NO: 3034251 - RNA, 23 nt, Human
ugucuuuggacccugaggcccag

SEQ ID NO: 3034252 - RNA, 14 nt, Human
ugucuaugggacuc

SEQ ID NO: 3034253 - RNA, 15 nt, Human
ugucuaugggacuca

SEQ ID NO: 3034254 - RNA, 16 nt, Human
ugucuaugggacucaa

SEQ ID NO: 3034255 - RNA, 23 nt, Human
ugucuaguuguuugauucagaca

SEQ ID NO: 3034256 - RNA, 15 nt, Human
ugucuaguuguuuga

SEQ ID NO: 3034257 - RNA, 21 nt, Human
ugucucaaaaaaagaaaaaga

SEQ ID NO: 3034258 - RNA, 15 nt, Human
uguccuauuauauuc

SEQ ID NO: 3034259 - RNA, 19 nt, Human
uguccccgcacugggcuug

SEQ ID NO: 3034260 - RNA, 17 nt, Human
uguccccgcacugggcu

SEQ ID NO: 3034261 - RNA, 12 nt, Human
uguccugggagu

SEQ ID NO: 3034262 - RNA, 19 nt, Human
uguccugggagugagcugg

SEQ ID NO: 3034263 - RNA, 20 nt, Human
uguccugggagugagcuggu

SEQ ID NO: 3034264 - RNA, 14 nt, Human
ugucuaaugaaacc

SEQ ID NO: 3034265 - RNA, 13 nt, Human
uguaucugagcag

SEQ ID NO: 3034266 - RNA, 23 nt, Human
uguacagcaaggagauuuacaac

SEQ ID NO: 3034267 - RNA, 22 nt, Human
uguacagcaaggagauuuacaa

SEQ ID NO: 3034268 - RNA, 12 nt, Human
uguacagagccc

SEQ ID NO: 3034269 - RNA, 21 nt, Human
uguacagagcccacgccccca

SEQ ID NO: 3034270 - RNA, 21 nt, Human
ugucaauuacaggaaguacug

SEQ ID NO: 3034271 - RNA, 14 nt, Human
ugucacaggcaggu

SEQ ID NO: 3034272 - RNA, 19 nt, Human
ugucaauuacaggaaguac

SEQ ID NO: 3034273 - RNA, 14 nt, Human
ugucagugugacug

SEQ ID NO: 3034274 - RNA, 15 nt, Human
ugucagugugacuga

SEQ ID NO: 3034275 - RNA, 19 nt, Human
ugucagugugacugaucuc

SEQ ID NO: 3034276 - RNA, 16 nt, Human
ugucagugugacugau

SEQ ID NO: 3034277 - RNA, 13 nt, Human
ugucacaggcagg

SEQ ID NO: 3034278 - RNA, 15 nt, Human
ugucacaggcagguc

SEQ ID NO: 3034279 - RNA, 16 nt, Human
ugucacaggcaggucc

SEQ ID NO: 3034280 - RNA, 17 nt, Human
ugucacaggcaggucca

SEQ ID NO: 3034281 - RNA, 21 nt, Human
ugucacaggcagguccagggu

SEQ ID NO: 3034282 - RNA, 17 nt, Human
uguaacaagccacccca

SEQ ID NO: 3034283 - RNA, 14 nt, Human
uguaacaagccacc

SEQ ID NO: 3034284 - RNA, 11 nt, Human
uguacagagcc

SEQ ID NO: 3034285 - RNA, 14 nt, Human
uguacagacaacaa

SEQ ID NO: 3034286 - RNA, 16 nt, Human
ugguuuucuguucuuu

SEQ ID NO: 3034287 - RNA, 19 nt, Human
ugguuuucuuguguguuua

SEQ ID NO: 3034288 - RNA, 21 nt, Human
ugguuuuuaaaaaacugcuga

SEQ ID NO: 3034289 - RNA, 23 nt, Human
ugguuuuuaaaaaacugcugacu

SEQ ID NO: 3034290 - RNA, 16 nt, Human
uggugucaccugaaga

SEQ ID NO: 3034291 - RNA, 15 nt, Human
uggugucgggcauga

SEQ ID NO: 3034292 - RNA, 18 nt, Human
uggugucgggcaugacac

SEQ ID NO: 3034293 - RNA, 18 nt, Human
ugguugaugaucuuugca

SEQ ID NO: 3034294 - RNA, 19 nt, Human
uggugguuuucuguucuuu

SEQ ID NO: 3034295 - RNA, 17 nt, Human
uggugguuucagaaaug

SEQ ID NO: 3034296 - RNA, 18 nt, Human
uggugguuucagaaaugu

SEQ ID NO: 3034297 - RNA, 18 nt, Human
uggugggggccucggugu

SEQ ID NO: 3034298 - RNA, 16 nt, Human
uggugggggccucggu

SEQ ID NO: 3034299 - RNA, 13 nt, Human
ugguggcuggguu

SEQ ID NO: 3034300 - RNA, 12 nt, Human
ugguggcagugg

SEQ ID NO: 3034301 - RNA, 19 nt, Human
uggugcaaugaccuuucaa

SEQ ID NO: 3034302 - RNA, 14 nt, Human
uggugcaaugaccu

SEQ ID NO: 3034303 - RNA, 20 nt, Human
ugguggcagugggagcugcc

SEQ ID NO: 3034304 - RNA, 13 nt, Human
ugguggcaguggg

SEQ ID NO: 3034305 - RNA, 18 nt, Human
ugguggcagugggagcug

SEQ ID NO: 3034306 - RNA, 14 nt, Human
uggugagaggcauc

SEQ ID NO: 3034307 - RNA, 20 nt, Human
uggguacuuguggacacagc

SEQ ID NO: 3034308 - RNA, 23 nt, Human
uggguacuuguggacacagcucu

SEQ ID NO: 3034309 - RNA, 19 nt, Human
ucuguuuuguguacuuuua

SEQ ID NO: 3034310 - RNA, 13 nt, Human
ucuguuuugugua

SEQ ID NO: 3034311 - RNA, 22 nt, Human
ucuuaaauauguggaguucauc

SEQ ID NO: 3034312 - RNA, 15 nt, Human
ucuucuccaggcugu

SEQ ID NO: 3034313 - RNA, 12 nt, Human
ucuugaacuccu

SEQ ID NO: 3034314 - RNA, 15 nt, Human
ucuucagaucucuaa

SEQ ID NO: 3034315 - RNA, 18 nt, Human
ucuucagaucucuaacuu

SEQ ID NO: 3034316 - RNA, 23 nt, Human
ucuucagaucucuaacuucacca

SEQ ID NO: 3034317 - RNA, 21 nt, Human
ucuggacaggcauguucucug

SEQ ID NO: 3034318 - RNA, 14 nt, Human
ucuggacaggcaug

SEQ ID NO: 3034319 - RNA, 15 nt, Human
ucuggaaugcagugg

SEQ ID NO: 3034320 - RNA, 19 nt, Human
ucuggaauaaggagaauga

SEQ ID NO: 3034321 - RNA, 19 nt, Human
ucugcugacagacacaggc

SEQ ID NO: 3034322 - RNA, 20 nt, Human
ucugcugacagacacaggcc

SEQ ID NO: 3034323 - RNA, 21 nt, Human
ucugcugacagacacaggccc

SEQ ID NO: 3034324 - RNA, 22 nt, Human
ucugcugacagacacaggcccg

SEQ ID NO: 3034325 - RNA, 15 nt, Human
ucugccugcccaggc

SEQ ID NO: 3034326 - RNA, 18 nt, Human
ucugcuccucuccccagc

SEQ ID NO: 3034327 - RNA, 18 nt, Human
ucugcugacagacacagg

SEQ ID NO: 3034328 - RNA, 17 nt, Human
ucugcugacagacacag

SEQ ID NO: 3034329 - RNA, 14 nt, Human
ucugccugcccagg

SEQ ID NO: 3034330 - RNA, 13 nt, Human
ucugccugcccag

SEQ ID NO: 3034331 - RNA, 14 nt, Human
ucugucgcccaguc

SEQ ID NO: 3034332 - RNA, 21 nt, Human
ucuguccugggagugagcugg

SEQ ID NO: 3034333 - RNA, 15 nt, Human
ucuguccuacucugu

SEQ ID NO: 3034334 - RNA, 19 nt, Human
ucuguccuacucuguguca

SEQ ID NO: 3034335 - RNA, 14 nt, Human
ucuguccuacucug

SEQ ID NO: 3034336 - RNA, 14 nt, Human
ucugggacacaguu

SEQ ID NO: 3034337 - RNA, 13 nt, Human
ucugggacacagu

SEQ ID NO: 3034338 - RNA, 23 nt, Human
ucuggugacuuuccucuuugguc

SEQ ID NO: 3034339 - RNA, 23 nt, Human
ucuggcucuuccaggcugggaga

SEQ ID NO: 3034340 - RNA, 18 nt, Human
ucuggcucuuccaggcug

SEQ ID NO: 3034341 - RNA, 19 nt, Human
ucuggcuaugcauuugaaa

SEQ ID NO: 3034342 - RNA, 22 nt, Human
ucuggcuaugcauuugaaaauu

SEQ ID NO: 3034343 - RNA, 17 nt, Human
ucuggcuaugcauuuga

SEQ ID NO: 3034344 - RNA, 22 nt, Human
ucucuguaauaaacucauuucu

SEQ ID NO: 3034345 - RNA, 18 nt, Human
ucucuguaauaaacucau

SEQ ID NO: 3034346 - RNA, 15 nt, Human
ucucuaguuugauua

SEQ ID NO: 3034347 - RNA, 14 nt, Human
ucucugaggacacu

SEQ ID NO: 3034348 - RNA, 17 nt, Human
ucucugaggacacuaac

SEQ ID NO: 3034349 - RNA, 19 nt, Human
ucucuaacuucaccauauu

SEQ ID NO: 3034350 - RNA, 12 nt, Human
ucucuaacuuca

SEQ ID NO: 3034351 - RNA, 22 nt, Human
ucucgugauugauaagaaccuu

SEQ ID NO: 3034352 - RNA, 14 nt, Human
ucucgugauugaua

SEQ ID NO: 3034353 - RNA, 13 nt, Human
ucuccuguaccuc

SEQ ID NO: 3034354 - RNA, 16 nt, Human
ucuccuguaccucuug

SEQ ID NO: 3034355 - RNA, 17 nt, Human
ucuccuguaccucuuga

SEQ ID NO: 3034356 - RNA, 17 nt, Human
ucuccugccucagccuc

SEQ ID NO: 3034357 - RNA, 15 nt, Human
ucuccugccucagcc

SEQ ID NO: 3034358 - RNA, 15 nt, Human
ucuccuguaccucuu

SEQ ID NO: 3034359 - RNA, 21 nt, Human
ucuccuggaaauauuaagaaa

SEQ ID NO: 3034360 - RNA, 20 nt, Human
ucugcaagaauugaagcagg

SEQ ID NO: 3034361 - RNA, 14 nt, Human
ucugacccacugcu

SEQ ID NO: 3034362 - RNA, 23 nt, Human
ucugaggaauccagacccggcug

SEQ ID NO: 3034363 - RNA, 13 nt, Human
ucugaaaauguau

SEQ ID NO: 3034364 - RNA, 16 nt, Human
ucugacacacagcucu

SEQ ID NO: 3034365 - RNA, 17 nt, Human
ucugacacacagcucug

SEQ ID NO: 3034366 - RNA, 18 nt, Human
ucugacacacagcucugu

SEQ ID NO: 3034367 - RNA, 19 nt, Human
ucugacacacagcucuguc

SEQ ID NO: 3034368 - RNA, 12 nt, Human
ucugacaggcaa

SEQ ID NO: 3034369 - RNA, 21 nt, Human
ucugacaggcaaugcuggcug

SEQ ID NO: 3034370 - RNA, 22 nt, Human
ucugacaggcaaugcuggcugu

SEQ ID NO: 3034371 - RNA, 13 nt, Human
ucugacccacugc

SEQ ID NO: 3034372 - RNA, 18 nt, Human
uccuaauaaaaaggugac

SEQ ID NO: 3034373 - RNA, 16 nt, Human
uccuaauaaaaaggug

SEQ ID NO: 3034374 - RNA, 17 nt, Human
uccuaauaaaaagguga

SEQ ID NO: 3034375 - RNA, 16 nt, Human
uccuaaucuucugaac

SEQ ID NO: 3034376 - RNA, 12 nt, Human
uccuaauaaaaa

SEQ ID NO: 3034377 - RNA, 13 nt, Human
uccuaauaaaaag

SEQ ID NO: 3034378 - RNA, 14 nt, Human
uccuaauaaaaagg

SEQ ID NO: 3034379 - RNA, 15 nt, Human
uccuaauaaaaaggu

SEQ ID NO: 3034380 - RNA, 13 nt, Human
uccgaccagacac

SEQ ID NO: 3034381 - RNA, 18 nt, Human
uccuacccacccuccuuu

SEQ ID NO: 3034382 - RNA, 12 nt, Human
uccuauuauauu

SEQ ID NO: 3034383 - RNA, 17 nt, Human
uccucauuagcauuuug

SEQ ID NO: 3034384 - RNA, 22 nt, Human
uccuaguuccaccaucaagcca

SEQ ID NO: 3034385 - RNA, 18 nt, Human
uccuauauuguuuucagu

SEQ ID NO: 3034386 - RNA, 19 nt, Human
uccuccuuuucacaguucu

SEQ ID NO: 3034387 - RNA, 14 nt, Human
uccucuaggagguc

SEQ ID NO: 3034388 - RNA, 15 nt, Human
uccucuguacagagc

SEQ ID NO: 3034389 - RNA, 18 nt, Human
uccucuguacagagccca

SEQ ID NO: 3034390 - RNA, 17 nt, Human
uccucuguacagagccc

SEQ ID NO: 3034391 - RNA, 16 nt, Human
uccucuguacagagcc

SEQ ID NO: 3034392 - RNA, 16 nt, Human
uccucugcugcuggcu

SEQ ID NO: 3034393 - RNA, 15 nt, Human
uccucugcugcuggc

SEQ ID NO: 3034394 - RNA, 14 nt, Human
uccucugcugcugg

SEQ ID NO: 3034395 - RNA, 12 nt, Human
uccucugcugcu

SEQ ID NO: 3034396 - RNA, 16 nt, Human
ucccuauuagagaaga

SEQ ID NO: 3034397 - RNA, 17 nt, Human
uccagguuuaagcuguu

SEQ ID NO: 3034398 - RNA, 20 nt, Human
uccccuguuuguuucugaaa

SEQ ID NO: 3034399 - RNA, 18 nt, Human
uccccuguuuguuucuga

SEQ ID NO: 3034400 - RNA, 21 nt, Human
uccccuguuuguuucugaaag

SEQ ID NO: 3034401 - RNA, 14 nt, Human
ucccugcacuugca

SEQ ID NO: 3034402 - RNA, 13 nt, Human
ucccugcacuugc

SEQ ID NO: 3034403 - RNA, 13 nt, Human
ucccuucccaccu

SEQ ID NO: 3034404 - RNA, 22 nt, Human
ucuaaauaucccuuggacauuu

SEQ ID NO: 3034405 - RNA, 21 nt, Human
ucuaaaucuccaaaauaaaac

SEQ ID NO: 3034406 - RNA, 16 nt, Human
ucgugauugauaagaa

SEQ ID NO: 3034407 - RNA, 21 nt, Human
ucuaggaagacuuuggaaaga

SEQ ID NO: 3034408 - RNA, 17 nt, Human
ucucaaauaacuaaaag

SEQ ID NO: 3034409 - RNA, 15 nt, Human
ucuaucaaguauuau

SEQ ID NO: 3034410 - RNA, 21 nt, Human
ucuaucaaguauuauaccuuu

SEQ ID NO: 3034411 - RNA, 22 nt, Human
ucuaucaaguauuauaccuuuu

SEQ ID NO: 3034412 - RNA, 19 nt, Human
uccugucggagcccugucu

SEQ ID NO: 3034413 - RNA, 14 nt, Human
uccuuaccagcaga

SEQ ID NO: 3034414 - RNA, 20 nt, Human
uccuguaccucuugagccuu

SEQ ID NO: 3034415 - RNA, 20 nt, Human
uccuggcacccggccccugc

SEQ ID NO: 3034416 - RNA, 21 nt, Human
uccuggcacccggccccugcu

SEQ ID NO: 3034417 - RNA, 17 nt, Human
uccuggcacugcuucca

SEQ ID NO: 3034418 - RNA, 22 nt, Human
uccuggcacugcuuccagugag

SEQ ID NO: 3034419 - RNA, 18 nt, Human
uccuggcacugcuuccag

SEQ ID NO: 3034420 - RNA, 16 nt, Human
uccugccucagccucc

SEQ ID NO: 3034421 - RNA, 13 nt, Human
uccugccucagcc

SEQ ID NO: 3034422 - RNA, 15 nt, Human
uccugccucagccuc

SEQ ID NO: 3034423 - RNA, 16 nt, Human
uccuggcacccggccc

SEQ ID NO: 3034424 - RNA, 19 nt, Human
uccuggcacccggccccug

SEQ ID NO: 3034425 - RNA, 14 nt, Human
uccuggcacccggc

SEQ ID NO: 3034426 - RNA, 13 nt, Human
uccugagccagau

SEQ ID NO: 3034427 - RNA, 14 nt, Human
uccugccucagccu

SEQ ID NO: 3034428 - RNA, 14 nt, Human
uccugagccagauu

SEQ ID NO: 3034429 - RNA, 19 nt, Human
uccuucacagaugggugcu

SEQ ID NO: 3034430 - RNA, 20 nt, Human
uccuucaccuuuguccccac

SEQ ID NO: 3034431 - RNA, 18 nt, Human
uccuucaccuuugucccc

SEQ ID NO: 3034432 - RNA, 18 nt, Human
uccuucacagaugggugc

SEQ ID NO: 3034433 - RNA, 18 nt, Human
uccuuaccagcagagcac

SEQ ID NO: 3034434 - RNA, 17 nt, Human
uccuuaccagcagagca

SEQ ID NO: 3034435 - RNA, 16 nt, Human
uccuuaccagcagagc

SEQ ID NO: 3034436 - RNA, 22 nt, Human
uccuucaccuuuguccccaccg

SEQ ID NO: 3034437 - RNA, 21 nt, Human
uccuucaccuuuguccccacc

SEQ ID NO: 3034438 - RNA, 23 nt, Human
uccuuuucacaguucucuccuuc

SEQ ID NO: 3034439 - RNA, 17 nt, Human
uauuuucuccaaauguu

SEQ ID NO: 3034440 - RNA, 22 nt, Human
uauuuucccuauuagagaagag

SEQ ID NO: 3034441 - RNA, 17 nt, Human
uauuuuuuucuuuucuu

SEQ ID NO: 3034442 - RNA, 14 nt, Human
uauuuuuuuacuaa

SEQ ID NO: 3034443 - RNA, 15 nt, Human
ucaaaaaaagaaaaa

SEQ ID NO: 3034444 - RNA, 14 nt, Human
ucaaaaaaagaaaa

SEQ ID NO: 3034445 - RNA, 14 nt, Human
uauuuuauuaugca

SEQ ID NO: 3034446 - RNA, 17 nt, Human
uauuuuauuaugcauga

SEQ ID NO: 3034447 - RNA, 23 nt, Human
ucaaccccuucgcuccugugucu

SEQ ID NO: 3034448 - RNA, 21 nt, Human
ucaagugauucuccugccuca

SEQ ID NO: 3034449 - RNA, 18 nt, Human
ucaagugauucuccugcc

SEQ ID NO: 3034450 - RNA, 20 nt, Human
ucaagugauucuccugccuc

SEQ ID NO: 3034451 - RNA, 23 nt, Human
ucaauuacaggaaguacuggaga

SEQ ID NO: 3034452 - RNA, 21 nt, Human
ucaauuacaggaaguacugga

SEQ ID NO: 3034453 - RNA, 18 nt, Human
ucacauuuauucugcuca

SEQ ID NO: 3034454 - RNA, 19 nt, Human
ucacauuuauucugcucac

SEQ ID NO: 3034455 - RNA, 17 nt, Human
ucacauuuauucugcuc

SEQ ID NO: 3034456 - RNA, 19 nt, Human
ucaccaaaucagcugcuac

SEQ ID NO: 3034457 - RNA, 20 nt, Human
ucaccaaaucagcugcuacu

SEQ ID NO: 3034458 - RNA, 16 nt, Human
ucacaggcagguccag

SEQ ID NO: 3034459 - RNA, 17 nt, Human
ucacaggcagguccagg

SEQ ID NO: 3034460 - RNA, 18 nt, Human
ucacaggcagguccaggg

SEQ ID NO: 3034461 - RNA, 19 nt, Human
ucacaguccuuaccagcag

SEQ ID NO: 3034462 - RNA, 23 nt, Human
ucacaguccuuaccagcagagca

SEQ ID NO: 3034463 - RNA, 22 nt, Human
ucacaguccuuaccagcagagc

SEQ ID NO: 3034464 - RNA, 20 nt, Human
ucaauuacaggaaguacugg

SEQ ID NO: 3034465 - RNA, 15 nt, Human
uauucucagcagagu

SEQ ID NO: 3034466 - RNA, 21 nt, Human
uauucucagcagagugcuuua

SEQ ID NO: 3034467 - RNA, 17 nt, Human
uauucucagcagagugc

SEQ ID NO: 3034468 - RNA, 17 nt, Human
uauucucuccuguaccu

SEQ ID NO: 3034469 - RNA, 21 nt, Human
uauugauaugcuuauacacuu

SEQ ID NO: 3034470 - RNA, 13 nt, Human
uauugauguuuuc

SEQ ID NO: 3034471 - RNA, 14 nt, Human
uauugauguuuuca

SEQ ID NO: 3034472 - RNA, 17 nt, Human
uauugcugauggugcaa

SEQ ID NO: 3034473 - RNA, 22 nt, Human
uauuggaaauuuguuauaauga

SEQ ID NO: 3034474 - RNA, 12 nt, Human
uauuguuuucag

SEQ ID NO: 3034475 - RNA, 22 nt, Human
uauuguuuucaguguacaugga

SEQ ID NO: 3034476 - RNA, 18 nt, Human
uauuguuuucaguguaca

SEQ ID NO: 3034477 - RNA, 20 nt, Human
uauuguuuucaguguacaug

SEQ ID NO: 3034478 - RNA, 13 nt, Human
uauuaacaaaaca

SEQ ID NO: 3034479 - RNA, 24 nt, Human
uauuaagaaagacuaucuaaaugu

SEQ ID NO: 3034480 - RNA, 12 nt, Human
uauuaaauuaug

SEQ ID NO: 3034481 - RNA, 20 nt, Human
uauguugcccaggcaggucu

SEQ ID NO: 3034482 - RNA, 13 nt, Human
uauguugcccagg

SEQ ID NO: 3034483 - RNA, 16 nt, Human
uauguugcccaggcag

SEQ ID NO: 3034484 - RNA, 19 nt, Human
uauguugcccaggcagguc

SEQ ID NO: 3034485 - RNA, 15 nt, Human
gggaguggccacaga

SEQ ID NO: 3034486 - RNA, 13 nt, Human
gggaguggccaca

SEQ ID NO: 3034487 - RNA, 14 nt, Human
ucauuaguuuugaa

SEQ ID NO: 3034488 - RNA, 23 nt, Human
ucauuaguuuugaagauucuaug

SEQ ID NO: 3034489 - RNA, 21 nt, Human
ucaugcugccaauauccuaau

SEQ ID NO: 3034490 - RNA, 23 nt, Human
ucaugcugccaauauccuaauaa

SEQ ID NO: 3034491 - RNA, 22 nt, Human
ucauuaggugugacugaauuuc

SEQ ID NO: 3034492 - RNA, 16 nt, Human
ucauuauguuaauauu

SEQ ID NO: 3034493 - RNA, 17 nt, Human
ucauuauguuaauauuu

SEQ ID NO: 3034494 - RNA, 21 nt, Human
ucauucaacccaccugcgucu

SEQ ID NO: 3034495 - RNA, 13 nt, Human
ucauuuccugugu

SEQ ID NO: 3034496 - RNA, 16 nt, Human
ucauuuccugugucuu

SEQ ID NO: 3034497 - RNA, 13 nt, Human
ucaugcugccaau

SEQ ID NO: 3034498 - RNA, 17 nt, Human
ucaugcugccaauaucc

SEQ ID NO: 3034499 - RNA, 19 nt, Human
ucaugcugccaauauccua

SEQ ID NO: 3034500 - RNA, 20 nt, Human
ucaugcugccaauauccuaa

SEQ ID NO: 3034501 - RNA, 23 nt, Human
ucaucuuagguuggcaaaaaggc

SEQ ID NO: 3034502 - RNA, 21 nt, Human
ucaucaccaacgucugugcca

SEQ ID NO: 3034503 - RNA, 20 nt, Human
ucaucaccaacgucugugcc

SEQ ID NO: 3034504 - RNA, 19 nt, Human
ucaucaccaacgucugugc

SEQ ID NO: 3034505 - RNA, 13 nt, Human
ucaggugcugcca

SEQ ID NO: 3034506 - RNA, 14 nt, Human
ucaggugcugccau

SEQ ID NO: 3034507 - RNA, 23 nt, Human
ucaggugccucaagagaaggcaa

SEQ ID NO: 3034508 - RNA, 21 nt, Human
ucaggugagaagcagaggaag

SEQ ID NO: 3034509 - RNA, 21 nt, Human
ucauacccacccccacccaag

SEQ ID NO: 3034510 - RNA, 22 nt, Human
uccaggggugggacacccugug

SEQ ID NO: 3034511 - RNA, 22 nt, Human
uccaggagcagccacauuccug

SEQ ID NO: 3034512 - RNA, 18 nt, Human
uccaggagcagccacauu

SEQ ID NO: 3034513 - RNA, 17 nt, Human
uccaggagcagccacau

SEQ ID NO: 3034514 - RNA, 15 nt, Human
uccaggugcacaagc

SEQ ID NO: 3034515 - RNA, 23 nt, Human
uccaggggugggacacccuguga

SEQ ID NO: 3034516 - RNA, 15 nt, Human
uccagguucagcuug

SEQ ID NO: 3034517 - RNA, 16 nt, Human
uccagguucagcuugu

SEQ ID NO: 3034518 - RNA, 22 nt, Human
uccaggugcacaagcuccaagc

SEQ ID NO: 3034519 - RNA, 21 nt, Human
uccaggugcacaagcuccaag

SEQ ID NO: 3034520 - RNA, 20 nt, Human
uccaggugcacaagcuccaa

SEQ ID NO: 3034521 - RNA, 18 nt, Human
uccaggugcacaagcucc

SEQ ID NO: 3034522 - RNA, 16 nt, Human
uccaggagcagccaca

SEQ ID NO: 3034523 - RNA, 17 nt, Human
uccagcuguucagcugg

SEQ ID NO: 3034524 - RNA, 15 nt, Human
uccagcucaccagcc

SEQ ID NO: 3034525 - RNA, 18 nt, Human
uccagcucaccagcccca

SEQ ID NO: 3034526 - RNA, 16 nt, Human
uccagcucaccagccc

SEQ ID NO: 3034527 - RNA, 17 nt, Human
uccagcucaccagcccc

SEQ ID NO: 3034528 - RNA, 23 nt, Human
uccagccaaagccuccuccagcc

SEQ ID NO: 3034529 - RNA, 17 nt, Human
uccacaaguuaaauaaa

SEQ ID NO: 3034530 - RNA, 18 nt, Human
uccacaaguuaaauaaau

SEQ ID NO: 3034531 - RNA, 15 nt, Human
uccacaagagcccag

SEQ ID NO: 3034532 - RNA, 18 nt, Human
uccacaagagcccaggcc

SEQ ID NO: 3034533 - RNA, 17 nt, Human
uccacaagagcccaggc

SEQ ID NO: 3034534 - RNA, 16 nt, Human
uccacaagagcccagg

SEQ ID NO: 3034535 - RNA, 17 nt, Human
uccaauuuacauacucu

SEQ ID NO: 3034536 - RNA, 18 nt, Human
uccaauuuacauacucug

SEQ ID NO: 3034537 - RNA, 20 nt, Human
uccaaaauaaaacuuuuuaa

SEQ ID NO: 3034538 - RNA, 18 nt, Human
uccaaaauaaaacuuuuu

SEQ ID NO: 3034539 - RNA, 21 nt, Human
uccaccugccagggacagagg

SEQ ID NO: 3034540 - RNA, 18 nt, Human
uccaccugccagggacag

SEQ ID NO: 3034541 - RNA, 15 nt, Human
uccaccugccaggga

SEQ ID NO: 3034542 - RNA, 17 nt, Human
uccaccugccagggaca

SEQ ID NO: 3034543 - RNA, 12 nt, Human
uccacccugcuc

SEQ ID NO: 3034544 - RNA, 17 nt, Human
ucacugguacucugcca

SEQ ID NO: 3034545 - RNA, 14 nt, Human
ucacugcuuaacuu

SEQ ID NO: 3034546 - RNA, 13 nt, Human
ucaccagccccag

SEQ ID NO: 3034547 - RNA, 22 nt, Human
ucaccccggccaccugcggugc

SEQ ID NO: 3034548 - RNA, 17 nt, Human
ucacucuuauugcccac

SEQ ID NO: 3034549 - RNA, 22 nt, Human
ucacucugucgcccagucugga

SEQ ID NO: 3034550 - RNA, 18 nt, Human
ucacugccaugccagcuu

SEQ ID NO: 3034551 - RNA, 20 nt, Human
ucacucuuauugcccacgcu

SEQ ID NO: 3034552 - RNA, 10 nt, Human
ucagaaaugu

SEQ ID NO: 3034553 - RNA, 23 nt, Human
ucagaauucucuaguuugauuaa

SEQ ID NO: 3034554 - RNA, 15 nt, Human
ucagaaauguguuau

SEQ ID NO: 3034555 - RNA, 16 nt, Human
ucagaauucucuaguu

SEQ ID NO: 3034556 - RNA, 13 nt, Human
ucagacagcugcc

SEQ ID NO: 3034557 - RNA, 16 nt, Human
ucagggccuggcucag

SEQ ID NO: 3034558 - RNA, 14 nt, Human
ucagggccuggcuc

SEQ ID NO: 3034559 - RNA, 16 nt, Human
ucaggugagaagcaga

SEQ ID NO: 3034560 - RNA, 15 nt, Human
ucaggugagaagcag

SEQ ID NO: 3034561 - RNA, 20 nt, Human
ucagccucccgaguagcugg

SEQ ID NO: 3034562 - RNA, 18 nt, Human
ucagccucccgaguagcu

SEQ ID NO: 3034563 - RNA, 21 nt, Human
ucagccucccgaauagcuggg

SEQ ID NO: 3034564 - RNA, 22 nt, Human
ucagccucccgaauagcuggga

SEQ ID NO: 3034565 - RNA, 13 nt, Human
ucagccucccaaa

SEQ ID NO: 3034566 - RNA, 14 nt, Human
ucagccucccaaag

SEQ ID NO: 3034567 - RNA, 19 nt, Human
ucagccucccaaagugcug

SEQ ID NO: 3034568 - RNA, 21 nt, Human
ucagccucccaaagugcuggg

SEQ ID NO: 3034569 - RNA, 19 nt, Human
ucagccugcuccagcuguu

SEQ ID NO: 3034570 - RNA, 18 nt, Human
ucagccugcuccagcugu

SEQ ID NO: 3034571 - RNA, 21 nt, Human
ucagccucccgaguagcuggg

SEQ ID NO: 3034572 - RNA, 22 nt, Human
ucagccucccgaguagcuggga

SEQ ID NO: 3034573 - RNA, 16 nt, Human
ucagcugaaccugggu

SEQ ID NO: 3034574 - RNA, 15 nt, Human
ucagcugaaccuggg

SEQ ID NO: 3034575 - RNA, 22 nt, Human
ggcuuagacccucaugcugcca

SEQ ID NO: 3034576 - RNA, 23 nt, Human
ggcuuagacccucaugcugccaa

SEQ ID NO: 3034577 - RNA, 14 nt, Human
ggcuuagucacuga

SEQ ID NO: 3034578 - RNA, 20 nt, Human
ggcuucacggaagagccuug

SEQ ID NO: 3034579 - RNA, 21 nt, Human
ggcuucacggaagagccuugc

SEQ ID NO: 3034580 - RNA, 18 nt, Human
ggcuuggggaccagagcu

SEQ ID NO: 3034581 - RNA, 17 nt, Human
ggcuuggggaccagagc

SEQ ID NO: 3034582 - RNA, 20 nt, Human
ggcuuagacccucaugcugc

SEQ ID NO: 3034583 - RNA, 18 nt, Human
ggcuuagacccucaugcu

SEQ ID NO: 3034584 - RNA, 16 nt, Human
ggcuguuggcuggggg

SEQ ID NO: 3034585 - RNA, 20 nt, Human
ggcuguuggcugggggccuc

SEQ ID NO: 3034586 - RNA, 14 nt, Human
ggcuguuggcuggg

SEQ ID NO: 3034587 - RNA, 15 nt, Human
ggcuguuggcugggg

SEQ ID NO: 3034588 - RNA, 15 nt, Human
ggcuggaguuauuga

SEQ ID NO: 3034589 - RNA, 23 nt, Human
ggcuggaguuauugaagcagagu

SEQ ID NO: 3034590 - RNA, 18 nt, Human
ggcugggcucccuuccca

SEQ ID NO: 3034591 - RNA, 21 nt, Human
ggcugggcucccuucccaccu

SEQ ID NO: 3034592 - RNA, 20 nt, Human
ggcugggcucccuucccacc

SEQ ID NO: 3034593 - RNA, 16 nt, Human
ggcugggggaagaagc

SEQ ID NO: 3034594 - RNA, 14 nt, Human
ggcugggggccuca

SEQ ID NO: 3034595 - RNA, 11 nt, Human
ggcugggcuuc

SEQ ID NO: 3034596 - RNA, 21 nt, Human
ggcugggcuucaguggcagcu

SEQ ID NO: 3034597 - RNA, 22 nt, Human
ggcugggcuucaguggcagcug

SEQ ID NO: 3034598 - RNA, 18 nt, Human
ggcugggcuucaguggca

SEQ ID NO: 3034599 - RNA, 19 nt, Human
ggcugcuucaaggauccug

SEQ ID NO: 3034600 - RNA, 15 nt, Human
ggcugcuucaaggau

SEQ ID NO: 3034601 - RNA, 20 nt, Human
ggcugcuucaaggauccuga

SEQ ID NO: 3034602 - RNA, 13 nt, Human
gggagcugccugu

SEQ ID NO: 3034603 - RNA, 21 nt, Human
gggagcugccuguucagcucc

SEQ ID NO: 3034604 - RNA, 22 nt, Human
gggagcugccuguucagcucca

SEQ ID NO: 3034605 - RNA, 20 nt, Human
gggaggugggauccuccagg

SEQ ID NO: 3034606 - RNA, 23 nt, Human
gggaggauugcuugagcucagga

SEQ ID NO: 3034607 - RNA, 21 nt, Human
gggagugaguugauagcacag

SEQ ID NO: 3034608 - RNA, 22 nt, Human
gggaggauguucugggacacag

SEQ ID NO: 3034609 - RNA, 21 nt, Human
gggaggauugcuugagcucag

SEQ ID NO: 3034610 - RNA, 23 nt, Human
gggaggaucucuugagccuggga

SEQ ID NO: 3034611 - RNA, 19 nt, Human
gggaauguuugccucugcc

SEQ ID NO: 3034612 - RNA, 21 nt, Human
gggaauguuugccucugccuc

SEQ ID NO: 3034613 - RNA, 14 nt, Human
gggacacccuguga

SEQ ID NO: 3034614 - RNA, 17 nt, Human
gggacucaaugcacuga

SEQ ID NO: 3034615 - RNA, 19 nt, Human
gggacucaaugcacugaca

SEQ ID NO: 3034616 - RNA, 23 nt, Human
gggacucaaugcacugacauugu

SEQ ID NO: 3034617 - RNA, 23 nt, Human
ggccugggggcugggcagaggaa

SEQ ID NO: 3034618 - RNA, 16 nt, Human
ggccuggccugagcug

SEQ ID NO: 3034619 - RNA, 15 nt, Human
ggccuggccugagcu

SEQ ID NO: 3034620 - RNA, 24 nt, Human
ggcgcagcauauucaggaagcuca

SEQ ID NO: 3034621 - RNA, 23 nt, Human
ggcgcagcauauucaggaagcuc

SEQ ID NO: 3034622 - RNA, 22 nt, Human
ggccucugcacuccccugcugg

SEQ ID NO: 3034623 - RNA, 19 nt, Human
ggccucugcacuccccugc

SEQ ID NO: 3034624 - RNA, 18 nt, Human
ggccucugcacuccccug

SEQ ID NO: 3034625 - RNA, 13 nt, Human
ggccuggccccuc

SEQ ID NO: 3034626 - RNA, 14 nt, Human
ggccuggccugagc

SEQ ID NO: 3034627 - RNA, 13 nt, Human
ggccuggccugag

SEQ ID NO: 3034628 - RNA, 10 nt, Human
ggccuggccu

SEQ ID NO: 3034629 - RNA, 23 nt, Human
ggccuggccccucagggucccug

SEQ ID NO: 3034630 - RNA, 18 nt, Human
ggccuggccccucagggu

SEQ ID NO: 3034631 - RNA, 17 nt, Human
ggccuggccccucaggg

SEQ ID NO: 3034632 - RNA, 15 nt, Human
ggccuggccccucag

SEQ ID NO: 3034633 - RNA, 14 nt, Human
ggccuggccccuca

SEQ ID NO: 3034634 - RNA, 20 nt, Human
ggcccagagggccugcaagg

SEQ ID NO: 3034635 - RNA, 19 nt, Human
ggcccagagggccugcaag

SEQ ID NO: 3034636 - RNA, 17 nt, Human
ggcccagagggccugca

SEQ ID NO: 3034637 - RNA, 14 nt, Human
ggcccagagggccu

SEQ ID NO: 3034638 - RNA, 14 nt, Human
ggccucaagugauu

SEQ ID NO: 3034639 - RNA, 22 nt, Human
ggccucaagugauucuccugcc

SEQ ID NO: 3034640 - RNA, 20 nt, Human
ggccuagcauacguacacau

SEQ ID NO: 3034641 - RNA, 22 nt, Human
ggccuagcauacguacacauuu

SEQ ID NO: 3034642 - RNA, 16 nt, Human
ggccucugcacucccc

SEQ ID NO: 3034643 - RNA, 20 nt, Human
ggccucgguguggagaagcg

SEQ ID NO: 3034644 - RNA, 14 nt, Human
ggccuccugugugu

SEQ ID NO: 3034645 - RNA, 12 nt, Human
ggcucugcccuu

SEQ ID NO: 3034646 - RNA, 15 nt, Human
ggcucugccucccau

SEQ ID NO: 3034647 - RNA, 13 nt, Human
ggcucugccuccc

SEQ ID NO: 3034648 - RNA, 15 nt, Human
ggcucugcccuuggu

SEQ ID NO: 3034649 - RNA, 14 nt, Human
ggcucugcccuugg

SEQ ID NO: 3034650 - RNA, 16 nt, Human
ggcucugccucccauc

SEQ ID NO: 3034651 - RNA, 14 nt, Human
ggcuccaggcuccu

SEQ ID NO: 3034652 - RNA, 16 nt, Human
ggcucucaggccagcu

SEQ ID NO: 3034653 - RNA, 15 nt, Human
ggcucucaggccagc

SEQ ID NO: 3034654 - RNA, 20 nt, Human
ggcucucaggccagcugcuu

SEQ ID NO: 3034655 - RNA, 19 nt, Human
ggcucucaggccagcugcu

SEQ ID NO: 3034656 - RNA, 18 nt, Human
ggcucucaggccagcugc

SEQ ID NO: 3034657 - RNA, 17 nt, Human
ggcucucaggccagcug

SEQ ID NO: 3034658 - RNA, 14 nt, Human
ggcucucaggccag

SEQ ID NO: 3034659 - RNA, 15 nt, Human
ggcgcgguggcucac

SEQ ID NO: 3034660 - RNA, 17 nt, Human
ggcgcugccccuggcag

SEQ ID NO: 3034661 - RNA, 11 nt, Human
ggcgcugcccc

SEQ ID NO: 3034662 - RNA, 12 nt, Human
ggcuccaggcuc

SEQ ID NO: 3034663 - RNA, 13 nt, Human
ggcuccaggcucc

SEQ ID NO: 3034664 - RNA, 17 nt, Human
ggcuccaggagcagcca

SEQ ID NO: 3034665 - RNA, 16 nt, Human
ggcuccaggagcagcc

SEQ ID NO: 3034666 - RNA, 14 nt, Human
ggcuccaggagcag

SEQ ID NO: 3034667 - RNA, 10 nt, Human
ggcuccagac

SEQ ID NO: 3034668 - RNA, 12 nt, Human
ggcuaugcauuu

SEQ ID NO: 3034669 - RNA, 13 nt, Human
ggcuaugcauuug

SEQ ID NO: 3034670 - RNA, 9 nt, Human
ggcuccaga

SEQ ID NO: 3034671 - RNA, 19 nt, Human
ggauugaaggaugcugucu

SEQ ID NO: 3034672 - RNA, 17 nt, Human
ggcaagcaccuccugcc

SEQ ID NO: 3034673 - RNA, 21 nt, Human
ggauucuuccucccucccucu

SEQ ID NO: 3034674 - RNA, 16 nt, Human
ggauucuuccucccuc

SEQ ID NO: 3034675 - RNA, 18 nt, Human
ggcaagcaccuccugccu

SEQ ID NO: 3034676 - RNA, 19 nt, Human
ggcaagcaccuccugccuc

SEQ ID NO: 3034677 - RNA, 17 nt, Human
ggcaccagcagccugga

SEQ ID NO: 3034678 - RNA, 18 nt, Human
ggcacccggccccugcug

SEQ ID NO: 3034679 - RNA, 19 nt, Human
ggcacccggccccugcugg

SEQ ID NO: 3034680 - RNA, 20 nt, Human
ggcacccggccccugcuggu

SEQ ID NO: 3034681 - RNA, 17 nt, Human
ggcacccggccccugcu

SEQ ID NO: 3034682 - RNA, 18 nt, Human
ggcacucagaagacacug

SEQ ID NO: 3034683 - RNA, 19 nt, Human
ggcacucagaagacacuga

SEQ ID NO: 3034684 - RNA, 22 nt, Human
ggcagagcagagaccaucccug

SEQ ID NO: 3034685 - RNA, 18 nt, Human
ggaugcccaaagaugcag

SEQ ID NO: 3034686 - RNA, 19 nt, Human
ggaugcccaaagaugcagc

SEQ ID NO: 3034687 - RNA, 13 nt, Human
ggaugccuggugg

SEQ ID NO: 3034688 - RNA, 17 nt, Human
ggaugccugguggcagc

SEQ ID NO: 3034689 - RNA, 16 nt, Human
ggaugaucuaggaaga

SEQ ID NO: 3034690 - RNA, 22 nt, Human
ggaugaucuaggaagacuuugg

SEQ ID NO: 3034691 - RNA, 18 nt, Human
ggaugaucuaggaagacu

SEQ ID NO: 3034692 - RNA, 23 nt, Human
ggagucccaccuuggcugcaggg

SEQ ID NO: 3034693 - RNA, 18 nt, Human
ggaugccugguggcagcu

SEQ ID NO: 3034694 - RNA, 19 nt, Human
ggaugccugguggcagcug

SEQ ID NO: 3034695 - RNA, 20 nt, Human
ggaugccugguggcagcugc

SEQ ID NO: 3034696 - RNA, 21 nt, Human
ggaugccugguggcagcugcg

SEQ ID NO: 3034697 - RNA, 17 nt, Human
ggcagugcuuggcccag

SEQ ID NO: 3034698 - RNA, 18 nt, Human
ggcagugcuuggcccagg

SEQ ID NO: 3034699 - RNA, 19 nt, Human
ggcagugcuuggcccagga

SEQ ID NO: 3034700 - RNA, 20 nt, Human
ggcagugcuuggcccaggag

SEQ ID NO: 3034701 - RNA, 21 nt, Human
ggcagugcuuggcccaggagu

SEQ ID NO: 3034702 - RNA, 22 nt, Human
ggcagugcuuggcccaggaguu

SEQ ID NO: 3034703 - RNA, 23 nt, Human
ggcagugcuuggcccaggaguuu

SEQ ID NO: 3034704 - RNA, 16 nt, Human
ggcagugcuuggccca

SEQ ID NO: 3034705 - RNA, 22 nt, Human
ggcaugacacgaauauugcuga

SEQ ID NO: 3034706 - RNA, 23 nt, Human
ggcaugugaugagaggaaaucac

SEQ ID NO: 3034707 - RNA, 18 nt, Human
ggcaugugaugagaggaa

SEQ ID NO: 3034708 - RNA, 17 nt, Human
ggcagggucucacucug

SEQ ID NO: 3034709 - RNA, 18 nt, Human
ggcagggucucacucugu

SEQ ID NO: 3034710 - RNA, 17 nt, Human
ggcagguuggugggggc

SEQ ID NO: 3034711 - RNA, 23 nt, Human
ggcagcugcgguccacccaggag

SEQ ID NO: 3034712 - RNA, 24 nt, Human
ggcagcugcgguccacccaggagc

SEQ ID NO: 3034713 - RNA, 12 nt, Human
ggcaggguccua

SEQ ID NO: 3034714 - RNA, 21 nt, Human
ggcagcugcgguccacccagg

SEQ ID NO: 3034715 - RNA, 17 nt, Human
ggcagaguugaagacag

SEQ ID NO: 3034716 - RNA, 21 nt, Human
ggcagaguugaagacagagcu

SEQ ID NO: 3034717 - RNA, 19 nt, Human
ggcagaguugaagacagag

SEQ ID NO: 3034718 - RNA, 20 nt, Human
ggcauguucucugaggacac

SEQ ID NO: 3034719 - RNA, 22 nt, Human
ggccacagaaaauucuucucca

SEQ ID NO: 3034720 - RNA, 20 nt, Human
ggccacugugaagagaacca

SEQ ID NO: 3034721 - RNA, 11 nt, Human
ggccaggagcc

SEQ ID NO: 3034722 - RNA, 14 nt, Human
ggccaggcccucug

SEQ ID NO: 3034723 - RNA, 13 nt, Human
ggccaggagccuc

SEQ ID NO: 3034724 - RNA, 17 nt, Human
ggccaggcccucugccc

SEQ ID NO: 3034725 - RNA, 16 nt, Human
ggccaggcccucugcc

SEQ ID NO: 3034726 - RNA, 15 nt, Human
ggccaggcccucugc

SEQ ID NO: 3034727 - RNA, 12 nt, Human
ggcccagagagg

SEQ ID NO: 3034728 - RNA, 15 nt, Human
ggacauuuuaugucu

SEQ ID NO: 3034729 - RNA, 19 nt, Human
ggaccagagcugccaccug

SEQ ID NO: 3034730 - RNA, 14 nt, Human
ggaccagagcugcc

SEQ ID NO: 3034731 - RNA, 22 nt, Human
ggacagccacggccaggccaga

SEQ ID NO: 3034732 - RNA, 20 nt, Human
ggacagaggggguggccucc

SEQ ID NO: 3034733 - RNA, 11 nt, Human
ggacagcuccu

SEQ ID NO: 3034734 - RNA, 15 nt, Human
ggacagcuccuucug

SEQ ID NO: 3034735 - RNA, 16 nt, Human
ggacagcuccuucugu

SEQ ID NO: 3034736 - RNA, 22 nt, Human
ggacacucaaaagcugggcagg

SEQ ID NO: 3034737 - RNA, 16 nt, Human
ggacagaggggguggc

SEQ ID NO: 3034738 - RNA, 19 nt, Human
ggagaagucuucuauuuau

SEQ ID NO: 3034739 - RNA, 20 nt, Human
ggagaagucuucuauuuauu

SEQ ID NO: 3034740 - RNA, 18 nt, Human
ggaccuugaacuggguac

SEQ ID NO: 3034741 - RNA, 18 nt, Human
ggagcccugucuccucuc

SEQ ID NO: 3034742 - RNA, 14 nt, Human
ggagccuccugccc

SEQ ID NO: 3034743 - RNA, 15 nt, Human
ggagccuccugcccu

SEQ ID NO: 3034744 - RNA, 17 nt, Human
ggagggagggcuccaga

SEQ ID NO: 3034745 - RNA, 16 nt, Human
ggagggagggcuccag

SEQ ID NO: 3034746 - RNA, 13 nt, Human
ggagggagggcuc

SEQ ID NO: 3034747 - RNA, 18 nt, Human
ggaggauguucugggaca

SEQ ID NO: 3034748 - RNA, 21 nt, Human
ggaggauguucugggacacag

SEQ ID NO: 3034749 - RNA, 21 nt, Human
ggagucccaccuuggcugcag

SEQ ID NO: 3034750 - RNA, 22 nt, Human
ggagucccaccuuggcugcagg

SEQ ID NO: 3034751 - RNA, 23 nt, Human
gccuuguuuaaugguaguuuuac

SEQ ID NO: 3034752 - RNA, 15 nt, Human
gccuuguuuaauggu

SEQ ID NO: 3034753 - RNA, 15 nt, Human
gccuuacacaauggu

SEQ ID NO: 3034754 - RNA, 21 nt, Human
gcgacaaugcaaaccaucauu

SEQ ID NO: 3034755 - RNA, 20 nt, Human
gcgacaaugcaaaccaucau

SEQ ID NO: 3034756 - RNA, 13 nt, Human
gcgacaaugcaaa

SEQ ID NO: 3034757 - RNA, 12 nt, Human
gcgacaaugcaa

SEQ ID NO: 3034758 - RNA, 15 nt, Human
gcggggacagcuccu

SEQ ID NO: 3034759 - RNA, 17 nt, Human
gcggggacagcuccuuc

SEQ ID NO: 3034760 - RNA, 19 nt, Human
gcggugagaggggaacaga

SEQ ID NO: 3034761 - RNA, 13 nt, Human
gcgguccacccag

SEQ ID NO: 3034762 - RNA, 14 nt, Human
gcgguccacccagg

SEQ ID NO: 3034763 - RNA, 21 nt, Human
gcgcugccccuggcagccccu

SEQ ID NO: 3034764 - RNA, 18 nt, Human
gcgcugccccuggcagcc

SEQ ID NO: 3034765 - RNA, 17 nt, Human
gcgcugccccuggcagc

SEQ ID NO: 3034766 - RNA, 16 nt, Human
gcggagaaaggaaggg

SEQ ID NO: 3034767 - RNA, 19 nt, Human
gcggagacggagucccacc

SEQ ID NO: 3034768 - RNA, 14 nt, Human
gcggggacagcucc

SEQ ID NO: 3034769 - RNA, 21 nt, Human
gcgccuuaaggauguucuagc

SEQ ID NO: 3034770 - RNA, 23 nt, Human
gcgcccaguuggguggaugccug

SEQ ID NO: 3034771 - RNA, 14 nt, Human
gccuggccccucag

SEQ ID NO: 3034772 - RNA, 13 nt, Human
gccuggccccuca

SEQ ID NO: 3034773 - RNA, 20 nt, Human
gccuggccagaugcaccagc

SEQ ID NO: 3034774 - RNA, 16 nt, Human
gccuggccagaugcac

SEQ ID NO: 3034775 - RNA, 21 nt, Human
gccuggccagaugcaccagcc

SEQ ID NO: 3034776 - RNA, 20 nt, Human
gccuguaauccuagcacuuu

SEQ ID NO: 3034777 - RNA, 15 nt, Human
gccuguaauccuagc

SEQ ID NO: 3034778 - RNA, 18 nt, Human
gccuggauggggcugcac

SEQ ID NO: 3034779 - RNA, 16 nt, Human
gccuggauggggcugc

SEQ ID NO: 3034780 - RNA, 20 nt, Human
gccuggauggggcugcaccg

SEQ ID NO: 3034781 - RNA, 12 nt, Human
gccugagcuggg

SEQ ID NO: 3034782 - RNA, 19 nt, Human
gcccaguuggguggaugcc

SEQ ID NO: 3034783 - RNA, 21 nt, Human
gcccaguuggguggaugccug

SEQ ID NO: 3034784 - RNA, 15 nt, Human
gccugaagucacaca

SEQ ID NO: 3034785 - RNA, 16 nt, Human
gccugaagucacacag

SEQ ID NO: 3034786 - RNA, 17 nt, Human
gccugaagucacacagu

SEQ ID NO: 3034787 - RNA, 18 nt, Human
gccugaagucacacagug

SEQ ID NO: 3034788 - RNA, 16 nt, Human
gcucagcggggacagc

SEQ ID NO: 3034789 - RNA, 17 nt, Human
gcucagcggggacagcu

SEQ ID NO: 3034790 - RNA, 18 nt, Human
gcucagcggggacagcuc

SEQ ID NO: 3034791 - RNA, 23 nt, Human
gcucagcggggacagcuccuucu

SEQ ID NO: 3034792 - RNA, 18 nt, Human
gcucaccucucccuugga

SEQ ID NO: 3034793 - RNA, 17 nt, Human
gcucaccucucccuugg

SEQ ID NO: 3034794 - RNA, 16 nt, Human
gcucaccucucccuug

SEQ ID NO: 3034795 - RNA, 14 nt, Human
gcucaccucucccu

SEQ ID NO: 3034796 - RNA, 16 nt, Human
gcucacauaucuguca

SEQ ID NO: 3034797 - RNA, 12 nt, Human
gcucaccagccc

SEQ ID NO: 3034798 - RNA, 13 nt, Human
gcucaccagcccc

SEQ ID NO: 3034799 - RNA, 14 nt, Human
gcucaccagcccca

SEQ ID NO: 3034800 - RNA, 15 nt, Human
gcucaccagccccag

SEQ ID NO: 3034801 - RNA, 14 nt, Human
gcuaucucccccag

SEQ ID NO: 3034802 - RNA, 18 nt, Human
gcucaaguccucuuuucu

SEQ ID NO: 3034803 - RNA, 13 nt, Human
gcuaucuccccca

SEQ ID NO: 3034804 - RNA, 19 nt, Human
gcucaaguccucuuuucug

SEQ ID NO: 3034805 - RNA, 22 nt, Human
gcucaaguccucuuuucugaga

SEQ ID NO: 3034806 - RNA, 21 nt, Human
gcuaguugggcuuccucauag

SEQ ID NO: 3034807 - RNA, 22 nt, Human
gcggugcuaucucccccagccc

SEQ ID NO: 3034808 - RNA, 19 nt, Human
gcggugcuaucucccccag

SEQ ID NO: 3034809 - RNA, 12 nt, Human
gcuccugugucu

SEQ ID NO: 3034810 - RNA, 13 nt, Human
gcuccugugucuu

SEQ ID NO: 3034811 - RNA, 13 nt, Human
gcuccuucugucc

SEQ ID NO: 3034812 - RNA, 17 nt, Human
gcuccuuuagcgcccag

SEQ ID NO: 3034813 - RNA, 17 nt, Human
gcucgagcaugccugga

SEQ ID NO: 3034814 - RNA, 21 nt, Human
gcucgagcaugccuggauggg

SEQ ID NO: 3034815 - RNA, 19 nt, Human
gcucgagcaugccuggaug

SEQ ID NO: 3034816 - RNA, 24 nt, Human
gcuccgcuuucuacccagcgagcc

SEQ ID NO: 3034817 - RNA, 20 nt, Human
gcuccagcuguucagcuggu

SEQ ID NO: 3034818 - RNA, 21 nt, Human
gcuccagcuguucagcugguu

SEQ ID NO: 3034819 - RNA, 11 nt, Human
gcuccaggagc

SEQ ID NO: 3034820 - RNA, 14 nt, Human
gcuccaggagcagc

SEQ ID NO: 3034821 - RNA, 12 nt, Human
gcuccaggagca

SEQ ID NO: 3034822 - RNA, 12 nt, Human
gcuccaggcucc

SEQ ID NO: 3034823 - RNA, 24 nt, Human
gcuccaggcuccuuuagcgcccag

SEQ ID NO: 3034824 - RNA, 18 nt, Human
gcuccaggagcagccaca

SEQ ID NO: 3034825 - RNA, 17 nt, Human
gcuccaggagcagccac

SEQ ID NO: 3034826 - RNA, 16 nt, Human
gcuccaggagcagcca

SEQ ID NO: 3034827 - RNA, 15 nt, Human
gcuccaggagcagcc

SEQ ID NO: 3034828 - RNA, 20 nt, Human
gcucccuucccaccucucuc

SEQ ID NO: 3034829 - RNA, 18 nt, Human
gcuccgcuuucuacccag

SEQ ID NO: 3034830 - RNA, 21 nt, Human
gcuccgcuuucuacccagcga

SEQ ID NO: 3034831 - RNA, 22 nt, Human
gcuccgcuuucuacccagcgag

SEQ ID NO: 3034832 - RNA, 23 nt, Human
gcuccgcuuucuacccagcgagc

SEQ ID NO: 3034833 - RNA, 19 nt, Human
gcucccuucccaccucucu

SEQ ID NO: 3034834 - RNA, 14 nt, Human
gcugaccuugcuga

SEQ ID NO: 3034835 - RNA, 22 nt, Human
gcugacuguuuucucuugagag

SEQ ID NO: 3034836 - RNA, 17 nt, Human
gcugacagacacaggcc

SEQ ID NO: 3034837 - RNA, 18 nt, Human
gcugacagacacaggccc

SEQ ID NO: 3034838 - RNA, 19 nt, Human
gcugacagacacaggcccg

SEQ ID NO: 3034839 - RNA, 20 nt, Human
gcucucaggccagcugcuug

SEQ ID NO: 3034840 - RNA, 21 nt, Human
gcucucaggccagcugcuugg

SEQ ID NO: 3034841 - RNA, 19 nt, Human
gcugauuuaaacacauuaa

SEQ ID NO: 3034842 - RNA, 22 nt, Human
gcugcaaaggguaucaggugcu

SEQ ID NO: 3034843 - RNA, 23 nt, Human
gcugcaaaggguaucaggugcug

SEQ ID NO: 3034844 - RNA, 14 nt, Human
gcugcaguugccag

SEQ ID NO: 3034845 - RNA, 13 nt, Human
gcugcaguugcca

SEQ ID NO: 3034846 - RNA, 19 nt, Human
gcugcauuuaaaagauaca

SEQ ID NO: 3034847 - RNA, 17 nt, Human
gcugcauuuaaaagaua

SEQ ID NO: 3034848 - RNA, 18 nt, Human
gcugcauuuaaaagauac

SEQ ID NO: 3034849 - RNA, 20 nt, Human
gcugccaaugggagcucaug

SEQ ID NO: 3034850 - RNA, 12 nt, Human
gcugccaccugc

SEQ ID NO: 3034851 - RNA, 22 nt, Human
gcugcuuuugucuaugggacuc

SEQ ID NO: 3034852 - RNA, 15 nt, Human
gcuggaccuugaacu

SEQ ID NO: 3034853 - RNA, 22 nt, Human
gcugcgguccacccaggagccc

SEQ ID NO: 3034854 - RNA, 19 nt, Human
gcugcgguccacccaggag

SEQ ID NO: 3034855 - RNA, 21 nt, Human
gcugcgguccacccaggagcc

SEQ ID NO: 3034856 - RNA, 14 nt, Human
gcugcgguccaccc

SEQ ID NO: 3034857 - RNA, 15 nt, Human
gcugcgguccaccca

SEQ ID NO: 3034858 - RNA, 20 nt, Human
gcugccuguucagcuccagc

SEQ ID NO: 3034859 - RNA, 22 nt, Human
gcugccuguucagcuccagcuc

SEQ ID NO: 3034860 - RNA, 18 nt, Human
gcugccuguucagcucca

SEQ ID NO: 3034861 - RNA, 19 nt, Human
gcugccuguucagcuccag

SEQ ID NO: 3034862 - RNA, 24 nt, Human
gcugcccugcccaccuggccucug

SEQ ID NO: 3034863 - RNA, 23 nt, Human
gcugcccugcccaccuggccucu

SEQ ID NO: 3034864 - RNA, 22 nt, Human
gcugcccugcccaccuggccuc

SEQ ID NO: 3034865 - RNA, 21 nt, Human
gcugcccugcccaccuggccu

SEQ ID NO: 3034866 - RNA, 20 nt, Human
gcugcccugcccaccuggcc

SEQ ID NO: 3034867 - RNA, 18 nt, Human
gcugcccugcccaccugg

SEQ ID NO: 3034868 - RNA, 16 nt, Human
gcugcccugcccaccu

SEQ ID NO: 3034869 - RNA, 12 nt, Human
gcugcccugccc

SEQ ID NO: 3034870 - RNA, 14 nt, Human
gcugcccugcccac

SEQ ID NO: 3034871 - RNA, 13 nt, Human
gcugcccugccca

SEQ ID NO: 3034872 - RNA, 22 nt, Human
gcuuacaugccuaccaauauuu

SEQ ID NO: 3034873 - RNA, 15 nt, Human
gcugugucucccuuc

SEQ ID NO: 3034874 - RNA, 16 nt, Human
gcugucccuuuuccuu

SEQ ID NO: 3034875 - RNA, 22 nt, Human
gcugucccuuacgugaguccug

SEQ ID NO: 3034876 - RNA, 23 nt, Human
gcugucccuuacgugaguccugg

SEQ ID NO: 3034877 - RNA, 17 nt, Human
gcugucagccauuccug

SEQ ID NO: 3034878 - RNA, 14 nt, Human
gcuggugucaccug

SEQ ID NO: 3034879 - RNA, 15 nt, Human
gcuggugucaccuga

SEQ ID NO: 3034880 - RNA, 21 nt, Human
gcugggcucccuucccaccuc

SEQ ID NO: 3034881 - RNA, 19 nt, Human
gcugggaugauuggagggg

SEQ ID NO: 3034882 - RNA, 15 nt, Human
gcuggccuggccccu

SEQ ID NO: 3034883 - RNA, 14 nt, Human
gcuggccuggcccc

SEQ ID NO: 3034884 - RNA, 12 nt, Human
gcuggccuggcc

SEQ ID NO: 3034885 - RNA, 13 nt, Human
gcuggccuggccc

SEQ ID NO: 3034886 - RNA, 21 nt, Human
gcugggcuucaguggcagcug

SEQ ID NO: 3034887 - RNA, 22 nt, Human
gcugggcuucaguggcagcugc

SEQ ID NO: 3034888 - RNA, 20 nt, Human
gcugggcuucaguggcagcu

SEQ ID NO: 3034889 - RNA, 14 nt, Human
gcugggggccucag

SEQ ID NO: 3034890 - RNA, 15 nt, Human
gcugggggccucagu

SEQ ID NO: 3034891 - RNA, 18 nt, Human
gcugggggccucagugcc

SEQ ID NO: 3034892 - RNA, 13 nt, Human
gcugggggccuca

SEQ ID NO: 3034893 - RNA, 16 nt, Human
gcuuagacccucaugc

SEQ ID NO: 3034894 - RNA, 21 nt, Human
gcuuagacccucaugcugcca

SEQ ID NO: 3034895 - RNA, 20 nt, Human
gcuuauacacuuacacuuua

SEQ ID NO: 3034896 - RNA, 21 nt, Human
gcuucauccuccucagaucuu

SEQ ID NO: 3034897 - RNA, 19 nt, Human
gcuucaguggcagcugcuu

SEQ ID NO: 3034898 - RNA, 20 nt, Human
gcuucaguggcagcugcuuu

SEQ ID NO: 3034899 - RNA, 17 nt, Human
gcuucucacugccaugc

SEQ ID NO: 3034900 - RNA, 22 nt, Human
gcuucucacugccaugccagcu

SEQ ID NO: 3034901 - RNA, 18 nt, Human
gcuucauuuccugugucu

SEQ ID NO: 3034902 - RNA, 22 nt, Human
gcagaguaggggucugucuuuu

SEQ ID NO: 3034903 - RNA, 18 nt, Human
gcagauggagaccccuug

SEQ ID NO: 3034904 - RNA, 22 nt, Human
gcacuucgggaggucgaggcag

SEQ ID NO: 3034905 - RNA, 14 nt, Human
gcacuugcagacuc

SEQ ID NO: 3034906 - RNA, 16 nt, Human
gcacuugcagacucua

SEQ ID NO: 3034907 - RNA, 17 nt, Human
gcagacucuacagaggc

SEQ ID NO: 3034908 - RNA, 18 nt, Human
gcagacucuacagaggcc

SEQ ID NO: 3034909 - RNA, 19 nt, Human
gcagacucuacagaggcca

SEQ ID NO: 3034910 - RNA, 22 nt, Human
gcagacucuacagaggccaugg

SEQ ID NO: 3034911 - RNA, 19 nt, Human
gcagagaccaucccugaag

SEQ ID NO: 3034912 - RNA, 21 nt, Human
gcagagaccaucccugaaggc

SEQ ID NO: 3034913 - RNA, 20 nt, Human
gcagagaccaucccugaagg

SEQ ID NO: 3034914 - RNA, 22 nt, Human
gcagagaccaucccugaaggcc

SEQ ID NO: 3034915 - RNA, 16 nt, Human
gcaggaagcugugaga

SEQ ID NO: 3034916 - RNA, 19 nt, Human
gcagcucagagaggguggg

SEQ ID NO: 3034917 - RNA, 18 nt, Human
gcagcucagagagggugg

SEQ ID NO: 3034918 - RNA, 16 nt, Human
gcagcucaccucuccc

SEQ ID NO: 3034919 - RNA, 14 nt, Human
gcagcucagagagg

SEQ ID NO: 3034920 - RNA, 21 nt, Human
gcagcucaccucucccuugga

SEQ ID NO: 3034921 - RNA, 20 nt, Human
gcagcucaccucucccuugg

SEQ ID NO: 3034922 - RNA, 17 nt, Human
gcagcucaccucucccu

SEQ ID NO: 3034923 - RNA, 17 nt, Human
gcagccucacaguccuu

SEQ ID NO: 3034924 - RNA, 15 nt, Human
gcagccucacagucc

SEQ ID NO: 3034925 - RNA, 19 nt, Human
gcagccucacaguccuuac

SEQ ID NO: 3034926 - RNA, 19 nt, Human
gcagcagggagggcuucug

SEQ ID NO: 3034927 - RNA, 18 nt, Human
gcagcagggagggcuucu

SEQ ID NO: 3034928 - RNA, 15 nt, Human
gcacgcacacugucu

SEQ ID NO: 3034929 - RNA, 16 nt, Human
gcacgcacacugucug

SEQ ID NO: 3034930 - RNA, 19 nt, Human
gcacccucaggcagguggg

SEQ ID NO: 3034931 - RNA, 16 nt, Human
gcacccucaggcaggu

SEQ ID NO: 3034932 - RNA, 19 nt, Human
gcacuaaggugugcucuga

SEQ ID NO: 3034933 - RNA, 20 nt, Human
gcacuaaggugugcucugau

SEQ ID NO: 3034934 - RNA, 14 nt, Human
gcacgugugugcac

SEQ ID NO: 3034935 - RNA, 20 nt, Human
gcacuauaauguaagcucua

SEQ ID NO: 3034936 - RNA, 14 nt, Human
gcacuauaauguaa

SEQ ID NO: 3034937 - RNA, 15 nt, Human
gcacuauaauguaag

SEQ ID NO: 3034938 - RNA, 15 nt, Human
gcacugcuuccagug

SEQ ID NO: 3034939 - RNA, 14 nt, Human
gcacugcuuccagu

SEQ ID NO: 3034940 - RNA, 13 nt, Human
gcacugcuuccag

SEQ ID NO: 3034941 - RNA, 12 nt, Human
gcacugcuucca

SEQ ID NO: 3034942 - RNA, 12 nt, Human
gcacugggcuug

SEQ ID NO: 3034943 - RNA, 19 nt, Human
gcacuguuuuauuuuaauu

SEQ ID NO: 3034944 - RNA, 13 nt, Human
gcaccagcagccu

SEQ ID NO: 3034945 - RNA, 15 nt, Human
gcaccaucucuccuc

SEQ ID NO: 3034946 - RNA, 14 nt, Human
gcaccaucucuccu

SEQ ID NO: 3034947 - RNA, 17 nt, Human
gcaccaucucuccuccu

SEQ ID NO: 3034948 - RNA, 23 nt, Human
gcacagcuucauuuccugugucu

SEQ ID NO: 3034949 - RNA, 21 nt, Human
gcacagcuucauuuccugugu

SEQ ID NO: 3034950 - RNA, 20 nt, Human
gauugugucucuugguccug

SEQ ID NO: 3034951 - RNA, 21 nt, Human
gcauacuauuaaacaugcugu

SEQ ID NO: 3034952 - RNA, 17 nt, Human
gcauacuauuaaacaug

SEQ ID NO: 3034953 - RNA, 14 nt, Human
gcauacuauuaaac

SEQ ID NO: 3034954 - RNA, 13 nt, Human
gcauacuauuaaa

SEQ ID NO: 3034955 - RNA, 18 nt, Human
gcauacguacacauuuua

SEQ ID NO: 3034956 - RNA, 19 nt, Human
gcauacguacacauuuuau

SEQ ID NO: 3034957 - RNA, 22 nt, Human
gcaguggugcgaucuggguuca

SEQ ID NO: 3034958 - RNA, 19 nt, Human
gcaguggugguuuucuguu

SEQ ID NO: 3034959 - RNA, 20 nt, Human
gcaguggugcgaucuggguu

SEQ ID NO: 3034960 - RNA, 21 nt, Human
gcaguggugcgaucuggguuc

SEQ ID NO: 3034961 - RNA, 20 nt, Human
gcaguggugguuuucuguuc

SEQ ID NO: 3034962 - RNA, 21 nt, Human
gcaguggugguuuucuguucu

SEQ ID NO: 3034963 - RNA, 11 nt, Human
gcagugggagc

SEQ ID NO: 3034964 - RNA, 18 nt, Human
gcaguggugcgaucuggg

SEQ ID NO: 3034965 - RNA, 19 nt, Human
gcaguggugcgaucugggu

SEQ ID NO: 3034966 - RNA, 17 nt, Human
gcaggcagccaggccac

SEQ ID NO: 3034967 - RNA, 18 nt, Human
gcaggcagccaggccaca

SEQ ID NO: 3034968 - RNA, 22 nt, Human
gcagggcucagcggggacagcu

SEQ ID NO: 3034969 - RNA, 16 nt, Human
gcagggucucacucug

SEQ ID NO: 3034970 - RNA, 19 nt, Human
gcaggguccuagaaauucc

SEQ ID NO: 3034971 - RNA, 22 nt, Human
gcaggggaggguagagcggaga

SEQ ID NO: 3034972 - RNA, 22 nt, Human
gcauacugccuuguuuaauggu

SEQ ID NO: 3034973 - RNA, 12 nt, Human
gcaucaggccag

SEQ ID NO: 3034974 - RNA, 23 nt, Human
gcaucaggccaggcccucugccc

SEQ ID NO: 3034975 - RNA, 18 nt, Human
gcaucaggccaggcccuc

SEQ ID NO: 3034976 - RNA, 20 nt, Human
gcaugaaguaauaugcacac

SEQ ID NO: 3034977 - RNA, 21 nt, Human
gcaugaaguaauaugcacaca

SEQ ID NO: 3034978 - RNA, 22 nt, Human
gcaugaaguaauaugcacacau

SEQ ID NO: 3034979 - RNA, 22 nt, Human
gcaugacacgaauauugcugau

SEQ ID NO: 3034980 - RNA, 18 nt, Human
gcaugaaguaauaugcac

SEQ ID NO: 3034981 - RNA, 21 nt, Human
gcaugacacgaauauugcuga

SEQ ID NO: 3034982 - RNA, 20 nt, Human
gcaugacacgaauauugcug

SEQ ID NO: 3034983 - RNA, 18 nt, Human
gcauuugaggucuguucu

SEQ ID NO: 3034984 - RNA, 22 nt, Human
gcauuccccaggaggccagccu

SEQ ID NO: 3034985 - RNA, 21 nt, Human
gcauuccccaggaggccagcc

SEQ ID NO: 3034986 - RNA, 20 nt, Human
gcauuccccaggaggccagc

SEQ ID NO: 3034987 - RNA, 19 nt, Human
gcauuccccaggaggccag

SEQ ID NO: 3034988 - RNA, 18 nt, Human
gcauuccccaggaggcca

SEQ ID NO: 3034989 - RNA, 17 nt, Human
gcauuccccaggaggcc

SEQ ID NO: 3034990 - RNA, 16 nt, Human
gcauuccccaggaggc

SEQ ID NO: 3034991 - RNA, 15 nt, Human
gcauuccccaggagg

SEQ ID NO: 3034992 - RNA, 14 nt, Human
gcauuccccaggag

SEQ ID NO: 3034993 - RNA, 12 nt, Human
gcauuccccagg

SEQ ID NO: 3034994 - RNA, 19 nt, Human
gcauuaucuagauacugua

SEQ ID NO: 3034995 - RNA, 22 nt, Human
gcauuaucuagauacuguauca

SEQ ID NO: 3034996 - RNA, 24 nt, Human
gcauuaucuagauacuguaucaug

SEQ ID NO: 3034997 - RNA, 14 nt, Human
gcaugccuggaugg

SEQ ID NO: 3034998 - RNA, 13 nt, Human
gcauguuacauaa

SEQ ID NO: 3034999 - RNA, 12 nt, Human
gccaauuugcac

SEQ ID NO: 3035000 - RNA, 22 nt, Human
gccacaagacccuugugguccc

SEQ ID NO: 3035001 - RNA, 16 nt, Human
gccacaagacccuugu

SEQ ID NO: 3035002 - RNA, 23 nt, Human
gccacagagaaaguacuucucca

SEQ ID NO: 3035003 - RNA, 13 nt, Human
gccacagagaaag

SEQ ID NO: 3035004 - RNA, 14 nt, Human
gccacagagaaagu

SEQ ID NO: 3035005 - RNA, 20 nt, Human
gccacagagaaaguacuucu

SEQ ID NO: 3035006 - RNA, 14 nt, Human
gccaauauccuaau

SEQ ID NO: 3035007 - RNA, 15 nt, Human
gccaauauccuaaua

SEQ ID NO: 3035008 - RNA, 16 nt, Human
gccaauauccuaauaa

SEQ ID NO: 3035009 - RNA, 17 nt, Human
gccaauauccuaauaaa

SEQ ID NO: 3035010 - RNA, 13 nt, Human
gccaauauccuaa

SEQ ID NO: 3035011 - RNA, 18 nt, Human
gccaauauccuaauaaaa

SEQ ID NO: 3035012 - RNA, 19 nt, Human
gccaauauccuaauaaaaa

SEQ ID NO: 3035013 - RNA, 20 nt, Human
gccaauauccuaauaaaaag

SEQ ID NO: 3035014 - RNA, 22 nt, Human
gccaauauccuaauaaaaaggu

SEQ ID NO: 3035015 - RNA, 23 nt, Human
gccaauauccuaauaaaaaggug

SEQ ID NO: 3035016 - RNA, 15 nt, Human
gccaaggugggagga

SEQ ID NO: 3035017 - RNA, 14 nt, Human
gccaaggugggagg

SEQ ID NO: 3035018 - RNA, 23 nt, Human
gccaaggugggaggauugcuuga

SEQ ID NO: 3035019 - RNA, 21 nt, Human
gccaaggcugggggaagaagc

SEQ ID NO: 3035020 - RNA, 19 nt, Human
gcauuugaggucuguucuu

SEQ ID NO: 3035021 - RNA, 20 nt, Human
gcauuugaggucuguucuuu

SEQ ID NO: 3035022 - RNA, 22 nt, Human
gcauuuggugguuucagaaaug

SEQ ID NO: 3035023 - RNA, 23 nt, Human
gcauuuggugguuucagaaaugu

SEQ ID NO: 3035024 - RNA, 18 nt, Human
gccacggccaggccagag

SEQ ID NO: 3035025 - RNA, 17 nt, Human
gccacggccaggccaga

SEQ ID NO: 3035026 - RNA, 19 nt, Human
gccacggccaggccagagg

SEQ ID NO: 3035027 - RNA, 22 nt, Human
gccaccugcggugcuaucuccc

SEQ ID NO: 3035028 - RNA, 20 nt, Human
gccaccugcggugcuaucuc

SEQ ID NO: 3035029 - RNA, 14 nt, Human
gccaccugcggugc

SEQ ID NO: 3035030 - RNA, 17 nt, Human
gccaccugccuguuggg

SEQ ID NO: 3035031 - RNA, 21 nt, Human
gccagagggagugacagaggc

SEQ ID NO: 3035032 - RNA, 22 nt, Human
gccagagggagugacagaggca

SEQ ID NO: 3035033 - RNA, 22 nt, Human
gccagaggagagaggacccccu

SEQ ID NO: 3035034 - RNA, 19 nt, Human
gccagaggagagaggaccc

SEQ ID NO: 3035035 - RNA, 17 nt, Human
gccagaggagagaggac

SEQ ID NO: 3035036 - RNA, 15 nt, Human
gccagaggagagagg

SEQ ID NO: 3035037 - RNA, 13 nt, Human
gccagaggagaga

SEQ ID NO: 3035038 - RNA, 12 nt, Human
gccagaggagag

SEQ ID NO: 3035039 - RNA, 23 nt, Human
gccagagggagugacagaggcag

SEQ ID NO: 3035040 - RNA, 16 nt, Human
gccagaugcaccagcc

SEQ ID NO: 3035041 - RNA, 17 nt, Human
gccagaugcaccagccc

SEQ ID NO: 3035042 - RNA, 18 nt, Human
gccagaugcaccagcccu

SEQ ID NO: 3035043 - RNA, 10 nt, Human
gccagaggag

SEQ ID NO: 3035044 - RNA, 20 nt, Human
gccagagacacaagccuucg

SEQ ID NO: 3035045 - RNA, 16 nt, Human
gccagagacacaagcc

SEQ ID NO: 3035046 - RNA, 19 nt, Human
gccagagacacaagccuuc

SEQ ID NO: 3035047 - RNA, 17 nt, Human
gccagagacacaagccu

SEQ ID NO: 3035048 - RNA, 17 nt, Human
gccagguuuuuggucug

SEQ ID NO: 3035049 - RNA, 20 nt, Human
gccagucaccccggccaccu

SEQ ID NO: 3035050 - RNA, 18 nt, Human
gccagucaccccggccac

SEQ ID NO: 3035051 - RNA, 17 nt, Human
gccagucaccccggcca

SEQ ID NO: 3035052 - RNA, 21 nt, Human
gccagauuucacucuccuugg

SEQ ID NO: 3035053 - RNA, 18 nt, Human
gccagauuucacucuccu

SEQ ID NO: 3035054 - RNA, 16 nt, Human
gccagauuucacucuc

SEQ ID NO: 3035055 - RNA, 13 nt, Human
gccagggacagag

SEQ ID NO: 3035056 - RNA, 18 nt, Human
gccagggacagagggggu

SEQ ID NO: 3035057 - RNA, 16 nt, Human
gccagggacagagggg

SEQ ID NO: 3035058 - RNA, 23 nt, Human
gccagggacagaggggguggccu

SEQ ID NO: 3035059 - RNA, 24 nt, Human
gccaugcuccuggcccacugcauc

SEQ ID NO: 3035060 - RNA, 19 nt, Human
gccaugccagcuuaucuca

SEQ ID NO: 3035061 - RNA, 18 nt, Human
gccaugccagcuuaucuc

SEQ ID NO: 3035062 - RNA, 13 nt, Human
gccaugccagcuu

SEQ ID NO: 3035063 - RNA, 18 nt, Human
gccaugaggaacaaggca

SEQ ID NO: 3035064 - RNA, 16 nt, Human
gccauuuguguuuaua

SEQ ID NO: 3035065 - RNA, 24 nt, Human
gcccagccccuucugacccaugcu

SEQ ID NO: 3035066 - RNA, 20 nt, Human
gcccagccccuucugaccca

SEQ ID NO: 3035067 - RNA, 17 nt, Human
gcccagccccuucugac

SEQ ID NO: 3035068 - RNA, 16 nt, Human
gcccagccccuucuga

SEQ ID NO: 3035069 - RNA, 14 nt, Human
gcccagccccuucu

SEQ ID NO: 3035070 - RNA, 13 nt, Human
gcccagccccuuc

SEQ ID NO: 3035071 - RNA, 15 nt, Human
gcccaguugggugga

SEQ ID NO: 3035072 - RNA, 19 nt, Human
gcccagucuggaaugcagu

SEQ ID NO: 3035073 - RNA, 23 nt, Human
gcccaggcuuagucacugagaca

SEQ ID NO: 3035074 - RNA, 21 nt, Human
gcccaggcuuagucacugaga

SEQ ID NO: 3035075 - RNA, 19 nt, Human
gcccaggcuuagucacuga

SEQ ID NO: 3035076 - RNA, 22 nt, Human
gcccaggcuggcgugcaguggu

SEQ ID NO: 3035077 - RNA, 19 nt, Human
gcccaggcuggcgugcagu

SEQ ID NO: 3035078 - RNA, 20 nt, Human
gcccaggcuggcgugcagug

SEQ ID NO: 3035079 - RNA, 21 nt, Human
gcccaggaaaggcuccaggag

SEQ ID NO: 3035080 - RNA, 20 nt, Human
gcccaggaaaggcuccagga

SEQ ID NO: 3035081 - RNA, 19 nt, Human
gcccaggaaaggcuccagg

SEQ ID NO: 3035082 - RNA, 18 nt, Human
gcccaggaaaggcuccag

SEQ ID NO: 3035083 - RNA, 21 nt, Human
gcccaaugcacuuuguucugg

SEQ ID NO: 3035084 - RNA, 12 nt, Human
gcccagagggcc

SEQ ID NO: 3035085 - RNA, 19 nt, Human
gcccagagggccugcaagg

SEQ ID NO: 3035086 - RNA, 18 nt, Human
gcccagagggccugcaag

SEQ ID NO: 3035087 - RNA, 15 nt, Human
gcccagagggccugc

SEQ ID NO: 3035088 - RNA, 14 nt, Human
gcccagagggccug

SEQ ID NO: 3035089 - RNA, 9 nt, Human
gcccagccc

SEQ ID NO: 3035090 - RNA, 12 nt, Human
gcccagccccuu

SEQ ID NO: 3035091 - RNA, 11 nt, Human
gcccagccccu

SEQ ID NO: 3035092 - RNA, 22 nt, Human
gcccagagggccugcaagggag

SEQ ID NO: 3035093 - RNA, 21 nt, Human
gcccagagggccugcaaggga

SEQ ID NO: 3035094 - RNA, 20 nt, Human
gcccagagggccugcaaggg

SEQ ID NO: 3035095 - RNA, 17 nt, Human
gaguuauugaagcagag

SEQ ID NO: 3035096 - RNA, 23 nt, Human
gaguucaucuugaauuguaagga

SEQ ID NO: 3035097 - RNA, 17 nt, Human
gagugugccugaagucc

SEQ ID NO: 3035098 - RNA, 13 nt, Human
gaguucugguucc

SEQ ID NO: 3035099 - RNA, 12 nt, Human
gagugggcccaa

SEQ ID NO: 3035100 - RNA, 23 nt, Human
gagugggggaucacagccucuga

SEQ ID NO: 3035101 - RNA, 15 nt, Human
gagucugaaggcugg

SEQ ID NO: 3035102 - RNA, 23 nt, Human
gauauaugcucugcauguuacau

SEQ ID NO: 3035103 - RNA, 21 nt, Human
gaucaaccccuucgcuccugu

SEQ ID NO: 3035104 - RNA, 22 nt, Human
gaucaaccccuucgcuccugug

SEQ ID NO: 3035105 - RNA, 13 nt, Human
gauagccaaggcc

SEQ ID NO: 3035106 - RNA, 19 nt, Human
gauagcacagacccugccc

SEQ ID NO: 3035107 - RNA, 12 nt, Human
gauagccaaggc

SEQ ID NO: 3035108 - RNA, 16 nt, Human
gauagcacagacccug

SEQ ID NO: 3035109 - RNA, 13 nt, Human
gauacaaugcugu

SEQ ID NO: 3035110 - RNA, 18 nt, Human
gauacaaugcugugcccu

SEQ ID NO: 3035111 - RNA, 18 nt, Human
gauagcacagacccugcc

SEQ ID NO: 3035112 - RNA, 17 nt, Human
gauagcacagacccugc

SEQ ID NO: 3035113 - RNA, 17 nt, Human
gauacaaaagcauguga

SEQ ID NO: 3035114 - RNA, 21 nt, Human
gagucccaccuuggcugcagg

SEQ ID NO: 3035115 - RNA, 12 nt, Human
gaguagcuggga

SEQ ID NO: 3035116 - RNA, 14 nt, Human
gaguagcugggacu

SEQ ID NO: 3035117 - RNA, 23 nt, Human
gaguccccuguuuguuucugaaa

SEQ ID NO: 3035118 - RNA, 14 nt, Human
gaguccccuguuug

SEQ ID NO: 3035119 - RNA, 12 nt, Human
gaguccccuguu

SEQ ID NO: 3035120 - RNA, 16 nt, Human
gagucgaggacaggga

SEQ ID NO: 3035121 - RNA, 17 nt, Human
gagucgaggacagggag

SEQ ID NO: 3035122 - RNA, 19 nt, Human
gagucucacuguugcccag

SEQ ID NO: 3035123 - RNA, 20 nt, Human
gagucucacuguugcccagg

SEQ ID NO: 3035124 - RNA, 21 nt, Human
gagucucacuguugcccaggc

SEQ ID NO: 3035125 - RNA, 21 nt, Human
gagucugaaggcuggguucug

SEQ ID NO: 3035126 - RNA, 22 nt, Human
gagucucacuguugcccaggcu

SEQ ID NO: 3035127 - RNA, 23 nt, Human
gagucucacuguugcccaggcug

SEQ ID NO: 3035128 - RNA, 22 nt, Human
gaggggggaggugggauccucc

SEQ ID NO: 3035129 - RNA, 15 nt, Human
gaggggguggccucc

SEQ ID NO: 3035130 - RNA, 15 nt, Human
gaggggggagguggg

SEQ ID NO: 3035131 - RNA, 18 nt, Human
gaggugggauccuccagg

SEQ ID NO: 3035132 - RNA, 22 nt, Human
gaggugggauccuccaggugca

SEQ ID NO: 3035133 - RNA, 21 nt, Human
gaggugggauccuccaggugc

SEQ ID NO: 3035134 - RNA, 19 nt, Human
gaguacuacaguccuccca

SEQ ID NO: 3035135 - RNA, 18 nt, Human
gaguacuacaguccuccc

SEQ ID NO: 3035136 - RNA, 17 nt, Human
gaguacguugugcauuu

SEQ ID NO: 3035137 - RNA, 18 nt, Human
gaguacguugugcauuug

SEQ ID NO: 3035138 - RNA, 15 nt, Human
gaguacuacaguccu

SEQ ID NO: 3035139 - RNA, 20 nt, Human
gaguacguugugcauuuggu

SEQ ID NO: 3035140 - RNA, 19 nt, Human
gagguuuuaaaaaaauccc

SEQ ID NO: 3035141 - RNA, 16 nt, Human
gaguacguugugcauu

SEQ ID NO: 3035142 - RNA, 19 nt, Human
gagguucaaagauauuuug

SEQ ID NO: 3035143 - RNA, 14 nt, Human
gagguucccuuuga

SEQ ID NO: 3035144 - RNA, 18 nt, Human
gauugugccuaauguguu

SEQ ID NO: 3035145 - RNA, 20 nt, Human
gauuguccccgacccuugcc

SEQ ID NO: 3035146 - RNA, 15 nt, Human
gauuguccccgaccc

SEQ ID NO: 3035147 - RNA, 17 nt, Human
gauucuauguuaauauu

SEQ ID NO: 3035148 - RNA, 18 nt, Human
gauugcuugagcucagga

SEQ ID NO: 3035149 - RNA, 23 nt, Human
gauugacgggacuguugguauug

SEQ ID NO: 3035150 - RNA, 21 nt, Human
gauucccaagcucugcuccuc

SEQ ID NO: 3035151 - RNA, 22 nt, Human
gauucccaagcucugcuccucu

SEQ ID NO: 3035152 - RNA, 12 nt, Human
gauucagacagc

SEQ ID NO: 3035153 - RNA, 19 nt, Human
gauucaacagguuuuccug

SEQ ID NO: 3035154 - RNA, 18 nt, Human
gauuaaccacuucagcug

SEQ ID NO: 3035155 - RNA, 21 nt, Human
gauuaaccacuucagcugacu

SEQ ID NO: 3035156 - RNA, 19 nt, Human
gauuaaccacuucagcuga

SEQ ID NO: 3035157 - RNA, 21 nt, Human
gauguucuuucacccuuuucu

SEQ ID NO: 3035158 - RNA, 21 nt, Human
gauguuuuaaggaugcuugua

SEQ ID NO: 3035159 - RNA, 14 nt, Human
gauguuuuccauga

SEQ ID NO: 3035160 - RNA, 23 nt, Human
gauguuuuccaugaguccccugu

SEQ ID NO: 3035161 - RNA, 15 nt, Human
gauguuuuccaugag

SEQ ID NO: 3035162 - RNA, 12 nt, Human
gauuaaauucuu

SEQ ID NO: 3035163 - RNA, 19 nt, Human
gauuaaauucuugcaaagu

SEQ ID NO: 3035164 - RNA, 14 nt, Human
gauguucugggaca

SEQ ID NO: 3035165 - RNA, 16 nt, Human
gauguucugggacaca

SEQ ID NO: 3035166 - RNA, 20 nt, Human
gauggugcaaugaccuuuca

SEQ ID NO: 3035167 - RNA, 23 nt, Human
gauggugcaaugaccuuucaaua

SEQ ID NO: 3035168 - RNA, 15 nt, Human
gaugacuguuuuuaa

SEQ ID NO: 3035169 - RNA, 22 nt, Human
gaugagaaagguugaagcacca

SEQ ID NO: 3035170 - RNA, 11 nt, Human
gaugagaaagg

SEQ ID NO: 3035171 - RNA, 20 nt, Human
gaugaccuugaaugaugcca

SEQ ID NO: 3035172 - RNA, 22 nt, Human
gaugggcaacccccagccugcu

SEQ ID NO: 3035173 - RNA, 23 nt, Human
gaucaaccccuucgcuccugugu

SEQ ID NO: 3035174 - RNA, 13 nt, Human
gaucacgccacug

SEQ ID NO: 3035175 - RNA, 14 nt, Human
gaucacgccacugc

SEQ ID NO: 3035176 - RNA, 15 nt, Human
gaucacgccacugca

SEQ ID NO: 3035177 - RNA, 18 nt, Human
gauccuaguuccaccauc

SEQ ID NO: 3035178 - RNA, 18 nt, Human
gauccuaggcauuugcug

SEQ ID NO: 3035179 - RNA, 11 nt, Human
gauccuccagg

SEQ ID NO: 3035180 - RNA, 19 nt, Human
gauccucccaccucagccu

SEQ ID NO: 3035181 - RNA, 12 nt, Human
gauccuccaggu

SEQ ID NO: 3035182 - RNA, 20 nt, Human
gauccucccaccucagccuc

SEQ ID NO: 3035183 - RNA, 19 nt, Human
gauccugagccagauuuca

SEQ ID NO: 3035184 - RNA, 15 nt, Human
gauccugagccagau

SEQ ID NO: 3035185 - RNA, 14 nt, Human
gauccugagccaga

SEQ ID NO: 3035186 - RNA, 13 nt, Human
gauccugagccag

SEQ ID NO: 3035187 - RNA, 18 nt, Human
gauccucccaccucagcc

SEQ ID NO: 3035188 - RNA, 15 nt, Human
gaugaaaaaauaaca

SEQ ID NO: 3035189 - RNA, 16 nt, Human
gaucuuugcagacagg

SEQ ID NO: 3035190 - RNA, 22 nt, Human
gagccacugcaccgggccacag

SEQ ID NO: 3035191 - RNA, 11 nt, Human
gagcccacgcc

SEQ ID NO: 3035192 - RNA, 14 nt, Human
gagcccaggccucc

SEQ ID NO: 3035193 - RNA, 13 nt, Human
gagcccaggccuc

SEQ ID NO: 3035194 - RNA, 12 nt, Human
gagcccaggccu

SEQ ID NO: 3035195 - RNA, 16 nt, Human
gagcccacgcccccac

SEQ ID NO: 3035196 - RNA, 15 nt, Human
gagcccacgccccca

SEQ ID NO: 3035197 - RNA, 12 nt, Human
gagcccacgccc

SEQ ID NO: 3035198 - RNA, 18 nt, Human
gagcagccacauuccuga

SEQ ID NO: 3035199 - RNA, 20 nt, Human
gagccacugcaccgggccac

SEQ ID NO: 3035200 - RNA, 13 nt, Human
gagaucagccugg

SEQ ID NO: 3035201 - RNA, 16 nt, Human
gagaucagccugggca

SEQ ID NO: 3035202 - RNA, 14 nt, Human
gagaucagccuggg

SEQ ID NO: 3035203 - RNA, 20 nt, Human
gagaucaaccccuucgcucc

SEQ ID NO: 3035204 - RNA, 19 nt, Human
gagcaaaaucgaugcagug

SEQ ID NO: 3035205 - RNA, 23 nt, Human
gagcaagacgcugugcugcccug

SEQ ID NO: 3035206 - RNA, 22 nt, Human
gagcaagacgcugugcugcccu

SEQ ID NO: 3035207 - RNA, 18 nt, Human
gagcaagacgcugugcug

SEQ ID NO: 3035208 - RNA, 21 nt, Human
gagcaagacgcugugcugccc

SEQ ID NO: 3035209 - RNA, 17 nt, Human
gagcaccuuagacaguc

SEQ ID NO: 3035210 - RNA, 20 nt, Human
gagccucagcauccuggcac

SEQ ID NO: 3035211 - RNA, 21 nt, Human
gagccucagcauccuggcacc

SEQ ID NO: 3035212 - RNA, 14 nt, Human
gagccuccugcccu

SEQ ID NO: 3035213 - RNA, 15 nt, Human
gagcccugguggcag

SEQ ID NO: 3035214 - RNA, 16 nt, Human
gagcccugguggcagu

SEQ ID NO: 3035215 - RNA, 19 nt, Human
gagccucagcauccuggca

SEQ ID NO: 3035216 - RNA, 17 nt, Human
gagcccugguggcagug

SEQ ID NO: 3035217 - RNA, 22 nt, Human
gagccuccugcccuuaccugcc

SEQ ID NO: 3035218 - RNA, 20 nt, Human
gagccuccugcccuuaccug

SEQ ID NO: 3035219 - RNA, 15 nt, Human
gagccuggcaagaau

SEQ ID NO: 3035220 - RNA, 10 nt, Human
gagccuggca

SEQ ID NO: 3035221 - RNA, 21 nt, Human
gagccugggaggucaaggcug

SEQ ID NO: 3035222 - RNA, 13 nt, Human
gagccugggaggu

SEQ ID NO: 3035223 - RNA, 23 nt, Human
gagcuacacaggggaaaagagga

SEQ ID NO: 3035224 - RNA, 13 nt, Human
gagcugccaccug

SEQ ID NO: 3035225 - RNA, 16 nt, Human
gagcugccaccugccu

SEQ ID NO: 3035226 - RNA, 15 nt, Human
gagcugccaccugcc

SEQ ID NO: 3035227 - RNA, 12 nt, Human
gaggggccucuu

SEQ ID NO: 3035228 - RNA, 22 nt, Human
gaggggccucuuaugggcuggg

SEQ ID NO: 3035229 - RNA, 23 nt, Human
gagggcacagaaaauggaagaca

SEQ ID NO: 3035230 - RNA, 22 nt, Human
gagggcacagaaaauggaagac

SEQ ID NO: 3035231 - RNA, 14 nt, Human
gagggcacagaaaa

SEQ ID NO: 3035232 - RNA, 13 nt, Human
gagggagugacag

SEQ ID NO: 3035233 - RNA, 14 nt, Human
gagggagguaagga

SEQ ID NO: 3035234 - RNA, 14 nt, Human
gagggagugacaga

SEQ ID NO: 3035235 - RNA, 14 nt, Human
gagggagggagggc

SEQ ID NO: 3035236 - RNA, 15 nt, Human
gagggagggcuccag

SEQ ID NO: 3035237 - RNA, 15 nt, Human
gagggagggagggcu

SEQ ID NO: 3035238 - RNA, 15 nt, Human
gaggcugggcucccu

SEQ ID NO: 3035239 - RNA, 14 nt, Human
gaggcugggcuccc

SEQ ID NO: 3035240 - RNA, 13 nt, Human
gaggcugggcucc

SEQ ID NO: 3035241 - RNA, 14 nt, Human
gaggccuucucuga

SEQ ID NO: 3035242 - RNA, 22 nt, Human
gaggcccuucucuccagccccu

SEQ ID NO: 3035243 - RNA, 24 nt, Human
gaggcccuucucuccagccccugg

SEQ ID NO: 3035244 - RNA, 23 nt, Human
gaggcccuucucuccagccccug

SEQ ID NO: 3035245 - RNA, 14 nt, Human
gaggcccuucucuc

SEQ ID NO: 3035246 - RNA, 13 nt, Human
gaggacagggagg

SEQ ID NO: 3035247 - RNA, 22 nt, Human
gaggacagggaggugaccccag

SEQ ID NO: 3035248 - RNA, 23 nt, Human
gaggacagggaggugaccccagg

SEQ ID NO: 3035249 - RNA, 14 nt, Human
gaggaauccagacc

SEQ ID NO: 3035250 - RNA, 22 nt, Human
gaggaaggaaacccagcucugg

SEQ ID NO: 3035251 - RNA, 15 nt, Human
gaggaauccagaccc

SEQ ID NO: 3035252 - RNA, 16 nt, Human
gaggauugcuugagcu

SEQ ID NO: 3035253 - RNA, 17 nt, Human
gaggauguucugggaca

SEQ ID NO: 3035254 - RNA, 20 nt, Human
gaggauguucugggacacag

SEQ ID NO: 3035255 - RNA, 12 nt, Human
gaggauguucug

SEQ ID NO: 3035256 - RNA, 23 nt, Human
gaggaguuugggguaugggagag

SEQ ID NO: 3035257 - RNA, 12 nt, Human
gaggccagccuu

SEQ ID NO: 3035258 - RNA, 13 nt, Human
gaggccagccuug

SEQ ID NO: 3035259 - RNA, 23 nt, Human
gaggcagccccauucugccugcc

SEQ ID NO: 3035260 - RNA, 21 nt, Human
gaggcagccccauucugccug

SEQ ID NO: 3035261 - RNA, 22 nt, Human
gaggcagccccauucugccugc

SEQ ID NO: 3035262 - RNA, 13 nt, Human
gaggcagccccau

SEQ ID NO: 3035263 - RNA, 23 nt, Human
cugacgacuugagugcucaguag

SEQ ID NO: 3035264 - RNA, 16 nt, Human
cugacagacacaggcc

SEQ ID NO: 3035265 - RNA, 14 nt, Human
cugaauuucuuuug

SEQ ID NO: 3035266 - RNA, 15 nt, Human
cugacagacacaggc

SEQ ID NO: 3035267 - RNA, 17 nt, Human
cugacagacacaggccc

SEQ ID NO: 3035268 - RNA, 18 nt, Human
cugacagacacaggcccg

SEQ ID NO: 3035269 - RNA, 14 nt, Human
cugagccagauuuc

SEQ ID NO: 3035270 - RNA, 13 nt, Human
cugagccagauuu

SEQ ID NO: 3035271 - RNA, 19 nt, Human
cugagacagcccgggcucu

SEQ ID NO: 3035272 - RNA, 20 nt, Human
cugagacagcccgggcucug

SEQ ID NO: 3035273 - RNA, 22 nt, Human
cugagacagcccgggcucugcc

SEQ ID NO: 3035274 - RNA, 21 nt, Human
cugagacagcccgggcucugc

SEQ ID NO: 3035275 - RNA, 17 nt, Human
cugaacaucacagcuua

SEQ ID NO: 3035276 - RNA, 16 nt, Human
cucuucuccaggcugu

SEQ ID NO: 3035277 - RNA, 23 nt, Human
cucuuuggucuacacugugcuga

SEQ ID NO: 3035278 - RNA, 22 nt, Human
cucuuuggucuacacugugcug

SEQ ID NO: 3035279 - RNA, 14 nt, Human
cucuuuucaaaaca

SEQ ID NO: 3035280 - RNA, 23 nt, Human
cugaaagggacgcuacccgggaa

SEQ ID NO: 3035281 - RNA, 17 nt, Human
cugaaguucagcugcau

SEQ ID NO: 3035282 - RNA, 20 nt, Human
cugaagucuuuguacagaca

SEQ ID NO: 3035283 - RNA, 17 nt, Human
cugaagucuuuguacag

SEQ ID NO: 3035284 - RNA, 22 nt, Human
cugaagucccagauacuugggg

SEQ ID NO: 3035285 - RNA, 16 nt, Human
cugaagucacacagug

SEQ ID NO: 3035286 - RNA, 21 nt, Human
cugaagucacacagugagucg

SEQ ID NO: 3035287 - RNA, 18 nt, Human
cugaagucacacagugag

SEQ ID NO: 3035288 - RNA, 19 nt, Human
cugaagucacacagugagu

SEQ ID NO: 3035289 - RNA, 17 nt, Human
cugaagucacacaguga

SEQ ID NO: 3035290 - RNA, 19 nt, Human
cugaaugguuuucaaaaua

SEQ ID NO: 3035291 - RNA, 20 nt, Human
cugaaugguuuucaaaauaa

SEQ ID NO: 3035292 - RNA, 12 nt, Human
cugaauuucuuu

SEQ ID NO: 3035293 - RNA, 14 nt, Human
cucuguccugggag

SEQ ID NO: 3035294 - RNA, 13 nt, Human
cucuguccuggga

SEQ ID NO: 3035295 - RNA, 15 nt, Human
cucuguccugggagu

SEQ ID NO: 3035296 - RNA, 22 nt, Human
cucuguccugggagugagcugg

SEQ ID NO: 3035297 - RNA, 18 nt, Human
cucugucgcccagucugg

SEQ ID NO: 3035298 - RNA, 19 nt, Human
cucugucgcccagucugga

SEQ ID NO: 3035299 - RNA, 17 nt, Human
cucugucgcccagucug

SEQ ID NO: 3035300 - RNA, 13 nt, Human
cucugucgcccag

SEQ ID NO: 3035301 - RNA, 16 nt, Human
cucugccucugacaca

SEQ ID NO: 3035302 - RNA, 21 nt, Human
cucugccucccaucacccgcu

SEQ ID NO: 3035303 - RNA, 19 nt, Human
cucugccucugacacacag

SEQ ID NO: 3035304 - RNA, 20 nt, Human
cucugccucugacacacagc

SEQ ID NO: 3035305 - RNA, 20 nt, Human
cucuggcagcucagagaggg

SEQ ID NO: 3035306 - RNA, 23 nt, Human
cucuggcagcucagagagggugg

SEQ ID NO: 3035307 - RNA, 19 nt, Human
cucugugucagguggggca

SEQ ID NO: 3035308 - RNA, 20 nt, Human
cucugugucagguggggcag

SEQ ID NO: 3035309 - RNA, 21 nt, Human
cucugugucagguggggcagc

SEQ ID NO: 3035310 - RNA, 22 nt, Human
cucugugucagguggggcagcu

SEQ ID NO: 3035311 - RNA, 23 nt, Human
cucugugucagguggggcagcuu

SEQ ID NO: 3035312 - RNA, 15 nt, Human
cucuucuccaggcug

SEQ ID NO: 3035313 - RNA, 13 nt, Human
cucuucuccaggc

SEQ ID NO: 3035314 - RNA, 22 nt, Human
cucugaaggacauugcggacag

SEQ ID NO: 3035315 - RNA, 14 nt, Human
cucugacacacagc

SEQ ID NO: 3035316 - RNA, 15 nt, Human
cucugacacacagcu

SEQ ID NO: 3035317 - RNA, 16 nt, Human
cucugacacacagcuc

SEQ ID NO: 3035318 - RNA, 17 nt, Human
cucugacacacagcucu

SEQ ID NO: 3035319 - RNA, 18 nt, Human
cucugacacacagcucug

SEQ ID NO: 3035320 - RNA, 19 nt, Human
cucugacacacagcucugu

SEQ ID NO: 3035321 - RNA, 23 nt, Human
cucugacagaagaaccccagggu

SEQ ID NO: 3035322 - RNA, 21 nt, Human
cucugagacucgcgacaaugc

SEQ ID NO: 3035323 - RNA, 23 nt, Human
cucugagacucgcgacaaugcaa

SEQ ID NO: 3035324 - RNA, 20 nt, Human
cucugagacucgcgacaaug

SEQ ID NO: 3035325 - RNA, 12 nt, Human
cucugaggacac

SEQ ID NO: 3035326 - RNA, 14 nt, Human
cucugaggacacua

SEQ ID NO: 3035327 - RNA, 13 nt, Human
cucugcacaagcu

SEQ ID NO: 3035328 - RNA, 10 nt, Human
cucugcacaa

SEQ ID NO: 3035329 - RNA, 15 nt, Human
cucugcacaagcugc

SEQ ID NO: 3035330 - RNA, 14 nt, Human
cucugcacaagcug

SEQ ID NO: 3035331 - RNA, 12 nt, Human
cucugcccuugg

SEQ ID NO: 3035332 - RNA, 17 nt, Human
cucugccucccaucacc

SEQ ID NO: 3035333 - RNA, 16 nt, Human
cucugccucccaucac

SEQ ID NO: 3035334 - RNA, 14 nt, Human
cucugccucccauc

SEQ ID NO: 3035335 - RNA, 13 nt, Human
cucugccucccau

SEQ ID NO: 3035336 - RNA, 20 nt, Human
cucugcccacucccugcaac

SEQ ID NO: 3035337 - RNA, 18 nt, Human
cucugcccacucccugca

SEQ ID NO: 3035338 - RNA, 17 nt, Human
cucugcccacucccugc

SEQ ID NO: 3035339 - RNA, 16 nt, Human
cucugcccacucccug

SEQ ID NO: 3035340 - RNA, 15 nt, Human
cucugcccacucccu

SEQ ID NO: 3035341 - RNA, 13 nt, Human
cucugcccacucc

SEQ ID NO: 3035342 - RNA, 22 nt, Human
cugauuuaaacacauuaaaggu

SEQ ID NO: 3035343 - RNA, 21 nt, Human
cugauugugucucuugguccu

SEQ ID NO: 3035344 - RNA, 17 nt, Human
cugauugugucucuugg

SEQ ID NO: 3035345 - RNA, 21 nt, Human
cugauggugcaaugaccuuuc

SEQ ID NO: 3035346 - RNA, 20 nt, Human
cugauggugcaaugaccuuu

SEQ ID NO: 3035347 - RNA, 19 nt, Human
cugauggugcaaugaccuu

SEQ ID NO: 3035348 - RNA, 17 nt, Human
cugauggugcaaugacc

SEQ ID NO: 3035349 - RNA, 23 nt, Human
cugauuuuuuuuuccuucagugc

SEQ ID NO: 3035350 - RNA, 22 nt, Human
cugauuuuuuuuuccuucagug

SEQ ID NO: 3035351 - RNA, 21 nt, Human
cugauuuuuuuuuccuucagu

SEQ ID NO: 3035352 - RNA, 20 nt, Human
cugauuuuuuuuuccuucag

SEQ ID NO: 3035353 - RNA, 19 nt, Human
cugauuuuuuuuuccuuca

SEQ ID NO: 3035354 - RNA, 18 nt, Human
cugauuuuuuuuuccuuc

SEQ ID NO: 3035355 - RNA, 16 nt, Human
cugauuuuuuuuuccu

SEQ ID NO: 3035356 - RNA, 12 nt, Human
cugcaccgggcc

SEQ ID NO: 3035357 - RNA, 23 nt, Human
cugcaccggcuggccuggccccu

SEQ ID NO: 3035358 - RNA, 15 nt, Human
cugcacuccccugcu

SEQ ID NO: 3035359 - RNA, 14 nt, Human
cugcacuccccugc

SEQ ID NO: 3035360 - RNA, 22 nt, Human
cugcaccggcuggccuggcccc

SEQ ID NO: 3035361 - RNA, 20 nt, Human
cugcaccggcuggccuggcc

SEQ ID NO: 3035362 - RNA, 14 nt, Human
cugcacccucaggc

SEQ ID NO: 3035363 - RNA, 13 nt, Human
cugcacccucagg

SEQ ID NO: 3035364 - RNA, 18 nt, Human
cugcacuugcagacucua

SEQ ID NO: 3035365 - RNA, 17 nt, Human
cugcacuccccugcugg

SEQ ID NO: 3035366 - RNA, 16 nt, Human
cugcacuccccugcug

SEQ ID NO: 3035367 - RNA, 18 nt, Human
cugcacaagcugcacccu

SEQ ID NO: 3035368 - RNA, 22 nt, Human
cugcacaagcugcacccucagg

SEQ ID NO: 3035369 - RNA, 18 nt, Human
cugcaauaaggggagagu

SEQ ID NO: 3035370 - RNA, 14 nt, Human
cugauggugcaaug

SEQ ID NO: 3035371 - RNA, 16 nt, Human
cugauggugcaaugac

SEQ ID NO: 3035372 - RNA, 15 nt, Human
cugauggugcaauga

SEQ ID NO: 3035373 - RNA, 21 nt, Human
cugauccuaguuccaccauca

SEQ ID NO: 3035374 - RNA, 20 nt, Human
cugauccuaguuccaccauc

SEQ ID NO: 3035375 - RNA, 21 nt, Human
cugauaaagaugagugagcau

SEQ ID NO: 3035376 - RNA, 17 nt, Human
cugagucugaaggcugg

SEQ ID NO: 3035377 - RNA, 19 nt, Human
cugagucugaaggcugggu

SEQ ID NO: 3035378 - RNA, 18 nt, Human
cugagucugaaggcuggg

SEQ ID NO: 3035379 - RNA, 13 nt, Human
cugaggcugggcu

SEQ ID NO: 3035380 - RNA, 22 nt, Human
cugaggcugggcucccuuccca

SEQ ID NO: 3035381 - RNA, 17 nt, Human
cugaggcugggcucccu

SEQ ID NO: 3035382 - RNA, 16 nt, Human
cugaggcugggcuccc

SEQ ID NO: 3035383 - RNA, 15 nt, Human
cugaggcugggcucc

SEQ ID NO: 3035384 - RNA, 24 nt, Human
cugaggcccuucucuccagccccu

SEQ ID NO: 3035385 - RNA, 19 nt, Human
cugcgguccacccaggagc

SEQ ID NO: 3035386 - RNA, 20 nt, Human
cugcgguccacccaggagcc

SEQ ID NO: 3035387 - RNA, 17 nt, Human
cugcgguccacccagga

SEQ ID NO: 3035388 - RNA, 18 nt, Human
cugcgguccacccaggag

SEQ ID NO: 3035389 - RNA, 21 nt, Human
cugccugcccaggccccugcc

SEQ ID NO: 3035390 - RNA, 22 nt, Human
cugccugcccaggccccugcca

SEQ ID NO: 3035391 - RNA, 17 nt, Human
cugccucugacacacag

SEQ ID NO: 3035392 - RNA, 15 nt, Human
cugccucugacacac

SEQ ID NO: 3035393 - RNA, 18 nt, Human
cugccucugacacacagc

SEQ ID NO: 3035394 - RNA, 21 nt, Human
cugccucugacacacagcucu

SEQ ID NO: 3035395 - RNA, 13 nt, Human
cugccgcagcccu

SEQ ID NO: 3035396 - RNA, 12 nt, Human
cugccgcagccc

SEQ ID NO: 3035397 - RNA, 23 nt, Human
cugccgcagcccugcagagggca

SEQ ID NO: 3035398 - RNA, 22 nt, Human
cugccgcagcccugcagagggc

SEQ ID NO: 3035399 - RNA, 21 nt, Human
cugccgcagcccugcagaggg

SEQ ID NO: 3035400 - RNA, 20 nt, Human
cugccgcagcccugcagagg

SEQ ID NO: 3035401 - RNA, 19 nt, Human
cugccgcagcccugcagag

SEQ ID NO: 3035402 - RNA, 19 nt, Human
cugccucagccucccaaag

SEQ ID NO: 3035403 - RNA, 15 nt, Human
cugccucagccuccc

SEQ ID NO: 3035404 - RNA, 14 nt, Human
cugccucagccucc

SEQ ID NO: 3035405 - RNA, 13 nt, Human
cugccaggcaugg

SEQ ID NO: 3035406 - RNA, 11 nt, Human
cugccaggcau

SEQ ID NO: 3035407 - RNA, 14 nt, Human
cugccaugccagcu

SEQ ID NO: 3035408 - RNA, 13 nt, Human
cugcccaccuggc

SEQ ID NO: 3035409 - RNA, 15 nt, Human
cugcccaccuggccu

SEQ ID NO: 3035410 - RNA, 14 nt, Human
cugcccaccuggcc

SEQ ID NO: 3035411 - RNA, 18 nt, Human
cugcccacucccugcaac

SEQ ID NO: 3035412 - RNA, 16 nt, Human
cugcccacucccugca

SEQ ID NO: 3035413 - RNA, 15 nt, Human
cugcccacucccugc

SEQ ID NO: 3035414 - RNA, 14 nt, Human
cugcccacucccug

SEQ ID NO: 3035415 - RNA, 22 nt, Human
cugcccaccuggccucugcacu

SEQ ID NO: 3035416 - RNA, 20 nt, Human
cugcccaccuggccucugca

SEQ ID NO: 3035417 - RNA, 19 nt, Human
cugcccaccuggccucugc

SEQ ID NO: 3035418 - RNA, 18 nt, Human
cugcccaccuggccucug

SEQ ID NO: 3035419 - RNA, 17 nt, Human
cugcccaccuggccucu

SEQ ID NO: 3035420 - RNA, 22 nt, Human
cugcaugcgggcuuccuccugg

SEQ ID NO: 3035421 - RNA, 18 nt, Human
cugcaugcgggcuuccuc

SEQ ID NO: 3035422 - RNA, 19 nt, Human
cugccaaugggagcucaug

SEQ ID NO: 3035423 - RNA, 18 nt, Human
cugccaaugggagcucau

SEQ ID NO: 3035424 - RNA, 22 nt, Human
cugcaucguuucaucuuccaac

SEQ ID NO: 3035425 - RNA, 16 nt, Human
cugcaucguuucaucu

SEQ ID NO: 3035426 - RNA, 23 nt, Human
cugcacuugcagacucuacagag

SEQ ID NO: 3035427 - RNA, 19 nt, Human
cugcaguugccagucaccc

SEQ ID NO: 3035428 - RNA, 17 nt, Human
cugcaguugccagucac

SEQ ID NO: 3035429 - RNA, 22 nt, Human
cugcaguugccagucaccccgg

SEQ ID NO: 3035430 - RNA, 21 nt, Human
cugcaguugccagucaccccg

SEQ ID NO: 3035431 - RNA, 13 nt, Human
cucagcagagugc

SEQ ID NO: 3035432 - RNA, 12 nt, Human
cucagcagagug

SEQ ID NO: 3035433 - RNA, 11 nt, Human
cucagcagagu

SEQ ID NO: 3035434 - RNA, 16 nt, Human
cucagcagagugcuuu

SEQ ID NO: 3035435 - RNA, 16 nt, Human
cucagcauccuggcac

SEQ ID NO: 3035436 - RNA, 17 nt, Human
cucagcauccuggcacc

SEQ ID NO: 3035437 - RNA, 15 nt, Human
cucagaucuucugug

SEQ ID NO: 3035438 - RNA, 21 nt, Human
cucagcaaaagaugcuucuca

SEQ ID NO: 3035439 - RNA, 20 nt, Human
cucacuguugcccaggcugg

SEQ ID NO: 3035440 - RNA, 22 nt, Human
cucacugccaugccagcuuauc

SEQ ID NO: 3035441 - RNA, 19 nt, Human
cucacugccaugccagcuu

SEQ ID NO: 3035442 - RNA, 21 nt, Human
cucacuguugcccaggcuggc

SEQ ID NO: 3035443 - RNA, 22 nt, Human
cucacuguugcccaggcuggcg

SEQ ID NO: 3035444 - RNA, 14 nt, Human
cucagagagggugg

SEQ ID NO: 3035445 - RNA, 23 nt, Human
cucacuauguugcccaggcaggu

SEQ ID NO: 3035446 - RNA, 21 nt, Human
cucacuauguugcccaggcag

SEQ ID NO: 3035447 - RNA, 22 nt, Human
cucacuauguugcccaggcagg

SEQ ID NO: 3035448 - RNA, 15 nt, Human
cucaccccagcccca

SEQ ID NO: 3035449 - RNA, 19 nt, Human
cucacuauguugcccaggc

SEQ ID NO: 3035450 - RNA, 20 nt, Human
cucacuauguugcccaggca

SEQ ID NO: 3035451 - RNA, 11 nt, Human
cucacucuguc

SEQ ID NO: 3035452 - RNA, 12 nt, Human
cucacucugucg

SEQ ID NO: 3035453 - RNA, 13 nt, Human
cucacuccuugaa

SEQ ID NO: 3035454 - RNA, 13 nt, Human
cucacugcagccu

SEQ ID NO: 3035455 - RNA, 12 nt, Human
cucacugcagcc

SEQ ID NO: 3035456 - RNA, 22 nt, Human
cucacucugucgcccagucugg

SEQ ID NO: 3035457 - RNA, 13 nt, Human
cucacucugucgc

SEQ ID NO: 3035458 - RNA, 21 nt, Human
cucacucugucgcccagucug

SEQ ID NO: 3035459 - RNA, 15 nt, Human
cucaagucuggcaga

SEQ ID NO: 3035460 - RNA, 17 nt, Human
cucaagugauucuccug

SEQ ID NO: 3035461 - RNA, 21 nt, Human
cucaaguccucuuuucugaga

SEQ ID NO: 3035462 - RNA, 14 nt, Human
cucaaguccucuuu

SEQ ID NO: 3035463 - RNA, 15 nt, Human
cucacaguccuuacc

SEQ ID NO: 3035464 - RNA, 24 nt, Human
cucacacaugagcaucaggccagg

SEQ ID NO: 3035465 - RNA, 22 nt, Human
cucacacaugagcaucaggcca

SEQ ID NO: 3035466 - RNA, 13 nt, Human
cucaccagcccca

SEQ ID NO: 3035467 - RNA, 14 nt, Human
cucaccagccccag

SEQ ID NO: 3035468 - RNA, 15 nt, Human
cucaccagccccagu

SEQ ID NO: 3035469 - RNA, 17 nt, Human
cucaccagccccagugc

SEQ ID NO: 3035470 - RNA, 18 nt, Human
cucaccagccccagugcc

SEQ ID NO: 3035471 - RNA, 15 nt, Human
cucacauuuauucug

SEQ ID NO: 3035472 - RNA, 19 nt, Human
cucacauuuauucugcuca

SEQ ID NO: 3035473 - RNA, 22 nt, Human
cucacauuuauucugcucacau

SEQ ID NO: 3035474 - RNA, 22 nt, Human
cucacaguccuuaccagcagag

SEQ ID NO: 3035475 - RNA, 19 nt, Human
cucacaguccuuaccagca

SEQ ID NO: 3035476 - RNA, 17 nt, Human
cucacaguccuuaccag

SEQ ID NO: 3035477 - RNA, 21 nt, Human
cucaacaccucugcacaagcu

SEQ ID NO: 3035478 - RNA, 13 nt, Human
cucaaccuccugg

SEQ ID NO: 3035479 - RNA, 15 nt, Human
cucaaccuccugggc

SEQ ID NO: 3035480 - RNA, 17 nt, Human
cucaaccuccugggcua

SEQ ID NO: 3035481 - RNA, 22 nt, Human
cuaugcuguucacuggacacuu

SEQ ID NO: 3035482 - RNA, 22 nt, Human
cuaugggguaaaagggguaggg

SEQ ID NO: 3035483 - RNA, 18 nt, Human
cuaugggacucaaugcac

SEQ ID NO: 3035484 - RNA, 22 nt, Human
cuaugggacucaaugcacugac

SEQ ID NO: 3035485 - RNA, 23 nt, Human
cuaugggacucaaugcacugaca

SEQ ID NO: 3035486 - RNA, 15 nt, Human
cuauuagagaagaga

SEQ ID NO: 3035487 - RNA, 16 nt, Human
cuauaauguaagcucu

SEQ ID NO: 3035488 - RNA, 22 nt, Human
cuauaauuuaccugaagucuuu

SEQ ID NO: 3035489 - RNA, 21 nt, Human
cuauaauguaagcucuacuga

SEQ ID NO: 3035490 - RNA, 17 nt, Human
cuauagccuaggugaca

SEQ ID NO: 3035491 - RNA, 23 nt, Human
cgcccaguuggguggaugccugg

SEQ ID NO: 3035492 - RNA, 22 nt, Human
cgcccaguuggguggaugccug

SEQ ID NO: 3035493 - RNA, 17 nt, Human
cgccaucccagccccaa

SEQ ID NO: 3035494 - RNA, 20 nt, Human
cgccaucccagccccaauga

SEQ ID NO: 3035495 - RNA, 15 nt, Human
cgccaugcuccuggc

SEQ ID NO: 3035496 - RNA, 24 nt, Human
cuaggugacagagugagacucugu

SEQ ID NO: 3035497 - RNA, 14 nt, Human
cuaggugacagagu

SEQ ID NO: 3035498 - RNA, 18 nt, Human
cuaggugacagagugaga

SEQ ID NO: 3035499 - RNA, 17 nt, Human
cuccaccuugcagcucu

SEQ ID NO: 3035500 - RNA, 15 nt, Human
cuccagccccuggau

SEQ ID NO: 3035501 - RNA, 14 nt, Human
cuccaccugccagg

SEQ ID NO: 3035502 - RNA, 13 nt, Human
cuccaccugccag

SEQ ID NO: 3035503 - RNA, 12 nt, Human
cuccaccugcca

SEQ ID NO: 3035504 - RNA, 12 nt, Human
cuccagccuggg

SEQ ID NO: 3035505 - RNA, 17 nt, Human
cuccagccccuggaugc

SEQ ID NO: 3035506 - RNA, 16 nt, Human
cuccagccccuggaug

SEQ ID NO: 3035507 - RNA, 20 nt, Human
cuccagccccuggaugcagc

SEQ ID NO: 3035508 - RNA, 13 nt, Human
cuccaggagcagc

SEQ ID NO: 3035509 - RNA, 11 nt, Human
cuccaggagca

SEQ ID NO: 3035510 - RNA, 17 nt, Human
cuccaggagcagccaca

SEQ ID NO: 3035511 - RNA, 16 nt, Human
cuccaggagcagccac

SEQ ID NO: 3035512 - RNA, 15 nt, Human
cuccaggagcagcca

SEQ ID NO: 3035513 - RNA, 14 nt, Human
cuccaggagcagcc

SEQ ID NO: 3035514 - RNA, 23 nt, Human
cuccaggagcagccacauuccug

SEQ ID NO: 3035515 - RNA, 18 nt, Human
cuccaggagcagccacau

SEQ ID NO: 3035516 - RNA, 13 nt, Human
cuccacauuuguu

SEQ ID NO: 3035517 - RNA, 15 nt, Human
cuccacauuuguuuu

SEQ ID NO: 3035518 - RNA, 13 nt, Human
cuccacccugcuc

SEQ ID NO: 3035519 - RNA, 15 nt, Human
cuccacccugcucuc

SEQ ID NO: 3035520 - RNA, 14 nt, Human
cucauuucuagcag

SEQ ID NO: 3035521 - RNA, 17 nt, Human
cucauuugucacacacu

SEQ ID NO: 3035522 - RNA, 17 nt, Human
cucauguugaaacuuua

SEQ ID NO: 3035523 - RNA, 15 nt, Human
cuccaaaauaaaacu

SEQ ID NO: 3035524 - RNA, 16 nt, Human
cuccaaaauaaaacuu

SEQ ID NO: 3035525 - RNA, 21 nt, Human
cucauaguaugguggcugggu

SEQ ID NO: 3035526 - RNA, 15 nt, Human
cucauacccaccccc

SEQ ID NO: 3035527 - RNA, 14 nt, Human
cucauacucaccuc

SEQ ID NO: 3035528 - RNA, 22 nt, Human
cucauacucaccucaccccacu

SEQ ID NO: 3035529 - RNA, 20 nt, Human
cucaggugauccacccaccu

SEQ ID NO: 3035530 - RNA, 14 nt, Human
cucagggucccugg

SEQ ID NO: 3035531 - RNA, 18 nt, Human
cucaggugauccacccac

SEQ ID NO: 3035532 - RNA, 19 nt, Human
cucaggugauccacccacc

SEQ ID NO: 3035533 - RNA, 21 nt, Human
cucauacccacccccacccaa

SEQ ID NO: 3035534 - RNA, 19 nt, Human
cucauacccacccccaccc

SEQ ID NO: 3035535 - RNA, 18 nt, Human
cucauacccacccccacc

SEQ ID NO: 3035536 - RNA, 16 nt, Human
cucauacccaccccca

SEQ ID NO: 3035537 - RNA, 22 nt, Human
cucaucaccaacgucugugcca

SEQ ID NO: 3035538 - RNA, 20 nt, Human
cucauaguaugguggcuggg

SEQ ID NO: 3035539 - RNA, 23 nt, Human
cucauaguaugguggcuggguug

SEQ ID NO: 3035540 - RNA, 21 nt, Human
cucaucaccaacgucugugcc

SEQ ID NO: 3035541 - RNA, 15 nt, Human
cucauccucauaccc

SEQ ID NO: 3035542 - RNA, 15 nt, Human
cucagcauccuggca

SEQ ID NO: 3035543 - RNA, 18 nt, Human
cucagcauccuggcaccc

SEQ ID NO: 3035544 - RNA, 23 nt, Human
cucaggaguuugagaccaaccug

SEQ ID NO: 3035545 - RNA, 18 nt, Human
cucaggaguuugagacca

SEQ ID NO: 3035546 - RNA, 13 nt, Human
cucagggccuggc

SEQ ID NO: 3035547 - RNA, 15 nt, Human
cucagggccuggcuc

SEQ ID NO: 3035548 - RNA, 14 nt, Human
cucagggccuggcu

SEQ ID NO: 3035549 - RNA, 16 nt, Human
cucagggccuggcuca

SEQ ID NO: 3035550 - RNA, 15 nt, Human
cucagggccuggucg

SEQ ID NO: 3035551 - RNA, 17 nt, Human
cucagggucccuggugg

SEQ ID NO: 3035552 - RNA, 16 nt, Human
cucagggucccuggug

SEQ ID NO: 3035553 - RNA, 15 nt, Human
cucagggucccuggu

SEQ ID NO: 3035554 - RNA, 20 nt, Human
cucaggugagaagcagagga

SEQ ID NO: 3035555 - RNA, 19 nt, Human
cucaggugagaagcagagg

SEQ ID NO: 3035556 - RNA, 14 nt, Human
cucaggugagaagc

SEQ ID NO: 3035557 - RNA, 16 nt, Human
cucaggugagaagcag

SEQ ID NO: 3035558 - RNA, 18 nt, Human
cuccucagaucuucugug

SEQ ID NO: 3035559 - RNA, 20 nt, Human
cucccuuggauuguccccga

SEQ ID NO: 3035560 - RNA, 15 nt, Human
cuccuccagagucag

SEQ ID NO: 3035561 - RNA, 13 nt, Human
cuccuccagaguc

SEQ ID NO: 3035562 - RNA, 15 nt, Human
cuccuccagccgcca

SEQ ID NO: 3035563 - RNA, 18 nt, Human
cucccgaguagcugggac

SEQ ID NO: 3035564 - RNA, 19 nt, Human
cucccgaguagcugggacu

SEQ ID NO: 3035565 - RNA, 20 nt, Human
cucccgaguagcugggacua

SEQ ID NO: 3035566 - RNA, 21 nt, Human
cuccccagcaagugagagcug

SEQ ID NO: 3035567 - RNA, 22 nt, Human
cuccccagcaagugagagcugg

SEQ ID NO: 3035568 - RNA, 23 nt, Human
cuccccagcaagugagagcuggg

SEQ ID NO: 3035569 - RNA, 22 nt, Human
cucgagcaugccuggauggggc

SEQ ID NO: 3035570 - RNA, 19 nt, Human
cucgagcaugccuggaugg

SEQ ID NO: 3035571 - RNA, 16 nt, Human
cucgagcaugccugga

SEQ ID NO: 3035572 - RNA, 15 nt, Human
cucgagcaugccugg

SEQ ID NO: 3035573 - RNA, 13 nt, Human
cucgagcaugccu

SEQ ID NO: 3035574 - RNA, 23 nt, Human
cuccuuggugucgggcaugacac

SEQ ID NO: 3035575 - RNA, 18 nt, Human
cuccugccucgaacuggc

SEQ ID NO: 3035576 - RNA, 20 nt, Human
cuccugccucgaacuggcug

SEQ ID NO: 3035577 - RNA, 21 nt, Human
cuccugccucgaacuggcugc

SEQ ID NO: 3035578 - RNA, 17 nt, Human
cuccugccucagccucc

SEQ ID NO: 3035579 - RNA, 16 nt, Human
cuccugccucagccuc

SEQ ID NO: 3035580 - RNA, 12 nt, Human
cuccugccucag

SEQ ID NO: 3035581 - RNA, 11 nt, Human
cuccugccuca

SEQ ID NO: 3035582 - RNA, 13 nt, Human
cuccucuccccag

SEQ ID NO: 3035583 - RNA, 15 nt, Human
cuccucuccccagca

SEQ ID NO: 3035584 - RNA, 14 nt, Human
cuccuggaaauauu

SEQ ID NO: 3035585 - RNA, 21 nt, Human
cuccugugugugcgccuacag

SEQ ID NO: 3035586 - RNA, 23 nt, Human
cuccugugugugcgccuacagga

SEQ ID NO: 3035587 - RNA, 24 nt, Human
cuccugugugugcgccuacaggag

SEQ ID NO: 3035588 - RNA, 16 nt, Human
cuuguuuaaugguagu

SEQ ID NO: 3035589 - RNA, 21 nt, Human
cuuguguguuuauugucaaag

SEQ ID NO: 3035590 - RNA, 20 nt, Human
cuuguguguuuauugucaaa

SEQ ID NO: 3035591 - RNA, 19 nt, Human
cuuuaaacuacauuagguu

SEQ ID NO: 3035592 - RNA, 22 nt, Human
cuuuccaaaugcccagcuuaaa

SEQ ID NO: 3035593 - RNA, 19 nt, Human
cuuuccaaaugcccagcuu

SEQ ID NO: 3035594 - RNA, 18 nt, Human
cuuuccaaaugcccagcu

SEQ ID NO: 3035595 - RNA, 16 nt, Human
cuugcucugcugacag

SEQ ID NO: 3035596 - RNA, 17 nt, Human
cuugcucugcugacaga

SEQ ID NO: 3035597 - RNA, 13 nt, Human
cuuggaagcuccg

SEQ ID NO: 3035598 - RNA, 13 nt, Human
cuuggaggaagga

SEQ ID NO: 3035599 - RNA, 16 nt, Human
cuuggaaaugggagac

SEQ ID NO: 3035600 - RNA, 17 nt, Human
cuucuccacccugcucu

SEQ ID NO: 3035601 - RNA, 18 nt, Human
cuucuccacccugcucuc

SEQ ID NO: 3035602 - RNA, 16 nt, Human
cuucuccacccugcuc

SEQ ID NO: 3035603 - RNA, 21 nt, Human
cuucuccacccugcucuccga

SEQ ID NO: 3035604 - RNA, 13 nt, Human
cuugcucugcuga

SEQ ID NO: 3035605 - RNA, 14 nt, Human
cuugcucugcugac

SEQ ID NO: 3035606 - RNA, 16 nt, Human
cuuggcugcagggagu

SEQ ID NO: 3035607 - RNA, 22 nt, Human
cuuggaggaaggaaacccagcu

SEQ ID NO: 3035608 - RNA, 23 nt, Human
cuuggagggcaugaagacagaua

SEQ ID NO: 3035609 - RNA, 12 nt, Human
cuuggagggcau

SEQ ID NO: 3035610 - RNA, 14 nt, Human
cuuggcugcaggga

SEQ ID NO: 3035611 - RNA, 17 nt, Human
cuuggcugcagggaguc

SEQ ID NO: 3035612 - RNA, 13 nt, Human
cuugggcuucauc

SEQ ID NO: 3035613 - RNA, 14 nt, Human
cuugggccacugug

SEQ ID NO: 3035614 - RNA, 21 nt, Human
cuuggggaccagagcugccac

SEQ ID NO: 3035615 - RNA, 20 nt, Human
cuuggggaccagagcugcca

SEQ ID NO: 3035616 - RNA, 22 nt, Human
cuugggcuucauccuccucaga

SEQ ID NO: 3035617 - RNA, 22 nt, Human
cuuggggaccagagcugccacc

SEQ ID NO: 3035618 - RNA, 15 nt, Human
cuuggggggcugagg

SEQ ID NO: 3035619 - RNA, 16 nt, Human
cuuggggggcugaggu

SEQ ID NO: 3035620 - RNA, 13 nt, Human
gaaacacugguuu

SEQ ID NO: 3035621 - RNA, 22 nt, Human
gaaacacugguuuuaaauauuu

SEQ ID NO: 3035622 - RNA, 18 nt, Human
gaaacagcuaaugggaca

SEQ ID NO: 3035623 - RNA, 14 nt, Human
gaaaaucagccugc

SEQ ID NO: 3035624 - RNA, 18 nt, Human
gaaaaucagccugcucca

SEQ ID NO: 3035625 - RNA, 16 nt, Human
gaaaaucagccugcuc

SEQ ID NO: 3035626 - RNA, 13 nt, Human
gaaaagcugcuga

SEQ ID NO: 3035627 - RNA, 17 nt, Human
gaaaagcugcugacagu

SEQ ID NO: 3035628 - RNA, 23 nt, Human
gaaaaaggaugcacagaguuguu

SEQ ID NO: 3035629 - RNA, 17 nt, Human
gaaaaaggaugcacaga

SEQ ID NO: 3035630 - RNA, 15 nt, Human
cuuuuuuggcugcug

SEQ ID NO: 3035631 - RNA, 14 nt, Human
cuuuuuuggcugcu

SEQ ID NO: 3035632 - RNA, 15 nt, Human
cuuuuuucacuacau

SEQ ID NO: 3035633 - RNA, 21 nt, Human
cuuuugagugccuuacacaau

SEQ ID NO: 3035634 - RNA, 16 nt, Human
cuuuugagcauuuaga

SEQ ID NO: 3035635 - RNA, 14 nt, Human
gaaaacguggcugc

SEQ ID NO: 3035636 - RNA, 18 nt, Human
gaaaacguggcugcuuca

SEQ ID NO: 3035637 - RNA, 16 nt, Human
gaaaacguggcugcuu

SEQ ID NO: 3035638 - RNA, 15 nt, Human
gaaaacguggcugcu

SEQ ID NO: 3035639 - RNA, 12 nt, Human
gaaaacaugcua

SEQ ID NO: 3035640 - RNA, 14 nt, Human
gaaaacaugcuaca

SEQ ID NO: 3035641 - RNA, 15 nt, Human
gaaaacaugcuacac

SEQ ID NO: 3035642 - RNA, 13 nt, Human
gaaaacacauuuu

SEQ ID NO: 3035643 - RNA, 20 nt, Human
cuuuguuuguugucagcuga

SEQ ID NO: 3035644 - RNA, 18 nt, Human
cuuuguuuguugucagcu

SEQ ID NO: 3035645 - RNA, 22 nt, Human
cuuuucauaaccuagccuuaga

SEQ ID NO: 3035646 - RNA, 20 nt, Human
cuuuucauaaccuagccuua

SEQ ID NO: 3035647 - RNA, 16 nt, Human
cuuuucuuucagccaa

SEQ ID NO: 3035648 - RNA, 23 nt, Human
cuuuucuugcaugaggcuagugu

SEQ ID NO: 3035649 - RNA, 18 nt, Human
cuuuucuugcaugaggcu

SEQ ID NO: 3035650 - RNA, 23 nt, Human
cuuuucuguccgagcuuugaaaa

SEQ ID NO: 3035651 - RNA, 18 nt, Human
cuuuucuguccgagcuuu

SEQ ID NO: 3035652 - RNA, 14 nt, Human
cuuugugauuuuug

SEQ ID NO: 3035653 - RNA, 22 nt, Human
cuuuguccccaccgcagacagg

SEQ ID NO: 3035654 - RNA, 18 nt, Human
cuuuguccccaccgcaga

SEQ ID NO: 3035655 - RNA, 13 nt, Human
cuuugggaggcca

SEQ ID NO: 3035656 - RNA, 15 nt, Human
cuuuguucuggcucu

SEQ ID NO: 3035657 - RNA, 14 nt, Human
cuuuguucuggcuc

SEQ ID NO: 3035658 - RNA, 17 nt, Human
cuuugugauuuuuguaa

SEQ ID NO: 3035659 - RNA, 18 nt, Human
cuuugugauuuuuguaau

SEQ ID NO: 3035660 - RNA, 16 nt, Human
cuuucccaucuuccaa

SEQ ID NO: 3035661 - RNA, 16 nt, Human
cuuuggacccugaggc

SEQ ID NO: 3035662 - RNA, 15 nt, Human
cuuuggacccugagg

SEQ ID NO: 3035663 - RNA, 18 nt, Human
cuuuggacccugaggccc

SEQ ID NO: 3035664 - RNA, 17 nt, Human
cuuuggacccugaggcc

SEQ ID NO: 3035665 - RNA, 19 nt, Human
cuuuggacccugaggccca

SEQ ID NO: 3035666 - RNA, 18 nt, Human
gaaguaaaauguggcagg

SEQ ID NO: 3035667 - RNA, 17 nt, Human
gaaguaaaauguggcag

SEQ ID NO: 3035668 - RNA, 12 nt, Human
gaaguuucugcc

SEQ ID NO: 3035669 - RNA, 14 nt, Human
gaauaacauguaau

SEQ ID NO: 3035670 - RNA, 15 nt, Human
gaauagcugggacua

SEQ ID NO: 3035671 - RNA, 14 nt, Human
gaauagcugggacu

SEQ ID NO: 3035672 - RNA, 19 nt, Human
gaaugaaagggcccagaga

SEQ ID NO: 3035673 - RNA, 14 nt, Human
gaaugaaagggccc

SEQ ID NO: 3035674 - RNA, 16 nt, Human
gaaucucaaauaacua

SEQ ID NO: 3035675 - RNA, 16 nt, Human
gaagguagaauguuuu

SEQ ID NO: 3035676 - RNA, 17 nt, Human
gaagguagaauguuuuc

SEQ ID NO: 3035677 - RNA, 15 nt, Human
gaagguagaauguuu

SEQ ID NO: 3035678 - RNA, 16 nt, Human
gaaggccccgcccagg

SEQ ID NO: 3035679 - RNA, 15 nt, Human
gaaggccccgcccag

SEQ ID NO: 3035680 - RNA, 14 nt, Human
gaaggccccgccca

SEQ ID NO: 3035681 - RNA, 18 nt, Human
gaaggaaacccagcucug

SEQ ID NO: 3035682 - RNA, 17 nt, Human
gaaggaaacccagcucu

SEQ ID NO: 3035683 - RNA, 14 nt, Human
gaaggaaacccagc

SEQ ID NO: 3035684 - RNA, 12 nt, Human
gaaggauacaaa

SEQ ID NO: 3035685 - RNA, 19 nt, Human
gaaggauacaaaagcaugu

SEQ ID NO: 3035686 - RNA, 21 nt, Human
gaaggauacaaaagcauguga

SEQ ID NO: 3035687 - RNA, 21 nt, Human
gaagccgcuggggccaguugg

SEQ ID NO: 3035688 - RNA, 22 nt, Human
gaagcccaggaaaggcuccagg

SEQ ID NO: 3035689 - RNA, 21 nt, Human
gaagcccaggaaaggcuccag

SEQ ID NO: 3035690 - RNA, 20 nt, Human
gaagcccaggaaaggcucca

SEQ ID NO: 3035691 - RNA, 23 nt, Human
gaagccagcaggcucucaggcca

SEQ ID NO: 3035692 - RNA, 19 nt, Human
gaagacucauucuucugua

SEQ ID NO: 3035693 - RNA, 21 nt, Human
gaagacucauucuucuguacg

SEQ ID NO: 3035694 - RNA, 16 nt, Human
gaagccagcaggcucu

SEQ ID NO: 3035695 - RNA, 15 nt, Human
gaagccagcaggcuc

SEQ ID NO: 3035696 - RNA, 14 nt, Human
gaagaaaauaauua

SEQ ID NO: 3035697 - RNA, 13 nt, Human
gaacuuggcgcug

SEQ ID NO: 3035698 - RNA, 16 nt, Human
gaacuuggcgcugccc

SEQ ID NO: 3035699 - RNA, 15 nt, Human
gaacuuggcgcugcc

SEQ ID NO: 3035700 - RNA, 12 nt, Human
gaacuugguucc

SEQ ID NO: 3035701 - RNA, 23 nt, Human
gaacuugguucccauuugcuccu

SEQ ID NO: 3035702 - RNA, 22 nt, Human
gaacuggguacuuguggacaca

SEQ ID NO: 3035703 - RNA, 16 nt, Human
gaaccaccacacccag

SEQ ID NO: 3035704 - RNA, 17 nt, Human
gaaccaccacacccagc

SEQ ID NO: 3035705 - RNA, 15 nt, Human
gaacagacuggaagc

SEQ ID NO: 3035706 - RNA, 16 nt, Human
gaacagacuggaagca

SEQ ID NO: 3035707 - RNA, 20 nt, Human
gaaccacaucuugcucugcu

SEQ ID NO: 3035708 - RNA, 21 nt, Human
gaaccacaucuugcucugcug

SEQ ID NO: 3035709 - RNA, 17 nt, Human
gaaauuuguuauaauga

SEQ ID NO: 3035710 - RNA, 14 nt, Human
gaaaugggcagagc

SEQ ID NO: 3035711 - RNA, 20 nt, Human
gaaaugggcagagcagagac

SEQ ID NO: 3035712 - RNA, 20 nt, Human
gaaauaucugaaaauguaug

SEQ ID NO: 3035713 - RNA, 13 nt, Human
gaaauauaauuga

SEQ ID NO: 3035714 - RNA, 21 nt, Human
gaaauaucugaaaauguaugu

SEQ ID NO: 3035715 - RNA, 23 nt, Human
cugggguggguggggcagugcuu

SEQ ID NO: 3035716 - RNA, 14 nt, Human
cugggggcugggca

SEQ ID NO: 3035717 - RNA, 15 nt, Human
cugggcuucaguggc

SEQ ID NO: 3035718 - RNA, 22 nt, Human
cugggcuuggggaccagagcug

SEQ ID NO: 3035719 - RNA, 18 nt, Human
cugggcuugucuguagau

SEQ ID NO: 3035720 - RNA, 21 nt, Human
cugggauuacaagcgugagcc

SEQ ID NO: 3035721 - RNA, 20 nt, Human
cuguauuuuguuuuugucuu

SEQ ID NO: 3035722 - RNA, 13 nt, Human
cugucaauuacag

SEQ ID NO: 3035723 - RNA, 16 nt, Human
cugucaauuacaggaa

SEQ ID NO: 3035724 - RNA, 15 nt, Human
cugucaauuacagga

SEQ ID NO: 3035725 - RNA, 21 nt, Human
cuguaucccaugagccucagc

SEQ ID NO: 3035726 - RNA, 22 nt, Human
cuguaucccaugagccucagca

SEQ ID NO: 3035727 - RNA, 20 nt, Human
cuguaucccaugagccucag

SEQ ID NO: 3035728 - RNA, 19 nt, Human
cuguaucccaugagccuca

SEQ ID NO: 3035729 - RNA, 19 nt, Human
cuguacgucugacaggcaa

SEQ ID NO: 3035730 - RNA, 20 nt, Human
cuguacgucugacaggcaau

SEQ ID NO: 3035731 - RNA, 17 nt, Human
cuguacaugaaaacaca

SEQ ID NO: 3035732 - RNA, 20 nt, Human
cuguacaugaaaacacauuu

SEQ ID NO: 3035733 - RNA, 21 nt, Human
cuguacaugaaaacacauuuu

SEQ ID NO: 3035734 - RNA, 14 nt, Human
cuguacgucugaca

SEQ ID NO: 3035735 - RNA, 15 nt, Human
cuguacgucugacag

SEQ ID NO: 3035736 - RNA, 16 nt, Human
cuguacgucugacagg

SEQ ID NO: 3035737 - RNA, 18 nt, Human
cuguacgucugacaggca

SEQ ID NO: 3035738 - RNA, 14 nt, Human
cuguaauuugugau

SEQ ID NO: 3035739 - RNA, 15 nt, Human
cuguaauuugugaua

SEQ ID NO: 3035740 - RNA, 22 nt, Human
cuguacagagcccacgccccca

SEQ ID NO: 3035741 - RNA, 18 nt, Human
cuguacagagcccacgcc

SEQ ID NO: 3035742 - RNA, 15 nt, Human
cuguacagagcccac

SEQ ID NO: 3035743 - RNA, 14 nt, Human
cuguacagagccca

SEQ ID NO: 3035744 - RNA, 19 nt, Human
cuguaauccuagcacuuug

SEQ ID NO: 3035745 - RNA, 22 nt, Human
cugguuagagguucccuuugac

SEQ ID NO: 3035746 - RNA, 21 nt, Human
cugguuagagguucccuuuga

SEQ ID NO: 3035747 - RNA, 16 nt, Human
cugguggcagcucacc

SEQ ID NO: 3035748 - RNA, 18 nt, Human
cugguggcagcucaccuc

SEQ ID NO: 3035749 - RNA, 17 nt, Human
cugguggcagcucaccu

SEQ ID NO: 3035750 - RNA, 15 nt, Human
cugguggcagcugcg

SEQ ID NO: 3035751 - RNA, 20 nt, Human
cugguggcagcucaccucuc

SEQ ID NO: 3035752 - RNA, 14 nt, Human
cugguggcaguggg

SEQ ID NO: 3035753 - RNA, 18 nt, Human
cugguggcagugggagcu

SEQ ID NO: 3035754 - RNA, 15 nt, Human
cugucuuuuaaacuc

SEQ ID NO: 3035755 - RNA, 14 nt, Human
cugucuuuuaaacu

SEQ ID NO: 3035756 - RNA, 15 nt, Human
cugugaaaggaaaga

SEQ ID NO: 3035757 - RNA, 18 nt, Human
cugucuucaguaagccgu

SEQ ID NO: 3035758 - RNA, 21 nt, Human
cugucauuugagcagggcuca

SEQ ID NO: 3035759 - RNA, 22 nt, Human
cugucauuugagcagggcucag

SEQ ID NO: 3035760 - RNA, 20 nt, Human
cugucauuugagcagggcuc

SEQ ID NO: 3035761 - RNA, 18 nt, Human
cugucaauuacaggaagu

SEQ ID NO: 3035762 - RNA, 22 nt, Human
cugugauuuuugguauuugaaa

SEQ ID NO: 3035763 - RNA, 23 nt, Human
cugugauggggcccugccuccuu

SEQ ID NO: 3035764 - RNA, 21 nt, Human
cugugauggggcccugccucc

SEQ ID NO: 3035765 - RNA, 16 nt, Human
cugugauggggcccug

SEQ ID NO: 3035766 - RNA, 19 nt, Human
cugugaugacauucccugc

SEQ ID NO: 3035767 - RNA, 15 nt, Human
cugugauggggcccu

SEQ ID NO: 3035768 - RNA, 22 nt, Human
cugugaaaggaaagagggaggu

SEQ ID NO: 3035769 - RNA, 16 nt, Human
cugugaaaggaaagag

SEQ ID NO: 3035770 - RNA, 15 nt, Human
cugugccaugugcca

SEQ ID NO: 3035771 - RNA, 22 nt, Human
cugugccauuuuguauuuuacu

SEQ ID NO: 3035772 - RNA, 19 nt, Human
cugugcccuaaaguguauu

SEQ ID NO: 3035773 - RNA, 14 nt, Human
cugugccaugugcc

SEQ ID NO: 3035774 - RNA, 15 nt, Human
cuguguuguacagcu

SEQ ID NO: 3035775 - RNA, 23 nt, Human
cugugucuugcaauggcagccuu

SEQ ID NO: 3035776 - RNA, 20 nt, Human
cugugucuuuuuucacuaca

SEQ ID NO: 3035777 - RNA, 21 nt, Human
cuguggguuucuaaagcugcc

SEQ ID NO: 3035778 - RNA, 22 nt, Human
cuguggguuucuaaagcugcca

SEQ ID NO: 3035779 - RNA, 23 nt, Human
cuuagacccucaugcugccaaua

SEQ ID NO: 3035780 - RNA, 19 nt, Human
cuuagacccucaugcugcc

SEQ ID NO: 3035781 - RNA, 20 nt, Human
cuuagacccucaugcugcca

SEQ ID NO: 3035782 - RNA, 21 nt, Human
cuuagacccucaugcugccaa

SEQ ID NO: 3035783 - RNA, 22 nt, Human
cuuagacccucaugcugccaau

SEQ ID NO: 3035784 - RNA, 18 nt, Human
cuuagacccucaugcugc

SEQ ID NO: 3035785 - RNA, 19 nt, Human
cuuagaauuaguggcacuu

SEQ ID NO: 3035786 - RNA, 21 nt, Human
cuuagguuggcaaaaaggcag

SEQ ID NO: 3035787 - RNA, 23 nt, Human
cuuagguuggcaaaaaggcagga

SEQ ID NO: 3035788 - RNA, 20 nt, Human
cuuaccugccaggaagccag

SEQ ID NO: 3035789 - RNA, 13 nt, Human
cuuaccugccagg

SEQ ID NO: 3035790 - RNA, 20 nt, Human
cuuagaaaaaccaccaccau

SEQ ID NO: 3035791 - RNA, 17 nt, Human
cuuagaagucacacagu

SEQ ID NO: 3035792 - RNA, 20 nt, Human
cuuagaagucacacaguauu

SEQ ID NO: 3035793 - RNA, 10 nt, Human
cuuaauuauu

SEQ ID NO: 3035794 - RNA, 16 nt, Human
cuuaauuauugauguu

SEQ ID NO: 3035795 - RNA, 20 nt, Human
cuuaauucuuagcucauucu

SEQ ID NO: 3035796 - RNA, 16 nt, Human
cuuaaucuaaauggaa

SEQ ID NO: 3035797 - RNA, 20 nt, Human
cuguuuuuauuauuaacaaa

SEQ ID NO: 3035798 - RNA, 17 nt, Human
cuuaaaaaguggaaaaa

SEQ ID NO: 3035799 - RNA, 16 nt, Human
cuuaaaaaguggaaaa

SEQ ID NO: 3035800 - RNA, 18 nt, Human
cuguuuuuauuauuaaca

SEQ ID NO: 3035801 - RNA, 17 nt, Human
cuguugcccaggcuggc

SEQ ID NO: 3035802 - RNA, 14 nt, Human
cuguuuagauaaua

SEQ ID NO: 3035803 - RNA, 17 nt, Human
cuguuuagauaauacac

SEQ ID NO: 3035804 - RNA, 15 nt, Human
cuguuucaaacuuua

SEQ ID NO: 3035805 - RNA, 17 nt, Human
cuguuucaaacuuuacu

SEQ ID NO: 3035806 - RNA, 18 nt, Human
cuguuuagauaauacacc

SEQ ID NO: 3035807 - RNA, 19 nt, Human
cuguuugcuaagugaggau

SEQ ID NO: 3035808 - RNA, 17 nt, Human
cuguuugcuaagugagg

SEQ ID NO: 3035809 - RNA, 16 nt, Human
cuguuaauaguucagg

SEQ ID NO: 3035810 - RNA, 15 nt, Human
cuguucuuuccaaag

SEQ ID NO: 3035811 - RNA, 16 nt, Human
cuguucuuuccaaagu

SEQ ID NO: 3035812 - RNA, 19 nt, Human
cuguucuuuccaaaguaca

SEQ ID NO: 3035813 - RNA, 21 nt, Human
cuguucuuuccaaaguacacu

SEQ ID NO: 3035814 - RNA, 13 nt, Human
cuguucuuucugg

SEQ ID NO: 3035815 - RNA, 14 nt, Human
cuguucuuucuggc

SEQ ID NO: 3035816 - RNA, 21 nt, Human
cuguucuuucuggcuaugcau

SEQ ID NO: 3035817 - RNA, 12 nt, Human
cuguugcccagg

SEQ ID NO: 3035818 - RNA, 13 nt, Human
cuguugcccaggc

SEQ ID NO: 3035819 - RNA, 14 nt, Human
cuguugcccaggcu

SEQ ID NO: 3035820 - RNA, 15 nt, Human
cuguugcccaggcug

SEQ ID NO: 3035821 - RNA, 16 nt, Human
cuguugcccaggcugg

SEQ ID NO: 3035822 - RNA, 23 nt, Human
cuguucuuucuggcuaugcauuu

SEQ ID NO: 3035823 - RNA, 14 nt, Human
cuucaagaaugcag

SEQ ID NO: 3035824 - RNA, 20 nt, Human
cuucaaggauccugagccag

SEQ ID NO: 3035825 - RNA, 19 nt, Human
cuucaaggauccugagcca

SEQ ID NO: 3035826 - RNA, 18 nt, Human
cuucaaggauccugagcc

SEQ ID NO: 3035827 - RNA, 17 nt, Human
cuucaaggauccugagc

SEQ ID NO: 3035828 - RNA, 15 nt, Human
cuucaaauauuuccc

SEQ ID NO: 3035829 - RNA, 22 nt, Human
cuuagucacugagacagcccgg

SEQ ID NO: 3035830 - RNA, 20 nt, Human
cuuagucacugagacagccc

SEQ ID NO: 3035831 - RNA, 21 nt, Human
cuuagucacugagacagcccg

SEQ ID NO: 3035832 - RNA, 24 nt, Human
cuucagagacuccugcaggcagcc

SEQ ID NO: 3035833 - RNA, 14 nt, Human
cuucacauauugau

SEQ ID NO: 3035834 - RNA, 23 nt, Human
cuucacauauugauuuccguuaa

SEQ ID NO: 3035835 - RNA, 23 nt, Human
cuucaaggauccugagccagauu

SEQ ID NO: 3035836 - RNA, 22 nt, Human
cuucaaggauccugagccagau

SEQ ID NO: 3035837 - RNA, 21 nt, Human
cuucaaggauccugagccaga

SEQ ID NO: 3035838 - RNA, 13 nt, Human
cuuccacaagagc

SEQ ID NO: 3035839 - RNA, 15 nt, Human
cuuccacaagagccc

SEQ ID NO: 3035840 - RNA, 14 nt, Human
cuuccacaagagcc

SEQ ID NO: 3035841 - RNA, 14 nt, Human
cuucagugccaaaa

SEQ ID NO: 3035842 - RNA, 19 nt, Human
cuucagcugacuuuucugu

SEQ ID NO: 3035843 - RNA, 15 nt, Human
cuucagcugacuuuu

SEQ ID NO: 3035844 - RNA, 14 nt, Human
cuucaguaagccgu

SEQ ID NO: 3035845 - RNA, 14 nt, Human
cuucagccucccga

SEQ ID NO: 3035846 - RNA, 16 nt, Human
cuucagccucccgagu

SEQ ID NO: 3035847 - RNA, 20 nt, Human
cuucagccucccgaguagcu

SEQ ID NO: 3035848 - RNA, 16 nt, Human
cuuccacuugaguguc

SEQ ID NO: 3035849 - RNA, 19 nt, Human
cuucgggaggucgaggcag

SEQ ID NO: 3035850 - RNA, 16 nt, Human
cuucucacugccaugc

SEQ ID NO: 3035851 - RNA, 21 nt, Human
cuucucacugccaugccagcu

SEQ ID NO: 3035852 - RNA, 16 nt, Human
cuucgcuccugugucu

SEQ ID NO: 3035853 - RNA, 17 nt, Human
cuucgcuccugugucuu

SEQ ID NO: 3035854 - RNA, 12 nt, Human
cccuaaucuucc

SEQ ID NO: 3035855 - RNA, 20 nt, Human
cccuacaguugaaaaacagc

SEQ ID NO: 3035856 - RNA, 16 nt, Human
cccgggcucugccucc

SEQ ID NO: 3035857 - RNA, 12 nt, Human
cccgggcucugc

SEQ ID NO: 3035858 - RNA, 15 nt, Human
cccgggcucugccuc

SEQ ID NO: 3035859 - RNA, 14 nt, Human
cccgggcucugccu

SEQ ID NO: 3035860 - RNA, 22 nt, Human
cccgaguagcugggacuacagg

SEQ ID NO: 3035861 - RNA, 20 nt, Human
cccgcugucagccauuccug

SEQ ID NO: 3035862 - RNA, 19 nt, Human
cccgcugucagccauuccu

SEQ ID NO: 3035863 - RNA, 14 nt, Human
cccagagggccugc

SEQ ID NO: 3035864 - RNA, 21 nt, Human
cccgaggccuucucugaagga

SEQ ID NO: 3035865 - RNA, 15 nt, Human
cccagagggccugca

SEQ ID NO: 3035866 - RNA, 13 nt, Human
cccgaguagcugg

SEQ ID NO: 3035867 - RNA, 14 nt, Human
cccgaguagcuggg

SEQ ID NO: 3035868 - RNA, 15 nt, Human
cccgaguagcuggga

SEQ ID NO: 3035869 - RNA, 16 nt, Human
cccgaguagcugggac

SEQ ID NO: 3035870 - RNA, 17 nt, Human
cccgaguagcugggacu

SEQ ID NO: 3035871 - RNA, 18 nt, Human
cccgaguagcugggacua

SEQ ID NO: 3035872 - RNA, 21 nt, Human
cccgaguagcugggacuacag

SEQ ID NO: 3035873 - RNA, 15 nt, Human
cccugguggcagcuc

SEQ ID NO: 3035874 - RNA, 17 nt, Human
cccugguggcagcucac

SEQ ID NO: 3035875 - RNA, 16 nt, Human
cccugguggcagcuca

SEQ ID NO: 3035876 - RNA, 22 nt, Human
cccugcuggguguggcgcagca

SEQ ID NO: 3035877 - RNA, 17 nt, Human
cccugcccaccuggccu

SEQ ID NO: 3035878 - RNA, 14 nt, Human
cccugcccaccugg

SEQ ID NO: 3035879 - RNA, 13 nt, Human
cccugcccaccug

SEQ ID NO: 3035880 - RNA, 21 nt, Human
cccugcuggguguggcgcagc

SEQ ID NO: 3035881 - RNA, 16 nt, Human
cccugcuggguguggc

SEQ ID NO: 3035882 - RNA, 18 nt, Human
cccugcccaccuggccuc

SEQ ID NO: 3035883 - RNA, 12 nt, Human
cccugcacuugc

SEQ ID NO: 3035884 - RNA, 19 nt, Human
cccugcacuugcagacucu

SEQ ID NO: 3035885 - RNA, 15 nt, Human
cccugaaagcccuga

SEQ ID NO: 3035886 - RNA, 13 nt, Human
cccugaggcccag

SEQ ID NO: 3035887 - RNA, 16 nt, Human
cccucuggggcuguuc

SEQ ID NO: 3035888 - RNA, 23 nt, Human
cccugaggcccagagggccugca

SEQ ID NO: 3035889 - RNA, 20 nt, Human
cccugaggcccagagggccu

SEQ ID NO: 3035890 - RNA, 19 nt, Human
cccugaggcccagagggcc

SEQ ID NO: 3035891 - RNA, 18 nt, Human
cccugaggcccagagggc

SEQ ID NO: 3035892 - RNA, 17 nt, Human
cccugaggcccagaggg

SEQ ID NO: 3035893 - RNA, 16 nt, Human
cccugaggcccagagg

SEQ ID NO: 3035894 - RNA, 15 nt, Human
cccugaggcccagag

SEQ ID NO: 3035895 - RNA, 14 nt, Human
cccugaggcccaga

SEQ ID NO: 3035896 - RNA, 12 nt, Human
cccucuggggcu

SEQ ID NO: 3035897 - RNA, 17 nt, Human
cccaccuggccucugca

SEQ ID NO: 3035898 - RNA, 21 nt, Human
cccaccuggccucugcacucc

SEQ ID NO: 3035899 - RNA, 19 nt, Human
cccaccuggccucugcacu

SEQ ID NO: 3035900 - RNA, 16 nt, Human
cccaccuggccucugc

SEQ ID NO: 3035901 - RNA, 20 nt, Human
cccaccuuggcugcagggag

SEQ ID NO: 3035902 - RNA, 21 nt, Human
cccacgacugcccggcagggu

SEQ ID NO: 3035903 - RNA, 20 nt, Human
cccacgacugcccggcaggg

SEQ ID NO: 3035904 - RNA, 12 nt, Human
cccacuucugcc

SEQ ID NO: 3035905 - RNA, 23 nt, Human
cccacuugagaauuacccuuuug

SEQ ID NO: 3035906 - RNA, 14 nt, Human
cccacgcuggagug

SEQ ID NO: 3035907 - RNA, 19 nt, Human
cccacgcuggagugcagug

SEQ ID NO: 3035908 - RNA, 20 nt, Human
cccacgcuggagugcaguga

SEQ ID NO: 3035909 - RNA, 21 nt, Human
cccacgcuggagugcagugag

SEQ ID NO: 3035910 - RNA, 19 nt, Human
cccaccgcagacaggacca

SEQ ID NO: 3035911 - RNA, 20 nt, Human
cccaccgcagacaggaccag

SEQ ID NO: 3035912 - RNA, 17 nt, Human
cccaccucagccucccg

SEQ ID NO: 3035913 - RNA, 22 nt, Human
cccaccucucucacuccuugaa

SEQ ID NO: 3035914 - RNA, 19 nt, Human
cccaccucucucacuccuu

SEQ ID NO: 3035915 - RNA, 21 nt, Human
cccacaaaggagagcuagcag

SEQ ID NO: 3035916 - RNA, 20 nt, Human
cccaaugcacuuuguucugg

SEQ ID NO: 3035917 - RNA, 16 nt, Human
cccaaugcacuuuguu

SEQ ID NO: 3035918 - RNA, 15 nt, Human
ccuccacauuuguuu

SEQ ID NO: 3035919 - RNA, 20 nt, Human
ccucauccucauacccaccc

SEQ ID NO: 3035920 - RNA, 13 nt, Human
ccucauccucaua

SEQ ID NO: 3035921 - RNA, 19 nt, Human
ccucagucuggcccuuccu

SEQ ID NO: 3035922 - RNA, 11 nt, Human
ccucagugcca

SEQ ID NO: 3035923 - RNA, 12 nt, Human
ccucauacccac

SEQ ID NO: 3035924 - RNA, 20 nt, Human
ccucagucuggcccuuccuu

SEQ ID NO: 3035925 - RNA, 20 nt, Human
ccucauaguaugguggcugg

SEQ ID NO: 3035926 - RNA, 13 nt, Human
ccucauacccacc

SEQ ID NO: 3035927 - RNA, 21 nt, Human
ccucauaguaugguggcuggg

SEQ ID NO: 3035928 - RNA, 22 nt, Human
ccucauaguaugguggcugggu

SEQ ID NO: 3035929 - RNA, 14 nt, Human
ccucaucaccaacg

SEQ ID NO: 3035930 - RNA, 13 nt, Human
ccucaucaccaac

SEQ ID NO: 3035931 - RNA, 16 nt, Human
ccucccaaagugcugg

SEQ ID NO: 3035932 - RNA, 23 nt, Human
ccuccaugugggcuaguugggcu

SEQ ID NO: 3035933 - RNA, 15 nt, Human
ccucccaaagugcug

SEQ ID NO: 3035934 - RNA, 22 nt, Human
ccuccaggugcacaagcuccaa

SEQ ID NO: 3035935 - RNA, 21 nt, Human
ccuccaggugcacaagcucca

SEQ ID NO: 3035936 - RNA, 19 nt, Human
ccuccaggugcacaagcuc

SEQ ID NO: 3035937 - RNA, 13 nt, Human
ccuccugccucga

SEQ ID NO: 3035938 - RNA, 23 nt, Human
ccuccugccucgaacuggcugca

SEQ ID NO: 3035939 - RNA, 14 nt, Human
ccuccugggcuaag

SEQ ID NO: 3035940 - RNA, 19 nt, Human
ccucccgaguagcugggac

SEQ ID NO: 3035941 - RNA, 20 nt, Human
ccucccgaguagcugggacu

SEQ ID NO: 3035942 - RNA, 21 nt, Human
ccucccgaguagcugggacua

SEQ ID NO: 3035943 - RNA, 14 nt, Human
ccuccucagaucuu

SEQ ID NO: 3035944 - RNA, 10 nt, Human
ccucccuccc

SEQ ID NO: 3035945 - RNA, 16 nt, Human
ccucuaggaggucucu

SEQ ID NO: 3035946 - RNA, 14 nt, Human
ccucgguguggaga

SEQ ID NO: 3035947 - RNA, 16 nt, Human
ccucggugccuuccuc

SEQ ID NO: 3035948 - RNA, 17 nt, Human
ccucccgaauagcuggg

SEQ ID NO: 3035949 - RNA, 21 nt, Human
ccgcuaagagggagggagggc

SEQ ID NO: 3035950 - RNA, 23 nt, Human
ccgcuaagagggagggagggcuc

SEQ ID NO: 3035951 - RNA, 14 nt, Human
ccgcacugggcuug

SEQ ID NO: 3035952 - RNA, 20 nt, Human
ccgaguagcugggacuacag

SEQ ID NO: 3035953 - RNA, 16 nt, Human
ccgaguagcugggacu

SEQ ID NO: 3035954 - RNA, 17 nt, Human
ccgaguagcugggacua

SEQ ID NO: 3035955 - RNA, 20 nt, Human
cccugguggcagcucaccuc

SEQ ID NO: 3035956 - RNA, 14 nt, Human
ccgaggccuucucu

SEQ ID NO: 3035957 - RNA, 12 nt, Human
ccgcuuucuacc

SEQ ID NO: 3035958 - RNA, 20 nt, Human
ccgggaagggggcugggaca

SEQ ID NO: 3035959 - RNA, 19 nt, Human
ccgcuuucuacccagcgag

SEQ ID NO: 3035960 - RNA, 15 nt, Human
ccggcuggccuggcc

SEQ ID NO: 3035961 - RNA, 18 nt, Human
ccggcuggccuggccccu

SEQ ID NO: 3035962 - RNA, 17 nt, Human
ccggcuggccuggcccc

SEQ ID NO: 3035963 - RNA, 22 nt, Human
ccgggcucugccucccaucacc

SEQ ID NO: 3035964 - RNA, 20 nt, Human
ccgggcgcgguggcucacgc

SEQ ID NO: 3035965 - RNA, 22 nt, Human
ccuauauuguuuucaguguaca

SEQ ID NO: 3035966 - RNA, 18 nt, Human
ccuauauuguuuucagug

SEQ ID NO: 3035967 - RNA, 23 nt, Human
ccuaguuccaccaucaagccacc

SEQ ID NO: 3035968 - RNA, 21 nt, Human
ccuaguuccaccaucaagcca

SEQ ID NO: 3035969 - RNA, 13 nt, Human
ccuaguuccacca

SEQ ID NO: 3035970 - RNA, 14 nt, Human
ccuaaaguguauuu

SEQ ID NO: 3035971 - RNA, 15 nt, Human
ccuguuuuuauuauu

SEQ ID NO: 3035972 - RNA, 14 nt, Human
ccuguuuuuauuau

SEQ ID NO: 3035973 - RNA, 20 nt, Human
ccuuacacaaugguuuucuu

SEQ ID NO: 3035974 - RNA, 14 nt, Human
ccuuacacaauggu

SEQ ID NO: 3035975 - RNA, 17 nt, Human
ccuuagaagucacacag

SEQ ID NO: 3035976 - RNA, 18 nt, Human
ccuuagaagucacacagu

SEQ ID NO: 3035977 - RNA, 19 nt, Human
ccuuaccugccaggaagcc

SEQ ID NO: 3035978 - RNA, 15 nt, Human
ccuuacccucauguu

SEQ ID NO: 3035979 - RNA, 20 nt, Human
ccuuaccagcagagcaccuu

SEQ ID NO: 3035980 - RNA, 13 nt, Human
ccuuaccagcaga

SEQ ID NO: 3035981 - RNA, 23 nt, Human
ccuguugggccaggagccuccug

SEQ ID NO: 3035982 - RNA, 16 nt, Human
ccuguuucugcagcca

SEQ ID NO: 3035983 - RNA, 18 nt, Human
ccuguuuguuucugaaag

SEQ ID NO: 3035984 - RNA, 14 nt, Human
ccuguuuguuucug

SEQ ID NO: 3035985 - RNA, 17 nt, Human
ccugugucuugcaaugg

SEQ ID NO: 3035986 - RNA, 19 nt, Human
ccugugucuugcaauggca

SEQ ID NO: 3035987 - RNA, 21 nt, Human
ccugugucuugcaauggcagc

SEQ ID NO: 3035988 - RNA, 22 nt, Human
ccugugucuugcaauggcagcc

SEQ ID NO: 3035989 - RNA, 20 nt, Human
ccugugugugcgccuacagg

SEQ ID NO: 3035990 - RNA, 21 nt, Human
ccugugugugcgccuacagga

SEQ ID NO: 3035991 - RNA, 13 nt, Human
ccuuguuuaaugg

SEQ ID NO: 3035992 - RNA, 18 nt, Human
ccuuugacgccaucccag

SEQ ID NO: 3035993 - RNA, 17 nt, Human
ccuuugacgccauccca

SEQ ID NO: 3035994 - RNA, 16 nt, Human
ccuuugacgccauccc

SEQ ID NO: 3035995 - RNA, 21 nt, Human
ccuuggugucgggcaugacac

SEQ ID NO: 3035996 - RNA, 22 nt, Human
ccuuggugucgggcaugacacg

SEQ ID NO: 3035997 - RNA, 22 nt, Human
ccuugguuaggcauugugggaa

SEQ ID NO: 3035998 - RNA, 21 nt, Human
ccuugguuaggcauuguggga

SEQ ID NO: 3035999 - RNA, 23 nt, Human
ccuucuucccaauagcaaggcug

SEQ ID NO: 3036000 - RNA, 15 nt, Human
ccuucggcgccuuaa

SEQ ID NO: 3036001 - RNA, 19 nt, Human
ccuucuccuucaccuuugu

SEQ ID NO: 3036002 - RNA, 15 nt, Human
ccuucuccuucaccu

SEQ ID NO: 3036003 - RNA, 23 nt, Human
ccuugaccauucuccaccugcca

SEQ ID NO: 3036004 - RNA, 22 nt, Human
ccuugaccauucuccaccugcc

SEQ ID NO: 3036005 - RNA, 13 nt, Human
ccuugacucuuuc

SEQ ID NO: 3036006 - RNA, 19 nt, Human
ccuugaacuuugaccucug

SEQ ID NO: 3036007 - RNA, 17 nt, Human
ccuucacagaugggugc

SEQ ID NO: 3036008 - RNA, 20 nt, Human
ccuucaccuuuguccccacc

SEQ ID NO: 3036009 - RNA, 19 nt, Human
ccuucaccuuuguccccac

SEQ ID NO: 3036010 - RNA, 21 nt, Human
ccuucaccuuuguccccaccg

SEQ ID NO: 3036011 - RNA, 10 nt, Human
ccuucagugc

SEQ ID NO: 3036012 - RNA, 11 nt, Human
ccuucagugcc

SEQ ID NO: 3036013 - RNA, 14 nt, Human
ccuucagugccaaa

SEQ ID NO: 3036014 - RNA, 19 nt, Human
ccuucauuuggcauucccc

SEQ ID NO: 3036015 - RNA, 22 nt, Human
ccuucauuuggcauuccccacu

SEQ ID NO: 3036016 - RNA, 22 nt, Human
ccuuugacgccaucccagcccc

SEQ ID NO: 3036017 - RNA, 21 nt, Human
ccuuugacgccaucccagccc

SEQ ID NO: 3036018 - RNA, 20 nt, Human
ccuuugacgccaucccagcc

SEQ ID NO: 3036019 - RNA, 20 nt, Human
cgaaaacguggcugcuucaa

SEQ ID NO: 3036020 - RNA, 15 nt, Human
cgaaaacguggcugc

SEQ ID NO: 3036021 - RNA, 19 nt, Human
cgaaaacguggcugcuuca

SEQ ID NO: 3036022 - RNA, 18 nt, Human
cgaaaacguggcugcuuc

SEQ ID NO: 3036023 - RNA, 21 nt, Human
cgaaagaacaguccauugaaa

SEQ ID NO: 3036024 - RNA, 12 nt, Human
cgaaagaacagu

SEQ ID NO: 3036025 - RNA, 19 nt, Human
cgaaagggacuuggaagcu

SEQ ID NO: 3036026 - RNA, 20 nt, Human
cgaaaggaugaaagugacca

SEQ ID NO: 3036027 - RNA, 22 nt, Human
cgaaagggacuuggaagcuccg

SEQ ID NO: 3036028 - RNA, 12 nt, Human
cgaacuggcugc

SEQ ID NO: 3036029 - RNA, 14 nt, Human
cgaacuggcugcaa

SEQ ID NO: 3036030 - RNA, 13 nt, Human
cgaauagcuggga

SEQ ID NO: 3036031 - RNA, 14 nt, Human
cgaauagcugggac

SEQ ID NO: 3036032 - RNA, 17 nt, Human
cgagaucacgccacugc

SEQ ID NO: 3036033 - RNA, 18 nt, Human
cgagauagccaaggccaa

SEQ ID NO: 3036034 - RNA, 20 nt, Human
cgagauugcaccacugcacu

SEQ ID NO: 3036035 - RNA, 18 nt, Human
cgagaucacgccacugca

SEQ ID NO: 3036036 - RNA, 20 nt, Human
cgagaucacgccacugcacu

SEQ ID NO: 3036037 - RNA, 20 nt, Human
cgagcaggcuucuucccccc

SEQ ID NO: 3036038 - RNA, 17 nt, Human
cgagcaugccuggaugg

SEQ ID NO: 3036039 - RNA, 16 nt, Human
cgagcaugccuggaug

SEQ ID NO: 3036040 - RNA, 13 nt, Human
cgagcaugccugg

SEQ ID NO: 3036041 - RNA, 14 nt, Human
cgagcaugccugga

SEQ ID NO: 3036042 - RNA, 15 nt, Human
cgagcccugguggca

SEQ ID NO: 3036043 - RNA, 16 nt, Human
cgagcccugguggcag

SEQ ID NO: 3036044 - RNA, 18 nt, Human
cgagcaugccuggauggg

SEQ ID NO: 3036045 - RNA, 20 nt, Human
cgauuucuguuuagauaaua

SEQ ID NO: 3036046 - RNA, 14 nt, Human
cgcagcccugcaga

SEQ ID NO: 3036047 - RNA, 16 nt, Human
cgcagacaggaccagg

SEQ ID NO: 3036048 - RNA, 15 nt, Human
cgcagacaggaccag

SEQ ID NO: 3036049 - RNA, 22 nt, Human
cgccaggggaaaaucagccugc

SEQ ID NO: 3036050 - RNA, 21 nt, Human
cgccagauucuuuccugaggc

SEQ ID NO: 3036051 - RNA, 20 nt, Human
cgccagauucuuuccugagg

SEQ ID NO: 3036052 - RNA, 19 nt, Human
cgccagauucuuuccugag

SEQ ID NO: 3036053 - RNA, 17 nt, Human
cgccagauucuuuccug

SEQ ID NO: 3036054 - RNA, 17 nt, Human
cgccaugcuccuggccc

SEQ ID NO: 3036055 - RNA, 22 nt, Human
ccuggcacccggccccugcugg

SEQ ID NO: 3036056 - RNA, 23 nt, Human
ccuggcacccggccccugcuggu

SEQ ID NO: 3036057 - RNA, 13 nt, Human
ccuggcagccccu

SEQ ID NO: 3036058 - RNA, 12 nt, Human
ccuggcagcccc

SEQ ID NO: 3036059 - RNA, 18 nt, Human
ccuggaauauauaaccag

SEQ ID NO: 3036060 - RNA, 15 nt, Human
ccuggccagaugcac

SEQ ID NO: 3036061 - RNA, 17 nt, Human
ccugcggugcuaucucc

SEQ ID NO: 3036062 - RNA, 16 nt, Human
ccugcggugcuaucuc

SEQ ID NO: 3036063 - RNA, 22 nt, Human
ccugccccucaacucuccucca

SEQ ID NO: 3036064 - RNA, 23 nt, Human
ccugccuguugggccaggagccu

SEQ ID NO: 3036065 - RNA, 21 nt, Human
ccugcucuccgaccagacacc

SEQ ID NO: 3036066 - RNA, 22 nt, Human
ccugcggugcuaucucccccag

SEQ ID NO: 3036067 - RNA, 22 nt, Human
ccugcucuccgaccagacaccu

SEQ ID NO: 3036068 - RNA, 14 nt, Human
ccugcuucaaauau

SEQ ID NO: 3036069 - RNA, 23 nt, Human
ccugacaacacucauugaccuga

SEQ ID NO: 3036070 - RNA, 16 nt, Human
ccugagcuuucugcua

SEQ ID NO: 3036071 - RNA, 21 nt, Human
ccugaggcccagagggccugc

SEQ ID NO: 3036072 - RNA, 20 nt, Human
ccugagccagauuucacucu

SEQ ID NO: 3036073 - RNA, 14 nt, Human
ccugagcuuucugc

SEQ ID NO: 3036074 - RNA, 16 nt, Human
ccugccagggacagag

SEQ ID NO: 3036075 - RNA, 15 nt, Human
ccugccagggacaga

SEQ ID NO: 3036076 - RNA, 14 nt, Human
ccugccagggacag

SEQ ID NO: 3036077 - RNA, 13 nt, Human
ccugccagggaca

SEQ ID NO: 3036078 - RNA, 12 nt, Human
ccugccagggac

SEQ ID NO: 3036079 - RNA, 22 nt, Human
ccugccaggaagccagcaggcu

SEQ ID NO: 3036080 - RNA, 21 nt, Human
ccugccaggaagccagcaggc

SEQ ID NO: 3036081 - RNA, 19 nt, Human
ccugccaggaagccagcag

SEQ ID NO: 3036082 - RNA, 18 nt, Human
ccugccaggaagccagca

SEQ ID NO: 3036083 - RNA, 11 nt, Human
ccugccaggga

SEQ ID NO: 3036084 - RNA, 16 nt, Human
ccugccaggcauggug

SEQ ID NO: 3036085 - RNA, 23 nt, Human
ccugccaggaagccagcaggcuc

SEQ ID NO: 3036086 - RNA, 15 nt, Human
ccugccaggcauggu

SEQ ID NO: 3036087 - RNA, 17 nt, Human
ccugccaggaagccagc

SEQ ID NO: 3036088 - RNA, 15 nt, Human
ccugccaggaagcca

SEQ ID NO: 3036089 - RNA, 14 nt, Human
ccugccaggaagcc

SEQ ID NO: 3036090 - RNA, 13 nt, Human
ccugccaggaagc

SEQ ID NO: 3036091 - RNA, 15 nt, Human
ccugauugugucucu

SEQ ID NO: 3036092 - RNA, 22 nt, Human
ccugaugcuucuucagagacuc

SEQ ID NO: 3036093 - RNA, 21 nt, Human
ccugaugcuucuucagagacu

SEQ ID NO: 3036094 - RNA, 20 nt, Human
ccugaugcuucuucagagac

SEQ ID NO: 3036095 - RNA, 19 nt, Human
ccugaugcuucuucagaga

SEQ ID NO: 3036096 - RNA, 12 nt, Human
ccugaggcccuu

SEQ ID NO: 3036097 - RNA, 11 nt, Human
ccugaggcccu

SEQ ID NO: 3036098 - RNA, 19 nt, Human
ccugauugugucucuuggu

SEQ ID NO: 3036099 - RNA, 17 nt, Human
ccugauugugucucuug

SEQ ID NO: 3036100 - RNA, 21 nt, Human
ccugcaaccugauugugucuc

SEQ ID NO: 3036101 - RNA, 22 nt, Human
ccugcaaccugauugugucucu

SEQ ID NO: 3036102 - RNA, 14 nt, Human
ccugcaagaacaag

SEQ ID NO: 3036103 - RNA, 19 nt, Human
ccaguguuuuaggagcaug

SEQ ID NO: 3036104 - RNA, 22 nt, Human
ccaguguuguggauuuaacaga

SEQ ID NO: 3036105 - RNA, 23 nt, Human
ccauauucuguuggccaguguga

SEQ ID NO: 3036106 - RNA, 23 nt, Human
ccagugcccacaggaucagucug

SEQ ID NO: 3036107 - RNA, 16 nt, Human
ccagugaggcucugcc

SEQ ID NO: 3036108 - RNA, 15 nt, Human
ccagugaggcucugc

SEQ ID NO: 3036109 - RNA, 14 nt, Human
ccagugaggcucug

SEQ ID NO: 3036110 - RNA, 22 nt, Human
ccagugguuccuaauccucuag

SEQ ID NO: 3036111 - RNA, 20 nt, Human
ccagugccgagaaggaagcc

SEQ ID NO: 3036112 - RNA, 15 nt, Human
ccagguucagcuugu

SEQ ID NO: 3036113 - RNA, 24 nt, Human
ccaggugcacaagcuccaagcucc

SEQ ID NO: 3036114 - RNA, 17 nt, Human
ccagguuuuuggucuga

SEQ ID NO: 3036115 - RNA, 19 nt, Human
ccagucuggaaugcagugg

SEQ ID NO: 3036116 - RNA, 20 nt, Human
ccagucuggaaugcaguggu

SEQ ID NO: 3036117 - RNA, 13 nt, Human
ccagugaggcucu

SEQ ID NO: 3036118 - RNA, 18 nt, Human
ccagucuggaaugcagug

SEQ ID NO: 3036119 - RNA, 18 nt, Human
ccaggugcacaagcucca

SEQ ID NO: 3036120 - RNA, 20 nt, Human
ccaggugcacaagcuccaag

SEQ ID NO: 3036121 - RNA, 19 nt, Human
ccaggugcacaagcuccaa

SEQ ID NO: 3036122 - RNA, 21 nt, Human
ccagggacagaggggguggcc

SEQ ID NO: 3036123 - RNA, 15 nt, Human
ccagggacagagggg

SEQ ID NO: 3036124 - RNA, 14 nt, Human
ccagggacagaggg

SEQ ID NO: 3036125 - RNA, 20 nt, Human
ccaggcuuagucacugagac

SEQ ID NO: 3036126 - RNA, 22 nt, Human
ccagggacagaggggguggccu

SEQ ID NO: 3036127 - RNA, 19 nt, Human
ccaggagccuccugcccuu

SEQ ID NO: 3036128 - RNA, 20 nt, Human
ccaggagccccgaggccuuc

SEQ ID NO: 3036129 - RNA, 16 nt, Human
ccaggagccccgaggc

SEQ ID NO: 3036130 - RNA, 19 nt, Human
ccaggagccccgaggccuu

SEQ ID NO: 3036131 - RNA, 21 nt, Human
ccaggcauuccccaggaggcc

SEQ ID NO: 3036132 - RNA, 19 nt, Human
ccaggcauuccccaggagg

SEQ ID NO: 3036133 - RNA, 18 nt, Human
ccaggcauuccccaggag

SEQ ID NO: 3036134 - RNA, 17 nt, Human
ccaggcauuccccagga

SEQ ID NO: 3036135 - RNA, 23 nt, Human
ccaggcccucugcccacucccug

SEQ ID NO: 3036136 - RNA, 22 nt, Human
ccaggcccucugcccacucccu

SEQ ID NO: 3036137 - RNA, 21 nt, Human
ccaggcccucugcccacuccc

SEQ ID NO: 3036138 - RNA, 20 nt, Human
ccaggcccucugcccacucc

SEQ ID NO: 3036139 - RNA, 24 nt, Human
ccaggcuguaucccaugagccuca

SEQ ID NO: 3036140 - RNA, 17 nt, Human
ccaggcuuagucacuga

SEQ ID NO: 3036141 - RNA, 13 nt, Human
cccaaagugcugg

SEQ ID NO: 3036142 - RNA, 15 nt, Human
cccaaagugcuggga

SEQ ID NO: 3036143 - RNA, 18 nt, Human
cccaaaacucuccucugc

SEQ ID NO: 3036144 - RNA, 16 nt, Human
cccaaaacucuccucu

SEQ ID NO: 3036145 - RNA, 14 nt, Human
ccauuuguguuuau

SEQ ID NO: 3036146 - RNA, 20 nt, Human
ccauucuccaccugccaggg

SEQ ID NO: 3036147 - RNA, 19 nt, Human
ccauucuccaccugccagg

SEQ ID NO: 3036148 - RNA, 22 nt, Human
cccaaauggaaaugggcagagc

SEQ ID NO: 3036149 - RNA, 18 nt, Human
cccaaauggaaaugggca

SEQ ID NO: 3036150 - RNA, 16 nt, Human
cccaaagugcugggau

SEQ ID NO: 3036151 - RNA, 19 nt, Human
ccauauucuguuggccagu

SEQ ID NO: 3036152 - RNA, 18 nt, Human
ccauucuccaccugccag

SEQ ID NO: 3036153 - RNA, 17 nt, Human
ccauguuggccaggcug

SEQ ID NO: 3036154 - RNA, 16 nt, Human
ccauguuggccaggcu

SEQ ID NO: 3036155 - RNA, 18 nt, Human
ccagauucuuuccugagg

SEQ ID NO: 3036156 - RNA, 22 nt, Human
ccagauucuuuccugaggcugg

SEQ ID NO: 3036157 - RNA, 21 nt, Human
ccagauucuuuccugaggcug

SEQ ID NO: 3036158 - RNA, 20 nt, Human
ccagauucuuuccugaggcu

SEQ ID NO: 3036159 - RNA, 19 nt, Human
ccagauucuuuccugaggc

SEQ ID NO: 3036160 - RNA, 13 nt, Human
ccagagggccugc

SEQ ID NO: 3036161 - RNA, 22 nt, Human
ccagagggagugacagaggcag

SEQ ID NO: 3036162 - RNA, 23 nt, Human
ccagagggagugacagaggcagc

SEQ ID NO: 3036163 - RNA, 23 nt, Human
ccagaugcaccagcccuuagcag

SEQ ID NO: 3036164 - RNA, 16 nt, Human
ccagagggccugcaag

SEQ ID NO: 3036165 - RNA, 15 nt, Human
ccagagggccugcaa

SEQ ID NO: 3036166 - RNA, 19 nt, Human
ccagauugcaacaggcugg

SEQ ID NO: 3036167 - RNA, 20 nt, Human
ccagauugcaacaggcuggg

SEQ ID NO: 3036168 - RNA, 23 nt, Human
ccagauucuuuccugaggcuggg

SEQ ID NO: 3036169 - RNA, 18 nt, Human
ccagauugcaacaggcug

SEQ ID NO: 3036170 - RNA, 21 nt, Human
ccagauugcaacaggcugggc

SEQ ID NO: 3036171 - RNA, 12 nt, Human
ccagauuucacu

SEQ ID NO: 3036172 - RNA, 17 nt, Human
ccagacaccuugacagg

SEQ ID NO: 3036173 - RNA, 19 nt, Human
ccagacaccuugacagggc

SEQ ID NO: 3036174 - RNA, 21 nt, Human
ccagagaggguggugaccucu

SEQ ID NO: 3036175 - RNA, 23 nt, Human
ccagagaggguggugaccucugc

SEQ ID NO: 3036176 - RNA, 14 nt, Human
ccagagaggguggu

SEQ ID NO: 3036177 - RNA, 13 nt, Human
ccagagagggugg

SEQ ID NO: 3036178 - RNA, 11 nt, Human
ccagagcugcc

SEQ ID NO: 3036179 - RNA, 13 nt, Human
ccagagcugccac

SEQ ID NO: 3036180 - RNA, 12 nt, Human
ccagagcugcca

SEQ ID NO: 3036181 - RNA, 19 nt, Human
ccagagcugccaccugccu

SEQ ID NO: 3036182 - RNA, 16 nt, Human
ccagagcugccaccug

SEQ ID NO: 3036183 - RNA, 15 nt, Human
ccagagcugccaccu

SEQ ID NO: 3036184 - RNA, 14 nt, Human
ccagagcugccacc

SEQ ID NO: 3036185 - RNA, 16 nt, Human
ccagagggagugacag

SEQ ID NO: 3036186 - RNA, 17 nt, Human
ccagagggagugacaga

SEQ ID NO: 3036187 - RNA, 18 nt, Human
ccagagggagugacagag

SEQ ID NO: 3036188 - RNA, 19 nt, Human
ccagagggagugacagagg

SEQ ID NO: 3036189 - RNA, 20 nt, Human
ccagagggagugacagaggc

SEQ ID NO: 3036190 - RNA, 21 nt, Human
ccagagggagugacagaggca

SEQ ID NO: 3036191 - RNA, 21 nt, Human
ccagaggagagaggacccccu

SEQ ID NO: 3036192 - RNA, 22 nt, Human
ccagaggagagaggacccccug

SEQ ID NO: 3036193 - RNA, 15 nt, Human
ccagcaagugagagc

SEQ ID NO: 3036194 - RNA, 14 nt, Human
ccagauuucacucu

SEQ ID NO: 3036195 - RNA, 16 nt, Human
ccagcaagugagagcu

SEQ ID NO: 3036196 - RNA, 20 nt, Human
ccagcaagugagagcugggu

SEQ ID NO: 3036197 - RNA, 21 nt, Human
ccagcaagugagagcugggug

SEQ ID NO: 3036198 - RNA, 22 nt, Human
ccagcaagugagagcugggugu

SEQ ID NO: 3036199 - RNA, 13 nt, Human
ccagccccagugc

SEQ ID NO: 3036200 - RNA, 15 nt, Human
ccagccccagugccc

SEQ ID NO: 3036201 - RNA, 23 nt, Human
ccagccccaaaacucuccucugc

SEQ ID NO: 3036202 - RNA, 16 nt, Human
ccagccccagugccca

SEQ ID NO: 3036203 - RNA, 16 nt, Human
ccagcccuuagcaggg

SEQ ID NO: 3036204 - RNA, 17 nt, Human
ccagcccuuagcaggga

SEQ ID NO: 3036205 - RNA, 23 nt, Human
ccagccgagauagccaaggccaa

SEQ ID NO: 3036206 - RNA, 14 nt, Human
ccagccgccaugcu

SEQ ID NO: 3036207 - RNA, 19 nt, Human
ccagccgccaugcuccugg

SEQ ID NO: 3036208 - RNA, 18 nt, Human
ccagccgccaugcuccug

SEQ ID NO: 3036209 - RNA, 15 nt, Human
ccagccaaagccucc

SEQ ID NO: 3036210 - RNA, 19 nt, Human
ccagccaaagccuccucca

SEQ ID NO: 3036211 - RNA, 18 nt, Human
ccagccaaagccuccucc

SEQ ID NO: 3036212 - RNA, 13 nt, Human
ccacacccagccc

SEQ ID NO: 3036213 - RNA, 14 nt, Human
ccacacccagccca

SEQ ID NO: 3036214 - RNA, 12 nt, Human
ccacacccagcc

SEQ ID NO: 3036215 - RNA, 18 nt, Human
ccaccaacauacucccau

SEQ ID NO: 3036216 - RNA, 14 nt, Human
ccaccaacauacuc

SEQ ID NO: 3036217 - RNA, 16 nt, Human
ccacaucuugcucugc

SEQ ID NO: 3036218 - RNA, 20 nt, Human
ccacaucuugcucugcugac

SEQ ID NO: 3036219 - RNA, 22 nt, Human
ccacaucuugcucugcugacag

SEQ ID NO: 3036220 - RNA, 23 nt, Human
ccacaucuugcucugcugacaga

SEQ ID NO: 3036221 - RNA, 14 nt, Human
ccacaucuugcucu

SEQ ID NO: 3036222 - RNA, 14 nt, Human
ccaccacacccagc

SEQ ID NO: 3036223 - RNA, 16 nt, Human
ccaccacacccagccc

SEQ ID NO: 3036224 - RNA, 20 nt, Human
ccaccaacauacucccaucu

SEQ ID NO: 3036225 - RNA, 16 nt, Human
ccacccaagggccugg

SEQ ID NO: 3036226 - RNA, 19 nt, Human
ccacccaagggccuggccu

SEQ ID NO: 3036227 - RNA, 17 nt, Human
ccacccaagggccuggc

SEQ ID NO: 3036228 - RNA, 16 nt, Human
ccacccaccucagccu

SEQ ID NO: 3036229 - RNA, 14 nt, Human
ccacccaccucagc

SEQ ID NO: 3036230 - RNA, 15 nt, Human
ccacccaccucagcc

SEQ ID NO: 3036231 - RNA, 13 nt, Human
ccacccaccucag

SEQ ID NO: 3036232 - RNA, 22 nt, Human
ccacccaagggccuggccugag

SEQ ID NO: 3036233 - RNA, 21 nt, Human
ccacccaagggccuggccuga

SEQ ID NO: 3036234 - RNA, 20 nt, Human
ccacccaagggccuggccug

SEQ ID NO: 3036235 - RNA, 13 nt, Human
ccacguuucuaaa

SEQ ID NO: 3036236 - RNA, 18 nt, Human
ccacugcacuccagccug

SEQ ID NO: 3036237 - RNA, 15 nt, Human
ccacucccugcaacc

SEQ ID NO: 3036238 - RNA, 19 nt, Human
ccacugcacuccagccugg

SEQ ID NO: 3036239 - RNA, 20 nt, Human
ccacugcacuccagccuggg

SEQ ID NO: 3036240 - RNA, 16 nt, Human
ccacugcgaccacaag

SEQ ID NO: 3036241 - RNA, 18 nt, Human
ccacucaguccauagcag

SEQ ID NO: 3036242 - RNA, 13 nt, Human
ccacucccugcaa

SEQ ID NO: 3036243 - RNA, 12 nt, Human
ccacucccugca

SEQ ID NO: 3036244 - RNA, 23 nt, Human
ccacuacggaauaguuggcuagg

SEQ ID NO: 3036245 - RNA, 22 nt, Human
ccacuacggaauaguuggcuag

SEQ ID NO: 3036246 - RNA, 18 nt, Human
ccacuacauucuguuaau

SEQ ID NO: 3036247 - RNA, 12 nt, Human
ccaccucagccu

SEQ ID NO: 3036248 - RNA, 17 nt, Human
ccacccugaaagcccug

SEQ ID NO: 3036249 - RNA, 16 nt, Human
ccacccugaaagcccu

SEQ ID NO: 3036250 - RNA, 13 nt, Human
ccaccucagccuc

SEQ ID NO: 3036251 - RNA, 14 nt, Human
ccaccucagccucc

SEQ ID NO: 3036252 - RNA, 15 nt, Human
ccaccucagccuccc

SEQ ID NO: 3036253 - RNA, 12 nt, Human
ccacccaggagc

SEQ ID NO: 3036254 - RNA, 14 nt, Human
ccacccaggagccc

SEQ ID NO: 3036255 - RNA, 15 nt, Human
ccacggccaggccag

SEQ ID NO: 3036256 - RNA, 12 nt, Human
ccacggccaggc

SEQ ID NO: 3036257 - RNA, 13 nt, Human
ccacggccaggcc

SEQ ID NO: 3036258 - RNA, 14 nt, Human
ccacggccaggcca

SEQ ID NO: 3036259 - RNA, 16 nt, Human
ccaccuggccucugca

SEQ ID NO: 3036260 - RNA, 15 nt, Human
ccaccuggccucugc

SEQ ID NO: 3036261 - RNA, 22 nt, Human
ccaccugcggugcuaucucccc

SEQ ID NO: 3036262 - RNA, 14 nt, Human
ccaccuggccucug

SEQ ID NO: 3036263 - RNA, 17 nt, Human
ccaccuggccucugcac

SEQ ID NO: 3036264 - RNA, 16 nt, Human
ccaccugccagggaca

SEQ ID NO: 3036265 - RNA, 20 nt, Human
ccaccugccuguugggccag

SEQ ID NO: 3036266 - RNA, 17 nt, Human
ccaccugccuguugggc

SEQ ID NO: 3036267 - RNA, 17 nt, Human
ccaccucccacaaagga

SEQ ID NO: 3036268 - RNA, 21 nt, Human
cauauugcauacuauuaaaca

SEQ ID NO: 3036269 - RNA, 19 nt, Human
cauauugcauacuauuaaa

SEQ ID NO: 3036270 - RNA, 21 nt, Human
cauauugauuuccguuaaaau

SEQ ID NO: 3036271 - RNA, 22 nt, Human
cauauugcauacuauuaaacau

SEQ ID NO: 3036272 - RNA, 22 nt, Human
cauauucuguuggccaguguga

SEQ ID NO: 3036273 - RNA, 17 nt, Human
cauauugauuuccguua

SEQ ID NO: 3036274 - RNA, 17 nt, Human
cauauuuaauuugaagg

SEQ ID NO: 3036275 - RNA, 23 nt, Human
cauauauauguuuuaagaggcag

SEQ ID NO: 3036276 - RNA, 23 nt, Human
cauauaagauucauauuuacuuc

SEQ ID NO: 3036277 - RNA, 16 nt, Human
cauaguaugguggcug

SEQ ID NO: 3036278 - RNA, 15 nt, Human
cauaguaugguggcu

SEQ ID NO: 3036279 - RNA, 14 nt, Human
caucaacaucuugg

SEQ ID NO: 3036280 - RNA, 14 nt, Human
caucccuuucccuu

SEQ ID NO: 3036281 - RNA, 17 nt, Human
caucccuuucccuuggu

SEQ ID NO: 3036282 - RNA, 22 nt, Human
caucccugaaggccccgcccag

SEQ ID NO: 3036283 - RNA, 15 nt, Human
caucccucuggggcu

SEQ ID NO: 3036284 - RNA, 14 nt, Human
cauccacugugcca

SEQ ID NO: 3036285 - RNA, 17 nt, Human
cauccacugugccaugu

SEQ ID NO: 3036286 - RNA, 23 nt, Human
cauccacugugccaugugccagg

SEQ ID NO: 3036287 - RNA, 17 nt, Human
cauccagguucagcuug

SEQ ID NO: 3036288 - RNA, 11 nt, Human
caucaucccuu

SEQ ID NO: 3036289 - RNA, 16 nt, Human
caucauccuaagcuau

SEQ ID NO: 3036290 - RNA, 13 nt, Human
caucaugucuggc

SEQ ID NO: 3036291 - RNA, 14 nt, Human
caucaugucuggcu

SEQ ID NO: 3036292 - RNA, 15 nt, Human
caucaugucuggcua

SEQ ID NO: 3036293 - RNA, 12 nt, Human
caucacccgcua

SEQ ID NO: 3036294 - RNA, 20 nt, Human
caucaccaacgucugugcca

SEQ ID NO: 3036295 - RNA, 13 nt, Human
caugagcaucagg

SEQ ID NO: 3036296 - RNA, 12 nt, Human
caugagccucag

SEQ ID NO: 3036297 - RNA, 15 nt, Human
caugagccucagcau

SEQ ID NO: 3036298 - RNA, 17 nt, Human
caugagccucagcaucc

SEQ ID NO: 3036299 - RNA, 18 nt, Human
caugagccucagcauccu

SEQ ID NO: 3036300 - RNA, 19 nt, Human
caugagccucagcauccug

SEQ ID NO: 3036301 - RNA, 20 nt, Human
caugagccucagcauccugg

SEQ ID NO: 3036302 - RNA, 21 nt, Human
caugagccucagcauccuggc

SEQ ID NO: 3036303 - RNA, 23 nt, Human
caugagcaucaggccaggcccuc

SEQ ID NO: 3036304 - RNA, 22 nt, Human
caugagcaucaggccaggcccu

SEQ ID NO: 3036305 - RNA, 21 nt, Human
caugagcaucaggccaggccc

SEQ ID NO: 3036306 - RNA, 20 nt, Human
caugagcaucaggccaggcc

SEQ ID NO: 3036307 - RNA, 18 nt, Human
caugagcaucaggccagg

SEQ ID NO: 3036308 - RNA, 17 nt, Human
caugagcaucaggccag

SEQ ID NO: 3036309 - RNA, 16 nt, Human
caugagcaucaggcca

SEQ ID NO: 3036310 - RNA, 15 nt, Human
caugagcaucaggcc

SEQ ID NO: 3036311 - RNA, 23 nt, Human
caugaguccccuguuuguuucug

SEQ ID NO: 3036312 - RNA, 15 nt, Human
caugaguccccuguu

SEQ ID NO: 3036313 - RNA, 14 nt, Human
caugaguccccugu

SEQ ID NO: 3036314 - RNA, 13 nt, Human
caugaguccccug

SEQ ID NO: 3036315 - RNA, 22 nt, Human
caugagccucagcauccuggca

SEQ ID NO: 3036316 - RNA, 23 nt, Human
caugagccucagcauccuggcac

SEQ ID NO: 3036317 - RNA, 21 nt, Human
caugaggaacaaggcaaggcu

SEQ ID NO: 3036318 - RNA, 20 nt, Human
caugaggaacaaggcaaggc

SEQ ID NO: 3036319 - RNA, 17 nt, Human
caugaggaacaaggcaa

SEQ ID NO: 3036320 - RNA, 16 nt, Human
caugaggaacaaggca

SEQ ID NO: 3036321 - RNA, 23 nt, Human
caugaggaacaaggcaaggcugu

SEQ ID NO: 3036322 - RNA, 13 nt, Human
caugaaaacacau

SEQ ID NO: 3036323 - RNA, 14 nt, Human
caugaaaacacauu

SEQ ID NO: 3036324 - RNA, 15 nt, Human
caugaaaacacauuu

SEQ ID NO: 3036325 - RNA, 16 nt, Human
caugaaaacacauuuu

SEQ ID NO: 3036326 - RNA, 17 nt, Human
caugaaaacacauuuuu

SEQ ID NO: 3036327 - RNA, 12 nt, Human
caugaagacaga

SEQ ID NO: 3036328 - RNA, 19 nt, Human
caugaaaacacauuuuucu

SEQ ID NO: 3036329 - RNA, 21 nt, Human
caugaaaacacauuuuucuua

SEQ ID NO: 3036330 - RNA, 16 nt, Human
caucucuacaaaaagc

SEQ ID NO: 3036331 - RNA, 15 nt, Human
caucucuccuccuuu

SEQ ID NO: 3036332 - RNA, 21 nt, Human
caucuugaauuguaaggaaug

SEQ ID NO: 3036333 - RNA, 16 nt, Human
caucuugaauuguaag

SEQ ID NO: 3036334 - RNA, 15 nt, Human
caucuugcucugcug

SEQ ID NO: 3036335 - RNA, 19 nt, Human
caucuugcucugcugacag

SEQ ID NO: 3036336 - RNA, 16 nt, Human
caucuugcucugcuga

SEQ ID NO: 3036337 - RNA, 17 nt, Human
caucuugcucugcugac

SEQ ID NO: 3036338 - RNA, 13 nt, Human
caugcuguacaua

SEQ ID NO: 3036339 - RNA, 21 nt, Human
caugcuguacauacuuuuugg

SEQ ID NO: 3036340 - RNA, 19 nt, Human
caugcuguacauacuuuuu

SEQ ID NO: 3036341 - RNA, 16 nt, Human
caugcuguacauacuu

SEQ ID NO: 3036342 - RNA, 15 nt, Human
caugcugucccuuac

SEQ ID NO: 3036343 - RNA, 13 nt, Human
caugcugucccuu

SEQ ID NO: 3036344 - RNA, 15 nt, Human
cauggacuuccacug

SEQ ID NO: 3036345 - RNA, 18 nt, Human
caugggccuccugugugu

SEQ ID NO: 3036346 - RNA, 22 nt, Human
caugugccagguuuuuggucug

SEQ ID NO: 3036347 - RNA, 14 nt, Human
caugugcacaugca

SEQ ID NO: 3036348 - RNA, 15 nt, Human
caugugaugagagga

SEQ ID NO: 3036349 - RNA, 17 nt, Human
caugugaugagaggaaa

SEQ ID NO: 3036350 - RNA, 16 nt, Human
caugugaugagaggaa

SEQ ID NO: 3036351 - RNA, 20 nt, Human
caugugaugagaggaaauca

SEQ ID NO: 3036352 - RNA, 18 nt, Human
caugugaugagaggaaau

SEQ ID NO: 3036353 - RNA, 21 nt, Human
caugugaugagaggaaaucac

SEQ ID NO: 3036354 - RNA, 12 nt, Human
caugucuggcua

SEQ ID NO: 3036355 - RNA, 23 nt, Human
cauggucggaaaacaugcuacac

SEQ ID NO: 3036356 - RNA, 17 nt, Human
cauggucggaaaacaug

SEQ ID NO: 3036357 - RNA, 19 nt, Human
cauggucggaaaacaugcu

SEQ ID NO: 3036358 - RNA, 12 nt, Human
cauguuugugau

SEQ ID NO: 3036359 - RNA, 14 nt, Human
cauguuugugauug

SEQ ID NO: 3036360 - RNA, 19 nt, Human
cauguuuuucuucucccuc

SEQ ID NO: 3036361 - RNA, 20 nt, Human
cauguuuuucuucucccuca

SEQ ID NO: 3036362 - RNA, 14 nt, Human
cauucuuuuugaaa

SEQ ID NO: 3036363 - RNA, 16 nt, Human
cauucuuuuugaaaug

SEQ ID NO: 3036364 - RNA, 13 nt, Human
cauucuuuuugaa

SEQ ID NO: 3036365 - RNA, 18 nt, Human
cauugaccugaggcccuu

SEQ ID NO: 3036366 - RNA, 14 nt, Human
cauugaccugaggc

SEQ ID NO: 3036367 - RNA, 17 nt, Human
cauugaccugaggcccu

SEQ ID NO: 3036368 - RNA, 15 nt, Human
cauugaccugaggcc

SEQ ID NO: 3036369 - RNA, 15 nt, Human
cauuuaaaaaaaauc

SEQ ID NO: 3036370 - RNA, 13 nt, Human
cauugugggaagg

SEQ ID NO: 3036371 - RNA, 15 nt, Human
cauugugggaagggg

SEQ ID NO: 3036372 - RNA, 17 nt, Human
cauuugaaaauuuugau

SEQ ID NO: 3036373 - RNA, 19 nt, Human
cauuugaaaauuuugaugu

SEQ ID NO: 3036374 - RNA, 22 nt, Human
cauuugaggucuguucuuucca

SEQ ID NO: 3036375 - RNA, 13 nt, Human
cauuugcugaaua

SEQ ID NO: 3036376 - RNA, 22 nt, Human
cauuuuauuuuauuaugcauga

SEQ ID NO: 3036377 - RNA, 23 nt, Human
cauuuuauuuuauuaugcaugaa

SEQ ID NO: 3036378 - RNA, 17 nt, Human
cauuuuuaguagagaca

SEQ ID NO: 3036379 - RNA, 21 nt, Human
cauuuuuaagugcugcauuua

SEQ ID NO: 3036380 - RNA, 13 nt, Human
cauucuuggccca

SEQ ID NO: 3036381 - RNA, 16 nt, Human
cauucuuggcccagga

SEQ ID NO: 3036382 - RNA, 23 nt, Human
cauucuucuguacgucugacagg

SEQ ID NO: 3036383 - RNA, 17 nt, Human
cauucuguuaaucauua

SEQ ID NO: 3036384 - RNA, 12 nt, Human
cauucugccugc

SEQ ID NO: 3036385 - RNA, 13 nt, Human
cauucugccugcc

SEQ ID NO: 3036386 - RNA, 15 nt, Human
cauucugccugccca

SEQ ID NO: 3036387 - RNA, 16 nt, Human
cauucugccugcccag

SEQ ID NO: 3036388 - RNA, 17 nt, Human
cauucugccugcccagg

SEQ ID NO: 3036389 - RNA, 18 nt, Human
cauucugccugcccaggc

SEQ ID NO: 3036390 - RNA, 19 nt, Human
cauucugccugcccaggcc

SEQ ID NO: 3036391 - RNA, 20 nt, Human
cauucugccugcccaggccc

SEQ ID NO: 3036392 - RNA, 23 nt, Human
cauuccugaugcuucuucagaga

SEQ ID NO: 3036393 - RNA, 22 nt, Human
cauuccugaugcuucuucagag

SEQ ID NO: 3036394 - RNA, 19 nt, Human
cauuccugaugcuucuuca

SEQ ID NO: 3036395 - RNA, 16 nt, Human
cauuccugaugcuucu

SEQ ID NO: 3036396 - RNA, 14 nt, Human
cauuccugaugcuu

SEQ ID NO: 3036397 - RNA, 13 nt, Human
cauuccccaggag

SEQ ID NO: 3036398 - RNA, 17 nt, Human
cauuccccaggaggcca

SEQ ID NO: 3036399 - RNA, 15 nt, Human
cauuccccaggaggc

SEQ ID NO: 3036400 - RNA, 20 nt, Human
cauuccccaggaggccagcc

SEQ ID NO: 3036401 - RNA, 19 nt, Human
cauuccccaggaggccagc

SEQ ID NO: 3036402 - RNA, 18 nt, Human
cauuccccaggaggccag

SEQ ID NO: 3036403 - RNA, 18 nt, Human
caguacuaacauuuauuu

SEQ ID NO: 3036404 - RNA, 21 nt, Human
caguaaugagcuuaagaaauu

SEQ ID NO: 3036405 - RNA, 12 nt, Human
caguaauaacuc

SEQ ID NO: 3036406 - RNA, 13 nt, Human
caguaauaacucu

SEQ ID NO: 3036407 - RNA, 13 nt, Human
caguaacauagcu

SEQ ID NO: 3036408 - RNA, 22 nt, Human
caguaaaugggggugcauuuga

SEQ ID NO: 3036409 - RNA, 20 nt, Human
caguaaaugggggugcauuu

SEQ ID NO: 3036410 - RNA, 21 nt, Human
caguaaaugggggugcauuug

SEQ ID NO: 3036411 - RNA, 13 nt, Human
cagguucagcuug

SEQ ID NO: 3036412 - RNA, 12 nt, Human
cagguucagcuu

SEQ ID NO: 3036413 - RNA, 22 nt, Human
caggugugagucaccaagccca

SEQ ID NO: 3036414 - RNA, 23 nt, Human
caggugugagucaccaagcccag

SEQ ID NO: 3036415 - RNA, 16 nt, Human
caggugugaaccacca

SEQ ID NO: 3036416 - RNA, 19 nt, Human
caggugugaaccaccacac

SEQ ID NO: 3036417 - RNA, 22 nt, Human
caggugugaaccaccacaccca

SEQ ID NO: 3036418 - RNA, 23 nt, Human
caggugugaaccaccacacccag

SEQ ID NO: 3036419 - RNA, 20 nt, Human
caggugugagucaccaagcc

SEQ ID NO: 3036420 - RNA, 21 nt, Human
caggugugagucaccaagccc

SEQ ID NO: 3036421 - RNA, 16 nt, Human
caggugugagucacca

SEQ ID NO: 3036422 - RNA, 15 nt, Human
caggugucccugcac

SEQ ID NO: 3036423 - RNA, 16 nt, Human
caggugucccugcacu

SEQ ID NO: 3036424 - RNA, 18 nt, Human
caggugucccugcacuug

SEQ ID NO: 3036425 - RNA, 19 nt, Human
caggugucccugcacuugc

SEQ ID NO: 3036426 - RNA, 12 nt, Human
caggugugaacc

SEQ ID NO: 3036427 - RNA, 20 nt, Human
caggugguuauggagagggu

SEQ ID NO: 3036428 - RNA, 11 nt, Human
caggugucccu

SEQ ID NO: 3036429 - RNA, 14 nt, Human
caggugucccugca

SEQ ID NO: 3036430 - RNA, 18 nt, Human
caggugguuauggagagg

SEQ ID NO: 3036431 - RNA, 23 nt, Human
cagguggggucacucuggcagcu

SEQ ID NO: 3036432 - RNA, 22 nt, Human
cagguggggucacucuggcagc

SEQ ID NO: 3036433 - RNA, 21 nt, Human
cagguggggucacucuggcag

SEQ ID NO: 3036434 - RNA, 20 nt, Human
cagguggggucacucuggca

SEQ ID NO: 3036435 - RNA, 19 nt, Human
cagguggggucacucuggc

SEQ ID NO: 3036436 - RNA, 13 nt, Human
cagguggggcagc

SEQ ID NO: 3036437 - RNA, 14 nt, Human
cagguggggcagcu

SEQ ID NO: 3036438 - RNA, 15 nt, Human
cagguggggcagcuu

SEQ ID NO: 3036439 - RNA, 16 nt, Human
cagguggggcagcuug

SEQ ID NO: 3036440 - RNA, 17 nt, Human
cagguggggcagcuuga

SEQ ID NO: 3036441 - RNA, 18 nt, Human
cagguggggucacucugg

SEQ ID NO: 3036442 - RNA, 20 nt, Human
cagguaacaggcagauacag

SEQ ID NO: 3036443 - RNA, 21 nt, Human
cagguaacaggcagauacagg

SEQ ID NO: 3036444 - RNA, 21 nt, Human
caggugagaagcagaggaagg

SEQ ID NO: 3036445 - RNA, 20 nt, Human
caggugagaagcagaggaag

SEQ ID NO: 3036446 - RNA, 13 nt, Human
caggugagaagca

SEQ ID NO: 3036447 - RNA, 18 nt, Human
caggucuugaacuccugg

SEQ ID NO: 3036448 - RNA, 19 nt, Human
caggucuugaacuccuggc

SEQ ID NO: 3036449 - RNA, 20 nt, Human
caggucuugaacuccuggcc

SEQ ID NO: 3036450 - RNA, 21 nt, Human
caggucuugaacuccuggccu

SEQ ID NO: 3036451 - RNA, 22 nt, Human
caggucuugaacuccuggccuc

SEQ ID NO: 3036452 - RNA, 23 nt, Human
caggucuugaacuccuggccuca

SEQ ID NO: 3036453 - RNA, 21 nt, Human
caggggugggacacccuguga

SEQ ID NO: 3036454 - RNA, 20 nt, Human
caggggugggacacccugug

SEQ ID NO: 3036455 - RNA, 15 nt, Human
caggggugggacacc

SEQ ID NO: 3036456 - RNA, 14 nt, Human
caggggugggacac

SEQ ID NO: 3036457 - RNA, 21 nt, Human
caggguauuccagagugggga

SEQ ID NO: 3036458 - RNA, 20 nt, Human
caggguauuccagagugggg

SEQ ID NO: 3036459 - RNA, 12 nt, Human
cagggucccugg

SEQ ID NO: 3036460 - RNA, 14 nt, Human
cagggucccuggug

SEQ ID NO: 3036461 - RNA, 22 nt, Human
cagggucccugguggcagcuca

SEQ ID NO: 3036462 - RNA, 19 nt, Human
cagggucccugguggcagc

SEQ ID NO: 3036463 - RNA, 18 nt, Human
cagggucccugguggcag

SEQ ID NO: 3036464 - RNA, 15 nt, Human
cagggucccuggugg

SEQ ID NO: 3036465 - RNA, 14 nt, Human
cagguaacaggcag

SEQ ID NO: 3036466 - RNA, 15 nt, Human
cagguaacaggcaga

SEQ ID NO: 3036467 - RNA, 16 nt, Human
cagguaacaggcagau

SEQ ID NO: 3036468 - RNA, 17 nt, Human
cagguaacaggcagaua

SEQ ID NO: 3036469 - RNA, 16 nt, Human
caggguuuugccaugu

SEQ ID NO: 3036470 - RNA, 16 nt, Human
cagggucucacucugu

SEQ ID NO: 3036471 - RNA, 21 nt, Human
cagggucucacuauguugccc

SEQ ID NO: 3036472 - RNA, 22 nt, Human
cagggucucacuauguugccca

SEQ ID NO: 3036473 - RNA, 23 nt, Human
cagggucucacuauguugcccag

SEQ ID NO: 3036474 - RNA, 15 nt, Human
cagggucucacucug

SEQ ID NO: 3036475 - RNA, 18 nt, Human
caggguccuguagcccua

SEQ ID NO: 3036476 - RNA, 23 nt, Human
cagggucccugguggcagcucac

SEQ ID NO: 3036477 - RNA, 23 nt, Human
cagucagggaaggugccucugga

SEQ ID NO: 3036478 - RNA, 18 nt, Human
caguauuacuucugcuac

SEQ ID NO: 3036479 - RNA, 16 nt, Human
caguauuacuucugcu

SEQ ID NO: 3036480 - RNA, 19 nt, Human
cagucauuauguuaauauu

SEQ ID NO: 3036481 - RNA, 16 nt, Human
caguccauagcagaga

SEQ ID NO: 3036482 - RNA, 14 nt, Human
caguccauugaaag

SEQ ID NO: 3036483 - RNA, 13 nt, Human
caguaucucaggg

SEQ ID NO: 3036484 - RNA, 21 nt, Human
caguaucuugaagacuuuucu

SEQ ID NO: 3036485 - RNA, 18 nt, Human
caguaucuugaagacuuu

SEQ ID NO: 3036486 - RNA, 12 nt, Human
caguaucuugaa

SEQ ID NO: 3036487 - RNA, 15 nt, Human
caguaucucagggcc

SEQ ID NO: 3036488 - RNA, 17 nt, Human
cagucccugccaaugga

SEQ ID NO: 3036489 - RNA, 15 nt, Human
caguccucccaucuc

SEQ ID NO: 3036490 - RNA, 14 nt, Human
caguccucccaucu

SEQ ID NO: 3036491 - RNA, 13 nt, Human
caguccucccauc

SEQ ID NO: 3036492 - RNA, 12 nt, Human
caguccucccau

SEQ ID NO: 3036493 - RNA, 12 nt, Human
cagucccugcca

SEQ ID NO: 3036494 - RNA, 16 nt, Human
cagucccugccaaugg

SEQ ID NO: 3036495 - RNA, 15 nt, Human
cagucccugccaaug

SEQ ID NO: 3036496 - RNA, 14 nt, Human
cagucccugccaau

SEQ ID NO: 3036497 - RNA, 13 nt, Human
cagucccugccaa

SEQ ID NO: 3036498 - RNA, 17 nt, Human
caguccucccaucucac

SEQ ID NO: 3036499 - RNA, 16 nt, Human
caguccucccaucuca

SEQ ID NO: 3036500 - RNA, 18 nt, Human
cagucuggaaugcagugg

SEQ ID NO: 3036501 - RNA, 21 nt, Human
caguccuuaccagcagagcac

SEQ ID NO: 3036502 - RNA, 20 nt, Human
caguccuuaccagcagagca

SEQ ID NO: 3036503 - RNA, 19 nt, Human
caguccuuaccagcagagc

SEQ ID NO: 3036504 - RNA, 18 nt, Human
caguccuuaccagcagag

SEQ ID NO: 3036505 - RNA, 15 nt, Human
caguccuuaccagca

SEQ ID NO: 3036506 - RNA, 19 nt, Human
cagucuggaaugcaguggu

SEQ ID NO: 3036507 - RNA, 24 nt, Human
cagugagccgagauugcaccacug

SEQ ID NO: 3036508 - RNA, 12 nt, Human
cagugaggcucu

SEQ ID NO: 3036509 - RNA, 16 nt, Human
cagugaggcucugccc

SEQ ID NO: 3036510 - RNA, 15 nt, Human
cagugaggcucugcc

SEQ ID NO: 3036511 - RNA, 14 nt, Human
cagugaggcucugc

SEQ ID NO: 3036512 - RNA, 13 nt, Human
cagugaggcucug

SEQ ID NO: 3036513 - RNA, 21 nt, Human
cagugaggcucugcccuuggu

SEQ ID NO: 3036514 - RNA, 17 nt, Human
cagugagucgaggacag

SEQ ID NO: 3036515 - RNA, 18 nt, Human
cagugagucgaggacagg

SEQ ID NO: 3036516 - RNA, 20 nt, Human
cagugaggcucugcccuugg

SEQ ID NO: 3036517 - RNA, 19 nt, Human
cagugaggcucugcccuug

SEQ ID NO: 3036518 - RNA, 18 nt, Human
cagugaggcucugcccuu

SEQ ID NO: 3036519 - RNA, 17 nt, Human
cagugaggcucugcccu

SEQ ID NO: 3036520 - RNA, 13 nt, Human
cagugccuuaugg

SEQ ID NO: 3036521 - RNA, 11 nt, Human
cagugccuuau

SEQ ID NO: 3036522 - RNA, 18 nt, Human
cagugccgagaaggaagc

SEQ ID NO: 3036523 - RNA, 15 nt, Human
cagugccgagaagga

SEQ ID NO: 3036524 - RNA, 22 nt, Human
cagugccuuauggaacacucug

SEQ ID NO: 3036525 - RNA, 21 nt, Human
cagugccuuauggaacacucu

SEQ ID NO: 3036526 - RNA, 20 nt, Human
cagugccuuauggaacacuc

SEQ ID NO: 3036527 - RNA, 19 nt, Human
cagugccuuauggaacacu

SEQ ID NO: 3036528 - RNA, 18 nt, Human
cagugccuuauggaacac

SEQ ID NO: 3036529 - RNA, 17 nt, Human
cagugccuuauggaaca

SEQ ID NO: 3036530 - RNA, 16 nt, Human
cagugccuuauggaac

SEQ ID NO: 3036531 - RNA, 15 nt, Human
cagugccuuauggaa

SEQ ID NO: 3036532 - RNA, 19 nt, Human
cagugagucgaggacaggg

SEQ ID NO: 3036533 - RNA, 20 nt, Human
cagugagucgaggacaggga

SEQ ID NO: 3036534 - RNA, 22 nt, Human
cagugagucgaggacagggagg

SEQ ID NO: 3036535 - RNA, 23 nt, Human
cagugagucgaggacagggaggu

SEQ ID NO: 3036536 - RNA, 23 nt, Human
cagugccuuauggaacacucuga

SEQ ID NO: 3036537 - RNA, 15 nt, Human
caggaguuuggccag

SEQ ID NO: 3036538 - RNA, 16 nt, Human
caggaguuuggccaga

SEQ ID NO: 3036539 - RNA, 17 nt, Human
caggaguuuggccagaa

SEQ ID NO: 3036540 - RNA, 13 nt, Human
caggaguuuggcc

SEQ ID NO: 3036541 - RNA, 14 nt, Human
caggaguuuggcca

SEQ ID NO: 3036542 - RNA, 23 nt, Human
caggaguuugagaccaaccuggg

SEQ ID NO: 3036543 - RNA, 22 nt, Human
caggaguuugagaccaaccugg

SEQ ID NO: 3036544 - RNA, 21 nt, Human
caggaguuugagaccaaccug

SEQ ID NO: 3036545 - RNA, 23 nt, Human
caggagccccgaggccuucucug

SEQ ID NO: 3036546 - RNA, 20 nt, Human
caggagccccgaggccuucu

SEQ ID NO: 3036547 - RNA, 22 nt, Human
caggagccccgaggccuucucu

SEQ ID NO: 3036548 - RNA, 15 nt, Human
caggagccccgaggc

SEQ ID NO: 3036549 - RNA, 16 nt, Human
caggagccccgaggcc

SEQ ID NO: 3036550 - RNA, 18 nt, Human
caggagccccgaggccuu

SEQ ID NO: 3036551 - RNA, 19 nt, Human
caggagcagccacauuccu

SEQ ID NO: 3036552 - RNA, 14 nt, Human
caggagcagccaca

SEQ ID NO: 3036553 - RNA, 13 nt, Human
caggagcagccac

SEQ ID NO: 3036554 - RNA, 12 nt, Human
caggagcagcca

SEQ ID NO: 3036555 - RNA, 20 nt, Human
caggagccuccugcccuuac

SEQ ID NO: 3036556 - RNA, 17 nt, Human
caggagccuccugcccu

SEQ ID NO: 3036557 - RNA, 14 nt, Human
caggagccuccugc

SEQ ID NO: 3036558 - RNA, 12 nt, Human
caggagugagca

SEQ ID NO: 3036559 - RNA, 14 nt, Human
caggaucagucuga

SEQ ID NO: 3036560 - RNA, 13 nt, Human
caggaucagucug

SEQ ID NO: 3036561 - RNA, 23 nt, Human
caggauggccgggcgcgguggcu

SEQ ID NO: 3036562 - RNA, 17 nt, Human
caggauucuuccucccu

SEQ ID NO: 3036563 - RNA, 18 nt, Human
caggauucuuccucccuc

SEQ ID NO: 3036564 - RNA, 17 nt, Human
caggcaugguggcccac

SEQ ID NO: 3036565 - RNA, 23 nt, Human
caggcaggucuugaacuccuggc

SEQ ID NO: 3036566 - RNA, 15 nt, Human
caggcaggugggaug

SEQ ID NO: 3036567 - RNA, 13 nt, Human
caggcaggucuug

SEQ ID NO: 3036568 - RNA, 22 nt, Human
caggcaggucuugaacuccugg

SEQ ID NO: 3036569 - RNA, 14 nt, Human
caggcagguccagg

SEQ ID NO: 3036570 - RNA, 15 nt, Human
caggcagguccaggg

SEQ ID NO: 3036571 - RNA, 19 nt, Human
caggcagguccaggguuug

SEQ ID NO: 3036572 - RNA, 12 nt, Human
caggcaggucuu

SEQ ID NO: 3036573 - RNA, 24 nt, Human
caggcauuccccaggaggccagcc

SEQ ID NO: 3036574 - RNA, 23 nt, Human
caggcauuccccaggaggccagc

SEQ ID NO: 3036575 - RNA, 22 nt, Human
caggcauuccccaggaggccag

SEQ ID NO: 3036576 - RNA, 21 nt, Human
caggcauuccccaggaggcca

SEQ ID NO: 3036577 - RNA, 20 nt, Human
caggcauuccccaggaggcc

SEQ ID NO: 3036578 - RNA, 19 nt, Human
caggcauuccccaggaggc

SEQ ID NO: 3036579 - RNA, 18 nt, Human
caggcauuccccaggagg

SEQ ID NO: 3036580 - RNA, 15 nt, Human
caggcauguucucug

SEQ ID NO: 3036581 - RNA, 18 nt, Human
caggcauguucucugagg

SEQ ID NO: 3036582 - RNA, 19 nt, Human
caggcauguucucugagga

SEQ ID NO: 3036583 - RNA, 20 nt, Human
caggcauguucucugaggac

SEQ ID NO: 3036584 - RNA, 17 nt, Human
caggcauuccccaggag

SEQ ID NO: 3036585 - RNA, 16 nt, Human
caggcauuccccagga

SEQ ID NO: 3036586 - RNA, 15 nt, Human
caggcauuccccagg

SEQ ID NO: 3036587 - RNA, 13 nt, Human
caggcauucccca

SEQ ID NO: 3036588 - RNA, 17 nt, Human
caggcagccaggccaca

SEQ ID NO: 3036589 - RNA, 16 nt, Human
caggcagccaggccac

SEQ ID NO: 3036590 - RNA, 13 nt, Human
caggcagguccag

SEQ ID NO: 3036591 - RNA, 14 nt, Human
caggcaagcaccuc

SEQ ID NO: 3036592 - RNA, 15 nt, Human
caggcaagcaccucc

SEQ ID NO: 3036593 - RNA, 16 nt, Human
caggcaagcaccuccu

SEQ ID NO: 3036594 - RNA, 21 nt, Human
caggcaagcaccuccugccuc

SEQ ID NO: 3036595 - RNA, 15 nt, Human
caggcagccaggcca

SEQ ID NO: 3036596 - RNA, 14 nt, Human
caggcagccaggcc

SEQ ID NO: 3036597 - RNA, 20 nt, Human
caggauucuuccucccuccc

SEQ ID NO: 3036598 - RNA, 13 nt, Human
caggcccggcucc

SEQ ID NO: 3036599 - RNA, 14 nt, Human
caggcccggcucca

SEQ ID NO: 3036600 - RNA, 15 nt, Human
caggcccggcuccag

SEQ ID NO: 3036601 - RNA, 15 nt, Human
caggccccugccacc

SEQ ID NO: 3036602 - RNA, 17 nt, Human
caggccccugccacccu

SEQ ID NO: 3036603 - RNA, 19 nt, Human
caggccccugccacccugg

SEQ ID NO: 3036604 - RNA, 20 nt, Human
caggccccugccacccuggg

SEQ ID NO: 3036605 - RNA, 23 nt, Human
caggccaaacucaccugccccuc

SEQ ID NO: 3036606 - RNA, 18 nt, Human
caggccaaacucaccugc

SEQ ID NO: 3036607 - RNA, 13 nt, Human
caggccacaagac

SEQ ID NO: 3036608 - RNA, 18 nt, Human
caggccacaagacccuug

SEQ ID NO: 3036609 - RNA, 17 nt, Human
caggccacaagacccuu

SEQ ID NO: 3036610 - RNA, 20 nt, Human
caggccacaagacccuugug

SEQ ID NO: 3036611 - RNA, 22 nt, Human
caggccaggcccucugcccacu

SEQ ID NO: 3036612 - RNA, 21 nt, Human
caggccaggcccucugcccac

SEQ ID NO: 3036613 - RNA, 20 nt, Human
caggccaggcccucugccca

SEQ ID NO: 3036614 - RNA, 13 nt, Human
caggccccugcca

SEQ ID NO: 3036615 - RNA, 13 nt, Human
caggcuggaguua

SEQ ID NO: 3036616 - RNA, 16 nt, Human
caggcuggaguuauug

SEQ ID NO: 3036617 - RNA, 23 nt, Human
caggcugggcuucaguggcagcu

SEQ ID NO: 3036618 - RNA, 23 nt, Human
caggcuuagucacugagacagcc

SEQ ID NO: 3036619 - RNA, 22 nt, Human
caggcuuagucacugagacagc

SEQ ID NO: 3036620 - RNA, 12 nt, Human
caggcuggucuc

SEQ ID NO: 3036621 - RNA, 19 nt, Human
caggcuggucucaaacucu

SEQ ID NO: 3036622 - RNA, 14 nt, Human
caggcuguauccca

SEQ ID NO: 3036623 - RNA, 20 nt, Human
caggcuguaucccaugagcc

SEQ ID NO: 3036624 - RNA, 21 nt, Human
caggcuguaucccaugagccu

SEQ ID NO: 3036625 - RNA, 22 nt, Human
caggcuguaucccaugagccuc

SEQ ID NO: 3036626 - RNA, 23 nt, Human
caggcuguaucccaugagccuca

SEQ ID NO: 3036627 - RNA, 21 nt, Human
caggcuuagucacugagacag

SEQ ID NO: 3036628 - RNA, 20 nt, Human
caggcuuagucacugagaca

SEQ ID NO: 3036629 - RNA, 17 nt, Human
caggcuuagucacugag

SEQ ID NO: 3036630 - RNA, 16 nt, Human
caggcuuagucacuga

SEQ ID NO: 3036631 - RNA, 22 nt, Human
caggcccucugcccacucccug

SEQ ID NO: 3036632 - RNA, 21 nt, Human
caggcccucugcccacucccu

SEQ ID NO: 3036633 - RNA, 20 nt, Human
caggcccucugcccacuccc

SEQ ID NO: 3036634 - RNA, 19 nt, Human
caggcccucugcccacucc

SEQ ID NO: 3036635 - RNA, 17 nt, Human
caggcccucugcccacu

SEQ ID NO: 3036636 - RNA, 16 nt, Human
caggcccucugcccac

SEQ ID NO: 3036637 - RNA, 22 nt, Human
caggcccggcuccaggcuccuu

SEQ ID NO: 3036638 - RNA, 20 nt, Human
caggcccggcuccaggcucc

SEQ ID NO: 3036639 - RNA, 21 nt, Human
caggcccggcuccaggcuccu

SEQ ID NO: 3036640 - RNA, 15 nt, Human
caggcccucugccca

SEQ ID NO: 3036641 - RNA, 14 nt, Human
caggcccucugccc

SEQ ID NO: 3036642 - RNA, 13 nt, Human
caggcccucugcc

SEQ ID NO: 3036643 - RNA, 17 nt, Human
caggcccggcuccaggc

SEQ ID NO: 3036644 - RNA, 16 nt, Human
caggcccggcuccagg

SEQ ID NO: 3036645 - RNA, 18 nt, Human
caggcccggcuccaggcu

SEQ ID NO: 3036646 - RNA, 19 nt, Human
caggcccggcuccaggcuc

SEQ ID NO: 3036647 - RNA, 23 nt, Human
caggcucucaggccagcugcuug

SEQ ID NO: 3036648 - RNA, 21 nt, Human
caggcucucaggccagcugcu

SEQ ID NO: 3036649 - RNA, 20 nt, Human
caggcucucaggccagcugc

SEQ ID NO: 3036650 - RNA, 19 nt, Human
caggcucucaggccagcug

SEQ ID NO: 3036651 - RNA, 18 nt, Human
caggcucucaggccagcu

SEQ ID NO: 3036652 - RNA, 17 nt, Human
caggcucucaggccagc

SEQ ID NO: 3036653 - RNA, 21 nt, Human
caggcuccuuuagcgcccagu

SEQ ID NO: 3036654 - RNA, 12 nt, Human
caggcucucagg

SEQ ID NO: 3036655 - RNA, 20 nt, Human
caggcucgggcuccccagcc

SEQ ID NO: 3036656 - RNA, 16 nt, Human
caggcucucaggccag

SEQ ID NO: 3036657 - RNA, 15 nt, Human
caggcucucaggcca

SEQ ID NO: 3036658 - RNA, 14 nt, Human
caggcucucaggcc

SEQ ID NO: 3036659 - RNA, 13 nt, Human
caggcucucaggc

SEQ ID NO: 3036660 - RNA, 14 nt, Human
caggcuccuuuagc

SEQ ID NO: 3036661 - RNA, 19 nt, Human
caggcuccuuuagcgccca

SEQ ID NO: 3036662 - RNA, 20 nt, Human
caggcuccuuuagcgcccag

SEQ ID NO: 3036663 - RNA, 22 nt, Human
cagggcacaccgggcacucaga

SEQ ID NO: 3036664 - RNA, 23 nt, Human
cagggcacaccgggcacucagaa

SEQ ID NO: 3036665 - RNA, 15 nt, Human
cagggcacaccgggc

SEQ ID NO: 3036666 - RNA, 17 nt, Human
cagggcacaccgggcac

SEQ ID NO: 3036667 - RNA, 19 nt, Human
cagggcacaccgggcacuc

SEQ ID NO: 3036668 - RNA, 21 nt, Human
cagggcacaccgggcacucag

SEQ ID NO: 3036669 - RNA, 14 nt, Human
cagggcacaccggg

SEQ ID NO: 3036670 - RNA, 23 nt, Human
cagggacagaggggguggccucc

SEQ ID NO: 3036671 - RNA, 19 nt, Human
caggggaggguagagcgga

SEQ ID NO: 3036672 - RNA, 19 nt, Human
cagggccuggcucaggugg

SEQ ID NO: 3036673 - RNA, 16 nt, Human
cagggccuggcucagg

SEQ ID NO: 3036674 - RNA, 13 nt, Human
cagggccuggcuc

SEQ ID NO: 3036675 - RNA, 15 nt, Human
cagggccuggcucag

SEQ ID NO: 3036676 - RNA, 14 nt, Human
cagggccuggcuca

SEQ ID NO: 3036677 - RNA, 13 nt, Human
cagggacagaggg

SEQ ID NO: 3036678 - RNA, 20 nt, Human
cagggacagaggggguggcc

SEQ ID NO: 3036679 - RNA, 14 nt, Human
cagggacagagggg

SEQ ID NO: 3036680 - RNA, 16 nt, Human
cagggaaacagcuaau

SEQ ID NO: 3036681 - RNA, 22 nt, Human
cagggaaacagcuaaugggaca

SEQ ID NO: 3036682 - RNA, 19 nt, Human
cagcacaaggaaauaaaau

SEQ ID NO: 3036683 - RNA, 22 nt, Human
cagcaauaaagcagcguuucua

SEQ ID NO: 3036684 - RNA, 19 nt, Human
cagcaagugagagcugggu

SEQ ID NO: 3036685 - RNA, 21 nt, Human
cagcaagugagagcugggugu

SEQ ID NO: 3036686 - RNA, 13 nt, Human
cagcaauaaagca

SEQ ID NO: 3036687 - RNA, 21 nt, Human
cagcaauaaagcagcguuucu

SEQ ID NO: 3036688 - RNA, 17 nt, Human
cagcaaggagauuuaca

SEQ ID NO: 3036689 - RNA, 18 nt, Human
cagcaaggagauuuacaa

SEQ ID NO: 3036690 - RNA, 14 nt, Human
cagcaagugagagc

SEQ ID NO: 3036691 - RNA, 15 nt, Human
cagcaagugagagcu

SEQ ID NO: 3036692 - RNA, 16 nt, Human
cagcaagugagagcug

SEQ ID NO: 3036693 - RNA, 17 nt, Human
cagcaagugagagcugg

SEQ ID NO: 3036694 - RNA, 12 nt, Human
cagcaagugaga

SEQ ID NO: 3036695 - RNA, 10 nt, Human
cagcagagug

SEQ ID NO: 3036696 - RNA, 9 nt, Human
cagcagagu

SEQ ID NO: 3036697 - RNA, 15 nt, Human
cagcagagugcuuua

SEQ ID NO: 3036698 - RNA, 11 nt, Human
cagcagagugc

SEQ ID NO: 3036699 - RNA, 15 nt, Human
cagcagaaaugccuu

SEQ ID NO: 3036700 - RNA, 17 nt, Human
cagcagaaaugccuuac

SEQ ID NO: 3036701 - RNA, 19 nt, Human
cagcagaaaugccuuaccc

SEQ ID NO: 3036702 - RNA, 22 nt, Human
cagcagaaaugccuuacccuca

SEQ ID NO: 3036703 - RNA, 13 nt, Human
cagcagagcaccu

SEQ ID NO: 3036704 - RNA, 11 nt, Human
cagcagagcac

SEQ ID NO: 3036705 - RNA, 15 nt, Human
cagcaacacaaagcu

SEQ ID NO: 3036706 - RNA, 23 nt, Human
cagcaacacaaagcuuuugcaua

SEQ ID NO: 3036707 - RNA, 18 nt, Human
cagcaaaagaugcuucuc

SEQ ID NO: 3036708 - RNA, 14 nt, Human
cagauucuuuccug

SEQ ID NO: 3036709 - RNA, 18 nt, Human
cagaugggugcuuggagg

SEQ ID NO: 3036710 - RNA, 23 nt, Human
cagaugggugcuuggaggaagga

SEQ ID NO: 3036711 - RNA, 21 nt, Human
cagccaaagccuccuccagcc

SEQ ID NO: 3036712 - RNA, 18 nt, Human
cagccaaagccuccucca

SEQ ID NO: 3036713 - RNA, 16 nt, Human
cagccaaagccuccuc

SEQ ID NO: 3036714 - RNA, 15 nt, Human
cagccaaagccuccu

SEQ ID NO: 3036715 - RNA, 21 nt, Human
cagcauccuggcacccggccc

SEQ ID NO: 3036716 - RNA, 19 nt, Human
cagcauccuggcacccggc

SEQ ID NO: 3036717 - RNA, 20 nt, Human
cagcauccuggcacccggcc

SEQ ID NO: 3036718 - RNA, 14 nt, Human
cagcauccuggcac

SEQ ID NO: 3036719 - RNA, 15 nt, Human
cagcauccuggcacc

SEQ ID NO: 3036720 - RNA, 16 nt, Human
cagcauccuggcaccc

SEQ ID NO: 3036721 - RNA, 17 nt, Human
cagcauccuggcacccg

SEQ ID NO: 3036722 - RNA, 20 nt, Human
cagcagggagggcuucugcc

SEQ ID NO: 3036723 - RNA, 19 nt, Human
cagcaggcucucaggccag

SEQ ID NO: 3036724 - RNA, 18 nt, Human
cagcaggcucucaggcca

SEQ ID NO: 3036725 - RNA, 17 nt, Human
cagcaggcucucaggcc

SEQ ID NO: 3036726 - RNA, 16 nt, Human
cagcaggcucucaggc

SEQ ID NO: 3036727 - RNA, 22 nt, Human
cagcaggcucucaggccagcug

SEQ ID NO: 3036728 - RNA, 20 nt, Human
cagcaggcucucaggccagc

SEQ ID NO: 3036729 - RNA, 18 nt, Human
cagcagggagggcuucug

SEQ ID NO: 3036730 - RNA, 12 nt, Human
cagcaggcucuc

SEQ ID NO: 3036731 - RNA, 15 nt, Human
cagcaggcucucagg

SEQ ID NO: 3036732 - RNA, 14 nt, Human
cagcaggcucucag

SEQ ID NO: 3036733 - RNA, 22 nt, Human
cagcagccuggacccuguggau

SEQ ID NO: 3036734 - RNA, 19 nt, Human
cagcagccuggacccugug

SEQ ID NO: 3036735 - RNA, 18 nt, Human
cagcagccuggacccugu

SEQ ID NO: 3036736 - RNA, 15 nt, Human
cagcagccuggaccc

SEQ ID NO: 3036737 - RNA, 14 nt, Human
cagcagccuggacc

SEQ ID NO: 3036738 - RNA, 12 nt, Human
cagcagccugga

SEQ ID NO: 3036739 - RNA, 14 nt, Human
cagccacauuccug

SEQ ID NO: 3036740 - RNA, 19 nt, Human
cagccacauuccugaugcu

SEQ ID NO: 3036741 - RNA, 17 nt, Human
cagccacauuccugaug

SEQ ID NO: 3036742 - RNA, 15 nt, Human
cagccacauuccuga

SEQ ID NO: 3036743 - RNA, 23 nt, Human
cagccacggccaggccagaggga

SEQ ID NO: 3036744 - RNA, 22 nt, Human
cagccaguaaaugggggugcau

SEQ ID NO: 3036745 - RNA, 13 nt, Human
cagccaguaaaug

SEQ ID NO: 3036746 - RNA, 14 nt, Human
cagccacggccagg

SEQ ID NO: 3036747 - RNA, 15 nt, Human
cagccacggccaggc

SEQ ID NO: 3036748 - RNA, 16 nt, Human
cagccacggccaggcc

SEQ ID NO: 3036749 - RNA, 17 nt, Human
cagccacggccaggcca

SEQ ID NO: 3036750 - RNA, 18 nt, Human
cagccacggccaggccag

SEQ ID NO: 3036751 - RNA, 19 nt, Human
cagccacggccaggccaga

SEQ ID NO: 3036752 - RNA, 21 nt, Human
cagccacggccaggccagagg

SEQ ID NO: 3036753 - RNA, 22 nt, Human
cagccacggccaggccagaggg

SEQ ID NO: 3036754 - RNA, 15 nt, Human
cagcccacuucugcc

SEQ ID NO: 3036755 - RNA, 15 nt, Human
cagcccaccccucaa

SEQ ID NO: 3036756 - RNA, 18 nt, Human
cagcccacuucugccaua

SEQ ID NO: 3036757 - RNA, 22 nt, Human
cagccccaaaacucuccucugc

SEQ ID NO: 3036758 - RNA, 21 nt, Human
cagccccaaaacucuccucug

SEQ ID NO: 3036759 - RNA, 20 nt, Human
cagccccaaaacucuccucu

SEQ ID NO: 3036760 - RNA, 14 nt, Human
cagcucaccagccc

SEQ ID NO: 3036761 - RNA, 13 nt, Human
cagcccucagaau

SEQ ID NO: 3036762 - RNA, 18 nt, Human
cagcccucaauugugaaa

SEQ ID NO: 3036763 - RNA, 22 nt, Human
cagcccgggcucugccucccau

SEQ ID NO: 3036764 - RNA, 21 nt, Human
cagcccgggcucugccuccca

SEQ ID NO: 3036765 - RNA, 20 nt, Human
cagcccgggcucugccuccc

SEQ ID NO: 3036766 - RNA, 19 nt, Human
cagcccgggcucugccucc

SEQ ID NO: 3036767 - RNA, 18 nt, Human
cagcccgggcucugccuc

SEQ ID NO: 3036768 - RNA, 17 nt, Human
cagcccgggcucugccu

SEQ ID NO: 3036769 - RNA, 16 nt, Human
cagcccgggcucugcc

SEQ ID NO: 3036770 - RNA, 15 nt, Human
cagcccgggcucugc

SEQ ID NO: 3036771 - RNA, 14 nt, Human
cagcccgggcucug

SEQ ID NO: 3036772 - RNA, 13 nt, Human
cagcccgggcucu

SEQ ID NO: 3036773 - RNA, 24 nt, Human
cagccccuucugacccaugcugcc

SEQ ID NO: 3036774 - RNA, 23 nt, Human
cagccccuucugacccaugcugc

SEQ ID NO: 3036775 - RNA, 22 nt, Human
cagccccuucugacccaugcug

SEQ ID NO: 3036776 - RNA, 21 nt, Human
cagccccuucugacccaugcu

SEQ ID NO: 3036777 - RNA, 19 nt, Human
cagccccuucugacccaug

SEQ ID NO: 3036778 - RNA, 17 nt, Human
cagccccuucugaccca

SEQ ID NO: 3036779 - RNA, 16 nt, Human
cagccccuucugaccc

SEQ ID NO: 3036780 - RNA, 13 nt, Human
cagccccagugcc

SEQ ID NO: 3036781 - RNA, 14 nt, Human
cagccccagugccc

SEQ ID NO: 3036782 - RNA, 15 nt, Human
cagccccagugccca

SEQ ID NO: 3036783 - RNA, 16 nt, Human
cagccccagugcccac

SEQ ID NO: 3036784 - RNA, 17 nt, Human
cagccccagugcccaca

SEQ ID NO: 3036785 - RNA, 18 nt, Human
cagccccagugcccacag

SEQ ID NO: 3036786 - RNA, 21 nt, Human
cagccccaucccaaacccuuc

SEQ ID NO: 3036787 - RNA, 11 nt, Human
cagccccaucc

SEQ ID NO: 3036788 - RNA, 21 nt, Human
cagccccuguucuggcagagu

SEQ ID NO: 3036789 - RNA, 22 nt, Human
cagccccuggaugcagccucac

SEQ ID NO: 3036790 - RNA, 20 nt, Human
cagccccuguucuggcagag

SEQ ID NO: 3036791 - RNA, 16 nt, Human
cagccccauucugccu

SEQ ID NO: 3036792 - RNA, 17 nt, Human
cagccccauucugccug

SEQ ID NO: 3036793 - RNA, 18 nt, Human
cagccccauucugccugc

SEQ ID NO: 3036794 - RNA, 23 nt, Human
cagccccuggaugcagccucaca

SEQ ID NO: 3036795 - RNA, 13 nt, Human
cagccccauucug

SEQ ID NO: 3036796 - RNA, 14 nt, Human
cagccccauucugc

SEQ ID NO: 3036797 - RNA, 22 nt, Human
cagccccauccucuguacagag

SEQ ID NO: 3036798 - RNA, 16 nt, Human
cagccccauccucugu

SEQ ID NO: 3036799 - RNA, 14 nt, Human
cagccccauccucu

SEQ ID NO: 3036800 - RNA, 13 nt, Human
cagccccauccuc

SEQ ID NO: 3036801 - RNA, 12 nt, Human
cagccccauccu

SEQ ID NO: 3036802 - RNA, 22 nt, Human
cagccccaucccaaacccuuca

SEQ ID NO: 3036803 - RNA, 16 nt, Human
cagcccugcagagggc

SEQ ID NO: 3036804 - RNA, 15 nt, Human
cagcccugcagaggg

SEQ ID NO: 3036805 - RNA, 14 nt, Human
cagcccugcagagg

SEQ ID NO: 3036806 - RNA, 13 nt, Human
cagcccugcagag

SEQ ID NO: 3036807 - RNA, 20 nt, Human
cagcccugcagagggcacag

SEQ ID NO: 3036808 - RNA, 18 nt, Human
cagcccugcagagggcac

SEQ ID NO: 3036809 - RNA, 21 nt, Human
cagccguguaaccauggaccc

SEQ ID NO: 3036810 - RNA, 19 nt, Human
cagccucccaaagugcugg

SEQ ID NO: 3036811 - RNA, 20 nt, Human
cagccucccaaagugcuggg

SEQ ID NO: 3036812 - RNA, 21 nt, Human
cagccucccaaagugcuggga

SEQ ID NO: 3036813 - RNA, 23 nt, Human
cagccucccaaagugcugggauu

SEQ ID NO: 3036814 - RNA, 20 nt, Human
cagccucccgaauagcuggg

SEQ ID NO: 3036815 - RNA, 21 nt, Human
cagccucccgaauagcuggga

SEQ ID NO: 3036816 - RNA, 22 nt, Human
cagccucccgaauagcugggac

SEQ ID NO: 3036817 - RNA, 20 nt, Human
cagccucacaguccuuacca

SEQ ID NO: 3036818 - RNA, 15 nt, Human
cagccucacaguccu

SEQ ID NO: 3036819 - RNA, 14 nt, Human
cagccucacagucc

SEQ ID NO: 3036820 - RNA, 19 nt, Human
cagccucaaccuccugggc

SEQ ID NO: 3036821 - RNA, 20 nt, Human
cagccucaaccuccugggcu

SEQ ID NO: 3036822 - RNA, 21 nt, Human
cagccucaaccuccugggcua

SEQ ID NO: 3036823 - RNA, 17 nt, Human
cagccucaaccuccugg

SEQ ID NO: 3036824 - RNA, 18 nt, Human
cagccucaaccuccuggg

SEQ ID NO: 3036825 - RNA, 20 nt, Human
cagccugcuccagcuguuca

SEQ ID NO: 3036826 - RNA, 23 nt, Human
cagccucccgaauagcugggacu

SEQ ID NO: 3036827 - RNA, 19 nt, Human
cagccucccgaguagcugg

SEQ ID NO: 3036828 - RNA, 20 nt, Human
cagccucccgaguagcuggg

SEQ ID NO: 3036829 - RNA, 21 nt, Human
cagccucccgaguagcuggga

SEQ ID NO: 3036830 - RNA, 22 nt, Human
cagccucccgaguagcugggac

SEQ ID NO: 3036831 - RNA, 23 nt, Human
cagccucccgaguagcugggacu

SEQ ID NO: 3036832 - RNA, 19 nt, Human
cagccuggacccuguggau

SEQ ID NO: 3036833 - RNA, 15 nt, Human
cagccuggacccugu

SEQ ID NO: 3036834 - RNA, 19 nt, Human
cagccugggcaaugugaua

SEQ ID NO: 3036835 - RNA, 16 nt, Human
cagccugggcaaugug

SEQ ID NO: 3036836 - RNA, 24 nt, Human
cagccuugaccauucuccaccugc

SEQ ID NO: 3036837 - RNA, 23 nt, Human
cagccuugaccauucuccaccug

SEQ ID NO: 3036838 - RNA, 22 nt, Human
cagccuugaccauucuccaccu

SEQ ID NO: 3036839 - RNA, 17 nt, Human
cagccuugaccauucuc

SEQ ID NO: 3036840 - RNA, 21 nt, Human
cagccuugaccauucuccacc

SEQ ID NO: 3036841 - RNA, 20 nt, Human
cagccuugaccauucuccac

SEQ ID NO: 3036842 - RNA, 12 nt, Human
cagcucagagag

SEQ ID NO: 3036843 - RNA, 20 nt, Human
cagcucaccucucccuugga

SEQ ID NO: 3036844 - RNA, 19 nt, Human
cagcucaccucucccuugg

SEQ ID NO: 3036845 - RNA, 22 nt, Human
cagcucaccagccccagugccc

SEQ ID NO: 3036846 - RNA, 20 nt, Human
cagcucaccagccccagugc

SEQ ID NO: 3036847 - RNA, 21 nt, Human
cagcucaccagccccagugcc

SEQ ID NO: 3036848 - RNA, 17 nt, Human
cagcucaccucucccuu

SEQ ID NO: 3036849 - RNA, 16 nt, Human
cagcucaccucucccu

SEQ ID NO: 3036850 - RNA, 15 nt, Human
cagcucaccucuccc

SEQ ID NO: 3036851 - RNA, 13 nt, Human
cagcucaccucuc

SEQ ID NO: 3036852 - RNA, 13 nt, Human
cagcucaccagcc

SEQ ID NO: 3036853 - RNA, 15 nt, Human
cagcucaccagcccc

SEQ ID NO: 3036854 - RNA, 16 nt, Human
cagcucaccagcccca

SEQ ID NO: 3036855 - RNA, 17 nt, Human
cagcucaccagccccag

SEQ ID NO: 3036856 - RNA, 19 nt, Human
cagcucaccagccccagug

SEQ ID NO: 3036857 - RNA, 21 nt, Human
cagcgagcccugguggcagug

SEQ ID NO: 3036858 - RNA, 18 nt, Human
cagcuaacauggaaguac

SEQ ID NO: 3036859 - RNA, 19 nt, Human
cagcuaacauggaaguacu

SEQ ID NO: 3036860 - RNA, 13 nt, Human
cagcgagcccugg

SEQ ID NO: 3036861 - RNA, 16 nt, Human
cagcgagcccuggugg

SEQ ID NO: 3036862 - RNA, 17 nt, Human
cagcgagcccugguggc

SEQ ID NO: 3036863 - RNA, 19 nt, Human
cagcgagcccugguggcag

SEQ ID NO: 3036864 - RNA, 20 nt, Human
cagcgagcccugguggcagu

SEQ ID NO: 3036865 - RNA, 20 nt, Human
cagcuaacauggaaguacua

SEQ ID NO: 3036866 - RNA, 15 nt, Human
cagcuaaugggacac

SEQ ID NO: 3036867 - RNA, 16 nt, Human
cagcuaaugggacacu

SEQ ID NO: 3036868 - RNA, 16 nt, Human
cagcucuccccuucuc

SEQ ID NO: 3036869 - RNA, 16 nt, Human
cagcucugcaagaauu

SEQ ID NO: 3036870 - RNA, 15 nt, Human
cagcucugcaagaau

SEQ ID NO: 3036871 - RNA, 21 nt, Human
cagcucugcaagaauugaagc

SEQ ID NO: 3036872 - RNA, 20 nt, Human
cagcucagagagggugggag

SEQ ID NO: 3036873 - RNA, 19 nt, Human
cagcucagagaggguggga

SEQ ID NO: 3036874 - RNA, 17 nt, Human
cagcucagagagggugg

SEQ ID NO: 3036875 - RNA, 13 nt, Human
cagcucagagagg

SEQ ID NO: 3036876 - RNA, 16 nt, Human
cagcuccuucuguccu

SEQ ID NO: 3036877 - RNA, 17 nt, Human
cagcuccuucuguccua

SEQ ID NO: 3036878 - RNA, 21 nt, Human
cagcuccuucuguccuacucu

SEQ ID NO: 3036879 - RNA, 23 nt, Human
cagcuccuucuguccuacucugu

SEQ ID NO: 3036880 - RNA, 13 nt, Human
cagcucuggucca

SEQ ID NO: 3036881 - RNA, 10 nt, Human
cagcucuggu

SEQ ID NO: 3036882 - RNA, 21 nt, Human
cagcucugguccauagagagc

SEQ ID NO: 3036883 - RNA, 18 nt, Human
cagcucugguccauagag

SEQ ID NO: 3036884 - RNA, 17 nt, Human
cagcucugguccauaga

SEQ ID NO: 3036885 - RNA, 16 nt, Human
cagcucugguccauag

SEQ ID NO: 3036886 - RNA, 12 nt, Human
cagcucuguccu

SEQ ID NO: 3036887 - RNA, 13 nt, Human
cagcucuguccug

SEQ ID NO: 3036888 - RNA, 23 nt, Human
cagcucugguccauagagagcaa

SEQ ID NO: 3036889 - RNA, 22 nt, Human
cagcucugguccauagagagca

SEQ ID NO: 3036890 - RNA, 14 nt, Human
cagcucuguccugg

SEQ ID NO: 3036891 - RNA, 16 nt, Human
cagcucuguccuggga

SEQ ID NO: 3036892 - RNA, 17 nt, Human
cagcucuguccugggag

SEQ ID NO: 3036893 - RNA, 18 nt, Human
cagcucuguccugggagu

SEQ ID NO: 3036894 - RNA, 23 nt, Human
cagcucuguccugggagugagcu

SEQ ID NO: 3036895 - RNA, 21 nt, Human
cagcucuuauauugccauuuc

SEQ ID NO: 3036896 - RNA, 10 nt, Human
cagcucuuau

SEQ ID NO: 3036897 - RNA, 13 nt, Human
cagcucuucucca

SEQ ID NO: 3036898 - RNA, 14 nt, Human
cagcucuucuccag

SEQ ID NO: 3036899 - RNA, 15 nt, Human
cagcucuucuccagg

SEQ ID NO: 3036900 - RNA, 16 nt, Human
cagcucuucuccaggc

SEQ ID NO: 3036901 - RNA, 17 nt, Human
cagcucuucuccaggcu

SEQ ID NO: 3036902 - RNA, 18 nt, Human
cagcucuucuccaggcug

SEQ ID NO: 3036903 - RNA, 19 nt, Human
cagcucuucuccaggcugu

SEQ ID NO: 3036904 - RNA, 23 nt, Human
cagcucuucuccaggcuguaucc

SEQ ID NO: 3036905 - RNA, 18 nt, Human
cagcugcgguccacccag

SEQ ID NO: 3036906 - RNA, 15 nt, Human
cagcugccugggauc

SEQ ID NO: 3036907 - RNA, 19 nt, Human
cagcugcgguccacccagg

SEQ ID NO: 3036908 - RNA, 20 nt, Human
cagcugcgguccacccagga

SEQ ID NO: 3036909 - RNA, 21 nt, Human
cagcugcgguccacccaggag

SEQ ID NO: 3036910 - RNA, 22 nt, Human
cagcugcgguccacccaggagc

SEQ ID NO: 3036911 - RNA, 23 nt, Human
cagcugcgguccacccaggagcc

SEQ ID NO: 3036912 - RNA, 24 nt, Human
cagcugcgguccacccaggagccc

SEQ ID NO: 3036913 - RNA, 23 nt, Human
cagcugccugggaucccucaucc

SEQ ID NO: 3036914 - RNA, 18 nt, Human
cagcugccugggaucccu

SEQ ID NO: 3036915 - RNA, 17 nt, Human
cagcugcuacuacuccu

SEQ ID NO: 3036916 - RNA, 22 nt, Human
cagcugcuugggcuucauccuc

SEQ ID NO: 3036917 - RNA, 21 nt, Human
cagcugcuugggcuucauccu

SEQ ID NO: 3036918 - RNA, 19 nt, Human
cagcugcuugggcuucauc

SEQ ID NO: 3036919 - RNA, 18 nt, Human
cagcugcuugggcuucau

SEQ ID NO: 3036920 - RNA, 16 nt, Human
cagcugcuugggcuuc

SEQ ID NO: 3036921 - RNA, 15 nt, Human
cagcugcuugggcuu

SEQ ID NO: 3036922 - RNA, 14 nt, Human
cagcugcuugggcu

SEQ ID NO: 3036923 - RNA, 13 nt, Human
cagcugcuugggc

SEQ ID NO: 3036924 - RNA, 23 nt, Human
cagcugcuuuugucuaugggacu

SEQ ID NO: 3036925 - RNA, 22 nt, Human
cagcugcuuuugucuaugggac

SEQ ID NO: 3036926 - RNA, 23 nt, Human
cagcugggguggggaccucaggc

SEQ ID NO: 3036927 - RNA, 22 nt, Human
cagcugggguggggaccucagg

SEQ ID NO: 3036928 - RNA, 21 nt, Human
cagcugggguggggaccucag

SEQ ID NO: 3036929 - RNA, 18 nt, Human
cagcugguugagguuuca

SEQ ID NO: 3036930 - RNA, 22 nt, Human
caggaagcugugagagcaguuu

SEQ ID NO: 3036931 - RNA, 13 nt, Human
caggaagcuguga

SEQ ID NO: 3036932 - RNA, 14 nt, Human
caggaagcugugag

SEQ ID NO: 3036933 - RNA, 23 nt, Human
caggaagcucagggccuggcuca

SEQ ID NO: 3036934 - RNA, 21 nt, Human
caggaagcucagggccuggcu

SEQ ID NO: 3036935 - RNA, 20 nt, Human
caggaagcucagggccuggc

SEQ ID NO: 3036936 - RNA, 13 nt, Human
caggaagcucagg

SEQ ID NO: 3036937 - RNA, 15 nt, Human
caggaagcucagggc

SEQ ID NO: 3036938 - RNA, 14 nt, Human
caggaagcucaggg

SEQ ID NO: 3036939 - RNA, 19 nt, Human
caggaagcucagggccugg

SEQ ID NO: 3036940 - RNA, 18 nt, Human
caggaagcucagggccug

SEQ ID NO: 3036941 - RNA, 17 nt, Human
caggaagcucagggccu

SEQ ID NO: 3036942 - RNA, 16 nt, Human
caggaagcucagggcc

SEQ ID NO: 3036943 - RNA, 22 nt, Human
caggaagccagcaggcucucag

SEQ ID NO: 3036944 - RNA, 21 nt, Human
caggaagccagcaggcucuca

SEQ ID NO: 3036945 - RNA, 19 nt, Human
caggaagccagcaggcucu

SEQ ID NO: 3036946 - RNA, 18 nt, Human
caggaagccagcaggcuc

SEQ ID NO: 3036947 - RNA, 17 nt, Human
caggaagccagcaggcu

SEQ ID NO: 3036948 - RNA, 16 nt, Human
caggaagccagcaggc

SEQ ID NO: 3036949 - RNA, 14 nt, Human
caggaagccagcag

SEQ ID NO: 3036950 - RNA, 20 nt, Human
caggaaguacuggagaaaau

SEQ ID NO: 3036951 - RNA, 18 nt, Human
caggaaguacuggagaaa

SEQ ID NO: 3036952 - RNA, 17 nt, Human
caggaaguacuggagaa

SEQ ID NO: 3036953 - RNA, 12 nt, Human
caggaaguacug

SEQ ID NO: 3036954 - RNA, 16 nt, Human
caggaaguacuggaga

SEQ ID NO: 3036955 - RNA, 14 nt, Human
caggaaguacugga

SEQ ID NO: 3036956 - RNA, 15 nt, Human
caggaaggcuaaagg

SEQ ID NO: 3036957 - RNA, 23 nt, Human
cagcuuuguuuguugucagcuga

SEQ ID NO: 3036958 - RNA, 22 nt, Human
cagcuuuguuuguugucagcug

SEQ ID NO: 3036959 - RNA, 21 nt, Human
cagcuuuguuuguugucagcu

SEQ ID NO: 3036960 - RNA, 12 nt, Human
cagcuuuguuug

SEQ ID NO: 3036961 - RNA, 18 nt, Human
cagcuuguaaauagcuca

SEQ ID NO: 3036962 - RNA, 19 nt, Human
cagcuuguaaauagcucag

SEQ ID NO: 3036963 - RNA, 20 nt, Human
cagcuuguaaauagcucagg

SEQ ID NO: 3036964 - RNA, 21 nt, Human
cagcuuguaaauagcucaggu

SEQ ID NO: 3036965 - RNA, 22 nt, Human
cagcuuguaaauagcucaggug

SEQ ID NO: 3036966 - RNA, 14 nt, Human
cagcuugaggguug

SEQ ID NO: 3036967 - RNA, 15 nt, Human
cagcuugaggguugg

SEQ ID NO: 3036968 - RNA, 21 nt, Human
cagcuugaccgugaggccaga

SEQ ID NO: 3036969 - RNA, 20 nt, Human
cagcuugaccgugaggccag

SEQ ID NO: 3036970 - RNA, 19 nt, Human
cagcuugaccgugaggcca

SEQ ID NO: 3036971 - RNA, 18 nt, Human
cagcuugaccgugaggcc

SEQ ID NO: 3036972 - RNA, 18 nt, Human
cagcuugaggguugggcu

SEQ ID NO: 3036973 - RNA, 19 nt, Human
cagcuugaggguugggcug

SEQ ID NO: 3036974 - RNA, 20 nt, Human
cagcuugaggguugggcugg

SEQ ID NO: 3036975 - RNA, 21 nt, Human
cagcuugaggguugggcuggu

SEQ ID NO: 3036976 - RNA, 19 nt, Human
cagcuucauuuccuguguc

SEQ ID NO: 3036977 - RNA, 20 nt, Human
cagcuucauuuccugugucu

SEQ ID NO: 3036978 - RNA, 21 nt, Human
cagcuucauuuccugugucuu

SEQ ID NO: 3036979 - RNA, 22 nt, Human
caggaagcucagggccuggcuc

SEQ ID NO: 3036980 - RNA, 20 nt, Human
cagagccccacccucagaug

SEQ ID NO: 3036981 - RNA, 12 nt, Human
cagagccugcag

SEQ ID NO: 3036982 - RNA, 13 nt, Human
cagaggaaggaga

SEQ ID NO: 3036983 - RNA, 13 nt, Human
cagagccugcagu

SEQ ID NO: 3036984 - RNA, 20 nt, Human
cagaggaaagcaaaggagau

SEQ ID NO: 3036985 - RNA, 21 nt, Human
cagagcccacgcccccacugg

SEQ ID NO: 3036986 - RNA, 20 nt, Human
cagagcccacgcccccacug

SEQ ID NO: 3036987 - RNA, 19 nt, Human
cagagcccacgcccccacu

SEQ ID NO: 3036988 - RNA, 17 nt, Human
cagagcccacgccccca

SEQ ID NO: 3036989 - RNA, 23 nt, Human
cagagcccacgcccccacuggug

SEQ ID NO: 3036990 - RNA, 13 nt, Human
cagaggagagagg

SEQ ID NO: 3036991 - RNA, 19 nt, Human
cagaggagagaggaccccc

SEQ ID NO: 3036992 - RNA, 15 nt, Human
cagaggagagaggac

SEQ ID NO: 3036993 - RNA, 11 nt, Human
cagaggcagcc

SEQ ID NO: 3036994 - RNA, 20 nt, Human
cagaggagagaggacccccu

SEQ ID NO: 3036995 - RNA, 23 nt, Human
cagagcaccuuagacagucccug

SEQ ID NO: 3036996 - RNA, 12 nt, Human
cagagcagagac

SEQ ID NO: 3036997 - RNA, 11 nt, Human
cagagcagaga

SEQ ID NO: 3036998 - RNA, 22 nt, Human
cagagcaccuuagacagucccu

SEQ ID NO: 3036999 - RNA, 21 nt, Human
cagagcaccuuagacaguccc

SEQ ID NO: 3037000 - RNA, 19 nt, Human
cagagcaccuuagacaguc

SEQ ID NO: 3037001 - RNA, 18 nt, Human
cagagcaccuuagacagu

SEQ ID NO: 3037002 - RNA, 21 nt, Human
cagagcagagaccaucccuga

SEQ ID NO: 3037003 - RNA, 19 nt, Human
cagagcagagaccaucccu

SEQ ID NO: 3037004 - RNA, 18 nt, Human
cagagcagagaccauccc

SEQ ID NO: 3037005 - RNA, 17 nt, Human
cagagcagagaccaucc

SEQ ID NO: 3037006 - RNA, 15 nt, Human
cagagcagagaccau

SEQ ID NO: 3037007 - RNA, 14 nt, Human
cagagcagagacca

SEQ ID NO: 3037008 - RNA, 13 nt, Human
cagagcagagacc

SEQ ID NO: 3037009 - RNA, 15 nt, Human
cagagcccaccuugg

SEQ ID NO: 3037010 - RNA, 17 nt, Human
cagagcccaccuuggcu

SEQ ID NO: 3037011 - RNA, 19 nt, Human
cagagcccaccuuggcuca

SEQ ID NO: 3037012 - RNA, 20 nt, Human
cagagcccaccuuggcucaa

SEQ ID NO: 3037013 - RNA, 16 nt, Human
cagagcccacgccccc

SEQ ID NO: 3037014 - RNA, 21 nt, Human
cagagaagauucuuguauuua

SEQ ID NO: 3037015 - RNA, 19 nt, Human
cagagaaugaaagggccca

SEQ ID NO: 3037016 - RNA, 15 nt, Human
cagagaauucucuua

SEQ ID NO: 3037017 - RNA, 20 nt, Human
cagagaaugaaagggcccag

SEQ ID NO: 3037018 - RNA, 21 nt, Human
cagagaaugaaagggcccaga

SEQ ID NO: 3037019 - RNA, 13 nt, Human
cagagaccauccc

SEQ ID NO: 3037020 - RNA, 16 nt, Human
cagagaccaucccuga

SEQ ID NO: 3037021 - RNA, 14 nt, Human
cagagaccaucccu

SEQ ID NO: 3037022 - RNA, 15 nt, Human
cagagacacaagccu

SEQ ID NO: 3037023 - RNA, 14 nt, Human
cagagacacaagcc

SEQ ID NO: 3037024 - RNA, 17 nt, Human
cagagacacaagccuuc

SEQ ID NO: 3037025 - RNA, 16 nt, Human
cagagacacaagccuu

SEQ ID NO: 3037026 - RNA, 16 nt, Human
cagagcaccuuagaca

SEQ ID NO: 3037027 - RNA, 20 nt, Human
cagagcaagugagacccugu

SEQ ID NO: 3037028 - RNA, 14 nt, Human
cagagcaagugaga

SEQ ID NO: 3037029 - RNA, 21 nt, Human
cagagaccaucccugaaggcc

SEQ ID NO: 3037030 - RNA, 20 nt, Human
cagagaccaucccugaaggc

SEQ ID NO: 3037031 - RNA, 19 nt, Human
cagagaccaucccugaagg

SEQ ID NO: 3037032 - RNA, 18 nt, Human
cagagaccaucccugaag

SEQ ID NO: 3037033 - RNA, 17 nt, Human
cagagaccaucccugaa

SEQ ID NO: 3037034 - RNA, 13 nt, Human
cagagacuccugc

SEQ ID NO: 3037035 - RNA, 15 nt, Human
cagagacuccugcag

SEQ ID NO: 3037036 - RNA, 14 nt, Human
cagagacuccugca

SEQ ID NO: 3037037 - RNA, 19 nt, Human
cagagacuccugcaggcag

SEQ ID NO: 3037038 - RNA, 18 nt, Human
cagagacuccugcaggca

SEQ ID NO: 3037039 - RNA, 17 nt, Human
cagagacuccugcaggc

SEQ ID NO: 3037040 - RNA, 16 nt, Human
cagagacuccugcagg

SEQ ID NO: 3037041 - RNA, 21 nt, Human
cagagugcuuuaccaauugaa

SEQ ID NO: 3037042 - RNA, 19 nt, Human
cagagugagacucugucuc

SEQ ID NO: 3037043 - RNA, 20 nt, Human
cagagugagacucugucuca

SEQ ID NO: 3037044 - RNA, 12 nt, Human
cagaguggcagu

SEQ ID NO: 3037045 - RNA, 22 nt, Human
cagagucucacuguugcccagg

SEQ ID NO: 3037046 - RNA, 23 nt, Human
cagagucucacuguugcccaggc

SEQ ID NO: 3037047 - RNA, 16 nt, Human
cagagugagacucugu

SEQ ID NO: 3037048 - RNA, 17 nt, Human
cagagugagacucuguc

SEQ ID NO: 3037049 - RNA, 18 nt, Human
cagagugagacucugucu

SEQ ID NO: 3037050 - RNA, 13 nt, Human
cagagucucacug

SEQ ID NO: 3037051 - RNA, 17 nt, Human
cagagucucacuguugc

SEQ ID NO: 3037052 - RNA, 19 nt, Human
cagagucucacuguugccc

SEQ ID NO: 3037053 - RNA, 20 nt, Human
cagagucucacuguugccca

SEQ ID NO: 3037054 - RNA, 21 nt, Human
cagagucucacuguugcccag

SEQ ID NO: 3037055 - RNA, 19 nt, Human
cagagggccugcaagggag

SEQ ID NO: 3037056 - RNA, 15 nt, Human
cagagggccugcaag

SEQ ID NO: 3037057 - RNA, 20 nt, Human
cagagggagugacagaggca

SEQ ID NO: 3037058 - RNA, 21 nt, Human
cagagggagugacagaggcag

SEQ ID NO: 3037059 - RNA, 22 nt, Human
cagagggagugacagaggcagc

SEQ ID NO: 3037060 - RNA, 23 nt, Human
cagagggagugacagaggcagcc

SEQ ID NO: 3037061 - RNA, 20 nt, Human
cagaggccaugggccuccug

SEQ ID NO: 3037062 - RNA, 21 nt, Human
cagaggccaugggccuccugu

SEQ ID NO: 3037063 - RNA, 23 nt, Human
cagaggcagccccauucugccug

SEQ ID NO: 3037064 - RNA, 19 nt, Human
cagaggccaugggccuccu

SEQ ID NO: 3037065 - RNA, 16 nt, Human
cagaggccaugggccu

SEQ ID NO: 3037066 - RNA, 12 nt, Human
cagaggcagccc

SEQ ID NO: 3037067 - RNA, 13 nt, Human
cagaggcagcccc

SEQ ID NO: 3037068 - RNA, 14 nt, Human
cagaggcagcccca

SEQ ID NO: 3037069 - RNA, 15 nt, Human
cagaggcagccccau

SEQ ID NO: 3037070 - RNA, 18 nt, Human
cagaggcagccccauucu

SEQ ID NO: 3037071 - RNA, 19 nt, Human
cagaggcagccccauucug

SEQ ID NO: 3037072 - RNA, 20 nt, Human
cagaggcagccccauucugc

SEQ ID NO: 3037073 - RNA, 22 nt, Human
cagaggcagccccauucugccu

SEQ ID NO: 3037074 - RNA, 23 nt, Human
cagaggcugccucucccaucacu

SEQ ID NO: 3037075 - RNA, 14 nt, Human
cagagggagugaca

SEQ ID NO: 3037076 - RNA, 16 nt, Human
cagagggagugacaga

SEQ ID NO: 3037077 - RNA, 18 nt, Human
cagagggagugacagagg

SEQ ID NO: 3037078 - RNA, 19 nt, Human
cagagggagugacagaggc

SEQ ID NO: 3037079 - RNA, 13 nt, Human
cagaggcugccuc

SEQ ID NO: 3037080 - RNA, 17 nt, Human
cagaugcacaugagcug

SEQ ID NO: 3037081 - RNA, 13 nt, Human
cagaugcaccagc

SEQ ID NO: 3037082 - RNA, 14 nt, Human
cagaugcaccagcc

SEQ ID NO: 3037083 - RNA, 16 nt, Human
cagaugcaccagcccu

SEQ ID NO: 3037084 - RNA, 17 nt, Human
cagaugcaccagcccuu

SEQ ID NO: 3037085 - RNA, 22 nt, Human
cagaugcaccagcccuuagcag

SEQ ID NO: 3037086 - RNA, 20 nt, Human
cagauacaggaaaagcugcu

SEQ ID NO: 3037087 - RNA, 21 nt, Human
cagauacaggaaaagcugcug

SEQ ID NO: 3037088 - RNA, 22 nt, Human
cagauacaggaaaagcugcuga

SEQ ID NO: 3037089 - RNA, 20 nt, Human
cagaucucuaacuucaccau

SEQ ID NO: 3037090 - RNA, 19 nt, Human
cagaguuguuacauuuuua

SEQ ID NO: 3037091 - RNA, 15 nt, Human
cagaguuguuacauu

SEQ ID NO: 3037092 - RNA, 18 nt, Human
cagaguuguuacauuuuu

SEQ ID NO: 3037093 - RNA, 22 nt, Human
cagaguugaagacagagcuaca

SEQ ID NO: 3037094 - RNA, 14 nt, Human
cagaguuguuacau

SEQ ID NO: 3037095 - RNA, 20 nt, Human
cagaguugaagacagagcua

SEQ ID NO: 3037096 - RNA, 19 nt, Human
cagaguugaagacagagcu

SEQ ID NO: 3037097 - RNA, 18 nt, Human
cagaguugaagacagagc

SEQ ID NO: 3037098 - RNA, 17 nt, Human
cagaguugaagacagag

SEQ ID NO: 3037099 - RNA, 14 nt, Human
cagaguugaagaca

SEQ ID NO: 3037100 - RNA, 16 nt, Human
cagaguugaagacaga

SEQ ID NO: 3037101 - RNA, 15 nt, Human
cagaguugaagacag

SEQ ID NO: 3037102 - RNA, 17 nt, Human
cagaacuauguuuuugu

SEQ ID NO: 3037103 - RNA, 21 nt, Human
cagaagacacugaugggcaac

SEQ ID NO: 3037104 - RNA, 18 nt, Human
cagaagucaaggcuuaga

SEQ ID NO: 3037105 - RNA, 16 nt, Human
cagaagucaaggcuua

SEQ ID NO: 3037106 - RNA, 17 nt, Human
cagaagucaaggcuuag

SEQ ID NO: 3037107 - RNA, 23 nt, Human
cagaaucgcuccaccuugcagcu

SEQ ID NO: 3037108 - RNA, 21 nt, Human
cagaaucgcuccaccuugcag

SEQ ID NO: 3037109 - RNA, 17 nt, Human
cagaaucucaaauaacu

SEQ ID NO: 3037110 - RNA, 18 nt, Human
cagaaucucaaauaacua

SEQ ID NO: 3037111 - RNA, 19 nt, Human
cagaaggaagacuucaucc

SEQ ID NO: 3037112 - RNA, 18 nt, Human
cagaaggaagacuucauc

SEQ ID NO: 3037113 - RNA, 17 nt, Human
cagaaggaagacuucau

SEQ ID NO: 3037114 - RNA, 16 nt, Human
cagaaggaagacuuca

SEQ ID NO: 3037115 - RNA, 23 nt, Human
cagaaaauggaagacagcucuua

SEQ ID NO: 3037116 - RNA, 22 nt, Human
cagaaaauggaagacagcucuu

SEQ ID NO: 3037117 - RNA, 21 nt, Human
cagaaaauggaagacagcucu

SEQ ID NO: 3037118 - RNA, 20 nt, Human
cagaaaauggaagacagcuc

SEQ ID NO: 3037119 - RNA, 16 nt, Human
cagaaaauggaagaca

SEQ ID NO: 3037120 - RNA, 22 nt, Human
cacuuuuguucuugguuuguaa

SEQ ID NO: 3037121 - RNA, 14 nt, Human
cacuuuuguucuug

SEQ ID NO: 3037122 - RNA, 16 nt, Human
cacuuugggaggccaa

SEQ ID NO: 3037123 - RNA, 13 nt, Human
cacuuugggaggc

SEQ ID NO: 3037124 - RNA, 12 nt, Human
cacuuugggagg

SEQ ID NO: 3037125 - RNA, 23 nt, Human
cacuuuguucuggcucuuccagg

SEQ ID NO: 3037126 - RNA, 16 nt, Human
cacuuuguucuggcuc

SEQ ID NO: 3037127 - RNA, 14 nt, Human
cacuuuguucuggc

SEQ ID NO: 3037128 - RNA, 13 nt, Human
cacuuuguucugg

SEQ ID NO: 3037129 - RNA, 22 nt, Human
cacuuucuagccagaggagaga

SEQ ID NO: 3037130 - RNA, 20 nt, Human
cagacaguuaagagaaauga

SEQ ID NO: 3037131 - RNA, 19 nt, Human
cagacaccuugacagggca

SEQ ID NO: 3037132 - RNA, 20 nt, Human
cagacaccuugacagggcac

SEQ ID NO: 3037133 - RNA, 22 nt, Human
cagacaccuugacagggcacac

SEQ ID NO: 3037134 - RNA, 19 nt, Human
cagacauacuaaccagcag

SEQ ID NO: 3037135 - RNA, 13 nt, Human
cagacacaggccc

SEQ ID NO: 3037136 - RNA, 14 nt, Human
cagacacaggcccg

SEQ ID NO: 3037137 - RNA, 15 nt, Human
cagacacaggcccgg

SEQ ID NO: 3037138 - RNA, 17 nt, Human
cagacacaggcccggcu

SEQ ID NO: 3037139 - RNA, 18 nt, Human
cagacacaggcccggcuc

SEQ ID NO: 3037140 - RNA, 21 nt, Human
cagacacaggcccggcuccag

SEQ ID NO: 3037141 - RNA, 22 nt, Human
cagacacaggcccggcuccagg

SEQ ID NO: 3037142 - RNA, 23 nt, Human
cagacacaggcccggcuccaggc

SEQ ID NO: 3037143 - RNA, 23 nt, Human
cagacacauguccaagaagccca

SEQ ID NO: 3037144 - RNA, 22 nt, Human
cagacacauguccaagaagccc

SEQ ID NO: 3037145 - RNA, 21 nt, Human
cagacacauguccaagaagcc

SEQ ID NO: 3037146 - RNA, 17 nt, Human
cagacacauguccaaga

SEQ ID NO: 3037147 - RNA, 14 nt, Human
cagacacaugucca

SEQ ID NO: 3037148 - RNA, 22 nt, Human
cagacaaagcgugguggacaug

SEQ ID NO: 3037149 - RNA, 20 nt, Human
cagacaacaaaccuguuucu

SEQ ID NO: 3037150 - RNA, 12 nt, Human
cagacaaagcgu

SEQ ID NO: 3037151 - RNA, 24 nt, Human
cagaauuucccaaagcagugcaug

SEQ ID NO: 3037152 - RNA, 20 nt, Human
cagaauuucccaaagcagug

SEQ ID NO: 3037153 - RNA, 19 nt, Human
cagaauuucccaaagcagu

SEQ ID NO: 3037154 - RNA, 18 nt, Human
cagaauuucccaaagcag

SEQ ID NO: 3037155 - RNA, 17 nt, Human
cagaauuucccaaagca

SEQ ID NO: 3037156 - RNA, 11 nt, Human
cagaauucuca

SEQ ID NO: 3037157 - RNA, 15 nt, Human
cagaauucucuaguu

SEQ ID NO: 3037158 - RNA, 18 nt, Human
cagaauucucuaguuuga

SEQ ID NO: 3037159 - RNA, 14 nt, Human
cagaauuucccaaa

SEQ ID NO: 3037160 - RNA, 16 nt, Human
cagacccggcugcgug

SEQ ID NO: 3037161 - RNA, 12 nt, Human
cagacccugccc

SEQ ID NO: 3037162 - RNA, 14 nt, Human
cagacccugcccug

SEQ ID NO: 3037163 - RNA, 13 nt, Human
cagacccugcccu

SEQ ID NO: 3037164 - RNA, 12 nt, Human
cagacccggcug

SEQ ID NO: 3037165 - RNA, 14 nt, Human
cagacccggcugcg

SEQ ID NO: 3037166 - RNA, 21 nt, Human
cagacccugcccugugggccc

SEQ ID NO: 3037167 - RNA, 17 nt, Human
cagacccugcccugugg

SEQ ID NO: 3037168 - RNA, 16 nt, Human
cagacccugcccugug

SEQ ID NO: 3037169 - RNA, 15 nt, Human
cagacccugcccugu

SEQ ID NO: 3037170 - RNA, 22 nt, Human
cagacccugcccugugggcccc

SEQ ID NO: 3037171 - RNA, 20 nt, Human
cagaccacaaaacuuuucua

SEQ ID NO: 3037172 - RNA, 14 nt, Human
cagaccacaaaacu

SEQ ID NO: 3037173 - RNA, 19 nt, Human
cagagaaaguacuucucca

SEQ ID NO: 3037174 - RNA, 23 nt, Human
cagagaaaguacuucuccacccu

SEQ ID NO: 3037175 - RNA, 16 nt, Human
cagacaacaaaccugu

SEQ ID NO: 3037176 - RNA, 20 nt, Human
cacccucagaugcacaugag

SEQ ID NO: 3037177 - RNA, 12 nt, Human
cacccggccccu

SEQ ID NO: 3037178 - RNA, 19 nt, Human
cacccgcuaagagggaggg

SEQ ID NO: 3037179 - RNA, 13 nt, Human
cacccggccccug

SEQ ID NO: 3037180 - RNA, 14 nt, Human
cacccggccccugc

SEQ ID NO: 3037181 - RNA, 16 nt, Human
cacccggccccugcug

SEQ ID NO: 3037182 - RNA, 17 nt, Human
cacccggccccugcugg

SEQ ID NO: 3037183 - RNA, 18 nt, Human
cacccggccccugcuggu

SEQ ID NO: 3037184 - RNA, 21 nt, Human
cacccggccccugcugguuca

SEQ ID NO: 3037185 - RNA, 13 nt, Human
cacauauugauuu

SEQ ID NO: 3037186 - RNA, 20 nt, Human
caccccucaacaccucugca

SEQ ID NO: 3037187 - RNA, 13 nt, Human
caccgcagacagg

SEQ ID NO: 3037188 - RNA, 12 nt, Human
caccgcagacag

SEQ ID NO: 3037189 - RNA, 18 nt, Human
caccgcagacaggaccag

SEQ ID NO: 3037190 - RNA, 17 nt, Human
caccgcagacaggacca

SEQ ID NO: 3037191 - RNA, 15 nt, Human
caccgcagacaggac

SEQ ID NO: 3037192 - RNA, 14 nt, Human
caccgcagacagga

SEQ ID NO: 3037193 - RNA, 22 nt, Human
caccgaaaacguggcugcuuca

SEQ ID NO: 3037194 - RNA, 21 nt, Human
caccgaaaacguggcugcuuc

SEQ ID NO: 3037195 - RNA, 19 nt, Human
caccgaaaacguggcugcu

SEQ ID NO: 3037196 - RNA, 18 nt, Human
caccgaaaacguggcugc

SEQ ID NO: 3037197 - RNA, 15 nt, Human
caccgaaaacguggc

SEQ ID NO: 3037198 - RNA, 23 nt, Human
cacccugugauggggcccugccu

SEQ ID NO: 3037199 - RNA, 22 nt, Human
cacccugugauggggcccugcc

SEQ ID NO: 3037200 - RNA, 21 nt, Human
cacccugugauggggcccugc

SEQ ID NO: 3037201 - RNA, 20 nt, Human
cacccugugauggggcccug

SEQ ID NO: 3037202 - RNA, 18 nt, Human
cacccugugauggggccc

SEQ ID NO: 3037203 - RNA, 15 nt, Human
cacccugugaugggg

SEQ ID NO: 3037204 - RNA, 12 nt, Human
cacccugugaug

SEQ ID NO: 3037205 - RNA, 11 nt, Human
cacccugugau

SEQ ID NO: 3037206 - RNA, 20 nt, Human
caccugcggugcuaucuccc

SEQ ID NO: 3037207 - RNA, 23 nt, Human
caccugcggugcuaucuccccca

SEQ ID NO: 3037208 - RNA, 20 nt, Human
caccuggaauauauaaccag

SEQ ID NO: 3037209 - RNA, 19 nt, Human
caccucugcacaagcugca

SEQ ID NO: 3037210 - RNA, 18 nt, Human
caccucugcacaagcugc

SEQ ID NO: 3037211 - RNA, 19 nt, Human
caccucucucacuccuuga

SEQ ID NO: 3037212 - RNA, 18 nt, Human
caccucucucacuccuug

SEQ ID NO: 3037213 - RNA, 17 nt, Human
caccucucucacuccuu

SEQ ID NO: 3037214 - RNA, 15 nt, Human
caccucucucacucc

SEQ ID NO: 3037215 - RNA, 14 nt, Human
caccugaagacuca

SEQ ID NO: 3037216 - RNA, 15 nt, Human
caccugaagacucau

SEQ ID NO: 3037217 - RNA, 23 nt, Human
caccugaagacucauucuucugu

SEQ ID NO: 3037218 - RNA, 23 nt, Human
caccuggccucugcacuccccug

SEQ ID NO: 3037219 - RNA, 20 nt, Human
caccuggccucugcacuccc

SEQ ID NO: 3037220 - RNA, 19 nt, Human
caccuggccucugcacucc

SEQ ID NO: 3037221 - RNA, 18 nt, Human
caccuggccucugcacuc

SEQ ID NO: 3037222 - RNA, 17 nt, Human
caccuggccucugcacu

SEQ ID NO: 3037223 - RNA, 15 nt, Human
caccuggccucugca

SEQ ID NO: 3037224 - RNA, 14 nt, Human
caccuggccucugc

SEQ ID NO: 3037225 - RNA, 13 nt, Human
caccuggccucug

SEQ ID NO: 3037226 - RNA, 12 nt, Human
caccuggccucu

SEQ ID NO: 3037227 - RNA, 21 nt, Human
caccgcagacaggaccaggga

SEQ ID NO: 3037228 - RNA, 14 nt, Human
caccgggcacucag

SEQ ID NO: 3037229 - RNA, 20 nt, Human
caccggcuggccuggccccu

SEQ ID NO: 3037230 - RNA, 18 nt, Human
caccggcuggccuggccc

SEQ ID NO: 3037231 - RNA, 17 nt, Human
caccggcuggccuggcc

SEQ ID NO: 3037232 - RNA, 14 nt, Human
caccggcuggccug

SEQ ID NO: 3037233 - RNA, 16 nt, Human
caccggcuggccuggc

SEQ ID NO: 3037234 - RNA, 15 nt, Human
caccggcuggccugg

SEQ ID NO: 3037235 - RNA, 15 nt, Human
caccgggcacucaga

SEQ ID NO: 3037236 - RNA, 22 nt, Human
caccgggcacucagaagacacu

SEQ ID NO: 3037237 - RNA, 15 nt, Human
caccgggccacagag

SEQ ID NO: 3037238 - RNA, 18 nt, Human
caccgggccacagagaaa

SEQ ID NO: 3037239 - RNA, 17 nt, Human
caccucucccuuggauu

SEQ ID NO: 3037240 - RNA, 14 nt, Human
caccucucccuugg

SEQ ID NO: 3037241 - RNA, 13 nt, Human
caccucucccuug

SEQ ID NO: 3037242 - RNA, 14 nt, Human
caccuccugccucg

SEQ ID NO: 3037243 - RNA, 13 nt, Human
caccuccugccuc

SEQ ID NO: 3037244 - RNA, 11 nt, Human
caccuccugcc

SEQ ID NO: 3037245 - RNA, 16 nt, Human
cacgccagauucuuuc

SEQ ID NO: 3037246 - RNA, 15 nt, Human
cacgcacacugucug

SEQ ID NO: 3037247 - RNA, 17 nt, Human
cacgcacuucgggaggu

SEQ ID NO: 3037248 - RNA, 16 nt, Human
cacgauuucuguuuag

SEQ ID NO: 3037249 - RNA, 12 nt, Human
cacgauuucugu

SEQ ID NO: 3037250 - RNA, 14 nt, Human
cacgauuucuguuu

SEQ ID NO: 3037251 - RNA, 18 nt, Human
cacgcccccacuggugac

SEQ ID NO: 3037252 - RNA, 17 nt, Human
cacgcccccacugguga

SEQ ID NO: 3037253 - RNA, 23 nt, Human
cacgccagauucuuuccugaggc

SEQ ID NO: 3037254 - RNA, 15 nt, Human
cacgcccccacuggu

SEQ ID NO: 3037255 - RNA, 13 nt, Human
cacgcccccacug

SEQ ID NO: 3037256 - RNA, 13 nt, Human
cacgccacugcac

SEQ ID NO: 3037257 - RNA, 15 nt, Human
cacgccacugcacua

SEQ ID NO: 3037258 - RNA, 19 nt, Human
cacgccagauucuuuccug

SEQ ID NO: 3037259 - RNA, 22 nt, Human
cacgccagauucuuuccugagg

SEQ ID NO: 3037260 - RNA, 20 nt, Human
cacgccagauucuuuccuga

SEQ ID NO: 3037261 - RNA, 15 nt, Human
caccuugacagggca

SEQ ID NO: 3037262 - RNA, 16 nt, Human
caccuugacagggcac

SEQ ID NO: 3037263 - RNA, 13 nt, Human
caccuugacaggg

SEQ ID NO: 3037264 - RNA, 17 nt, Human
cacgacugcccggcagg

SEQ ID NO: 3037265 - RNA, 16 nt, Human
cacgacugcccggcag

SEQ ID NO: 3037266 - RNA, 22 nt, Human
cacgaauauugcugauggugca

SEQ ID NO: 3037267 - RNA, 19 nt, Human
cacgaauauugcugauggu

SEQ ID NO: 3037268 - RNA, 16 nt, Human
cacgaauauugcugau

SEQ ID NO: 3037269 - RNA, 23 nt, Human
caccuuagacagucccugccaau

SEQ ID NO: 3037270 - RNA, 21 nt, Human
caccuuagacagucccugcca

SEQ ID NO: 3037271 - RNA, 19 nt, Human
caccuuagacagucccugc

SEQ ID NO: 3037272 - RNA, 18 nt, Human
caccuuagacagucccug

SEQ ID NO: 3037273 - RNA, 16 nt, Human
caccuuagacaguccc

SEQ ID NO: 3037274 - RNA, 14 nt, Human
caccuuagacaguc

SEQ ID NO: 3037275 - RNA, 20 nt, Human
cacgccuguaauccuagcac

SEQ ID NO: 3037276 - RNA, 19 nt, Human
cacgccuguaauccuagca

SEQ ID NO: 3037277 - RNA, 15 nt, Human
cacgcgugcacacac

SEQ ID NO: 3037278 - RNA, 16 nt, Human
cacgcgugcacacacc

SEQ ID NO: 3037279 - RNA, 21 nt, Human
cacgcgugcacacaccagagc

SEQ ID NO: 3037280 - RNA, 23 nt, Human
cacgcgugcacacaccagagccc

SEQ ID NO: 3037281 - RNA, 15 nt, Human
cacggcucacugcag

SEQ ID NO: 3037282 - RNA, 20 nt, Human
cacgcuggaccuugaacugg

SEQ ID NO: 3037283 - RNA, 17 nt, Human
cacgcuggaccuugaac

SEQ ID NO: 3037284 - RNA, 16 nt, Human
cacggcucacugcagc

SEQ ID NO: 3037285 - RNA, 17 nt, Human
cacggcucacugcagcc

SEQ ID NO: 3037286 - RNA, 19 nt, Human
cacggcucacugcagccuc

SEQ ID NO: 3037287 - RNA, 20 nt, Human
cacggcucacugcagccuca

SEQ ID NO: 3037288 - RNA, 18 nt, Human
cacguacacacacauaca

SEQ ID NO: 3037289 - RNA, 19 nt, Human
cacguacacacacauacac

SEQ ID NO: 3037290 - RNA, 14 nt, Human
cacguacacacaca

SEQ ID NO: 3037291 - RNA, 23 nt, Human
cacguuucuaaaggcuaccuuug

SEQ ID NO: 3037292 - RNA, 12 nt, Human
cacguuucuaaa

SEQ ID NO: 3037293 - RNA, 14 nt, Human
cacguuucuaaagg

SEQ ID NO: 3037294 - RNA, 19 nt, Human
cacgugguccuaaucuucu

SEQ ID NO: 3037295 - RNA, 16 nt, Human
cacgugguccuaaucu

SEQ ID NO: 3037296 - RNA, 13 nt, Human
cacucuauaacaa

SEQ ID NO: 3037297 - RNA, 14 nt, Human
cacucuggcagcuc

SEQ ID NO: 3037298 - RNA, 13 nt, Human
cacucuggcagcu

SEQ ID NO: 3037299 - RNA, 12 nt, Human
cacucuggcagc

SEQ ID NO: 3037300 - RNA, 12 nt, Human
cacucuccuugg

SEQ ID NO: 3037301 - RNA, 23 nt, Human
cacucugagacucgcgacaaugc

SEQ ID NO: 3037302 - RNA, 12 nt, Human
cacucugagacu

SEQ ID NO: 3037303 - RNA, 17 nt, Human
cacucccugcaaccuga

SEQ ID NO: 3037304 - RNA, 21 nt, Human
cacuccuucacagaugggugc

SEQ ID NO: 3037305 - RNA, 14 nt, Human
cacuccuucacaga

SEQ ID NO: 3037306 - RNA, 15 nt, Human
cacuccccugcuggg

SEQ ID NO: 3037307 - RNA, 12 nt, Human
cacucccugcaa

SEQ ID NO: 3037308 - RNA, 16 nt, Human
cacucccugcaaccug

SEQ ID NO: 3037309 - RNA, 13 nt, Human
cacucccugcaac

SEQ ID NO: 3037310 - RNA, 22 nt, Human
cacucauugaccugaggcccuu

SEQ ID NO: 3037311 - RNA, 20 nt, Human
cacucauugaccugaggccc

SEQ ID NO: 3037312 - RNA, 19 nt, Human
cacucauugaccugaggcc

SEQ ID NO: 3037313 - RNA, 18 nt, Human
cacucauugaccugaggc

SEQ ID NO: 3037314 - RNA, 15 nt, Human
cacucauugaccuga

SEQ ID NO: 3037315 - RNA, 16 nt, Human
cacucaguccauagca

SEQ ID NO: 3037316 - RNA, 15 nt, Human
cacuauguugcccag

SEQ ID NO: 3037317 - RNA, 16 nt, Human
cacuauguugcccagg

SEQ ID NO: 3037318 - RNA, 17 nt, Human
cacuauguugcccaggc

SEQ ID NO: 3037319 - RNA, 18 nt, Human
cacuauguugcccaggca

SEQ ID NO: 3037320 - RNA, 19 nt, Human
cacuauguugcccaggcag

SEQ ID NO: 3037321 - RNA, 14 nt, Human
cacuauagccuagg

SEQ ID NO: 3037322 - RNA, 18 nt, Human
cacuauaauguaagcucu

SEQ ID NO: 3037323 - RNA, 21 nt, Human
cacuauagccuaggugacaga

SEQ ID NO: 3037324 - RNA, 14 nt, Human
cacuauaauguaag

SEQ ID NO: 3037325 - RNA, 17 nt, Human
cacuaaggugugcucug

SEQ ID NO: 3037326 - RNA, 18 nt, Human
cacuaaggugugcucuga

SEQ ID NO: 3037327 - RNA, 18 nt, Human
cacuaaccacgcuggacc

SEQ ID NO: 3037328 - RNA, 14 nt, Human
cacuaaccacgcug

SEQ ID NO: 3037329 - RNA, 15 nt, Human
cacuaaccacgcugg

SEQ ID NO: 3037330 - RNA, 16 nt, Human
cacuaaccacgcugga

SEQ ID NO: 3037331 - RNA, 12 nt, Human
cacucagaagac

SEQ ID NO: 3037332 - RNA, 16 nt, Human
cacucagaagacacug

SEQ ID NO: 3037333 - RNA, 17 nt, Human
cacucagaagacacuga

SEQ ID NO: 3037334 - RNA, 19 nt, Human
cacucacauuuauucugcu

SEQ ID NO: 3037335 - RNA, 20 nt, Human
cacucacauuuauucugcuc

SEQ ID NO: 3037336 - RNA, 22 nt, Human
cacucagaagacacugaugggc

SEQ ID NO: 3037337 - RNA, 18 nt, Human
cacucagaagacacugau

SEQ ID NO: 3037338 - RNA, 19 nt, Human
cacucagaagacacugaug

SEQ ID NO: 3037339 - RNA, 20 nt, Human
cacuauguugcccaggcagg

SEQ ID NO: 3037340 - RNA, 21 nt, Human
cacuauguugcccaggcaggu

SEQ ID NO: 3037341 - RNA, 19 nt, Human
cacucaaaagcugggcagg

SEQ ID NO: 3037342 - RNA, 18 nt, Human
cacucaaaagcugggcag

SEQ ID NO: 3037343 - RNA, 17 nt, Human
cacucaaaagcugggca

SEQ ID NO: 3037344 - RNA, 15 nt, Human
cacucaaaagcuggg

SEQ ID NO: 3037345 - RNA, 20 nt, Human
cacucaaaagcugggcaggu

SEQ ID NO: 3037346 - RNA, 19 nt, Human
cacuucacgcccuuggcca

SEQ ID NO: 3037347 - RNA, 17 nt, Human
cacuucacgcccuuggc

SEQ ID NO: 3037348 - RNA, 21 nt, Human
cacuucacgcccuuggccaug

SEQ ID NO: 3037349 - RNA, 20 nt, Human
cacuucacgcccuuggccau

SEQ ID NO: 3037350 - RNA, 21 nt, Human
cacuucagcugacuuuucugu

SEQ ID NO: 3037351 - RNA, 12 nt, Human
cacuucagcuga

SEQ ID NO: 3037352 - RNA, 16 nt, Human
cacuucccuacaugga

SEQ ID NO: 3037353 - RNA, 23 nt, Human
cacuucgggaggucgaggcagga

SEQ ID NO: 3037354 - RNA, 21 nt, Human
cacuucgggaggucgaggcag

SEQ ID NO: 3037355 - RNA, 22 nt, Human
cacuucugccauauucuguugg

SEQ ID NO: 3037356 - RNA, 24 nt, Human
cacuugcagacucuacagaggcca

SEQ ID NO: 3037357 - RNA, 14 nt, Human
cacuugcagacucu

SEQ ID NO: 3037358 - RNA, 18 nt, Human
cacuugcagacucuacag

SEQ ID NO: 3037359 - RNA, 19 nt, Human
cacuugcagacucuacaga

SEQ ID NO: 3037360 - RNA, 22 nt, Human
cacuugcagacucuacagaggc

SEQ ID NO: 3037361 - RNA, 18 nt, Human
cacuuucuagccagagga

SEQ ID NO: 3037362 - RNA, 20 nt, Human
cacuuucuagccagaggaga

SEQ ID NO: 3037363 - RNA, 19 nt, Human
cacuuucuagccagaggag

SEQ ID NO: 3037364 - RNA, 20 nt, Human
cacuugagaauuacccuuuu

SEQ ID NO: 3037365 - RNA, 19 nt, Human
cacuugacaucaacugcau

SEQ ID NO: 3037366 - RNA, 17 nt, Human
cacuugagaauuacccu

SEQ ID NO: 3037367 - RNA, 13 nt, Human
cacuugaguccag

SEQ ID NO: 3037368 - RNA, 13 nt, Human
cacuugcagacuc

SEQ ID NO: 3037369 - RNA, 16 nt, Human
cacuugacaucaacug

SEQ ID NO: 3037370 - RNA, 18 nt, Human
cacugguuuguucccugu

SEQ ID NO: 3037371 - RNA, 16 nt, Human
cacugguuuuaaauau

SEQ ID NO: 3037372 - RNA, 15 nt, Human
cacugguuuuaaaua

SEQ ID NO: 3037373 - RNA, 13 nt, Human
cacugguuuuaaa

SEQ ID NO: 3037374 - RNA, 12 nt, Human
cacugguuuuaa

SEQ ID NO: 3037375 - RNA, 14 nt, Human
cacugguuugguuc

SEQ ID NO: 3037376 - RNA, 16 nt, Human
cacuguccuauuauau

SEQ ID NO: 3037377 - RNA, 13 nt, Human
cacugugaagaga

SEQ ID NO: 3037378 - RNA, 14 nt, Human
cacugugccaugug

SEQ ID NO: 3037379 - RNA, 22 nt, Human
cacuguucucugcccuccaaga

SEQ ID NO: 3037380 - RNA, 21 nt, Human
cacuguucucugcccuccaag

SEQ ID NO: 3037381 - RNA, 19 nt, Human
cacuguucucugcccucca

SEQ ID NO: 3037382 - RNA, 17 nt, Human
cacuguucucugcccuc

SEQ ID NO: 3037383 - RNA, 16 nt, Human
cacuguucucugcccu

SEQ ID NO: 3037384 - RNA, 15 nt, Human
cacuguucucugccc

SEQ ID NO: 3037385 - RNA, 14 nt, Human
cacuguucucugcc

SEQ ID NO: 3037386 - RNA, 13 nt, Human
cacuguucucugc

SEQ ID NO: 3037387 - RNA, 15 nt, Human
cacugugcugagucu

SEQ ID NO: 3037388 - RNA, 13 nt, Human
cacugugcugagu

SEQ ID NO: 3037389 - RNA, 18 nt, Human
cacugugccaugugccag

SEQ ID NO: 3037390 - RNA, 15 nt, Human
cacugugccaugugc

SEQ ID NO: 3037391 - RNA, 16 nt, Human
cacugugccaugugcc

SEQ ID NO: 3037392 - RNA, 22 nt, Human
cacugugcugagucugaaggcu

SEQ ID NO: 3037393 - RNA, 21 nt, Human
cacugugcugagucugaaggc

SEQ ID NO: 3037394 - RNA, 20 nt, Human
cacugugcugagucugaagg

SEQ ID NO: 3037395 - RNA, 17 nt, Human
cacugugcugagucuga

SEQ ID NO: 3037396 - RNA, 21 nt, Human
cacugcuuuuggucuguguga

SEQ ID NO: 3037397 - RNA, 17 nt, Human
cacuggaacacuaauga

SEQ ID NO: 3037398 - RNA, 16 nt, Human
cacugcuuccagugag

SEQ ID NO: 3037399 - RNA, 15 nt, Human
cacugcuuccaguga

SEQ ID NO: 3037400 - RNA, 14 nt, Human
cacugcuuccagug

SEQ ID NO: 3037401 - RNA, 13 nt, Human
cacugcuuaacuu

SEQ ID NO: 3037402 - RNA, 20 nt, Human
cacugcuuuuggucugugug

SEQ ID NO: 3037403 - RNA, 22 nt, Human
cacugcuuccagugaggcucug

SEQ ID NO: 3037404 - RNA, 21 nt, Human
cacugcuuccagugaggcucu

SEQ ID NO: 3037405 - RNA, 20 nt, Human
cacugcuuccagugaggcuc

SEQ ID NO: 3037406 - RNA, 19 nt, Human
cacugcuuccagugaggcu

SEQ ID NO: 3037407 - RNA, 18 nt, Human
cacugcuuccagugaggc

SEQ ID NO: 3037408 - RNA, 14 nt, Human
cacugcaccgggcc

SEQ ID NO: 3037409 - RNA, 15 nt, Human
cacugcaccgggcca

SEQ ID NO: 3037410 - RNA, 16 nt, Human
cacugcaccgggccac

SEQ ID NO: 3037411 - RNA, 18 nt, Human
cacugcaccgggccacag

SEQ ID NO: 3037412 - RNA, 19 nt, Human
cacugcaccgggccacaga

SEQ ID NO: 3037413 - RNA, 18 nt, Human
cacugcacuauagccuag

SEQ ID NO: 3037414 - RNA, 12 nt, Human
cacugcucuggu

SEQ ID NO: 3037415 - RNA, 23 nt, Human
cacugagacagcccgggcucugc

SEQ ID NO: 3037416 - RNA, 14 nt, Human
cacugaugggcaac

SEQ ID NO: 3037417 - RNA, 18 nt, Human
cacugaugggcaaccccc

SEQ ID NO: 3037418 - RNA, 24 nt, Human
cacugaugggcaacccccagccug

SEQ ID NO: 3037419 - RNA, 14 nt, Human
cacugcaaccuccg

SEQ ID NO: 3037420 - RNA, 16 nt, Human
cacugcaaccuccgcc

SEQ ID NO: 3037421 - RNA, 23 nt, Human
cacugcaaccuccgccucuuggg

SEQ ID NO: 3037422 - RNA, 13 nt, Human
cacugcaaccucc

SEQ ID NO: 3037423 - RNA, 23 nt, Human
cacucuggcagcucagagagggu

SEQ ID NO: 3037424 - RNA, 21 nt, Human
cacucuggcagcucagagagg

SEQ ID NO: 3037425 - RNA, 20 nt, Human
cacucuggcagcucagagag

SEQ ID NO: 3037426 - RNA, 19 nt, Human
cacucuggcagcucagaga

SEQ ID NO: 3037427 - RNA, 17 nt, Human
cacucuggcagcucaga

SEQ ID NO: 3037428 - RNA, 16 nt, Human
cacucuggcagcucag

SEQ ID NO: 3037429 - RNA, 15 nt, Human
cacucuggcagcuca

SEQ ID NO: 3037430 - RNA, 15 nt, Human
cacucugucgcccag

SEQ ID NO: 3037431 - RNA, 16 nt, Human
cacucugucgcccagu

SEQ ID NO: 3037432 - RNA, 19 nt, Human
cacucugucgcccagucug

SEQ ID NO: 3037433 - RNA, 23 nt, Human
cacugacauuguuggccaaagcc

SEQ ID NO: 3037434 - RNA, 13 nt, Human
cacugagacagcc

SEQ ID NO: 3037435 - RNA, 12 nt, Human
cacugagacagc

SEQ ID NO: 3037436 - RNA, 22 nt, Human
cacugagacagcccgggcucug

SEQ ID NO: 3037437 - RNA, 19 nt, Human
cacugagacagcccgggcu

SEQ ID NO: 3037438 - RNA, 17 nt, Human
cacugagacagcccggg

SEQ ID NO: 3037439 - RNA, 14 nt, Human
cacugagacagccc

SEQ ID NO: 3037440 - RNA, 12 nt, Human
cuagccagagga

SEQ ID NO: 3037441 - RNA, 19 nt, Human
cuaggccuggccagaugca

SEQ ID NO: 3037442 - RNA, 12 nt, Human
cauuuggugguu

SEQ ID NO: 3037443 - RNA, 15 nt, Human
caguaaaugggggug

SEQ ID NO: 3037444 - RNA, 17 nt, Human
cagcccugcagagggca

SEQ ID NO: 3037445 - RNA, 15 nt, Human
caauaccucgagcca

SEQ ID NO: 3037446 - RNA, 20 nt, Human
caguuaagagaaaugagcuu

SEQ ID NO: 3037447 - RNA, 11 nt, Human
caguggugguu

SEQ ID NO: 3037448 - RNA, 20 nt, Human
cagagggagugacagaggca

SEQ ID NO: 3037449 - RNA, 16 nt, Human
cccuuggugcccuccu

SEQ ID NO: 3037450 - RNA, 17 nt, Human
cagacucuacagaggcc

SEQ ID NO: 3037451 - RNA, 18 nt, Human
ucuagaccaggaccuccc

SEQ ID NO: 3037452 - RNA, 14 nt, Human
gugcuuggaggaag

SEQ ID NO: 3037453 - RNA, 14 nt, Human
uucuucaaccagca

SEQ ID NO: 3037454 - RNA, 19 nt, Human
uggaacacuaaugaggaaa

SEQ ID NO: 3037455 - RNA, 19 nt, Human
ugccuccuuugugaggaag

SEQ ID NO: 3037456 - RNA, 15 nt, Human
aagagaaaugagcug

SEQ ID NO: 3037457 - RNA, 22 nt, Human
cuugaccgugaggccagagaca

SEQ ID NO: 3037458 - RNA, 16 nt, Human
ugcacaaacagaggcc

SEQ ID NO: 3037459 - RNA, 19 nt, Human
ccggagaggccucgaccca

SEQ ID NO: 3037460 - RNA, 16 nt, Human
uugcuaagugaggaug

SEQ ID NO: 3037461 - RNA, 23 nt, Human
uguggcgcagcauauucaggaag

SEQ ID NO: 3037462 - RNA, 14 nt, Japanese encephalitis virus
ugcggcccaagccc

SEQ ID NO: 3037463 - RNA, 20 nt, Japanese encephalitis virus
aucucaacaucagcuacuag

SEQ ID NO: 3037464 - RNA, 17 nt, Japanese encephalitis virus
aggccagcaaaagcugc

SEQ ID NO: 3037465 - RNA, 21 nt, Japanese encephalitis virus
uugagcccccacggcccaagc

SEQ ID NO: 3037466 - RNA, 23 nt, Japanese encephalitis virus
cgucucagucccaggaggacugg

SEQ ID NO: 3037467 - RNA, 16 nt, Japanese encephalitis virus
gccccaggaggacugg

SEQ ID NO: 3037468 - RNA, 23 nt, Japanese encephalitis virus
ugcggccugcgcagccccaggag

SEQ ID NO: 3037469 - RNA, 18 nt, Japanese encephalitis virus
ugcgcagccccaggagga

SEQ ID NO: 3037470 - RNA, 21 nt, Japanese encephalitis virus
ugcggccugcgcagccccagg

SEQ ID NO: 3037471 - RNA, 16 nt, Japanese encephalitis virus
aggaagaacacaggau

SEQ ID NO: 3037472 - RNA, 23 nt, Japanese encephalitis virus
cgagguguaaggacuagagguua

SEQ ID NO: 3037473 - RNA, 17 nt, Japanese encephalitis virus
gccugcgcagccccagg

SEQ ID NO: 3037474 - RNA, 16 nt, Japanese encephalitis virus
aaugcaugcauaugga

SEQ ID NO: 3037475 - RNA, 13 nt, Japanese encephalitis virus
cgcagccccagga

SEQ ID NO: 3037476 - RNA, 17 nt, Japanese encephalitis virus
ccacggcccaagccucg

SEQ ID NO: 3037477 - RNA, 13 nt, Japanese encephalitis virus
uagagguuagagg

SEQ ID NO: 3037478 - RNA, 19 nt, Japanese encephalitis virus
gucugcgucucagucccag

SEQ ID NO: 3037479 - RNA, 18 nt, Japanese encephalitis virus
gacuggguuaccaaagcc

SEQ ID NO: 3037480 - RNA, 16 nt, Japanese encephalitis virus
ucucagucccaggagg

SEQ ID NO: 3037481 - RNA, 18 nt, Japanese encephalitis virus
caacaauaugcggcccaa

SEQ ID NO: 3037482 - RNA, 20 nt, Japanese encephalitis virus
gaggagaccccgcauuugca

SEQ ID NO: 3037483 - RNA, 22 nt, Japanese encephalitis virus
ugcgucucagucccaggaggac

SEQ ID NO: 3037484 - RNA, 22 nt, Japanese encephalitis virus
auugacaccugggaauagacug

SEQ ID NO: 3037485 - RNA, 18 nt, Japanese encephalitis virus
gcgucucagucccaggag

SEQ ID NO: 3037486 - RNA, 18 nt, Japanese encephalitis virus
acuagagguuagaggaga

SEQ ID NO: 3037487 - RNA, 17 nt, Japanese encephalitis virus
agagcgccgaaguaugu

SEQ ID NO: 3037488 - RNA, 19 nt, Japanese encephalitis virus
guggaaggacuagagguua

SEQ ID NO: 3037489 - RNA, 21 nt, Japanese encephalitis virus
ugcgucucagucccaggagga

SEQ ID NO: 3037490 - RNA, 16 nt, Japanese encephalitis virus
uaaaugagaaaaugca

SEQ ID NO: 3037491 - RNA, 16 nt, Japanese encephalitis virus
gauuuaaaguagaaaa

SEQ ID NO: 3037492 - RNA, 11 nt, Japanese encephalitis virus
uugugccaccc

SEQ ID NO: 3037493 - RNA, 18 nt, Japanese encephalitis virus
uuaaaguagaaaaguaga

SEQ ID NO: 3037494 - RNA, 14 nt, Japanese encephalitis virus
uaugcggcccaagc

SEQ ID NO: 3037495 - RNA, 13 nt, Japanese encephalitis virus
aggcacagagcgc

SEQ ID NO: 3037496 - RNA, 16 nt, Japanese encephalitis virus
ccccgcauuugcauca

SEQ ID NO: 3037497 - RNA, 22 nt, Japanese encephalitis virus
ugagcccccacggcccaagccu

SEQ ID NO: 3037498 - RNA, 14 nt, Japanese encephalitis virus
gucucagucccagg

SEQ ID NO: 3037499 - RNA, 18 nt, Japanese encephalitis virus
cugucugcgucucagucc

SEQ ID NO: 3037500 - RNA, 19 nt, Japanese encephalitis virus
cccucgaagcuguagagga

SEQ ID NO: 3037501 - RNA, 20 nt, Japanese encephalitis virus
agcaaaagcugccaccggau

SEQ ID NO: 3037502 - RNA, 19 nt, Japanese encephalitis virus
cugggaauagacugggaga

SEQ ID NO: 3037503 - RNA, 19 nt, Japanese encephalitis virus
agucccaggaggacugggu

SEQ ID NO: 3037504 - RNA, 12 nt, Japanese encephalitis virus
guuaccaaagcc

SEQ ID NO: 3037505 - RNA, 19 nt, Japanese encephalitis virus
caucagcuacuaggcacag

SEQ ID NO: 3037506 - RNA, 14 nt, Japanese encephalitis virus
aggagguggaagga

SEQ ID NO: 3037507 - RNA, 22 nt, Japanese encephalitis virus
uugaaagaccaacgucaggcca

SEQ ID NO: 3037508 - RNA, 13 nt, Japanese encephalitis virus
agaaagugagaaa

SEQ ID NO: 3037509 - RNA, 12 nt, Japanese encephalitis virus
cucacuggaagu

SEQ ID NO: 3037510 - RNA, 13 nt, Japanese encephalitis virus
cucagucccagga

SEQ ID NO: 3037511 - RNA, 21 nt, Japanese encephalitis virus
ucagaaccgucucggaaguag

SEQ ID NO: 3037512 - RNA, 21 nt, Japanese encephalitis virus
aggagguggaaggacuagagg

SEQ ID NO: 3037513 - RNA, 19 nt, Japanese encephalitis virus
agcugguggugaggaagaa

SEQ ID NO: 3037514 - RNA, 13 nt, Japanese encephalitis virus
agccccaggagga

SEQ ID NO: 3037515 - RNA, 19 nt, Japanese encephalitis virus
aggccacaaauuugugcca

SEQ ID NO: 3037516 - RNA, 23 nt, Japanese encephalitis virus
ucaggccacaaauuugugccacc

SEQ ID NO: 3037517 - RNA, 11 nt, Japanese encephalitis virus
gagaccccgca

SEQ ID NO: 3037518 - RNA, 17 nt, Japanese encephalitis virus
cuaggaugcaauagacg

SEQ ID NO: 3037519 - RNA, 18 nt, Japanese encephalitis virus
gccaccggauacugggua

SEQ ID NO: 3037520 - RNA, 18 nt, Japanese encephalitis virus
agguguaaggacuagagg

SEQ ID NO: 3037521 - RNA, 18 nt, Japanese encephalitis virus
aaguugaaagaccaacgu

SEQ ID NO: 3037522 - RNA, 14 nt, Japanese encephalitis virus
guagcuggugguga

SEQ ID NO: 3037523 - RNA, 21 nt, Japanese encephalitis virus
caccugggaauagacugggag

SEQ ID NO: 3037524 - RNA, 15 nt, Japanese encephalitis virus
gaggagguggaagga

SEQ ID NO: 3037525 - RNA, 13 nt, Japanese encephalitis virus
caacgucaggcca

SEQ ID NO: 3037526 - RNA, 21 nt, Japanese encephalitis virus
uaucucaacaucagcuacuag

SEQ ID NO: 3037527 - RNA, 19 nt, Japanese encephalitis virus
ugcgcagccccaggaggac

SEQ ID NO: 3037528 - RNA, 17 nt, Japanese encephalitis virus
ucccugcucacuggaag

SEQ ID NO: 3037529 - RNA, 16 nt, Japanese encephalitis virus
gguggaaggacuagag

SEQ ID NO: 3037530 - RNA, 13 nt, Japanese encephalitis virus
cacggcccaagcc

SEQ ID NO: 3037531 - RNA, 14 nt, Japanese encephalitis virus
aggaagaacacagg

SEQ ID NO: 3037532 - RNA, 16 nt, Japanese encephalitis virus
agcaaaagcugccacc

SEQ ID NO: 3037533 - RNA, 20 nt, Japanese encephalitis virus
uaggaugcaauagacgaggu

SEQ ID NO: 3037534 - RNA, 20 nt, Japanese encephalitis virus
acuggguagacggugcuguc

SEQ ID NO: 3037535 - RNA, 14 nt, Japanese encephalitis virus
ccugcgcagcccca

SEQ ID NO: 3037536 - RNA, 13 nt, Japanese encephalitis virus
cagccccaggagg

SEQ ID NO: 3037537 - RNA, 12 nt, Japanese encephalitis virus
uuugugccaccc

SEQ ID NO: 3037538 - RNA, 19 nt, Japanese encephalitis virus
agaggagguggaaggacua

SEQ ID NO: 3037539 - RNA, 20 nt, Japanese encephalitis virus
caauagacgagguguaagga

SEQ ID NO: 3037540 - RNA, 22 nt, Japanese encephalitis virus
gugccaccccgcuagggggugc

SEQ ID NO: 3037541 - RNA, 22 nt, Japanese encephalitis virus
uugacaccugggaauagacugg

SEQ ID NO: 3037542 - RNA, 18 nt, Japanese encephalitis virus
ugcggcccaagcccccuc

SEQ ID NO: 3037543 - RNA, 15 nt, Japanese encephalitis virus
ugagcccccacggcc

SEQ ID NO: 3037544 - RNA, 18 nt, Japanese encephalitis virus
caccggauacuggguaga

SEQ ID NO: 3037545 - RNA, 20 nt, Japanese encephalitis virus
gucucggaaguaggucccug

SEQ ID NO: 3037546 - RNA, 17 nt, Japanese encephalitis virus
gaccaacgucaggccac

SEQ ID NO: 3037547 - RNA, 20 nt, Japanese encephalitis virus
aggccagcaaaagcugccac

SEQ ID NO: 3037548 - RNA, 13 nt, Japanese encephalitis virus
agucccaggagga

SEQ ID NO: 3037549 - RNA, 20 nt, Japanese encephalitis virus
cggccugcgcagccccagga

SEQ ID NO: 3037550 - RNA, 21 nt, Japanese encephalitis virus
aguugaaagaccaacgucagg

SEQ ID NO: 3037551 - RNA, 14 nt, Japanese encephalitis virus
cucgucuaggaugc

SEQ ID NO: 3037552 - RNA, 15 nt, Japanese encephalitis virus
cucagucccaggagg

SEQ ID NO: 3037553 - RNA, 20 nt, Japanese encephalitis virus
caagccucgucuaggaugca

SEQ ID NO: 3037554 - RNA, 19 nt, Japanese encephalitis virus
ggugaggaagaacacagga

SEQ ID NO: 3037555 - RNA, 13 nt, Japanese encephalitis virus
gcagccccaggag

SEQ ID NO: 3037556 - RNA, 16 nt, Japanese encephalitis virus
cugggaauagacuggg

SEQ ID NO: 3037557 - RNA, 19 nt, Japanese encephalitis virus
ccgucucggaaguaggucc

SEQ ID NO: 3037558 - RNA, 15 nt, Japanese encephalitis virus
ucagucccaggagga

SEQ ID NO: 3037559 - RNA, 23 nt, Japanese encephalitis virus
uacuggguagacggugcugucug

SEQ ID NO: 3037560 - RNA, 11 nt, Japanese encephalitis virus
gcggcccaagc

SEQ ID NO: 3037561 - RNA, 19 nt, Japanese encephalitis virus
cagucccaggaggacuggg

SEQ ID NO: 3037562 - RNA, 19 nt, Japanese encephalitis virus
gcgucucagucccaggagg

SEQ ID NO: 3037563 - RNA, 17 nt, Japanese encephalitis virus
gucucagucccaggagg

SEQ ID NO: 3037564 - RNA, 14 nt, Japanese encephalitis virus
cagccccaggagga

SEQ ID NO: 3037565 - RNA, 21 nt, Japanese encephalitis virus
ucuaucucaacaucagcuacu

SEQ ID NO: 3037566 - RNA, 15 nt, Japanese encephalitis virus
agcuguagaggaggu

SEQ ID NO: 3037567 - RNA, 15 nt, Japanese encephalitis virus
cgcagccccaggagg

SEQ ID NO: 3037568 - RNA, 20 nt, Japanese encephalitis virus
cugcgucucagucccaggag

SEQ ID NO: 3037569 - RNA, 19 nt, Japanese encephalitis virus
gagguuagaggagaccccg

SEQ ID NO: 3037570 - RNA, 20 nt, Japanese encephalitis virus
cugcgcagccccaggaggac

SEQ ID NO: 3037571 - RNA, 14 nt, Japanese encephalitis virus
agguguaaggacua

SEQ ID NO: 3037572 - RNA, 17 nt, Japanese encephalitis virus
cuagagguuagaggaga

SEQ ID NO: 3037573 - RNA, 12 nt, Japanese encephalitis virus
agucaggccagc

SEQ ID NO: 3037574 - RNA, 19 nt, Japanese encephalitis virus
cagccccaggaggacuggg

SEQ ID NO: 3037575 - RNA, 14 nt, Japanese encephalitis virus
caggaggacugggu

SEQ ID NO: 3037576 - RNA, 15 nt, Japanese encephalitis virus
uugcaucaaacagca

SEQ ID NO: 3037577 - RNA, 17 nt, Japanese encephalitis virus
agccccaggaggacugg

SEQ ID NO: 3037578 - RNA, 12 nt, Japanese encephalitis virus
gucaggccagca

SEQ ID NO: 3037579 - RNA, 14 nt, Japanese encephalitis virus
ccaggaggacuggg

SEQ ID NO: 3037580 - RNA, 20 nt, Japanese encephalitis virus
aggccacaaauuugugccac

SEQ ID NO: 3037581 - RNA, 16 nt, Japanese encephalitis virus
ggagguggaaggacua

SEQ ID NO: 3037582 - RNA, 15 nt, Japanese encephalitis virus
cugcgcagccccagg

SEQ ID NO: 3037583 - RNA, 14 nt, Japanese encephalitis virus
cggcccaagccccc

SEQ ID NO: 3037584 - RNA, 13 nt, Japanese encephalitis virus
ccugcgcagcccc

SEQ ID NO: 3037585 - RNA, 23 nt, Japanese encephalitis virus
aaggacuagagguuagaggagac

SEQ ID NO: 3037586 - RNA, 19 nt, Japanese encephalitis virus
gccagcaaaagcugccacc

SEQ ID NO: 3037587 - RNA, 18 nt, Japanese encephalitis virus
cuagagguuagaggagac

SEQ ID NO: 3037588 - RNA, 16 nt, Japanese encephalitis virus
gguguaaggacuagag

SEQ ID NO: 3037589 - RNA, 14 nt, Japanese encephalitis virus
ucagucccaggagg

SEQ ID NO: 3037590 - RNA, 21 nt, Japanese encephalitis virus
ucaggccagcaaaagcugcca

SEQ ID NO: 3037591 - RNA, 11 nt, Japanese encephalitis virus
agucccaggag

SEQ ID NO: 3037592 - RNA, 20 nt, Japanese encephalitis virus
cgagguguaaggacuagagg

SEQ ID NO: 3037593 - RNA, 22 nt, Japanese encephalitis virus
cgccgaaguauguagcuggugg

SEQ ID NO: 3037594 - RNA, 13 nt, Japanese encephalitis virus
aggaggacugggu

SEQ ID NO: 3037595 - RNA, 24 nt, Japanese encephalitis virus
gaugcaauagacgagguguaagga

SEQ ID NO: 3037596 - RNA, 15 nt, Japanese encephalitis virus
ccugcgcagccccag

SEQ ID NO: 3037597 - RNA, 19 nt, Japanese encephalitis virus
ccagcaaaagcugccaccg

SEQ ID NO: 3037598 - RNA, 16 nt, Japanese encephalitis virus
caacgucaggccacaa

SEQ ID NO: 3037599 - RNA, 18 nt, Japanese encephalitis virus
gaccaacgucaggccaca

SEQ ID NO: 3037600 - RNA, 16 nt, Japanese encephalitis virus
cgucucagucccagga

SEQ ID NO: 3037601 - RNA, 17 nt, Japanese encephalitis virus
gugcggccugcgcagcc

SEQ ID NO: 3037602 - RNA, 16 nt, Japanese encephalitis virus
caccggauacugggua

SEQ ID NO: 3037603 - RNA, 19 nt, Japanese encephalitis virus
ugcauauggagucaggcca

SEQ ID NO: 3037604 - RNA, 20 nt, Japanese encephalitis virus
aaguagaaaaguagacuaug

SEQ ID NO: 3037605 - RNA, 22 nt, Japanese encephalitis virus
ccaagcccccucgaagcuguag

SEQ ID NO: 3037606 - RNA, 24 nt, Japanese encephalitis virus
cugcgcagccccaggaggacuggg

SEQ ID NO: 3037607 - RNA, 23 nt, Japanese encephalitis virus
gcccccacggcccaagccucguc

SEQ ID NO: 3037608 - RNA, 15 nt, Japanese encephalitis virus
ucucagucccaggag

SEQ ID NO: 3037609 - RNA, 21 nt, Japanese encephalitis virus
cuagagguuagaggagacccc

SEQ ID NO: 3037610 - RNA, 18 nt, Japanese encephalitis virus
uuuaaaguagaaaaguag

SEQ ID NO: 3037611 - RNA, 21 nt, Japanese encephalitis virus
cagucccaggaggacuggguu

SEQ ID NO: 3037612 - RNA, 20 nt, Japanese encephalitis virus
gccgaaguauguagcuggug

SEQ ID NO: 3037613 - RNA, 22 nt, Japanese encephalitis virus
guuagaggagaccccguggaaa

SEQ ID NO: 3037614 - RNA, 23 nt, Japanese encephalitis virus
ccacaaauuugugccaccccgcu

SEQ ID NO: 3037615 - RNA, 22 nt, Japanese encephalitis virus
ugaaagaccaacgucaggccac

SEQ ID NO: 3037616 - RNA, 17 nt, Japanese encephalitis virus
caacaauaugcggccca

SEQ ID NO: 3037617 - RNA, 19 nt, Japanese encephalitis virus
accugggaauagacuggga

SEQ ID NO: 3037618 - RNA, 20 nt, Japanese encephalitis virus
aggagaccccgcauuugcau

SEQ ID NO: 3037619 - RNA, 15 nt, Japanese encephalitis virus
aaggacuagagguua

SEQ ID NO: 3037620 - RNA, 21 nt, Japanese encephalitis virus
ucaggccacaaauuugugcca

SEQ ID NO: 3037621 - RNA, 13 nt, Japanese encephalitis virus
gcccaagcccccu

SEQ ID NO: 3037622 - RNA, 14 nt, Japanese encephalitis virus
caacgucaggccac

SEQ ID NO: 3037623 - RNA, 13 nt, Japanese encephalitis virus
agagguuagagga

SEQ ID NO: 3037624 - RNA, 16 nt, Japanese encephalitis virus
agacgagguguaagga

SEQ ID NO: 3037625 - RNA, 22 nt, Japanese encephalitis virus
ggacuagagguuagaggagacc

SEQ ID NO: 3037626 - RNA, 15 nt, Japanese encephalitis virus
gcagccccaggagga

SEQ ID NO: 3037627 - RNA, 18 nt, Japanese encephalitis virus
ggggugcggccugcgcag

SEQ ID NO: 3037628 - RNA, 14 nt, Japanese encephalitis virus
gcagccccaggagg

SEQ ID NO: 3037629 - RNA, 19 nt, Japanese encephalitis virus
ugcgucucagucccaggag

SEQ ID NO: 3037630 - RNA, 18 nt, Japanese encephalitis virus
gccugcgcagccccagga

SEQ ID NO: 3037631 - RNA, 22 nt, Japanese encephalitis virus
acugggagaucuucugcucuau

SEQ ID NO: 3037632 - RNA, 23 nt, Japanese encephalitis virus
guugagcccccacggcccaagcc

SEQ ID NO: 3037633 - RNA, 15 nt, Japanese encephalitis virus
cagucccaggaggac

SEQ ID NO: 3037634 - RNA, 19 nt, Japanese encephalitis virus
aggacuggguuaccaaagc

SEQ ID NO: 3037635 - RNA, 11 nt, Japanese encephalitis virus
agccccaggag

SEQ ID NO: 3037636 - RNA, 16 nt, Japanese encephalitis virus
cgcagccccaggagga

SEQ ID NO: 3037637 - RNA, 22 nt, Japanese encephalitis virus
acaccugggaauagacugggag

SEQ ID NO: 3037638 - RNA, 13 nt, Japanese encephalitis virus
gaggacuggguua

SEQ ID NO: 3037639 - RNA, 14 nt, Japanese encephalitis virus
uggagucaggccag

SEQ ID NO: 3037640 - RNA, 15 nt, Japanese encephalitis virus
guagaaaaguagacu

SEQ ID NO: 3037641 - RNA, 12 nt, Japanese encephalitis virus
gagucaggccag

SEQ ID NO: 3037642 - RNA, 13 nt, Japanese encephalitis virus
ccaggaggacugg

SEQ ID NO: 3037643 - RNA, 20 nt, Japanese encephalitis virus
gccccaggaggacuggguua

SEQ ID NO: 3037644 - RNA, 20 nt, Japanese encephalitis virus
gagucaggccagcaaaagcu

SEQ ID NO: 3037645 - RNA, 15 nt, Japanese encephalitis virus
ccccaggaggacugg

SEQ ID NO: 3037646 - RNA, 22 nt, Japanese encephalitis virus
agaaagugagaaagcccucaga

SEQ ID NO: 3037647 - RNA, 14 nt, Japanese encephalitis virus
ccaacgucaggcca

SEQ ID NO: 3037648 - RNA, 21 nt, Japanese encephalitis virus
cagccccaggaggacuggguu

SEQ ID NO: 3037649 - RNA, 15 nt, Japanese encephalitis virus
auuugcaucaaacag

SEQ ID NO: 3037650 - RNA, 15 nt, Japanese encephalitis virus
gagaaaaugcaugca

SEQ ID NO: 3037651 - RNA, 17 nt, Japanese encephalitis virus
gcuacuaggcacagagc

SEQ ID NO: 3037652 - RNA, 17 nt, Japanese encephalitis virus
caacgucaggccacaaa

SEQ ID NO: 3037653 - RNA, 22 nt, Japanese encephalitis virus
guugagcccccacggcccaagc

SEQ ID NO: 3037654 - RNA, 22 nt, Japanese encephalitis virus
cagcauauugacaccugggaau

SEQ ID NO: 3037655 - RNA, 21 nt, Japanese encephalitis virus
cagcauauugacaccugggaa

SEQ ID NO: 3037656 - RNA, 18 nt, Japanese encephalitis virus
gacaccugggaauagacu

SEQ ID NO: 3037657 - RNA, 16 nt, Japanese encephalitis virus
uugagcccccacggcc

SEQ ID NO: 3037658 - RNA, 16 nt, Japanese encephalitis virus
ugcgcagccccaggag

SEQ ID NO: 3037659 - RNA, 19 nt, Japanese encephalitis virus
gccacaaauuugugccacc

SEQ ID NO: 3037660 - RNA, 12 nt, Japanese encephalitis virus
agccccaggagg

SEQ ID NO: 3037661 - RNA, 17 nt, Japanese encephalitis virus
agucccaggaggacugg

SEQ ID NO: 3037662 - RNA, 15 nt, Japanese encephalitis virus
aggagguggaaggac

SEQ ID NO: 3037663 - RNA, 19 nt, Japanese encephalitis virus
auguagcugguggugagga

SEQ ID NO: 3037664 - RNA, 15 nt, Japanese encephalitis virus
caggaggacuggguu

SEQ ID NO: 3037665 - RNA, 20 nt, Japanese encephalitis virus
cccaagccucgucuaggaug

SEQ ID NO: 3037666 - RNA, 19 nt, Japanese encephalitis virus
cagaaagugagaaagcccu

SEQ ID NO: 3037667 - RNA, 19 nt, Japanese encephalitis virus
ccugggaauagacugggag

SEQ ID NO: 3037668 - RNA, 17 nt, Japanese encephalitis virus
auaauguaaaugagaaa

SEQ ID NO: 3037669 - RNA, 14 nt, Japanese encephalitis virus
aggagaccccgcau

SEQ ID NO: 3037670 - RNA, 18 nt, Japanese encephalitis virus
ugcaucaaacagcauauu

SEQ ID NO: 3037671 - RNA, 19 nt, Japanese encephalitis virus
agucaggccagcaaaagcu

SEQ ID NO: 3037672 - RNA, 20 nt, Japanese encephalitis virus
ggacuagagguuagaggaga

SEQ ID NO: 3037673 - RNA, 17 nt, Japanese encephalitis virus
ugcgucucagucccagg

SEQ ID NO: 3037674 - RNA, 22 nt, Japanese encephalitis virus
uaccaaagccguugagccccca

SEQ ID NO: 3037675 - RNA, 16 nt, Japanese encephalitis virus
gcgcagccccaggagg

SEQ ID NO: 3037676 - RNA, 17 nt, Japanese encephalitis virus
cccucgaagcuguagag

SEQ ID NO: 3037677 - RNA, 13 nt, Japanese encephalitis virus
cagucccaggagg

SEQ ID NO: 3037678 - RNA, 23 nt, Japanese encephalitis virus
ucaggccagcaaaagcugccacc

SEQ ID NO: 3037679 - RNA, 18 nt, Japanese encephalitis virus
caauaugcggcccaagcc

SEQ ID NO: 3037680 - RNA, 14 nt, Japanese encephalitis virus
augagaaaaugcau

SEQ ID NO: 3037681 - RNA, 19 nt, Japanese encephalitis virus
guaaauaauguaaaugaga

SEQ ID NO: 3037682 - RNA, 22 nt, Japanese encephalitis virus
ugcgcagccccaggaggacugg

SEQ ID NO: 3037683 - RNA, 13 nt, Japanese encephalitis virus
cugggaauagacu

SEQ ID NO: 3037684 - RNA, 19 nt, Japanese encephalitis virus
agccguugagcccccacgg

SEQ ID NO: 3037685 - RNA, 24 nt, Japanese encephalitis virus
aaaaguagacuauguaaauaaugu

SEQ ID NO: 3037686 - RNA, 20 nt, Japanese encephalitis virus
agcugguggugaggaagaac

SEQ ID NO: 3037687 - RNA, 22 nt, Japanese encephalitis virus
aggacuagagguuagaggagac

SEQ ID NO: 3037688 - RNA, 13 nt, Japanese encephalitis virus
ugcggcccaagcc

SEQ ID NO: 3037689 - RNA, 12 nt, Japanese encephalitis virus
gucccaggagga

SEQ ID NO: 3037690 - RNA, 15 nt, Japanese encephalitis virus
aagcuguagaggagg

SEQ ID NO: 3037691 - RNA, 14 nt, Japanese encephalitis virus
cucagucccaggag

SEQ ID NO: 3037692 - RNA, 16 nt, Japanese encephalitis virus
cgagguguaaggacua

SEQ ID NO: 3037693 - RNA, 13 nt, Japanese encephalitis virus
uggagucaggcca

SEQ ID NO: 3037694 - RNA, 18 nt, Japanese encephalitis virus
cagaaccgucucggaagu

SEQ ID NO: 3037695 - RNA, 16 nt, Japanese encephalitis virus
gcaaaagcugccaccg

SEQ ID NO: 3037696 - RNA, 18 nt, Japanese encephalitis virus
gcauauggagucaggcca

SEQ ID NO: 3037697 - RNA, 16 nt, Japanese encephalitis virus
agagguuagaggagac

SEQ ID NO: 3037698 - RNA, 22 nt, Japanese encephalitis virus
cugccaccggauacuggguaga

SEQ ID NO: 3037699 - RNA, 22 nt, Japanese encephalitis virus
aucuucugcucuaucucaacau

SEQ ID NO: 3037700 - RNA, 22 nt, Japanese encephalitis virus
uuaccaaagccguugagccccc

SEQ ID NO: 3037701 - RNA, 16 nt, Japanese encephalitis virus
gucccaggaggacugg

SEQ ID NO: 3037702 - RNA, 14 nt, Japanese encephalitis virus
agcuguagaggagg

SEQ ID NO: 3037703 - RNA, 18 nt, Japanese encephalitis virus
accugggaauagacuggg

SEQ ID NO: 3037704 - RNA, 20 nt, Japanese encephalitis virus
cucagucccaggaggacugg

SEQ ID NO: 3037705 - RNA, 17 nt, Japanese encephalitis virus
guaaggacuagagguua

SEQ ID NO: 3037706 - RNA, 23 nt, Japanese encephalitis virus
gugauuuaaaguagaaaaguaga

SEQ ID NO: 3037707 - RNA, 19 nt, Japanese encephalitis virus
aggccagcaaaagcugcca

SEQ ID NO: 3037708 - RNA, 14 nt, Japanese encephalitis virus
gucucggaaguagg

SEQ ID NO: 3037709 - RNA, 18 nt, Japanese encephalitis virus
agguggaaggacuagagg

SEQ ID NO: 3037710 - RNA, 14 nt, Japanese encephalitis virus
ggaugcaauagacg

SEQ ID NO: 3037711 - RNA, 12 nt, Japanese encephalitis virus
caggccagcaaa

SEQ ID NO: 3037712 - RNA, 17 nt, Japanese encephalitis virus
gacugggagaucuucug

SEQ ID NO: 3037713 - RNA, 13 nt, Japanese encephalitis virus
ggucccugcucac

SEQ ID NO: 3037714 - RNA, 16 nt, Japanese encephalitis virus
cucagucccaggagga

SEQ ID NO: 3037715 - RNA, 12 nt, Japanese encephalitis virus
cagccccaggag

SEQ ID NO: 3037716 - RNA, 19 nt, Japanese encephalitis virus
acugggagaucuucugcuc

SEQ ID NO: 3037717 - RNA, 20 nt, Japanese encephalitis virus
uguagcugguggugaggaag

SEQ ID NO: 3037718 - RNA, 20 nt, Japanese encephalitis virus
uaucucaacaucagcuacua

SEQ ID NO: 3037719 - RNA, 21 nt, Japanese encephalitis virus
cgcagccccaggaggacuggg

SEQ ID NO: 3037720 - RNA, 14 nt, Japanese encephalitis virus
ccaggaggacuggg

SEQ ID NO: 3037721 - RNA, 15 nt, Human
cuccccuaaugccug

SEQ ID NO: 3037722 - RNA, 16 nt, Human
cuccccuaaugccugc

SEQ ID NO: 3037723 - RNA, 14 nt, Human
cgggcugggcagcu

SEQ ID NO: 3037724 - RNA, 15 nt, Human
cgggcugggcagcug

SEQ ID NO: 3037725 - RNA, 16 nt, Human
cgggcugggcagcugu

SEQ ID NO: 3037726 - RNA, 17 nt, Human
cgggcugggcagcuguu

SEQ ID NO: 3037727 - RNA, 20 nt, Human
cguucaccccuccacccuug

SEQ ID NO: 3037728 - RNA, 15 nt, Human
cguucaccccuccac

SEQ ID NO: 3037729 - RNA, 17 nt, Human
cuaaaguagacuucauu

SEQ ID NO: 3037730 - RNA, 21 nt, Human
ccuguuaccuaauuagagcag

SEQ ID NO: 3037731 - RNA, 22 nt, Human
ccuguuaccuaauuagagcaga

SEQ ID NO: 3037732 - RNA, 23 nt, Human
ccuguuaccuaauuagagcagau

SEQ ID NO: 3037733 - RNA, 21 nt, Human
ccuugcgcuuuugcuggucac

SEQ ID NO: 3037734 - RNA, 13 nt, Human
ccuccccaggccg

SEQ ID NO: 3037735 - RNA, 18 nt, Human
ccagacgcacgugggucu

SEQ ID NO: 3037736 - RNA, 23 nt, Human
ccagacgcacgugggucuucagg

SEQ ID NO: 3037737 - RNA, 17 nt, Human
caggccguggcugccca

SEQ ID NO: 3037738 - RNA, 19 nt, Human
caggccguggcugcccaca

SEQ ID NO: 3037739 - RNA, 15 nt, Human
caggccguggcugcc

SEQ ID NO: 3037740 - RNA, 20 nt, Human
cagagagggggccaccuccc

SEQ ID NO: 3037741 - RNA, 22 nt, Human
cagagagggggccaccucccca

SEQ ID NO: 3037742 - RNA, 15 nt, Human
cagagagggggccac

SEQ ID NO: 3037743 - RNA, 23 nt, Human
gcuuccuuuguuuuuuuuuccug

SEQ ID NO: 3037744 - RNA, 22 nt, Human
gcuuccuuuguuuuuuuuuccu

SEQ ID NO: 3037745 - RNA, 12 nt, Human
gcugggcagcug

SEQ ID NO: 3037746 - RNA, 13 nt, Human
gcugggcagcugu

SEQ ID NO: 3037747 - RNA, 14 nt, Human
gcugggcagcuguu

SEQ ID NO: 3037748 - RNA, 17 nt, Human
gcugcccacacacccca

SEQ ID NO: 3037749 - RNA, 22 nt, Human
gccuaccggcaauuuccggcca

SEQ ID NO: 3037750 - RNA, 14 nt, Human
ggccaggugcacag

SEQ ID NO: 3037751 - RNA, 23 nt, Human
ggacuguugacauccaagcuucc

SEQ ID NO: 3037752 - RNA, 17 nt, Human
ggcugcccacacacccc

SEQ ID NO: 3037753 - RNA, 19 nt, Human
ggcugcccacacaccccaa

SEQ ID NO: 3037754 - RNA, 20 nt, Human
ggcugcccacacaccccaau

SEQ ID NO: 3037755 - RNA, 11 nt, Human
aaaauauacug

SEQ ID NO: 3037756 - RNA, 15 nt, Human
aaaauauacuguaaa

SEQ ID NO: 3037757 - RNA, 14 nt, Human
aaaauauacuguaa

SEQ ID NO: 3037758 - RNA, 13 nt, Human
aaaauauacugua

SEQ ID NO: 3037759 - RNA, 12 nt, Human
aaaauauacugu

SEQ ID NO: 3037760 - RNA, 23 nt, Human
aaaauauacuguaaagaaagaga

SEQ ID NO: 3037761 - RNA, 22 nt, Human
aaaauauacuguaaagaaagag

SEQ ID NO: 3037762 - RNA, 20 nt, Human
aaaauauacuguaaagaaag

SEQ ID NO: 3037763 - RNA, 18 nt, Human
aaaauauacuguaaagaa

SEQ ID NO: 3037764 - RNA, 17 nt, Human
aaaauauacuguaaaga

SEQ ID NO: 3037765 - RNA, 16 nt, Human
aaaauauacuguaaag

SEQ ID NO: 3037766 - RNA, 16 nt, Human
gggcagcacagagagg

SEQ ID NO: 3037767 - RNA, 19 nt, Human
gggcagcuguuagagucca

SEQ ID NO: 3037768 - RNA, 15 nt, Human
gggucaggccacggc

SEQ ID NO: 3037769 - RNA, 17 nt, Human
gggucaggccacggcag

SEQ ID NO: 3037770 - RNA, 21 nt, Human
gggucaggccacggcagccua

SEQ ID NO: 3037771 - RNA, 20 nt, Human
ggugcacagacgucccucca

SEQ ID NO: 3037772 - RNA, 12 nt, Human
aaagagagaaaa

SEQ ID NO: 3037773 - RNA, 22 nt, Human
aaagagagaaaauaaaaaguua

SEQ ID NO: 3037774 - RNA, 21 nt, Human
aaagagagaaaauaaaaaguu

SEQ ID NO: 3037775 - RNA, 19 nt, Human
aaagagagaaaauaaaaag

SEQ ID NO: 3037776 - RNA, 18 nt, Human
aaagagagaaaauaaaaa

SEQ ID NO: 3037777 - RNA, 17 nt, Human
aaagagagaaaauaaaa

SEQ ID NO: 3037778 - RNA, 16 nt, Human
aaagagagaaaauaaa

SEQ ID NO: 3037779 - RNA, 15 nt, Human
aaagagagaaaauaa

SEQ ID NO: 3037780 - RNA, 14 nt, Human
aaagagagaaaaua

SEQ ID NO: 3037781 - RNA, 13 nt, Human
aaagagagaaaau

SEQ ID NO: 3037782 - RNA, 21 nt, Human
cugggcagcuguuagagucca

SEQ ID NO: 3037783 - RNA, 19 nt, Human
guccuucucucaccuccua

SEQ ID NO: 3037784 - RNA, 17 nt, Human
guccuucucucaccucc

SEQ ID NO: 3037785 - RNA, 18 nt, Human
guccuucucucaccuccu

SEQ ID NO: 3037786 - RNA, 22 nt, Human
guuagaguccaacguggggcag

SEQ ID NO: 3037787 - RNA, 17 nt, Human
gugggucuucagggggc

SEQ ID NO: 3037788 - RNA, 21 nt, Human
gugggucuucagggggccagg

SEQ ID NO: 3037789 - RNA, 13 nt, Human
gugggucuucagg

SEQ ID NO: 3037790 - RNA, 12 nt, Human
aauaaaaaguua

SEQ ID NO: 3037791 - RNA, 14 nt, Human
aauaaaaaguuaaa

SEQ ID NO: 3037792 - RNA, 13 nt, Human
aauaaaaaguuaa

SEQ ID NO: 3037793 - RNA, 19 nt, Human
acacagcugcagagacaga

SEQ ID NO: 3037794 - RNA, 17 nt, Human
acacacacacaugcaua

SEQ ID NO: 3037795 - RNA, 13 nt, Human
acacacacagaaa

SEQ ID NO: 3037796 - RNA, 12 nt, Human
acacacacagaa

SEQ ID NO: 3037797 - RNA, 16 nt, Human
acacacacagaaaaua

SEQ ID NO: 3037798 - RNA, 15 nt, Human
acacacacagaaaau

SEQ ID NO: 3037799 - RNA, 14 nt, Human
acacacacagaaaa

SEQ ID NO: 3037800 - RNA, 15 nt, Human
acacacacacaugca

SEQ ID NO: 3037801 - RNA, 13 nt, Human
acacacagccaca

SEQ ID NO: 3037802 - RNA, 15 nt, Human
acacacagccacaca

SEQ ID NO: 3037803 - RNA, 14 nt, Human
acacacagccacac

SEQ ID NO: 3037804 - RNA, 22 nt, Human
acacacagccacacacacagaa

SEQ ID NO: 3037805 - RNA, 21 nt, Human
acacacagccacacacacaga

SEQ ID NO: 3037806 - RNA, 18 nt, Human
acacacagccacacacac

SEQ ID NO: 3037807 - RNA, 17 nt, Human
acacacagccacacaca

SEQ ID NO: 3037808 - RNA, 16 nt, Human
acacacacagccacac

SEQ ID NO: 3037809 - RNA, 15 nt, Human
acacacacagccaca

SEQ ID NO: 3037810 - RNA, 14 nt, Human
acacacacagccac

SEQ ID NO: 3037811 - RNA, 13 nt, Human
acacacacagcca

SEQ ID NO: 3037812 - RNA, 12 nt, Human
acacacacagcc

SEQ ID NO: 3037813 - RNA, 21 nt, Human
acacacaugcauacacacaca

SEQ ID NO: 3037814 - RNA, 20 nt, Human
acacacaugcauacacacac

SEQ ID NO: 3037815 - RNA, 15 nt, Human
acacacaugcauaca

SEQ ID NO: 3037816 - RNA, 14 nt, Human
acacacaugcauac

SEQ ID NO: 3037817 - RNA, 19 nt, Human
acacacaugcauacacaca

SEQ ID NO: 3037818 - RNA, 18 nt, Human
acacacaugcauacacac

SEQ ID NO: 3037819 - RNA, 17 nt, Human
acacacaugcauacaca

SEQ ID NO: 3037820 - RNA, 16 nt, Human
acacacaugcauacac

SEQ ID NO: 3037821 - RNA, 19 nt, Human
acacaugcauacacacaca

SEQ ID NO: 3037822 - RNA, 18 nt, Human
acacaugcauacacacac

SEQ ID NO: 3037823 - RNA, 17 nt, Human
acacaugcauacacaca

SEQ ID NO: 3037824 - RNA, 16 nt, Human
acacaugcauacacac

SEQ ID NO: 3037825 - RNA, 15 nt, Human
acacaugcauacaca

SEQ ID NO: 3037826 - RNA, 14 nt, Human
acacaugcauacac

SEQ ID NO: 3037827 - RNA, 13 nt, Human
acacaugcauaca

SEQ ID NO: 3037828 - RNA, 21 nt, Human
acagagagggggccaccuccc

SEQ ID NO: 3037829 - RNA, 13 nt, Human
ucagcuucuuaau

SEQ ID NO: 3037830 - RNA, 14 nt, Human
ucagcuucuuaaua

SEQ ID NO: 3037831 - RNA, 21 nt, Human
acccccacacacacacacaug

SEQ ID NO: 3037832 - RNA, 20 nt, Human
acccccacacacacacacau

SEQ ID NO: 3037833 - RNA, 15 nt, Human
acccccacacacaca

SEQ ID NO: 3037834 - RNA, 14 nt, Human
acccccacacacac

SEQ ID NO: 3037835 - RNA, 13 nt, Human
acccccacacaca

SEQ ID NO: 3037836 - RNA, 12 nt, Human
acccccacacac

SEQ ID NO: 3037837 - RNA, 18 nt, Human
ucccuccacguucacccc

SEQ ID NO: 3037838 - RNA, 19 nt, Human
ucccuccacguucaccccu

SEQ ID NO: 3037839 - RNA, 20 nt, Human
ucccuccacguucaccccuc

SEQ ID NO: 3037840 - RNA, 13 nt, Human
uccccuaaugccu

SEQ ID NO: 3037841 - RNA, 15 nt, Human
acgugggcggcagag

SEQ ID NO: 3037842 - RNA, 20 nt, Human
acgugggcggcagagaggac

SEQ ID NO: 3037843 - RNA, 22 nt, Human
acgugggucuucagggggccag

SEQ ID NO: 3037844 - RNA, 14 nt, Human
acguggggcagcac

SEQ ID NO: 3037845 - RNA, 15 nt, Human
acguggggcagcaca

SEQ ID NO: 3037846 - RNA, 19 nt, Human
acguggggcagcacagaga

SEQ ID NO: 3037847 - RNA, 20 nt, Human
acguggggcagcacagagag

SEQ ID NO: 3037848 - RNA, 14 nt, Human
acguucaccccucc

SEQ ID NO: 3037849 - RNA, 16 nt, Human
acguucaccccuccac

SEQ ID NO: 3037850 - RNA, 15 nt, Human
accuaauuagagcag

SEQ ID NO: 3037851 - RNA, 16 nt, Human
accuaauuagagcaga

SEQ ID NO: 3037852 - RNA, 19 nt, Human
accuaauuagagcagauga

SEQ ID NO: 3037853 - RNA, 14 nt, Human
acugccuuaaaacu

SEQ ID NO: 3037854 - RNA, 15 nt, Human
acugccuuaaaacuu

SEQ ID NO: 3037855 - RNA, 16 nt, Human
acugccuuaaaacuuu

SEQ ID NO: 3037856 - RNA, 20 nt, Human
uccuucucucaccuccuaaa

SEQ ID NO: 3037857 - RNA, 13 nt, Human
agagacagagagg

SEQ ID NO: 3037858 - RNA, 17 nt, Human
agacuucauuuuuccua

SEQ ID NO: 3037859 - RNA, 20 nt, Human
agacagucaaggaguggcuu

SEQ ID NO: 3037860 - RNA, 17 nt, Human
agacagucaaggagugg

SEQ ID NO: 3037861 - RNA, 23 nt, Human
agccacacacacagaaaauauac

SEQ ID NO: 3037862 - RNA, 22 nt, Human
agccacacacacagaaaauaua

SEQ ID NO: 3037863 - RNA, 10 nt, Human
agccacacac

SEQ ID NO: 3037864 - RNA, 13 nt, Human
agccacacacaca

SEQ ID NO: 3037865 - RNA, 12 nt, Human
agccacacacac

SEQ ID NO: 3037866 - RNA, 21 nt, Human
agccacacacacagaaaauau

SEQ ID NO: 3037867 - RNA, 20 nt, Human
agccacacacacagaaaaua

SEQ ID NO: 3037868 - RNA, 19 nt, Human
agccacacacacagaaaau

SEQ ID NO: 3037869 - RNA, 18 nt, Human
agccacacacacagaaaa

SEQ ID NO: 3037870 - RNA, 17 nt, Human
agccacacacacagaaa

SEQ ID NO: 3037871 - RNA, 16 nt, Human
agccacacacacagaa

SEQ ID NO: 3037872 - RNA, 15 nt, Human
agccacacacacaga

SEQ ID NO: 3037873 - RNA, 14 nt, Human
agccacacacacag

SEQ ID NO: 3037874 - RNA, 14 nt, Human
aggacgugggcggc

SEQ ID NO: 3037875 - RNA, 20 nt, Human
aggacgugggcggcagagag

SEQ ID NO: 3037876 - RNA, 14 nt, Human
aggcacacagcugc

SEQ ID NO: 3037877 - RNA, 18 nt, Human
aggcacacagcugcagag

SEQ ID NO: 3037878 - RNA, 23 nt, Human
aggcacacagcugcagagacaga

SEQ ID NO: 3037879 - RNA, 19 nt, Human
agcugcagagacagagagg

SEQ ID NO: 3037880 - RNA, 17 nt, Human
agcugcagagacagaga

SEQ ID NO: 3037881 - RNA, 18 nt, Human
agcugcagagacagagag

SEQ ID NO: 3037882 - RNA, 15 nt, Human
agcugcagagacaga

SEQ ID NO: 3037883 - RNA, 13 nt, Human
uggucacugccau

SEQ ID NO: 3037884 - RNA, 14 nt, Human
uggucacugccaug

SEQ ID NO: 3037885 - RNA, 22 nt, Human
uggucacugccauggaggcaca

SEQ ID NO: 3037886 - RNA, 21 nt, Human
uguaaagaaagagagaaaaua

SEQ ID NO: 3037887 - RNA, 20 nt, Human
uguaaagaaagagagaaaau

SEQ ID NO: 3037888 - RNA, 13 nt, Human
uguaaagaaagag

SEQ ID NO: 3037889 - RNA, 15 nt, Human
uguaaagaaagagag

SEQ ID NO: 3037890 - RNA, 14 nt, Human
uguaaagaaagaga

SEQ ID NO: 3037891 - RNA, 19 nt, Human
uguaaagaaagagagaaaa

SEQ ID NO: 3037892 - RNA, 18 nt, Human
uguaaagaaagagagaaa

SEQ ID NO: 3037893 - RNA, 17 nt, Human
uguaaagaaagagagaa

SEQ ID NO: 3037894 - RNA, 16 nt, Human
uguaaagaaagagaga

SEQ ID NO: 3037895 - RNA, 13 nt, Human
aguagggucaggc

SEQ ID NO: 3037896 - RNA, 19 nt, Human
agggggccaccuccccagg

SEQ ID NO: 3037897 - RNA, 15 nt, Human
agggggccaggugca

SEQ ID NO: 3037898 - RNA, 10 nt, Human
agggggccac

SEQ ID NO: 3037899 - RNA, 15 nt, Human
agggggccaccuccc

SEQ ID NO: 3037900 - RNA, 16 nt, Human
ugugcccccagacgca

SEQ ID NO: 3037901 - RNA, 22 nt, Human
ugugcccccagacgcacguggg

SEQ ID NO: 3037902 - RNA, 21 nt, Human
uuccuuuguuuuuuuuuccug

SEQ ID NO: 3037903 - RNA, 13 nt, Human
uucagggggccag

SEQ ID NO: 3037904 - RNA, 22 nt, Human
uucagggggccaggugcacaga

SEQ ID NO: 3037905 - RNA, 19 nt, Human
augugacaugcgggcuggg

SEQ ID NO: 3037906 - RNA, 19 nt, Human
aaaauaaaaaguuaaaaag

SEQ ID NO: 3037907 - RNA, 16 nt, Human
aaaauaaaaaguuaaa

SEQ ID NO: 3037908 - RNA, 14 nt, Human
aaaauaaaaaguua

SEQ ID NO: 3037909 - RNA, 15 nt, Human
aaaauaaaaaguuaa

SEQ ID NO: 3037910 - RNA, 12 nt, Human
aagagagaaaau

SEQ ID NO: 3037911 - RNA, 15 nt, Human
aagagagaaaauaaa

SEQ ID NO: 3037912 - RNA, 13 nt, Human
aagagagaaaaua

SEQ ID NO: 3037913 - RNA, 14 nt, Human
aagagagaaaauaa

SEQ ID NO: 3037914 - RNA, 18 nt, Human
aagagagaaaauaaaaag

SEQ ID NO: 3037915 - RNA, 17 nt, Human
aagagagaaaauaaaaa

SEQ ID NO: 3037916 - RNA, 16 nt, Human
aagagagaaaauaaaa

SEQ ID NO: 3037917 - RNA, 23 nt, Human
acacagccacacacacagaaaau

SEQ ID NO: 3037918 - RNA, 22 nt, Human
acacagccacacacacagaaaa

SEQ ID NO: 3037919 - RNA, 21 nt, Human
acacagccacacacacagaaa

SEQ ID NO: 3037920 - RNA, 20 nt, Human
acacagccacacacacagaa

SEQ ID NO: 3037921 - RNA, 19 nt, Human
acacagccacacacacaga

SEQ ID NO: 3037922 - RNA, 23 nt, Human
acacagaaaauauacuguaaaga

SEQ ID NO: 3037923 - RNA, 22 nt, Human
acacagaaaauauacuguaaag

SEQ ID NO: 3037924 - RNA, 21 nt, Human
acacagaaaauauacuguaaa

SEQ ID NO: 3037925 - RNA, 12 nt, Human
acacagccacac

SEQ ID NO: 3037926 - RNA, 11 nt, Human
acacagccaca

SEQ ID NO: 3037927 - RNA, 18 nt, Human
acacagccacacacacag

SEQ ID NO: 3037928 - RNA, 15 nt, Human
acacagccacacaca

SEQ ID NO: 3037929 - RNA, 14 nt, Human
acacagccacacac

SEQ ID NO: 3037930 - RNA, 13 nt, Human
acacagccacaca

SEQ ID NO: 3037931 - RNA, 12 nt, Human
acacagaaaaua

SEQ ID NO: 3037932 - RNA, 11 nt, Human
acacagaaaau

SEQ ID NO: 3037933 - RNA, 20 nt, Human
acacagaaaauauacuguaa

SEQ ID NO: 3037934 - RNA, 19 nt, Human
acacagaaaauauacugua

SEQ ID NO: 3037935 - RNA, 18 nt, Human
acacagaaaauauacugu

SEQ ID NO: 3037936 - RNA, 17 nt, Human
acacagaaaauauacug

SEQ ID NO: 3037937 - RNA, 16 nt, Human
acacagaaaauauacu

SEQ ID NO: 3037938 - RNA, 15 nt, Human
acacagaaaauauac

SEQ ID NO: 3037939 - RNA, 14 nt, Human
acacagaaaauaua

SEQ ID NO: 3037940 - RNA, 13 nt, Human
acacagaaaauau

SEQ ID NO: 3037941 - RNA, 15 nt, Human
acaggauuagacagu

SEQ ID NO: 3037942 - RNA, 14 nt, Human
acaugcgggcuggg

SEQ ID NO: 3037943 - RNA, 16 nt, Human
acaugcgggcugggca

SEQ ID NO: 3037944 - RNA, 17 nt, Human
acaugcgggcugggcag

SEQ ID NO: 3037945 - RNA, 19 nt, Human
acaugcgggcugggcagcu

SEQ ID NO: 3037946 - RNA, 21 nt, Human
acaugcgggcugggcagcugu

SEQ ID NO: 3037947 - RNA, 22 nt, Human
acaugcgggcugggcagcuguu

SEQ ID NO: 3037948 - RNA, 23 nt, Human
acuguaaagaaagagagaaaaua

SEQ ID NO: 3037949 - RNA, 22 nt, Human
acuguaaagaaagagagaaaau

SEQ ID NO: 3037950 - RNA, 21 nt, Human
acuguaaagaaagagagaaaa

SEQ ID NO: 3037951 - RNA, 20 nt, Human
acuguaaagaaagagagaaa

SEQ ID NO: 3037952 - RNA, 19 nt, Human
acuguaaagaaagagagaa

SEQ ID NO: 3037953 - RNA, 18 nt, Human
acuguaaagaaagagaga

SEQ ID NO: 3037954 - RNA, 16 nt, Human
acuguaaagaaagaga

SEQ ID NO: 3037955 - RNA, 15 nt, Human
acuguaaagaaagag

SEQ ID NO: 3037956 - RNA, 14 nt, Human
acuguaaagaaaga

SEQ ID NO: 3037957 - RNA, 13 nt, Human
acuguaaagaaag

SEQ ID NO: 3037958 - RNA, 21 nt, Human
acugccauggaggcacacagc

SEQ ID NO: 3037959 - RNA, 18 nt, Human
acugccauggaggcacac

SEQ ID NO: 3037960 - RNA, 23 nt, Human
acugaaugaaacccccacacaca

SEQ ID NO: 3037961 - RNA, 22 nt, Human
acugaaugaaacccccacacac

SEQ ID NO: 3037962 - RNA, 23 nt, Human
augcauacacacacacacacagc

SEQ ID NO: 3037963 - RNA, 22 nt, Human
augcauacacacacacacacag

SEQ ID NO: 3037964 - RNA, 10 nt, Human
augcauacac

SEQ ID NO: 3037965 - RNA, 12 nt, Human
augcauacacac

SEQ ID NO: 3037966 - RNA, 11 nt, Human
augcauacaca

SEQ ID NO: 3037967 - RNA, 17 nt, Human
augcauacacacacaca

SEQ ID NO: 3037968 - RNA, 15 nt, Human
augcauacacacaca

SEQ ID NO: 3037969 - RNA, 14 nt, Human
augcauacacacac

SEQ ID NO: 3037970 - RNA, 13 nt, Human
augcauacacaca

SEQ ID NO: 3037971 - RNA, 20 nt, Human
agagaaaauaaaaaguuaaa

SEQ ID NO: 3037972 - RNA, 19 nt, Human
agagaaaauaaaaaguuaa

SEQ ID NO: 3037973 - RNA, 18 nt, Human
agagaaaauaaaaaguua

SEQ ID NO: 3037974 - RNA, 12 nt, Human
agcacagagagg

SEQ ID NO: 3037975 - RNA, 19 nt, Human
agcacagagagggggccac

SEQ ID NO: 3037976 - RNA, 20 nt, Human
agcacagagagggggccacc

SEQ ID NO: 3037977 - RNA, 21 nt, Human
agcacagagagggggccaccu

SEQ ID NO: 3037978 - RNA, 23 nt, Human
agcacagagagggggccaccucc

SEQ ID NO: 3037979 - RNA, 16 nt, Human
cacacagaaaauauac

SEQ ID NO: 3037980 - RNA, 15 nt, Human
cacacagaaaauaua

SEQ ID NO: 3037981 - RNA, 14 nt, Human
cacacagaaaauau

SEQ ID NO: 3037982 - RNA, 13 nt, Human
cacacagaaaaua

SEQ ID NO: 3037983 - RNA, 18 nt, Human
cacacagaaaauauacug

SEQ ID NO: 3037984 - RNA, 17 nt, Human
cacacagaaaauauacu

SEQ ID NO: 3037985 - RNA, 12 nt, Human
cacacagaaaau

SEQ ID NO: 3037986 - RNA, 11 nt, Human
cacacagaaaa

SEQ ID NO: 3037987 - RNA, 11 nt, Human
cacacacacac

SEQ ID NO: 3037988 - RNA, 12 nt, Human
cacacacacaca

SEQ ID NO: 3037989 - RNA, 13 nt, Human
cacacaccccaau

SEQ ID NO: 3037990 - RNA, 14 nt, Human
cacaugcauacaca

SEQ ID NO: 3037991 - RNA, 13 nt, Human
cacaugcauacac

SEQ ID NO: 3037992 - RNA, 18 nt, Human
cacaugcauacacacaca

SEQ ID NO: 3037993 - RNA, 17 nt, Human
cacaugcauacacacac

SEQ ID NO: 3037994 - RNA, 16 nt, Human
cacaugcauacacaca

SEQ ID NO: 3037995 - RNA, 15 nt, Human
cacaugcauacacac

SEQ ID NO: 3037996 - RNA, 13 nt, Human
cccacacacccca

SEQ ID NO: 3037997 - RNA, 14 nt, Human
cccacacaccccaa

SEQ ID NO: 3037998 - RNA, 15 nt, Human
cccaggccguggcug

SEQ ID NO: 3037999 - RNA, 13 nt, Human
cauuuuuccuaac

SEQ ID NO: 3038000 - RNA, 18 nt, Human
cauuuuuccuaacaggau

SEQ ID NO: 3038001 - RNA, 21 nt, Human
ccaccugguuccggaauccug

SEQ ID NO: 3038002 - RNA, 15 nt, Human
ccuguccucagcuuc

SEQ ID NO: 3038003 - RNA, 21 nt, Human
cguggcugcccacacacccca

SEQ ID NO: 3038004 - RNA, 19 nt, Human
cguggcugcggcacccuug

SEQ ID NO: 3038005 - RNA, 17 nt, Human
cguaguagggucaggcc

SEQ ID NO: 3038006 - RNA, 18 nt, Human
cgcaaugugcccccagac

SEQ ID NO: 3038007 - RNA, 20 nt, Human
cgcaaugugcccccagacgc

SEQ ID NO: 3038008 - RNA, 18 nt, Human
cggaauccuguccucagc

SEQ ID NO: 3038009 - RNA, 21 nt, Human
cggaauccuguccucagcuuc

SEQ ID NO: 3038010 - RNA, 16 nt, Human
cggcaauuuccggcca

SEQ ID NO: 3038011 - RNA, 11 nt, Human
cccccacacac

SEQ ID NO: 3038012 - RNA, 14 nt, Human
cccccacacacaca

SEQ ID NO: 3038013 - RNA, 12 nt, Human
cccccacacaca

SEQ ID NO: 3038014 - RNA, 19 nt, Human
ccccuccccuaaugccugc

SEQ ID NO: 3038015 - RNA, 18 nt, Human
ccccuaaugccugcggag

SEQ ID NO: 3038016 - RNA, 19 nt, Human
ccggaauccuguccucagc

SEQ ID NO: 3038017 - RNA, 20 nt, Human
ccggaauccuguccucagcu

SEQ ID NO: 3038018 - RNA, 22 nt, Human
ccggaauccuguccucagcuuc

SEQ ID NO: 3038019 - RNA, 19 nt, Human
ccuaaaguagacuucauuu

SEQ ID NO: 3038020 - RNA, 17 nt, Human
cugccauggaggcacac

SEQ ID NO: 3038021 - RNA, 17 nt, Human
cugcagagacagagagg

SEQ ID NO: 3038022 - RNA, 18 nt, Human
cugaaugaaacccccaca

SEQ ID NO: 3038023 - RNA, 17 nt, Human
cugaaugaaacccccac

SEQ ID NO: 3038024 - RNA, 23 nt, Human
cugaaugaaacccccacacacac

SEQ ID NO: 3038025 - RNA, 22 nt, Human
cugaaugaaacccccacacaca

SEQ ID NO: 3038026 - RNA, 21 nt, Human
cugaaugaaacccccacacac

SEQ ID NO: 3038027 - RNA, 20 nt, Human
cugaaugaaacccccacaca

SEQ ID NO: 3038028 - RNA, 19 nt, Human
cugaaugaaacccccacac

SEQ ID NO: 3038029 - RNA, 14 nt, Human
cuucucucaccucc

SEQ ID NO: 3038030 - RNA, 15 nt, Human
cuucucucaccuccu

SEQ ID NO: 3038031 - RNA, 16 nt, Human
cuucucucaccuccua

SEQ ID NO: 3038032 - RNA, 18 nt, Human
cuucucucaccuccuaaa

SEQ ID NO: 3038033 - RNA, 23 nt, Human
cuucagggggccaggugcacaga

SEQ ID NO: 3038034 - RNA, 14 nt, Human
cuucagggggccag

SEQ ID NO: 3038035 - RNA, 15 nt, Human
cuucagggggccagg

SEQ ID NO: 3038036 - RNA, 18 nt, Human
cuuacuacaugugggagc

SEQ ID NO: 3038037 - RNA, 20 nt, Human
cuuacuacaugugggagcuu

SEQ ID NO: 3038038 - RNA, 17 nt, Human
gaaaacgguuaaaacug

SEQ ID NO: 3038039 - RNA, 14 nt, Human
gaaaauaaaaaguu

SEQ ID NO: 3038040 - RNA, 16 nt, Human
gaaaauaaaaaguuaa

SEQ ID NO: 3038041 - RNA, 15 nt, Human
gaaaauaaaaaguua

SEQ ID NO: 3038042 - RNA, 17 nt, Human
gacauccaagcuuccuu

SEQ ID NO: 3038043 - RNA, 15 nt, Human
gacauccaagcuucc

SEQ ID NO: 3038044 - RNA, 16 nt, Human
gacauccaagcuuccu

SEQ ID NO: 3038045 - RNA, 22 nt, Human
gacgucccuccacguucacccc

SEQ ID NO: 3038046 - RNA, 14 nt, Human
gaaugaaaccccca

SEQ ID NO: 3038047 - RNA, 17 nt, Human
gaaaauauacuguaaag

SEQ ID NO: 3038048 - RNA, 17 nt, Human
gaaaauaaaaaguuaaa

SEQ ID NO: 3038049 - RNA, 12 nt, Human
gaaaauauacug

SEQ ID NO: 3038050 - RNA, 16 nt, Human
gaaaauauacuguaaa

SEQ ID NO: 3038051 - RNA, 15 nt, Human
gaaaauauacuguaa

SEQ ID NO: 3038052 - RNA, 14 nt, Human
gaaaauauacugua

SEQ ID NO: 3038053 - RNA, 13 nt, Human
gaaaauauacugu

SEQ ID NO: 3038054 - RNA, 15 nt, Human
gacuucauuuuuccu

SEQ ID NO: 3038055 - RNA, 16 nt, Human
gacuucauuuuuccua

SEQ ID NO: 3038056 - RNA, 12 nt, Human
gaugaccccucc

SEQ ID NO: 3038057 - RNA, 16 nt, Human
gaugaccccuccccua

SEQ ID NO: 3038058 - RNA, 17 nt, Human
gaugaccccuccccuaa

SEQ ID NO: 3038059 - RNA, 14 nt, Human
gcagcacagagagg

SEQ ID NO: 3038060 - RNA, 15 nt, Human
gcagagacagagagg

SEQ ID NO: 3038061 - RNA, 14 nt, Human
gccacggcagccua

SEQ ID NO: 3038062 - RNA, 13 nt, Human
gcccacacacccc

SEQ ID NO: 3038063 - RNA, 15 nt, Human
gccauggaggcacac

SEQ ID NO: 3038064 - RNA, 16 nt, Human
gccauggaggcacaca

SEQ ID NO: 3038065 - RNA, 18 nt, Human
gccauggaggcacacagc

SEQ ID NO: 3038066 - RNA, 21 nt, Human
gccauggaggcacacagcugc

SEQ ID NO: 3038067 - RNA, 18 nt, Human
gccguggcugcggcaccc

SEQ ID NO: 3038068 - RNA, 14 nt, Human
gccguggcugcggc

SEQ ID NO: 3038069 - RNA, 15 nt, Human
gccguggcugcggca

SEQ ID NO: 3038070 - RNA, 17 nt, Human
gcgcuuuugcuggucac

SEQ ID NO: 3038071 - RNA, 13 nt, Human
ggcugggcagcug

SEQ ID NO: 3038072 - RNA, 14 nt, Human
ggcugggcagcugu

SEQ ID NO: 3038073 - RNA, 22 nt, Human
ggcuuacuacaugugggagcuu

SEQ ID NO: 3038074 - RNA, 15 nt, Human
gggccaccuccccag

SEQ ID NO: 3038075 - RNA, 16 nt, Human
gggccaccuccccagg

SEQ ID NO: 3038076 - RNA, 17 nt, Human
gggccaccuccccaggc

SEQ ID NO: 3038077 - RNA, 19 nt, Human
gggccaccuccccaggccg

SEQ ID NO: 3038078 - RNA, 22 nt, Human
gggccaccuccccaggccgugg

SEQ ID NO: 3038079 - RNA, 11 nt, Human
gguuaaaacug

SEQ ID NO: 3038080 - RNA, 13 nt, Human
gguuaaaacuguc

SEQ ID NO: 3038081 - RNA, 20 nt, Human
gggucuucagggggccaggu

SEQ ID NO: 3038082 - RNA, 16 nt, Human
ggucaggccacggcag

SEQ ID NO: 3038083 - RNA, 15 nt, Human
ggucacugccaugga

SEQ ID NO: 3038084 - RNA, 23 nt, Human
uauacuguaaagaaagagagaaa

SEQ ID NO: 3038085 - RNA, 22 nt, Human
uauacuguaaagaaagagagaa

SEQ ID NO: 3038086 - RNA, 19 nt, Human
uagaguccaacguggggca

SEQ ID NO: 3038087 - RNA, 22 nt, Human
uagaguccaacguggggcagca

SEQ ID NO: 3038088 - RNA, 18 nt, Human
uacuacaugugggagcuu

SEQ ID NO: 3038089 - RNA, 21 nt, Human
uacacacacacacacagccac

SEQ ID NO: 3038090 - RNA, 23 nt, Human
uacacacacacacacagccacac

SEQ ID NO: 3038091 - RNA, 22 nt, Human
uacacacacacacacagccaca

SEQ ID NO: 3038092 - RNA, 12 nt, Human
uaauuagagcag

SEQ ID NO: 3038093 - RNA, 16 nt, Human
uaauauaacugccuua

SEQ ID NO: 3038094 - RNA, 21 nt, Human
uaauauaacugccuuaaaacu

SEQ ID NO: 3038095 - RNA, 22 nt, Human
uaauauaacugccuuaaaacuu

SEQ ID NO: 3038096 - RNA, 23 nt, Human
uaauauaacugccuuaaaacuuu

SEQ ID NO: 3038097 - RNA, 18 nt, Human
uaacugccuuaaaacuuu

SEQ ID NO: 3038098 - RNA, 16 nt, Human
uaacaggauuagacag

SEQ ID NO: 3038099 - RNA, 23 nt, Human
ucaaacugaaugaaacccccaca

SEQ ID NO: 3038100 - RNA, 21 nt, Human
ucccccgcaaugugcccccag

SEQ ID NO: 3038101 - RNA, 20 nt, Human
ucccccgcaaugugccccca

SEQ ID NO: 3038102 - RNA, 15 nt, Human
ucuucagggggccag

SEQ ID NO: 3038103 - RNA, 22 nt, Human
uggaggcacacagcugcagaga

SEQ ID NO: 3038104 - RNA, 17 nt, Human
uggaggcacacagcugc

SEQ ID NO: 3038105 - RNA, 18 nt, Human
uggaggcacacagcugca

SEQ ID NO: 3038106 - RNA, 19 nt, Human
uggaggcacacagcugcag

SEQ ID NO: 3038107 - RNA, 19 nt, Human
ugggcggcagagaggacug

SEQ ID NO: 3038108 - RNA, 13 nt, Human
ugggcggcagaga

SEQ ID NO: 3038109 - RNA, 15 nt, Human
ugggcggcagagagg

SEQ ID NO: 3038110 - RNA, 23 nt, Human
ugccauggaggcacacagcugca

SEQ ID NO: 3038111 - RNA, 16 nt, Human
ugccauggaggcacac

SEQ ID NO: 3038112 - RNA, 17 nt, Human
ugccauggaggcacaca

SEQ ID NO: 3038113 - RNA, 18 nt, Human
ugccauggaggcacacag

SEQ ID NO: 3038114 - RNA, 19 nt, Human
ugcacagacgucccuccac

SEQ ID NO: 3038115 - RNA, 23 nt, Human
uguuagaguccaacguggggcag

SEQ ID NO: 3038116 - RNA, 18 nt, Human
uguuagaguccaacgugg

SEQ ID NO: 3038117 - RNA, 19 nt, Human
ugugacaugcgggcugggc

SEQ ID NO: 3038118 - RNA, 21 nt, Human
ugugacaugcgggcugggcag

SEQ ID NO: 3038119 - RNA, 17 nt, Human
ugugacaugcgggcugg

SEQ ID NO: 3038120 - RNA, 15 nt, Human
uugcuggucacugcc

SEQ ID NO: 3038121 - RNA, 18 nt, Human
gcugcagagacagagagg

SEQ ID NO: 3038122 - RNA, 21 nt, Human
gcuucuuaauauaacugccuu

SEQ ID NO: 3038123 - RNA, 22 nt, Human
gcuucuuaauauaacugccuua

SEQ ID NO: 3038124 - RNA, 19 nt, Human
gcuucuuaauauaacugcc

SEQ ID NO: 3038125 - RNA, 14 nt, Human
gggcggcagagagg

SEQ ID NO: 3038126 - RNA, 19 nt, Human
ggucuucagggggccaggu

SEQ ID NO: 3038127 - RNA, 16 nt, Human
gacagucaaggagugg

SEQ ID NO: 3038128 - RNA, 17 nt, Human
gacagucaaggaguggc

SEQ ID NO: 3038129 - RNA, 19 nt, Human
gacagucaaggaguggcuu

SEQ ID NO: 3038130 - RNA, 22 nt, Human
gacagucaaggaguggcuuacu

SEQ ID NO: 3038131 - RNA, 19 nt, Human
cuugcgcuuuugcugguca

SEQ ID NO: 3038132 - RNA, 12 nt, Human
cugggcagcugu

SEQ ID NO: 3038133 - RNA, 13 nt, Human
cgccguggcugcg

SEQ ID NO: 3038134 - RNA, 22 nt, Human
cgugggucuucagggggccagg

SEQ ID NO: 3038135 - RNA, 18 nt, Human
cguggggcagcacagaga

SEQ ID NO: 3038136 - RNA, 20 nt, Human
cguggggcagcacagagagg

SEQ ID NO: 3038137 - RNA, 15 nt, Human
cacacagcugcagag

SEQ ID NO: 3038138 - RNA, 14 nt, Human
cacacaugcauaca

SEQ ID NO: 3038139 - RNA, 16 nt, Human
cacacaugcauacaca

SEQ ID NO: 3038140 - RNA, 15 nt, Human
cacacaugcauacac

SEQ ID NO: 3038141 - RNA, 21 nt, Human
cacagaaaauauacuguaaag

SEQ ID NO: 3038142 - RNA, 19 nt, Human
cacacaugcauacacacac

SEQ ID NO: 3038143 - RNA, 18 nt, Human
cacacaugcauacacaca

SEQ ID NO: 3038144 - RNA, 17 nt, Human
cacacaugcauacacac

SEQ ID NO: 3038145 - RNA, 22 nt, Human
cacagaaaauauacuguaaaga

SEQ ID NO: 3038146 - RNA, 12 nt, Human
cauacacacaca

SEQ ID NO: 3038147 - RNA, 20 nt, Human
cauacacacacacacacagc

SEQ ID NO: 3038148 - RNA, 19 nt, Human
cauacacacacacacacag

SEQ ID NO: 3038149 - RNA, 16 nt, Human
cauacacacacacaca

SEQ ID NO: 3038150 - RNA, 15 nt, Human
cauacacacacacac

SEQ ID NO: 3038151 - RNA, 14 nt, Human
cauacacacacaca

SEQ ID NO: 3038152 - RNA, 15 nt, Human
ccaacguggggcagc

SEQ ID NO: 3038153 - RNA, 16 nt, Human
ccaacguggggcagca

SEQ ID NO: 3038154 - RNA, 20 nt, Human
ccaacguggggcagcacaga

SEQ ID NO: 3038155 - RNA, 17 nt, Human
ccaagcuuccuuuguuu

SEQ ID NO: 3038156 - RNA, 18 nt, Human
cagagaggacgugggcgg

SEQ ID NO: 3038157 - RNA, 21 nt, Human
cagagaggacgugggcggcag

SEQ ID NO: 3038158 - RNA, 16 nt, Human
cagagaggacgugggc

SEQ ID NO: 3038159 - RNA, 17 nt, Human
cagagaggacgugggcg

SEQ ID NO: 3038160 - RNA, 16 nt, Human
caggccacggcagccu

SEQ ID NO: 3038161 - RNA, 22 nt, Human
cagcuguuagaguccaacgugg

SEQ ID NO: 3038162 - RNA, 12 nt, Human
aacccccacaca

SEQ ID NO: 3038163 - RNA, 14 nt, Human
aacccccacacaca

SEQ ID NO: 3038164 - RNA, 13 nt, Human
aacccccacacac

SEQ ID NO: 3038165 - RNA, 15 nt, Human
aacccccacacacac

SEQ ID NO: 3038166 - RNA, 20 nt, Human
gugcacagacgucccuccac

SEQ ID NO: 3038167 - RNA, 22 nt, Human
gugcacagacgucccuccacgu

SEQ ID NO: 3038168 - RNA, 17 nt, Human
aacugccuuaaaacuuu

SEQ ID NO: 3038169 - RNA, 20 nt, Human
guccaacguggggcagcaca

SEQ ID NO: 3038170 - RNA, 21 nt, Human
guccaacguggggcagcacag

SEQ ID NO: 3038171 - RNA, 18 nt, Human
guccaacguggggcagca

SEQ ID NO: 3038172 - RNA, 12 nt, Human
gucaggccacgg

SEQ ID NO: 3038173 - RNA, 14 nt, Human
gucaggccacggca

SEQ ID NO: 3038174 - RNA, 15 nt, Human
gucaggccacggcag

SEQ ID NO: 3038175 - RNA, 16 nt, Human
gucaggccacggcagc

SEQ ID NO: 3038176 - RNA, 18 nt, Human
gucaggccacggcagccu

SEQ ID NO: 3038177 - RNA, 13 nt, Human
uaaaacuuuaauc

SEQ ID NO: 3038178 - RNA, 9 nt, Human
uaaaaaguu

SEQ ID NO: 3038179 - RNA, 15 nt, Human
uaaaaaguuaaaaag

SEQ ID NO: 3038180 - RNA, 13 nt, Human
uaaaaaguuaaaa

SEQ ID NO: 3038181 - RNA, 12 nt, Human
uaaaaaguuaaa

SEQ ID NO: 3038182 - RNA, 11 nt, Human
uaaaaaguuaa

SEQ ID NO: 3038183 - RNA, 17 nt, Human
uaaaaaguuaaaaaguu

SEQ ID NO: 3038184 - RNA, 12 nt, Human
aauuagagcaga

SEQ ID NO: 3038185 - RNA, 22 nt, Human
aauuagagcagaugaccccucc

SEQ ID NO: 3038186 - RNA, 20 nt, Human
uauaacugccuuaaaacuuu

SEQ ID NO: 3038187 - RNA, 19 nt, Human
uauaacugccuuaaaacuu

SEQ ID NO: 3038188 - RNA, 16 nt, Human
acagacgucccuccac

SEQ ID NO: 3038189 - RNA, 15 nt, Human
acagacgucccucca

SEQ ID NO: 3038190 - RNA, 20 nt, Human
acagaaaacgguuaaaacug

SEQ ID NO: 3038191 - RNA, 15 nt, Human
acagaaaauauacug

SEQ ID NO: 3038192 - RNA, 14 nt, Human
acagaaaauauacu

SEQ ID NO: 3038193 - RNA, 13 nt, Human
acagaaaauauac

SEQ ID NO: 3038194 - RNA, 12 nt, Human
acagaaaauaua

SEQ ID NO: 3038195 - RNA, 12 nt, Human
acacacagccac

SEQ ID NO: 3038196 - RNA, 11 nt, Human
acacacagcca

SEQ ID NO: 3038197 - RNA, 22 nt, Human
acacacagaaaauauacuguaa

SEQ ID NO: 3038198 - RNA, 21 nt, Human
acacacagaaaauauacugua

SEQ ID NO: 3038199 - RNA, 20 nt, Human
acacacagaaaauauacugu

SEQ ID NO: 3038200 - RNA, 19 nt, Human
acacacagaaaauauacug

SEQ ID NO: 3038201 - RNA, 18 nt, Human
acacacagaaaauauacu

SEQ ID NO: 3038202 - RNA, 17 nt, Human
acacacagaaaauauac

SEQ ID NO: 3038203 - RNA, 16 nt, Human
acacacagaaaauaua

SEQ ID NO: 3038204 - RNA, 15 nt, Human
acacacagaaaauau

SEQ ID NO: 3038205 - RNA, 14 nt, Human
acacacagaaaaua

SEQ ID NO: 3038206 - RNA, 13 nt, Human
acacacagaaaau

SEQ ID NO: 3038207 - RNA, 15 nt, Human
acacacacacacaug

SEQ ID NO: 3038208 - RNA, 14 nt, Human
acacacacacacau

SEQ ID NO: 3038209 - RNA, 16 nt, Human
acacacacacacagcc

SEQ ID NO: 3038210 - RNA, 15 nt, Human
acacacacacacagc

SEQ ID NO: 3038211 - RNA, 13 nt, Human
acacacacacagc

SEQ ID NO: 3038212 - RNA, 12 nt, Human
acacacacacag

SEQ ID NO: 3038213 - RNA, 17 nt, Human
acacacacacacaugca

SEQ ID NO: 3038214 - RNA, 16 nt, Human
acacacacacacaugc

SEQ ID NO: 3038215 - RNA, 13 nt, Human
acacacacacaug

SEQ ID NO: 3038216 - RNA, 14 nt, Human
acacacacacaugc

SEQ ID NO: 3038217 - RNA, 12 nt, Human
acacacacacau

SEQ ID NO: 3038218 - RNA, 15 nt, Human
acacacacacagcca

SEQ ID NO: 3038219 - RNA, 14 nt, Human
acacacacacagcc

SEQ ID NO: 3038220 - RNA, 16 nt, Human
acacacacacacacag

SEQ ID NO: 3038221 - RNA, 14 nt, Human
acacacacacacag

SEQ ID NO: 3038222 - RNA, 17 nt, Human
ucaggccacggcagccu

SEQ ID NO: 3038223 - RNA, 14 nt, Human
ucaggccacggcag

SEQ ID NO: 3038224 - RNA, 16 nt, Human
ucaggccacggcagcc

SEQ ID NO: 3038225 - RNA, 13 nt, Human
ucagggggccagg

SEQ ID NO: 3038226 - RNA, 14 nt, Human
ucgccguggcugcg

SEQ ID NO: 3038227 - RNA, 20 nt, Human
acuuucuuuucgccguggcu

SEQ ID NO: 3038228 - RNA, 21 nt, Human
acuuucuuuucgccguggcug

SEQ ID NO: 3038229 - RNA, 11 nt, Human
agaaagagaga

SEQ ID NO: 3038230 - RNA, 10 nt, Human
agaaagagag

SEQ ID NO: 3038231 - RNA, 15 nt, Human
agaaagagagaaaau

SEQ ID NO: 3038232 - RNA, 14 nt, Human
agaaagagagaaaa

SEQ ID NO: 3038233 - RNA, 13 nt, Human
agaaagagagaaa

SEQ ID NO: 3038234 - RNA, 12 nt, Human
agaaagagagaa

SEQ ID NO: 3038235 - RNA, 22 nt, Human
agaaagagagaaaauaaaaagu

SEQ ID NO: 3038236 - RNA, 18 nt, Human
agaaagagagaaaauaaa

SEQ ID NO: 3038237 - RNA, 17 nt, Human
agaaagagagaaaauaa

SEQ ID NO: 3038238 - RNA, 16 nt, Human
agaaagagagaaaaua

SEQ ID NO: 3038239 - RNA, 13 nt, Human
agagagaaaauaa

SEQ ID NO: 3038240 - RNA, 12 nt, Human
agagagaaaaua

SEQ ID NO: 3038241 - RNA, 22 nt, Human
agagagaaaauaaaaaguuaaa

SEQ ID NO: 3038242 - RNA, 20 nt, Human
agagagaaaauaaaaaguua

SEQ ID NO: 3038243 - RNA, 18 nt, Human
agagagaaaauaaaaagu

SEQ ID NO: 3038244 - RNA, 17 nt, Human
agagagaaaauaaaaag

SEQ ID NO: 3038245 - RNA, 16 nt, Human
agagagaaaauaaaaa

SEQ ID NO: 3038246 - RNA, 15 nt, Human
agagagaaaauaaaa

SEQ ID NO: 3038247 - RNA, 22 nt, Human
agccuaccggcaauuuccggcc

SEQ ID NO: 3038248 - RNA, 13 nt, Human
ugcauacacacac

SEQ ID NO: 3038249 - RNA, 23 nt, Human
ugcauacacacacacacacagcc

SEQ ID NO: 3038250 - RNA, 22 nt, Human
ugcauacacacacacacacagc

SEQ ID NO: 3038251 - RNA, 21 nt, Human
ugcauacacacacacacacag

SEQ ID NO: 3038252 - RNA, 14 nt, Human
ugcauacacacaca

SEQ ID NO: 3038253 - RNA, 16 nt, Human
ugcauacacacacaca

SEQ ID NO: 3038254 - RNA, 15 nt, Human
ugcauacacacacac

SEQ ID NO: 3038255 - RNA, 15 nt, Human
ugccuuaaaacuuua

SEQ ID NO: 3038256 - RNA, 17 nt, Human
ugcgggcugggcagcug

SEQ ID NO: 3038257 - RNA, 13 nt, Human
ugcgggcugggca

SEQ ID NO: 3038258 - RNA, 14 nt, Human
ugcgggcugggcag

SEQ ID NO: 3038259 - RNA, 15 nt, Human
ugcgggcugggcagc

SEQ ID NO: 3038260 - RNA, 16 nt, Human
ugcgggcugggcagcu

SEQ ID NO: 3038261 - RNA, 22 nt, Human
aggugcacagacgucccuccac

SEQ ID NO: 3038262 - RNA, 23 nt, Human
aggugcacagacgucccuccacg

SEQ ID NO: 3038263 - RNA, 23 nt, Human
uuagacagucaaggaguggcuua

SEQ ID NO: 3038264 - RNA, 21 nt, Human
auuagagcagaugaccccucc

SEQ ID NO: 3038265 - RNA, 13 nt, Human
auauaacugccuu

SEQ ID NO: 3038266 - RNA, 20 nt, Human
auauaacugccuuaaaacuu

SEQ ID NO: 3038267 - RNA, 14 nt, Human
uucgccguggcugc

SEQ ID NO: 3038268 - RNA, 20 nt, Human
uucgccguggcugcggcacc

SEQ ID NO: 3038269 - RNA, 21 nt, Human
uucgccguggcugcggcaccc

SEQ ID NO: 3038270 - RNA, 18 nt, Human
aguccaacguggggcagc

SEQ ID NO: 3038271 - RNA, 19 nt, Human
aguccaacguggggcagca

SEQ ID NO: 3038272 - RNA, 20 nt, Human
aguccaacguggggcagcac

SEQ ID NO: 3038273 - RNA, 22 nt, Human
aguccaacguggggcagcacag

SEQ ID NO: 3038274 - RNA, 23 nt, Human
aguccaacguggggcagcacaga

SEQ ID NO: 3038275 - RNA, 16 nt, Human
augccugcggaguugu

SEQ ID NO: 3038276 - RNA, 19 nt, Human
auggaggcacacagcugca

SEQ ID NO: 3038277 - RNA, 12 nt, Human
agagggggccac

SEQ ID NO: 3038278 - RNA, 14 nt, Human
agagagggggccac

SEQ ID NO: 3038279 - RNA, 16 nt, Human
agagagggggccaccu

SEQ ID NO: 3038280 - RNA, 19 nt, Human
agagagggggccaccuccc

SEQ ID NO: 3038281 - RNA, 19 nt, Human
aaguagacuucauuuuucc

SEQ ID NO: 3038282 - RNA, 23 nt, Human
aaguagacuucauuuuuccuaac

SEQ ID NO: 3038283 - RNA, 23 nt, Human
aagagagaaaauaaaaaguuaaa

SEQ ID NO: 3038284 - RNA, 22 nt, Human
aagagagaaaauaaaaaguuaa

SEQ ID NO: 3038285 - RNA, 21 nt, Human
aagagagaaaauaaaaaguua

SEQ ID NO: 3038286 - RNA, 20 nt, Human
aagagagaaaauaaaaaguu

SEQ ID NO: 3038287 - RNA, 19 nt, Human
aagagagaaaauaaaaagu

SEQ ID NO: 3038288 - RNA, 13 nt, Human
aauauaacugccu

SEQ ID NO: 3038289 - RNA, 13 nt, Human
aacgguuaaaacu

SEQ ID NO: 3038290 - RNA, 14 nt, Human
aacgguuaaaacug

SEQ ID NO: 3038291 - RNA, 23 nt, Human
aacugaaugaaacccccacacac

SEQ ID NO: 3038292 - RNA, 18 nt, Human
aacugaaugaaaccccca

SEQ ID NO: 3038293 - RNA, 16 nt, Human
aacaggauuagacagu

SEQ ID NO: 3038294 - RNA, 19 nt, Human
aacaggauuagacagucaa

SEQ ID NO: 3038295 - RNA, 12 nt, Human
aaaauaaaaagu

SEQ ID NO: 3038296 - RNA, 13 nt, Human
aaaauaaaaaguu

SEQ ID NO: 3038297 - RNA, 22 nt, Human
aaacccccacacacacacacau

SEQ ID NO: 3038298 - RNA, 16 nt, Human
aaacccccacacacac

SEQ ID NO: 3038299 - RNA, 15 nt, Human
aaacccccacacaca

SEQ ID NO: 3038300 - RNA, 20 nt, Human
acgcacgugggucuucaggg

SEQ ID NO: 3038301 - RNA, 19 nt, Human
acgcacgugggucuucagg

SEQ ID NO: 3038302 - RNA, 17 nt, Human
accggcaauuuccggcc

SEQ ID NO: 3038303 - RNA, 18 nt, Human
accggcaauuuccggcca

SEQ ID NO: 3038304 - RNA, 21 nt, Human
acugaaugaaacccccacaca

SEQ ID NO: 3038305 - RNA, 19 nt, Human
acugaaugaaacccccaca

SEQ ID NO: 3038306 - RNA, 16 nt, Human
acugaaugaaaccccc

SEQ ID NO: 3038307 - RNA, 15 nt, Human
acagcugcagagaca

SEQ ID NO: 3038308 - RNA, 17 nt, Human
acagcugcagagacaga

SEQ ID NO: 3038309 - RNA, 21 nt, Human
acagcugcagagacagagagg

SEQ ID NO: 3038310 - RNA, 21 nt, Human
caaacugaaugaaacccccac

SEQ ID NO: 3038311 - RNA, 22 nt, Human
caaacugaaugaaacccccaca

SEQ ID NO: 3038312 - RNA, 12 nt, Human
caacguggggca

SEQ ID NO: 3038313 - RNA, 15 nt, Human
caacguggggcagca

SEQ ID NO: 3038314 - RNA, 17 nt, Human
caacguggggcagcaca

SEQ ID NO: 3038315 - RNA, 18 nt, Human
caacguggggcagcacag

SEQ ID NO: 3038316 - RNA, 18 nt, Human
cacagcugcagagacaga

SEQ ID NO: 3038317 - RNA, 19 nt, Human
cacagcugcagagacagag

SEQ ID NO: 3038318 - RNA, 15 nt, Human
cacagccacacacac

SEQ ID NO: 3038319 - RNA, 23 nt, Human
cacagccacacacacagaaaaua

SEQ ID NO: 3038320 - RNA, 22 nt, Human
cacagccacacacacagaaaau

SEQ ID NO: 3038321 - RNA, 21 nt, Human
cacagccacacacacagaaaa

SEQ ID NO: 3038322 - RNA, 20 nt, Human
cacagccacacacacagaaa

SEQ ID NO: 3038323 - RNA, 19 nt, Human
cacagccacacacacagaa

SEQ ID NO: 3038324 - RNA, 18 nt, Human
cacagccacacacacaga

SEQ ID NO: 3038325 - RNA, 17 nt, Human
cacagccacacacacag

SEQ ID NO: 3038326 - RNA, 13 nt, Human
caaugugccccca

SEQ ID NO: 3038327 - RNA, 16 nt, Human
cacacacagccacaca

SEQ ID NO: 3038328 - RNA, 15 nt, Human
cacacacagccacac

SEQ ID NO: 3038329 - RNA, 13 nt, Human
cacacacagaaaa

SEQ ID NO: 3038330 - RNA, 11 nt, Human
cacacacagaa

SEQ ID NO: 3038331 - RNA, 19 nt, Human
cacacacagaaaauauacu

SEQ ID NO: 3038332 - RNA, 16 nt, Human
cacacacagaaaauau

SEQ ID NO: 3038333 - RNA, 15 nt, Human
cacacacagaaaaua

SEQ ID NO: 3038334 - RNA, 14 nt, Human
cacacacagaaaau

SEQ ID NO: 3038335 - RNA, 23 nt, Human
cacacacagaaaauauacuguaa

SEQ ID NO: 3038336 - RNA, 21 nt, Human
cacacacagaaaauauacugu

SEQ ID NO: 3038337 - RNA, 20 nt, Human
cacacacagaaaauauacug

SEQ ID NO: 3038338 - RNA, 14 nt, Human
cacacacagccaca

SEQ ID NO: 3038339 - RNA, 13 nt, Human
cacacacagccac

SEQ ID NO: 3038340 - RNA, 12 nt, Human
cacacacagcca

SEQ ID NO: 3038341 - RNA, 11 nt, Human
cacacacagcc

SEQ ID NO: 3038342 - RNA, 16 nt, Human
cacacacacacaugca

SEQ ID NO: 3038343 - RNA, 12 nt, Human
cacacacacaga

SEQ ID NO: 3038344 - RNA, 11 nt, Human
cacacacacag

SEQ ID NO: 3038345 - RNA, 14 nt, Human
cacacacacacaug

SEQ ID NO: 3038346 - RNA, 15 nt, Human
cacacacacacaugc

SEQ ID NO: 3038347 - RNA, 13 nt, Human
cacacacacacau

SEQ ID NO: 3038348 - RNA, 16 nt, Human
cacacacacacagcca

SEQ ID NO: 3038349 - RNA, 15 nt, Human
cacacacacacagcc

SEQ ID NO: 3038350 - RNA, 14 nt, Human
cacacacacacagc

SEQ ID NO: 3038351 - RNA, 13 nt, Human
cacacacacacag

SEQ ID NO: 3038352 - RNA, 16 nt, Human
cacacacacacacaug

SEQ ID NO: 3038353 - RNA, 15 nt, Human
cacacacacacacau

SEQ ID NO: 3038354 - RNA, 15 nt, Human
cacacacacaugcau

SEQ ID NO: 3038355 - RNA, 14 nt, Human
cacacacacaugca

SEQ ID NO: 3038356 - RNA, 12 nt, Human
cacacacacaug

SEQ ID NO: 3038357 - RNA, 13 nt, Human
cacacacacaugc

SEQ ID NO: 3038358 - RNA, 15 nt, Human
cacacacacagccac

SEQ ID NO: 3038359 - RNA, 14 nt, Human
cacacacacagcca

SEQ ID NO: 3038360 - RNA, 13 nt, Human
cacacacacagcc

SEQ ID NO: 3038361 - RNA, 12 nt, Human
cacacacacagc

SEQ ID NO: 3038362 - RNA, 15 nt, Human
cacacacacagaaaa

SEQ ID NO: 3038363 - RNA, 14 nt, Human
cacacacacagaaa

SEQ ID NO: 3038364 - RNA, 13 nt, Human
cacacacacagaa

SEQ ID NO: 3038365 - RNA, 14 nt, Human
cacacacacacaca

SEQ ID NO: 3038366 - RNA, 13 nt, Human
cacacacacacac

SEQ ID NO: 3038367 - RNA, 15 nt, Human
cacacacacacacag

SEQ ID NO: 3038368 - RNA, 16 nt, Human
cacacacacacacagc

SEQ ID NO: 3038369 - RNA, 23 nt, Human
caugcauacacacacacacacag

SEQ ID NO: 3038370 - RNA, 16 nt, Human
caugcauacacacaca

SEQ ID NO: 3038371 - RNA, 15 nt, Human
caugcauacacacac

SEQ ID NO: 3038372 - RNA, 14 nt, Human
caugcauacacaca

SEQ ID NO: 3038373 - RNA, 13 nt, Human
caugcauacacac

SEQ ID NO: 3038374 - RNA, 12 nt, Human
caugcauacaca

SEQ ID NO: 3038375 - RNA, 11 nt, Human
caugcauacac

SEQ ID NO: 3038376 - RNA, 12 nt, Human
caugugggagcu

SEQ ID NO: 3038377 - RNA, 11 nt, Human
ccacacacaca

SEQ ID NO: 3038378 - RNA, 13 nt, Human
ccacacacacaca

SEQ ID NO: 3038379 - RNA, 15 nt, Human
ccacacacacacaca

SEQ ID NO: 3038380 - RNA, 14 nt, Human
ccacacacacacac

SEQ ID NO: 3038381 - RNA, 12 nt, Human
ccacacacacag

SEQ ID NO: 3038382 - RNA, 24 nt, Human
ccacacacacacacaugcauacac

SEQ ID NO: 3038383 - RNA, 21 nt, Human
ccacacacacacacaugcaua

SEQ ID NO: 3038384 - RNA, 17 nt, Human
ccacacacacacacaug

SEQ ID NO: 3038385 - RNA, 16 nt, Human
ccacacacacagaaaa

SEQ ID NO: 3038386 - RNA, 15 nt, Human
ccacacacacagaaa

SEQ ID NO: 3038387 - RNA, 14 nt, Human
ccacacacacagaa

SEQ ID NO: 3038388 - RNA, 13 nt, Human
ccacacacacaga

SEQ ID NO: 3038389 - RNA, 13 nt, Human
ccauggaggcaca

SEQ ID NO: 3038390 - RNA, 21 nt, Human
ccauggaggcacacagcugca

SEQ ID NO: 3038391 - RNA, 17 nt, Human
ccauggaggcacacagc

SEQ ID NO: 3038392 - RNA, 20 nt, Human
ccauggaggcacacagcugc

SEQ ID NO: 3038393 - RNA, 18 nt, Human
cccgcaaugugcccccag

SEQ ID NO: 3038394 - RNA, 22 nt, Human
cccgcaaugugcccccagacgc

SEQ ID NO: 3038395 - RNA, 21 nt, Human
cccuccccuaaugccugcgga

SEQ ID NO: 3038396 - RNA, 17 nt, Human
cgugggcggcagagagg

SEQ ID NO: 3038397 - RNA, 12 nt, Human
cguggggcagca

SEQ ID NO: 3038398 - RNA, 19 nt, Human
cgcuuuugcuggucacugc

SEQ ID NO: 3038399 - RNA, 11 nt, Human
cggcagagagg

SEQ ID NO: 3038400 - RNA, 13 nt, Human
cggcagagaggac

SEQ ID NO: 3038401 - RNA, 21 nt, Human
cuccccaggccguggcugccc

SEQ ID NO: 3038402 - RNA, 20 nt, Human
cugccauggaggcacacagc

SEQ ID NO: 3038403 - RNA, 21 nt, Human
cugccauggaggcacacagcu

SEQ ID NO: 3038404 - RNA, 23 nt, Human
cugccauggaggcacacagcugc

SEQ ID NO: 3038405 - RNA, 22 nt, Human
cuggucacugccauggaggcac

SEQ ID NO: 3038406 - RNA, 14 nt, Human
cuggucacugccau

SEQ ID NO: 3038407 - RNA, 23 nt, Human
gaacaugaaaacagaaaacgguu

SEQ ID NO: 3038408 - RNA, 23 nt, Human
gaaagagagaaaauaaaaaguua

SEQ ID NO: 3038409 - RNA, 22 nt, Human
gaaagagagaaaauaaaaaguu

SEQ ID NO: 3038410 - RNA, 21 nt, Human
gaaagagagaaaauaaaaagu

SEQ ID NO: 3038411 - RNA, 20 nt, Human
gaaagagagaaaauaaaaag

SEQ ID NO: 3038412 - RNA, 18 nt, Human
gaaagagagaaaauaaaa

SEQ ID NO: 3038413 - RNA, 17 nt, Human
gaaagagagaaaauaaa

SEQ ID NO: 3038414 - RNA, 16 nt, Human
gaaagagagaaaauaa

SEQ ID NO: 3038415 - RNA, 11 nt, Human
gaaagagagaa

SEQ ID NO: 3038416 - RNA, 15 nt, Human
gaaagagagaaaaua

SEQ ID NO: 3038417 - RNA, 14 nt, Human
gaaagagagaaaau

SEQ ID NO: 3038418 - RNA, 13 nt, Human
gaaagagagaaaa

SEQ ID NO: 3038419 - RNA, 12 nt, Human
gaaagagagaaa

SEQ ID NO: 3038420 - RNA, 16 nt, Human
cuuuucgccguggcug

SEQ ID NO: 3038421 - RNA, 23 nt, Human
cuuuguuuuuuuuuccuguccuu

SEQ ID NO: 3038422 - RNA, 16 nt, Human
cuuuguuuuuuuuucc

SEQ ID NO: 3038423 - RNA, 21 nt, Human
cuuuguuuuuuuuuccugucc

SEQ ID NO: 3038424 - RNA, 21 nt, Human
cuuucuuuucgccguggcugc

SEQ ID NO: 3038425 - RNA, 17 nt, Human
gagaaaauaaaaaguua

SEQ ID NO: 3038426 - RNA, 18 nt, Human
gagaaaauaaaaaguuaa

SEQ ID NO: 3038427 - RNA, 19 nt, Human
gagaaaauaaaaaguuaaa

SEQ ID NO: 3038428 - RNA, 22 nt, Human
gagacagagaggacgugggcgg

SEQ ID NO: 3038429 - RNA, 12 nt, Human
gagagaaaauaa

SEQ ID NO: 3038430 - RNA, 11 nt, Human
gagagaaaaua

SEQ ID NO: 3038431 - RNA, 13 nt, Human
gagagaaaauaaa

SEQ ID NO: 3038432 - RNA, 12 nt, Human
gacgucccucca

SEQ ID NO: 3038433 - RNA, 16 nt, Human
gcacguaguaggguca

SEQ ID NO: 3038434 - RNA, 20 nt, Human
gcacguaguagggucaggcc

SEQ ID NO: 3038435 - RNA, 21 nt, Human
gcacguaguagggucaggcca

SEQ ID NO: 3038436 - RNA, 22 nt, Human
gccccuguuaccuaauuagagc

SEQ ID NO: 3038437 - RNA, 12 nt, Human
gccuuaaaacuu

SEQ ID NO: 3038438 - RNA, 14 nt, Human
uuuuuccuguccuu

SEQ ID NO: 3038439 - RNA, 21 nt, Human
gucccuccacguucaccccuc

SEQ ID NO: 3038440 - RNA, 19 nt, Human
gucccuccacguucacccc

SEQ ID NO: 3038441 - RNA, 20 nt, Human
gucccuccacguucaccccu

SEQ ID NO: 3038442 - RNA, 18 nt, Human
guaguagggucaggccac

SEQ ID NO: 3038443 - RNA, 21 nt, Human
guagggucaggccacggcagc

SEQ ID NO: 3038444 - RNA, 22 nt, Human
guagggucaggccacggcagcc

SEQ ID NO: 3038445 - RNA, 10 nt, Human
guuaccuaau

SEQ ID NO: 3038446 - RNA, 19 nt, Human
guuaccuaauuagagcaga

SEQ ID NO: 3038447 - RNA, 16 nt, Human
guucaccccuccaccc

SEQ ID NO: 3038448 - RNA, 12 nt, Human
guucaccccucc

SEQ ID NO: 3038449 - RNA, 14 nt, Human
guucaccccuccac

SEQ ID NO: 3038450 - RNA, 12 nt, Human
guuaaaacuguc

SEQ ID NO: 3038451 - RNA, 20 nt, Human
guggcuuacuacauguggga

SEQ ID NO: 3038452 - RNA, 18 nt, Human
guggcugcggcacccuug

SEQ ID NO: 3038453 - RNA, 16 nt, Human
guggcugcccacacac

SEQ ID NO: 3038454 - RNA, 13 nt, Human
gugggcggcagag

SEQ ID NO: 3038455 - RNA, 16 nt, Human
gugggcggcagagagg

SEQ ID NO: 3038456 - RNA, 12 nt, Human
guggggcagcac

SEQ ID NO: 3038457 - RNA, 14 nt, Human
guggggcagcacag

SEQ ID NO: 3038458 - RNA, 19 nt, Human
guggggcagcacagagagg

SEQ ID NO: 3038459 - RNA, 23 nt, Human
guggggcagcacagagagggggc

SEQ ID NO: 3038460 - RNA, 12 nt, Human
uaaagaaagaga

SEQ ID NO: 3038461 - RNA, 13 nt, Human
uaaagaaagagag

SEQ ID NO: 3038462 - RNA, 22 nt, Human
uaauuagagcagaugaccccuc

SEQ ID NO: 3038463 - RNA, 20 nt, Human
uacacacacacacacagcca

SEQ ID NO: 3038464 - RNA, 19 nt, Human
uacacacacacacacagcc

SEQ ID NO: 3038465 - RNA, 12 nt, Human
uacacacacaca

SEQ ID NO: 3038466 - RNA, 13 nt, Human
uacacacacacac

SEQ ID NO: 3038467 - RNA, 18 nt, Human
uacacacacacacacagc

SEQ ID NO: 3038468 - RNA, 17 nt, Human
uacacacacacacacag

SEQ ID NO: 3038469 - RNA, 16 nt, Human
uacacacacacacaca

SEQ ID NO: 3038470 - RNA, 14 nt, Human
uacacacacacaca

SEQ ID NO: 3038471 - RNA, 17 nt, Human
uaccuaauuagagcaga

SEQ ID NO: 3038472 - RNA, 20 nt, Human
uaccuaauuagagcagauga

SEQ ID NO: 3038473 - RNA, 15 nt, Human
uaccuaauuagagca

SEQ ID NO: 3038474 - RNA, 19 nt, Human
ugacaugcgggcugggcag

SEQ ID NO: 3038475 - RNA, 20 nt, Human
ugacaugcgggcugggcagc

SEQ ID NO: 3038476 - RNA, 21 nt, Human
ugacaugcgggcugggcagcu

SEQ ID NO: 3038477 - RNA, 22 nt, Human
ugacaugcgggcugggcagcug

SEQ ID NO: 3038478 - RNA, 17 nt, Human
ugacaugcgggcugggc

SEQ ID NO: 3038479 - RNA, 18 nt, Human
ugacaugcgggcugggca

SEQ ID NO: 3038480 - RNA, 13 nt, Human
ugacauccaagcu

SEQ ID NO: 3038481 - RNA, 17 nt, Human
ugacauccaagcuuccu

SEQ ID NO: 3038482 - RNA, 22 nt, Human
ucuuuucgccguggcugcggca

SEQ ID NO: 3038483 - RNA, 18 nt, Human
ugaaaacagaaaacgguu

SEQ ID NO: 3038484 - RNA, 15 nt, Human
ucccacuugccccug

SEQ ID NO: 3038485 - RNA, 18 nt, Human
uccggaauccuguccuca

SEQ ID NO: 3038486 - RNA, 22 nt, Human
uccggaauccuguccucagcuu

SEQ ID NO: 3038487 - RNA, 15 nt, Human
uccggaauccugucc

SEQ ID NO: 3038488 - RNA, 14 nt, Human
uguccucagcuucu

SEQ ID NO: 3038489 - RNA, 14 nt, Human
uuaaaacuuuaauc

SEQ ID NO: 3038490 - RNA, 17 nt, Human
uguugacauccaagcuu

SEQ ID NO: 3038491 - RNA, 19 nt, Human
uguugacauccaagcuucc

SEQ ID NO: 3038492 - RNA, 23 nt, Human
ugugugaagaucacguuccuucc

SEQ ID NO: 3038493 - RNA, 20 nt, Human
uguuaccuaauuagagcaga

SEQ ID NO: 3038494 - RNA, 20 nt, Human
ccugguuccggaauccuguc

SEQ ID NO: 3038495 - RNA, 21 nt, Human
ccugguuccggaauccugucc

SEQ ID NO: 3038496 - RNA, 14 nt, Human
ccuaauuagagcag

SEQ ID NO: 3038497 - RNA, 23 nt, Human
ccuaauuagagcagaugaccccu

SEQ ID NO: 3038498 - RNA, 15 nt, Human
cagucaaggaguggc

SEQ ID NO: 3038499 - RNA, 15 nt, Human
caggugcacagacgu

SEQ ID NO: 3038500 - RNA, 23 nt, Human
caggugcacagacgucccuccac

SEQ ID NO: 3038501 - RNA, 15 nt, Human
cagcugcagagacag

SEQ ID NO: 3038502 - RNA, 16 nt, Human
cagcugcagagacaga

SEQ ID NO: 3038503 - RNA, 20 nt, Human
cagcacagagagggggccac

SEQ ID NO: 3038504 - RNA, 13 nt, Human
cagcacagagagg

SEQ ID NO: 3038505 - RNA, 17 nt, Human
cagcacagagagggggc

SEQ ID NO: 3038506 - RNA, 12 nt, Human
cagcacagagag

SEQ ID NO: 3038507 - RNA, 22 nt, Human
cauacacacacacacacagcca

SEQ ID NO: 3038508 - RNA, 21 nt, Human
cauacacacacacacacagcc

SEQ ID NO: 3038509 - RNA, 23 nt, Human
cauacacacacacacacagccac

SEQ ID NO: 3038510 - RNA, 15 nt, Human
cacagaaaauauacu

SEQ ID NO: 3038511 - RNA, 14 nt, Human
cacagaaaauauac

SEQ ID NO: 3038512 - RNA, 13 nt, Human
cacagaaaauaua

SEQ ID NO: 3038513 - RNA, 12 nt, Human
cacagaaaauau

SEQ ID NO: 3038514 - RNA, 20 nt, Human
cacagaaaauauacuguaaa

SEQ ID NO: 3038515 - RNA, 19 nt, Human
cacagaaaauauacuguaa

SEQ ID NO: 3038516 - RNA, 18 nt, Human
cacagaaaauauacugua

SEQ ID NO: 3038517 - RNA, 17 nt, Human
cacagaaaauauacugu

SEQ ID NO: 3038518 - RNA, 16 nt, Human
cacagaaaauauacug

SEQ ID NO: 3038519 - RNA, 23 nt, Human
ggacuuucuuuucgccguggcug

SEQ ID NO: 3038520 - RNA, 21 nt, Human
ggacuuucuuuucgccguggc

SEQ ID NO: 3038521 - RNA, 14 nt, Human
ggaauccuguccuc

SEQ ID NO: 3038522 - RNA, 19 nt, Human
ggaauccuguccucagcuu

SEQ ID NO: 3038523 - RNA, 18 nt, Human
aaaacgguuaaaacuguc

SEQ ID NO: 3038524 - RNA, 16 nt, Human
aaaacgguuaaaacug

SEQ ID NO: 3038525 - RNA, 23 nt, Human
aaauauacuguaaagaaagagag

SEQ ID NO: 3038526 - RNA, 21 nt, Human
aaauauacuguaaagaaagag

SEQ ID NO: 3038527 - RNA, 19 nt, Human
aaauauacuguaaagaaag

SEQ ID NO: 3038528 - RNA, 17 nt, Human
aaauauacuguaaagaa

SEQ ID NO: 3038529 - RNA, 12 nt, Human
aaauauacugua

SEQ ID NO: 3038530 - RNA, 16 nt, Human
aaauauacuguaaaga

SEQ ID NO: 3038531 - RNA, 15 nt, Human
aaauauacuguaaag

SEQ ID NO: 3038532 - RNA, 14 nt, Human
aaauauacuguaaa

SEQ ID NO: 3038533 - RNA, 13 nt, Human
aaauauacuguaa

SEQ ID NO: 3038534 - RNA, 23 nt, Human
guaaagaaagagagaaaauaaaa

SEQ ID NO: 3038535 - RNA, 14 nt, Human
guaaagaaagagag

SEQ ID NO: 3038536 - RNA, 22 nt, Human
guaaagaaagagagaaaauaaa

SEQ ID NO: 3038537 - RNA, 21 nt, Human
guaaagaaagagagaaaauaa

SEQ ID NO: 3038538 - RNA, 20 nt, Human
guaaagaaagagagaaaaua

SEQ ID NO: 3038539 - RNA, 19 nt, Human
guaaagaaagagagaaaau

SEQ ID NO: 3038540 - RNA, 18 nt, Human
guaaagaaagagagaaaa

SEQ ID NO: 3038541 - RNA, 17 nt, Human
guaaagaaagagagaaa

SEQ ID NO: 3038542 - RNA, 16 nt, Human
guaaagaaagagagaa

SEQ ID NO: 3038543 - RNA, 15 nt, Human
guaaagaaagagaga

SEQ ID NO: 3038544 - RNA, 12 nt, Human
aaauaaaaaguu

SEQ ID NO: 3038545 - RNA, 14 nt, Human
aaauaaaaaguuaa

SEQ ID NO: 3038546 - RNA, 13 nt, Human
aaauaaaaaguua

SEQ ID NO: 3038547 - RNA, 19 nt, Human
aaauaaaaaguuaaaaagu

SEQ ID NO: 3038548 - RNA, 15 nt, Human
aaauaaaaaguuaaa

SEQ ID NO: 3038549 - RNA, 10 nt, Human
aaauaaaaag

SEQ ID NO: 3038550 - RNA, 12 nt, Human
aaacugucccuu

SEQ ID NO: 3038551 - RNA, 15 nt, Human
aaacgguuaaaacug

SEQ ID NO: 3038552 - RNA, 17 nt, Human
aaacgguuaaaacuguc

SEQ ID NO: 3038553 - RNA, 14 nt, Human
gggggccaggugca

SEQ ID NO: 3038554 - RNA, 20 nt, Human
gaguccaacguggggcagca

SEQ ID NO: 3038555 - RNA, 22 nt, Human
gaguccaacguggggcagcaca

SEQ ID NO: 3038556 - RNA, 14 nt, Human
gcagcuguuagagu

SEQ ID NO: 3038557 - RNA, 17 nt, Human
gcagcuguuagagucca

SEQ ID NO: 3038558 - RNA, 11 nt, Human
gcauacacaca

SEQ ID NO: 3038559 - RNA, 22 nt, Human
gcauacacacacacacacagcc

SEQ ID NO: 3038560 - RNA, 21 nt, Human
gcauacacacacacacacagc

SEQ ID NO: 3038561 - RNA, 14 nt, Human
gcauacacacacac

SEQ ID NO: 3038562 - RNA, 13 nt, Human
gcauacacacaca

SEQ ID NO: 3038563 - RNA, 23 nt, Human
gcauacacacacacacacagcca

SEQ ID NO: 3038564 - RNA, 19 nt, Human
gcacacagcugcagagaca

SEQ ID NO: 3038565 - RNA, 18 nt, Human
cuucuuaauauaacugcc

SEQ ID NO: 3038566 - RNA, 20 nt, Human
cuucuuaauauaacugccuu

SEQ ID NO: 3038567 - RNA, 13 nt, Human
cuguaaagaaaga

SEQ ID NO: 3038568 - RNA, 17 nt, Human
cuguaaagaaagagaga

SEQ ID NO: 3038569 - RNA, 16 nt, Human
cuguaaagaaagagag

SEQ ID NO: 3038570 - RNA, 15 nt, Human
cuguaaagaaagaga

SEQ ID NO: 3038571 - RNA, 14 nt, Human
cuguaaagaaagag

SEQ ID NO: 3038572 - RNA, 23 nt, Human
cuguaaagaaagagagaaaauaa

SEQ ID NO: 3038573 - RNA, 22 nt, Human
cuguaaagaaagagagaaaaua

SEQ ID NO: 3038574 - RNA, 21 nt, Human
cuguaaagaaagagagaaaau

SEQ ID NO: 3038575 - RNA, 20 nt, Human
cuguaaagaaagagagaaaa

SEQ ID NO: 3038576 - RNA, 19 nt, Human
cuguaaagaaagagagaaa

SEQ ID NO: 3038577 - RNA, 18 nt, Human
cuguaaagaaagagagaa

SEQ ID NO: 3038578 - RNA, 15 nt, Human
aauaaaaaguuaaaa

SEQ ID NO: 3038579 - RNA, 20 nt, Human
guuuuuuuuuccuguccuuc

SEQ ID NO: 3038580 - RNA, 19 nt, Human
guuuuuuuuuccuguccuu

SEQ ID NO: 3038581 - RNA, 15 nt, Human
uaaagaaagagagaa

SEQ ID NO: 3038582 - RNA, 17 nt, Human
uaaagaaagagagaaaa

SEQ ID NO: 3038583 - RNA, 16 nt, Human
uaaagaaagagagaaa

SEQ ID NO: 3038584 - RNA, 23 nt, Human
uaaagaaagagagaaaauaaaaa

SEQ ID NO: 3038585 - RNA, 22 nt, Human
uaaagaaagagagaaaauaaaa

SEQ ID NO: 3038586 - RNA, 21 nt, Human
uaaagaaagagagaaaauaaa

SEQ ID NO: 3038587 - RNA, 20 nt, Human
uaaagaaagagagaaaauaa

SEQ ID NO: 3038588 - RNA, 19 nt, Human
uaaagaaagagagaaaaua

SEQ ID NO: 3038589 - RNA, 18 nt, Human
uaaagaaagagagaaaau

SEQ ID NO: 3038590 - RNA, 14 nt, Human
uaaagaaagagaga

SEQ ID NO: 3038591 - RNA, 18 nt, Human
gucuucagggggccaggu

SEQ ID NO: 3038592 - RNA, 22 nt, Human
aacguggggcagcacagagagg

SEQ ID NO: 3038593 - RNA, 17 nt, Human
aacguggggcagcacag

SEQ ID NO: 3038594 - RNA, 18 nt, Human
aacguggggcagcacaga

SEQ ID NO: 3038595 - RNA, 22 nt, Human
gugacaugcgggcugggcagcu

SEQ ID NO: 3038596 - RNA, 16 nt, Human
gugacaugcgggcugg

SEQ ID NO: 3038597 - RNA, 20 nt, Human
gugacaugcgggcugggcag

SEQ ID NO: 3038598 - RNA, 21 nt, Human
gugacaugcgggcugggcagc

SEQ ID NO: 3038599 - RNA, 19 nt, Human
uagagcagaugaccccucc

SEQ ID NO: 3038600 - RNA, 23 nt, Human
uacuguaaagaaagagagaaaau

SEQ ID NO: 3038601 - RNA, 21 nt, Human
uacuguaaagaaagagagaaa

SEQ ID NO: 3038602 - RNA, 12 nt, Human
uacuguaaagaa

SEQ ID NO: 3038603 - RNA, 16 nt, Human
uacuguaaagaaagag

SEQ ID NO: 3038604 - RNA, 13 nt, Human
uacuguaaagaaa

SEQ ID NO: 3038605 - RNA, 20 nt, Human
uacuguaaagaaagagagaa

SEQ ID NO: 3038606 - RNA, 19 nt, Human
uacuguaaagaaagagaga

SEQ ID NO: 3038607 - RNA, 18 nt, Human
uacuguaaagaaagagag

SEQ ID NO: 3038608 - RNA, 17 nt, Human
uacuguaaagaaagaga

SEQ ID NO: 3038609 - RNA, 21 nt, Human
acaguuaaaugagaacaugaa

SEQ ID NO: 3038610 - RNA, 17 nt, Human
acagucaaggaguggcu

SEQ ID NO: 3038611 - RNA, 15 nt, Human
acagagaggacgugg

SEQ ID NO: 3038612 - RNA, 19 nt, Human
uccccaggccguggcugcc

SEQ ID NO: 3038613 - RNA, 21 nt, Human
uccccaggccguggcugccca

SEQ ID NO: 3038614 - RNA, 23 nt, Human
uccccaggccguggcugcccaca

SEQ ID NO: 3038615 - RNA, 13 nt, Human
accuccccaggcc

SEQ ID NO: 3038616 - RNA, 14 nt, Human
accuccccaggccg

SEQ ID NO: 3038617 - RNA, 19 nt, Human
accuccccaggccguggcu

SEQ ID NO: 3038618 - RNA, 20 nt, Human
accuccccaggccguggcug

SEQ ID NO: 3038619 - RNA, 22 nt, Human
accugguuccggaauccugucc

SEQ ID NO: 3038620 - RNA, 17 nt, Human
uccacguucaccccucc

SEQ ID NO: 3038621 - RNA, 19 nt, Human
uccaacguggggcagcaca

SEQ ID NO: 3038622 - RNA, 17 nt, Human
uccaacguggggcagca

SEQ ID NO: 3038623 - RNA, 18 nt, Human
uccaacguggggcagcac

SEQ ID NO: 3038624 - RNA, 17 nt, Human
agcagaugaccccuccc

SEQ ID NO: 3038625 - RNA, 18 nt, Human
agaucacguuccuucccc

SEQ ID NO: 3038626 - RNA, 20 nt, Human
agaaaacgguuaaaacuguc

SEQ ID NO: 3038627 - RNA, 19 nt, Human
ucuuaauauaacugccuua

SEQ ID NO: 3038628 - RNA, 18 nt, Human
ucuuaauauaacugccuu

SEQ ID NO: 3038629 - RNA, 15 nt, Human
ucuuaauauaacugc

SEQ ID NO: 3038630 - RNA, 11 nt, Human
ugcauacacac

SEQ ID NO: 3038631 - RNA, 10 nt, Human
ugcauacaca

SEQ ID NO: 3038632 - RNA, 9 nt, Human
ugcauacac

SEQ ID NO: 3038633 - RNA, 12 nt, Human
ugcauacacaca

SEQ ID NO: 3038634 - RNA, 24 nt, Human
ugcagagacagagaggacgugggc

SEQ ID NO: 3038635 - RNA, 19 nt, Human
ugcacguaguagggucagg

SEQ ID NO: 3038636 - RNA, 22 nt, Human
ugcacguaguagggucaggcca

SEQ ID NO: 3038637 - RNA, 16 nt, Human
ugcccacacaccccaa

SEQ ID NO: 3038638 - RNA, 12 nt, Human
aggccguggcug

SEQ ID NO: 3038639 - RNA, 20 nt, Human
aggccguggcugcccacaca

SEQ ID NO: 3038640 - RNA, 23 nt, Human
auacuguaaagaaagagagaaaa

SEQ ID NO: 3038641 - RNA, 22 nt, Human
auacuguaaagaaagagagaaa

SEQ ID NO: 3038642 - RNA, 21 nt, Human
auacuguaaagaaagagagaa

SEQ ID NO: 3038643 - RNA, 20 nt, Human
auacuguaaagaaagagaga

SEQ ID NO: 3038644 - RNA, 19 nt, Human
auacuguaaagaaagagag

SEQ ID NO: 3038645 - RNA, 18 nt, Human
auacuguaaagaaagaga

SEQ ID NO: 3038646 - RNA, 16 nt, Human
auacuguaaagaaaga

SEQ ID NO: 3038647 - RNA, 15 nt, Human
auacuguaaagaaag

SEQ ID NO: 3038648 - RNA, 14 nt, Human
auacuguaaagaaa

SEQ ID NO: 3038649 - RNA, 13 nt, Human
auacuguaaagaa

SEQ ID NO: 3038650 - RNA, 12 nt, Human
auacuguaaaga

SEQ ID NO: 3038651 - RNA, 23 nt, Human
uuccuguccuucucucaccuccu

SEQ ID NO: 3038652 - RNA, 24 nt, Human
uuccuguccuucucucaccuccua

SEQ ID NO: 3038653 - RNA, 17 nt, Human
augcgggcugggcagcu

SEQ ID NO: 3038654 - RNA, 18 nt, Human
augcgggcugggcagcug

SEQ ID NO: 3038655 - RNA, 19 nt, Human
augcgggcugggcagcugu

SEQ ID NO: 3038656 - RNA, 10 nt, Human
agaaaauaua

SEQ ID NO: 3038657 - RNA, 11 nt, Human
acagccacaca

SEQ ID NO: 3038658 - RNA, 10 nt, Human
acagccacac

SEQ ID NO: 3038659 - RNA, 19 nt, Human
acagccacacacacagaaa

SEQ ID NO: 3038660 - RNA, 18 nt, Human
acagccacacacacagaa

SEQ ID NO: 3038661 - RNA, 17 nt, Human
acagccacacacacaga

SEQ ID NO: 3038662 - RNA, 16 nt, Human
acagccacacacacag

SEQ ID NO: 3038663 - RNA, 15 nt, Human
acagccacacacaca

SEQ ID NO: 3038664 - RNA, 14 nt, Human
acagccacacacac

SEQ ID NO: 3038665 - RNA, 13 nt, Human
acagccacacaca

SEQ ID NO: 3038666 - RNA, 12 nt, Human
acagccacacac

SEQ ID NO: 3038667 - RNA, 23 nt, Human
acagccacacacacagaaaauau

SEQ ID NO: 3038668 - RNA, 22 nt, Human
acagccacacacacagaaaaua

SEQ ID NO: 3038669 - RNA, 21 nt, Human
acagccacacacacagaaaau

SEQ ID NO: 3038670 - RNA, 20 nt, Human
acagccacacacacagaaaa

SEQ ID NO: 3038671 - RNA, 13 nt, Human
acaugcauacaca

SEQ ID NO: 3038672 - RNA, 12 nt, Human
acaugcauacac

SEQ ID NO: 3038673 - RNA, 24 nt, Human
acaugcauacacacacacacacag

SEQ ID NO: 3038674 - RNA, 17 nt, Human
acaugcauacacacaca

SEQ ID NO: 3038675 - RNA, 16 nt, Human
acaugcauacacacac

SEQ ID NO: 3038676 - RNA, 15 nt, Human
acaugcauacacaca

SEQ ID NO: 3038677 - RNA, 14 nt, Human
acaugcauacacac

SEQ ID NO: 3038678 - RNA, 18 nt, Human
accccuccccuaaugccu

SEQ ID NO: 3038679 - RNA, 14 nt, Human
aaaaguuaaaaagu

SEQ ID NO: 3038680 - RNA, 11 nt, Human
aauauacugua

SEQ ID NO: 3038681 - RNA, 13 nt, Human
aauauacuguaaa

SEQ ID NO: 3038682 - RNA, 12 nt, Human
aauauacuguaa

SEQ ID NO: 3038683 - RNA, 23 nt, Human
aauauacuguaaagaaagagaga

SEQ ID NO: 3038684 - RNA, 22 nt, Human
aauauacuguaaagaaagagag

SEQ ID NO: 3038685 - RNA, 21 nt, Human
aauauacuguaaagaaagaga

SEQ ID NO: 3038686 - RNA, 18 nt, Human
aauauacuguaaagaaag

SEQ ID NO: 3038687 - RNA, 17 nt, Human
aauauacuguaaagaaa

SEQ ID NO: 3038688 - RNA, 16 nt, Human
aauauacuguaaagaa

SEQ ID NO: 3038689 - RNA, 15 nt, Human
aauauacuguaaaga

SEQ ID NO: 3038690 - RNA, 14 nt, Human
aauauacuguaaag

SEQ ID NO: 3038691 - RNA, 14 nt, Human
agaggacgugggcg

SEQ ID NO: 3038692 - RNA, 16 nt, Human
agaggacgugggcggc

SEQ ID NO: 3038693 - RNA, 12 nt, Human
agagaaaauaaa

SEQ ID NO: 3038694 - RNA, 14 nt, Human
agagaaaauaaaaa

SEQ ID NO: 3038695 - RNA, 13 nt, Human
agagaaaauaaaa

SEQ ID NO: 3038696 - RNA, 17 nt, Human
agagaaaauaaaaaguu

SEQ ID NO: 3038697 - RNA, 16 nt, Human
agagaaaauaaaaagu

SEQ ID NO: 3038698 - RNA, 15 nt, Human
agagaaaauaaaaag

SEQ ID NO: 3038699 - RNA, 14 nt, Human
agacgucccuccac

SEQ ID NO: 3038700 - RNA, 19 nt, Human
aguggcuuacuacaugugg

SEQ ID NO: 3038701 - RNA, 13 nt, Human
auauacuguaaag

SEQ ID NO: 3038702 - RNA, 12 nt, Human
auauacuguaaa

SEQ ID NO: 3038703 - RNA, 11 nt, Human
auauacuguaa

SEQ ID NO: 3038704 - RNA, 10 nt, Human
auauacugua

SEQ ID NO: 3038705 - RNA, 24 nt, Human
auauacuguaaagaaagagagaaa

SEQ ID NO: 3038706 - RNA, 23 nt, Human
auauacuguaaagaaagagagaa

SEQ ID NO: 3038707 - RNA, 22 nt, Human
auauacuguaaagaaagagaga

SEQ ID NO: 3038708 - RNA, 21 nt, Human
auauacuguaaagaaagagag

SEQ ID NO: 3038709 - RNA, 20 nt, Human
auauacuguaaagaaagaga

SEQ ID NO: 3038710 - RNA, 19 nt, Human
auauacuguaaagaaagag

SEQ ID NO: 3038711 - RNA, 18 nt, Human
auauacuguaaagaaaga

SEQ ID NO: 3038712 - RNA, 15 nt, Human
auauacuguaaagaa

SEQ ID NO: 3038713 - RNA, 14 nt, Human
auauacuguaaaga

SEQ ID NO: 3038714 - RNA, 21 nt, Human
auacacacacacacacagcca

SEQ ID NO: 3038715 - RNA, 23 nt, Human
auacacacacacacacagccaca

SEQ ID NO: 3038716 - RNA, 22 nt, Human
auacacacacacacacagccac

SEQ ID NO: 3038717 - RNA, 18 nt, Human
auaaaaaguuaaaaaguu

SEQ ID NO: 3038718 - RNA, 13 nt, Human
auaaaaaguuaaa

SEQ ID NO: 3038719 - RNA, 10 nt, Human
auaaaaaguu

SEQ ID NO: 3038720 - RNA, 12 nt, Human
auaaaaaguuaa

SEQ ID NO: 3038721 - RNA, 11 nt, Human
auaaaaaguua

SEQ ID NO: 3038722 - RNA, 12 nt, Human
auggaggcacac

SEQ ID NO: 3038723 - RNA, 14 nt, Human
cacagccacacaca

SEQ ID NO: 3038724 - RNA, 13 nt, Human
cacagccacacac

SEQ ID NO: 3038725 - RNA, 10 nt, Human
cacagccaca

SEQ ID NO: 3038726 - RNA, 12 nt, Human
cacagccacaca

SEQ ID NO: 3038727 - RNA, 11 nt, Human
cacagccacac

SEQ ID NO: 3038728 - RNA, 22 nt, Human
cacagagagggggccaccuccc

SEQ ID NO: 3038729 - RNA, 16 nt, Human
cacagacgucccucca

SEQ ID NO: 3038730 - RNA, 20 nt, Human
cacacagaaaauauacugua

SEQ ID NO: 3038731 - RNA, 19 nt, Human
cacacagaaaauauacugu

SEQ ID NO: 3038732 - RNA, 18 nt, Human
cacacacaugcauacaca

SEQ ID NO: 3038733 - RNA, 17 nt, Human
cacacacaugcauacac

SEQ ID NO: 3038734 - RNA, 16 nt, Human
cacacacaugcauaca

SEQ ID NO: 3038735 - RNA, 12 nt, Human
cacacacaugca

SEQ ID NO: 3038736 - RNA, 11 nt, Human
cacacagccac

SEQ ID NO: 3038737 - RNA, 22 nt, Human
cacacagaaaauauacuguaaa

SEQ ID NO: 3038738 - RNA, 21 nt, Human
cacacagaaaauauacuguaa

SEQ ID NO: 3038739 - RNA, 23 nt, Human
cacacagaaaauauacuguaaag

SEQ ID NO: 3038740 - RNA, 22 nt, Human
cacacagccacacacacagaaa

SEQ ID NO: 3038741 - RNA, 21 nt, Human
cacacagccacacacacagaa

SEQ ID NO: 3038742 - RNA, 20 nt, Human
cacacagccacacacacaga

SEQ ID NO: 3038743 - RNA, 19 nt, Human
cacacagccacacacacag

SEQ ID NO: 3038744 - RNA, 17 nt, Human
cacacagccacacacac

SEQ ID NO: 3038745 - RNA, 16 nt, Human
cacacagccacacaca

SEQ ID NO: 3038746 - RNA, 15 nt, Human
cacacagccacacac

SEQ ID NO: 3038747 - RNA, 14 nt, Human
cacacagccacaca

SEQ ID NO: 3038748 - RNA, 13 nt, Human
cacacagccacac

SEQ ID NO: 3038749 - RNA, 12 nt, Human
cacacagccaca

SEQ ID NO: 3038750 - RNA, 14 nt, Human
ccguggcugcggca

SEQ ID NO: 3038751 - RNA, 19 nt, Human
cccccacacacacacacau

SEQ ID NO: 3038752 - RNA, 11 nt, Human
ccccacacaca

SEQ ID NO: 3038753 - RNA, 14 nt, Human
ccccacacacacac

SEQ ID NO: 3038754 - RNA, 12 nt, Human
ccccacacacac

SEQ ID NO: 3038755 - RNA, 19 nt, Human
ccaggugcacagacguccc

SEQ ID NO: 3038756 - RNA, 13 nt, Human
ccaggugcacaga

SEQ ID NO: 3038757 - RNA, 16 nt, Human
ccaggugcacagacgu

SEQ ID NO: 3038758 - RNA, 17 nt, Human
cggaauccuguccucag

SEQ ID NO: 3038759 - RNA, 15 nt, Human
cggaauccuguccuc

SEQ ID NO: 3038760 - RNA, 18 nt, Human
cgcacgugggucuucagg

SEQ ID NO: 3038761 - RNA, 19 nt, Human
ccuuuguuuuuuuuuccug

SEQ ID NO: 3038762 - RNA, 14 nt, Human
cuaauuagagcaga

SEQ ID NO: 3038763 - RNA, 17 nt, Human
cuacaugugggagcuuu

SEQ ID NO: 3038764 - RNA, 16 nt, Human
cuacaugugggagcuu

SEQ ID NO: 3038765 - RNA, 23 nt, Human
gaaacccccacacacacacacau

SEQ ID NO: 3038766 - RNA, 15 nt, Human
gaaacccccacacac

SEQ ID NO: 3038767 - RNA, 17 nt, Human
gaaacccccacacacac

SEQ ID NO: 3038768 - RNA, 16 nt, Human
gaaacccccacacaca

SEQ ID NO: 3038769 - RNA, 11 nt, Human
gaaaauaaaaa

SEQ ID NO: 3038770 - RNA, 13 nt, Human
gaaaauaaaaagu

SEQ ID NO: 3038771 - RNA, 12 nt, Human
gaaaauaaaaag

SEQ ID NO: 3038772 - RNA, 17 nt, Human
cuguccucagcuucuua

SEQ ID NO: 3038773 - RNA, 15 nt, Human
cuguccucagcuucu

SEQ ID NO: 3038774 - RNA, 17 nt, Human
cugguuccggaauccug

SEQ ID NO: 3038775 - RNA, 18 nt, Human
cugguuccggaauccugu

SEQ ID NO: 3038776 - RNA, 14 nt, Human
gagagaaaauaaaa

SEQ ID NO: 3038777 - RNA, 17 nt, Human
gagagaaaauaaaaagu

SEQ ID NO: 3038778 - RNA, 16 nt, Human
gagagaaaauaaaaag

SEQ ID NO: 3038779 - RNA, 21 nt, Human
gagagaaaauaaaaaguuaaa

SEQ ID NO: 3038780 - RNA, 20 nt, Human
gagagaaaauaaaaaguuaa

SEQ ID NO: 3038781 - RNA, 19 nt, Human
gagagaaaauaaaaaguua

SEQ ID NO: 3038782 - RNA, 18 nt, Human
gagagaaaauaaaaaguu

SEQ ID NO: 3038783 - RNA, 18 nt, Human
gagagggggccaccuccc

SEQ ID NO: 3038784 - RNA, 12 nt, Human
gagaaaauaaaa

SEQ ID NO: 3038785 - RNA, 11 nt, Human
gagaaaauaaa

SEQ ID NO: 3038786 - RNA, 16 nt, Human
gagaaaauaaaaaguu

SEQ ID NO: 3038787 - RNA, 15 nt, Human
gagaaaauaaaaagu

SEQ ID NO: 3038788 - RNA, 14 nt, Human
gagaaaauaaaaag

SEQ ID NO: 3038789 - RNA, 13 nt, Human
gagaaaauaaaaa

SEQ ID NO: 3038790 - RNA, 18 nt, Human
gacaugcgggcugggcag

SEQ ID NO: 3038791 - RNA, 20 nt, Human
gacaugcgggcugggcagcu

SEQ ID NO: 3038792 - RNA, 21 nt, Human
gacaugcgggcugggcagcug

SEQ ID NO: 3038793 - RNA, 22 nt, Human
gacaugcgggcugggcagcugu

SEQ ID NO: 3038794 - RNA, 14 nt, Human
gacaugcgggcugg

SEQ ID NO: 3038795 - RNA, 15 nt, Human
gacaugcgggcuggg

SEQ ID NO: 3038796 - RNA, 18 nt, Human
gacagagaggacgugggc

SEQ ID NO: 3038797 - RNA, 19 nt, Human
gacagagaggacgugggcg

SEQ ID NO: 3038798 - RNA, 22 nt, Human
gagggggccaccuccccaggcc

SEQ ID NO: 3038799 - RNA, 18 nt, Human
gagggggccaccucccca

SEQ ID NO: 3038800 - RNA, 20 nt, Human
gagggggccaccuccccagg

SEQ ID NO: 3038801 - RNA, 19 nt, Human
gcacagagagggggccacc

SEQ ID NO: 3038802 - RNA, 23 nt, Human
gcacagagagggggccaccuccc

SEQ ID NO: 3038803 - RNA, 18 nt, Human
gcacagacgucccuccac

SEQ ID NO: 3038804 - RNA, 15 nt, Human
gcacagagagggggc

SEQ ID NO: 3038805 - RNA, 17 nt, Human
gcacagagagggggcca

SEQ ID NO: 3038806 - RNA, 16 nt, Human
gcgggcugggcagcug

SEQ ID NO: 3038807 - RNA, 14 nt, Human
gcgggcugggcagc

SEQ ID NO: 3038808 - RNA, 15 nt, Human
gucaaggaguggcuu

SEQ ID NO: 3038809 - RNA, 17 nt, Human
guccucagcuucuuaau

SEQ ID NO: 3038810 - RNA, 13 nt, Human
guccucagcuucu

SEQ ID NO: 3038811 - RNA, 12 nt, Human
gugcccccagac

SEQ ID NO: 3038812 - RNA, 10 nt, Human
uauacuguaa

SEQ ID NO: 3038813 - RNA, 19 nt, Human
uauacuguaaagaaagaga

SEQ ID NO: 3038814 - RNA, 17 nt, Human
uauacuguaaagaaaga

SEQ ID NO: 3038815 - RNA, 16 nt, Human
uauacuguaaagaaag

SEQ ID NO: 3038816 - RNA, 15 nt, Human
uauacuguaaagaaa

SEQ ID NO: 3038817 - RNA, 14 nt, Human
uauacuguaaagaa

SEQ ID NO: 3038818 - RNA, 13 nt, Human
uauacuguaaaga

SEQ ID NO: 3038819 - RNA, 12 nt, Human
uauacuguaaag

SEQ ID NO: 3038820 - RNA, 11 nt, Human
uauacuguaaa

SEQ ID NO: 3038821 - RNA, 20 nt, Human
uauacuguaaagaaagagag

SEQ ID NO: 3038822 - RNA, 22 nt, Human
ugaaugaaacccccacacacac

SEQ ID NO: 3038823 - RNA, 21 nt, Human
ugaaugaaacccccacacaca

SEQ ID NO: 3038824 - RNA, 20 nt, Human
ugaaugaaacccccacacac

SEQ ID NO: 3038825 - RNA, 19 nt, Human
ugaaugaaacccccacaca

SEQ ID NO: 3038826 - RNA, 18 nt, Human
ugaaugaaacccccacac

SEQ ID NO: 3038827 - RNA, 16 nt, Human
ugaaugaaacccccac

SEQ ID NO: 3038828 - RNA, 16 nt, Human
ugaaacccccacacac

SEQ ID NO: 3038829 - RNA, 18 nt, Human
ugaaacccccacacacac

SEQ ID NO: 3038830 - RNA, 17 nt, Human
ugaaacccccacacaca

SEQ ID NO: 3038831 - RNA, 17 nt, Human
ugcgcuuuugcugguca

SEQ ID NO: 3038832 - RNA, 18 nt, Human
ugcgcuuuugcuggucac

SEQ ID NO: 3038833 - RNA, 16 nt, Human
ugcuggucacugccau

SEQ ID NO: 3038834 - RNA, 21 nt, Human
ugguaugugacaugcgggcug

SEQ ID NO: 3038835 - RNA, 23 nt, Human
uuaauauaacugccuuaaaacuu

SEQ ID NO: 3038836 - RNA, 15 nt, Human
uuaauauaacugccu

SEQ ID NO: 3038837 - RNA, 21 nt, Human
uuagagcagaugaccccuccc

SEQ ID NO: 3038838 - RNA, 18 nt, Human
uuacuacaugugggagcu

SEQ ID NO: 3038839 - RNA, 18 nt, Human
uuuccuaacaggauuaga

SEQ ID NO: 3038840 - RNA, 22 nt, Human
uuuccuaacaggauuagacagu

SEQ ID NO: 3038841 - RNA, 20 nt, Human
cuguccuucucucaccuccu

SEQ ID NO: 3038842 - RNA, 23 nt, Human
cuguccuucucucaccuccuaaa

SEQ ID NO: 3038843 - RNA, 15 nt, Human
cuguccuucucucac

SEQ ID NO: 3038844 - RNA, 19 nt, Human
gaccccuccccuaaugccu

SEQ ID NO: 3038845 - RNA, 23 nt, Human
gaggacuguugacauccaagcuu

SEQ ID NO: 3038846 - RNA, 15 nt, Human
gaggacgugggcggc

SEQ ID NO: 3038847 - RNA, 16 nt, Human
gaggacgugggcggca

SEQ ID NO: 3038848 - RNA, 18 nt, Human
gaggacgugggcggcaga

SEQ ID NO: 3038849 - RNA, 20 nt, Human
gaggacgugggcggcagaga

SEQ ID NO: 3038850 - RNA, 22 nt, Human
gaggacgugggcggcagagagg

SEQ ID NO: 3038851 - RNA, 16 nt, Human
gagaggacgugggcgg

SEQ ID NO: 3038852 - RNA, 17 nt, Human
gagaggacgugggcggc

SEQ ID NO: 3038853 - RNA, 15 nt, Human
gcuuuugcuggucac

SEQ ID NO: 3038854 - RNA, 19 nt, Human
gcuuuugcuggucacugcc

SEQ ID NO: 3038855 - RNA, 21 nt, Human
gcuuuugcuggucacugccau

SEQ ID NO: 3038856 - RNA, 22 nt, Human
gcuuuugcuggucacugccaug

SEQ ID NO: 3038857 - RNA, 12 nt, Human
gcccccagacgc

SEQ ID NO: 3038858 - RNA, 12 nt, Human
gcggcagagagg

SEQ ID NO: 3038859 - RNA, 21 nt, Human
gguuccggaauccuguccuca

SEQ ID NO: 3038860 - RNA, 17 nt, Human
gggggccaccuccccag

SEQ ID NO: 3038861 - RNA, 13 nt, Human
gggcugggcagcu

SEQ ID NO: 3038862 - RNA, 14 nt, Human
gggcugggcagcug

SEQ ID NO: 3038863 - RNA, 17 nt, Human
cuccuaaaguagacuuc

SEQ ID NO: 3038864 - RNA, 12 nt, Human
cucucaccuccu

SEQ ID NO: 3038865 - RNA, 21 nt, Human
ccuguccuucucucaccuccu

SEQ ID NO: 3038866 - RNA, 17 nt, Human
cagucaaggaguggcuu

SEQ ID NO: 3038867 - RNA, 17 nt, Human
caggccacggcagccua

SEQ ID NO: 3038868 - RNA, 13 nt, Human
uaaaacugucccu

SEQ ID NO: 3038869 - RNA, 23 nt, Human
aagcuuccuuuguuuuuuuuucc

SEQ ID NO: 3038870 - RNA, 19 nt, Human
guuccggaauccuguccuc

SEQ ID NO: 3038871 - RNA, 22 nt, Human
guuccggaauccuguccucagc

SEQ ID NO: 3038872 - RNA, 16 nt, Human
gucacugccauggagg

SEQ ID NO: 3038873 - RNA, 20 nt, Human
gucacugccauggaggcaca

SEQ ID NO: 3038874 - RNA, 13 nt, Human
aagaaagagagaa

SEQ ID NO: 3038875 - RNA, 12 nt, Human
aagaaagagaga

SEQ ID NO: 3038876 - RNA, 20 nt, Human
aagaaagagagaaaauaaaa

SEQ ID NO: 3038877 - RNA, 18 nt, Human
aagaaagagagaaaauaa

SEQ ID NO: 3038878 - RNA, 16 nt, Human
aagaaagagagaaaau

SEQ ID NO: 3038879 - RNA, 15 nt, Human
aagaaagagagaaaa

SEQ ID NO: 3038880 - RNA, 14 nt, Human
aagaaagagagaaa

SEQ ID NO: 3038881 - RNA, 16 nt, Human
acacacacaugcauac

SEQ ID NO: 3038882 - RNA, 15 nt, Human
acacacacacacaca

SEQ ID NO: 3038883 - RNA, 12 nt, Human
acacacacaugc

SEQ ID NO: 3038884 - RNA, 11 nt, Human
acacacacaug

SEQ ID NO: 3038885 - RNA, 13 nt, Human
acacacacaugca

SEQ ID NO: 3038886 - RNA, 15 nt, Human
acacacacaugcaua

SEQ ID NO: 3038887 - RNA, 14 nt, Human
acacacacaugcau

SEQ ID NO: 3038888 - RNA, 14 nt, Human
acacacacacacac

SEQ ID NO: 3038889 - RNA, 12 nt, Human
acacacacacac

SEQ ID NO: 3038890 - RNA, 13 nt, Human
acacacacacaca

SEQ ID NO: 3038891 - RNA, 21 nt, Human
acagaaaauauacuguaaaga

SEQ ID NO: 3038892 - RNA, 20 nt, Human
acagaaaauauacuguaaag

SEQ ID NO: 3038893 - RNA, 19 nt, Human
acagaaaauauacuguaaa

SEQ ID NO: 3038894 - RNA, 18 nt, Human
acagaaaauauacuguaa

SEQ ID NO: 3038895 - RNA, 17 nt, Human
acagaaaauauacugua

SEQ ID NO: 3038896 - RNA, 16 nt, Human
acagaaaauauacugu

SEQ ID NO: 3038897 - RNA, 22 nt, Human
acagucaaggaguggcuuacua

SEQ ID NO: 3038898 - RNA, 18 nt, Human
acagucaaggaguggcuu

SEQ ID NO: 3038899 - RNA, 13 nt, Human
aaugugcccccag

SEQ ID NO: 3038900 - RNA, 13 nt, Human
uacaugugggagc

SEQ ID NO: 3038901 - RNA, 20 nt, Human
aaugaaacccccacacacac

SEQ ID NO: 3038902 - RNA, 19 nt, Human
aaugaaacccccacacaca

SEQ ID NO: 3038903 - RNA, 18 nt, Human
aaugaaacccccacacac

SEQ ID NO: 3038904 - RNA, 14 nt, Human
aaugaaacccccac

SEQ ID NO: 3038905 - RNA, 15 nt, Human
aauccuguccucagc

SEQ ID NO: 3038906 - RNA, 18 nt, Human
aauccuguccucagcuuc

SEQ ID NO: 3038907 - RNA, 21 nt, Human
aauccuguccucagcuucuua

SEQ ID NO: 3038908 - RNA, 12 nt, Human
ucagggggccag

SEQ ID NO: 3038909 - RNA, 12 nt, Human
acgucccuccac

SEQ ID NO: 3038910 - RNA, 22 nt, Human
acgucccuccacguucaccccu

SEQ ID NO: 3038911 - RNA, 13 nt, Human
acguucaccccuc

SEQ ID NO: 3038912 - RNA, 11 nt, Human
agagagaaaau

SEQ ID NO: 3038913 - RNA, 22 nt, Human
uguaaagaaagagagaaaauaa

SEQ ID NO: 3038914 - RNA, 23 nt, Human
uguaaagaaagagagaaaauaaa

SEQ ID NO: 3038915 - RNA, 22 nt, Human
ugggucuucagggggccaggug

SEQ ID NO: 3038916 - RNA, 22 nt, Human
ugugaagaucacguuccuuccc

SEQ ID NO: 3038917 - RNA, 20 nt, Human
ugucccuuucugugugaaga

SEQ ID NO: 3038918 - RNA, 21 nt, Human
uguccuucucucaccuccuaa

SEQ ID NO: 3038919 - RNA, 18 nt, Human
uguccuucucucaccucc

SEQ ID NO: 3038920 - RNA, 19 nt, Human
uguccuucucucaccuccu

SEQ ID NO: 3038921 - RNA, 13 nt, Human
uuaccuaauuaga

SEQ ID NO: 3038922 - RNA, 18 nt, Human
auaacugccuuaaaacuu

SEQ ID NO: 3038923 - RNA, 19 nt, Human
ugccugcggaguugugcac

SEQ ID NO: 3038924 - RNA, 13 nt, Human
uggcugcccacac

SEQ ID NO: 3038925 - RNA, 16 nt, Human
uggcugcggcacccuu

SEQ ID NO: 3038926 - RNA, 17 nt, Human
uggcugcggcacccuug

SEQ ID NO: 3038927 - RNA, 20 nt, Human
uggcuuacuacaugugggag

SEQ ID NO: 3038928 - RNA, 23 nt, Human
uggcuuacuacaugugggagcuu

SEQ ID NO: 3038929 - RNA, 13 nt, Human
aggccacggcagc

SEQ ID NO: 3038930 - RNA, 23 nt, Human
uucuuuucgccguggcugcggca

SEQ ID NO: 3038931 - RNA, 17 nt, Human
auccuguccucagcuuc

SEQ ID NO: 3038932 - RNA, 18 nt, Human
auccuguccucagcuucu

SEQ ID NO: 3038933 - RNA, 14 nt, Human
auccuguccucagc

SEQ ID NO: 3038934 - RNA, 16 nt, Human
aucccacuugccccug

SEQ ID NO: 3038935 - RNA, 13 nt, Human
uucucucaccucc

SEQ ID NO: 3038936 - RNA, 19 nt, Human
uuccuaacaggauuagaca

SEQ ID NO: 3038937 - RNA, 21 nt, Human
uuccggaauccuguccucagc

SEQ ID NO: 3038938 - RNA, 12 nt, Human
augugcccccag

SEQ ID NO: 3038939 - RNA, 14 nt, Human
augugcccccagac

SEQ ID NO: 3038940 - RNA, 22 nt, Human
aauauaacugccuuaaaacuuu

SEQ ID NO: 3038941 - RNA, 18 nt, Human
aaagaaagagagaaaaua

SEQ ID NO: 3038942 - RNA, 17 nt, Human
aaagaaagagagaaaau

SEQ ID NO: 3038943 - RNA, 16 nt, Human
aaacugaaugaaaccc

SEQ ID NO: 3038944 - RNA, 12 nt, Human
aaagaaagagag

SEQ ID NO: 3038945 - RNA, 16 nt, Human
aaagaaagagagaaaa

SEQ ID NO: 3038946 - RNA, 15 nt, Human
aaagaaagagagaaa

SEQ ID NO: 3038947 - RNA, 14 nt, Human
aaagaaagagagaa

SEQ ID NO: 3038948 - RNA, 13 nt, Human
aaagaaagagaga

SEQ ID NO: 3038949 - RNA, 16 nt, Human
acauccaagcuuccuu

SEQ ID NO: 3038950 - RNA, 13 nt, Human
acauccaagcuuc

SEQ ID NO: 3038951 - RNA, 12 nt, Human
agaaaauaaaaa

SEQ ID NO: 3038952 - RNA, 14 nt, Human
agaaaauaaaaagu

SEQ ID NO: 3038953 - RNA, 13 nt, Human
agaaaauaaaaag

SEQ ID NO: 3038954 - RNA, 18 nt, Human
agaaaauaaaaaguuaaa

SEQ ID NO: 3038955 - RNA, 17 nt, Human
agaaaauaaaaaguuaa

SEQ ID NO: 3038956 - RNA, 16 nt, Human
agaaaauaaaaaguua

SEQ ID NO: 3038957 - RNA, 15 nt, Human
agaaaauaaaaaguu

SEQ ID NO: 3038958 - RNA, 23 nt, Human
agaaaauauacuguaaagaaaga

SEQ ID NO: 3038959 - RNA, 12 nt, Human
agaaaauauacu

SEQ ID NO: 3038960 - RNA, 14 nt, Human
agaaaauauacugu

SEQ ID NO: 3038961 - RNA, 13 nt, Human
agaaaauauacug

SEQ ID NO: 3038962 - RNA, 11 nt, Human
agaaaauauac

SEQ ID NO: 3038963 - RNA, 22 nt, Human
agaaaauauacuguaaagaaag

SEQ ID NO: 3038964 - RNA, 21 nt, Human
agaaaauauacuguaaagaaa

SEQ ID NO: 3038965 - RNA, 20 nt, Human
agaaaauauacuguaaagaa

SEQ ID NO: 3038966 - RNA, 19 nt, Human
agaaaauauacuguaaaga

SEQ ID NO: 3038967 - RNA, 18 nt, Human
agaaaauauacuguaaag

SEQ ID NO: 3038968 - RNA, 17 nt, Human
agaaaauauacuguaaa

SEQ ID NO: 3038969 - RNA, 16 nt, Human
agaaaauauacuguaa

SEQ ID NO: 3038970 - RNA, 15 nt, Human
agaaaauauacugua

SEQ ID NO: 3038971 - RNA, 13 nt, Human
auacacacacaca

SEQ ID NO: 3038972 - RNA, 14 nt, Human
auacacacacacac

SEQ ID NO: 3038973 - RNA, 11 nt, Human
auacacacaca

SEQ ID NO: 3038974 - RNA, 15 nt, Human
auacacacacacaca

SEQ ID NO: 3038975 - RNA, 19 nt, Human
auacacacacacacacagc

SEQ ID NO: 3038976 - RNA, 18 nt, Human
auacacacacacacacag

SEQ ID NO: 3038977 - RNA, 20 nt, Human
auacacacacacacacagcc

SEQ ID NO: 3038978 - RNA, 16 nt, Human
agucaaggaguggcuu

SEQ ID NO: 3038979 - RNA, 11 nt, Human
augaccccucc

SEQ ID NO: 3038980 - RNA, 19 nt, Human
augaaacccccacacacac

SEQ ID NO: 3038981 - RNA, 18 nt, Human
augaaacccccacacaca

SEQ ID NO: 3038982 - RNA, 17 nt, Human
augaaacccccacacac

SEQ ID NO: 3038983 - RNA, 16 nt, Human
augaaacccccacaca

SEQ ID NO: 3038984 - RNA, 15 nt, Human
augaaacccccacac

SEQ ID NO: 3038985 - RNA, 20 nt, Human
agcuucuuaauauaacugcc

SEQ ID NO: 3038986 - RNA, 21 nt, Human
agcuucuuaauauaacugccu

SEQ ID NO: 3038987 - RNA, 22 nt, Human
agcuucuuaauauaacugccuu

SEQ ID NO: 3038988 - RNA, 23 nt, Human
agcuucuuaauauaacugccuua

SEQ ID NO: 3038989 - RNA, 23 nt, Human
agcuuccuuuguuuuuuuuuccu

SEQ ID NO: 3038990 - RNA, 18 nt, Human
agagaggacgugggcggc

SEQ ID NO: 3038991 - RNA, 14 nt, Human
agaugaccccuccc

SEQ ID NO: 3038992 - RNA, 17 nt, Human
cacugccauggaggcac

SEQ ID NO: 3038993 - RNA, 19 nt, Human
cacugccauggaggcacac

SEQ ID NO: 3038994 - RNA, 22 nt, Human
cacugccauggaggcacacagc

SEQ ID NO: 3038995 - RNA, 18 nt, Human
cacuugccccuguuaccu

SEQ ID NO: 3038996 - RNA, 13 nt, Human
cacguucaccccu

SEQ ID NO: 3038997 - RNA, 20 nt, Human
cacguuccuucccccgcaau

SEQ ID NO: 3038998 - RNA, 17 nt, Human
cacguaguagggucagg

SEQ ID NO: 3038999 - RNA, 19 nt, Human
cacguaguagggucaggcc

SEQ ID NO: 3039000 - RNA, 20 nt, Human
cacguaguagggucaggcca

SEQ ID NO: 3039001 - RNA, 21 nt, Human
cacguaguagggucaggccac

SEQ ID NO: 3039002 - RNA, 23 nt, Human
cacguaguagggucaggccacgg

SEQ ID NO: 3039003 - RNA, 21 nt, Human
caccuccccaggccguggcug

SEQ ID NO: 3039004 - RNA, 14 nt, Human
caccuccccaggcc

SEQ ID NO: 3039005 - RNA, 15 nt, Human
caccuccccaggccg

SEQ ID NO: 3039006 - RNA, 16 nt, Human
caccugguuccggaau

SEQ ID NO: 3039007 - RNA, 20 nt, Human
caccugguuccggaauccug

SEQ ID NO: 3039008 - RNA, 21 nt, Human
caccugguuccggaauccugu

SEQ ID NO: 3039009 - RNA, 23 nt, Human
caccugguuccggaauccugucc

SEQ ID NO: 3039010 - RNA, 17 nt, Human
cagacgcacgugggucu

SEQ ID NO: 3039011 - RNA, 15 nt, Human
cagacgucccuccac

SEQ ID NO: 3039012 - RNA, 19 nt, Human
cagaaaacgguuaaaacug

SEQ ID NO: 3039013 - RNA, 20 nt, Human
cagaaaacgguuaaaacugu

SEQ ID NO: 3039014 - RNA, 21 nt, Human
cagaaaauauacuguaaagaa

SEQ ID NO: 3039015 - RNA, 20 nt, Human
cagaaaauauacuguaaaga

SEQ ID NO: 3039016 - RNA, 19 nt, Human
cagaaaauauacuguaaag

SEQ ID NO: 3039017 - RNA, 18 nt, Human
cagaaaauauacuguaaa

SEQ ID NO: 3039018 - RNA, 11 nt, Human
cagaaaauaua

SEQ ID NO: 3039019 - RNA, 13 nt, Human
cagaaaauauacu

SEQ ID NO: 3039020 - RNA, 12 nt, Human
cagaaaauauac

SEQ ID NO: 3039021 - RNA, 17 nt, Human
cagaaaauauacuguaa

SEQ ID NO: 3039022 - RNA, 16 nt, Human
cagaaaauauacugua

SEQ ID NO: 3039023 - RNA, 15 nt, Human
cagaaaauauacugu

SEQ ID NO: 3039024 - RNA, 14 nt, Human
cagaaaauauacug

SEQ ID NO: 3039025 - RNA, 13 nt, Human
cagaugaccccuc

SEQ ID NO: 3039026 - RNA, 14 nt, Human
cagaugaccccucc

SEQ ID NO: 3039027 - RNA, 18 nt, Human
cagaugaccccuccccua

SEQ ID NO: 3039028 - RNA, 14 nt, Human
cagagacagagagg

SEQ ID NO: 3039029 - RNA, 16 nt, Human
cagagacagagaggac

SEQ ID NO: 3039030 - RNA, 22 nt, Human
cagcuucuuaauauaacugccu

SEQ ID NO: 3039031 - RNA, 23 nt, Human
cagccacacacacagaaaauaua

SEQ ID NO: 3039032 - RNA, 22 nt, Human
cagccacacacacagaaaauau

SEQ ID NO: 3039033 - RNA, 21 nt, Human
cagccacacacacagaaaaua

SEQ ID NO: 3039034 - RNA, 20 nt, Human
cagccacacacacagaaaau

SEQ ID NO: 3039035 - RNA, 19 nt, Human
cagccacacacacagaaaa

SEQ ID NO: 3039036 - RNA, 18 nt, Human
cagccacacacacagaaa

SEQ ID NO: 3039037 - RNA, 17 nt, Human
cagccacacacacagaa

SEQ ID NO: 3039038 - RNA, 16 nt, Human
cagccacacacacaga

SEQ ID NO: 3039039 - RNA, 15 nt, Human
cagccacacacacag

SEQ ID NO: 3039040 - RNA, 9 nt, Human
cagccacac

SEQ ID NO: 3039041 - RNA, 14 nt, Human
cagccacacacaca

SEQ ID NO: 3039042 - RNA, 13 nt, Human
cagccacacacac

SEQ ID NO: 3039043 - RNA, 12 nt, Human
cagccacacaca

SEQ ID NO: 3039044 - RNA, 11 nt, Human
cagccacacac

SEQ ID NO: 3039045 - RNA, 19 nt, Human
cagggggccaggugcacag

SEQ ID NO: 3039046 - RNA, 11 nt, Human
cagggggccag

SEQ ID NO: 3039047 - RNA, 13 nt, Human
cagggggccaggu

SEQ ID NO: 3039048 - RNA, 16 nt, Human
cagggggccaggugca

SEQ ID NO: 3039049 - RNA, 20 nt, Human
cauggaggcacacagcugca

SEQ ID NO: 3039050 - RNA, 16 nt, Human
cauggaggcacacagc

SEQ ID NO: 3039051 - RNA, 19 nt, Human
cauggaggcacacagcugc

SEQ ID NO: 3039052 - RNA, 13 nt, Human
cauggaggcacac

SEQ ID NO: 3039053 - RNA, 21 nt, Human
caugcgggcugggcagcuguu

SEQ ID NO: 3039054 - RNA, 15 nt, Human
caugcgggcugggca

SEQ ID NO: 3039055 - RNA, 18 nt, Human
caugcgggcugggcagcu

SEQ ID NO: 3039056 - RNA, 19 nt, Human
caugcgggcugggcagcug

SEQ ID NO: 3039057 - RNA, 20 nt, Human
caugcgggcugggcagcugu

SEQ ID NO: 3039058 - RNA, 13 nt, Human
ccaccuccccagg

SEQ ID NO: 3039059 - RNA, 16 nt, Human
ccaccuccccaggccg

SEQ ID NO: 3039060 - RNA, 23 nt, Human
ccaccuccccaggccguggcugc

SEQ ID NO: 3039061 - RNA, 14 nt, Human
ccacguucaccccu

SEQ ID NO: 3039062 - RNA, 15 nt, Human
ccacguucaccccuc

SEQ ID NO: 3039063 - RNA, 17 nt, Human
ccacguucaccccucca

SEQ ID NO: 3039064 - RNA, 13 nt, Human
ccacacaccccaa

SEQ ID NO: 3039065 - RNA, 12 nt, Human
ccacacacccca

SEQ ID NO: 3039066 - RNA, 23 nt, Human
ccacacacacagaaaauauacug

SEQ ID NO: 3039067 - RNA, 22 nt, Human
ccacacacacagaaaauauacu

SEQ ID NO: 3039068 - RNA, 17 nt, Human
ccacacacacagaaaau

SEQ ID NO: 3039069 - RNA, 21 nt, Human
ccacacacacagaaaauauac

SEQ ID NO: 3039070 - RNA, 20 nt, Human
ccacacacacagaaaauaua

SEQ ID NO: 3039071 - RNA, 19 nt, Human
ccacacacacagaaaauau

SEQ ID NO: 3039072 - RNA, 18 nt, Human
ccacacacacagaaaaua

SEQ ID NO: 3039073 - RNA, 14 nt, Human
ccaggccguggcug

SEQ ID NO: 3039074 - RNA, 16 nt, Human
ccaggccguggcugcc

SEQ ID NO: 3039075 - RNA, 18 nt, Human
ccaggccguggcugccca

SEQ ID NO: 3039076 - RNA, 16 nt, Human
ccuucucucaccuccu

SEQ ID NO: 3039077 - RNA, 19 nt, Human
ccuucucucaccuccuaaa

SEQ ID NO: 3039078 - RNA, 17 nt, Human
ccuucucucaccuccua

SEQ ID NO: 3039079 - RNA, 18 nt, Human
ccuucucucaccuccuaa

SEQ ID NO: 3039080 - RNA, 23 nt, Human
ccuuaaaacuuuaaucccacuug

SEQ ID NO: 3039081 - RNA, 21 nt, Human
ccuaccggcaauuuccggcca

SEQ ID NO: 3039082 - RNA, 20 nt, Human
ccuaccggcaauuuccggcc

SEQ ID NO: 3039083 - RNA, 21 nt, Human
ccgcaaugugcccccagacgc

SEQ ID NO: 3039084 - RNA, 17 nt, Human
ccuccacguucaccccu

SEQ ID NO: 3039085 - RNA, 18 nt, Human
ccuccacguucaccccuc

SEQ ID NO: 3039086 - RNA, 14 nt, Human
cccacacacacaca

SEQ ID NO: 3039087 - RNA, 13 nt, Human
cccacacacacac

SEQ ID NO: 3039088 - RNA, 11 nt, Human
cccacacacac

SEQ ID NO: 3039089 - RNA, 10 nt, Human
cccacacaca

SEQ ID NO: 3039090 - RNA, 20 nt, Human
cccacacacacacacaugca

SEQ ID NO: 3039091 - RNA, 19 nt, Human
cccacacacacacacaugc

SEQ ID NO: 3039092 - RNA, 18 nt, Human
cccacacacacacacaug

SEQ ID NO: 3039093 - RNA, 17 nt, Human
cccacacacacacacau

SEQ ID NO: 3039094 - RNA, 18 nt, Human
cccuccacguucaccccu

SEQ ID NO: 3039095 - RNA, 12 nt, Human
cccuaaugccug

SEQ ID NO: 3039096 - RNA, 22 nt, Human
cuuccuuuguuuuuuuuuccug

SEQ ID NO: 3039097 - RNA, 20 nt, Human
cuucccccgcaaugugcccc

SEQ ID NO: 3039098 - RNA, 13 nt, Human
cuucauuuuuccu

SEQ ID NO: 3039099 - RNA, 14 nt, Human
cuucauuuuuccua

SEQ ID NO: 3039100 - RNA, 16 nt, Human
cuucauuuuuccuaac

SEQ ID NO: 3039101 - RNA, 17 nt, Human
cuucauuuuuccuaaca

SEQ ID NO: 3039102 - RNA, 20 nt, Human
cuguugacauccaagcuucc

SEQ ID NO: 3039103 - RNA, 23 nt, Human
cuguugacauccaagcuuccuuu

SEQ ID NO: 3039104 - RNA, 22 nt, Human
gaauccuguccucagcuucuua

SEQ ID NO: 3039105 - RNA, 16 nt, Human
gaaugaaacccccaca

SEQ ID NO: 3039106 - RNA, 20 nt, Human
gaaugaaacccccacacaca

SEQ ID NO: 3039107 - RNA, 19 nt, Human
gaaugaaacccccacacac

SEQ ID NO: 3039108 - RNA, 21 nt, Human
gaaugaaacccccacacacac

SEQ ID NO: 3039109 - RNA, 18 nt, Human
gaaaauauacuguaaaga

SEQ ID NO: 3039110 - RNA, 20 nt, Human
gaaaauauacuguaaagaaa

SEQ ID NO: 3039111 - RNA, 19 nt, Human
gaaaauauacuguaaagaa

SEQ ID NO: 3039112 - RNA, 23 nt, Human
gaaaauauacuguaaagaaagag

SEQ ID NO: 3039113 - RNA, 21 nt, Human
gaaaauauacuguaaagaaag

SEQ ID NO: 3039114 - RNA, 20 nt, Human
cuccacguucaccccuccac

SEQ ID NO: 3039115 - RNA, 16 nt, Human
cuccacguucaccccu

SEQ ID NO: 3039116 - RNA, 18 nt, Human
cuccacguucaccccucc

SEQ ID NO: 3039117 - RNA, 21 nt, Human
cugcggcacccuugcgcuuuu

SEQ ID NO: 3039118 - RNA, 20 nt, Human
gaggcacacagcugcagaga

SEQ ID NO: 3039119 - RNA, 24 nt, Human
gaggcacacagcugcagagacaga

SEQ ID NO: 3039120 - RNA, 15 nt, Human
gccaccuccccaggc

SEQ ID NO: 3039121 - RNA, 17 nt, Human
gccaccuccccaggccg

SEQ ID NO: 3039122 - RNA, 13 nt, Human
gccacggcagccu

SEQ ID NO: 3039123 - RNA, 10 nt, Human
gccacacaca

SEQ ID NO: 3039124 - RNA, 18 nt, Human
gccacacacacagaaaau

SEQ ID NO: 3039125 - RNA, 17 nt, Human
gccacacacacagaaaa

SEQ ID NO: 3039126 - RNA, 16 nt, Human
gccacacacacagaaa

SEQ ID NO: 3039127 - RNA, 15 nt, Human
gccacacacacagaa

SEQ ID NO: 3039128 - RNA, 14 nt, Human
gccacacacacaga

SEQ ID NO: 3039129 - RNA, 13 nt, Human
gccacacacacag

SEQ ID NO: 3039130 - RNA, 12 nt, Human
gccacacacaca

SEQ ID NO: 3039131 - RNA, 11 nt, Human
gccacacacac

SEQ ID NO: 3039132 - RNA, 23 nt, Human
gccacacacacagaaaauauacu

SEQ ID NO: 3039133 - RNA, 22 nt, Human
gccacacacacagaaaauauac

SEQ ID NO: 3039134 - RNA, 21 nt, Human
gccacacacacagaaaauaua

SEQ ID NO: 3039135 - RNA, 20 nt, Human
gccacacacacagaaaauau

SEQ ID NO: 3039136 - RNA, 19 nt, Human
gccacacacacagaaaaua

SEQ ID NO: 3039137 - RNA, 23 nt, Human
gcacgugggucuucagggggcca

SEQ ID NO: 3039138 - RNA, 15 nt, Human
gcagaugaccccucc

SEQ ID NO: 3039139 - RNA, 16 nt, Human
gcagaugaccccuccc

SEQ ID NO: 3039140 - RNA, 21 nt, Human
gcuuacuacaugugggagcuu

SEQ ID NO: 3039141 - RNA, 13 nt, Human
gcuggucacugcc

SEQ ID NO: 3039142 - RNA, 15 nt, Human
gcuggucacugccau

SEQ ID NO: 3039143 - RNA, 18 nt, Human
gcuggucacugccaugga

SEQ ID NO: 3039144 - RNA, 13 nt, Human
gcuguuagagucc

SEQ ID NO: 3039145 - RNA, 14 nt, Human
gcugcggcacccuu

SEQ ID NO: 3039146 - RNA, 15 nt, Human
gcugcggcacccuug

SEQ ID NO: 3039147 - RNA, 16 nt, Human
gccuuaaaacuuuaau

SEQ ID NO: 3039148 - RNA, 13 nt, Human
gccuuaaaacuuu

SEQ ID NO: 3039149 - RNA, 16 nt, Human
ggaggcacacagcugc

SEQ ID NO: 3039150 - RNA, 17 nt, Human
ggaggcacacagcugca

SEQ ID NO: 3039151 - RNA, 13 nt, Human
ggccguggcugcc

SEQ ID NO: 3039152 - RNA, 16 nt, Human
ggccguggcugcccac

SEQ ID NO: 3039153 - RNA, 17 nt, Human
ucaccccuccacccuug

SEQ ID NO: 3039154 - RNA, 12 nt, Human
ucaccccuccac

SEQ ID NO: 3039155 - RNA, 19 nt, Human
uccuuuguuuuuuuuuccu

SEQ ID NO: 3039156 - RNA, 23 nt, Human
uccuuuguuuuuuuuuccugucc

SEQ ID NO: 3039157 - RNA, 16 nt, Human
uccuguccucagcuuc

SEQ ID NO: 3039158 - RNA, 22 nt, Human
uccuguccuucucucaccuccu

SEQ ID NO: 3039159 - RNA, 20 nt, Human
ugguuccggaauccuguccu

SEQ ID NO: 3039160 - RNA, 13 nt, Human
uggggcagcacag

SEQ ID NO: 3039161 - RNA, 14 nt, Human
uggggcagcacaga

SEQ ID NO: 3039162 - RNA, 22 nt, Human
uggggcagcacagagagggggc

SEQ ID NO: 3039163 - RNA, 16 nt, Human
uggggcagcacagaga

SEQ ID NO: 3039164 - RNA, 18 nt, Human
uggggcagcacagagagg

SEQ ID NO: 3039165 - RNA, 13 nt, Human
uucauuuuuccua

SEQ ID NO: 3039166 - RNA, 15 nt, Human
uucauuuuuccuaac

SEQ ID NO: 3039167 - RNA, 13 nt, Human
uucugugugaaga

SEQ ID NO: 3039168 - RNA, 16 nt, Human
agaggguguccugcac

SEQ ID NO: 3039169 - RNA, 14 nt, Human
agacgggcccuggu

SEQ ID NO: 3039170 - RNA, 23 nt, Human
aggugcuucuaguucugccagga

SEQ ID NO: 3039171 - RNA, 22 nt, Human
aggugcuucuaguucugccagg

SEQ ID NO: 3039172 - RNA, 21 nt, Human
aggugcuucuaguucugccag

SEQ ID NO: 3039173 - RNA, 17 nt, Human
aggggccgggggcaguc

SEQ ID NO: 3039174 - RNA, 22 nt, Human
acgccagacuucccacggcucc

SEQ ID NO: 3039175 - RNA, 16 nt, Human
acgccagacuucccac

SEQ ID NO: 3039176 - RNA, 15 nt, Human
acagguuagcugcuc

SEQ ID NO: 3039177 - RNA, 15 nt, Human
accccgacuuuuguu

SEQ ID NO: 3039178 - RNA, 12 nt, Human
accccgacuuuu

SEQ ID NO: 3039179 - RNA, 16 nt, Human
uuuuguuuaccagaga

SEQ ID NO: 3039180 - RNA, 20 nt, Human
auuucccuuccuuccucucc

SEQ ID NO: 3039181 - RNA, 16 nt, Human
aucggggagccgggag

SEQ ID NO: 3039182 - RNA, 18 nt, Human
aucggggagccgggagcc

SEQ ID NO: 3039183 - RNA, 22 nt, Human
uuguccucagccccgcguggaa

SEQ ID NO: 3039184 - RNA, 20 nt, Human
uugucacgccagacuuccca

SEQ ID NO: 3039185 - RNA, 13 nt, Human
uugucacgccaga

SEQ ID NO: 3039186 - RNA, 19 nt, Human
aggccauucuuucccaaca

SEQ ID NO: 3039187 - RNA, 18 nt, Human
aggccauucuuucccaac

SEQ ID NO: 3039188 - RNA, 17 nt, Human
aggccauucuuucccaa

SEQ ID NO: 3039189 - RNA, 22 nt, Human
uggaccagccucuccacucaug

SEQ ID NO: 3039190 - RNA, 16 nt, Human
uggaccagccucucca

SEQ ID NO: 3039191 - RNA, 13 nt, Human
ugcuccccacguc

SEQ ID NO: 3039192 - RNA, 14 nt, Human
aguccaucagccuc

SEQ ID NO: 3039193 - RNA, 13 nt, Human
aguccaucagccu

SEQ ID NO: 3039194 - RNA, 16 nt, Human
aguccaucagccucca

SEQ ID NO: 3039195 - RNA, 13 nt, Human
agucccugccugg

SEQ ID NO: 3039196 - RNA, 13 nt, Human
ugagagaggccau

SEQ ID NO: 3039197 - RNA, 17 nt, Human
ucuaguucugccaggag

SEQ ID NO: 3039198 - RNA, 16 nt, Human
ucuaguucugccagga

SEQ ID NO: 3039199 - RNA, 15 nt, Human
ucuaguucugccagg

SEQ ID NO: 3039200 - RNA, 19 nt, Human
uccugcaccggggccuggg

SEQ ID NO: 3039201 - RNA, 18 nt, Human
uccugcaccggggccugg

SEQ ID NO: 3039202 - RNA, 17 nt, Human
accuaggcuaggguggg

SEQ ID NO: 3039203 - RNA, 12 nt, Human
accuaggcuagg

SEQ ID NO: 3039204 - RNA, 19 nt, Human
ucaugugacucuuuccaac

SEQ ID NO: 3039205 - RNA, 18 nt, Human
ucaugugacucuuuccaa

SEQ ID NO: 3039206 - RNA, 17 nt, Human
ucaugugacucuuucca

SEQ ID NO: 3039207 - RNA, 14 nt, Human
ucaugugacucuuu

SEQ ID NO: 3039208 - RNA, 13 nt, Human
accgaggcaggga

SEQ ID NO: 3039209 - RNA, 16 nt, Human
acaccucuuggggagu

SEQ ID NO: 3039210 - RNA, 15 nt, Human
guccaucagccucca

SEQ ID NO: 3039211 - RNA, 22 nt, Human
gucccgggacaccuaggcuagg

SEQ ID NO: 3039212 - RNA, 17 nt, Human
cagucugagagaggcca

SEQ ID NO: 3039213 - RNA, 17 nt, Human
cagaggguguccugcac

SEQ ID NO: 3039214 - RNA, 18 nt, Human
caacaccucuuggggagu

SEQ ID NO: 3039215 - RNA, 15 nt, Human
cacuggggcaggggc

SEQ ID NO: 3039216 - RNA, 13 nt, Human
cacuggggcaggg

SEQ ID NO: 3039217 - RNA, 17 nt, Human
ccauccuacccccugug

SEQ ID NO: 3039218 - RNA, 15 nt, Human
cucgugucuggcaca

SEQ ID NO: 3039219 - RNA, 18 nt, Human
cucaugugacucuuucca

SEQ ID NO: 3039220 - RNA, 13 nt, Human
cugagagaggcca

SEQ ID NO: 3039221 - RNA, 22 nt, Human
cugagagaggccauucuuuccc

SEQ ID NO: 3039222 - RNA, 21 nt, Human
cugagagaggccauucuuucc

SEQ ID NO: 3039223 - RNA, 14 nt, Human
cugagagaggccau

SEQ ID NO: 3039224 - RNA, 22 nt, Human
gggggcagucugagagaggcca

SEQ ID NO: 3039225 - RNA, 21 nt, Human
ggguguccugcaccggggccu

SEQ ID NO: 3039226 - RNA, 17 nt, Human
ggguguccugcaccggg

SEQ ID NO: 3039227 - RNA, 22 nt, Human
gguggggggggggcgcggcugg

SEQ ID NO: 3039228 - RNA, 21 nt, Human
gguggggagagacgggcccug

SEQ ID NO: 3039229 - RNA, 14 nt, Human
ggcaggagggaggu

SEQ ID NO: 3039230 - RNA, 12 nt, Human
ggcaggggccgg

SEQ ID NO: 3039231 - RNA, 23 nt, Human
ggcaucggggagccgggagccug

SEQ ID NO: 3039232 - RNA, 18 nt, Human
ggcauccagagucccugc

SEQ ID NO: 3039233 - RNA, 16 nt, Human
ggcauccagagucccu

SEQ ID NO: 3039234 - RNA, 22 nt, Human
ggcaucggggagccgggagccu

SEQ ID NO: 3039235 - RNA, 14 nt, Human
ggagggggagaggg

SEQ ID NO: 3039236 - RNA, 21 nt, Human
gcguggaacucgugucuggca

SEQ ID NO: 3039237 - RNA, 19 nt, Human
gcucagaggguguccugca

SEQ ID NO: 3039238 - RNA, 18 nt, Human
gcucagaggguguccugc

SEQ ID NO: 3039239 - RNA, 18 nt, Human
gcuaggguggggagagac

SEQ ID NO: 3039240 - RNA, 17 nt, Human
gcuaggguggggagaga

SEQ ID NO: 3039241 - RNA, 12 nt, Human
gccauucuuucc

SEQ ID NO: 3039242 - RNA, 19 nt, Human
gccauucuuucccaacacc

SEQ ID NO: 3039243 - RNA, 16 nt, Human
ggacaccuaggcuagg

SEQ ID NO: 3039244 - RNA, 16 nt, Human
ggacaccccgacuuuu

SEQ ID NO: 3039245 - RNA, 16 nt, Human
gagacgggcccuggug

SEQ ID NO: 3039246 - RNA, 21 nt, Human
gcauccagagucccugccugg

SEQ ID NO: 3039247 - RNA, 23 nt, Human
gcauccagagucccugccuggac

SEQ ID NO: 3039248 - RNA, 22 nt, Human
gcauccagagucccugccugga

SEQ ID NO: 3039249 - RNA, 17 nt, Human
gcaucggggagccggga

SEQ ID NO: 3039250 - RNA, 15 nt, Human
gaucccaugagcucc

SEQ ID NO: 3039251 - RNA, 19 nt, Human
gaucccaacacugccagca

SEQ ID NO: 3039252 - RNA, 18 nt, Human
gaucccaacacugccagc

SEQ ID NO: 3039253 - RNA, 17 nt, Human
gaucccaacacugccag

SEQ ID NO: 3039254 - RNA, 19 nt, Human
cuuccucuccugucucccu

SEQ ID NO: 3039255 - RNA, 15 nt, Human
cuuccucuccugucu

SEQ ID NO: 3039256 - RNA, 12 nt, Human
caacacugccag

SEQ ID NO: 3039257 - RNA, 14 nt, Human
caacacugccagca

SEQ ID NO: 3039258 - RNA, 13 nt, Human
caacacugccagc

SEQ ID NO: 3039259 - RNA, 22 nt, Human
caaccggcuuuguggcacuggg

SEQ ID NO: 3039260 - RNA, 13 nt, Human
caaccggcuuugu

SEQ ID NO: 3039261 - RNA, 19 nt, Human
uuuccaaccggcuuugugg

SEQ ID NO: 3039262 - RNA, 18 nt, Human
ugggaggagggcaggcau

SEQ ID NO: 3039263 - RNA, 17 nt, Human
ugggaggagggcaggca

SEQ ID NO: 3039264 - RNA, 14 nt, Human
ugggaggagggcag

SEQ ID NO: 3039265 - RNA, 23 nt, Human
uggccuaaccugccgagagucca

SEQ ID NO: 3039266 - RNA, 18 nt, Human
uguccugcaccggggccu

SEQ ID NO: 3039267 - RNA, 13 nt, Human
uguccucagcccc

SEQ ID NO: 3039268 - RNA, 21 nt, Human
ugacccucaucuuucuuccaa

SEQ ID NO: 3039269 - RNA, 17 nt, Human
ugcccgggagcucagga

SEQ ID NO: 3039270 - RNA, 18 nt, Human
ugcccgggagcucaggaa

SEQ ID NO: 3039271 - RNA, 18 nt, Human
ugauuuuuaugccaccug

SEQ ID NO: 3039272 - RNA, 21 nt, Human
ucgugucuggcacagccuggc

SEQ ID NO: 3039273 - RNA, 14 nt, Human
ucgugucuggcaca

SEQ ID NO: 3039274 - RNA, 19 nt, Human
ucccuuccuuccucuccug

SEQ ID NO: 3039275 - RNA, 16 nt, Human
ucccuuccuuccucuc

SEQ ID NO: 3039276 - RNA, 13 nt, Human
ucccugccuggac

SEQ ID NO: 3039277 - RNA, 16 nt, Human
ucccuccucugcccgg

SEQ ID NO: 3039278 - RNA, 15 nt, Human
ucugccaggagacag

SEQ ID NO: 3039279 - RNA, 19 nt, Human
ucagaggguguccugcacc

SEQ ID NO: 3039280 - RNA, 21 nt, Human
ggccuaaccugccgagagucc

SEQ ID NO: 3039281 - RNA, 16 nt, Human
ggccuaaccugccgag

SEQ ID NO: 3039282 - RNA, 15 nt, Human
ggccuaaccugccga

SEQ ID NO: 3039283 - RNA, 17 nt, Human
ggccugggcaggaggga

SEQ ID NO: 3039284 - RNA, 15 nt, Human
ggccugggcaggagg

SEQ ID NO: 3039285 - RNA, 19 nt, Human
ggccugggcaggagggagg

SEQ ID NO: 3039286 - RNA, 14 nt, Human
gggacaccuaggcu

SEQ ID NO: 3039287 - RNA, 16 nt, Human
gggaggagggcaggca

SEQ ID NO: 3039288 - RNA, 12 nt, Human
gggaggagggca

SEQ ID NO: 3039289 - RNA, 13 nt, Human
gggagccgggagc

SEQ ID NO: 3039290 - RNA, 23 nt, Human
gggagcucaggaaccgaggcagg

SEQ ID NO: 3039291 - RNA, 22 nt, Human
gggagcucaggaaccgaggcag

SEQ ID NO: 3039292 - RNA, 12 nt, Human
gggagcucagga

SEQ ID NO: 3039293 - RNA, 13 nt, Human
ggcugggaggagg

SEQ ID NO: 3039294 - RNA, 21 nt, Human
ggcugggaggagggcaggcau

SEQ ID NO: 3039295 - RNA, 20 nt, Human
ggcugggaggagggcaggca

SEQ ID NO: 3039296 - RNA, 23 nt, Human
ggcuguggcauccagagucccug

SEQ ID NO: 3039297 - RNA, 21 nt, Human
ggcuguggcauccagaguccc

SEQ ID NO: 3039298 - RNA, 14 nt, Human
ggagggcaggcauc

SEQ ID NO: 3039299 - RNA, 21 nt, Human
ggagcucaggaaccgaggcag

SEQ ID NO: 3039300 - RNA, 19 nt, Human
ggagacagguuagcugcuc

SEQ ID NO: 3039301 - RNA, 12 nt, Human
ggaccagccucu

SEQ ID NO: 3039302 - RNA, 17 nt, Human
gccuugucacgccagac

SEQ ID NO: 3039303 - RNA, 16 nt, Human
gccuugucacgccaga

SEQ ID NO: 3039304 - RNA, 15 nt, Human
gccuugucacgccag

SEQ ID NO: 3039305 - RNA, 17 nt, Human
gcgaagcguuguccuca

SEQ ID NO: 3039306 - RNA, 16 nt, Human
gccuggaccagccucu

SEQ ID NO: 3039307 - RNA, 17 nt, Human
gccuggaccagccucuc

SEQ ID NO: 3039308 - RNA, 16 nt, Human
gccugggcaggaggga

SEQ ID NO: 3039309 - RNA, 21 nt, Human
gcuccuuaaggcucuuuugua

SEQ ID NO: 3039310 - RNA, 17 nt, Human
gcuccuuaaggcucuuu

SEQ ID NO: 3039311 - RNA, 15 nt, Human
gcuccuuaaggcucu

SEQ ID NO: 3039312 - RNA, 20 nt, Human
gcuguggccuaaccugccga

SEQ ID NO: 3039313 - RNA, 19 nt, Human
gcuguggccuaaccugccg

SEQ ID NO: 3039314 - RNA, 21 nt, Human
gcugggaggagggcaggcauc

SEQ ID NO: 3039315 - RNA, 22 nt, Human
gcaggcaucggggagccgggag

SEQ ID NO: 3039316 - RNA, 21 nt, Human
gcaggcaucggggagccggga

SEQ ID NO: 3039317 - RNA, 23 nt, Human
gcaggcaucggggagccgggagc

SEQ ID NO: 3039318 - RNA, 16 nt, Human
gccaccugaauaaaga

SEQ ID NO: 3039319 - RNA, 21 nt, Human
gccagacuucccacggcuccu

SEQ ID NO: 3039320 - RNA, 15 nt, Human
gaggagggcaggcau

SEQ ID NO: 3039321 - RNA, 14 nt, Human
gaggagggcaggca

SEQ ID NO: 3039322 - RNA, 13 nt, Human
gaggagggcaggc

SEQ ID NO: 3039323 - RNA, 23 nt, Human
gagcucaggaaccgaggcaggga

SEQ ID NO: 3039324 - RNA, 19 nt, Human
gagucccugccuggaccag

SEQ ID NO: 3039325 - RNA, 16 nt, Human
gagucccugccuggac

SEQ ID NO: 3039326 - RNA, 15 nt, Human
gagucccugccugga

SEQ ID NO: 3039327 - RNA, 14 nt, Human
gagucccugccugg

SEQ ID NO: 3039328 - RNA, 17 nt, Human
cugccuggaccagccuc

SEQ ID NO: 3039329 - RNA, 14 nt, Human
cucugcccgggagc

SEQ ID NO: 3039330 - RNA, 20 nt, Human
cucugcccgggagcucagga

SEQ ID NO: 3039331 - RNA, 23 nt, Human
cucgagaucccaacacugccagc

SEQ ID NO: 3039332 - RNA, 22 nt, Human
cucgagaucccaacacugccag

SEQ ID NO: 3039333 - RNA, 21 nt, Human
cucgagaucccaacacugcca

SEQ ID NO: 3039334 - RNA, 13 nt, Human
cucgagaucccaa

SEQ ID NO: 3039335 - RNA, 17 nt, Human
cuuucccaacaccucuu

SEQ ID NO: 3039336 - RNA, 17 nt, Human
gaauaaagaaugaaugg

SEQ ID NO: 3039337 - RNA, 19 nt, Human
gaaggaucccaugagcucc

SEQ ID NO: 3039338 - RNA, 15 nt, Human
cuuaaggcucuuuug

SEQ ID NO: 3039339 - RNA, 19 nt, Human
cuuccaaacaggcucagag

SEQ ID NO: 3039340 - RNA, 18 nt, Human
cuguggccuaaccugccg

SEQ ID NO: 3039341 - RNA, 22 nt, Human
cuggugguggcucgggaggcga

SEQ ID NO: 3039342 - RNA, 14 nt, Human
cuggugguggcucg

SEQ ID NO: 3039343 - RNA, 18 nt, Human
ccucuccacucaugugac

SEQ ID NO: 3039344 - RNA, 15 nt, Human
ccgaggcagggaagg

SEQ ID NO: 3039345 - RNA, 19 nt, Human
ccgggacaccuaggcuagg

SEQ ID NO: 3039346 - RNA, 20 nt, Human
ccgggacaccuaggcuaggg

SEQ ID NO: 3039347 - RNA, 13 nt, Human
ccuuaaggcucuu

SEQ ID NO: 3039348 - RNA, 18 nt, Human
ccuuaaggcucuuuugua

SEQ ID NO: 3039349 - RNA, 16 nt, Human
ccuuaaggcucuuuug

SEQ ID NO: 3039350 - RNA, 18 nt, Human
ccuugucacgccagacuu

SEQ ID NO: 3039351 - RNA, 15 nt, Human
ccuugucacgccaga

SEQ ID NO: 3039352 - RNA, 13 nt, Human
cgagaucccaaca

SEQ ID NO: 3039353 - RNA, 21 nt, Human
cgagaucccaacacugccagc

SEQ ID NO: 3039354 - RNA, 15 nt, Human
cgagaucccaacacu

SEQ ID NO: 3039355 - RNA, 22 nt, Human
cgagaucccaacacugccagca

SEQ ID NO: 3039356 - RNA, 12 nt, Human
ccugggcaggag

SEQ ID NO: 3039357 - RNA, 14 nt, Human
ccugggcaggaggg

SEQ ID NO: 3039358 - RNA, 13 nt, Human
ccaggagacaggu

SEQ ID NO: 3039359 - RNA, 18 nt, Human
ccauccuacccccugugc

SEQ ID NO: 3039360 - RNA, 20 nt, Human
ccaccugaauaaagaaugaa

SEQ ID NO: 3039361 - RNA, 19 nt, Human
ccacucaugugacucuuuc

SEQ ID NO: 3039362 - RNA, 22 nt, Human
ccacucaugugacucuuuccaa

SEQ ID NO: 3039363 - RNA, 21 nt, Human
ccagcauuucccuuccuuccu

SEQ ID NO: 3039364 - RNA, 16 nt, Human
ccagcauuucccuucc

SEQ ID NO: 3039365 - RNA, 14 nt, Human
caugugacucuuuc

SEQ ID NO: 3039366 - RNA, 17 nt, Human
caugugacucuuuccaa

SEQ ID NO: 3039367 - RNA, 16 nt, Human
caugugacucuuucca

SEQ ID NO: 3039368 - RNA, 12 nt, Human
cauucuuuccca

SEQ ID NO: 3039369 - RNA, 14 nt, Human
cauucuuucccaac

SEQ ID NO: 3039370 - RNA, 18 nt, Human
cauccuacccccugugcc

SEQ ID NO: 3039371 - RNA, 15 nt, Human
cauccuacccccugu

SEQ ID NO: 3039372 - RNA, 23 nt, Human
caugagcuccuuaaggcucuuuu

SEQ ID NO: 3039373 - RNA, 20 nt, Human
cauccagagucccugccugg

SEQ ID NO: 3039374 - RNA, 18 nt, Human
cauccagagucccugccu

SEQ ID NO: 3039375 - RNA, 17 nt, Human
cauccagagucccugcc

SEQ ID NO: 3039376 - RNA, 13 nt, Human
cauccagaguccc

SEQ ID NO: 3039377 - RNA, 21 nt, Human
cauccagagucccugccugga

SEQ ID NO: 3039378 - RNA, 18 nt, Human
cagggaaggaucccauga

SEQ ID NO: 3039379 - RNA, 13 nt, Human
cagggaaggaucc

SEQ ID NO: 3039380 - RNA, 11 nt, Human
caggcucagag

SEQ ID NO: 3039381 - RNA, 15 nt, Human
caggcucagagggug

SEQ ID NO: 3039382 - RNA, 21 nt, Human
caggcaucggggagccgggag

SEQ ID NO: 3039383 - RNA, 20 nt, Human
caggcaucggggagccggga

SEQ ID NO: 3039384 - RNA, 23 nt, Human
caggagacagguuagcugcuccc

SEQ ID NO: 3039385 - RNA, 15 nt, Human
cagcauuucccuucc

SEQ ID NO: 3039386 - RNA, 18 nt, Human
caggaaccgaggcaggga

SEQ ID NO: 3039387 - RNA, 17 nt, Human
caggaaccgaggcaggg

SEQ ID NO: 3039388 - RNA, 15 nt, Human
caggaaccgaggcag

SEQ ID NO: 3039389 - RNA, 23 nt, Human
cagccucuccacucaugugacuc

SEQ ID NO: 3039390 - RNA, 23 nt, Human
cagccuggcuguggccuaaccug

SEQ ID NO: 3039391 - RNA, 21 nt, Human
cagccuccauccuacccccug

SEQ ID NO: 3039392 - RNA, 18 nt, Human
cagccuccauccuacccc

SEQ ID NO: 3039393 - RNA, 18 nt, Human
cagagucccugccuggac

SEQ ID NO: 3039394 - RNA, 14 nt, Human
cagagucccugccu

SEQ ID NO: 3039395 - RNA, 12 nt, Human
cagagaaaaagg

SEQ ID NO: 3039396 - RNA, 18 nt, Human
cagagaaaaagggagggg

SEQ ID NO: 3039397 - RNA, 17 nt, Human
cagagaaaaagggaggg

SEQ ID NO: 3039398 - RNA, 22 nt, Human
cagacuucccacggcuccucga

SEQ ID NO: 3039399 - RNA, 12 nt, Human
cagacuucccac

SEQ ID NO: 3039400 - RNA, 22 nt, Human
caccggggccugggcaggaggg

SEQ ID NO: 3039401 - RNA, 21 nt, Human
caccggggccugggcaggagg

SEQ ID NO: 3039402 - RNA, 14 nt, Human
caccggggccuggg

SEQ ID NO: 3039403 - RNA, 22 nt, Human
cacggcuccucgagaucccaac

SEQ ID NO: 3039404 - RNA, 20 nt, Human
cacggcuccucgagauccca

SEQ ID NO: 3039405 - RNA, 22 nt, Human
cacucaugugacucuuuccaac

SEQ ID NO: 3039406 - RNA, 16 nt, Human
cacucaugugacucuu

SEQ ID NO: 3039407 - RNA, 16 nt, Human
caccccgacuuuuguu

SEQ ID NO: 3039408 - RNA, 19 nt, Human
augagcuccuuaaggcucu

SEQ ID NO: 3039409 - RNA, 14 nt, Human
agccgggagccuga

SEQ ID NO: 3039410 - RNA, 22 nt, Human
agcuccuuaaggcucuuuugua

SEQ ID NO: 3039411 - RNA, 17 nt, Human
agcugcuccccacguca

SEQ ID NO: 3039412 - RNA, 14 nt, Human
agcugcuccccacg

SEQ ID NO: 3039413 - RNA, 13 nt, Human
acccccugugccu

SEQ ID NO: 3039414 - RNA, 11 nt, Human
acacugccagc

SEQ ID NO: 3039415 - RNA, 12 nt, Human
acugccagcauu

SEQ ID NO: 3039416 - RNA, 23 nt, Human
accugccgagaguccaucagccu

SEQ ID NO: 3039417 - RNA, 16 nt, Human
accugccgagagucca

SEQ ID NO: 3039418 - RNA, 21 nt, Human
augugacucuuuccaaccggc

SEQ ID NO: 3039419 - RNA, 16 nt, Human
augugacucuuuccaa

SEQ ID NO: 3039420 - RNA, 12 nt, Human
augugacucuuu

SEQ ID NO: 3039421 - RNA, 13 nt, Human
uucugccaggaga

SEQ ID NO: 3039422 - RNA, 16 nt, Human
auccuacccccugugc

SEQ ID NO: 3039423 - RNA, 14 nt, Human
auccuacccccugu

SEQ ID NO: 3039424 - RNA, 16 nt, Human
auuucccuuccuuccu

SEQ ID NO: 3039425 - RNA, 21 nt, Human
uguagugauuuuuaugccacc

SEQ ID NO: 3039426 - RNA, 20 nt, Human
uguagugauuuuuaugccac

SEQ ID NO: 3039427 - RNA, 21 nt, Human
agugauuuuuaugccaccuga

SEQ ID NO: 3039428 - RNA, 20 nt, Human
agugauuuuuaugccaccug

SEQ ID NO: 3039429 - RNA, 16 nt, Human
agugauuuuuaugcca

SEQ ID NO: 3039430 - RNA, 20 nt, Human
uggcauccagagucccugcc

SEQ ID NO: 3039431 - RNA, 22 nt, Human
uggcauccagagucccugccug

SEQ ID NO: 3039432 - RNA, 21 nt, Human
uggcauccagagucccugccu

SEQ ID NO: 3039433 - RNA, 22 nt, Human
uggcacagccuggcuguggccu

SEQ ID NO: 3039434 - RNA, 15 nt, Human
aggccauucuuuccc

SEQ ID NO: 3039435 - RNA, 14 nt, Human
aggccauucuuucc

SEQ ID NO: 3039436 - RNA, 20 nt, Human
aggcucagaggguguccugc

SEQ ID NO: 3039437 - RNA, 19 nt, Human
aggcucagaggguguccug

SEQ ID NO: 3039438 - RNA, 18 nt, Human
aggcucagaggguguccu

SEQ ID NO: 3039439 - RNA, 18 nt, Human
aggcgaagcguuguccuc

SEQ ID NO: 3039440 - RNA, 17 nt, Human
uggcuguggcauccaga

SEQ ID NO: 3039441 - RNA, 20 nt, Human
uggcuguggccuaaccugcc

SEQ ID NO: 3039442 - RNA, 19 nt, Human
agccugacccucaucuuuc

SEQ ID NO: 3039443 - RNA, 17 nt, Human
ugccuugucacgccaga

SEQ ID NO: 3039444 - RNA, 18 nt, Human
accugaauaaagaaugaa

SEQ ID NO: 3039445 - RNA, 18 nt, Human
accagagaaaaagggagg

SEQ ID NO: 3039446 - RNA, 20 nt, Human
accagagaaaaagggagggg

SEQ ID NO: 3039447 - RNA, 18 nt, Human
ucaggaaccgaggcaggg

SEQ ID NO: 3039448 - RNA, 17 nt, Human
ucaggaaccgaggcagg

SEQ ID NO: 3039449 - RNA, 16 nt, Human
ucagccccgcguggaa

SEQ ID NO: 3039450 - RNA, 17 nt, Human
acucaugugacucuuuc

SEQ ID NO: 3039451 - RNA, 16 nt, Human
acucaugugacucuuu

SEQ ID NO: 3039452 - RNA, 15 nt, Human
acucaugugacucuu

SEQ ID NO: 3039453 - RNA, 11 nt, Human
uccucagcccc

SEQ ID NO: 3039454 - RNA, 14 nt, Human
acuggggcaggggc

SEQ ID NO: 3039455 - RNA, 23 nt, Human
ucgagaucccaacacugccagca

SEQ ID NO: 3039456 - RNA, 22 nt, Human
ucgagaucccaacacugccagc

SEQ ID NO: 3039457 - RNA, 21 nt, Human
uccugcaccggggccugggca

SEQ ID NO: 3039458 - RNA, 20 nt, Human
uccugcaccggggccugggc

SEQ ID NO: 3039459 - RNA, 12 nt, Human
acagccuggcug

SEQ ID NO: 3039460 - RNA, 20 nt, Human
acaccuaggcuagggugggg

SEQ ID NO: 3039461 - RNA, 23 nt, Human
acaccuaggcuaggguggggaga

SEQ ID NO: 3039462 - RNA, 13 nt, Human
uaguucugccagg

SEQ ID NO: 3039463 - RNA, 14 nt, Human
uaguucugccagga

SEQ ID NO: 3039464 - RNA, 20 nt, Human
guccugcaccggggccuggg

SEQ ID NO: 3039465 - RNA, 19 nt, Human
guccugcaccggggccugg

SEQ ID NO: 3039466 - RNA, 15 nt, Human
guccugcaccggggc

SEQ ID NO: 3039467 - RNA, 18 nt, Human
guggcacuggggcagggg

SEQ ID NO: 3039468 - RNA, 17 nt, Human
guggcacuggggcaggg

SEQ ID NO: 3039469 - RNA, 20 nt, Human
cugugccuugucacgccaga

SEQ ID NO: 3039470 - RNA, 19 nt, Human
cuucuaguucugccaggag

SEQ ID NO: 3039471 - RNA, 16 nt, Human
cuucuaguucugccag

SEQ ID NO: 3039472 - RNA, 18 nt, Human
cuucuaguucugccagga

SEQ ID NO: 3039473 - RNA, 17 nt, Human
cuucuaguucugccagg

SEQ ID NO: 3039474 - RNA, 18 nt, Human
gcauuucccuuccuuccu

SEQ ID NO: 3039475 - RNA, 20 nt, Human
gacccucaucuuucuuccaa

SEQ ID NO: 3039476 - RNA, 19 nt, Human
gacccucaucuuucuucca

SEQ ID NO: 3039477 - RNA, 15 nt, Human
gacccucaucuuucu

SEQ ID NO: 3039478 - RNA, 17 nt, Human
ggggccgggggcagucu

SEQ ID NO: 3039479 - RNA, 18 nt, Human
gggggcgcggcugggagg

SEQ ID NO: 3039480 - RNA, 14 nt, Human
ggguggggagagac

SEQ ID NO: 3039481 - RNA, 13 nt, Human
ggguggggagaga

SEQ ID NO: 3039482 - RNA, 18 nt, Human
ggguggggagagacgggc

SEQ ID NO: 3039483 - RNA, 22 nt, Human
ggugcuucuaguucugccagga

SEQ ID NO: 3039484 - RNA, 22 nt, Human
gggacaccuaggcuaggguggg

SEQ ID NO: 3039485 - RNA, 20 nt, Human
ggcucagaggguguccugca

SEQ ID NO: 3039486 - RNA, 17 nt, Human
gcuucuaguucugccag

SEQ ID NO: 3039487 - RNA, 16 nt, Human
gcuucuaguucugcca

SEQ ID NO: 3039488 - RNA, 23 nt, Human
gccuccauccuacccccugugcc

SEQ ID NO: 3039489 - RNA, 19 nt, Human
gcucaggaaccgaggcagg

SEQ ID NO: 3039490 - RNA, 16 nt, Human
gcucaggaaccgaggc

SEQ ID NO: 3039491 - RNA, 21 nt, Human
gcucaggaaccgaggcaggga

SEQ ID NO: 3039492 - RNA, 20 nt, Human
gcucaggaaccgaggcaggg

SEQ ID NO: 3039493 - RNA, 18 nt, Human
cagucugagagaggccau

SEQ ID NO: 3039494 - RNA, 21 nt, Human
ccuggugguggcucgggaggc

SEQ ID NO: 3039495 - RNA, 18 nt, Human
ccuggugguggcucggga

SEQ ID NO: 3039496 - RNA, 21 nt, Human
ccugucucccuccucugcccg

SEQ ID NO: 3039497 - RNA, 19 nt, Human
ccugacccucaucuuucuu

SEQ ID NO: 3039498 - RNA, 18 nt, Human
ccugacccucaucuuucu

SEQ ID NO: 3039499 - RNA, 12 nt, Human
ccauucuuuccc

SEQ ID NO: 3039500 - RNA, 20 nt, Human
ccauucuuucccaacaccuc

SEQ ID NO: 3039501 - RNA, 14 nt, Human
ccauucuuucccaa

SEQ ID NO: 3039502 - RNA, 18 nt, Human
cugacccucaucuuucuu

SEQ ID NO: 3039503 - RNA, 15 nt, Human
cuaggcuaggguggg

SEQ ID NO: 3039504 - RNA, 16 nt, Human
cuaguucugccaggag

SEQ ID NO: 3039505 - RNA, 15 nt, Human
cuaguucugccagga

SEQ ID NO: 3039506 - RNA, 14 nt, Human
cuaguucugccagg

SEQ ID NO: 3039507 - RNA, 15 nt, Human
cuaggguggggagag

SEQ ID NO: 3039508 - RNA, 13 nt, Human
cuaguucugccag

SEQ ID NO: 3039509 - RNA, 14 nt, Human
uuuaugccaccuga

SEQ ID NO: 3039510 - RNA, 16 nt, Human
uuaugccaccugaaua

SEQ ID NO: 3039511 - RNA, 13 nt, Human
uuaugccaccuga

SEQ ID NO: 3039512 - RNA, 13 nt, Human
ugggcaggaggga

SEQ ID NO: 3039513 - RNA, 18 nt, Human
ugggcaggagggaggugc

SEQ ID NO: 3039514 - RNA, 16 nt, Human
ugggcaggagggaggu

SEQ ID NO: 3039515 - RNA, 15 nt, Human
ugggcaggagggagg

SEQ ID NO: 3039516 - RNA, 20 nt, Human
uggggaguuuaggguggggg

SEQ ID NO: 3039517 - RNA, 15 nt, Human
uggaccagccucucc

SEQ ID NO: 3039518 - RNA, 21 nt, Human
ugagcuccuuaaggcucuuuu

SEQ ID NO: 3039519 - RNA, 19 nt, Human
ugagcuccuuaaggcucuu

SEQ ID NO: 3039520 - RNA, 16 nt, Human
uaggcuagggugggga

SEQ ID NO: 3039521 - RNA, 15 nt, Human
uaggcuagggugggg

SEQ ID NO: 3039522 - RNA, 21 nt, Human
uccagagucccugccuggacc

SEQ ID NO: 3039523 - RNA, 20 nt, Human
uccagagucccugccuggac

SEQ ID NO: 3039524 - RNA, 19 nt, Human
uccagagucccugccugga

SEQ ID NO: 3039525 - RNA, 18 nt, Human
uccagagucccugccugg

SEQ ID NO: 3039526 - RNA, 14 nt, Human
uccaaacaggcuca

SEQ ID NO: 3039527 - RNA, 12 nt, Human
ucaucuuucuuc

SEQ ID NO: 3039528 - RNA, 18 nt, Human
ucucccuccucugcccgg

SEQ ID NO: 3039529 - RNA, 17 nt, Human
uccuacccccugugccu

SEQ ID NO: 3039530 - RNA, 16 nt, Human
uccuacccccugugcc

SEQ ID NO: 3039531 - RNA, 15 nt, Human
uccuacccccugugc

SEQ ID NO: 3039532 - RNA, 13 nt, Human
uccuacccccugu

SEQ ID NO: 3039533 - RNA, 15 nt, Human
uccugucucccuccu

SEQ ID NO: 3039534 - RNA, 23 nt, Human
uccugucucccuccucugcccgg

SEQ ID NO: 3039535 - RNA, 16 nt, Human
gugauuuuuaugccac

SEQ ID NO: 3039536 - RNA, 20 nt, Human
gugauuuuuaugccaccuga

SEQ ID NO: 3039537 - RNA, 19 nt, Human
gugauuuuuaugccaccug

SEQ ID NO: 3039538 - RNA, 17 nt, Human
gugauuuuuaugccacc

SEQ ID NO: 3039539 - RNA, 12 nt, Human
gugacucuuucc

SEQ ID NO: 3039540 - RNA, 14 nt, Human
guggcauccagagu

SEQ ID NO: 3039541 - RNA, 18 nt, Human
guggcucgggaggcgaag

SEQ ID NO: 3039542 - RNA, 16 nt, Human
guggcucgggaggcga

SEQ ID NO: 3039543 - RNA, 19 nt, Human
gugccuugucacgccagac

SEQ ID NO: 3039544 - RNA, 20 nt, Human
gugcuucuaguucugccagg

SEQ ID NO: 3039545 - RNA, 22 nt, Human
gugcuucuaguucugccaggag

SEQ ID NO: 3039546 - RNA, 21 nt, Human
gugcuucuaguucugccagga

SEQ ID NO: 3039547 - RNA, 12 nt, Human
guccucagcccc

SEQ ID NO: 3039548 - RNA, 14 nt, Human
gucccugccuggac

SEQ ID NO: 3039549 - RNA, 21 nt, Human
gucccugccuggaccagccuc

SEQ ID NO: 3039550 - RNA, 20 nt, Human
gucccugccuggaccagccu

SEQ ID NO: 3039551 - RNA, 23 nt, Human
gucccugccuggaccagccucuc

SEQ ID NO: 3039552 - RNA, 22 nt, Human
gucccugccuggaccagccucu

SEQ ID NO: 3039553 - RNA, 14 nt, Human
gucacgccagacuu

SEQ ID NO: 3039554 - RNA, 18 nt, Human
ggggaguuuagggugggg

SEQ ID NO: 3039555 - RNA, 14 nt, Human
gggcgcggcuggga

SEQ ID NO: 3039556 - RNA, 21 nt, Human
gcucagaggguguccugcacc

SEQ ID NO: 3039557 - RNA, 23 nt, Human
gcccuggugguggcucgggaggc

SEQ ID NO: 3039558 - RNA, 14 nt, Human
ggccugggcaggag

SEQ ID NO: 3039559 - RNA, 13 nt, Human
ggccugggcagga

SEQ ID NO: 3039560 - RNA, 16 nt, Human
ggcgcggcugggagga

SEQ ID NO: 3039561 - RNA, 16 nt, Human
ggcuaggguggggaga

SEQ ID NO: 3039562 - RNA, 22 nt, Human
ggccuaaccugccgagagucca

SEQ ID NO: 3039563 - RNA, 20 nt, Human
ggccauucuuucccaacacc

SEQ ID NO: 3039564 - RNA, 22 nt, Human
ggaaggaucccaugagcuccuu

SEQ ID NO: 3039565 - RNA, 14 nt, Human
gcuuuguggcacug

SEQ ID NO: 3039566 - RNA, 22 nt, Human
gcuuuguggcacuggggcaggg

SEQ ID NO: 3039567 - RNA, 18 nt, Human
gcacuggggcaggggccg

SEQ ID NO: 3039568 - RNA, 15 nt, Human
gcacuggggcagggg

SEQ ID NO: 3039569 - RNA, 23 nt, Human
gcacuggggcaggggccgggggc

SEQ ID NO: 3039570 - RNA, 14 nt, Human
gagggggagagggc

SEQ ID NO: 3039571 - RNA, 13 nt, Human
gaggguguccugc

SEQ ID NO: 3039572 - RNA, 20 nt, Human
gaggcgaagcguuguccuca

SEQ ID NO: 3039573 - RNA, 21 nt, Human
gaggcgaagcguuguccucag

SEQ ID NO: 3039574 - RNA, 14 nt, Human
gaggcagggaagga

SEQ ID NO: 3039575 - RNA, 23 nt, Human
gagucccugccuggaccagccuc

SEQ ID NO: 3039576 - RNA, 21 nt, Human
gagucccugccuggaccagcc

SEQ ID NO: 3039577 - RNA, 14 nt, Human
gaccagccucucca

SEQ ID NO: 3039578 - RNA, 13 nt, Human
gagagacgggccc

SEQ ID NO: 3039579 - RNA, 20 nt, Human
gagaucccaacacugccagc

SEQ ID NO: 3039580 - RNA, 19 nt, Human
gagaucccaacacugccag

SEQ ID NO: 3039581 - RNA, 18 nt, Human
gagaucccaacacugcca

SEQ ID NO: 3039582 - RNA, 21 nt, Human
cugucucccuccucugcccgg

SEQ ID NO: 3039583 - RNA, 22 nt, Human
cugccgagaguccaucagccuc

SEQ ID NO: 3039584 - RNA, 23 nt, Human
cugccgagaguccaucagccucc

SEQ ID NO: 3039585 - RNA, 18 nt, Human
cuggaccagccucuccac

SEQ ID NO: 3039586 - RNA, 14 nt, Human
cuggaccagccucu

SEQ ID NO: 3039587 - RNA, 14 nt, Human
cuuuguggcacugg

SEQ ID NO: 3039588 - RNA, 13 nt, Human
cuugucacgccag

SEQ ID NO: 3039589 - RNA, 18 nt, Human
cuugucacgccagacuuc

SEQ ID NO: 3039590 - RNA, 16 nt, Human
cuugucacgccagacu

SEQ ID NO: 3039591 - RNA, 22 nt, Human
cuuucuuccaaacaggcucaga

SEQ ID NO: 3039592 - RNA, 13 nt, Human
cuuucccaacacc

SEQ ID NO: 3039593 - RNA, 17 nt, Human
cucaggaaccgaggcag

SEQ ID NO: 3039594 - RNA, 19 nt, Human
cucaggaaccgaggcaggg

SEQ ID NO: 3039595 - RNA, 18 nt, Human
cucaggaaccgaggcagg

SEQ ID NO: 3039596 - RNA, 17 nt, Human
cucagccccgcguggaa

SEQ ID NO: 3039597 - RNA, 16 nt, Human
cucagaggguguccug

SEQ ID NO: 3039598 - RNA, 20 nt, Human
cuccccacgucagcugggac

SEQ ID NO: 3039599 - RNA, 16 nt, Human
cuccacucaugugacu

SEQ ID NO: 3039600 - RNA, 22 nt, Human
cuccacucaugugacucuuucc

SEQ ID NO: 3039601 - RNA, 21 nt, Human
cgaagcguuguccucagcccc

SEQ ID NO: 3039602 - RNA, 17 nt, Human
cgaagcguuguccucag

SEQ ID NO: 3039603 - RNA, 16 nt, Human
cgaagcguuguccuca

SEQ ID NO: 3039604 - RNA, 15 nt, Human
cgaagcguuguccuc

SEQ ID NO: 3039605 - RNA, 16 nt, Human
cgcggcugggaggagg

SEQ ID NO: 3039606 - RNA, 12 nt, Human
cgcggcugggag

SEQ ID NO: 3039607 - RNA, 11 nt, Human
cgcggcuggga

SEQ ID NO: 3039608 - RNA, 18 nt, Human
cgggacaccuaggcuagg

SEQ ID NO: 3039609 - RNA, 19 nt, Human
cgggacaccuaggcuaggg

SEQ ID NO: 3039610 - RNA, 14 nt, Human
ccugccgagagucc

SEQ ID NO: 3039611 - RNA, 23 nt, Human
ccugccgagaguccaucagccuc

SEQ ID NO: 3039612 - RNA, 22 nt, Human
ccugccgagaguccaucagccu

SEQ ID NO: 3039613 - RNA, 15 nt, Human
ccugcaccggggccu

SEQ ID NO: 3039614 - RNA, 17 nt, Human
ccugcaccggggccugg

SEQ ID NO: 3039615 - RNA, 15 nt, Human
cccacggcuccucga

SEQ ID NO: 3039616 - RNA, 15 nt, Human
cccacgucagcuggg

SEQ ID NO: 3039617 - RNA, 14 nt, Human
cccaacacugccag

SEQ ID NO: 3039618 - RNA, 16 nt, Human
cccaacacugccagca

SEQ ID NO: 3039619 - RNA, 15 nt, Human
cccaacacugccagc

SEQ ID NO: 3039620 - RNA, 13 nt, Human
cccaugagcuccu

SEQ ID NO: 3039621 - RNA, 22 nt, Human
cccaugagcuccuuaaggcucu

SEQ ID NO: 3039622 - RNA, 15 nt, Human
cccaugagcuccuua

SEQ ID NO: 3039623 - RNA, 14 nt, Human
cccaugagcuccuu

SEQ ID NO: 3039624 - RNA, 14 nt, Human
ccccugugccuugu

SEQ ID NO: 3039625 - RNA, 23 nt, Human
ccguggcuguggcauccagaguc

SEQ ID NO: 3039626 - RNA, 13 nt, Human
ccuaaccugccga

SEQ ID NO: 3039627 - RNA, 12 nt, Human
ccuaaccugccg

SEQ ID NO: 3039628 - RNA, 16 nt, Human
ccuaggcuaggguggg

SEQ ID NO: 3039629 - RNA, 20 nt, Human
ccggggccugggcaggaggg

SEQ ID NO: 3039630 - RNA, 21 nt, Human
ccgggggcagucugagagagg

SEQ ID NO: 3039631 - RNA, 21 nt, Human
ccgagaguccaucagccucca

SEQ ID NO: 3039632 - RNA, 20 nt, Human
ccgagaguccaucagccucc

SEQ ID NO: 3039633 - RNA, 19 nt, Human
accggggccugggcaggag

SEQ ID NO: 3039634 - RNA, 13 nt, Human
aagggagggggag

SEQ ID NO: 3039635 - RNA, 10 nt, Human
agagggcugc

SEQ ID NO: 3039636 - RNA, 18 nt, Human
agcuccuuaaggcucuuu

SEQ ID NO: 3039637 - RNA, 17 nt, Human
agcuccuuaaggcucuu

SEQ ID NO: 3039638 - RNA, 16 nt, Human
agcuccuuaaggcucu

SEQ ID NO: 3039639 - RNA, 16 nt, Human
aggaaccgaggcaggg

SEQ ID NO: 3039640 - RNA, 19 nt, Human
auccagagucccugccugg

SEQ ID NO: 3039641 - RNA, 21 nt, Human
auccagagucccugccuggac

SEQ ID NO: 3039642 - RNA, 20 nt, Human
auccagagucccugccugga

SEQ ID NO: 3039643 - RNA, 16 nt, Human
agucugagagaggcca

SEQ ID NO: 3039644 - RNA, 23 nt, Human
agucugagagaggccauucuuuc

SEQ ID NO: 3039645 - RNA, 16 nt, Human
uucuaguucugccagg

SEQ ID NO: 3039646 - RNA, 15 nt, Human
uucuaguucugccag

SEQ ID NO: 3039647 - RNA, 19 nt, Human
uguggcacuggggcagggg

SEQ ID NO: 3039648 - RNA, 14 nt, Human
agucccugccugga

SEQ ID NO: 3039649 - RNA, 21 nt, Human
agucccugccuggaccagccu

SEQ ID NO: 3039650 - RNA, 15 nt, Human
agucccugccuggac

SEQ ID NO: 3039651 - RNA, 23 nt, Human
agucccugccuggaccagccucu

SEQ ID NO: 3039652 - RNA, 22 nt, Human
agucccugccuggaccagccuc

SEQ ID NO: 3039653 - RNA, 19 nt, Human
uggggaguuuagggugggg

SEQ ID NO: 3039654 - RNA, 18 nt, Human
uggggaguuuaggguggg

SEQ ID NO: 3039655 - RNA, 16 nt, Human
agggggagagggcugc

SEQ ID NO: 3039656 - RNA, 15 nt, Human
agggggagagggcug

SEQ ID NO: 3039657 - RNA, 21 nt, Human
agcugggacaccccgacuuuu

SEQ ID NO: 3039658 - RNA, 19 nt, Human
aggaucccaugagcuccuu

SEQ ID NO: 3039659 - RNA, 16 nt, Human
uggccuaaccugccga

SEQ ID NO: 3039660 - RNA, 20 nt, Human
agcucaggaaccgaggcagg

SEQ ID NO: 3039661 - RNA, 22 nt, Human
agcucaggaaccgaggcaggga

SEQ ID NO: 3039662 - RNA, 21 nt, Human
agcucaggaaccgaggcaggg

SEQ ID NO: 3039663 - RNA, 18 nt, Human
agccugacccucaucuuu

SEQ ID NO: 3039664 - RNA, 17 nt, Human
agcauuucccuuccuuc

SEQ ID NO: 3039665 - RNA, 17 nt, Human
agagacgggcccuggug

SEQ ID NO: 3039666 - RNA, 23 nt, Human
ucuuggggaguuuaggguggggg

SEQ ID NO: 3039667 - RNA, 22 nt, Human
ucuuggggaguuuagggugggg

SEQ ID NO: 3039668 - RNA, 22 nt, Human
ucuggcacagccuggcuguggc

SEQ ID NO: 3039669 - RNA, 16 nt, Human
acuggggcaggggccg

SEQ ID NO: 3039670 - RNA, 20 nt, Human
ucggggagccgggagccuga

SEQ ID NO: 3039671 - RNA, 14 nt, Human
ucuaguucugccag

SEQ ID NO: 3039672 - RNA, 22 nt, Human
uccucugcccgggagcucagga

SEQ ID NO: 3039673 - RNA, 16 nt, Human
uccucugcccgggagc

SEQ ID NO: 3039674 - RNA, 13 nt, Human
uccucuccugucu

SEQ ID NO: 3039675 - RNA, 23 nt, Human
acucgugucuggcacagccuggc

SEQ ID NO: 3039676 - RNA, 22 nt, Human
acucgugucuggcacagccugg

SEQ ID NO: 3039677 - RNA, 20 nt, Human
uccauccuacccccugugcc

SEQ ID NO: 3039678 - RNA, 16 nt, Human
uccauccuacccccug

SEQ ID NO: 3039679 - RNA, 20 nt, Human
uaugccaccugaauaaagaa

SEQ ID NO: 3039680 - RNA, 15 nt, Human
uacccccugugccuu

SEQ ID NO: 3039681 - RNA, 19 nt, Human
uaccagagaaaaagggagg

SEQ ID NO: 3039682 - RNA, 14 nt, Human
aaggcucuuuugua

SEQ ID NO: 3039683 - RNA, 22 nt, Human
guggccuaaccugccgagaguc

SEQ ID NO: 3039684 - RNA, 21 nt, Human
guggccuaaccugccgagagu

SEQ ID NO: 3039685 - RNA, 19 nt, Human
gucucccuccucugcccgg

SEQ ID NO: 3039686 - RNA, 19 nt, Human
gucuggcacagccuggcug

SEQ ID NO: 3039687 - RNA, 17 nt, Human
gucuggcacagccuggc

SEQ ID NO: 3039688 - RNA, 24 nt, Human
cagccucuccacucaugugacucu

SEQ ID NO: 3039689 - RNA, 24 nt, Human
cagccccgcguggaacucgugucu

SEQ ID NO: 3039690 - RNA, 22 nt, Human
cacugccagcauuucccuuccu

SEQ ID NO: 3039691 - RNA, 18 nt, Human
cacugccagcauuucccu

SEQ ID NO: 3039692 - RNA, 19 nt, Human
cacuggggcaggggccggg

SEQ ID NO: 3039693 - RNA, 15 nt, Human
caaacaggcucagag

SEQ ID NO: 3039694 - RNA, 14 nt, Human
caaacaggcucaga

SEQ ID NO: 3039695 - RNA, 19 nt, Human
auucuuucccaacaccucu

SEQ ID NO: 3039696 - RNA, 16 nt, Human
auucuuucccaacacc

SEQ ID NO: 3039697 - RNA, 13 nt, Human
auucuuucccaac

SEQ ID NO: 3039698 - RNA, 21 nt, Human
cgugucuggcacagccuggcu

SEQ ID NO: 3039699 - RNA, 13 nt, Human
cgugucuggcaca

SEQ ID NO: 3039700 - RNA, 14 nt, Human
cgugucuggcacag

SEQ ID NO: 3039701 - RNA, 12 nt, Human
cuaaccugccga

SEQ ID NO: 3039702 - RNA, 21 nt, Human
cuaaccugccgagaguccauc

SEQ ID NO: 3039703 - RNA, 19 nt, Human
cuaaccugccgagagucca

SEQ ID NO: 3039704 - RNA, 23 nt, Human
cggcuccucgagaucccaacacu

SEQ ID NO: 3039705 - RNA, 13 nt, Human
cucccuccucugc

SEQ ID NO: 3039706 - RNA, 14 nt, Human
cucccuccucugcc

SEQ ID NO: 3039707 - RNA, 16 nt, Human
cucaucuuucuuccaa

SEQ ID NO: 3039708 - RNA, 14 nt, Human
ccccgacuuuuguu

SEQ ID NO: 3039709 - RNA, 14 nt, Human
cccgggagcucagg

SEQ ID NO: 3039710 - RNA, 16 nt, Human
ccagagucccugccug

SEQ ID NO: 3039711 - RNA, 22 nt, Human
ccagagucccugccuggaccag

SEQ ID NO: 3039712 - RNA, 19 nt, Human
ccagagucccugccuggac

SEQ ID NO: 3039713 - RNA, 18 nt, Human
ccagagucccugccugga

SEQ ID NO: 3039714 - RNA, 17 nt, Human
ccagagucccugccugg

SEQ ID NO: 3039715 - RNA, 12 nt, Human
ccaugagcuccu

SEQ ID NO: 3039716 - RNA, 22 nt, Human
ccugacccucaucuuucuucca

SEQ ID NO: 3039717 - RNA, 15 nt, Human
cccugugccuuguca

SEQ ID NO: 3039718 - RNA, 22 nt, Human
cccugugccuugucacgccaga

SEQ ID NO: 3039719 - RNA, 20 nt, Human
cccugugccuugucacgcca

SEQ ID NO: 3039720 - RNA, 16 nt, Human
gacagguuagcugcuc

SEQ ID NO: 3039721 - RNA, 19 nt, Human
gcaccggggccugggcagg

SEQ ID NO: 3039722 - RNA, 20 nt, Human
gcaccggggccugggcagga

SEQ ID NO: 3039723 - RNA, 15 nt, Human
gaguuuagggugggg

SEQ ID NO: 3039724 - RNA, 14 nt, Human
gaguuuaggguggg

SEQ ID NO: 3039725 - RNA, 16 nt, Human
gaguccaucagccucc

SEQ ID NO: 3039726 - RNA, 15 nt, Human
gaguccaucagccuc

SEQ ID NO: 3039727 - RNA, 14 nt, Human
gaguccaucagccu

SEQ ID NO: 3039728 - RNA, 13 nt, Human
gaguccaucagcc

SEQ ID NO: 3039729 - RNA, 16 nt, Human
gaucccaacacugcca

SEQ ID NO: 3039730 - RNA, 12 nt, Human
gaucccaacacu

SEQ ID NO: 3039731 - RNA, 21 nt, Human
ggugcuucuaguucugccagg

SEQ ID NO: 3039732 - RNA, 23 nt, Human
ggguguccugcaccggggccugg

SEQ ID NO: 3039733 - RNA, 22 nt, Human
gggcccuggugguggcucggga

SEQ ID NO: 3039734 - RNA, 14 nt, Human
aaaagggaggggga

SEQ ID NO: 3039735 - RNA, 12 nt, Human
ggcacagccugg

SEQ ID NO: 3039736 - RNA, 13 nt, Human
ggcacagccuggc

SEQ ID NO: 3039737 - RNA, 15 nt, Human
ggcacuggggcaggg

SEQ ID NO: 3039738 - RNA, 22 nt, Human
ggcauccagagucccugccugg

SEQ ID NO: 3039739 - RNA, 22 nt, Human
ggcgaagcguuguccucagccc

SEQ ID NO: 3039740 - RNA, 22 nt, Human
gcugcuccccacgucagcuggg

SEQ ID NO: 3039741 - RNA, 13 nt, Human
gcugcuccccacg

SEQ ID NO: 3039742 - RNA, 18 nt, Human
gcuccucgagaucccaac

SEQ ID NO: 3039743 - RNA, 14 nt, Human
gcggcugggaggag

SEQ ID NO: 3039744 - RNA, 13 nt, Human
gcggcugggagga

SEQ ID NO: 3039745 - RNA, 22 nt, Human
gcggcugggaggagggcaggca

SEQ ID NO: 3039746 - RNA, 19 nt, Human
gcggcugggaggagggcag

SEQ ID NO: 3039747 - RNA, 18 nt, Human
gcggcugggaggagggca

SEQ ID NO: 3039748 - RNA, 17 nt, Human
gcggcugggaggagggc

SEQ ID NO: 3039749 - RNA, 17 nt, Human
ugucuggcacagccugg

SEQ ID NO: 3039750 - RNA, 15 nt, Human
uguggccuaaccugc

SEQ ID NO: 3039751 - RNA, 20 nt, Human
ugugccuugucacgccagac

SEQ ID NO: 3039752 - RNA, 19 nt, Human
ugugccuugucacgccaga

SEQ ID NO: 3039753 - RNA, 17 nt, Human
ugugccuugucacgcca

SEQ ID NO: 3039754 - RNA, 21 nt, Human
uguccucagccccgcguggaa

SEQ ID NO: 3039755 - RNA, 12 nt, Human
ugcaccggggcc

SEQ ID NO: 3039756 - RNA, 22 nt, Human
ugcaccggggccugggcaggag

SEQ ID NO: 3039757 - RNA, 16 nt, Human
ugcaccggggccuggg

SEQ ID NO: 3039758 - RNA, 21 nt, Human
ugggacaccccgacuuuuguu

SEQ ID NO: 3039759 - RNA, 18 nt, Human
uggaacucgugucuggca

SEQ ID NO: 3039760 - RNA, 23 nt, Human
ucccaugagcuccuuaaggcucu

SEQ ID NO: 3039761 - RNA, 23 nt, Human
uccucgagaucccaacacugcca

SEQ ID NO: 3039762 - RNA, 16 nt, Human
uccucgagaucccaac

SEQ ID NO: 3039763 - RNA, 16 nt, Human
ucccaacacugccagc

SEQ ID NO: 3039764 - RNA, 15 nt, Human
ucccaacacugccag

SEQ ID NO: 3039765 - RNA, 14 nt, Human
ucccaacacugcca

SEQ ID NO: 3039766 - RNA, 15 nt, Human
uccagagucccugcc

SEQ ID NO: 3039767 - RNA, 17 nt, Human
ucaucuuucuuccaaac

SEQ ID NO: 3039768 - RNA, 14 nt, Human
ucaucuuucuucca

SEQ ID NO: 3039769 - RNA, 23 nt, Human
ucagccuccauccuacccccugu

SEQ ID NO: 3039770 - RNA, 19 nt, Human
ucuuuccaaccggcuuugu

SEQ ID NO: 3039771 - RNA, 16 nt, Human
ugacucuuuccaaccg

SEQ ID NO: 3039772 - RNA, 14 nt, Human
ugacucuuuccaac

SEQ ID NO: 3039773 - RNA, 13 nt, Human
ugacucuuuccaa

SEQ ID NO: 3039774 - RNA, 19 nt, Human
ugacucuuuccaaccggcu

SEQ ID NO: 3039775 - RNA, 23 nt, Human
guuguccucagccccgcguggaa

SEQ ID NO: 3039776 - RNA, 17 nt, Human
guuguccucagccccgc

SEQ ID NO: 3039777 - RNA, 21 nt, Human
guggggagagacgggcccugg

SEQ ID NO: 3039778 - RNA, 21 nt, Human
guguccugcaccggggccugg

SEQ ID NO: 3039779 - RNA, 17 nt, Human
gugucuggcacagccug

SEQ ID NO: 3039780 - RNA, 12 nt, Human
guucugccagga

SEQ ID NO: 3039781 - RNA, 14 nt, Human
guucugccaggaga

SEQ ID NO: 3039782 - RNA, 13 nt, Human
guucugccaggag

SEQ ID NO: 3039783 - RNA, 19 nt, Human
guagugauuuuuaugccac

SEQ ID NO: 3039784 - RNA, 22 nt, Human
gucagcugggacaccccgacuu

SEQ ID NO: 3039785 - RNA, 21 nt, Human
gugauuuuuaugccaccugaa

SEQ ID NO: 3039786 - RNA, 13 nt, Human
gucccugccugga

SEQ ID NO: 3039787 - RNA, 18 nt, Human
gucugagagaggccauuc

SEQ ID NO: 3039788 - RNA, 15 nt, Human
gucugagagaggcca

SEQ ID NO: 3039789 - RNA, 14 nt, Human
gucugagagaggcc

SEQ ID NO: 3039790 - RNA, 13 nt, Human
gucugagagaggc

SEQ ID NO: 3039791 - RNA, 18 nt, Human
gccuuuggacuugucccg

SEQ ID NO: 3039792 - RNA, 12 nt, Human
gcgcggcuggga

SEQ ID NO: 3039793 - RNA, 18 nt, Human
gcgcggcugggaggaggg

SEQ ID NO: 3039794 - RNA, 24 nt, Human
gccucuccacucaugugacucuuu

SEQ ID NO: 3039795 - RNA, 21 nt, Human
gccucuccacucaugugacuc

SEQ ID NO: 3039796 - RNA, 17 nt, Human
gccugacccucaucuuu

SEQ ID NO: 3039797 - RNA, 17 nt, Human
gccuaaccugccgagag

SEQ ID NO: 3039798 - RNA, 15 nt, Human
gcccgggagcucagg

SEQ ID NO: 3039799 - RNA, 19 nt, Human
gcccgggagcucaggaacc

SEQ ID NO: 3039800 - RNA, 17 nt, Human
gcccgggagcucaggaa

SEQ ID NO: 3039801 - RNA, 20 nt, Human
gcaggggccgggggcagucu

SEQ ID NO: 3039802 - RNA, 19 nt, Human
gcaggggccgggggcaguc

SEQ ID NO: 3039803 - RNA, 17 nt, Human
gaucccaugagcuccuu

SEQ ID NO: 3039804 - RNA, 20 nt, Human
gacaccuaggcuaggguggg

SEQ ID NO: 3039805 - RNA, 16 nt, Human
gacaccuaggcuaggg

SEQ ID NO: 3039806 - RNA, 15 nt, Human
gacaccuaggcuagg

SEQ ID NO: 3039807 - RNA, 21 nt, Human
gagagaggccauucuuuccca

SEQ ID NO: 3039808 - RNA, 13 nt, Human
gagagaggccauu

SEQ ID NO: 3039809 - RNA, 18 nt, Human
gacuugucccgggacacc

SEQ ID NO: 3039810 - RNA, 20 nt, Human
gagcuccuuaaggcucuuuu

SEQ ID NO: 3039811 - RNA, 20 nt, Human
gagcucaggaaccgaggcag

SEQ ID NO: 3039812 - RNA, 22 nt, Human
gagcucaggaaccgaggcaggg

SEQ ID NO: 3039813 - RNA, 21 nt, Human
gagcucaggaaccgaggcagg

SEQ ID NO: 3039814 - RNA, 21 nt, Human
gagccugacccucaucuuucu

SEQ ID NO: 3039815 - RNA, 13 nt, Human
cuuucuuccaaac

SEQ ID NO: 3039816 - RNA, 19 nt, Human
cuuucuuccaaacaggcuc

SEQ ID NO: 3039817 - RNA, 12 nt, Human
cuuuggacuugu

SEQ ID NO: 3039818 - RNA, 21 nt, Human
cuuggggaguuuagggugggg

SEQ ID NO: 3039819 - RNA, 20 nt, Human
cuuggggaguuuaggguggg

SEQ ID NO: 3039820 - RNA, 23 nt, Human
cuugucacgccagacuucccacg

SEQ ID NO: 3039821 - RNA, 21 nt, Human
gaaggaucccaugagcuccuu

SEQ ID NO: 3039822 - RNA, 23 nt, Human
cuggcacagccuggcuguggccu

SEQ ID NO: 3039823 - RNA, 15 nt, Human
cuggcacagccuggc

SEQ ID NO: 3039824 - RNA, 21 nt, Human
cuggcacagccuggcuguggc

SEQ ID NO: 3039825 - RNA, 16 nt, Human
cuggcacagccuggcu

SEQ ID NO: 3039826 - RNA, 19 nt, Human
cugggaggagggcaggcau

SEQ ID NO: 3039827 - RNA, 18 nt, Human
cuggcuguggccuaaccu

SEQ ID NO: 3039828 - RNA, 11 nt, Human
cugccaggaga

SEQ ID NO: 3039829 - RNA, 19 nt, Human
cugcccgggagcucaggaa

SEQ ID NO: 3039830 - RNA, 18 nt, Human
cuccauccuacccccugu

SEQ ID NO: 3039831 - RNA, 23 nt, Human
cuccauccuacccccugugccuu

SEQ ID NO: 3039832 - RNA, 22 nt, Human
cuccauccuacccccugugccu

SEQ ID NO: 3039833 - RNA, 20 nt, Human
cuccauccuacccccugugc

SEQ ID NO: 3039834 - RNA, 17 nt, Human
cuccucgagaucccaac

SEQ ID NO: 3039835 - RNA, 24 nt, Human
cuccucgagaucccaacacugcca

SEQ ID NO: 3039836 - RNA, 21 nt, Human
cuccucgagaucccaacacug

SEQ ID NO: 3039837 - RNA, 17 nt, Human
cucuccugucucccucc

SEQ ID NO: 3039838 - RNA, 15 nt, Human
cucuccugucucccu

SEQ ID NO: 3039839 - RNA, 18 nt, Human
cucuccugucucccuccu

SEQ ID NO: 3039840 - RNA, 21 nt, Human
cucuccacucaugugacucuu

SEQ ID NO: 3039841 - RNA, 22 nt, Human
cucuccacucaugugacucuuu

SEQ ID NO: 3039842 - RNA, 21 nt, Human
cucuuggggaguuuagggugg

SEQ ID NO: 3039843 - RNA, 23 nt, Human
cucuuggggaguuuagggugggg

SEQ ID NO: 3039844 - RNA, 12 nt, Human
cggcugggagga

SEQ ID NO: 3039845 - RNA, 17 nt, Human
cgggagccugacccuca

SEQ ID NO: 3039846 - RNA, 17 nt, Human
cgggggcagucugagag

SEQ ID NO: 3039847 - RNA, 21 nt, Human
cgggggcagucugagagaggc

SEQ ID NO: 3039848 - RNA, 18 nt, Human
cgggggcagucugagaga

SEQ ID NO: 3039849 - RNA, 17 nt, Human
cggggccugggcaggag

SEQ ID NO: 3039850 - RNA, 19 nt, Human
cggggccugggcaggaggg

SEQ ID NO: 3039851 - RNA, 23 nt, Human
cguggcuguggcauccagagucc

SEQ ID NO: 3039852 - RNA, 16 nt, Human
cguuguccucagcccc

SEQ ID NO: 3039853 - RNA, 14 nt, Human
cuacccccugugcc

SEQ ID NO: 3039854 - RNA, 13 nt, Human
cuacccccugugc

SEQ ID NO: 3039855 - RNA, 14 nt, Human
cccucaucuuucuu

SEQ ID NO: 3039856 - RNA, 18 nt, Human
cccugccuggaccagccu

SEQ ID NO: 3039857 - RNA, 13 nt, Human
cccugccuggacc

SEQ ID NO: 3039858 - RNA, 12 nt, Human
cccugccuggac

SEQ ID NO: 3039859 - RNA, 16 nt, Human
ccggcuuuguggcacu

SEQ ID NO: 3039860 - RNA, 19 nt, Human
ccggcuuuguggcacuggg

SEQ ID NO: 3039861 - RNA, 17 nt, Human
ccggcuuuguggcacug

SEQ ID NO: 3039862 - RNA, 15 nt, Human
ccgggagcucaggaa

SEQ ID NO: 3039863 - RNA, 13 nt, Human
ccgggagcucagg

SEQ ID NO: 3039864 - RNA, 15 nt, Human
ccggggccugggcag

SEQ ID NO: 3039865 - RNA, 19 nt, Human
ccggggccugggcaggagg

SEQ ID NO: 3039866 - RNA, 18 nt, Human
ccucagccccgcguggaa

SEQ ID NO: 3039867 - RNA, 23 nt, Human
ccuccauccuacccccugugccu

SEQ ID NO: 3039868 - RNA, 22 nt, Human
ccuccauccuacccccugugcc

SEQ ID NO: 3039869 - RNA, 17 nt, Human
ccuccauccuacccccu

SEQ ID NO: 3039870 - RNA, 19 nt, Human
cauccuacccccugugccu

SEQ ID NO: 3039871 - RNA, 23 nt, Human
agagaggccauucuuucccaaca

SEQ ID NO: 3039872 - RNA, 22 nt, Human
agagaggccauucuuucccaac

SEQ ID NO: 3039873 - RNA, 12 nt, Human
agagaggccauu

SEQ ID NO: 3039874 - RNA, 15 nt, Human
aggagggcaggcauc

SEQ ID NO: 3039875 - RNA, 13 nt, Human
aggagggcaggca

SEQ ID NO: 3039876 - RNA, 15 nt, Human
aggagggaggugcuu

SEQ ID NO: 3039877 - RNA, 20 nt, Human
aggagacagguuagcugcuc

SEQ ID NO: 3039878 - RNA, 19 nt, Human
aggcaucggggagccggga

SEQ ID NO: 3039879 - RNA, 19 nt, Human
aggcuaggguggggagaga

SEQ ID NO: 3039880 - RNA, 16 nt, Human
aggcuaggguggggag

SEQ ID NO: 3039881 - RNA, 15 nt, Human
aggcuagggugggga

SEQ ID NO: 3039882 - RNA, 14 nt, Human
aggcuagggugggg

SEQ ID NO: 3039883 - RNA, 13 nt, Human
accggggccuggg

SEQ ID NO: 3039884 - RNA, 14 nt, Human
acccucaucuuucu

SEQ ID NO: 3039885 - RNA, 13 nt, Human
acccucaucuuuc

SEQ ID NO: 3039886 - RNA, 19 nt, Human
acccucaucuuucuuccaa

SEQ ID NO: 3039887 - RNA, 16 nt, Human
acccucaucuuucuuc

SEQ ID NO: 3039888 - RNA, 14 nt, Human
aacaggcucagagg

SEQ ID NO: 3039889 - RNA, 15 nt, Human
uuuguagugauuuuu

SEQ ID NO: 3039890 - RNA, 22 nt, Human
uuuguagugauuuuuaugccac

SEQ ID NO: 3039891 - RNA, 18 nt, Human
uuuguaagguuuuuguag

SEQ ID NO: 3039892 - RNA, 19 nt, Human
uuucccuuccuuccucucc

SEQ ID NO: 3039893 - RNA, 17 nt, Human
aucccaacacugccagc

SEQ ID NO: 3039894 - RNA, 16 nt, Human
aucccaacacugccag

SEQ ID NO: 3039895 - RNA, 15 nt, Human
aucccaacacugcca

SEQ ID NO: 3039896 - RNA, 11 nt, Human
aucccaacacu

SEQ ID NO: 3039897 - RNA, 12 nt, Human
uucugccaggag

SEQ ID NO: 3039898 - RNA, 17 nt, Human
uucuaguucugccagga

SEQ ID NO: 3039899 - RNA, 16 nt, Human
uuggacuugucccggg

SEQ ID NO: 3039900 - RNA, 16 nt, Human
uguggcauccagaguc

SEQ ID NO: 3039901 - RNA, 21 nt, Human
uguggcauccagagucccugc

SEQ ID NO: 3039902 - RNA, 19 nt, Human
uguggcauccagagucccu

SEQ ID NO: 3039903 - RNA, 14 nt, Human
ugugacucuuucca

SEQ ID NO: 3039904 - RNA, 12 nt, Human
ugugacucuuuc

SEQ ID NO: 3039905 - RNA, 17 nt, Human
ugugacucuuuccaacc

SEQ ID NO: 3039906 - RNA, 15 nt, Human
ugugacucuuuccaa

SEQ ID NO: 3039907 - RNA, 20 nt, Human
aguucugccaggagacaggu

SEQ ID NO: 3039908 - RNA, 14 nt, Human
aguucugccaggag

SEQ ID NO: 3039909 - RNA, 13 nt, Human
aguucugccagga

SEQ ID NO: 3039910 - RNA, 12 nt, Human
aguucugccagg

SEQ ID NO: 3039911 - RNA, 14 nt, Human
aguuuagggugggg

SEQ ID NO: 3039912 - RNA, 13 nt, Human
aguuuaggguggg

SEQ ID NO: 3039913 - RNA, 12 nt, Human
aguuuagggugg

SEQ ID NO: 3039914 - RNA, 21 nt, Human
aggguggggggggggcgcggc

SEQ ID NO: 3039915 - RNA, 13 nt, Human
uggggagagacgg

SEQ ID NO: 3039916 - RNA, 22 nt, Human
agggaaggaucccaugagcucc

SEQ ID NO: 3039917 - RNA, 15 nt, Human
agggaaggaucccau

SEQ ID NO: 3039918 - RNA, 23 nt, Human
agggaaggaucccaugagcuccu

SEQ ID NO: 3039919 - RNA, 19 nt, Human
agguuuuuguagugauuuu

SEQ ID NO: 3039920 - RNA, 22 nt, Human
ugccgagaguccaucagccucc

SEQ ID NO: 3039921 - RNA, 15 nt, Human
ugccuugucacgcca

SEQ ID NO: 3039922 - RNA, 16 nt, Human
agccucuccacucaug

SEQ ID NO: 3039923 - RNA, 23 nt, Human
agccccgcguggaacucgugucu

SEQ ID NO: 3039924 - RNA, 19 nt, Human
agacuucccacggcuccuc

SEQ ID NO: 3039925 - RNA, 13 nt, Human
ucuuucuuccaaa

SEQ ID NO: 3039926 - RNA, 18 nt, Human
agaucccaacacugccag

SEQ ID NO: 3039927 - RNA, 20 nt, Human
agaucccaacacugccagca

SEQ ID NO: 3039928 - RNA, 19 nt, Human
agaucccaacacugccagc

SEQ ID NO: 3039929 - RNA, 23 nt, Human
agaguccaucagccuccauccua

SEQ ID NO: 3039930 - RNA, 17 nt, Human
agagucccugccuggac

SEQ ID NO: 3039931 - RNA, 14 nt, Human
agagucccugccug

SEQ ID NO: 3039932 - RNA, 21 nt, Human
agaggccauucuuucccaaca

SEQ ID NO: 3039933 - RNA, 17 nt, Human
ucgagaucccaacacug

SEQ ID NO: 3039934 - RNA, 21 nt, Human
ucgagaucccaacacugccag

SEQ ID NO: 3039935 - RNA, 18 nt, Human
ucgagaucccaacacugc

SEQ ID NO: 3039936 - RNA, 20 nt, Human
ucugagagaggccauucuuu

SEQ ID NO: 3039937 - RNA, 14 nt, Human
ucugagagaggcca

SEQ ID NO: 3039938 - RNA, 23 nt, Human
acuugucccgggacaccuaggcu

SEQ ID NO: 3039939 - RNA, 21 nt, Human
uccacucaugugacucuuucc

SEQ ID NO: 3039940 - RNA, 14 nt, Human
uccacucaugugac

SEQ ID NO: 3039941 - RNA, 21 nt, Human
uccaaccggcuuuguggcacu

SEQ ID NO: 3039942 - RNA, 21 nt, Human
ucccgggacaccuaggcuagg

SEQ ID NO: 3039943 - RNA, 19 nt, Human
acucaugugacucuuucca

SEQ ID NO: 3039944 - RNA, 18 nt, Human
acucaugugacucuuucc

SEQ ID NO: 3039945 - RNA, 17 nt, Human
acaccccgacuuuuguu

SEQ ID NO: 3039946 - RNA, 14 nt, Human
gugguggcucggga

SEQ ID NO: 3039947 - RNA, 23 nt, Human
guggggggggggcgcggcuggga

SEQ ID NO: 3039948 - RNA, 14 nt, Human
guggcacuggggca

SEQ ID NO: 3039949 - RNA, 16 nt, Human
gucucccuccucugcc

SEQ ID NO: 3039950 - RNA, 12 nt, Human
gucucccuccuc

SEQ ID NO: 3039951 - RNA, 19 nt, Human
aacucgugucuggcacagc

SEQ ID NO: 3039952 - RNA, 22 nt, Human
aacacugccagcauuucccuuc

SEQ ID NO: 3039953 - RNA, 12 nt, Human
aacacugccagc

SEQ ID NO: 3039954 - RNA, 13 nt, Human
cugggcaggaggg

SEQ ID NO: 3039955 - RNA, 16 nt, Human
cugcaccggggccugg

SEQ ID NO: 3039956 - RNA, 14 nt, Human
cugcaccggggccu

SEQ ID NO: 3039957 - RNA, 19 nt, Human
cugcaccggggccugggca

SEQ ID NO: 3039958 - RNA, 18 nt, Human
cugcaccggggccugggc

SEQ ID NO: 3039959 - RNA, 15 nt, Human
gaaccgaggcaggga

SEQ ID NO: 3039960 - RNA, 12 nt, Human
gaaccgaggcag

SEQ ID NO: 3039961 - RNA, 14 nt, Human
gcaccggggccugg

SEQ ID NO: 3039962 - RNA, 16 nt, Human
gcaccggggccugggc

SEQ ID NO: 3039963 - RNA, 23 nt, Human
gaggugcuucuaguucugccagg

SEQ ID NO: 3039964 - RNA, 22 nt, Human
gaggugcuucuaguucugccag

SEQ ID NO: 3039965 - RNA, 17 nt, Human
gaguccaucagccucca

SEQ ID NO: 3039966 - RNA, 16 nt, Human
gagggcugccuuugga

SEQ ID NO: 3039967 - RNA, 9 nt, Human
gagggcugc

SEQ ID NO: 3039968 - RNA, 12 nt, Human
ggggccugggca

SEQ ID NO: 3039969 - RNA, 15 nt, Human
ggggccugggcagga

SEQ ID NO: 3039970 - RNA, 14 nt, Human
gggagggggagagg

SEQ ID NO: 3039971 - RNA, 20 nt, Human
ggcuccucgagaucccaaca

SEQ ID NO: 3039972 - RNA, 15 nt, Human
aaaaagggaggggga

SEQ ID NO: 3039973 - RNA, 17 nt, Human
ggagagacgggcccugg

SEQ ID NO: 3039974 - RNA, 15 nt, Human
ggagagacgggcccu

SEQ ID NO: 3039975 - RNA, 23 nt, Human
ggcaggcaucggggagccgggag

SEQ ID NO: 3039976 - RNA, 17 nt, Human
caccuaggcuagggugg

SEQ ID NO: 3039977 - RNA, 19 nt, Human
caccuaggcuagggugggg

SEQ ID NO: 3039978 - RNA, 18 nt, Human
caccuaggcuaggguggg

SEQ ID NO: 3039979 - RNA, 17 nt, Human
auuuuuaugccaccuga

SEQ ID NO: 3039980 - RNA, 18 nt, Human
ccagagaaaaagggaggg

SEQ ID NO: 3039981 - RNA, 23 nt, Human
ccagacuucccacggcuccucga

SEQ ID NO: 3039982 - RNA, 21 nt, Human
ccaugagcuccuuaaggcucu

SEQ ID NO: 3039983 - RNA, 22 nt, Human
cccccugugccuugucacgcca

SEQ ID NO: 3039984 - RNA, 21 nt, Human
ccccgcguggaacucgugucu

SEQ ID NO: 3039985 - RNA, 22 nt, Human
ccucugcccgggagcucaggaa

SEQ ID NO: 3039986 - RNA, 21 nt, Human
ccucugcccgggagcucagga

SEQ ID NO: 3039987 - RNA, 12 nt, Human
ccugccuggacc

SEQ ID NO: 3039988 - RNA, 19 nt, Human
ccugccuggaccagccucu

SEQ ID NO: 3039989 - RNA, 23 nt, Human
ccucuuggggaguuuaggguggg

SEQ ID NO: 3039990 - RNA, 22 nt, Human
ccucuuggggaguuuagggugg

SEQ ID NO: 3039991 - RNA, 14 nt, Human
cucaugugacucuu

SEQ ID NO: 3039992 - RNA, 16 nt, Human
cuccugucucccuccu

SEQ ID NO: 3039993 - RNA, 24 nt, Human
cuccucugcccgggagcucaggaa

SEQ ID NO: 3039994 - RNA, 22 nt, Human
cuccucugcccgggagcucagg

SEQ ID NO: 3039995 - RNA, 14 nt, Human
ugucacgccagacu

SEQ ID NO: 3039996 - RNA, 18 nt, Human
uggggcaggggccggggg

SEQ ID NO: 3039997 - RNA, 16 nt, Human
uggggcaggggccggg

SEQ ID NO: 3039998 - RNA, 20 nt, Human
ugcuucuaguucugccagga

SEQ ID NO: 3039999 - RNA, 19 nt, Human
ugcuucuaguucugccagg

SEQ ID NO: 3040000 - RNA, 18 nt, Human
ugcuucuaguucugccag

SEQ ID NO: 3040001 - RNA, 19 nt, Human
ucuuuuguaagguuuuugu

SEQ ID NO: 3040002 - RNA, 19 nt, Human
uccuuaaggcucuuuugua

SEQ ID NO: 3040003 - RNA, 16 nt, Human
uccuuaaggcucuuuu

SEQ ID NO: 3040004 - RNA, 18 nt, Human
ucacgccagacuucccac

SEQ ID NO: 3040005 - RNA, 13 nt, Human
uaggcuagggugg

SEQ ID NO: 3040006 - RNA, 22 nt, Human
uagugauuuuuaugccaccuga

SEQ ID NO: 3040007 - RNA, 21 nt, Human
uagugauuuuuaugccaccug

SEQ ID NO: 3040008 - RNA, 20 nt, Human
uagugauuuuuaugccaccu

SEQ ID NO: 3040009 - RNA, 15 nt, Human
gggggagagggcugc

SEQ ID NO: 3040010 - RNA, 17 nt, Human
gggccugggcaggaggg

SEQ ID NO: 3040011 - RNA, 16 nt, Human
gggccugggcaggagg

SEQ ID NO: 3040012 - RNA, 19 nt, Human
ggggcagucugagagaggc

SEQ ID NO: 3040013 - RNA, 15 nt, Human
ggggcagucugagag

SEQ ID NO: 3040014 - RNA, 18 nt, Human
ggggcagucugagagagg

SEQ ID NO: 3040015 - RNA, 16 nt, Human
ggggcgcggcugggag

SEQ ID NO: 3040016 - RNA, 15 nt, Human
ggggcgcggcuggga

SEQ ID NO: 3040017 - RNA, 21 nt, Human
gguguccugcaccggggccug

SEQ ID NO: 3040018 - RNA, 15 nt, Human
ggugguggcucggga

SEQ ID NO: 3040019 - RNA, 21 nt, Human
gggcagucugagagaggccau

SEQ ID NO: 3040020 - RNA, 20 nt, Human
gggcagucugagagaggcca

SEQ ID NO: 3040021 - RNA, 12 nt, Human
gggccugggcag

SEQ ID NO: 3040022 - RNA, 15 nt, Human
gggccugggcaggag

SEQ ID NO: 3040023 - RNA, 13 nt, Human
gggccugggcagg

SEQ ID NO: 3040024 - RNA, 16 nt, Human
gggaguuuaggguggg

SEQ ID NO: 3040025 - RNA, 23 nt, Human
gggaggugcuucuaguucugcca

SEQ ID NO: 3040026 - RNA, 17 nt, Human
gggcagucugagagagg

SEQ ID NO: 3040027 - RNA, 19 nt, Human
gggcagucugagagaggcc

SEQ ID NO: 3040028 - RNA, 18 nt, Human
gggcagucugagagaggc

SEQ ID NO: 3040029 - RNA, 15 nt, Human
gggaaggaucccaug

SEQ ID NO: 3040030 - RNA, 20 nt, Human
gcugccuuuggacuuguccc

SEQ ID NO: 3040031 - RNA, 15 nt, Human
gcugccuuuggacuu

SEQ ID NO: 3040032 - RNA, 23 nt, Human
gcugggacaccccgacuuuuguu

SEQ ID NO: 3040033 - RNA, 19 nt, Human
gcugggaggagggcaggca

SEQ ID NO: 3040034 - RNA, 17 nt, Human
gcugggaggagggcagg

SEQ ID NO: 3040035 - RNA, 17 nt, Human
ggaacucgugucuggca

SEQ ID NO: 3040036 - RNA, 20 nt, Human
ggaaccgaggcagggaagga

SEQ ID NO: 3040037 - RNA, 16 nt, Human
ggaaccgaggcaggga

SEQ ID NO: 3040038 - RNA, 15 nt, Human
ggaaccgaggcaggg

SEQ ID NO: 3040039 - RNA, 18 nt, Human
gcuucuaguucugccagg

SEQ ID NO: 3040040 - RNA, 21 nt, Human
gcuucuaguucugccaggaga

SEQ ID NO: 3040041 - RNA, 20 nt, Human
gcuucuaguucugccaggag

SEQ ID NO: 3040042 - RNA, 19 nt, Human
gcuucuaguucugccagga

SEQ ID NO: 3040043 - RNA, 20 nt, Human
ggaucccaugagcuccuuaa

SEQ ID NO: 3040044 - RNA, 17 nt, Human
ggaucccaugagcuccu

SEQ ID NO: 3040045 - RNA, 20 nt, Human
ggcagucugagagaggccau

SEQ ID NO: 3040046 - RNA, 13 nt, Human
ggagggcaggcau

SEQ ID NO: 3040047 - RNA, 16 nt, Human
ggagccgggagccuga

SEQ ID NO: 3040048 - RNA, 20 nt, Human
ggaggagggcaggcaucggg

SEQ ID NO: 3040049 - RNA, 15 nt, Human
ggaggagggcaggca

SEQ ID NO: 3040050 - RNA, 14 nt, Human
ggaggagggcaggc

SEQ ID NO: 3040051 - RNA, 17 nt, Human
ggaaggaucccaugagc

SEQ ID NO: 3040052 - RNA, 21 nt, Human
gccgagaguccaucagccucc

SEQ ID NO: 3040053 - RNA, 14 nt, Human
gccgggagccugac

SEQ ID NO: 3040054 - RNA, 13 nt, Human
gccgggagccuga

SEQ ID NO: 3040055 - RNA, 19 nt, Human
gccgggagccugacccuca

SEQ ID NO: 3040056 - RNA, 13 nt, Human
gccccgcguggaa

SEQ ID NO: 3040057 - RNA, 15 nt, Human
gcaggagggaggugc

SEQ ID NO: 3040058 - RNA, 19 nt, Human
gcacagccuggcuguggcc

SEQ ID NO: 3040059 - RNA, 12 nt, Human
gcacagccuggc

SEQ ID NO: 3040060 - RNA, 18 nt, Human
gacuucccacggcuccuc

SEQ ID NO: 3040061 - RNA, 19 nt, Human
gaagcguuguccucagccc

SEQ ID NO: 3040062 - RNA, 13 nt, Human
gaagcguuguccu

SEQ ID NO: 3040063 - RNA, 20 nt, Human
gaagcguuguccucagcccc

SEQ ID NO: 3040064 - RNA, 14 nt, Human
cuuccuuccucucc

SEQ ID NO: 3040065 - RNA, 19 nt, Human
cucuccacucaugugacuc

SEQ ID NO: 3040066 - RNA, 13 nt, Human
cuccuuaaggcuc

SEQ ID NO: 3040067 - RNA, 22 nt, Human
cuccuuaaggcucuuuuguaag

SEQ ID NO: 3040068 - RNA, 18 nt, Human
cugcccgggagcucagga

SEQ ID NO: 3040069 - RNA, 16 nt, Human
cugccaggagacaggu

SEQ ID NO: 3040070 - RNA, 20 nt, Human
cugccagcauuucccuuccu

SEQ ID NO: 3040071 - RNA, 14 nt, Human
cuggcacagccugg

SEQ ID NO: 3040072 - RNA, 12 nt, Human
cuggaccagccu

SEQ ID NO: 3040073 - RNA, 22 nt, Human
ccgacuuuuguuuaccagagaa

SEQ ID NO: 3040074 - RNA, 15 nt, Human
ccuccucugcccggg

SEQ ID NO: 3040075 - RNA, 14 nt, Human
ccuccucugcccgg

SEQ ID NO: 3040076 - RNA, 23 nt, Human
ccucuccacucaugugacucuuu

SEQ ID NO: 3040077 - RNA, 16 nt, Human
cgggagcucaggaacc

SEQ ID NO: 3040078 - RNA, 23 nt, Human
cggcugggaggagggcaggcauc

SEQ ID NO: 3040079 - RNA, 18 nt, Human
cggcugggaggagggcag

SEQ ID NO: 3040080 - RNA, 22 nt, Human
cggcugggaggagggcaggcau

SEQ ID NO: 3040081 - RNA, 19 nt, Human
cgucagcugggacaccccg

SEQ ID NO: 3040082 - RNA, 14 nt, Human
ccuggaccagccuc

SEQ ID NO: 3040083 - RNA, 16 nt, Human
ccuggaccagccucuc

SEQ ID NO: 3040084 - RNA, 15 nt, Human
ccuggaccagccucu

SEQ ID NO: 3040085 - RNA, 21 nt, Human
ccacgucagcugggacacccc

SEQ ID NO: 3040086 - RNA, 16 nt, Human
ccaaacaggcucagag

SEQ ID NO: 3040087 - RNA, 13 nt, Human
ccaacacugccag

SEQ ID NO: 3040088 - RNA, 16 nt, Human
ccaacacugccagcau

SEQ ID NO: 3040089 - RNA, 15 nt, Human
ccaacacugccagca

SEQ ID NO: 3040090 - RNA, 14 nt, Human
ccaacacugccagc

SEQ ID NO: 3040091 - RNA, 13 nt, Human
cccaacaccucuu

SEQ ID NO: 3040092 - RNA, 13 nt, Human
ccaucagccucca

SEQ ID NO: 3040093 - RNA, 22 nt, Human
cuccucugcccgggagcucagg

SEQ ID NO: 3040094 - RNA, 24 nt, Human
cuccucugcccgggagcucaggaa

SEQ ID NO: 3040095 - RNA, 16 nt, Human
cuccugucucccuccu

SEQ ID NO: 3040096 - RNA, 14 nt, Human
cuccucuuccaggc

SEQ ID NO: 3040097 - RNA, 14 nt, Human
cucaugugacucuu

SEQ ID NO: 3040098 - RNA, 19 nt, Human
cucccucuacugggagccu

SEQ ID NO: 3040099 - RNA, 13 nt, Human
cucccucuacugg

SEQ ID NO: 3040100 - RNA, 20 nt, Human
cucccucuacugggagccua

SEQ ID NO: 3040101 - RNA, 20 nt, Human
cucugcaggaaauggcugug

SEQ ID NO: 3040102 - RNA, 23 nt, Human
cucaggccgaaggaggagucagg

SEQ ID NO: 3040103 - RNA, 20 nt, Human
cucaggccugacucucagca

SEQ ID NO: 3040104 - RNA, 23 nt, Human
cucaugauagaaggcuaugggga

SEQ ID NO: 3040105 - RNA, 14 nt, Human
ccuugcauaauggu

SEQ ID NO: 3040106 - RNA, 23 nt, Human
cuaaaguaaaaacaaagaaauua

SEQ ID NO: 3040107 - RNA, 22 nt, Human
ccucuuggggaguuuagggugg

SEQ ID NO: 3040108 - RNA, 15 nt, Human
ccucuuggcugccuu

SEQ ID NO: 3040109 - RNA, 23 nt, Human
ccucuuggggaguuuaggguggg

SEQ ID NO: 3040110 - RNA, 14 nt, Human
ccugaguuccuagc

SEQ ID NO: 3040111 - RNA, 17 nt, Human
ccugcagagcugcgggc

SEQ ID NO: 3040112 - RNA, 14 nt, Human
ccugcagagcugcg

SEQ ID NO: 3040113 - RNA, 13 nt, Human
ccugcagagcugc

SEQ ID NO: 3040114 - RNA, 12 nt, Human
ccugcagagcug

SEQ ID NO: 3040115 - RNA, 19 nt, Human
ccugccuggaccagccucu

SEQ ID NO: 3040116 - RNA, 12 nt, Human
ccugccuggacc

SEQ ID NO: 3040117 - RNA, 20 nt, Human
ccugccucucugcagguccc

SEQ ID NO: 3040118 - RNA, 21 nt, Human
ccugccucucugcaggucccu

SEQ ID NO: 3040119 - RNA, 17 nt, Human
ccugccucucugcaggu

SEQ ID NO: 3040120 - RNA, 21 nt, Human
ccucugcccgggagcucagga

SEQ ID NO: 3040121 - RNA, 22 nt, Human
ccucugcccgggagcucaggaa

SEQ ID NO: 3040122 - RNA, 18 nt, Human
ccucucugcaggucccua

SEQ ID NO: 3040123 - RNA, 19 nt, Human
ccucucugcaggucccuaa

SEQ ID NO: 3040124 - RNA, 16 nt, Human
ccucucugcagguccc

SEQ ID NO: 3040125 - RNA, 17 nt, Human
ccucucugcaggucccu

SEQ ID NO: 3040126 - RNA, 23 nt, Human
ccgaaggugaggagcuugaaacc

SEQ ID NO: 3040127 - RNA, 18 nt, Human
cccugagaucucugcagg

SEQ ID NO: 3040128 - RNA, 14 nt, Human
cccugaaggaacca

SEQ ID NO: 3040129 - RNA, 21 nt, Human
ccccgcguggaacucgugucu

SEQ ID NO: 3040130 - RNA, 22 nt, Human
cccccugugccuugucacgcca

SEQ ID NO: 3040131 - RNA, 22 nt, Human
cccagcuggggccaggcugggu

SEQ ID NO: 3040132 - RNA, 23 nt, Human
cccagcuggggccaggcuggguc

SEQ ID NO: 3040133 - RNA, 20 nt, Human
cccagcuggggccaggcugg

SEQ ID NO: 3040134 - RNA, 21 nt, Human
ccaugagcuccuuaaggcucu

SEQ ID NO: 3040135 - RNA, 23 nt, Human
cccacuguacuugcucuugaugc

SEQ ID NO: 3040136 - RNA, 18 nt, Human
cccacuguacuugcucuu

SEQ ID NO: 3040137 - RNA, 19 nt, Human
cccacuguacuugcucuug

SEQ ID NO: 3040138 - RNA, 13 nt, Human
ccauugguguuga

SEQ ID NO: 3040139 - RNA, 23 nt, Human
ccagacuucccacggcuccucga

SEQ ID NO: 3040140 - RNA, 18 nt, Human
ccagagaaaaagggaggg

SEQ ID NO: 3040141 - RNA, 18 nt, Human
ccagacuccaccaagccu

SEQ ID NO: 3040142 - RNA, 14 nt, Human
ccagacuccaccaa

SEQ ID NO: 3040143 - RNA, 17 nt, Human
auuuuuaugccaccuga

SEQ ID NO: 3040144 - RNA, 15 nt, Human
auuuuuuucugaauu

SEQ ID NO: 3040145 - RNA, 19 nt, Human
auuuucuauaauuuaaaua

SEQ ID NO: 3040146 - RNA, 18 nt, Human
auuuucuauaauuuaaau

SEQ ID NO: 3040147 - RNA, 17 nt, Human
auuuucuauaauuuaaa

SEQ ID NO: 3040148 - RNA, 13 nt, Human
auuuugaaaaacu

SEQ ID NO: 3040149 - RNA, 15 nt, Human
auuuugaaaaacugc

SEQ ID NO: 3040150 - RNA, 19 nt, Human
auuuguucuauagcuuuuc

SEQ ID NO: 3040151 - RNA, 16 nt, Human
auuucagcagcugcag

SEQ ID NO: 3040152 - RNA, 15 nt, Human
auugauaaguucaua

SEQ ID NO: 3040153 - RNA, 12 nt, Human
auugauaaguuc

SEQ ID NO: 3040154 - RNA, 19 nt, Human
auugauaaguucauacauu

SEQ ID NO: 3040155 - RNA, 18 nt, Human
auugauaaguucauacau

SEQ ID NO: 3040156 - RNA, 17 nt, Human
auugauaaguucauaca

SEQ ID NO: 3040157 - RNA, 16 nt, Human
auugauaaguucauac

SEQ ID NO: 3040158 - RNA, 21 nt, Human
auugauaaguucauacauugu

SEQ ID NO: 3040159 - RNA, 21 nt, Human
auuaacaugaauauuuagugu

SEQ ID NO: 3040160 - RNA, 20 nt, Human
auuaaauuuugaguucuaca

SEQ ID NO: 3040161 - RNA, 17 nt, Human
auucauggccuggggga

SEQ ID NO: 3040162 - RNA, 13 nt, Human
auuaugugccaga

SEQ ID NO: 3040163 - RNA, 21 nt, Human
auuaugugccagauuuaugca

SEQ ID NO: 3040164 - RNA, 18 nt, Human
caccuaggcuaggguggg

SEQ ID NO: 3040165 - RNA, 19 nt, Human
caccuaggcuagggugggg

SEQ ID NO: 3040166 - RNA, 17 nt, Human
caccuaggcuagggugg

SEQ ID NO: 3040167 - RNA, 15 nt, Human
caagcaaaugugaau

SEQ ID NO: 3040168 - RNA, 17 nt, Human
caagcaaaugugaauca

SEQ ID NO: 3040169 - RNA, 19 nt, Human
caagcaaaugugaaucauu

SEQ ID NO: 3040170 - RNA, 15 nt, Human
caacuauuuuuccaa

SEQ ID NO: 3040171 - RNA, 14 nt, Human
caacuauggccugu

SEQ ID NO: 3040172 - RNA, 13 nt, Human
caacuauggccug

SEQ ID NO: 3040173 - RNA, 18 nt, Human
cagccaggccacuggccc

SEQ ID NO: 3040174 - RNA, 17 nt, Human
cagcacguguggccugu

SEQ ID NO: 3040175 - RNA, 13 nt, Human
cagauuuaugcau

SEQ ID NO: 3040176 - RNA, 20 nt, Human
cauuggauucugagagcugu

SEQ ID NO: 3040177 - RNA, 15 nt, Human
cauuggauucugaga

SEQ ID NO: 3040178 - RNA, 16 nt, Human
cauuggagauguuuag

SEQ ID NO: 3040179 - RNA, 16 nt, Human
ccaacuauggccugug

SEQ ID NO: 3040180 - RNA, 14 nt, Human
ccaacuauggccug

SEQ ID NO: 3040181 - RNA, 15 nt, Human
ccaacuauggccugu

SEQ ID NO: 3040182 - RNA, 22 nt, Human
ccaauuauaugagacguuuuug

SEQ ID NO: 3040183 - RNA, 19 nt, Human
ccaauucgaacuuuuucca

SEQ ID NO: 3040184 - RNA, 16 nt, Human
caugaauuugugaagg

SEQ ID NO: 3040185 - RNA, 21 nt, Human
caugaauauuuaguguucaua

SEQ ID NO: 3040186 - RNA, 21 nt, Human
caguuauuauauuuacaaaug

SEQ ID NO: 3040187 - RNA, 17 nt, Human
caguuauuauauuuaca

SEQ ID NO: 3040188 - RNA, 14 nt, Human
caguucagcuuggg

SEQ ID NO: 3040189 - RNA, 15 nt, Human
caguucagcuugggg

SEQ ID NO: 3040190 - RNA, 22 nt, Human
caguuauuauauuuacaaaugg

SEQ ID NO: 3040191 - RNA, 17 nt, Human
caucuguaccucugccu

SEQ ID NO: 3040192 - RNA, 21 nt, Human
cauauuauuuuauguugcaua

SEQ ID NO: 3040193 - RNA, 16 nt, Human
cauacagggauggugu

SEQ ID NO: 3040194 - RNA, 19 nt, Human
cauacagggaugguguuca

SEQ ID NO: 3040195 - RNA, 18 nt, Human
cauaauuauuauuuggcc

SEQ ID NO: 3040196 - RNA, 23 nt, Human
caguuguucaauaauaaauauuu

SEQ ID NO: 3040197 - RNA, 23 nt, Human
ggcaggcaucggggagccgggag

SEQ ID NO: 3040198 - RNA, 15 nt, Human
ggaugguguucaaaa

SEQ ID NO: 3040199 - RNA, 13 nt, Human
ggaugucugggcc

SEQ ID NO: 3040200 - RNA, 18 nt, Human
ggccagcaccaucucuuu

SEQ ID NO: 3040201 - RNA, 15 nt, Human
ggagagacgggcccu

SEQ ID NO: 3040202 - RNA, 17 nt, Human
ggagagacgggcccugg

SEQ ID NO: 3040203 - RNA, 23 nt, Human
ggacugugugcucaggagcccug

SEQ ID NO: 3040204 - RNA, 22 nt, Human
ggacugugugcucaggagcccu

SEQ ID NO: 3040205 - RNA, 18 nt, Human
ggagaaaugaaaaaauau

SEQ ID NO: 3040206 - RNA, 16 nt, Human
ggacuuggagguagcu

SEQ ID NO: 3040207 - RNA, 18 nt, Human
ggaccccuggugguucac

SEQ ID NO: 3040208 - RNA, 15 nt, Human
ggagcccacuguacu

SEQ ID NO: 3040209 - RNA, 18 nt, Human
ggagcccacuguacuugc

SEQ ID NO: 3040210 - RNA, 17 nt, Human
ggaggcucuggagccca

SEQ ID NO: 3040211 - RNA, 20 nt, Human
ggaggcucuggagcccacug

SEQ ID NO: 3040212 - RNA, 21 nt, Human
ggaggcucuggagcccacugu

SEQ ID NO: 3040213 - RNA, 15 nt, Human
ggaggcucuggagcc

SEQ ID NO: 3040214 - RNA, 15 nt, Human
aaaaagggaggggga

SEQ ID NO: 3040215 - RNA, 20 nt, Human
ggcuccucgagaucccaaca

SEQ ID NO: 3040216 - RNA, 17 nt, Human
ggcuggaucugugaggg

SEQ ID NO: 3040217 - RNA, 14 nt, Human
gggagggggagagg

SEQ ID NO: 3040218 - RNA, 16 nt, Human
aaaagggacugagaaa

SEQ ID NO: 3040219 - RNA, 18 nt, Human
aaaauauauaucaaauau

SEQ ID NO: 3040220 - RNA, 14 nt, Human
aaaauauauuuaau

SEQ ID NO: 3040221 - RNA, 19 nt, Human
aaaagccugcaauuucaua

SEQ ID NO: 3040222 - RNA, 16 nt, Human
aaaagccuguuuaaga

SEQ ID NO: 3040223 - RNA, 18 nt, Human
aaaagccuguuuaagaga

SEQ ID NO: 3040224 - RNA, 22 nt, Human
aaaagcuccauuuuuagugaaa

SEQ ID NO: 3040225 - RNA, 19 nt, Human
aaaacugcucauaugaugu

SEQ ID NO: 3040226 - RNA, 15 nt, Human
ggggccugggcagga

SEQ ID NO: 3040227 - RNA, 12 nt, Human
ggggccugggca

SEQ ID NO: 3040228 - RNA, 23 nt, Human
ggggucuguguguuuaugugugu

SEQ ID NO: 3040229 - RNA, 19 nt, Human
aaacauguuucuuuguaau

SEQ ID NO: 3040230 - RNA, 22 nt, Human
aaacauguuucuuuguaaugaa

SEQ ID NO: 3040231 - RNA, 23 nt, Human
aaacauguuucuuuguaaugaaa

SEQ ID NO: 3040232 - RNA, 14 nt, Human
aaaccaccagaagc

SEQ ID NO: 3040233 - RNA, 21 nt, Human
aaaccacauuggagauguuua

SEQ ID NO: 3040234 - RNA, 21 nt, Human
aaaauauuauguguuuccaua

SEQ ID NO: 3040235 - RNA, 14 nt, Human
aaaauauuaugugu

SEQ ID NO: 3040236 - RNA, 15 nt, Human
aaaauauuauguguu

SEQ ID NO: 3040237 - RNA, 19 nt, Human
aaaauuuuuaaucuuuaau

SEQ ID NO: 3040238 - RNA, 16 nt, Human
aaaauugugauguguc

SEQ ID NO: 3040239 - RNA, 15 nt, Human
aaaauuuuuaaucuu

SEQ ID NO: 3040240 - RNA, 16 nt, Human
aaaauuuuuaaucuuu

SEQ ID NO: 3040241 - RNA, 19 nt, Human
aaacaacuucaauauccaa

SEQ ID NO: 3040242 - RNA, 13 nt, Human
aaacaaagaaauu

SEQ ID NO: 3040243 - RNA, 16 nt, Human
ggggccaggcuggguc

SEQ ID NO: 3040244 - RNA, 13 nt, Human
ggggccaggcugg

SEQ ID NO: 3040245 - RNA, 14 nt, Human
ggggccaggcuggg

SEQ ID NO: 3040246 - RNA, 14 nt, Human
aaagaugcaaugua

SEQ ID NO: 3040247 - RNA, 14 nt, Human
aaagauuuucagaa

SEQ ID NO: 3040248 - RNA, 15 nt, Human
aaagauuuucagaaa

SEQ ID NO: 3040249 - RNA, 18 nt, Human
ggucauauuaauauauuu

SEQ ID NO: 3040250 - RNA, 21 nt, Human
ggucauauuaauauauuucca

SEQ ID NO: 3040251 - RNA, 21 nt, Human
ggucuugguuccagccugcca

SEQ ID NO: 3040252 - RNA, 20 nt, Human
ggucuugguuccagccugcc

SEQ ID NO: 3040253 - RNA, 21 nt, Human
aaagauuuucagaaaauauua

SEQ ID NO: 3040254 - RNA, 14 nt, Human
aaagcgaauuuuaa

SEQ ID NO: 3040255 - RNA, 13 nt, Human
aaaggaauuuaaa

SEQ ID NO: 3040256 - RNA, 17 nt, Human
gccuacccacccccagg

SEQ ID NO: 3040257 - RNA, 16 nt, Human
gccuacccacccccag

SEQ ID NO: 3040258 - RNA, 16 nt, Human
gccauaugaaaaggcu

SEQ ID NO: 3040259 - RNA, 19 nt, Human
gccaggccacuggccccug

SEQ ID NO: 3040260 - RNA, 17 nt, Human
gccagacccccuggaga

SEQ ID NO: 3040261 - RNA, 16 nt, Human
gccaccgccuccuaca

SEQ ID NO: 3040262 - RNA, 21 nt, Human
gccacuguuuugaaucucaua

SEQ ID NO: 3040263 - RNA, 12 nt, Human
gcugggucgccc

SEQ ID NO: 3040264 - RNA, 16 nt, Human
gcugggucgcccugga

SEQ ID NO: 3040265 - RNA, 17 nt, Human
gcugggucgcccuggac

SEQ ID NO: 3040266 - RNA, 18 nt, Human
gcugggucgcccuggacu

SEQ ID NO: 3040267 - RNA, 19 nt, Human
gcugggucgcccuggacug

SEQ ID NO: 3040268 - RNA, 19 nt, Human
gcuugaaacccguggcgcu

SEQ ID NO: 3040269 - RNA, 22 nt, Human
gcuuccuucugugaaaguacau

SEQ ID NO: 3040270 - RNA, 14 nt, Human
gcucaggagcccug

SEQ ID NO: 3040271 - RNA, 15 nt, Human
gcucaggagcccugg

SEQ ID NO: 3040272 - RNA, 18 nt, Human
gcucaggagcccugggag

SEQ ID NO: 3040273 - RNA, 19 nt, Human
gcuauggggauagaugugu

SEQ ID NO: 3040274 - RNA, 21 nt, Human
gcuauggggauagaugugugg

SEQ ID NO: 3040275 - RNA, 23 nt, Human
gcucuggagcccacuguacuugc

SEQ ID NO: 3040276 - RNA, 9 nt, Human
gagggcugc

SEQ ID NO: 3040277 - RNA, 16 nt, Human
gagggcugccuuugga

SEQ ID NO: 3040278 - RNA, 18 nt, Human
gaggcugcagccaggcca

SEQ ID NO: 3040279 - RNA, 18 nt, Human
gaggcuacuguaaggcaa

SEQ ID NO: 3040280 - RNA, 12 nt, Human
gaggcagguccc

SEQ ID NO: 3040281 - RNA, 16 nt, Human
gaggcagguccccaga

SEQ ID NO: 3040282 - RNA, 13 nt, Human
gaggcaggucccc

SEQ ID NO: 3040283 - RNA, 17 nt, Human
gaguccaucagccucca

SEQ ID NO: 3040284 - RNA, 18 nt, Human
gagucagggagagcugaa

SEQ ID NO: 3040285 - RNA, 22 nt, Human
gaggugcuucuaguucugccag

SEQ ID NO: 3040286 - RNA, 23 nt, Human
gaggugcuucuaguucugccagg

SEQ ID NO: 3040287 - RNA, 20 nt, Human
gagguggaagagggcugcaa

SEQ ID NO: 3040288 - RNA, 17 nt, Human
gagguggaagagggcug

SEQ ID NO: 3040289 - RNA, 16 nt, Human
gcaccggggccugggc

SEQ ID NO: 3040290 - RNA, 14 nt, Human
gcaccggggccugg

SEQ ID NO: 3040291 - RNA, 18 nt, Human
gcaagucagaauagaaau

SEQ ID NO: 3040292 - RNA, 14 nt, Human
gauuauauuaugaa

SEQ ID NO: 3040293 - RNA, 14 nt, Human
gauucugagagcug

SEQ ID NO: 3040294 - RNA, 14 nt, Human
gaugguucuagcau

SEQ ID NO: 3040295 - RNA, 12 nt, Human
gaaccgaggcag

SEQ ID NO: 3040296 - RNA, 15 nt, Human
gaaccgaggcaggga

SEQ ID NO: 3040297 - RNA, 20 nt, Human
gaacugcugggcuuggcagc

SEQ ID NO: 3040298 - RNA, 17 nt, Human
gaacugcugggcuuggc

SEQ ID NO: 3040299 - RNA, 20 nt, Human
gaagcaaugcuucaucccuu

SEQ ID NO: 3040300 - RNA, 20 nt, Human
gaagcuaucguaaaauuaag

SEQ ID NO: 3040301 - RNA, 20 nt, Human
gaauauguuucaaacuuugg

SEQ ID NO: 3040302 - RNA, 15 nt, Human
gaauauguuucaaac

SEQ ID NO: 3040303 - RNA, 14 nt, Human
gaauauguuucaaa

SEQ ID NO: 3040304 - RNA, 24 nt, Human
gaagugugggucugugugugugua

SEQ ID NO: 3040305 - RNA, 21 nt, Human
gaagugugggucugugugugu

SEQ ID NO: 3040306 - RNA, 22 nt, Human
gacugugugcucaggagcccug

SEQ ID NO: 3040307 - RNA, 14 nt, Human
gacagugaaagaaa

SEQ ID NO: 3040308 - RNA, 18 nt, Human
cugcaccggggccugggc

SEQ ID NO: 3040309 - RNA, 19 nt, Human
cugcaccggggccugggca

SEQ ID NO: 3040310 - RNA, 14 nt, Human
cugcaccggggccu

SEQ ID NO: 3040311 - RNA, 16 nt, Human
cugcaccggggccugg

SEQ ID NO: 3040312 - RNA, 19 nt, Human
cugcaaauccuugugggaa

SEQ ID NO: 3040313 - RNA, 16 nt, Human
cugcaaauccuugugg

SEQ ID NO: 3040314 - RNA, 17 nt, Human
cugcaggaaauggcugu

SEQ ID NO: 3040315 - RNA, 13 nt, Human
cugggcaggaggg

SEQ ID NO: 3040316 - RNA, 17 nt, Human
cugggagaaaugaaaaa

SEQ ID NO: 3040317 - RNA, 16 nt, Human
cugggagaaaugaaaa

SEQ ID NO: 3040318 - RNA, 13 nt, Human
cuggcccugugcc

SEQ ID NO: 3040319 - RNA, 14 nt, Human
cuggaucugugagg

SEQ ID NO: 3040320 - RNA, 23 nt, Human
cuggacugugugcucaggagccc

SEQ ID NO: 3040321 - RNA, 19 nt, Human
cuggacugugugcucagga

SEQ ID NO: 3040322 - RNA, 22 nt, Human
cuggacugugugcucaggagcc

SEQ ID NO: 3040323 - RNA, 22 nt, Human
cuugacaaagucaagccacaug

SEQ ID NO: 3040324 - RNA, 14 nt, Human
cuuugagguggaag

SEQ ID NO: 3040325 - RNA, 17 nt, Human
cuuugagguggaagagg

SEQ ID NO: 3040326 - RNA, 16 nt, Human
cuuugagguggaagag

SEQ ID NO: 3040327 - RNA, 22 nt, Human
cuuugagguggaagagggcugc

SEQ ID NO: 3040328 - RNA, 12 nt, Human
cuucaucugacu

SEQ ID NO: 3040329 - RNA, 18 nt, Human
cuucaucugacuaugaca

SEQ ID NO: 3040330 - RNA, 12 nt, Human
aacacugccagc

SEQ ID NO: 3040331 - RNA, 22 nt, Human
aacacugccagcauuucccuuc

SEQ ID NO: 3040332 - RNA, 21 nt, Human
aacaagccuccuuuuaaagua

SEQ ID NO: 3040333 - RNA, 23 nt, Human
aaauuuuuaaucuuuaauuuuac

SEQ ID NO: 3040334 - RNA, 18 nt, Human
aacaaugaagauaaaaag

SEQ ID NO: 3040335 - RNA, 14 nt, Human
aacaaugaagauaa

SEQ ID NO: 3040336 - RNA, 20 nt, Human
aacauuuguucuauagcuuu

SEQ ID NO: 3040337 - RNA, 19 nt, Human
aacucgugucuggcacagc

SEQ ID NO: 3040338 - RNA, 14 nt, Human
gucuggcugcagag

SEQ ID NO: 3040339 - RNA, 13 nt, Human
gucuggcugcaga

SEQ ID NO: 3040340 - RNA, 12 nt, Human
gucuggcugcag

SEQ ID NO: 3040341 - RNA, 12 nt, Human
gucucccuccuc

SEQ ID NO: 3040342 - RNA, 16 nt, Human
gucucccuccucugcc

SEQ ID NO: 3040343 - RNA, 19 nt, Human
aaccaaagcgaauuuuaaa

SEQ ID NO: 3040344 - RNA, 17 nt, Human
aaccucaaaaugucuaa

SEQ ID NO: 3040345 - RNA, 15 nt, Human
guauguggaagugug

SEQ ID NO: 3040346 - RNA, 17 nt, Human
guauguggaaguguggg

SEQ ID NO: 3040347 - RNA, 16 nt, Human
guauguggaagugugg

SEQ ID NO: 3040348 - RNA, 20 nt, Human
guaugugggggucugugugu

SEQ ID NO: 3040349 - RNA, 19 nt, Human
guaugugggggucugugug

SEQ ID NO: 3040350 - RNA, 21 nt, Human
guauguggaagugugggucug

SEQ ID NO: 3040351 - RNA, 18 nt, Human
guauguggaagugugggu

SEQ ID NO: 3040352 - RNA, 17 nt, Human
guauaaaagccuguuua

SEQ ID NO: 3040353 - RNA, 22 nt, Human
guauauugauccagaaagaaaa

SEQ ID NO: 3040354 - RNA, 18 nt, Human
guauaaaagccuguuuaa

SEQ ID NO: 3040355 - RNA, 21 nt, Human
guauaaaagccuguuuaagag

SEQ ID NO: 3040356 - RNA, 16 nt, Human
guauuuaauucauguu

SEQ ID NO: 3040357 - RNA, 22 nt, Human
aaauuauuuuguucauacauau

SEQ ID NO: 3040358 - RNA, 21 nt, Human
aaauuauuuuguucauacaua

SEQ ID NO: 3040359 - RNA, 20 nt, Human
aaauuauuuuguucauacau

SEQ ID NO: 3040360 - RNA, 18 nt, Human
aaauuauauaaguauucu

SEQ ID NO: 3040361 - RNA, 16 nt, Human
aaauuauauaaguauu

SEQ ID NO: 3040362 - RNA, 22 nt, Human
aaauuauauaaguauucuaaau

SEQ ID NO: 3040363 - RNA, 19 nt, Human
aaauuauuuuguucauaca

SEQ ID NO: 3040364 - RNA, 17 nt, Human
aaauuauuuuguucaua

SEQ ID NO: 3040365 - RNA, 20 nt, Human
guauuuuugacagaauaugu

SEQ ID NO: 3040366 - RNA, 18 nt, Human
aaauuucagcagcugcag

SEQ ID NO: 3040367 - RNA, 17 nt, Human
aaauuucagcagcugca

SEQ ID NO: 3040368 - RNA, 14 nt, Human
aaaugaaaaaauau

SEQ ID NO: 3040369 - RNA, 16 nt, Human
aaaucuaugauuccag

SEQ ID NO: 3040370 - RNA, 14 nt, Human
aaaucuaugauucc

SEQ ID NO: 3040371 - RNA, 16 nt, Human
guaggaacugcugggc

SEQ ID NO: 3040372 - RNA, 13 nt, Human
guaggauuacuag

SEQ ID NO: 3040373 - RNA, 9 nt, Human
aaaugaggg

SEQ ID NO: 3040374 - RNA, 16 nt, Human
aaaugagaaaucuaaa

SEQ ID NO: 3040375 - RNA, 13 nt, Human
aaaugagaaaucu

SEQ ID NO: 3040376 - RNA, 14 nt, Human
aaaugagaaaucua

SEQ ID NO: 3040377 - RNA, 11 nt, Human
aaaugagaaau

SEQ ID NO: 3040378 - RNA, 14 nt, Human
aaaugcauuucuaa

SEQ ID NO: 3040379 - RNA, 13 nt, Human
aaaugcauguugc

SEQ ID NO: 3040380 - RNA, 14 nt, Human
guggcacuggggca

SEQ ID NO: 3040381 - RNA, 20 nt, Human
aagaauugucuuucugucuc

SEQ ID NO: 3040382 - RNA, 19 nt, Human
guggaauuauuuuaaaaga

SEQ ID NO: 3040383 - RNA, 15 nt, Human
guggaauuauuuuaa

SEQ ID NO: 3040384 - RNA, 18 nt, Human
guggaauuauuuuaaaag

SEQ ID NO: 3040385 - RNA, 16 nt, Human
guggaauuauuuuaaa

SEQ ID NO: 3040386 - RNA, 22 nt, Human
guggaagugugggucugugugu

SEQ ID NO: 3040387 - RNA, 21 nt, Human
guggaagugugggucugugug

SEQ ID NO: 3040388 - RNA, 20 nt, Human
guggaagugugggucugugu

SEQ ID NO: 3040389 - RNA, 19 nt, Human
guggaagugugggucugug

SEQ ID NO: 3040390 - RNA, 15 nt, Human
guggaaguguggguc

SEQ ID NO: 3040391 - RNA, 14 nt, Human
guggaagugugggu

SEQ ID NO: 3040392 - RNA, 23 nt, Human
gugcuauuguagagccagagguc

SEQ ID NO: 3040393 - RNA, 15 nt, Human
gugcucaggagcccu

SEQ ID NO: 3040394 - RNA, 13 nt, Human
aagaaauauaccu

SEQ ID NO: 3040395 - RNA, 15 nt, Human
aacuuguauuaugug

SEQ ID NO: 3040396 - RNA, 16 nt, Human
aacuuguauuaugugu

SEQ ID NO: 3040397 - RNA, 23 nt, Human
guggggggggggcgcggcuggga

SEQ ID NO: 3040398 - RNA, 16 nt, Human
guggggggcuucauac

SEQ ID NO: 3040399 - RNA, 15 nt, Human
guggggggcuucaua

SEQ ID NO: 3040400 - RNA, 14 nt, Human
gugguggcucggga

SEQ ID NO: 3040401 - RNA, 16 nt, Human
gugggucugugugugu

SEQ ID NO: 3040402 - RNA, 13 nt, Human
gugggucugugug

SEQ ID NO: 3040403 - RNA, 14 nt, Human
gugggaguguguaa

SEQ ID NO: 3040404 - RNA, 13 nt, Human
gugggagugugua

SEQ ID NO: 3040405 - RNA, 14 nt, Human
guguguaauuuaaa

SEQ ID NO: 3040406 - RNA, 17 nt, Human
gugucuuuccacuccuc

SEQ ID NO: 3040407 - RNA, 18 nt, Human
guguuuccauauuuuaua

SEQ ID NO: 3040408 - RNA, 15 nt, Human
guguuguguguggga

SEQ ID NO: 3040409 - RNA, 12 nt, Human
guguguaugugg

SEQ ID NO: 3040410 - RNA, 14 nt, Human
guuaaguaugugua

SEQ ID NO: 3040411 - RNA, 18 nt, Human
guguuuuaaaaugagaaa

SEQ ID NO: 3040412 - RNA, 15 nt, Human
aagccuggucagccc

SEQ ID NO: 3040413 - RNA, 14 nt, Human
guucauacauugua

SEQ ID NO: 3040414 - RNA, 11 nt, Human
guucauacauu

SEQ ID NO: 3040415 - RNA, 15 nt, Human
aagccucgacacaga

SEQ ID NO: 3040416 - RNA, 9 nt, Human
guucauaca

SEQ ID NO: 3040417 - RNA, 23 nt, Human
guucauacauauuuuuguagcac

SEQ ID NO: 3040418 - RNA, 14 nt, Human
guucauacauauuu

SEQ ID NO: 3040419 - RNA, 13 nt, Human
guucauacauauu

SEQ ID NO: 3040420 - RNA, 10 nt, Human
guucauacau

SEQ ID NO: 3040421 - RNA, 18 nt, Human
guucuagcauggcauauu

SEQ ID NO: 3040422 - RNA, 17 nt, Human
aagcuaucguaaaauua

SEQ ID NO: 3040423 - RNA, 21 nt, Human
aagggguaggauuacuaggug

SEQ ID NO: 3040424 - RNA, 13 nt, Human
aaguaaaaacaaa

SEQ ID NO: 3040425 - RNA, 20 nt, Human
aaguaaaaacaaagaaauua

SEQ ID NO: 3040426 - RNA, 16 nt, Human
guuugggaccccuggu

SEQ ID NO: 3040427 - RNA, 22 nt, Human
guuugggaccccuggugguuca

SEQ ID NO: 3040428 - RNA, 19 nt, Human
guuugcaucugaaaauuga

SEQ ID NO: 3040429 - RNA, 16 nt, Human
guuuucuuaacuuaaa

SEQ ID NO: 3040430 - RNA, 20 nt, Human
guuuucuuaaccagaucauu

SEQ ID NO: 3040431 - RNA, 23 nt, Human
aaggcuauggggauagaugugug

SEQ ID NO: 3040432 - RNA, 18 nt, Human
guuguaucagcacgugug

SEQ ID NO: 3040433 - RNA, 16 nt, Human
guuuaugugugugugu

SEQ ID NO: 3040434 - RNA, 13 nt, Human
guuuaugugugug

SEQ ID NO: 3040435 - RNA, 17 nt, Human
acaccccgacuuuuguu

SEQ ID NO: 3040436 - RNA, 20 nt, Human
uauaaaaauaaaaaacacug

SEQ ID NO: 3040437 - RNA, 21 nt, Human
uauaaaaauaaaaaacacugg

SEQ ID NO: 3040438 - RNA, 18 nt, Human
acacaacuauuuuuccaa

SEQ ID NO: 3040439 - RNA, 14 nt, Human
uaguaauagagcaa

SEQ ID NO: 3040440 - RNA, 20 nt, Human
uaguaauagagcaaaauuga

SEQ ID NO: 3040441 - RNA, 13 nt, Human
uaguguucauaaa

SEQ ID NO: 3040442 - RNA, 14 nt, Human
acagauaaucagug

SEQ ID NO: 3040443 - RNA, 16 nt, Human
uaucuuguagcuuuau

SEQ ID NO: 3040444 - RNA, 12 nt, Human
uauauuuacaaa

SEQ ID NO: 3040445 - RNA, 15 nt, Human
uauauuuaaugauaa

SEQ ID NO: 3040446 - RNA, 16 nt, Human
acacucacccaacaau

SEQ ID NO: 3040447 - RNA, 16 nt, Human
uauaaguauucuaaau

SEQ ID NO: 3040448 - RNA, 17 nt, Human
acaagaugguucuagca

SEQ ID NO: 3040449 - RNA, 18 nt, Human
acaaauucugucucugga

SEQ ID NO: 3040450 - RNA, 21 nt, Human
acaaauucugucucuggauua

SEQ ID NO: 3040451 - RNA, 16 nt, Human
uagcuacuaauuuuaa

SEQ ID NO: 3040452 - RNA, 18 nt, Human
acaaugaagauaaaaaga

SEQ ID NO: 3040453 - RNA, 22 nt, Human
uagauaggucagugcaaauacu

SEQ ID NO: 3040454 - RNA, 22 nt, Human
aauuuuuaaucuuuaauuuuac

SEQ ID NO: 3040455 - RNA, 15 nt, Human
uacuugaaaauuaac

SEQ ID NO: 3040456 - RNA, 17 nt, Human
aauuuauacaggucaua

SEQ ID NO: 3040457 - RNA, 16 nt, Human
aauuuauacaggucau

SEQ ID NO: 3040458 - RNA, 22 nt, Human
aauuuauaaacuuuuuucuuac

SEQ ID NO: 3040459 - RNA, 18 nt, Human
uacuagggaaaugccuuu

SEQ ID NO: 3040460 - RNA, 16 nt, Human
uacugggagccuaccc

SEQ ID NO: 3040461 - RNA, 19 nt, Human
uacuguacagacagaaaaa

SEQ ID NO: 3040462 - RNA, 23 nt, Human
uacuguacagacagaaaaaacug

SEQ ID NO: 3040463 - RNA, 22 nt, Human
uaaagguucaugcaaacuuuau

SEQ ID NO: 3040464 - RNA, 19 nt, Human
uaaaguaaaaacaaagaaa

SEQ ID NO: 3040465 - RNA, 21 nt, Human
uaaaguaaaaacaaagaaauu

SEQ ID NO: 3040466 - RNA, 22 nt, Human
uaaaguaaaaacaaagaaauua

SEQ ID NO: 3040467 - RNA, 13 nt, Human
aauaacugugaag

SEQ ID NO: 3040468 - RNA, 21 nt, Human
aauaacaaugaaaguugauaa

SEQ ID NO: 3040469 - RNA, 12 nt, Human
uaaauaaaguuu

SEQ ID NO: 3040470 - RNA, 21 nt, Human
uaaauaaaguuuguugaaaca

SEQ ID NO: 3040471 - RNA, 21 nt, Human
aauaauuuuaagaaaucaaag

SEQ ID NO: 3040472 - RNA, 20 nt, Human
aauaacugugaaguuuacau

SEQ ID NO: 3040473 - RNA, 14 nt, Human
aauaacugugaagu

SEQ ID NO: 3040474 - RNA, 16 nt, Human
aauaacugugaaguuu

SEQ ID NO: 3040475 - RNA, 23 nt, Human
uaaauguuuuuuuuuaaagacuu

SEQ ID NO: 3040476 - RNA, 17 nt, Human
uaaauuuugaguucuac

SEQ ID NO: 3040477 - RNA, 24 nt, Human
uaaauguuuuuuuuuaaagacuuu

SEQ ID NO: 3040478 - RNA, 20 nt, Human
aauauugcuuuggucauaug

SEQ ID NO: 3040479 - RNA, 18 nt, Human
aauauuguguugugaaug

SEQ ID NO: 3040480 - RNA, 18 nt, Human
uaagaauauuugaaugua

SEQ ID NO: 3040481 - RNA, 15 nt, Human
uaagaauauuugaau

SEQ ID NO: 3040482 - RNA, 18 nt, Human
aauaggcguaacuaauuu

SEQ ID NO: 3040483 - RNA, 20 nt, Human
uaaauuuugucuuuaacuca

SEQ ID NO: 3040484 - RNA, 18 nt, Human
uaaauuuugaguucuaca

SEQ ID NO: 3040485 - RNA, 19 nt, Human
uaaauuuugaguucuacau

SEQ ID NO: 3040486 - RNA, 14 nt, Human
uaacaugauuuggg

SEQ ID NO: 3040487 - RNA, 15 nt, Human
aauaguauuugagag

SEQ ID NO: 3040488 - RNA, 14 nt, Human
aaucuuauaauuua

SEQ ID NO: 3040489 - RNA, 13 nt, Human
uaaguucauacau

SEQ ID NO: 3040490 - RNA, 14 nt, Human
uaaguucauacauu

SEQ ID NO: 3040491 - RNA, 12 nt, Human
uaaguucauaca

SEQ ID NO: 3040492 - RNA, 20 nt, Human
uaaguauguguaaaauguga

SEQ ID NO: 3040493 - RNA, 14 nt, Human
aaucagacuaugaa

SEQ ID NO: 3040494 - RNA, 17 nt, Human
aaucagacuaugaaguu

SEQ ID NO: 3040495 - RNA, 17 nt, Human
aaucauggugcucagag

SEQ ID NO: 3040496 - RNA, 15 nt, Human
aaucaucaagucuuu

SEQ ID NO: 3040497 - RNA, 23 nt, Human
uaaucagugugucuaaauuugaa

SEQ ID NO: 3040498 - RNA, 14 nt, Human
uaaugaaacuugga

SEQ ID NO: 3040499 - RNA, 15 nt, Human
uaaugaaacuuggau

SEQ ID NO: 3040500 - RNA, 14 nt, Human
uaaugguguuuuaa

SEQ ID NO: 3040501 - RNA, 22 nt, Human
aaugacagguuugggaccccug

SEQ ID NO: 3040502 - RNA, 15 nt, Human
aaugaaaaccacauu

SEQ ID NO: 3040503 - RNA, 17 nt, Human
aauguaugcuucauaca

SEQ ID NO: 3040504 - RNA, 18 nt, Human
aauguaugcuucauacag

SEQ ID NO: 3040505 - RNA, 21 nt, Human
aauguaugcuucauacaggga

SEQ ID NO: 3040506 - RNA, 18 nt, Human
uacauauuuuuguagcac

SEQ ID NO: 3040507 - RNA, 17 nt, Human
uacauauuuuuguagca

SEQ ID NO: 3040508 - RNA, 19 nt, Human
uacauauaagugauugcug

SEQ ID NO: 3040509 - RNA, 14 nt, Human
uacagaggacagua

SEQ ID NO: 3040510 - RNA, 18 nt, Human
uacagaggacaguauuug

SEQ ID NO: 3040511 - RNA, 19 nt, Human
aauggacuuuuguacauag

SEQ ID NO: 3040512 - RNA, 13 nt, Human
uaauucaagaaaa

SEQ ID NO: 3040513 - RNA, 16 nt, Human
uaauuuaaaauuguga

SEQ ID NO: 3040514 - RNA, 15 nt, Human
uaauuuaaaauugug

SEQ ID NO: 3040515 - RNA, 17 nt, Human
uaauuuauacaggucau

SEQ ID NO: 3040516 - RNA, 18 nt, Human
acucaugugacucuuucc

SEQ ID NO: 3040517 - RNA, 19 nt, Human
acucaugugacucuuucca

SEQ ID NO: 3040518 - RNA, 13 nt, Human
acuccuccuagcc

SEQ ID NO: 3040519 - RNA, 14 nt, Human
acuccuccuagcca

SEQ ID NO: 3040520 - RNA, 18 nt, Human
acuccuccuagccaccca

SEQ ID NO: 3040521 - RNA, 16 nt, Human
acuccuccuagccacc

SEQ ID NO: 3040522 - RNA, 15 nt, Human
acuccuccuagccac

SEQ ID NO: 3040523 - RNA, 19 nt, Human
ucccuuucugcuuguguua

SEQ ID NO: 3040524 - RNA, 19 nt, Human
uccuaaauauauuuuaaga

SEQ ID NO: 3040525 - RNA, 21 nt, Human
ucccgggacaccuaggcuagg

SEQ ID NO: 3040526 - RNA, 20 nt, Human
ucccugaaggaaccaaagcg

SEQ ID NO: 3040527 - RNA, 11 nt, Human
ucccugaggca

SEQ ID NO: 3040528 - RNA, 22 nt, Human
ucccugaggcagguccccagac

SEQ ID NO: 3040529 - RNA, 21 nt, Human
ucccugaggcagguccccaga

SEQ ID NO: 3040530 - RNA, 20 nt, Human
ucccugaggcagguccccag

SEQ ID NO: 3040531 - RNA, 14 nt, Human
acuacuagggaaau

SEQ ID NO: 3040532 - RNA, 21 nt, Human
acuacuagggaaaugccuuug

SEQ ID NO: 3040533 - RNA, 22 nt, Human
acguauaaaagccuguuuaaga

SEQ ID NO: 3040534 - RNA, 21 nt, Human
uccaaccggcuuuguggcacu

SEQ ID NO: 3040535 - RNA, 14 nt, Human
uccacucaugugac

SEQ ID NO: 3040536 - RNA, 21 nt, Human
uccacucaugugacucuuucc

SEQ ID NO: 3040537 - RNA, 18 nt, Human
uccacuccuccuagccac

SEQ ID NO: 3040538 - RNA, 15 nt, Human
uccacuccuccuagc

SEQ ID NO: 3040539 - RNA, 18 nt, Human
uccacuggggauugggcc

SEQ ID NO: 3040540 - RNA, 14 nt, Human
acgagaaaacaaua

SEQ ID NO: 3040541 - RNA, 18 nt, Human
uccaggccagggggccag

SEQ ID NO: 3040542 - RNA, 16 nt, Human
uccaggccagggggcc

SEQ ID NO: 3040543 - RNA, 16 nt, Human
accucaaaaugucuaa

SEQ ID NO: 3040544 - RNA, 19 nt, Human
accucaaaaugucuaagau

SEQ ID NO: 3040545 - RNA, 14 nt, Human
ucaucuaggauuuu

SEQ ID NO: 3040546 - RNA, 18 nt, Human
ucaucuagguaaauuaca

SEQ ID NO: 3040547 - RNA, 23 nt, Human
accccagcuggggccaggcuggg

SEQ ID NO: 3040548 - RNA, 22 nt, Human
ucagcccaaaccaccagaagcc

SEQ ID NO: 3040549 - RNA, 21 nt, Human
ucagcccaaaccaccagaagc

SEQ ID NO: 3040550 - RNA, 23 nt, Human
accauuucuugagguaaaagcau

SEQ ID NO: 3040551 - RNA, 13 nt, Human
ucacucuuggagc

SEQ ID NO: 3040552 - RNA, 17 nt, Human
ucacuaccuucaugcau

SEQ ID NO: 3040553 - RNA, 13 nt, Human
accagaagcccag

SEQ ID NO: 3040554 - RNA, 16 nt, Human
accagaagcccagaau

SEQ ID NO: 3040555 - RNA, 14 nt, Human
accagaagcccaga

SEQ ID NO: 3040556 - RNA, 22 nt, Human
ucacauaucuaguaugaaauua

SEQ ID NO: 3040557 - RNA, 21 nt, Human
ucacauaucuaguaugaaauu

SEQ ID NO: 3040558 - RNA, 17 nt, Human
ucacauaucuaguauga

SEQ ID NO: 3040559 - RNA, 22 nt, Human
accacacguaaugaaacuugga

SEQ ID NO: 3040560 - RNA, 15 nt, Human
ucaauucuugccaaa

SEQ ID NO: 3040561 - RNA, 14 nt, Human
ucaaagcugaaaug

SEQ ID NO: 3040562 - RNA, 17 nt, Human
ucaaagggugaaaauua

SEQ ID NO: 3040563 - RNA, 16 nt, Human
uauuuguaaauuuaug

SEQ ID NO: 3040564 - RNA, 22 nt, Human
uauuuguaaauuuaugugaugg

SEQ ID NO: 3040565 - RNA, 17 nt, Human
uauuuguaaauuuaugu

SEQ ID NO: 3040566 - RNA, 23 nt, Human
uauuuuugacagaauauguuuca

SEQ ID NO: 3040567 - RNA, 19 nt, Human
uauuuuugacagaauaugu

SEQ ID NO: 3040568 - RNA, 13 nt, Human
uauuuuugacaga

SEQ ID NO: 3040569 - RNA, 15 nt, Human
uauuuuugacagaau

SEQ ID NO: 3040570 - RNA, 14 nt, Human
uauuuuugacagaa

SEQ ID NO: 3040571 - RNA, 14 nt, Human
ucaaaaugucuaag

SEQ ID NO: 3040572 - RNA, 16 nt, Human
ucaaaauuguuacaaa

SEQ ID NO: 3040573 - RNA, 19 nt, Human
ucaaaauuguuacaaauug

SEQ ID NO: 3040574 - RNA, 21 nt, Human
acauaaaaacaacuuuauacc

SEQ ID NO: 3040575 - RNA, 19 nt, Human
acauaaaaacaacuuuaua

SEQ ID NO: 3040576 - RNA, 16 nt, Human
acauaaaaacaacuuu

SEQ ID NO: 3040577 - RNA, 22 nt, Human
uauuucccugaaggaaccaaag

SEQ ID NO: 3040578 - RNA, 21 nt, Human
uauuuccauuaaaaaaucagu

SEQ ID NO: 3040579 - RNA, 17 nt, Human
acauaucuaguaugaaa

SEQ ID NO: 3040580 - RNA, 23 nt, Human
acauaucuaguaugaaauuauau

SEQ ID NO: 3040581 - RNA, 22 nt, Human
acauaucuaguaugaaauuaua

SEQ ID NO: 3040582 - RNA, 20 nt, Human
acauaucuaguaugaaauua

SEQ ID NO: 3040583 - RNA, 23 nt, Human
acuugucccgggacaccuaggcu

SEQ ID NO: 3040584 - RNA, 16 nt, Human
ucucauuccagaggaa

SEQ ID NO: 3040585 - RNA, 14 nt, Human
ucugagagaggcca

SEQ ID NO: 3040586 - RNA, 20 nt, Human
ucugagagaggccauucuuu

SEQ ID NO: 3040587 - RNA, 16 nt, Human
ucugacuaugacauaa

SEQ ID NO: 3040588 - RNA, 14 nt, Human
ucugacuaugacau

SEQ ID NO: 3040589 - RNA, 15 nt, Human
ucugcaggucccuaa

SEQ ID NO: 3040590 - RNA, 16 nt, Human
ucugcaggucccuaau

SEQ ID NO: 3040591 - RNA, 17 nt, Human
ucugcaggucccuaaua

SEQ ID NO: 3040592 - RNA, 22 nt, Human
agaaauuaugugccagauuuau

SEQ ID NO: 3040593 - RNA, 16 nt, Human
agaaauuuauaaacuu

SEQ ID NO: 3040594 - RNA, 17 nt, Human
agaaauuuauaaacuuu

SEQ ID NO: 3040595 - RNA, 14 nt, Human
ucugcaggucccua

SEQ ID NO: 3040596 - RNA, 18 nt, Human
ucugcaggucccuaauaa

SEQ ID NO: 3040597 - RNA, 13 nt, Human
agaaauuaugugc

SEQ ID NO: 3040598 - RNA, 21 nt, Human
agaaauuaugugccagauuua

SEQ ID NO: 3040599 - RNA, 17 nt, Human
agaaaucaaagagagaa

SEQ ID NO: 3040600 - RNA, 17 nt, Human
agaaaugaaaaaauaua

SEQ ID NO: 3040601 - RNA, 12 nt, Human
agaaaucuaaaa

SEQ ID NO: 3040602 - RNA, 16 nt, Human
agaaaugaaaaaauau

SEQ ID NO: 3040603 - RNA, 18 nt, Human
agaaaugaaaaaauauau

SEQ ID NO: 3040604 - RNA, 23 nt, Human
agaaaugaaaaaauauauaucaa

SEQ ID NO: 3040605 - RNA, 21 nt, Human
agaaaacuuguauuaugugug

SEQ ID NO: 3040606 - RNA, 19 nt, Human
agaaaacuuguauuaugug

SEQ ID NO: 3040607 - RNA, 19 nt, Human
ucucuggaauuugaaacac

SEQ ID NO: 3040608 - RNA, 15 nt, Human
ucucuggaauuugaa

SEQ ID NO: 3040609 - RNA, 18 nt, Human
ucgagaucccaacacugc

SEQ ID NO: 3040610 - RNA, 21 nt, Human
ucgagaucccaacacugccag

SEQ ID NO: 3040611 - RNA, 17 nt, Human
ucgagaucccaacacug

SEQ ID NO: 3040612 - RNA, 22 nt, Human
uccuuucuaacaaaaaaauaua

SEQ ID NO: 3040613 - RNA, 23 nt, Human
acuggccaguggcuggaucugug

SEQ ID NO: 3040614 - RNA, 16 nt, Human
acugccuauuuuaaua

SEQ ID NO: 3040615 - RNA, 21 nt, Human
acugccuauuuuaauaaacac

SEQ ID NO: 3040616 - RNA, 18 nt, Human
acugcuaagaauauuuga

SEQ ID NO: 3040617 - RNA, 16 nt, Human
acugcuaagaauauuu

SEQ ID NO: 3040618 - RNA, 20 nt, Human
ucuaaagccauuguaguccu

SEQ ID NO: 3040619 - RNA, 17 nt, Human
ucuacauaaguaauuca

SEQ ID NO: 3040620 - RNA, 20 nt, Human
ucuacauaaguaauucaaga

SEQ ID NO: 3040621 - RNA, 19 nt, Human
acuguucccugagguggga

SEQ ID NO: 3040622 - RNA, 16 nt, Human
acuguucccugaggug

SEQ ID NO: 3040623 - RNA, 22 nt, Human
ucuacauaaguaauucaagaaa

SEQ ID NO: 3040624 - RNA, 22 nt, Human
ucguuuucaaaauuguuacaaa

SEQ ID NO: 3040625 - RNA, 16 nt, Human
ucguaaaauuaagaaa

SEQ ID NO: 3040626 - RNA, 13 nt, Human
ucguaaaauuaag

SEQ ID NO: 3040627 - RNA, 16 nt, Human
acugggagaaaugaaa

SEQ ID NO: 3040628 - RNA, 12 nt, Human
acugugugcuca

SEQ ID NO: 3040629 - RNA, 15 nt, Human
acugugugcucagga

SEQ ID NO: 3040630 - RNA, 19 nt, Human
acugugugcucaggagccc

SEQ ID NO: 3040631 - RNA, 20 nt, Human
acugugugcucaggagcccu

SEQ ID NO: 3040632 - RNA, 21 nt, Human
acugugugcucaggagcccug

SEQ ID NO: 3040633 - RNA, 21 nt, Human
agaggccauucuuucccaaca

SEQ ID NO: 3040634 - RNA, 22 nt, Human
agaguaauccaagcaaauguga

SEQ ID NO: 3040635 - RNA, 14 nt, Human
agagcugcgggcug

SEQ ID NO: 3040636 - RNA, 21 nt, Human
ugaacuaggauuguaguccca

SEQ ID NO: 3040637 - RNA, 14 nt, Human
agagcaaaauugau

SEQ ID NO: 3040638 - RNA, 16 nt, Human
agagcagugggccugg

SEQ ID NO: 3040639 - RNA, 15 nt, Human
ugaaauuguauuaca

SEQ ID NO: 3040640 - RNA, 14 nt, Human
agagucccugccug

SEQ ID NO: 3040641 - RNA, 17 nt, Human
agagucccugccuggac

SEQ ID NO: 3040642 - RNA, 23 nt, Human
agaguccaucagccuccauccua

SEQ ID NO: 3040643 - RNA, 20 nt, Human
agaguugaugguuguacaua

SEQ ID NO: 3040644 - RNA, 14 nt, Human
agauaaauauuaua

SEQ ID NO: 3040645 - RNA, 12 nt, Human
agauaaauauua

SEQ ID NO: 3040646 - RNA, 17 nt, Human
agauaaagguucaugca

SEQ ID NO: 3040647 - RNA, 19 nt, Human
agaucccaacacugccagc

SEQ ID NO: 3040648 - RNA, 20 nt, Human
agaucccaacacugccagca

SEQ ID NO: 3040649 - RNA, 18 nt, Human
agaucccaacacugccag

SEQ ID NO: 3040650 - RNA, 17 nt, Human
agauguggaaaagccaa

SEQ ID NO: 3040651 - RNA, 22 nt, Human
agauguggaaaagccaagaggc

SEQ ID NO: 3040652 - RNA, 20 nt, Human
ugacauaaaaacaacuuuau

SEQ ID NO: 3040653 - RNA, 18 nt, Human
ugacauaaaaacaacuuu

SEQ ID NO: 3040654 - RNA, 17 nt, Human
ugacauaaaaacaacuu

SEQ ID NO: 3040655 - RNA, 13 nt, Human
ucuuucuuccaaa

SEQ ID NO: 3040656 - RNA, 14 nt, Human
ucuuuaauuuuaca

SEQ ID NO: 3040657 - RNA, 19 nt, Human
ucuugguuccagccugcca

SEQ ID NO: 3040658 - RNA, 18 nt, Human
ucuugguuccagccugcc

SEQ ID NO: 3040659 - RNA, 17 nt, Human
ucuugguuccagccugc

SEQ ID NO: 3040660 - RNA, 13 nt, Human
ucuugguuccagc

SEQ ID NO: 3040661 - RNA, 19 nt, Human
agacuucccacggcuccuc

SEQ ID NO: 3040662 - RNA, 21 nt, Human
agacauuugcuaugagcuggg

SEQ ID NO: 3040663 - RNA, 19 nt, Human
ucuuacugucuuuuuucua

SEQ ID NO: 3040664 - RNA, 19 nt, Human
agacacaacuauuuuucca

SEQ ID NO: 3040665 - RNA, 20 nt, Human
agacacaacuauuuuuccaa

SEQ ID NO: 3040666 - RNA, 12 nt, Human
agacagaaaaaa

SEQ ID NO: 3040667 - RNA, 22 nt, Human
agaaccccuggcuccaggccag

SEQ ID NO: 3040668 - RNA, 13 nt, Human
agaaugucaguau

SEQ ID NO: 3040669 - RNA, 16 nt, Human
agaaugucaguaugug

SEQ ID NO: 3040670 - RNA, 15 nt, Human
agaaugucaguaugu

SEQ ID NO: 3040671 - RNA, 19 nt, Human
agaaugucaguauguggaa

SEQ ID NO: 3040672 - RNA, 17 nt, Human
agaaugucaguaugugg

SEQ ID NO: 3040673 - RNA, 23 nt, Human
agccccgcguggaacucgugucu

SEQ ID NO: 3040674 - RNA, 18 nt, Human
agcccugaguuccuagcc

SEQ ID NO: 3040675 - RNA, 14 nt, Human
agcccugaguuccu

SEQ ID NO: 3040676 - RNA, 23 nt, Human
agcccugaguuccuagccaccgc

SEQ ID NO: 3040677 - RNA, 20 nt, Human
agcccugaguuccuagccac

SEQ ID NO: 3040678 - RNA, 17 nt, Human
agcccugggaggcucug

SEQ ID NO: 3040679 - RNA, 18 nt, Human
agcccugggaggcucugg

SEQ ID NO: 3040680 - RNA, 20 nt, Human
agcccugggaggcucuggag

SEQ ID NO: 3040681 - RNA, 16 nt, Human
agccucuccacucaug

SEQ ID NO: 3040682 - RNA, 18 nt, Human
agccucgacacagagugg

SEQ ID NO: 3040683 - RNA, 17 nt, Human
agccucgacacagagug

SEQ ID NO: 3040684 - RNA, 21 nt, Human
ugcaggucccuaauaaagcug

SEQ ID NO: 3040685 - RNA, 22 nt, Human
ugcaggucccuaauaaagcugu

SEQ ID NO: 3040686 - RNA, 17 nt, Human
ugcauagaauaaaauuu

SEQ ID NO: 3040687 - RNA, 15 nt, Human
agccuguuuaagaga

SEQ ID NO: 3040688 - RNA, 13 nt, Human
ugauccagaaaga

SEQ ID NO: 3040689 - RNA, 23 nt, Human
ugauccagaaagaaaacuuguau

SEQ ID NO: 3040690 - RNA, 15 nt, Human
ugaugggucaguugu

SEQ ID NO: 3040691 - RNA, 15 nt, Human
ugaugaaaauauuua

SEQ ID NO: 3040692 - RNA, 18 nt, Human
ugaugaaaauauuuaaag

SEQ ID NO: 3040693 - RNA, 20 nt, Human
agcaucacaugaacuuguaa

SEQ ID NO: 3040694 - RNA, 20 nt, Human
agcagguccccagcuuuggc

SEQ ID NO: 3040695 - RNA, 21 nt, Human
agcagguccccagcuuuggcu

SEQ ID NO: 3040696 - RNA, 18 nt, Human
ugaguuccuagccaccgc

SEQ ID NO: 3040697 - RNA, 24 nt, Human
ugaguuacuugcugcccugugcuc

SEQ ID NO: 3040698 - RNA, 14 nt, Human
ugaguuccuagcca

SEQ ID NO: 3040699 - RNA, 15 nt, Human
ugaguucuacauaag

SEQ ID NO: 3040700 - RNA, 20 nt, Human
ugaguucuacauaaguaauu

SEQ ID NO: 3040701 - RNA, 16 nt, Human
ugauaaguaaaugcua

SEQ ID NO: 3040702 - RNA, 19 nt, Human
ugauaaguucauacauugu

SEQ ID NO: 3040703 - RNA, 17 nt, Human
ugauaaguucauacauu

SEQ ID NO: 3040704 - RNA, 15 nt, Human
ugauaaguucauaca

SEQ ID NO: 3040705 - RNA, 13 nt, Human
ugauaaguucaua

SEQ ID NO: 3040706 - RNA, 15 nt, Human
ugccuugucacgcca

SEQ ID NO: 3040707 - RNA, 16 nt, Human
ugccuuggugugcugu

SEQ ID NO: 3040708 - RNA, 16 nt, Human
ugcuaauuuugaaaaa

SEQ ID NO: 3040709 - RNA, 18 nt, Human
ugcuaauuuugaaaaacu

SEQ ID NO: 3040710 - RNA, 19 nt, Human
ugcuaauuuugaaaaacug

SEQ ID NO: 3040711 - RNA, 20 nt, Human
ugcuaauuuugaaaaacugc

SEQ ID NO: 3040712 - RNA, 21 nt, Human
agcuuuggcuaugagggccuu

SEQ ID NO: 3040713 - RNA, 20 nt, Human
agcuuuggcuaugagggccu

SEQ ID NO: 3040714 - RNA, 22 nt, Human
agcuuugagguggaagagggcu

SEQ ID NO: 3040715 - RNA, 22 nt, Human
ugcuaugagcuggggaugucuc

SEQ ID NO: 3040716 - RNA, 16 nt, Human
ugcuaugagcugggga

SEQ ID NO: 3040717 - RNA, 20 nt, Human
ugcuaugagcuggggauguc

SEQ ID NO: 3040718 - RNA, 19 nt, Human
ugcuaugagcuggggaugu

SEQ ID NO: 3040719 - RNA, 22 nt, Human
ugccgagaguccaucagccucc

SEQ ID NO: 3040720 - RNA, 16 nt, Human
ugccaucauguuuaca

SEQ ID NO: 3040721 - RNA, 22 nt, Human
ugccugcuuuuuauggccugug

SEQ ID NO: 3040722 - RNA, 20 nt, Human
ugccugcuuuuuauggccug

SEQ ID NO: 3040723 - RNA, 21 nt, Human
ugccugcuuuuuauggccugu

SEQ ID NO: 3040724 - RNA, 17 nt, Human
uggacuguucccugagg

SEQ ID NO: 3040725 - RNA, 16 nt, Human
uggacuguucccugag

SEQ ID NO: 3040726 - RNA, 15 nt, Human
uggagcaaagcugau

SEQ ID NO: 3040727 - RNA, 17 nt, Human
uggauucugagagcugu

SEQ ID NO: 3040728 - RNA, 16 nt, Human
uggauucugagagcug

SEQ ID NO: 3040729 - RNA, 14 nt, Human
uggaguugaaaauc

SEQ ID NO: 3040730 - RNA, 23 nt, Human
aggagcccugggaggcucuggag

SEQ ID NO: 3040731 - RNA, 17 nt, Human
aggagaguagaacagau

SEQ ID NO: 3040732 - RNA, 15 nt, Human
uggaagagggcugca

SEQ ID NO: 3040733 - RNA, 16 nt, Human
ugcuuuuuauggccug

SEQ ID NO: 3040734 - RNA, 19 nt, Human
agguuuuuguagugauuuu

SEQ ID NO: 3040735 - RNA, 13 nt, Human
aguaaaauccaca

SEQ ID NO: 3040736 - RNA, 14 nt, Human
aguaauagagcaaa

SEQ ID NO: 3040737 - RNA, 23 nt, Human
agguuuguuuagaagaagugugu

SEQ ID NO: 3040738 - RNA, 19 nt, Human
uguacuugcucuugaugcc

SEQ ID NO: 3040739 - RNA, 22 nt, Human
uguacuugcucuugaugccugg

SEQ ID NO: 3040740 - RNA, 23 nt, Human
uguacuugcucuugaugccuggc

SEQ ID NO: 3040741 - RNA, 21 nt, Human
uguagugauuuuuaugccacc

SEQ ID NO: 3040742 - RNA, 16 nt, Human
aguacauuuggagaca

SEQ ID NO: 3040743 - RNA, 15 nt, Human
aguaauucaagaaaa

SEQ ID NO: 3040744 - RNA, 16 nt, Human
aguaguaauagagcaa

SEQ ID NO: 3040745 - RNA, 12 nt, Human
uguauguggggg

SEQ ID NO: 3040746 - RNA, 22 nt, Human
uguauucuagcuaauguaauaa

SEQ ID NO: 3040747 - RNA, 13 nt, Human
uguauuacaaauc

SEQ ID NO: 3040748 - RNA, 22 nt, Human
uguauuacaaauccaaugaaau

SEQ ID NO: 3040749 - RNA, 20 nt, Human
uguauucuagcuaauguaau

SEQ ID NO: 3040750 - RNA, 16 nt, Human
uguaaaggaauuuaaa

SEQ ID NO: 3040751 - RNA, 16 nt, Human
uguaaauaguauuuga

SEQ ID NO: 3040752 - RNA, 17 nt, Human
uguaaauaaaggaacca

SEQ ID NO: 3040753 - RNA, 20 nt, Human
aggugcauauuuauaaaaau

SEQ ID NO: 3040754 - RNA, 22 nt, Human
aggugcccagaaugaggcugcu

SEQ ID NO: 3040755 - RNA, 18 nt, Human
aggugcccagaaugaggc

SEQ ID NO: 3040756 - RNA, 23 nt, Human
agggaaggaucccaugagcuccu

SEQ ID NO: 3040757 - RNA, 15 nt, Human
agggaaggaucccau

SEQ ID NO: 3040758 - RNA, 22 nt, Human
agggaaggaucccaugagcucc

SEQ ID NO: 3040759 - RNA, 13 nt, Human
agggaaauuucag

SEQ ID NO: 3040760 - RNA, 22 nt, Human
aggcccuaucuguuuacagugu

SEQ ID NO: 3040761 - RNA, 22 nt, Human
ugggagaaugucaguaugugga

SEQ ID NO: 3040762 - RNA, 20 nt, Human
ugggagaaugucaguaugug

SEQ ID NO: 3040763 - RNA, 19 nt, Human
ugggagaaugucaguaugu

SEQ ID NO: 3040764 - RNA, 15 nt, Human
ugggccccugccaga

SEQ ID NO: 3040765 - RNA, 15 nt, Human
ugggccccugccucu

SEQ ID NO: 3040766 - RNA, 19 nt, Human
ugggccccugccucucugc

SEQ ID NO: 3040767 - RNA, 13 nt, Human
uggggagagacgg

SEQ ID NO: 3040768 - RNA, 14 nt, Human
uggggagggauuug

SEQ ID NO: 3040769 - RNA, 22 nt, Human
uggggagggauuuggggcucag

SEQ ID NO: 3040770 - RNA, 15 nt, Human
uggggcucagagugg

SEQ ID NO: 3040771 - RNA, 21 nt, Human
aggguggggggggggcgcggc

SEQ ID NO: 3040772 - RNA, 16 nt, Human
ugggucgcccuggacu

SEQ ID NO: 3040773 - RNA, 18 nt, Human
ugggucgcccuggacugu

SEQ ID NO: 3040774 - RNA, 12 nt, Human
aguuuagggugg

SEQ ID NO: 3040775 - RNA, 13 nt, Human
aguuuaggguggg

SEQ ID NO: 3040776 - RNA, 14 nt, Human
aguuuagggugggg

SEQ ID NO: 3040777 - RNA, 18 nt, Human
uuaaaauugugauguguc

SEQ ID NO: 3040778 - RNA, 13 nt, Human
uuaaaauugugau

SEQ ID NO: 3040779 - RNA, 12 nt, Human
aguucugccagg

SEQ ID NO: 3040780 - RNA, 13 nt, Human
aguucugccagga

SEQ ID NO: 3040781 - RNA, 14 nt, Human
aguucugccaggag

SEQ ID NO: 3040782 - RNA, 20 nt, Human
aguucugccaggagacaggu

SEQ ID NO: 3040783 - RNA, 19 nt, Human
uguuuugaaucucauaauu

SEQ ID NO: 3040784 - RNA, 18 nt, Human
uguuucuuuguaaugaaa

SEQ ID NO: 3040785 - RNA, 19 nt, Human
uguuucuuuguaaugaaaa

SEQ ID NO: 3040786 - RNA, 14 nt, Human
uguuuauuuauaga

SEQ ID NO: 3040787 - RNA, 24 nt, Human
uguuuauuuauagaguguacuuaa

SEQ ID NO: 3040788 - RNA, 13 nt, Human
uguuuaugugugu

SEQ ID NO: 3040789 - RNA, 16 nt, Human
uguuuaugugugugug

SEQ ID NO: 3040790 - RNA, 19 nt, Human
uguugccuugcauaauggu

SEQ ID NO: 3040791 - RNA, 12 nt, Human
auaaauauuaua

SEQ ID NO: 3040792 - RNA, 22 nt, Human
auaaauauuauauuauauauau

SEQ ID NO: 3040793 - RNA, 15 nt, Human
uuagaagaagugugu

SEQ ID NO: 3040794 - RNA, 14 nt, Human
uuagaagaagugug

SEQ ID NO: 3040795 - RNA, 16 nt, Human
uuagaagaaguguguc

SEQ ID NO: 3040796 - RNA, 17 nt, Human
uuaauaaacacucuuga

SEQ ID NO: 3040797 - RNA, 13 nt, Human
uuaauaaacacuc

SEQ ID NO: 3040798 - RNA, 17 nt, Human
uuaauuccaauuauaug

SEQ ID NO: 3040799 - RNA, 20 nt, Human
auaaaauuuuuaaucuuuaa

SEQ ID NO: 3040800 - RNA, 18 nt, Human
uuaaguaaggaauuuuau

SEQ ID NO: 3040801 - RNA, 22 nt, Human
auaaaagggacugagaaauuua

SEQ ID NO: 3040802 - RNA, 15 nt, Human
ugugacucuuuccaa

SEQ ID NO: 3040803 - RNA, 17 nt, Human
ugugacucuuuccaacc

SEQ ID NO: 3040804 - RNA, 18 nt, Human
agucuuucacauuuaaau

SEQ ID NO: 3040805 - RNA, 12 nt, Human
ugugacucuuuc

SEQ ID NO: 3040806 - RNA, 14 nt, Human
ugugacucuuucca

SEQ ID NO: 3040807 - RNA, 15 nt, Human
ugugaacagcggcug

SEQ ID NO: 3040808 - RNA, 12 nt, Human
ugugaaauuauu

SEQ ID NO: 3040809 - RNA, 18 nt, Human
agucacuaccuucaugca

SEQ ID NO: 3040810 - RNA, 19 nt, Human
uguggcauccagagucccu

SEQ ID NO: 3040811 - RNA, 21 nt, Human
uguggcauccagagucccugc

SEQ ID NO: 3040812 - RNA, 16 nt, Human
uguggcauccagaguc

SEQ ID NO: 3040813 - RNA, 23 nt, Human
uguggcaguuuggcaaacucucc

SEQ ID NO: 3040814 - RNA, 23 nt, Human
ugugcccacccuccacucuccuc

SEQ ID NO: 3040815 - RNA, 14 nt, Human
ugugcccacccucc

SEQ ID NO: 3040816 - RNA, 20 nt, Human
ugugccagauuuaugcauau

SEQ ID NO: 3040817 - RNA, 18 nt, Human
ugugccagauuuaugcau

SEQ ID NO: 3040818 - RNA, 14 nt, Human
ugugauguauucua

SEQ ID NO: 3040819 - RNA, 15 nt, Human
agugaaagaaaauaa

SEQ ID NO: 3040820 - RNA, 14 nt, Human
uguguguguaugug

SEQ ID NO: 3040821 - RNA, 20 nt, Human
ugugugugggaguguguaau

SEQ ID NO: 3040822 - RNA, 12 nt, Human
ugugugugggag

SEQ ID NO: 3040823 - RNA, 19 nt, Human
uguguuaaguauguguaaa

SEQ ID NO: 3040824 - RNA, 15 nt, Human
uguuaaguaugugua

SEQ ID NO: 3040825 - RNA, 16 nt, Human
uguuaaguauguguaa

SEQ ID NO: 3040826 - RNA, 17 nt, Human
aguguacuuaacuauuc

SEQ ID NO: 3040827 - RNA, 15 nt, Human
uguucugugauauaa

SEQ ID NO: 3040828 - RNA, 18 nt, Human
uguucugugauauaagug

SEQ ID NO: 3040829 - RNA, 21 nt, Human
uguuccgugguuaaacucgcu

SEQ ID NO: 3040830 - RNA, 14 nt, Human
agugugucuaaauu

SEQ ID NO: 3040831 - RNA, 16 nt, Human
uuggacuugucccggg

SEQ ID NO: 3040832 - RNA, 11 nt, Human
uuggagccugc

SEQ ID NO: 3040833 - RNA, 15 nt, Human
uuggagccugcagag

SEQ ID NO: 3040834 - RNA, 18 nt, Human
uuggagacacaacuauuu

SEQ ID NO: 3040835 - RNA, 18 nt, Human
uugcucuugaugccuggc

SEQ ID NO: 3040836 - RNA, 14 nt, Human
uugcucuugaugcc

SEQ ID NO: 3040837 - RNA, 17 nt, Human
uugcucuugaugccugg

SEQ ID NO: 3040838 - RNA, 16 nt, Human
aucuuauaauuuaaaa

SEQ ID NO: 3040839 - RNA, 15 nt, Human
aucuuauaauuuaaa

SEQ ID NO: 3040840 - RNA, 14 nt, Human
aucuuauaauuuaa

SEQ ID NO: 3040841 - RNA, 22 nt, Human
aucugugaggggcucucucaug

SEQ ID NO: 3040842 - RNA, 21 nt, Human
aucugugaggggcucucucau

SEQ ID NO: 3040843 - RNA, 19 nt, Human
uuguaaauuuaugugaugg

SEQ ID NO: 3040844 - RNA, 15 nt, Human
augaagcaaugcuuc

SEQ ID NO: 3040845 - RNA, 18 nt, Human
augaacuuguaaaggaau

SEQ ID NO: 3040846 - RNA, 14 nt, Human
augaagcaaugcuu

SEQ ID NO: 3040847 - RNA, 18 nt, Human
uuggagccugcagagcug

SEQ ID NO: 3040848 - RNA, 16 nt, Human
aucucuuguuuaaauu

SEQ ID NO: 3040849 - RNA, 20 nt, Human
uugauguguuuauuuauaga

SEQ ID NO: 3040850 - RNA, 17 nt, Human
aucugacuaugacauaa

SEQ ID NO: 3040851 - RNA, 14 nt, Human
aucugacuaugaca

SEQ ID NO: 3040852 - RNA, 18 nt, Human
uugcaacuuuguauaaaa

SEQ ID NO: 3040853 - RNA, 16 nt, Human
uugcaacuuuguauaa

SEQ ID NO: 3040854 - RNA, 17 nt, Human
uugcaacuuuguauaaa

SEQ ID NO: 3040855 - RNA, 18 nt, Human
augcuacaggauuugaaa

SEQ ID NO: 3040856 - RNA, 22 nt, Human
uuucacauaucuaguaugaaau

SEQ ID NO: 3040857 - RNA, 21 nt, Human
auggaaugcuguguuaaauaa

SEQ ID NO: 3040858 - RNA, 17 nt, Human
auggaaugcuguguuaa

SEQ ID NO: 3040859 - RNA, 17 nt, Human
uuguagcuuuaucaaag

SEQ ID NO: 3040860 - RNA, 16 nt, Human
uuguagcuuuaucaaa

SEQ ID NO: 3040861 - RNA, 18 nt, Human
augaguuggcugggaaua

SEQ ID NO: 3040862 - RNA, 12 nt, Human
uugugauguguc

SEQ ID NO: 3040863 - RNA, 20 nt, Human
uuguucaauaauaaauauuu

SEQ ID NO: 3040864 - RNA, 22 nt, Human
uuguucaauaauaaauauuuuu

SEQ ID NO: 3040865 - RNA, 13 nt, Human
uuguucauacaua

SEQ ID NO: 3040866 - RNA, 18 nt, Human
uuguucauacauauuuuu

SEQ ID NO: 3040867 - RNA, 16 nt, Human
uuguucauacauauuu

SEQ ID NO: 3040868 - RNA, 18 nt, Human
uuuaaaaaaauuccaagu

SEQ ID NO: 3040869 - RNA, 20 nt, Human
uuuaagacgaaacauuuguu

SEQ ID NO: 3040870 - RNA, 21 nt, Human
uuuaaauauaugcuaagucuu

SEQ ID NO: 3040871 - RNA, 18 nt, Human
uuuaaauauaugcuaagu

SEQ ID NO: 3040872 - RNA, 14 nt, Human
uuuaagagacagcc

SEQ ID NO: 3040873 - RNA, 17 nt, Human
uucuaguucugccagga

SEQ ID NO: 3040874 - RNA, 14 nt, Human
aucauucauuuucu

SEQ ID NO: 3040875 - RNA, 23 nt, Human
aucauguuuacagaggacaguau

SEQ ID NO: 3040876 - RNA, 18 nt, Human
aucauguuuacagaggac

SEQ ID NO: 3040877 - RNA, 16 nt, Human
aucagugucuuuccac

SEQ ID NO: 3040878 - RNA, 20 nt, Human
aucagugugucuaaauuuga

SEQ ID NO: 3040879 - RNA, 19 nt, Human
aucagugugucuaaauuug

SEQ ID NO: 3040880 - RNA, 12 nt, Human
uucugccaggag

SEQ ID NO: 3040881 - RNA, 13 nt, Human
uucucuucacuca

SEQ ID NO: 3040882 - RNA, 11 nt, Human
aucccaacacu

SEQ ID NO: 3040883 - RNA, 15 nt, Human
aucccaacacugcca

SEQ ID NO: 3040884 - RNA, 16 nt, Human
aucccaacacugccag

SEQ ID NO: 3040885 - RNA, 17 nt, Human
aucccaacacugccagc

SEQ ID NO: 3040886 - RNA, 17 nt, Human
auauguuucaaacuuug

SEQ ID NO: 3040887 - RNA, 15 nt, Human
auauugauccagaaa

SEQ ID NO: 3040888 - RNA, 22 nt, Human
auauugauccagaaagaaaacu

SEQ ID NO: 3040889 - RNA, 17 nt, Human
auauuguguugugaaug

SEQ ID NO: 3040890 - RNA, 18 nt, Human
auauuguguugugaaugu

SEQ ID NO: 3040891 - RNA, 20 nt, Human
auauuuguaaauuuauguga

SEQ ID NO: 3040892 - RNA, 18 nt, Human
auauauucagccuggcuu

SEQ ID NO: 3040893 - RNA, 13 nt, Human
uucagaaaauauu

SEQ ID NO: 3040894 - RNA, 14 nt, Human
uucagaaaauauua

SEQ ID NO: 3040895 - RNA, 20 nt, Human
uucagaaaauauuauguguu

SEQ ID NO: 3040896 - RNA, 21 nt, Human
uucagaaaauauuauguguuu

SEQ ID NO: 3040897 - RNA, 17 nt, Human
auauaaguauucuaaau

SEQ ID NO: 3040898 - RNA, 19 nt, Human
auauaaguauucuaaauuu

SEQ ID NO: 3040899 - RNA, 18 nt, Human
auagcuacuaauuuuaaa

SEQ ID NO: 3040900 - RNA, 17 nt, Human
auagcuacuaauuuuaa

SEQ ID NO: 3040901 - RNA, 14 nt, Human
auagcuacuaauuu

SEQ ID NO: 3040902 - RNA, 21 nt, Human
uucacauaucuaguaugaaau

SEQ ID NO: 3040903 - RNA, 20 nt, Human
uucacauaucuaguaugaaa

SEQ ID NO: 3040904 - RNA, 19 nt, Human
uucacauuguauucagagu

SEQ ID NO: 3040905 - RNA, 17 nt, Human
auaggcacaggaaacca

SEQ ID NO: 3040906 - RNA, 22 nt, Human
uucaagaaaacaacuucaauau

SEQ ID NO: 3040907 - RNA, 16 nt, Human
uucaaaaaacuuguaa

SEQ ID NO: 3040908 - RNA, 16 nt, Human
uucaaacuuuggaaca

SEQ ID NO: 3040909 - RNA, 19 nt, Human
uuucccuuccuuccucucc

SEQ ID NO: 3040910 - RNA, 21 nt, Human
uuugacagaauauguuucaaa

SEQ ID NO: 3040911 - RNA, 20 nt, Human
uuugacagaauauguuucaa

SEQ ID NO: 3040912 - RNA, 19 nt, Human
uuugacagaauauguuuca

SEQ ID NO: 3040913 - RNA, 18 nt, Human
uuugacagaauauguuuc

SEQ ID NO: 3040914 - RNA, 18 nt, Human
uuugacaaagguaaauca

SEQ ID NO: 3040915 - RNA, 13 nt, Human
uuugagaguucua

SEQ ID NO: 3040916 - RNA, 23 nt, Human
uuugaccuguugggagugaggau

SEQ ID NO: 3040917 - RNA, 18 nt, Human
uuuggcaaacucuccacc

SEQ ID NO: 3040918 - RNA, 17 nt, Human
auguauauaaacaugcu

SEQ ID NO: 3040919 - RNA, 18 nt, Human
uuuguaagguuuuuguag

SEQ ID NO: 3040920 - RNA, 22 nt, Human
uuuguagugauuuuuaugccac

SEQ ID NO: 3040921 - RNA, 15 nt, Human
uuuguagugauuuuu

SEQ ID NO: 3040922 - RNA, 23 nt, Human
augucgucaaagcugaaauggac

SEQ ID NO: 3040923 - RNA, 15 nt, Human
auguuuuuuuuuaaa

SEQ ID NO: 3040924 - RNA, 23 nt, Human
auguggaaaagccaagaggcugc

SEQ ID NO: 3040925 - RNA, 23 nt, Human
auguguguguguuguguguggga

SEQ ID NO: 3040926 - RNA, 22 nt, Human
auguguguguguuguguguggg

SEQ ID NO: 3040927 - RNA, 18 nt, Human
auguguguguguugugug

SEQ ID NO: 3040928 - RNA, 12 nt, Human
auguguuuccau

SEQ ID NO: 3040929 - RNA, 13 nt, Human
auguuaagcagau

SEQ ID NO: 3040930 - RNA, 12 nt, Human
auguuaagcaga

SEQ ID NO: 3040931 - RNA, 13 nt, Human
uuuuugacagaau

SEQ ID NO: 3040932 - RNA, 12 nt, Human
uuuuugacagaa

SEQ ID NO: 3040933 - RNA, 15 nt, Human
uuuuugaagcuguau

SEQ ID NO: 3040934 - RNA, 19 nt, Human
uuuuuguagcacugacaga

SEQ ID NO: 3040935 - RNA, 17 nt, Human
uuuuuguagcacugaca

SEQ ID NO: 3040936 - RNA, 21 nt, Human
uuuuuguagcacugacagauu

SEQ ID NO: 3040937 - RNA, 20 nt, Human
uuuuuguagcacugacagau

SEQ ID NO: 3040938 - RNA, 20 nt, Human
auuauauggcuugaguuuaa

SEQ ID NO: 3040939 - RNA, 17 nt, Human
auuccaagugauugaaa

SEQ ID NO: 3040940 - RNA, 21 nt, Human
auucaggagaguagaacagau

SEQ ID NO: 3040941 - RNA, 22 nt, Human
auucaggagaguagaacagaua

SEQ ID NO: 3040942 - RNA, 14 nt, Human
auucagccuggcuu

SEQ ID NO: 3040943 - RNA, 15 nt, Human
auucagccuggcuuc

SEQ ID NO: 3040944 - RNA, 17 nt, Human
auuguacgaagaguauu

SEQ ID NO: 3040945 - RNA, 19 nt, Human
auugauguguuuauuuaua

SEQ ID NO: 3040946 - RNA, 12 nt, Human
auugauguguuu

SEQ ID NO: 3040947 - RNA, 18 nt, Human
auugaugggauuugguca

SEQ ID NO: 3040948 - RNA, 21 nt, Human
auuuggagacacaacuauuuu

SEQ ID NO: 3040949 - RNA, 19 nt, Human
auuugaauguuaagcagau

SEQ ID NO: 3040950 - RNA, 20 nt, Human
auuucuugagguaaaagcau

SEQ ID NO: 3040951 - RNA, 13 nt, Human
auuugaauguuaa

SEQ ID NO: 3040952 - RNA, 18 nt, Human
auuugaauguuaagcaga

SEQ ID NO: 3040953 - RNA, 23 nt, Human
auuugaauguaugcuucauacag

SEQ ID NO: 3040954 - RNA, 14 nt, Human
auuuccuaaauaua

SEQ ID NO: 3040955 - RNA, 21 nt, Human
auuuccuaaauauauuuuaag

SEQ ID NO: 3040956 - RNA, 15 nt, Human
auuuauaaacuuuuu

SEQ ID NO: 3040957 - RNA, 16 nt, Human
auuuaguguucauaaa

SEQ ID NO: 3040958 - RNA, 23 nt, Human
auuuauaaaaauaaaaaacacug

SEQ ID NO: 3040959 - RNA, 17 nt, Human
auuuaguguucauaaau

SEQ ID NO: 3040960 - RNA, 16 nt, Human
auuguaguccuguaau

SEQ ID NO: 3040961 - RNA, 18 nt, Human
auuguagagccagagguc

SEQ ID NO: 3040962 - RNA, 17 nt, Human
auuguagagccagaggu

SEQ ID NO: 3040963 - RNA, 15 nt, Human
auuuaaaauugugau

SEQ ID NO: 3040964 - RNA, 14 nt, Human
aacaggcucagagg

SEQ ID NO: 3040965 - RNA, 18 nt, Human
aaccuuuguuugcaucug

SEQ ID NO: 3040966 - RNA, 23 nt, Human
aaaucucaaauuuggauugcuaa

SEQ ID NO: 3040967 - RNA, 20 nt, Human
aaaagacaaggaaaaaauaa

SEQ ID NO: 3040968 - RNA, 17 nt, Human
aaaagauaaauauuaua

SEQ ID NO: 3040969 - RNA, 14 nt, Human
aaaagauaaauauu

SEQ ID NO: 3040970 - RNA, 19 nt, Human
aaaagagaugaugaaaaua

SEQ ID NO: 3040971 - RNA, 16 nt, Human
aaaagagaugaugaaa

SEQ ID NO: 3040972 - RNA, 13 nt, Human
aaagccugcaauu

SEQ ID NO: 3040973 - RNA, 18 nt, Human
aaagccugcaauuucaua

SEQ ID NO: 3040974 - RNA, 14 nt, Human
aagagagaaaauaa

SEQ ID NO: 3040975 - RNA, 21 nt, Human
aagacaaggaaaaaauaacaa

SEQ ID NO: 3040976 - RNA, 16 nt, Human
aagaguaguaauagag

SEQ ID NO: 3040977 - RNA, 19 nt, Human
aagaguauuuuugacagaa

SEQ ID NO: 3040978 - RNA, 19 nt, Human
aauaaacacucuugaaaaa

SEQ ID NO: 3040979 - RNA, 11 nt, Human
aauaaacacuc

SEQ ID NO: 3040980 - RNA, 16 nt, Human
aauaaacacucuugaa

SEQ ID NO: 3040981 - RNA, 20 nt, Human
aaugaauacuuuauaaagga

SEQ ID NO: 3040982 - RNA, 14 nt, Human
aaugaagcaaugcu

SEQ ID NO: 3040983 - RNA, 16 nt, Human
aaucucauaauuuaua

SEQ ID NO: 3040984 - RNA, 16 nt, Human
acccucaucuuucuuc

SEQ ID NO: 3040985 - RNA, 19 nt, Human
acccucaucuuucuuccaa

SEQ ID NO: 3040986 - RNA, 13 nt, Human
acccucaucuuuc

SEQ ID NO: 3040987 - RNA, 14 nt, Human
acccucaucuuucu

SEQ ID NO: 3040988 - RNA, 13 nt, Human
accggggccuggg

SEQ ID NO: 3040989 - RNA, 16 nt, Human
acugacagauuuccau

SEQ ID NO: 3040990 - RNA, 14 nt, Human
acugauuacugccu

SEQ ID NO: 3040991 - RNA, 17 nt, Human
acugauccagcccugag

SEQ ID NO: 3040992 - RNA, 16 nt, Human
acugauccagcccuga

SEQ ID NO: 3040993 - RNA, 15 nt, Human
acugccuauuuuaau

SEQ ID NO: 3040994 - RNA, 17 nt, Human
acuguaaaauaauaacu

SEQ ID NO: 3040995 - RNA, 16 nt, Human
acugucuuuuuucuaa

SEQ ID NO: 3040996 - RNA, 22 nt, Human
acugucuuuuuucuaaaguaaa

SEQ ID NO: 3040997 - RNA, 23 nt, Human
acugucuuuuuucuaaaguaaaa

SEQ ID NO: 3040998 - RNA, 12 nt, Human
acuugaaaauua

SEQ ID NO: 3040999 - RNA, 14 nt, Human
acuugaaaauuaac

SEQ ID NO: 3041000 - RNA, 20 nt, Human
acauaaguaauucaagaaaa

SEQ ID NO: 3041001 - RNA, 21 nt, Human
acauaaguaauucaagaaaac

SEQ ID NO: 3041002 - RNA, 20 nt, Human
acauaaguauuuaauucaug

SEQ ID NO: 3041003 - RNA, 23 nt, Human
acauguuucuuuguaaugaaaac

SEQ ID NO: 3041004 - RNA, 17 nt, Human
accaccagaagcccaga

SEQ ID NO: 3041005 - RNA, 16 nt, Human
accaccagaagcccag

SEQ ID NO: 3041006 - RNA, 15 nt, Human
accaccagaagccca

SEQ ID NO: 3041007 - RNA, 13 nt, Human
accaccagaagcc

SEQ ID NO: 3041008 - RNA, 18 nt, Human
accaagccuggucagccc

SEQ ID NO: 3041009 - RNA, 16 nt, Human
aauuucauaugcugua

SEQ ID NO: 3041010 - RNA, 18 nt, Human
aauuucauaugcuguaua

SEQ ID NO: 3041011 - RNA, 11 nt, Human
aauuguaauag

SEQ ID NO: 3041012 - RNA, 17 nt, Human
aauuauauaaguauucu

SEQ ID NO: 3041013 - RNA, 16 nt, Human
aauuauauaaguauuc

SEQ ID NO: 3041014 - RNA, 15 nt, Human
aauuauauaaguauu

SEQ ID NO: 3041015 - RNA, 14 nt, Human
aggcuagggugggg

SEQ ID NO: 3041016 - RNA, 15 nt, Human
aggcuagggugggga

SEQ ID NO: 3041017 - RNA, 16 nt, Human
aggcuaggguggggag

SEQ ID NO: 3041018 - RNA, 19 nt, Human
aggcuaggguggggagaga

SEQ ID NO: 3041019 - RNA, 22 nt, Human
aggcucuggagcccacuguacu

SEQ ID NO: 3041020 - RNA, 22 nt, Human
agggauuuggggcucagagugg

SEQ ID NO: 3041021 - RNA, 15 nt, Human
agggaugcauggaga

SEQ ID NO: 3041022 - RNA, 15 nt, Human
agggacugagaaauu

SEQ ID NO: 3041023 - RNA, 13 nt, Human
agggacugagaaa

SEQ ID NO: 3041024 - RNA, 14 nt, Human
agggacugagaaau

SEQ ID NO: 3041025 - RNA, 19 nt, Human
aggcaucggggagccggga

SEQ ID NO: 3041026 - RNA, 23 nt, Human
aggccagggggccagucccugag

SEQ ID NO: 3041027 - RNA, 19 nt, Human
aggccagggggccaguccc

SEQ ID NO: 3041028 - RNA, 22 nt, Human
aggcagaacucaucuagguaaa

SEQ ID NO: 3041029 - RNA, 20 nt, Human
aggagacagguuagcugcuc

SEQ ID NO: 3041030 - RNA, 15 nt, Human
aggagggaggugcuu

SEQ ID NO: 3041031 - RNA, 13 nt, Human
aggagggcaggca

SEQ ID NO: 3041032 - RNA, 15 nt, Human
aggagggcaggcauc

SEQ ID NO: 3041033 - RNA, 18 nt, Human
aggaguuucguuuucaaa

SEQ ID NO: 3041034 - RNA, 13 nt, Human
aggaugucugggc

SEQ ID NO: 3041035 - RNA, 13 nt, Human
agcuacaaaugca

SEQ ID NO: 3041036 - RNA, 12 nt, Human
agcuacaaaugc

SEQ ID NO: 3041037 - RNA, 13 nt, Human
agcgaauuuuaaa

SEQ ID NO: 3041038 - RNA, 16 nt, Human
agcgaauuuuaaaaga

SEQ ID NO: 3041039 - RNA, 15 nt, Human
agcgaauuuuaaaag

SEQ ID NO: 3041040 - RNA, 17 nt, Human
agccugcugccugcuuu

SEQ ID NO: 3041041 - RNA, 18 nt, Human
aggaaaaaauaacaauga

SEQ ID NO: 3041042 - RNA, 12 nt, Human
agagaggccauu

SEQ ID NO: 3041043 - RNA, 22 nt, Human
agagaggccauucuuucccaac

SEQ ID NO: 3041044 - RNA, 23 nt, Human
agagaggccauucuuucccaaca

SEQ ID NO: 3041045 - RNA, 19 nt, Human
agacaaggaaaaaauaaca

SEQ ID NO: 3041046 - RNA, 18 nt, Human
agacgaaacauuuguucu

SEQ ID NO: 3041047 - RNA, 13 nt, Human
agaacaucccucc

SEQ ID NO: 3041048 - RNA, 17 nt, Human
agaacaucccuccuggg

SEQ ID NO: 3041049 - RNA, 19 nt, Human
agaacagauaaucagugug

SEQ ID NO: 3041050 - RNA, 20 nt, Human
agaaugaggcugcuuuccaa

SEQ ID NO: 3041051 - RNA, 14 nt, Human
agaaugaggcugcu

SEQ ID NO: 3041052 - RNA, 13 nt, Human
agaaugaggcugc

SEQ ID NO: 3041053 - RNA, 12 nt, Human
agaaugaggcug

SEQ ID NO: 3041054 - RNA, 14 nt, Human
agcagugggccugg

SEQ ID NO: 3041055 - RNA, 22 nt, Human
agcccaaaccaccagaagccca

SEQ ID NO: 3041056 - RNA, 20 nt, Human
agcccaaaccaccagaagcc

SEQ ID NO: 3041057 - RNA, 19 nt, Human
agcccaaaccaccagaagc

SEQ ID NO: 3041058 - RNA, 17 nt, Human
agcccaaaccaccagaa

SEQ ID NO: 3041059 - RNA, 14 nt, Human
agccaagaggcugc

SEQ ID NO: 3041060 - RNA, 17 nt, Human
agccaacuauggccugu

SEQ ID NO: 3041061 - RNA, 13 nt, Human
agcaucucccagu

SEQ ID NO: 3041062 - RNA, 19 nt, Human
agauagccccacaggaggu

SEQ ID NO: 3041063 - RNA, 20 nt, Human
agauagauaggucagugcaa

SEQ ID NO: 3041064 - RNA, 19 nt, Human
agagugggguagguuggga

SEQ ID NO: 3041065 - RNA, 17 nt, Human
agauugagauguguuca

SEQ ID NO: 3041066 - RNA, 13 nt, Human
agcaaaauugaug

SEQ ID NO: 3041067 - RNA, 19 nt, Human
agcaaaauugauguguuua

SEQ ID NO: 3041068 - RNA, 23 nt, Human
agcaaaauugauguguuuauuua

SEQ ID NO: 3041069 - RNA, 20 nt, Human
augcauauuauuuuauguug

SEQ ID NO: 3041070 - RNA, 24 nt, Human
augcauauuauuuuauguugcaua

SEQ ID NO: 3041071 - RNA, 23 nt, Human
auggagauagccccacaggaggu

SEQ ID NO: 3041072 - RNA, 11 nt, Human
aucuaggauuu

SEQ ID NO: 3041073 - RNA, 19 nt, Human
aucuaggauuuuaagggaa

SEQ ID NO: 3041074 - RNA, 23 nt, Human
augaaguuuuuuuuauacaggau

SEQ ID NO: 3041075 - RNA, 13 nt, Human
augaaacuuggau

SEQ ID NO: 3041076 - RNA, 22 nt, Human
augaggcugcuuuccaaagcca

SEQ ID NO: 3041077 - RNA, 23 nt, Human
auccacuuuaucuugaauaaugu

SEQ ID NO: 3041078 - RNA, 21 nt, Human
auccagcccugaguuccuagc

SEQ ID NO: 3041079 - RNA, 18 nt, Human
aucaaagagagaaaauaa

SEQ ID NO: 3041080 - RNA, 20 nt, Human
aucaaagggugaaaauuauu

SEQ ID NO: 3041081 - RNA, 15 nt, Human
auaaaagacagugaa

SEQ ID NO: 3041082 - RNA, 16 nt, Human
auaaaagacagugaaa

SEQ ID NO: 3041083 - RNA, 22 nt, Human
auaaaaauauuguguugugaau

SEQ ID NO: 3041084 - RNA, 23 nt, Human
auaaaaauauuguguugugaaug

SEQ ID NO: 3041085 - RNA, 20 nt, Human
auaaaaagacauucuuccaa

SEQ ID NO: 3041086 - RNA, 14 nt, Human
auaaaaacaacuuu

SEQ ID NO: 3041087 - RNA, 20 nt, Human
aguuguucaauaauaaauau

SEQ ID NO: 3041088 - RNA, 19 nt, Human
auacuugaaaauuaacaug

SEQ ID NO: 3041089 - RNA, 17 nt, Human
auaaguaauucaagaaa

SEQ ID NO: 3041090 - RNA, 15 nt, Human
auaaguaaaugcuag

SEQ ID NO: 3041091 - RNA, 22 nt, Human
aguauauugauccagaaagaaa

SEQ ID NO: 3041092 - RNA, 13 nt, Human
agugaaugaaaca

SEQ ID NO: 3041093 - RNA, 16 nt, Human
cacaugagauaauaug

SEQ ID NO: 3041094 - RNA, 15 nt, Human
cacaugagauaauau

SEQ ID NO: 3041095 - RNA, 20 nt, Human
cacacguaaugaaacuugga

SEQ ID NO: 3041096 - RNA, 19 nt, Human
cacacguaaugaaacuugg

SEQ ID NO: 3041097 - RNA, 14 nt, Human
caccacacucagcc

SEQ ID NO: 3041098 - RNA, 19 nt, Human
caccacacugauccagccc

SEQ ID NO: 3041099 - RNA, 15 nt, Human
caccacacucagccc

SEQ ID NO: 3041100 - RNA, 18 nt, Human
caaauucugucucuggau

SEQ ID NO: 3041101 - RNA, 12 nt, Human
caaagaaauuau

SEQ ID NO: 3041102 - RNA, 13 nt, Human
caaagaaauuaug

SEQ ID NO: 3041103 - RNA, 13 nt, Human
caagagccugaga

SEQ ID NO: 3041104 - RNA, 11 nt, Human
caagagccuga

SEQ ID NO: 3041105 - RNA, 23 nt, Human
caagagccugagagugaggugga

SEQ ID NO: 3041106 - RNA, 20 nt, Human
caagcccaguucagcuuggg

SEQ ID NO: 3041107 - RNA, 13 nt, Human
ccaucagccucca

SEQ ID NO: 3041108 - RNA, 18 nt, Human
cccaaaccaccagaagcc

SEQ ID NO: 3041109 - RNA, 17 nt, Human
cccaaaccaccagaagc

SEQ ID NO: 3041110 - RNA, 22 nt, Human
cccaaaccaccagaagcccaga

SEQ ID NO: 3041111 - RNA, 16 nt, Human
ccagugaauucuugaa

SEQ ID NO: 3041112 - RNA, 20 nt, Human
ccagugaauucuugaaggaa

SEQ ID NO: 3041113 - RNA, 19 nt, Human
ccaggcuuuuuuaucaugu

SEQ ID NO: 3041114 - RNA, 17 nt, Human
ccagcuggggccaggcu

SEQ ID NO: 3041115 - RNA, 18 nt, Human
ccagcuggggccaggcug

SEQ ID NO: 3041116 - RNA, 19 nt, Human
ccagcuggggccaggcugg

SEQ ID NO: 3041117 - RNA, 20 nt, Human
ccagcuggggccaggcuggg

SEQ ID NO: 3041118 - RNA, 21 nt, Human
ccagcuggggccaggcugggu

SEQ ID NO: 3041119 - RNA, 22 nt, Human
ccagcuggggccaggcuggguc

SEQ ID NO: 3041120 - RNA, 23 nt, Human
ccagcuggggccaggcugggucg

SEQ ID NO: 3041121 - RNA, 13 nt, Human
cccaacaccucuu

SEQ ID NO: 3041122 - RNA, 14 nt, Human
ccaacacugccagc

SEQ ID NO: 3041123 - RNA, 15 nt, Human
ccaacacugccagca

SEQ ID NO: 3041124 - RNA, 16 nt, Human
ccaacacugccagcau

SEQ ID NO: 3041125 - RNA, 13 nt, Human
ccaacacugccag

SEQ ID NO: 3041126 - RNA, 16 nt, Human
ccaaaggcucucuccu

SEQ ID NO: 3041127 - RNA, 17 nt, Human
ccaaagcgaauuuuaaa

SEQ ID NO: 3041128 - RNA, 14 nt, Human
ccaaagccaaugug

SEQ ID NO: 3041129 - RNA, 16 nt, Human
ccaagaggcugcagcc

SEQ ID NO: 3041130 - RNA, 15 nt, Human
ccaagaggcugcagc

SEQ ID NO: 3041131 - RNA, 14 nt, Human
ccaagaggcugcag

SEQ ID NO: 3041132 - RNA, 19 nt, Human
ccaagccuuggcucuaccc

SEQ ID NO: 3041133 - RNA, 20 nt, Human
ccaagccuggucagcccaaa

SEQ ID NO: 3041134 - RNA, 19 nt, Human
ccaagccuggucagcccaa

SEQ ID NO: 3041135 - RNA, 16 nt, Human
ccaaacaggcucagag

SEQ ID NO: 3041136 - RNA, 19 nt, Human
cauugucccugaagagaag

SEQ ID NO: 3041137 - RNA, 23 nt, Human
cauuguauucagaguugaugguu

SEQ ID NO: 3041138 - RNA, 15 nt, Human
cauuuccuaaauaua

SEQ ID NO: 3041139 - RNA, 21 nt, Human
ccacgucagcugggacacccc

SEQ ID NO: 3041140 - RNA, 14 nt, Human
ccacgguguucugu

SEQ ID NO: 3041141 - RNA, 22 nt, Human
ccagaauaaacuggcagcucag

SEQ ID NO: 3041142 - RNA, 14 nt, Human
ccagaagcccagaa

SEQ ID NO: 3041143 - RNA, 13 nt, Human
ccagaagcccaga

SEQ ID NO: 3041144 - RNA, 12 nt, Human
ccagaagcccag

SEQ ID NO: 3041145 - RNA, 22 nt, Human
ccacacguaaugaaacuuggau

SEQ ID NO: 3041146 - RNA, 16 nt, Human
ccacacccucacugcu

SEQ ID NO: 3041147 - RNA, 20 nt, Human
ccacacagacuugggcaggg

SEQ ID NO: 3041148 - RNA, 15 nt, Human
ccuggaccagccucu

SEQ ID NO: 3041149 - RNA, 16 nt, Human
ccuggaccagccucuc

SEQ ID NO: 3041150 - RNA, 14 nt, Human
ccuggaccagccuc

SEQ ID NO: 3041151 - RNA, 17 nt, Human
ccuggacugugugcuca

SEQ ID NO: 3041152 - RNA, 20 nt, Human
ccuggacugugugcucagga

SEQ ID NO: 3041153 - RNA, 13 nt, Human
ccugggaggcucu

SEQ ID NO: 3041154 - RNA, 21 nt, Human
ccugggaggcucuggagccca

SEQ ID NO: 3041155 - RNA, 12 nt, Human
ccuggcggggug

SEQ ID NO: 3041156 - RNA, 20 nt, Human
ccugcuuuuuauggccugug

SEQ ID NO: 3041157 - RNA, 22 nt, Human
ccugugagcuaggaauuguguu

SEQ ID NO: 3041158 - RNA, 21 nt, Human
ccuugacaaagucaagccaca

SEQ ID NO: 3041159 - RNA, 23 nt, Human
ccuugacaaagucaagccacaug

SEQ ID NO: 3041160 - RNA, 19 nt, Human
cgucagcugggacaccccg

SEQ ID NO: 3041161 - RNA, 16 nt, Human
cguauaaaagccuguu

SEQ ID NO: 3041162 - RNA, 17 nt, Human
cguauaaaagccuguuu

SEQ ID NO: 3041163 - RNA, 21 nt, Human
cguauaaaagccuguuuaaga

SEQ ID NO: 3041164 - RNA, 22 nt, Human
cguauaaaagccuguuuaagag

SEQ ID NO: 3041165 - RNA, 22 nt, Human
cggcugggaggagggcaggcau

SEQ ID NO: 3041166 - RNA, 18 nt, Human
cggcugggaggagggcag

SEQ ID NO: 3041167 - RNA, 23 nt, Human
cggcugggaggagggcaggcauc

SEQ ID NO: 3041168 - RNA, 16 nt, Human
cgggagcucaggaacc

SEQ ID NO: 3041169 - RNA, 23 nt, Human
cgauugcaggagucccugccauc

SEQ ID NO: 3041170 - RNA, 21 nt, Human
cgauugcaggagucccugcca

SEQ ID NO: 3041171 - RNA, 14 nt, Human
ccuuugacaaaggu

SEQ ID NO: 3041172 - RNA, 23 nt, Human
ccucuccacucaugugacucuuu

SEQ ID NO: 3041173 - RNA, 14 nt, Human
ccuccucugcccgg

SEQ ID NO: 3041174 - RNA, 15 nt, Human
ccuccucugcccggg

SEQ ID NO: 3041175 - RNA, 17 nt, Human
ccuccugggaaugaagc

SEQ ID NO: 3041176 - RNA, 19 nt, Human
ccugaggcagguccccaga

SEQ ID NO: 3041177 - RNA, 15 nt, Human
ccugaggcagguccc

SEQ ID NO: 3041178 - RNA, 18 nt, Human
ccugaggcagguccccag

SEQ ID NO: 3041179 - RNA, 20 nt, Human
ccugaagcuaucguaaaauu

SEQ ID NO: 3041180 - RNA, 22 nt, Human
ccugaagcuaucguaaaauuaa

SEQ ID NO: 3041181 - RNA, 23 nt, Human
ccugaagcuaucguaaaauuaag

SEQ ID NO: 3041182 - RNA, 22 nt, Human
ccgacuuuuguuuaccagagaa

SEQ ID NO: 3041183 - RNA, 12 nt, Human
cuggaccagccu

SEQ ID NO: 3041184 - RNA, 21 nt, Human
cuggagcccacuguacuugcu

SEQ ID NO: 3041185 - RNA, 13 nt, Human
cuggagcccacug

SEQ ID NO: 3041186 - RNA, 15 nt, Human
cuggagcccacugua

SEQ ID NO: 3041187 - RNA, 16 nt, Human
cuggagcccacuguac

SEQ ID NO: 3041188 - RNA, 17 nt, Human
cuggagcccacuguacu

SEQ ID NO: 3041189 - RNA, 20 nt, Human
cuggagcccacuguacuugc

SEQ ID NO: 3041190 - RNA, 23 nt, Human
cuggaauaauccuaaacauauga

SEQ ID NO: 3041191 - RNA, 21 nt, Human
cuggaagugcuaauuuugaaa

SEQ ID NO: 3041192 - RNA, 17 nt, Human
cugcuuuccaaagccaa

SEQ ID NO: 3041193 - RNA, 15 nt, Human
cugcuuuccaaagcc

SEQ ID NO: 3041194 - RNA, 14 nt, Human
cuggcacagccugg

SEQ ID NO: 3041195 - RNA, 17 nt, Human
cuggauuauauuaugaa

SEQ ID NO: 3041196 - RNA, 22 nt, Human
cugggaggcucuggagcccacu

SEQ ID NO: 3041197 - RNA, 15 nt, Human
cugggaggcucugga

SEQ ID NO: 3041198 - RNA, 16 nt, Human
cugggaggcucuggag

SEQ ID NO: 3041199 - RNA, 10 nt, Human
cugggccccu

SEQ ID NO: 3041200 - RNA, 12 nt, Human
cugggccccugc

SEQ ID NO: 3041201 - RNA, 16 nt, Human
cugggccccugccucu

SEQ ID NO: 3041202 - RNA, 17 nt, Human
cugggccccugccucuc

SEQ ID NO: 3041203 - RNA, 20 nt, Human
cugccagcauuucccuuccu

SEQ ID NO: 3041204 - RNA, 16 nt, Human
cugccaggagacaggu

SEQ ID NO: 3041205 - RNA, 13 nt, Human
cugccuauuuuaa

SEQ ID NO: 3041206 - RNA, 14 nt, Human
cugccucucugcag

SEQ ID NO: 3041207 - RNA, 12 nt, Human
cugccucucugc

SEQ ID NO: 3041208 - RNA, 13 nt, Human
cugccucucugca

SEQ ID NO: 3041209 - RNA, 18 nt, Human
cugcagagcagugggccu

SEQ ID NO: 3041210 - RNA, 23 nt, Human
cugcagagcagugggccuggcca

SEQ ID NO: 3041211 - RNA, 21 nt, Human
cugcagagcagugggccuggc

SEQ ID NO: 3041212 - RNA, 21 nt, Human
cugcagagcugcgggcugggu

SEQ ID NO: 3041213 - RNA, 12 nt, Human
cugcagagcugc

SEQ ID NO: 3041214 - RNA, 23 nt, Human
cugcagccaggccacuggccccu

SEQ ID NO: 3041215 - RNA, 22 nt, Human
cugcagccaggccacuggcccc

SEQ ID NO: 3041216 - RNA, 17 nt, Human
cugcagccaggccacug

SEQ ID NO: 3041217 - RNA, 16 nt, Human
cugcagccaggccacu

SEQ ID NO: 3041218 - RNA, 15 nt, Human
cugcagccaggccac

SEQ ID NO: 3041219 - RNA, 20 nt, Human
cugcaauuucauaugcugua

SEQ ID NO: 3041220 - RNA, 18 nt, Human
cugcaauuucauaugcug

SEQ ID NO: 3041221 - RNA, 20 nt, Human
cugauccagcccugaguucc

SEQ ID NO: 3041222 - RNA, 22 nt, Human
cuccuuaaggcucuuuuguaag

SEQ ID NO: 3041223 - RNA, 13 nt, Human
cuccuuaaggcuc

SEQ ID NO: 3041224 - RNA, 17 nt, Human
cuccauugguguugaca

SEQ ID NO: 3041225 - RNA, 21 nt, Human
cuccacucuccucuuccaggc

SEQ ID NO: 3041226 - RNA, 15 nt, Human
cucauaauuuauaca

SEQ ID NO: 3041227 - RNA, 13 nt, Human
cucauaauuuaua

SEQ ID NO: 3041228 - RNA, 22 nt, Human
cucauaauuuauacaggucaua

SEQ ID NO: 3041229 - RNA, 20 nt, Human
cucagugucuggcugcagag

SEQ ID NO: 3041230 - RNA, 22 nt, Human
cucagugucuggcugcagagca

SEQ ID NO: 3041231 - RNA, 21 nt, Human
cucagugucuggcugcagagc

SEQ ID NO: 3041232 - RNA, 17 nt, Human
cucaucuccccaucauu

SEQ ID NO: 3041233 - RNA, 21 nt, Human
cucaucuagguaaauuacagu

SEQ ID NO: 3041234 - RNA, 15 nt, Human
cucauuccagaggaa

SEQ ID NO: 3041235 - RNA, 17 nt, Human
cucauuccagaggaagg

SEQ ID NO: 3041236 - RNA, 19 nt, Human
cucuccacucaugugacuc

SEQ ID NO: 3041237 - RNA, 12 nt, Human
cucucugcaggu

SEQ ID NO: 3041238 - RNA, 13 nt, Human
cucucugcagguc

SEQ ID NO: 3041239 - RNA, 14 nt, Human
cucucugcaggucc

SEQ ID NO: 3041240 - RNA, 16 nt, Human
cucucugcaggucccu

SEQ ID NO: 3041241 - RNA, 17 nt, Human
cucucugcaggucccua

SEQ ID NO: 3041242 - RNA, 19 nt, Human
cucucugcaggucccuaau

SEQ ID NO: 3041243 - RNA, 22 nt, Human
cucucugcaggucccuaauaaa

SEQ ID NO: 3041244 - RNA, 23 nt, Human
cucugcaggucccuaauaaagcu

SEQ ID NO: 3041245 - RNA, 22 nt, Human
cucugcaggucccuaauaaagc

SEQ ID NO: 3041246 - RNA, 14 nt, Human
cucuggaauuugaa

SEQ ID NO: 3041247 - RNA, 12 nt, Human
cucuggagccca

SEQ ID NO: 3041248 - RNA, 21 nt, Human
cugaagagaagggcagggcug

SEQ ID NO: 3041249 - RNA, 17 nt, Human
cucuugaacugagcuug

SEQ ID NO: 3041250 - RNA, 16 nt, Human
cucuugaacugagcuu

SEQ ID NO: 3041251 - RNA, 19 nt, Human
cucuugaacugagcuugga

SEQ ID NO: 3041252 - RNA, 22 nt, Human
cucuuggagccugcagagcugc

SEQ ID NO: 3041253 - RNA, 15 nt, Human
cucuuggagccugca

SEQ ID NO: 3041254 - RNA, 15 nt, Human
cucuggagcccacug

SEQ ID NO: 3041255 - RNA, 14 nt, Human
cuuccuuccucucc

SEQ ID NO: 3041256 - RNA, 15 nt, Human
cuuccaagagccuga

SEQ ID NO: 3041257 - RNA, 14 nt, Human
cuuccaagagccug

SEQ ID NO: 3041258 - RNA, 13 nt, Human
cuuauaauuuaaa

SEQ ID NO: 3041259 - RNA, 14 nt, Human
cuuauaauuuaaaa

SEQ ID NO: 3041260 - RNA, 15 nt, Human
cuuaugauugcagau

SEQ ID NO: 3041261 - RNA, 18 nt, Human
cuguuuugaaucucauaa

SEQ ID NO: 3041262 - RNA, 15 nt, Human
cuguuuacaguguuc

SEQ ID NO: 3041263 - RNA, 13 nt, Human
cuguuuacagugu

SEQ ID NO: 3041264 - RNA, 11 nt, Human
cuuaacuauuc

SEQ ID NO: 3041265 - RNA, 19 nt, Human
gaaaauaacaauaaaagac

SEQ ID NO: 3041266 - RNA, 17 nt, Human
cuuugacaaagguaaau

SEQ ID NO: 3041267 - RNA, 14 nt, Human
cuuucugucucucu

SEQ ID NO: 3041268 - RNA, 19 nt, Human
cuuugacaaagguaaauca

SEQ ID NO: 3041269 - RNA, 22 nt, Human
cuuugcauaacguauaaaagcc

SEQ ID NO: 3041270 - RNA, 19 nt, Human
cuugcucuugaugccuggc

SEQ ID NO: 3041271 - RNA, 17 nt, Human
cuugcucuugaugccug

SEQ ID NO: 3041272 - RNA, 18 nt, Human
cuugcucuugaugccugg

SEQ ID NO: 3041273 - RNA, 20 nt, Human
cuugcugcccugugcuccuc

SEQ ID NO: 3041274 - RNA, 20 nt, Human
cuugcuugauuguauggugg

SEQ ID NO: 3041275 - RNA, 15 nt, Human
cuuggaagcuucugg

SEQ ID NO: 3041276 - RNA, 17 nt, Human
cuuguacuuuauuuucu

SEQ ID NO: 3041277 - RNA, 20 nt, Human
gaagcguuguccucagcccc

SEQ ID NO: 3041278 - RNA, 13 nt, Human
gaagcguuguccu

SEQ ID NO: 3041279 - RNA, 19 nt, Human
gaagcguuguccucagccc

SEQ ID NO: 3041280 - RNA, 22 nt, Human
gaagggguaggauuacuaggug

SEQ ID NO: 3041281 - RNA, 17 nt, Human
gaauauuugaauguaug

SEQ ID NO: 3041282 - RNA, 18 nt, Human
gaauguaugcuucauaca

SEQ ID NO: 3041283 - RNA, 16 nt, Human
gaauguaugcuucaua

SEQ ID NO: 3041284 - RNA, 21 nt, Human
gaauguaugcuucauacaggg

SEQ ID NO: 3041285 - RNA, 15 nt, Human
gaauuguguuuauaa

SEQ ID NO: 3041286 - RNA, 23 nt, Human
gaauuguguuuauaauuuuaaau

SEQ ID NO: 3041287 - RNA, 23 nt, Human
gaauucuugaaggaaaaugauac

SEQ ID NO: 3041288 - RNA, 16 nt, Human
gaaauuguauuacaaa

SEQ ID NO: 3041289 - RNA, 16 nt, Human
gaaauuuauaaacuuu

SEQ ID NO: 3041290 - RNA, 17 nt, Human
gaaauuuauaaacuuuu

SEQ ID NO: 3041291 - RNA, 21 nt, Human
gaacagcggcuggacuuggag

SEQ ID NO: 3041292 - RNA, 14 nt, Human
gaacuacugaggau

SEQ ID NO: 3041293 - RNA, 17 nt, Human
gaagagaagggcagggc

SEQ ID NO: 3041294 - RNA, 21 nt, Human
gaacucaucuagguaaauuac

SEQ ID NO: 3041295 - RNA, 20 nt, Human
gaacucaucuagguaaauua

SEQ ID NO: 3041296 - RNA, 12 nt, Human
gaagagggcugc

SEQ ID NO: 3041297 - RNA, 18 nt, Human
gacuaaccccaccacacc

SEQ ID NO: 3041298 - RNA, 18 nt, Human
gaccuuccaagagccuga

SEQ ID NO: 3041299 - RNA, 17 nt, Human
gaccuuccaagagccug

SEQ ID NO: 3041300 - RNA, 16 nt, Human
gaccuuccaagagccu

SEQ ID NO: 3041301 - RNA, 11 nt, Human
gacugagaaau

SEQ ID NO: 3041302 - RNA, 13 nt, Human
gacugagaaauuu

SEQ ID NO: 3041303 - RNA, 12 nt, Human
gacccccuggag

SEQ ID NO: 3041304 - RNA, 17 nt, Human
gacauaaaaacaacuuu

SEQ ID NO: 3041305 - RNA, 18 nt, Human
gacuucccacggcuccuc

SEQ ID NO: 3041306 - RNA, 22 nt, Human
gaguguguaauuuaaaauugug

SEQ ID NO: 3041307 - RNA, 21 nt, Human
gaguguguaauuuaaaauugu

SEQ ID NO: 3041308 - RNA, 11 nt, Human
gaguucuacau

SEQ ID NO: 3041309 - RNA, 15 nt, Human
gauugggccccugcc

SEQ ID NO: 3041310 - RNA, 16 nt, Human
gauugggaauccgccc

SEQ ID NO: 3041311 - RNA, 22 nt, Human
gcaacuuuguauaaaagggacu

SEQ ID NO: 3041312 - RNA, 12 nt, Human
gcaaaugugaau

SEQ ID NO: 3041313 - RNA, 20 nt, Human
gcaaacuuuauuuuguguuu

SEQ ID NO: 3041314 - RNA, 18 nt, Human
gcaaacuuuauuuugugu

SEQ ID NO: 3041315 - RNA, 12 nt, Human
gcacagccuggc

SEQ ID NO: 3041316 - RNA, 19 nt, Human
gcacagccuggcuguggcc

SEQ ID NO: 3041317 - RNA, 15 nt, Human
gcaggagggaggugc

SEQ ID NO: 3041318 - RNA, 11 nt, Human
gcaggaggaag

SEQ ID NO: 3041319 - RNA, 20 nt, Human
gcaggaguuucguuuucaaa

SEQ ID NO: 3041320 - RNA, 21 nt, Human
gcaggaguuucguuuucaaaa

SEQ ID NO: 3041321 - RNA, 18 nt, Human
gcagauggaaugcugugu

SEQ ID NO: 3041322 - RNA, 19 nt, Human
gcagauuuugcccuugaca

SEQ ID NO: 3041323 - RNA, 15 nt, Human
gcaugaauuugugaa

SEQ ID NO: 3041324 - RNA, 17 nt, Human
gcaugaauuugugaagg

SEQ ID NO: 3041325 - RNA, 17 nt, Human
gcauuuuacuguacaga

SEQ ID NO: 3041326 - RNA, 16 nt, Human
gcauuuuacuguacag

SEQ ID NO: 3041327 - RNA, 23 nt, Human
gcauauuauuuuauguugcauag

SEQ ID NO: 3041328 - RNA, 18 nt, Human
gcauauuauuuuauguug

SEQ ID NO: 3041329 - RNA, 23 nt, Human
gcagguccccagacuccaccaag

SEQ ID NO: 3041330 - RNA, 12 nt, Human
gcaggucccuaa

SEQ ID NO: 3041331 - RNA, 13 nt, Human
gcaggucccuaau

SEQ ID NO: 3041332 - RNA, 14 nt, Human
gcagguccccagac

SEQ ID NO: 3041333 - RNA, 10 nt, Human
gcaggucccu

SEQ ID NO: 3041334 - RNA, 11 nt, Human
gcaggucccua

SEQ ID NO: 3041335 - RNA, 13 nt, Human
gccccgcguggaa

SEQ ID NO: 3041336 - RNA, 20 nt, Human
gccccugagaucucugcagg

SEQ ID NO: 3041337 - RNA, 22 nt, Human
gcccaucugggggccucuucug

SEQ ID NO: 3041338 - RNA, 14 nt, Human
gccacucaggccca

SEQ ID NO: 3041339 - RNA, 22 nt, Human
gccacucaggcccaaagccucg

SEQ ID NO: 3041340 - RNA, 19 nt, Human
gccgggagccugacccuca

SEQ ID NO: 3041341 - RNA, 13 nt, Human
gccgggagccuga

SEQ ID NO: 3041342 - RNA, 14 nt, Human
gccgggagccugac

SEQ ID NO: 3041343 - RNA, 21 nt, Human
gccgagaguccaucagccucc

SEQ ID NO: 3041344 - RNA, 17 nt, Human
gccuaaccugccgagag

SEQ ID NO: 3041345 - RNA, 17 nt, Human
gccuauuuuaauaaaca

SEQ ID NO: 3041346 - RNA, 16 nt, Human
gccucucugcaggucc

SEQ ID NO: 3041347 - RNA, 17 nt, Human
gccucucugcagguccc

SEQ ID NO: 3041348 - RNA, 10 nt, Human
gccucucugc

SEQ ID NO: 3041349 - RNA, 14 nt, Human
gccucucugcaggu

SEQ ID NO: 3041350 - RNA, 20 nt, Human
gccugcagagcugcgggcug

SEQ ID NO: 3041351 - RNA, 14 nt, Human
gcuaagaauauuug

SEQ ID NO: 3041352 - RNA, 17 nt, Human
ggaaggaucccaugagc

SEQ ID NO: 3041353 - RNA, 13 nt, Human
ggagcccugggag

SEQ ID NO: 3041354 - RNA, 12 nt, Human
ggagcccuggga

SEQ ID NO: 3041355 - RNA, 14 nt, Human
ggaggagggcaggc

SEQ ID NO: 3041356 - RNA, 15 nt, Human
ggaggagggcaggca

SEQ ID NO: 3041357 - RNA, 20 nt, Human
ggaggagggcaggcaucggg

SEQ ID NO: 3041358 - RNA, 16 nt, Human
ggagccgggagccuga

SEQ ID NO: 3041359 - RNA, 13 nt, Human
ggagggcaggcau

SEQ ID NO: 3041360 - RNA, 12 nt, Human
ggagggauuugg

SEQ ID NO: 3041361 - RNA, 15 nt, Human
ggauagaugugugga

SEQ ID NO: 3041362 - RNA, 14 nt, Human
ggauagaugugugg

SEQ ID NO: 3041363 - RNA, 13 nt, Human
ggauagaugugug

SEQ ID NO: 3041364 - RNA, 20 nt, Human
ggcagucugagagaggccau

SEQ ID NO: 3041365 - RNA, 18 nt, Human
ggccaggcugggucgccc

SEQ ID NO: 3041366 - RNA, 22 nt, Human
ggccaggcugggucgcccugga

SEQ ID NO: 3041367 - RNA, 21 nt, Human
ggccccugagaucucugcagg

SEQ ID NO: 3041368 - RNA, 17 nt, Human
ggccccugagaucucug

SEQ ID NO: 3041369 - RNA, 19 nt, Human
ggccccugccagacccccu

SEQ ID NO: 3041370 - RNA, 17 nt, Human
ggccccugccagacccc

SEQ ID NO: 3041371 - RNA, 17 nt, Human
ggaucccaugagcuccu

SEQ ID NO: 3041372 - RNA, 20 nt, Human
ggaucccaugagcuccuuaa

SEQ ID NO: 3041373 - RNA, 19 nt, Human
ggcagguccccagacucca

SEQ ID NO: 3041374 - RNA, 14 nt, Human
ggcagguccccaga

SEQ ID NO: 3041375 - RNA, 19 nt, Human
gcuucuaguucugccagga

SEQ ID NO: 3041376 - RNA, 20 nt, Human
gcuucuaguucugccaggag

SEQ ID NO: 3041377 - RNA, 21 nt, Human
gcuucuaguucugccaggaga

SEQ ID NO: 3041378 - RNA, 18 nt, Human
gcuucuaguucugccagg

SEQ ID NO: 3041379 - RNA, 19 nt, Human
gcuucuggugaccuuccaa

SEQ ID NO: 3041380 - RNA, 20 nt, Human
ggaaaaaauaacaaugaaag

SEQ ID NO: 3041381 - RNA, 14 nt, Human
gcuuuaucaaaggg

SEQ ID NO: 3041382 - RNA, 15 nt, Human
ggaaccgaggcaggg

SEQ ID NO: 3041383 - RNA, 16 nt, Human
ggaaccgaggcaggga

SEQ ID NO: 3041384 - RNA, 20 nt, Human
ggaaccgaggcagggaagga

SEQ ID NO: 3041385 - RNA, 17 nt, Human
ggaacucgugucuggca

SEQ ID NO: 3041386 - RNA, 17 nt, Human
gcugggaggagggcagg

SEQ ID NO: 3041387 - RNA, 19 nt, Human
gcugggaggagggcaggca

SEQ ID NO: 3041388 - RNA, 16 nt, Human
gcuggggccaggcugg

SEQ ID NO: 3041389 - RNA, 19 nt, Human
gcuggggccaggcuggguc

SEQ ID NO: 3041390 - RNA, 23 nt, Human
gcugggacaccccgacuuuuguu

SEQ ID NO: 3041391 - RNA, 15 nt, Human
gcugccuuuggacuu

SEQ ID NO: 3041392 - RNA, 20 nt, Human
gcugccuuuggacuuguccc

SEQ ID NO: 3041393 - RNA, 15 nt, Human
gggaaggaucccaug

SEQ ID NO: 3041394 - RNA, 20 nt, Human
gggaccccuggugguucacu

SEQ ID NO: 3041395 - RNA, 22 nt, Human
ggcuugaguuuaaauuguaaua

SEQ ID NO: 3041396 - RNA, 15 nt, Human
ggcugcuuuccaaag

SEQ ID NO: 3041397 - RNA, 16 nt, Human
ggcugcagccaggcca

SEQ ID NO: 3041398 - RNA, 22 nt, Human
ggcugcagccaggccacuggcc

SEQ ID NO: 3041399 - RNA, 20 nt, Human
ggccccugccagacccccug

SEQ ID NO: 3041400 - RNA, 13 nt, Human
ggcucuggagccc

SEQ ID NO: 3041401 - RNA, 14 nt, Human
ggcucuggagccca

SEQ ID NO: 3041402 - RNA, 18 nt, Human
gggcagucugagagaggc

SEQ ID NO: 3041403 - RNA, 19 nt, Human
gggcagucugagagaggcc

SEQ ID NO: 3041404 - RNA, 17 nt, Human
gggcagucugagagagg

SEQ ID NO: 3041405 - RNA, 23 nt, Human
gggaggugcuucuaguucugcca

SEQ ID NO: 3041406 - RNA, 13 nt, Human
gggacugagaaau

SEQ ID NO: 3041407 - RNA, 16 nt, Human
gggaguuuaggguggg

SEQ ID NO: 3041408 - RNA, 11 nt, Human
gggagugugua

SEQ ID NO: 3041409 - RNA, 14 nt, Human
gggauagaugugug

SEQ ID NO: 3041410 - RNA, 13 nt, Human
gggauagaugugu

SEQ ID NO: 3041411 - RNA, 13 nt, Human
gggccugggcagg

SEQ ID NO: 3041412 - RNA, 15 nt, Human
gggccugggcaggag

SEQ ID NO: 3041413 - RNA, 12 nt, Human
gggccugggcag

SEQ ID NO: 3041414 - RNA, 22 nt, Human
gggccccugccucucugcaggu

SEQ ID NO: 3041415 - RNA, 13 nt, Human
gggccccugccag

SEQ ID NO: 3041416 - RNA, 13 nt, Human
gggccccugccuc

SEQ ID NO: 3041417 - RNA, 15 nt, Human
gggccccugccucuc

SEQ ID NO: 3041418 - RNA, 17 nt, Human
gggccccugccucucug

SEQ ID NO: 3041419 - RNA, 18 nt, Human
gggccccugccucucugc

SEQ ID NO: 3041420 - RNA, 19 nt, Human
gggccccugccucucugca

SEQ ID NO: 3041421 - RNA, 21 nt, Human
gggccccugccucucugcagg

SEQ ID NO: 3041422 - RNA, 20 nt, Human
gggcagucugagagaggcca

SEQ ID NO: 3041423 - RNA, 21 nt, Human
gggcagucugagagaggccau

SEQ ID NO: 3041424 - RNA, 15 nt, Human
ggugguggcucggga

SEQ ID NO: 3041425 - RNA, 23 nt, Human
ggugguucacucuuggagccugc

SEQ ID NO: 3041426 - RNA, 22 nt, Human
ggugguucacucuuggagccug

SEQ ID NO: 3041427 - RNA, 21 nt, Human
gguguccugcaccggggccug

SEQ ID NO: 3041428 - RNA, 23 nt, Human
gguucacucuuggagccugcaga

SEQ ID NO: 3041429 - RNA, 21 nt, Human
gguucacucuuggagccugca

SEQ ID NO: 3041430 - RNA, 20 nt, Human
gguucacucuuggagccugc

SEQ ID NO: 3041431 - RNA, 19 nt, Human
gguucacucuuggagccug

SEQ ID NO: 3041432 - RNA, 19 nt, Human
ggugaccuuccaagagccu

SEQ ID NO: 3041433 - RNA, 21 nt, Human
ggugaccuuccaagagccuga

SEQ ID NO: 3041434 - RNA, 20 nt, Human
ggugaccuuccaagagccug

SEQ ID NO: 3041435 - RNA, 15 nt, Human
ggggcgcggcuggga

SEQ ID NO: 3041436 - RNA, 16 nt, Human
ggggcgcggcugggag

SEQ ID NO: 3041437 - RNA, 18 nt, Human
ggggcagucugagagagg

SEQ ID NO: 3041438 - RNA, 15 nt, Human
ggggcagucugagag

SEQ ID NO: 3041439 - RNA, 19 nt, Human
ggggcagucugagagaggc

SEQ ID NO: 3041440 - RNA, 16 nt, Human
gggccugggcaggagg

SEQ ID NO: 3041441 - RNA, 17 nt, Human
gggccugggcaggaggg

SEQ ID NO: 3041442 - RNA, 15 nt, Human
ggggaaaagagauga

SEQ ID NO: 3041443 - RNA, 15 nt, Human
gggggagagggcugc

SEQ ID NO: 3041444 - RNA, 20 nt, Human
gggguggggggggugcuggg

SEQ ID NO: 3041445 - RNA, 18 nt, Human
ggggugcugggccccugc

SEQ ID NO: 3041446 - RNA, 20 nt, Human
gggucuugguuccagccugc

SEQ ID NO: 3041447 - RNA, 17 nt, Human
gggugcugggccccugc

SEQ ID NO: 3041448 - RNA, 20 nt, Human
uagugauuuuuaugccaccu

SEQ ID NO: 3041449 - RNA, 21 nt, Human
uagugauuuuuaugccaccug

SEQ ID NO: 3041450 - RNA, 22 nt, Human
uagugauuuuuaugccaccuga

SEQ ID NO: 3041451 - RNA, 13 nt, Human
uaggcuagggugg

SEQ ID NO: 3041452 - RNA, 21 nt, Human
uauaauucagaaggaucuuca

SEQ ID NO: 3041453 - RNA, 20 nt, Human
uauaauucacauuguauuca

SEQ ID NO: 3041454 - RNA, 16 nt, Human
uauacccagaaaguua

SEQ ID NO: 3041455 - RNA, 18 nt, Human
uauauaaguauucuaaau

SEQ ID NO: 3041456 - RNA, 13 nt, Human
uauauuuuaagac

SEQ ID NO: 3041457 - RNA, 14 nt, Human
uauauuuuaagacg

SEQ ID NO: 3041458 - RNA, 21 nt, Human
uauauuucccugaaggaacca

SEQ ID NO: 3041459 - RNA, 15 nt, Human
uaucagcacgugugg

SEQ ID NO: 3041460 - RNA, 17 nt, Human
uaucaugugaaaucauu

SEQ ID NO: 3041461 - RNA, 22 nt, Human
uaucaugugaaaucauucauuu

SEQ ID NO: 3041462 - RNA, 11 nt, Human
uagaugugugg

SEQ ID NO: 3041463 - RNA, 16 nt, Human
uagccccacaggaggu

SEQ ID NO: 3041464 - RNA, 14 nt, Human
uaggaauuguguuu

SEQ ID NO: 3041465 - RNA, 18 nt, Human
uaggaacugcugggcuug

SEQ ID NO: 3041466 - RNA, 15 nt, Human
uaggaacugcugggc

SEQ ID NO: 3041467 - RNA, 13 nt, Human
uaauuuugaaaaa

SEQ ID NO: 3041468 - RNA, 17 nt, Human
uaauuuugaaaaacugc

SEQ ID NO: 3041469 - RNA, 14 nt, Human
uacaggauuugaaa

SEQ ID NO: 3041470 - RNA, 17 nt, Human
uacagcccaccuggcuu

SEQ ID NO: 3041471 - RNA, 23 nt, Human
uacauuuggagacacaacuauuu

SEQ ID NO: 3041472 - RNA, 22 nt, Human
uacgaagaguauuuuugacaga

SEQ ID NO: 3041473 - RNA, 20 nt, Human
uacgaagaguauuuuugaca

SEQ ID NO: 3041474 - RNA, 23 nt, Human
uacgaagaguauuuuugacagaa

SEQ ID NO: 3041475 - RNA, 19 nt, Human
uaccuuugacaaagguaaa

SEQ ID NO: 3041476 - RNA, 17 nt, Human
uagaacagauaaucagu

SEQ ID NO: 3041477 - RNA, 20 nt, Human
uacuugcucuugaugccugg

SEQ ID NO: 3041478 - RNA, 21 nt, Human
uacuugcucuugaugccuggc

SEQ ID NO: 3041479 - RNA, 14 nt, Human
uaaggcaaucaugg

SEQ ID NO: 3041480 - RNA, 15 nt, Human
uaaggcaaucauggu

SEQ ID NO: 3041481 - RNA, 19 nt, Human
uaagaucucagugguuaag

SEQ ID NO: 3041482 - RNA, 13 nt, Human
uaagaucucagug

SEQ ID NO: 3041483 - RNA, 15 nt, Human
uaagcaugcacaaau

SEQ ID NO: 3041484 - RNA, 19 nt, Human
uaauaaauauuuuugccau

SEQ ID NO: 3041485 - RNA, 15 nt, Human
uaauaacugugaagu

SEQ ID NO: 3041486 - RNA, 14 nt, Human
uaauauauuuccau

SEQ ID NO: 3041487 - RNA, 19 nt, Human
uaaugauaaguaaaugcua

SEQ ID NO: 3041488 - RNA, 19 nt, Human
uaauucuuugaccuguugg

SEQ ID NO: 3041489 - RNA, 23 nt, Human
uaauuaaauuuugaguucuacau

SEQ ID NO: 3041490 - RNA, 13 nt, Human
uaauuuuaagaaa

SEQ ID NO: 3041491 - RNA, 14 nt, Human
guuucuuuguaaug

SEQ ID NO: 3041492 - RNA, 17 nt, Human
guuucuuuguaaugaaa

SEQ ID NO: 3041493 - RNA, 16 nt, Human
guuuccuuauauuaug

SEQ ID NO: 3041494 - RNA, 19 nt, Human
gguugggagaaugucagua

SEQ ID NO: 3041495 - RNA, 13 nt, Human
guuuagcaguaua

SEQ ID NO: 3041496 - RNA, 16 nt, Human
guuuaguaaucauauu

SEQ ID NO: 3041497 - RNA, 12 nt, Human
uaaaaaacacug

SEQ ID NO: 3041498 - RNA, 15 nt, Human
uaaaaaagcugugug

SEQ ID NO: 3041499 - RNA, 11 nt, Human
uaaaaaacacu

SEQ ID NO: 3041500 - RNA, 14 nt, Human
uaaaguuuguugaa

SEQ ID NO: 3041501 - RNA, 17 nt, Human
uaaauaaaaauaauccu

SEQ ID NO: 3041502 - RNA, 14 nt, Human
uaaaggaauuuaaa

SEQ ID NO: 3041503 - RNA, 20 nt, Human
uaaacuuuuuucuuacuguc

SEQ ID NO: 3041504 - RNA, 20 nt, Human
uaaaucagacuaugaaguuu

SEQ ID NO: 3041505 - RNA, 16 nt, Human
uaaauauauuuuaaga

SEQ ID NO: 3041506 - RNA, 22 nt, Human
uaaauauauuuuaagacgaaac

SEQ ID NO: 3041507 - RNA, 18 nt, Human
uaaauauaugcuaagucu

SEQ ID NO: 3041508 - RNA, 22 nt, Human
uaaauaaaccucaaaaugucua

SEQ ID NO: 3041509 - RNA, 21 nt, Human
uaaacacucuugaaaaaugca

SEQ ID NO: 3041510 - RNA, 15 nt, Human
uaaaaugagaaaucu

SEQ ID NO: 3041511 - RNA, 16 nt, Human
uaaaaugagaaaucua

SEQ ID NO: 3041512 - RNA, 13 nt, Human
uaaaaugagaaau

SEQ ID NO: 3041513 - RNA, 17 nt, Human
uaaaagggacugagaaa

SEQ ID NO: 3041514 - RNA, 19 nt, Human
uaaaagggacugagaaauu

SEQ ID NO: 3041515 - RNA, 20 nt, Human
uaaaagggacugagaaauuu

SEQ ID NO: 3041516 - RNA, 21 nt, Human
uaaaagggacugagaaauuua

SEQ ID NO: 3041517 - RNA, 16 nt, Human
uaaaagaugcaaugua

SEQ ID NO: 3041518 - RNA, 18 nt, Human
ucacgccagacuucccac

SEQ ID NO: 3041519 - RNA, 22 nt, Human
ucagaguugaugguuguacaua

SEQ ID NO: 3041520 - RNA, 19 nt, Human
ucagaaaauauuauguguu

SEQ ID NO: 3041521 - RNA, 20 nt, Human
ucagaaaauauuauguguuu

SEQ ID NO: 3041522 - RNA, 17 nt, Human
ucagaaaauauuaugug

SEQ ID NO: 3041523 - RNA, 18 nt, Human
uauuugagaguucuaaau

SEQ ID NO: 3041524 - RNA, 19 nt, Human
uauuugagaguucuaaauu

SEQ ID NO: 3041525 - RNA, 15 nt, Human
uauuugagaguucua

SEQ ID NO: 3041526 - RNA, 16 nt, Human
uauuugagaguucuaa

SEQ ID NO: 3041527 - RNA, 15 nt, Human
uauuuuauguugcau

SEQ ID NO: 3041528 - RNA, 16 nt, Human
uauuuuauguugcaua

SEQ ID NO: 3041529 - RNA, 16 nt, Human
ucccccuccaccugcu

SEQ ID NO: 3041530 - RNA, 13 nt, Human
ucccuaauaaagc

SEQ ID NO: 3041531 - RNA, 11 nt, Human
ucccuaauaaa

SEQ ID NO: 3041532 - RNA, 12 nt, Human
ucccuaauaaag

SEQ ID NO: 3041533 - RNA, 22 nt, Human
uccccagacuccaccaagccug

SEQ ID NO: 3041534 - RNA, 17 nt, Human
uccaaagccaaugugaa

SEQ ID NO: 3041535 - RNA, 13 nt, Human
uccaagcaaaugu

SEQ ID NO: 3041536 - RNA, 16 nt, Human
ucauacauuguacgaa

SEQ ID NO: 3041537 - RNA, 15 nt, Human
ucauacauuguacga

SEQ ID NO: 3041538 - RNA, 13 nt, Human
ucauacauuguac

SEQ ID NO: 3041539 - RNA, 15 nt, Human
ucauaauuuauacag

SEQ ID NO: 3041540 - RNA, 15 nt, Human
ucauaauuauuauuu

SEQ ID NO: 3041541 - RNA, 13 nt, Human
ucaguuguacagu

SEQ ID NO: 3041542 - RNA, 16 nt, Human
uccuuaaggcucuuuu

SEQ ID NO: 3041543 - RNA, 19 nt, Human
uccuuaaggcucuuuugua

SEQ ID NO: 3041544 - RNA, 20 nt, Human
uccuucugugaaaguacauu

SEQ ID NO: 3041545 - RNA, 13 nt, Human
ucuaaauuugaau

SEQ ID NO: 3041546 - RNA, 17 nt, Human
ucuaaauuugaauguua

SEQ ID NO: 3041547 - RNA, 19 nt, Human
ucuaacaaaaaaauauauu

SEQ ID NO: 3041548 - RNA, 22 nt, Human
ucuaaauuugaauguuaagcag

SEQ ID NO: 3041549 - RNA, 23 nt, Human
ucuaaauuugaauguuaagcaga

SEQ ID NO: 3041550 - RNA, 23 nt, Human
ucuaaauuuuauaucuuguagcu

SEQ ID NO: 3041551 - RNA, 18 nt, Human
ucuaaauuuuauaucuug

SEQ ID NO: 3041552 - RNA, 21 nt, Human
ucucaaauuuggauugcuaau

SEQ ID NO: 3041553 - RNA, 17 nt, Human
ucuaguaugaaauuaua

SEQ ID NO: 3041554 - RNA, 15 nt, Human
ucuaguaugaaauua

SEQ ID NO: 3041555 - RNA, 11 nt, Human
ucucugcaggu

SEQ ID NO: 3041556 - RNA, 15 nt, Human
ucucucgugaguaua

SEQ ID NO: 3041557 - RNA, 22 nt, Human
ucucagugguuaagauuccuaa

SEQ ID NO: 3041558 - RNA, 19 nt, Human
ucuuuuguaagguuuuugu

SEQ ID NO: 3041559 - RNA, 22 nt, Human
ugaaaagaggugugcaagagag

SEQ ID NO: 3041560 - RNA, 13 nt, Human
ugaaaagaggugu

SEQ ID NO: 3041561 - RNA, 15 nt, Human
ugaaaucauucauuu

SEQ ID NO: 3041562 - RNA, 15 nt, Human
ugaacugagcuugga

SEQ ID NO: 3041563 - RNA, 12 nt, Human
ugaacugagcuu

SEQ ID NO: 3041564 - RNA, 16 nt, Human
ugaacugagcuuggaa

SEQ ID NO: 3041565 - RNA, 15 nt, Human
ucuugaacugagcuu

SEQ ID NO: 3041566 - RNA, 23 nt, Human
ucuggagcccacuguacuugcuc

SEQ ID NO: 3041567 - RNA, 13 nt, Human
ucugugugugugu

SEQ ID NO: 3041568 - RNA, 21 nt, Human
ucuguguguguguaugugggg

SEQ ID NO: 3041569 - RNA, 19 nt, Human
ucuguguguguguaugugg

SEQ ID NO: 3041570 - RNA, 18 nt, Human
ucuguguguguguaugug

SEQ ID NO: 3041571 - RNA, 15 nt, Human
ucuguguguguguau

SEQ ID NO: 3041572 - RNA, 20 nt, Human
ucuguguguuuaugugugug

SEQ ID NO: 3041573 - RNA, 19 nt, Human
ucuguguguuuaugugugu

SEQ ID NO: 3041574 - RNA, 22 nt, Human
ucuguguguguguauguggggg

SEQ ID NO: 3041575 - RNA, 16 nt, Human
ucuguguguuuaugug

SEQ ID NO: 3041576 - RNA, 15 nt, Human
ucuguguguuuaugu

SEQ ID NO: 3041577 - RNA, 18 nt, Human
ugcuucuaguucugccag

SEQ ID NO: 3041578 - RNA, 19 nt, Human
ugcuucuaguucugccagg

SEQ ID NO: 3041579 - RNA, 20 nt, Human
ugcuucuaguucugccagga

SEQ ID NO: 3041580 - RNA, 14 nt, Human
ugcuuuccaaagcc

SEQ ID NO: 3041581 - RNA, 21 nt, Human
uggaagugugggucugugugu

SEQ ID NO: 3041582 - RNA, 23 nt, Human
uggaagugugggucugugugugu

SEQ ID NO: 3041583 - RNA, 15 nt, Human
uggaauuauuuuaaa

SEQ ID NO: 3041584 - RNA, 17 nt, Human
uggaauuauuuuaaaag

SEQ ID NO: 3041585 - RNA, 13 nt, Human
uggagauguuuag

SEQ ID NO: 3041586 - RNA, 16 nt, Human
uggggcaggggccggg

SEQ ID NO: 3041587 - RNA, 18 nt, Human
uggggcaggggccggggg

SEQ ID NO: 3041588 - RNA, 19 nt, Human
ugggguggggggggugcug

SEQ ID NO: 3041589 - RNA, 21 nt, Human
ugggguggggggggugcuggg

SEQ ID NO: 3041590 - RNA, 22 nt, Human
ugggguggggggggugcugggc

SEQ ID NO: 3041591 - RNA, 17 nt, Human
ugcaggaaauggcugug

SEQ ID NO: 3041592 - RNA, 14 nt, Human
ugcucaggagcccu

SEQ ID NO: 3041593 - RNA, 16 nt, Human
ugcuagguuaauucca

SEQ ID NO: 3041594 - RNA, 23 nt, Human
ugcuagguuaauuccaauuauau

SEQ ID NO: 3041595 - RNA, 14 nt, Human
ugucacgccagacu

SEQ ID NO: 3041596 - RNA, 22 nt, Human
uguagcacugacagauuuccau

SEQ ID NO: 3041597 - RNA, 17 nt, Human
uguagcacugacagauu

SEQ ID NO: 3041598 - RNA, 16 nt, Human
uguagcacugacagau

SEQ ID NO: 3041599 - RNA, 17 nt, Human
uguagauaauacaguuc

SEQ ID NO: 3041600 - RNA, 20 nt, Human
uguaaaaugugaagugaaug

SEQ ID NO: 3041601 - RNA, 16 nt, Human
uguaaauuuaugugau

SEQ ID NO: 3041602 - RNA, 15 nt, Human
uguaaauuuauguga

SEQ ID NO: 3041603 - RNA, 16 nt, Human
ugugaaucauuuuacc

SEQ ID NO: 3041604 - RNA, 14 nt, Human
ugugcaagagaggg

SEQ ID NO: 3041605 - RNA, 18 nt, Human
ugugaggggcucucucau

SEQ ID NO: 3041606 - RNA, 14 nt, Human
ugucuuuuuucuaa

SEQ ID NO: 3041607 - RNA, 20 nt, Human
ugugaaguuuacauuguaaa

SEQ ID NO: 3041608 - RNA, 14 nt, Human
ugugaaguuuacau

SEQ ID NO: 3041609 - RNA, 13 nt, Human
ugugaaacauguu

SEQ ID NO: 3041610 - RNA, 14 nt, Human
ugucuggcugcaga

SEQ ID NO: 3041611 - RNA, 17 nt, Human
ugucuggcugcagagca

SEQ ID NO: 3041612 - RNA, 16 nt, Human
ugucuggcugcagagc

SEQ ID NO: 3041613 - RNA, 19 nt, Human
uguggaaaagccaagaggc

SEQ ID NO: 3041614 - RNA, 23 nt, Human
uguggaaaagccaagaggcugca

SEQ ID NO: 3041615 - RNA, 21 nt, Human
uguggaaaagccaagaggcug

SEQ ID NO: 3041616 - RNA, 20 nt, Human
ugugggucugugugugugua

SEQ ID NO: 3041617 - RNA, 16 nt, Human
ugugggucugugugug

SEQ ID NO: 3041618 - RNA, 14 nt, Human
ugugggucugugug

SEQ ID NO: 3041619 - RNA, 16 nt, Human
ugugggggucugugug

SEQ ID NO: 3041620 - RNA, 13 nt, Human
uguguaugugggg

SEQ ID NO: 3041621 - RNA, 14 nt, Human
uguguauguggggg

SEQ ID NO: 3041622 - RNA, 23 nt, Human
uguguaugugggggucugugugu

SEQ ID NO: 3041623 - RNA, 11 nt, Human
uguguguaugu

SEQ ID NO: 3041624 - RNA, 15 nt, Human
uguguuuaugugugu

SEQ ID NO: 3041625 - RNA, 13 nt, Human
uguguuuaugugu

SEQ ID NO: 3041626 - RNA, 22 nt, Human
uguguuuaggaacuacugagga

SEQ ID NO: 3041627 - RNA, 23 nt, Human
uguguugugugugggagugugua

SEQ ID NO: 3041628 - RNA, 14 nt, Human
uguguugugugugg

SEQ ID NO: 3041629 - RNA, 21 nt, Human
uguuuacagaggacaguauuu

SEQ ID NO: 3041630 - RNA, 14 nt, Human
uguuuacagaggac

SEQ ID NO: 3041631 - RNA, 12 nt, Human
uguucuauagcu

SEQ ID NO: 3041632 - RNA, 13 nt, Human
uguucauaaauaa

SEQ ID NO: 3041633 - RNA, 22 nt, Human
uuaaugucaauucuugccaaau

SEQ ID NO: 3041634 - RNA, 15 nt, Human
uuacagaggacagua

SEQ ID NO: 3041635 - RNA, 14 nt, Human
uuacauuuccuaaa

SEQ ID NO: 3041636 - RNA, 18 nt, Human
uuaaaagauaaauauuau

SEQ ID NO: 3041637 - RNA, 14 nt, Human
uuaaagacuuuuau

SEQ ID NO: 3041638 - RNA, 18 nt, Human
uguuuuaaaaugagaaau

SEQ ID NO: 3041639 - RNA, 12 nt, Human
uguuuuaaaaaa

SEQ ID NO: 3041640 - RNA, 23 nt, Human
uguuuuaaaaugagaaaucuaaa

SEQ ID NO: 3041641 - RNA, 20 nt, Human
uuggcaaacucuccaccaca

SEQ ID NO: 3041642 - RNA, 16 nt, Human
uuggcaaacucuccac

SEQ ID NO: 3041643 - RNA, 17 nt, Human
uuggauucugagagcug

SEQ ID NO: 3041644 - RNA, 15 nt, Human
uuggauucugagagc

SEQ ID NO: 3041645 - RNA, 19 nt, Human
uuggguggggggcuucaua

SEQ ID NO: 3041646 - RNA, 17 nt, Human
uuggguggggggcuuca

SEQ ID NO: 3041647 - RNA, 22 nt, Human
uuggguggggggcuucauacac

SEQ ID NO: 3041648 - RNA, 21 nt, Human
uuggguggggggcuucauaca

SEQ ID NO: 3041649 - RNA, 20 nt, Human
uuggguggggggcuucauac

SEQ ID NO: 3041650 - RNA, 12 nt, Human
uugguaaaccuu

SEQ ID NO: 3041651 - RNA, 14 nt, Human
uugguaaaccuuuu

SEQ ID NO: 3041652 - RNA, 23 nt, Human
uuggcaaacucuccaccacacgu

SEQ ID NO: 3041653 - RNA, 14 nt, Human
uuguauucagaguu

SEQ ID NO: 3041654 - RNA, 14 nt, Human
uuguauuacaaauc

SEQ ID NO: 3041655 - RNA, 16 nt, Human
uuguaaaggaauuuaa

SEQ ID NO: 3041656 - RNA, 18 nt, Human
uuguaaauaaaggaacca

SEQ ID NO: 3041657 - RNA, 14 nt, Human
uucugagcauuuaa

SEQ ID NO: 3041658 - RNA, 15 nt, Human
uugaaucucauaauu

SEQ ID NO: 3041659 - RNA, 21 nt, Human
uugaaucucauaauuuauaca

SEQ ID NO: 3041660 - RNA, 16 nt, Human
uugaacugagcuugga

SEQ ID NO: 3041661 - RNA, 15 nt, Human
uugaacugagcuugg

SEQ ID NO: 3041662 - RNA, 15 nt, Human
uugaaaaaugcaugu

SEQ ID NO: 3041663 - RNA, 14 nt, Human
uugcauagaauaaa

SEQ ID NO: 3041664 - RNA, 18 nt, Human
uugaauguaugcuucaua

SEQ ID NO: 3041665 - RNA, 14 nt, Human
uucacucuuggagc

SEQ ID NO: 3041666 - RNA, 19 nt, Human
uucacucuuggagccugca

SEQ ID NO: 3041667 - RNA, 18 nt, Human
uucacucuuggagccugc

SEQ ID NO: 3041668 - RNA, 23 nt, Human
uucaaauuguaagcaugcacaaa

SEQ ID NO: 3041669 - RNA, 16 nt, Human
uuccagccugccacuc

SEQ ID NO: 3041670 - RNA, 21 nt, Human
uuccauccuagucacuaccuu

SEQ ID NO: 3041671 - RNA, 14 nt, Human
uuccagccugccac

SEQ ID NO: 3041672 - RNA, 12 nt, Human
uuccagccugcc

SEQ ID NO: 3041673 - RNA, 17 nt, Human
uucaucugacuaugaca

SEQ ID NO: 3041674 - RNA, 20 nt, Human
uucaucugacuaugacauaa

SEQ ID NO: 3041675 - RNA, 15 nt, Human
uucaucuaggauuuu

SEQ ID NO: 3041676 - RNA, 22 nt, Human
uuccuagccaccgccuccuaca

SEQ ID NO: 3041677 - RNA, 20 nt, Human
uuccuagguauaauucacau

SEQ ID NO: 3041678 - RNA, 14 nt, Human
uuccuagccaccgc

SEQ ID NO: 3041679 - RNA, 21 nt, Human
uuccuagccaccgccuccuac

SEQ ID NO: 3041680 - RNA, 15 nt, Human
uuccuagccaccgcc

SEQ ID NO: 3041681 - RNA, 17 nt, Human
uuccuucugugaaagua

SEQ ID NO: 3041682 - RNA, 20 nt, Human
uuccuucugugaaaguacau

SEQ ID NO: 3041683 - RNA, 20 nt, Human
uuuuuuauacaggaugauga

SEQ ID NO: 3041684 - RNA, 13 nt, Human
uuuugaaaaacug

SEQ ID NO: 3041685 - RNA, 22 nt, Human
uuuaugauacuugaaaauuaac

SEQ ID NO: 3041686 - RNA, 14 nt, Human
uuuaugcauauuau

SEQ ID NO: 3041687 - RNA, 15 nt, Human
uuuacauuguaaaua

SEQ ID NO: 3041688 - RNA, 13 nt, Human
uuuacauuguaaa

SEQ ID NO: 3041689 - RNA, 17 nt, Human
uuuagaagaaguguguc

SEQ ID NO: 3041690 - RNA, 19 nt, Human
uuuagaagaagugugucac

SEQ ID NO: 3041691 - RNA, 14 nt, Human
uuuccaaaauaauu

SEQ ID NO: 3041692 - RNA, 15 nt, Human
uuucagcagcugcag

SEQ ID NO: 3041693 - RNA, 16 nt, Human
uuuuaugauacuugaa

SEQ ID NO: 3041694 - RNA, 20 nt, Human
uuuuaugauacuugaaaauu

SEQ ID NO: 3041695 - RNA, 14 nt, Human
uuuuacuguacaga

SEQ ID NO: 3041696 - RNA, 22 nt, Human
uuuuaaaaugagaaaucuaaaa

SEQ ID NO: 3041697 - RNA, 15 nt, Human
uuuuaaaaugagaaa

SEQ ID NO: 3041698 - RNA, 16 nt, Human
uuuucagaaaauauua

SEQ ID NO: 3041699 - RNA, 15 nt, Human
uuuucagaaaauauu

SEQ ID NO: 3041700 - RNA, 13 nt, Human
uuuucacauaucu

SEQ ID NO: 3041701 - RNA, 16 nt, Human
uuuucacauaucuagu

SEQ ID NO: 3041702 - RNA, 13 nt, Human
uuuguucauacau

SEQ ID NO: 3041703 - RNA, 16 nt, Human
uuuguucauacauauu

SEQ ID NO: 3041704 - RNA, 22 nt, Human
uuucuuacugucuuuuuucuaa

SEQ ID NO: 3041705 - RNA, 16 nt, Human
uuugagguggaagagg

SEQ ID NO: 3041706 - RNA, 23 nt, Human
uuuggaacaagaugguucuagca

SEQ ID NO: 3041707 - RNA, 19 nt, Human
uuugcauaacguauaaaag

SEQ ID NO: 3041708 - RNA, 23 nt, Human
uuugcauaacguauaaaagccug

SEQ ID NO: 3041709 - RNA, 13 nt, Human
uuuuuucuuacug

SEQ ID NO: 3041710 - RNA, 17 nt, Human
gcggcugggaggagggc

SEQ ID NO: 3041711 - RNA, 18 nt, Human
gcggcugggaggagggca

SEQ ID NO: 3041712 - RNA, 19 nt, Human
gcggcugggaggagggcag

SEQ ID NO: 3041713 - RNA, 22 nt, Human
gcggcugggaggagggcaggca

SEQ ID NO: 3041714 - RNA, 13 nt, Human
gcggcugggagga

SEQ ID NO: 3041715 - RNA, 14 nt, Human
gcggcugggaggag

SEQ ID NO: 3041716 - RNA, 18 nt, Human
gcuaauuuugaaaaacug

SEQ ID NO: 3041717 - RNA, 18 nt, Human
gcuacuguaaggcaauca

SEQ ID NO: 3041718 - RNA, 19 nt, Human
gcuacuguaaggcaaucau

SEQ ID NO: 3041719 - RNA, 11 nt, Human
gcccuaucugu

SEQ ID NO: 3041720 - RNA, 17 nt, Human
gccccugccucucugca

SEQ ID NO: 3041721 - RNA, 18 nt, Human
gccccugccucucugcag

SEQ ID NO: 3041722 - RNA, 15 nt, Human
gccccugccucucug

SEQ ID NO: 3041723 - RNA, 16 nt, Human
gccccugccucucugc

SEQ ID NO: 3041724 - RNA, 23 nt, Human
gccaguggcuggaucugugaggg

SEQ ID NO: 3041725 - RNA, 14 nt, Human
gccaguggcuggau

SEQ ID NO: 3041726 - RNA, 14 nt, Human
gccaggauggaaug

SEQ ID NO: 3041727 - RNA, 18 nt, Human
gcuccucgagaucccaac

SEQ ID NO: 3041728 - RNA, 15 nt, Human
gcucuggagcccacu

SEQ ID NO: 3041729 - RNA, 16 nt, Human
gcucuggagcccacug

SEQ ID NO: 3041730 - RNA, 14 nt, Human
gcugaggccucuca

SEQ ID NO: 3041731 - RNA, 17 nt, Human
gcucuggagcccacugu

SEQ ID NO: 3041732 - RNA, 17 nt, Human
gcucugugcccacccuc

SEQ ID NO: 3041733 - RNA, 13 nt, Human
gcugcuccccacg

SEQ ID NO: 3041734 - RNA, 22 nt, Human
gcugcuccccacgucagcuggg

SEQ ID NO: 3041735 - RNA, 20 nt, Human
gcugcagagcagugggccug

SEQ ID NO: 3041736 - RNA, 21 nt, Human
gcugcagagcagugggccugg

SEQ ID NO: 3041737 - RNA, 19 nt, Human
gcuuuccucaucaggccau

SEQ ID NO: 3041738 - RNA, 22 nt, Human
gcuuugagguggaagagggcug

SEQ ID NO: 3041739 - RNA, 19 nt, Human
gcuuugagguggaagaggg

SEQ ID NO: 3041740 - RNA, 13 nt, Human
gcuggaucuguga

SEQ ID NO: 3041741 - RNA, 20 nt, Human
gcuguagacauuugcuauga

SEQ ID NO: 3041742 - RNA, 16 nt, Human
gcuucaaauuguaagc

SEQ ID NO: 3041743 - RNA, 15 nt, Human
ggaacugcugggcuu

SEQ ID NO: 3041744 - RNA, 14 nt, Human
ggaacugcugggcu

SEQ ID NO: 3041745 - RNA, 15 nt, Human
gcuuuuuuaucaugu

SEQ ID NO: 3041746 - RNA, 18 nt, Human
gcuuuuuuaucaugugaa

SEQ ID NO: 3041747 - RNA, 20 nt, Human
gcuuuuuuaucaugugaaau

SEQ ID NO: 3041748 - RNA, 22 nt, Human
ggcgaagcguuguccucagccc

SEQ ID NO: 3041749 - RNA, 16 nt, Human
ggccuugaguccccca

SEQ ID NO: 3041750 - RNA, 20 nt, Human
ggccuguggaucaaauccag

SEQ ID NO: 3041751 - RNA, 22 nt, Human
ggcauccagagucccugccugg

SEQ ID NO: 3041752 - RNA, 18 nt, Human
ggcauuuuacuguacaga

SEQ ID NO: 3041753 - RNA, 17 nt, Human
ggcauauuuuucacaua

SEQ ID NO: 3041754 - RNA, 15 nt, Human
ggcauauuuuucaca

SEQ ID NO: 3041755 - RNA, 15 nt, Human
ggcacuggggcaggg

SEQ ID NO: 3041756 - RNA, 19 nt, Human
ggccaguggcuggaucugu

SEQ ID NO: 3041757 - RNA, 17 nt, Human
ggcccugugccuuggug

SEQ ID NO: 3041758 - RNA, 13 nt, Human
ggcacagccuggc

SEQ ID NO: 3041759 - RNA, 12 nt, Human
ggcacagccugg

SEQ ID NO: 3041760 - RNA, 22 nt, Human
ggaucuucaucugacuaugaca

SEQ ID NO: 3041761 - RNA, 22 nt, Human
ggagcccacuguacuugcucuu

SEQ ID NO: 3041762 - RNA, 21 nt, Human
ggagguagcuuugagguggaa

SEQ ID NO: 3041763 - RNA, 14 nt, Human
aaaagggaggggga

SEQ ID NO: 3041764 - RNA, 19 nt, Human
aaaagggacugagaaauuu

SEQ ID NO: 3041765 - RNA, 15 nt, Human
gggauugggccccug

SEQ ID NO: 3041766 - RNA, 15 nt, Human
aaaagaugcaaugua

SEQ ID NO: 3041767 - RNA, 19 nt, Human
gggagaaugucaguaugug

SEQ ID NO: 3041768 - RNA, 22 nt, Human
gggagaaugucaguauguggaa

SEQ ID NO: 3041769 - RNA, 22 nt, Human
gggaggcucuggagcccacugu

SEQ ID NO: 3041770 - RNA, 14 nt, Human
gggaugucucucau

SEQ ID NO: 3041771 - RNA, 16 nt, Human
gggaugguguucaaaa

SEQ ID NO: 3041772 - RNA, 15 nt, Human
aaaacccagauaaag

SEQ ID NO: 3041773 - RNA, 19 nt, Human
aaaaauauauuuaaugaua

SEQ ID NO: 3041774 - RNA, 13 nt, Human
aaaaauauauuua

SEQ ID NO: 3041775 - RNA, 15 nt, Human
aaaaauauauuuaau

SEQ ID NO: 3041776 - RNA, 22 nt, Human
gggcccuggugguggcucggga

SEQ ID NO: 3041777 - RNA, 13 nt, Human
gggccaggcuggg

SEQ ID NO: 3041778 - RNA, 21 nt, Human
gggccaggcugggucgcccug

SEQ ID NO: 3041779 - RNA, 14 nt, Human
gggccaggcugggu

SEQ ID NO: 3041780 - RNA, 15 nt, Human
gggccaggcuggguc

SEQ ID NO: 3041781 - RNA, 18 nt, Human
gggccagucccugaggca

SEQ ID NO: 3041782 - RNA, 21 nt, Human
gggccagucccugaggcaggu

SEQ ID NO: 3041783 - RNA, 12 nt, Human
aaaaugugaagu

SEQ ID NO: 3041784 - RNA, 18 nt, Human
gggcucagagugggguag

SEQ ID NO: 3041785 - RNA, 20 nt, Human
aaacaagcacuaaacaaaga

SEQ ID NO: 3041786 - RNA, 17 nt, Human
aaacaccggguuccagc

SEQ ID NO: 3041787 - RNA, 23 nt, Human
ggguguccugcaccggggccugg

SEQ ID NO: 3041788 - RNA, 15 nt, Human
ggguggggggggugc

SEQ ID NO: 3041789 - RNA, 18 nt, Human
ggguggggggggugcugg

SEQ ID NO: 3041790 - RNA, 17 nt, Human
gguagcuuugaggugga

SEQ ID NO: 3041791 - RNA, 21 nt, Human
ggugcuucuaguucugccagg

SEQ ID NO: 3041792 - RNA, 17 nt, Human
aaagcaggcagaacuca

SEQ ID NO: 3041793 - RNA, 19 nt, Human
aaagcaggcagaacucauc

SEQ ID NO: 3041794 - RNA, 21 nt, Human
ggucuguguguguguaugugg

SEQ ID NO: 3041795 - RNA, 20 nt, Human
ggucuguguguguguaugug

SEQ ID NO: 3041796 - RNA, 20 nt, Human
ggugcugggccccugccucu

SEQ ID NO: 3041797 - RNA, 19 nt, Human
ggugcugggccccugccuc

SEQ ID NO: 3041798 - RNA, 20 nt, Human
ggucgcccuggacugugugc

SEQ ID NO: 3041799 - RNA, 17 nt, Human
ggucuguguguguguau

SEQ ID NO: 3041800 - RNA, 11 nt, Human
ggucugugugu

SEQ ID NO: 3041801 - RNA, 13 nt, Human
aaagauuuucaga

SEQ ID NO: 3041802 - RNA, 16 nt, Human
aaaguuuguugaaaca

SEQ ID NO: 3041803 - RNA, 23 nt, Human
aaaguuauugauaaguucauaca

SEQ ID NO: 3041804 - RNA, 17 nt, Human
guaacaaugaagauaaa

SEQ ID NO: 3041805 - RNA, 17 nt, Human
guaaauuuaugugaugg

SEQ ID NO: 3041806 - RNA, 16 nt, Human
guaaauuuaugugaug

SEQ ID NO: 3041807 - RNA, 12 nt, Human
guaaaaugugaa

SEQ ID NO: 3041808 - RNA, 19 nt, Human
guaaaaugugaagugaaug

SEQ ID NO: 3041809 - RNA, 20 nt, Human
guaaaaugugaagugaauga

SEQ ID NO: 3041810 - RNA, 22 nt, Human
guaaaaugugaagugaaugaaa

SEQ ID NO: 3041811 - RNA, 17 nt, Human
gguggggggggugcugg

SEQ ID NO: 3041812 - RNA, 16 nt, Human
aaagccuguuuaagag

SEQ ID NO: 3041813 - RNA, 18 nt, Human
aaagccuguuuaagagac

SEQ ID NO: 3041814 - RNA, 12 nt, Human
gaucccaacacu

SEQ ID NO: 3041815 - RNA, 16 nt, Human
gaucccaacacugcca

SEQ ID NO: 3041816 - RNA, 23 nt, Human
gaucucagugguuaagauuccua

SEQ ID NO: 3041817 - RNA, 18 nt, Human
gauuacugccuauuuuaa

SEQ ID NO: 3041818 - RNA, 13 nt, Human
gaguccaucagcc

SEQ ID NO: 3041819 - RNA, 14 nt, Human
gaguccaucagccu

SEQ ID NO: 3041820 - RNA, 15 nt, Human
gaguccaucagccuc

SEQ ID NO: 3041821 - RNA, 16 nt, Human
gaguccaucagccucc

SEQ ID NO: 3041822 - RNA, 18 nt, Human
gagugaggaugucugggc

SEQ ID NO: 3041823 - RNA, 14 nt, Human
gaguuuaggguggg

SEQ ID NO: 3041824 - RNA, 15 nt, Human
gaguuuagggugggg

SEQ ID NO: 3041825 - RNA, 16 nt, Human
gaguuuaaauuguaau

SEQ ID NO: 3041826 - RNA, 19 nt, Human
gaguggacuguucccugag

SEQ ID NO: 3041827 - RNA, 13 nt, Human
gaguuggcuggga

SEQ ID NO: 3041828 - RNA, 16 nt, Human
gauacuugaaaauuaa

SEQ ID NO: 3041829 - RNA, 20 nt, Human
gcaccggggccugggcagga

SEQ ID NO: 3041830 - RNA, 19 nt, Human
gcaccggggccugggcagg

SEQ ID NO: 3041831 - RNA, 13 nt, Human
gauucugagagcu

SEQ ID NO: 3041832 - RNA, 21 nt, Human
gcagagcagugggccuggcca

SEQ ID NO: 3041833 - RNA, 12 nt, Human
gcacugacagau

SEQ ID NO: 3041834 - RNA, 17 nt, Human
gcacugacagauuucca

SEQ ID NO: 3041835 - RNA, 22 nt, Human
gcauaacguauaaaagccuguu

SEQ ID NO: 3041836 - RNA, 16 nt, Human
gacagguuagcugcuc

SEQ ID NO: 3041837 - RNA, 15 nt, Human
gacaguauuuguggg

SEQ ID NO: 3041838 - RNA, 16 nt, Human
gacagaauauguuuca

SEQ ID NO: 3041839 - RNA, 23 nt, Human
gaauuuuaaaagaugcaauguag

SEQ ID NO: 3041840 - RNA, 21 nt, Human
gaauuuuaaaagaugcaaugu

SEQ ID NO: 3041841 - RNA, 15 nt, Human
gaauuuuaaaagaug

SEQ ID NO: 3041842 - RNA, 12 nt, Human
gaauuuuaaaag

SEQ ID NO: 3041843 - RNA, 20 nt, Human
gaauuugugaagguggaaau

SEQ ID NO: 3041844 - RNA, 19 nt, Human
gaagugugggucugugugu

SEQ ID NO: 3041845 - RNA, 18 nt, Human
gaagugugggucugugug

SEQ ID NO: 3041846 - RNA, 17 nt, Human
gaagugugggucugugu

SEQ ID NO: 3041847 - RNA, 15 nt, Human
gaaggcuauggggau

SEQ ID NO: 3041848 - RNA, 19 nt, Human
gaagggcagggcugaggcc

SEQ ID NO: 3041849 - RNA, 13 nt, Human
gacuaugacauaa

SEQ ID NO: 3041850 - RNA, 18 nt, Human
gacuuuugaaaagaggug

SEQ ID NO: 3041851 - RNA, 22 nt, Human
gagacguuuuuggaagaguagu

SEQ ID NO: 3041852 - RNA, 23 nt, Human
gagacuaaccccaccacacccuc

SEQ ID NO: 3041853 - RNA, 19 nt, Human
gagcuggggaugucucuca

SEQ ID NO: 3041854 - RNA, 19 nt, Human
gagaugaugaaaauauuua

SEQ ID NO: 3041855 - RNA, 20 nt, Human
gagaugaugaaaauauuuaa

SEQ ID NO: 3041856 - RNA, 14 nt, Human
gagauguagccccu

SEQ ID NO: 3041857 - RNA, 18 nt, Human
cuggggccaggcuggguc

SEQ ID NO: 3041858 - RNA, 22 nt, Human
cuggggaugucucucaugacca

SEQ ID NO: 3041859 - RNA, 17 nt, Human
cuggggaugucucucau

SEQ ID NO: 3041860 - RNA, 16 nt, Human
cuggggauugggcccc

SEQ ID NO: 3041861 - RNA, 22 nt, Human
cuggggauugggccccugccag

SEQ ID NO: 3041862 - RNA, 18 nt, Human
cuggggauugggccccug

SEQ ID NO: 3041863 - RNA, 16 nt, Human
cuggcuccaggccagg

SEQ ID NO: 3041864 - RNA, 17 nt, Human
cuggagacuaaccccac

SEQ ID NO: 3041865 - RNA, 16 nt, Human
cuggacugugugcuca

SEQ ID NO: 3041866 - RNA, 21 nt, Human
cuguacuugcucuugaugccu

SEQ ID NO: 3041867 - RNA, 22 nt, Human
cuguacuugcucuugaugccug

SEQ ID NO: 3041868 - RNA, 23 nt, Human
cuguacuugcucuugaugccugg

SEQ ID NO: 3041869 - RNA, 22 nt, Human
cugccaucauguuuacagagga

SEQ ID NO: 3041870 - RNA, 17 nt, Human
cugccaucauguuuaca

SEQ ID NO: 3041871 - RNA, 23 nt, Human
cugccaucauguuuacagaggac

SEQ ID NO: 3041872 - RNA, 18 nt, Human
cugcuuuuuauggccugu

SEQ ID NO: 3041873 - RNA, 13 nt, Human
cuggacugugugc

SEQ ID NO: 3041874 - RNA, 17 nt, Human
cugcuuuuuauggccug

SEQ ID NO: 3041875 - RNA, 12 nt, Human
cuugaugccugg

SEQ ID NO: 3041876 - RNA, 19 nt, Human
cuugacaaagucaagccac

SEQ ID NO: 3041877 - RNA, 16 nt, Human
cuugacaaagucaagc

SEQ ID NO: 3041878 - RNA, 20 nt, Human
cuucaugcauagguuuagca

SEQ ID NO: 3041879 - RNA, 22 nt, Human
cuucauacagggaugguguuca

SEQ ID NO: 3041880 - RNA, 13 nt, Human
cuucauacaggga

SEQ ID NO: 3041881 - RNA, 12 nt, Human
cuucauacaggg

SEQ ID NO: 3041882 - RNA, 19 nt, Human
cuucaucugacuaugacau

SEQ ID NO: 3041883 - RNA, 21 nt, Human
cuucaucugacuaugacauaa

SEQ ID NO: 3041884 - RNA, 10 nt, Human
cuucauacac

SEQ ID NO: 3041885 - RNA, 9 nt, Human
cuucauaca

SEQ ID NO: 3041886 - RNA, 15 nt, Human
cuucacuguaaaaua

SEQ ID NO: 3041887 - RNA, 18 nt, Human
cuuauuggcagcucuacu

SEQ ID NO: 3041888 - RNA, 15 nt, Human
cuuuuggcauuuuac

SEQ ID NO: 3041889 - RNA, 14 nt, Human
cuuuuaugugaaac

SEQ ID NO: 3041890 - RNA, 20 nt, Human
cccugugccuugucacgcca

SEQ ID NO: 3041891 - RNA, 22 nt, Human
cccugugccuugucacgccaga

SEQ ID NO: 3041892 - RNA, 15 nt, Human
cccugugccuuguca

SEQ ID NO: 3041893 - RNA, 24 nt, Human
cccugugccuuggugugcuguauc

SEQ ID NO: 3041894 - RNA, 16 nt, Human
cccuggcuccaggcca

SEQ ID NO: 3041895 - RNA, 13 nt, Human
cccuggcuccagg

SEQ ID NO: 3041896 - RNA, 15 nt, Human
ccuauuuuaauaaac

SEQ ID NO: 3041897 - RNA, 16 nt, Human
ccguagguuauuuuca

SEQ ID NO: 3041898 - RNA, 13 nt, Human
ccuaauaaagcug

SEQ ID NO: 3041899 - RNA, 14 nt, Human
ccuaauaaagcugu

SEQ ID NO: 3041900 - RNA, 23 nt, Human
ccuaauaaagcuguguggcaguc

SEQ ID NO: 3041901 - RNA, 22 nt, Human
ccugacccucaucuuucuucca

SEQ ID NO: 3041902 - RNA, 14 nt, Human
ccugacucucagca

SEQ ID NO: 3041903 - RNA, 22 nt, Human
ccugaguaaaaaagcugugugc

SEQ ID NO: 3041904 - RNA, 13 nt, Human
ccucucugcaggu

SEQ ID NO: 3041905 - RNA, 20 nt, Human
ccucucugcaggucccuaau

SEQ ID NO: 3041906 - RNA, 15 nt, Human
ccucucugcaggucc

SEQ ID NO: 3041907 - RNA, 23 nt, Human
ccucucugcaggucccuaauaaa

SEQ ID NO: 3041908 - RNA, 21 nt, Human
ccucucugcaggucccuaaua

SEQ ID NO: 3041909 - RNA, 22 nt, Human
ccucucugcaggucccuaauaa

SEQ ID NO: 3041910 - RNA, 12 nt, Human
ccaugagcuccu

SEQ ID NO: 3041911 - RNA, 15 nt, Human
ccaguucagcuuggg

SEQ ID NO: 3041912 - RNA, 17 nt, Human
ccagagucccugccugg

SEQ ID NO: 3041913 - RNA, 18 nt, Human
ccagagucccugccugga

SEQ ID NO: 3041914 - RNA, 19 nt, Human
ccagagucccugccuggac

SEQ ID NO: 3041915 - RNA, 22 nt, Human
ccagagucccugccuggaccag

SEQ ID NO: 3041916 - RNA, 16 nt, Human
ccagagucccugccug

SEQ ID NO: 3041917 - RNA, 14 nt, Human
cccgggagcucagg

SEQ ID NO: 3041918 - RNA, 14 nt, Human
ccccgacuuuuguu

SEQ ID NO: 3041919 - RNA, 20 nt, Human
ccccagacuccaccaagccu

SEQ ID NO: 3041920 - RNA, 21 nt, Human
ccccagacuccaccaagccug

SEQ ID NO: 3041921 - RNA, 16 nt, Human
cucaucuuucuuccaa

SEQ ID NO: 3041922 - RNA, 16 nt, Human
cuccaaagucucugga

SEQ ID NO: 3041923 - RNA, 16 nt, Human
cucaggcccaaagccu

SEQ ID NO: 3041924 - RNA, 14 nt, Human
cucccuccucugcc

SEQ ID NO: 3041925 - RNA, 13 nt, Human
cucccuccucugc

SEQ ID NO: 3041926 - RNA, 14 nt, Human
cucuuggagccugc

SEQ ID NO: 3041927 - RNA, 23 nt, Human
cggcuccucgagaucccaacacu

SEQ ID NO: 3041928 - RNA, 19 nt, Human
cuaaccugccgagagucca

SEQ ID NO: 3041929 - RNA, 21 nt, Human
cuaaccugccgagaguccauc

SEQ ID NO: 3041930 - RNA, 12 nt, Human
cuaaccugccga

SEQ ID NO: 3041931 - RNA, 14 nt, Human
cgugucuggcacag

SEQ ID NO: 3041932 - RNA, 13 nt, Human
cgugucuggcaca

SEQ ID NO: 3041933 - RNA, 21 nt, Human
cgugucuggcacagccuggcu

SEQ ID NO: 3041934 - RNA, 23 nt, Human
cuacauaaguaauucaagaaaac

SEQ ID NO: 3041935 - RNA, 22 nt, Human
cuacauaaguaauucaagaaaa

SEQ ID NO: 3041936 - RNA, 18 nt, Human
cuagccaccgccuccuac

SEQ ID NO: 3041937 - RNA, 13 nt, Human
auucuuucccaac

SEQ ID NO: 3041938 - RNA, 16 nt, Human
auucuuucccaacacc

SEQ ID NO: 3041939 - RNA, 19 nt, Human
auucuuucccaacaccucu

SEQ ID NO: 3041940 - RNA, 15 nt, Human
auucuugaaggaaaa

SEQ ID NO: 3041941 - RNA, 18 nt, Human
auucuugaaggaaaauga

SEQ ID NO: 3041942 - RNA, 22 nt, Human
auugauaaguucauacauugua

SEQ ID NO: 3041943 - RNA, 23 nt, Human
auuguaauaggcguaacuaauuu

SEQ ID NO: 3041944 - RNA, 14 nt, Human
auuguaaauaguau

SEQ ID NO: 3041945 - RNA, 21 nt, Human
auucauaauuauuauuuggcc

SEQ ID NO: 3041946 - RNA, 14 nt, Human
caaacaggcucaga

SEQ ID NO: 3041947 - RNA, 15 nt, Human
caaacaggcucagag

SEQ ID NO: 3041948 - RNA, 22 nt, Human
caaagguaaaucagacuaugaa

SEQ ID NO: 3041949 - RNA, 21 nt, Human
caaagucucuggaauuugaaa

SEQ ID NO: 3041950 - RNA, 17 nt, Human
caacaaucccaaggccc

SEQ ID NO: 3041951 - RNA, 14 nt, Human
caacacuaacauga

SEQ ID NO: 3041952 - RNA, 20 nt, Human
auuugcuaugagcuggggau

SEQ ID NO: 3041953 - RNA, 16 nt, Human
auuugcuaugagcugg

SEQ ID NO: 3041954 - RNA, 19 nt, Human
auuuuauagcuacuaauuu

SEQ ID NO: 3041955 - RNA, 17 nt, Human
auuuuauagcuacuaau

SEQ ID NO: 3041956 - RNA, 22 nt, Human
auuuguggggagggauuugggg

SEQ ID NO: 3041957 - RNA, 19 nt, Human
cacuggggcaggggccggg

SEQ ID NO: 3041958 - RNA, 18 nt, Human
cacugggagaaaugaaaa

SEQ ID NO: 3041959 - RNA, 18 nt, Human
cacugccagcauuucccu

SEQ ID NO: 3041960 - RNA, 22 nt, Human
cacugccagcauuucccuuccu

SEQ ID NO: 3041961 - RNA, 23 nt, Human
cacucuuggagccugcagagcug

SEQ ID NO: 3041962 - RNA, 22 nt, Human
cacucuuggagccugcagagcu

SEQ ID NO: 3041963 - RNA, 21 nt, Human
cacucuuggagccugcagagc

SEQ ID NO: 3041964 - RNA, 11 nt, Human
cacugacagau

SEQ ID NO: 3041965 - RNA, 15 nt, Human
caauucuugccaaau

SEQ ID NO: 3041966 - RNA, 24 nt, Human
cagccccgcguggaacucgugucu

SEQ ID NO: 3041967 - RNA, 24 nt, Human
cagccucuccacucaugugacucu

SEQ ID NO: 3041968 - RNA, 18 nt, Human
cagcggcuggacuuggag

SEQ ID NO: 3041969 - RNA, 16 nt, Human
cagcggcuggacuugg

SEQ ID NO: 3041970 - RNA, 17 nt, Human
cagcggcuggaauuggg

SEQ ID NO: 3041971 - RNA, 17 nt, Human
cagccugccacucaggc

SEQ ID NO: 3041972 - RNA, 16 nt, Human
cagccugccacucagg

SEQ ID NO: 3041973 - RNA, 12 nt, Human
cagccugccacu

SEQ ID NO: 3041974 - RNA, 11 nt, Human
cagccugccac

SEQ ID NO: 3041975 - RNA, 16 nt, Human
cagagcugcgggcugg

SEQ ID NO: 3041976 - RNA, 23 nt, Human
cagaucauuaucagccugugcca

SEQ ID NO: 3041977 - RNA, 22 nt, Human
cagaucauugugaaauuauuca

SEQ ID NO: 3041978 - RNA, 16 nt, Human
cagaucauugugaaau

SEQ ID NO: 3041979 - RNA, 15 nt, Human
caguauuugugggga

SEQ ID NO: 3041980 - RNA, 22 nt, Human
ccaaaugagggucuugguucca

SEQ ID NO: 3041981 - RNA, 18 nt, Human
ccaccagaagcccagaau

SEQ ID NO: 3041982 - RNA, 16 nt, Human
ccaccagaagcccaga

SEQ ID NO: 3041983 - RNA, 15 nt, Human
ccaccagaagcccag

SEQ ID NO: 3041984 - RNA, 14 nt, Human
ccaccagaagccca

SEQ ID NO: 3041985 - RNA, 13 nt, Human
ccaccagaagccc

SEQ ID NO: 3041986 - RNA, 12 nt, Human
ccaccagaagcc

SEQ ID NO: 3041987 - RNA, 11 nt, Human
ccaccagaagc

SEQ ID NO: 3041988 - RNA, 19 nt, Human
ccaaaaagauuuucagaaa

SEQ ID NO: 3041989 - RNA, 22 nt, Human
cauuggcucuugaacugagcuu

SEQ ID NO: 3041990 - RNA, 17 nt, Human
caguuuggcaaacucuc

SEQ ID NO: 3041991 - RNA, 14 nt, Human
caugaauuugugaa

SEQ ID NO: 3041992 - RNA, 17 nt, Human
gucuggcacagccuggc

SEQ ID NO: 3041993 - RNA, 19 nt, Human
gucuggcacagccuggcug

SEQ ID NO: 3041994 - RNA, 16 nt, Human
gucuuucacauuuaaa

SEQ ID NO: 3041995 - RNA, 22 nt, Human
aacucaucuagguaaauuacag

SEQ ID NO: 3041996 - RNA, 19 nt, Human
gucucccuccucugcccgg

SEQ ID NO: 3041997 - RNA, 20 nt, Human
aaccacauuggagauguuua

SEQ ID NO: 3041998 - RNA, 17 nt, Human
aaccaccagaagcccag

SEQ ID NO: 3041999 - RNA, 14 nt, Human
aaccaccagaagcc

SEQ ID NO: 3042000 - RNA, 20 nt, Human
aaccccuggcuccaggccag

SEQ ID NO: 3042001 - RNA, 17 nt, Human
aaccccccauuucuucc

SEQ ID NO: 3042002 - RNA, 14 nt, Human
aacccagauaaagg

SEQ ID NO: 3042003 - RNA, 12 nt, Human
gugcaagagagg

SEQ ID NO: 3042004 - RNA, 18 nt, Human
aacuucccagugaauucu

SEQ ID NO: 3042005 - RNA, 13 nt, Human
gucagaauagaaa

SEQ ID NO: 3042006 - RNA, 17 nt, Human
gucagaauagaaauuag

SEQ ID NO: 3042007 - RNA, 13 nt, Human
gucaguuguauca

SEQ ID NO: 3042008 - RNA, 17 nt, Human
gucaguauguggaagug

SEQ ID NO: 3042009 - RNA, 21 nt, Human
gucaguauguggaaguguggg

SEQ ID NO: 3042010 - RNA, 19 nt, Human
aacaagaugguucuagcau

SEQ ID NO: 3042011 - RNA, 12 nt, Human
aacaauaaaaga

SEQ ID NO: 3042012 - RNA, 13 nt, Human
aacagauaaucag

SEQ ID NO: 3042013 - RNA, 16 nt, Human
guauuuuugacagaau

SEQ ID NO: 3042014 - RNA, 15 nt, Human
guauuuuugacagaa

SEQ ID NO: 3042015 - RNA, 12 nt, Human
guauuuuugaca

SEQ ID NO: 3042016 - RNA, 17 nt, Human
gucaacacuaacaugau

SEQ ID NO: 3042017 - RNA, 16 nt, Human
aaauucugucucugga

SEQ ID NO: 3042018 - RNA, 20 nt, Human
aaauuguaagcaugcacaaa

SEQ ID NO: 3042019 - RNA, 19 nt, Human
aaauuguaagcaugcacaa

SEQ ID NO: 3042020 - RNA, 18 nt, Human
aaauucugucucuggauu

SEQ ID NO: 3042021 - RNA, 15 nt, Human
aaauuuaugugaugg

SEQ ID NO: 3042022 - RNA, 12 nt, Human
aaauuuauguga

SEQ ID NO: 3042023 - RNA, 12 nt, Human
aaauugugaugu

SEQ ID NO: 3042024 - RNA, 15 nt, Human
aaauugugauguguc

SEQ ID NO: 3042025 - RNA, 14 nt, Human
aaauuaagaaagga

SEQ ID NO: 3042026 - RNA, 18 nt, Human
guauaaaagggacugaga

SEQ ID NO: 3042027 - RNA, 21 nt, Human
guaugcuucauacagggaugg

SEQ ID NO: 3042028 - RNA, 15 nt, Human
guaugcuucauacag

SEQ ID NO: 3042029 - RNA, 14 nt, Human
guaugcuucauaca

SEQ ID NO: 3042030 - RNA, 13 nt, Human
guaugcuucauac

SEQ ID NO: 3042031 - RNA, 12 nt, Human
guaugcuucaua

SEQ ID NO: 3042032 - RNA, 19 nt, Human
guauaaaagggacugagaa

SEQ ID NO: 3042033 - RNA, 21 nt, Human
guggccuaaccugccgagagu

SEQ ID NO: 3042034 - RNA, 22 nt, Human
guggccuaaccugccgagaguc

SEQ ID NO: 3042035 - RNA, 21 nt, Human
aagaccuuuggagcaaagcug

SEQ ID NO: 3042036 - RNA, 23 nt, Human
aagaccuugcuuaugauugcaga

SEQ ID NO: 3042037 - RNA, 14 nt, Human
aagaggcugcagcc

SEQ ID NO: 3042038 - RNA, 19 nt, Human
gugggguagguugggagaa

SEQ ID NO: 3042039 - RNA, 18 nt, Human
aagaucucagugguuaag

SEQ ID NO: 3042040 - RNA, 14 nt, Human
gugugggucugugu

SEQ ID NO: 3042041 - RNA, 15 nt, Human
guguguauguggggg

SEQ ID NO: 3042042 - RNA, 13 nt, Human
guguguauguggg

SEQ ID NO: 3042043 - RNA, 20 nt, Human
gugugucacccuuaggccag

SEQ ID NO: 3042044 - RNA, 19 nt, Human
aagcccaguucagcuuggg

SEQ ID NO: 3042045 - RNA, 18 nt, Human
aagcccaguucagcuugg

SEQ ID NO: 3042046 - RNA, 22 nt, Human
aagccaagaggcugcagccagg

SEQ ID NO: 3042047 - RNA, 18 nt, Human
aagccaagaggcugcagc

SEQ ID NO: 3042048 - RNA, 17 nt, Human
aagccugcaauuucaua

SEQ ID NO: 3042049 - RNA, 22 nt, Human
aagccugcaauuucauaugcug

SEQ ID NO: 3042050 - RNA, 14 nt, Human
guuaagauuccuaa

SEQ ID NO: 3042051 - RNA, 18 nt, Human
guuauugauaaguucaua

SEQ ID NO: 3042052 - RNA, 20 nt, Human
guuauuauauuuacaaaugg

SEQ ID NO: 3042053 - RNA, 14 nt, Human
aaggcucuuuugua

SEQ ID NO: 3042054 - RNA, 16 nt, Human
aagggugaaaauuauu

SEQ ID NO: 3042055 - RNA, 15 nt, Human
aagggugaaaauuau

SEQ ID NO: 3042056 - RNA, 16 nt, Human
aaguaaggaauuuuau

SEQ ID NO: 3042057 - RNA, 12 nt, Human
guuucaaacuuu

SEQ ID NO: 3042058 - RNA, 15 nt, Human
guuuacaguguuccg

SEQ ID NO: 3042059 - RNA, 13 nt, Human
guuuacaguguuc

SEQ ID NO: 3042060 - RNA, 23 nt, Human
aaggaaccaaagcgaauuuuaaa

SEQ ID NO: 3042061 - RNA, 22 nt, Human
aaggaaccaaagcgaauuuuaa

SEQ ID NO: 3042062 - RNA, 13 nt, Human
aaggauaaugaau

SEQ ID NO: 3042063 - RNA, 22 nt, Human
aaggcccuaucuguuuacagug

SEQ ID NO: 3042064 - RNA, 21 nt, Human
uaaaaauaaaaaacacuggga

SEQ ID NO: 3042065 - RNA, 18 nt, Human
uaaaaauaaaaaacacug

SEQ ID NO: 3042066 - RNA, 19 nt, Human
uaaaaauaaaaaacacugg

SEQ ID NO: 3042067 - RNA, 12 nt, Human
uaaaagaauugu

SEQ ID NO: 3042068 - RNA, 20 nt, Human
uaaaagacagugaaagaaaa

SEQ ID NO: 3042069 - RNA, 15 nt, Human
guuuuucauaaagca

SEQ ID NO: 3042070 - RNA, 16 nt, Human
aagucuuucacauuua

SEQ ID NO: 3042071 - RNA, 22 nt, Human
aagucuuauauauuguagauaa

SEQ ID NO: 3042072 - RNA, 19 nt, Human
uaccagagaaaaagggagg

SEQ ID NO: 3042073 - RNA, 13 nt, Human
uacauuuccuaaa

SEQ ID NO: 3042074 - RNA, 17 nt, Human
uacagggaugguguuca

SEQ ID NO: 3042075 - RNA, 15 nt, Human
uacccccugugccuu

SEQ ID NO: 3042076 - RNA, 13 nt, Human
uaccucuuggcug

SEQ ID NO: 3042077 - RNA, 23 nt, Human
uaccugaagcuaucguaaaauua

SEQ ID NO: 3042078 - RNA, 22 nt, Human
aauuaugugccagauuuaugca

SEQ ID NO: 3042079 - RNA, 12 nt, Human
aauuauuuuaaa

SEQ ID NO: 3042080 - RNA, 15 nt, Human
aauuauuuuaaaaga

SEQ ID NO: 3042081 - RNA, 12 nt, Human
aauucaagaaaa

SEQ ID NO: 3042082 - RNA, 20 nt, Human
aauucaagaaaacaacuuca

SEQ ID NO: 3042083 - RNA, 15 nt, Human
aauucagaaggaucu

SEQ ID NO: 3042084 - RNA, 21 nt, Human
aauucagaaggaucuucaucu

SEQ ID NO: 3042085 - RNA, 16 nt, Human
uaauuuauacagguca

SEQ ID NO: 3042086 - RNA, 22 nt, Human
uaauuccguagguuauuuucag

SEQ ID NO: 3042087 - RNA, 20 nt, Human
uaauuuaaaauugugaugug

SEQ ID NO: 3042088 - RNA, 19 nt, Human
uaauuuaaaauugugaugu

SEQ ID NO: 3042089 - RNA, 12 nt, Human
aaugagaaaucu

SEQ ID NO: 3042090 - RNA, 22 nt, Human
aaugagaaaucuaaaaaacgaa

SEQ ID NO: 3042091 - RNA, 20 nt, Human
aaugacucagaauauugcuu

SEQ ID NO: 3042092 - RNA, 13 nt, Human
uacagaauuuuau

SEQ ID NO: 3042093 - RNA, 20 nt, Human
aauagagcaaaauugaugug

SEQ ID NO: 3042094 - RNA, 22 nt, Human
aauagagcaaaauugauguguu

SEQ ID NO: 3042095 - RNA, 17 nt, Human
uaacaaugaagauaaaa

SEQ ID NO: 3042096 - RNA, 14 nt, Human
uaacaugaauauuu

SEQ ID NO: 3042097 - RNA, 20 nt, Human
uaacaugaauauuuaguguu

SEQ ID NO: 3042098 - RNA, 21 nt, Human
uaacaugaauauuuaguguuc

SEQ ID NO: 3042099 - RNA, 19 nt, Human
uaacaugaauauuuagugu

SEQ ID NO: 3042100 - RNA, 18 nt, Human
aauauauuuuaagacgaa

SEQ ID NO: 3042101 - RNA, 14 nt, Human
aauauauuuaauga

SEQ ID NO: 3042102 - RNA, 21 nt, Human
aauauauuuuaagacgaaaca

SEQ ID NO: 3042103 - RNA, 21 nt, Human
aauauauucagccuggcuuca

SEQ ID NO: 3042104 - RNA, 13 nt, Human
uaacguauaaaag

SEQ ID NO: 3042105 - RNA, 17 nt, Human
uaacguauaaaagccug

SEQ ID NO: 3042106 - RNA, 14 nt, Human
aaucagugugucua

SEQ ID NO: 3042107 - RNA, 17 nt, Human
aaucagugugucuaaau

SEQ ID NO: 3042108 - RNA, 18 nt, Human
aaucagugugucuaaauu

SEQ ID NO: 3042109 - RNA, 22 nt, Human
aaucagugugucuaaauuugaa

SEQ ID NO: 3042110 - RNA, 20 nt, Human
aauccucaguuuuugugaaa

SEQ ID NO: 3042111 - RNA, 18 nt, Human
aaucuaugauuccaggug

SEQ ID NO: 3042112 - RNA, 15 nt, Human
aaucuaugauuccag

SEQ ID NO: 3042113 - RNA, 17 nt, Human
uaaguguguguuuuuca

SEQ ID NO: 3042114 - RNA, 16 nt, Human
uaaguaauucaagaaa

SEQ ID NO: 3042115 - RNA, 22 nt, Human
uaagcagauggaaugcuguguu

SEQ ID NO: 3042116 - RNA, 22 nt, Human
uaaggaauuuuauuuuuuucug

SEQ ID NO: 3042117 - RNA, 20 nt, Human
uaugccaccugaauaaagaa

SEQ ID NO: 3042118 - RNA, 17 nt, Human
uaugauacuugaaaauu

SEQ ID NO: 3042119 - RNA, 21 nt, Human
uaugguaggaacugcugggcu

SEQ ID NO: 3042120 - RNA, 18 nt, Human
acagcggcuggacuugga

SEQ ID NO: 3042121 - RNA, 23 nt, Human
uaugaagcuuuuaugugaaacau

SEQ ID NO: 3042122 - RNA, 20 nt, Human
uaugaagcuuuuaugugaaa

SEQ ID NO: 3042123 - RNA, 22 nt, Human
uaugaagcuuuuaugugaaaca

SEQ ID NO: 3042124 - RNA, 19 nt, Human
uaucaaagggugaaaauua

SEQ ID NO: 3042125 - RNA, 18 nt, Human
uaucaaagggugaaaauu

SEQ ID NO: 3042126 - RNA, 22 nt, Human
uaucaaagggugaaaauuauuu

SEQ ID NO: 3042127 - RNA, 14 nt, Human
uaucagcacgugug

SEQ ID NO: 3042128 - RNA, 19 nt, Human
uauaagugauugcugguuu

SEQ ID NO: 3042129 - RNA, 21 nt, Human
uauacaggucauauuaauaua

SEQ ID NO: 3042130 - RNA, 16 nt, Human
uauacaggucauauua

SEQ ID NO: 3042131 - RNA, 15 nt, Human
uauacaggucauauu

SEQ ID NO: 3042132 - RNA, 16 nt, Human
acacucaguuguucaa

SEQ ID NO: 3042133 - RNA, 11 nt, Human
uauauauuucc

SEQ ID NO: 3042134 - RNA, 17 nt, Human
uauauccuuucuaacaa

SEQ ID NO: 3042135 - RNA, 20 nt, Human
uauauccuuucuaacaaaaa

SEQ ID NO: 3042136 - RNA, 12 nt, Human
uaguaaucauau

SEQ ID NO: 3042137 - RNA, 21 nt, Human
uagacauuugcuaugagcugg

SEQ ID NO: 3042138 - RNA, 16 nt, Human
aauuuggauugcuaau

SEQ ID NO: 3042139 - RNA, 14 nt, Human
uagaagaagugugu

SEQ ID NO: 3042140 - RNA, 17 nt, Human
aauuccaauuauaugag

SEQ ID NO: 3042141 - RNA, 16 nt, Human
aauuccacacccucac

SEQ ID NO: 3042142 - RNA, 12 nt, Human
aauuuuacauuu

SEQ ID NO: 3042143 - RNA, 18 nt, Human
acaaaaggauaaugaaua

SEQ ID NO: 3042144 - RNA, 19 nt, Human
acaaaaauucucaguucuc

SEQ ID NO: 3042145 - RNA, 18 nt, Human
uagccaccgccuccuaca

SEQ ID NO: 3042146 - RNA, 18 nt, Human
uagccacccaccacacug

SEQ ID NO: 3042147 - RNA, 19 nt, Human
uagccaccgccuccuacag

SEQ ID NO: 3042148 - RNA, 19 nt, Human
uagcacugacagauuucca

SEQ ID NO: 3042149 - RNA, 14 nt, Human
uagcacugacagau

SEQ ID NO: 3042150 - RNA, 24 nt, Human
uagaggggaaaagagaugaugaaa

SEQ ID NO: 3042151 - RNA, 16 nt, Human
uccauccuacccccug

SEQ ID NO: 3042152 - RNA, 20 nt, Human
uccauccuacccccugugcc

SEQ ID NO: 3042153 - RNA, 20 nt, Human
uccaucucuuguuuaaauuc

SEQ ID NO: 3042154 - RNA, 20 nt, Human
acgaagaguauuuuugacag

SEQ ID NO: 3042155 - RNA, 22 nt, Human
acgaagaguauuuuugacagaa

SEQ ID NO: 3042156 - RNA, 15 nt, Human
accuuccaagagccu

SEQ ID NO: 3042157 - RNA, 16 nt, Human
accuuccaagagccug

SEQ ID NO: 3042158 - RNA, 20 nt, Human
accuggcuuuucuuucuacc

SEQ ID NO: 3042159 - RNA, 20 nt, Human
uccaaaaagauuuucagaaa

SEQ ID NO: 3042160 - RNA, 19 nt, Human
uccaaaaagauuuucagaa

SEQ ID NO: 3042161 - RNA, 16 nt, Human
ucauaauaaguugcau

SEQ ID NO: 3042162 - RNA, 22 nt, Human
acucgugucuggcacagccugg

SEQ ID NO: 3042163 - RNA, 23 nt, Human
acucgugucuggcacagccuggc

SEQ ID NO: 3042164 - RNA, 13 nt, Human
acucuugaaaaau

SEQ ID NO: 3042165 - RNA, 21 nt, Human
uccuagccaccgccuccuaca

SEQ ID NO: 3042166 - RNA, 20 nt, Human
uccuagccacccaccacacu

SEQ ID NO: 3042167 - RNA, 13 nt, Human
uccucuccugucu

SEQ ID NO: 3042168 - RNA, 14 nt, Human
acucuugaaaaaug

SEQ ID NO: 3042169 - RNA, 19 nt, Human
acucuugaaaaaugcaugu

SEQ ID NO: 3042170 - RNA, 16 nt, Human
uccucugcccgggagc

SEQ ID NO: 3042171 - RNA, 22 nt, Human
uccucugcccgggagcucagga

SEQ ID NO: 3042172 - RNA, 13 nt, Human
acugaaacuuccc

SEQ ID NO: 3042173 - RNA, 22 nt, Human
acuaugacauaaaaacaacuuu

SEQ ID NO: 3042174 - RNA, 14 nt, Human
acuccaccaagccu

SEQ ID NO: 3042175 - RNA, 21 nt, Human
acucaucuagguaaauuacag

SEQ ID NO: 3042176 - RNA, 23 nt, Human
acucaucuagguaaauuacaguu

SEQ ID NO: 3042177 - RNA, 14 nt, Human
acucagaauauugc

SEQ ID NO: 3042178 - RNA, 18 nt, Human
ucauaaauaaaguuuguu

SEQ ID NO: 3042179 - RNA, 24 nt, Human
ucauaaagcaggcagaacucaucu

SEQ ID NO: 3042180 - RNA, 21 nt, Human
acccagauaaagguucaugca

SEQ ID NO: 3042181 - RNA, 18 nt, Human
ucacucuuggagccugca

SEQ ID NO: 3042182 - RNA, 17 nt, Human
ucacucuuggagccugc

SEQ ID NO: 3042183 - RNA, 16 nt, Human
ucacucuuggagccug

SEQ ID NO: 3042184 - RNA, 14 nt, Human
ucacucuuggagcc

SEQ ID NO: 3042185 - RNA, 16 nt, Human
ucagaauagaaauuag

SEQ ID NO: 3042186 - RNA, 19 nt, Human
accccagcuggggccaggc

SEQ ID NO: 3042187 - RNA, 22 nt, Human
accccagcuggggccaggcugg

SEQ ID NO: 3042188 - RNA, 19 nt, Human
uauuuuuguagcacugaca

SEQ ID NO: 3042189 - RNA, 15 nt, Human
uauuuuuguagcacu

SEQ ID NO: 3042190 - RNA, 13 nt, Human
ucaaauauauuca

SEQ ID NO: 3042191 - RNA, 21 nt, Human
uauuuuaaaagauaaauauua

SEQ ID NO: 3042192 - RNA, 14 nt, Human
uauuuuaagacgaa

SEQ ID NO: 3042193 - RNA, 22 nt, Human
uauuuuaagacgaaacauuugu

SEQ ID NO: 3042194 - RNA, 14 nt, Human
uauguguaaaaugu

SEQ ID NO: 3042195 - RNA, 14 nt, Human
uaugugccagauuu

SEQ ID NO: 3042196 - RNA, 19 nt, Human
uaugugccagauuuaugca

SEQ ID NO: 3042197 - RNA, 20 nt, Human
uaugugggggucuguguguu

SEQ ID NO: 3042198 - RNA, 19 nt, Human
uaugugggggucugugugu

SEQ ID NO: 3042199 - RNA, 18 nt, Human
uaugugggggucugugug

SEQ ID NO: 3042200 - RNA, 13 nt, Human
uauuuuuguagca

SEQ ID NO: 3042201 - RNA, 13 nt, Human
uauuuuucacaua

SEQ ID NO: 3042202 - RNA, 12 nt, Human
uauuuuucacau

SEQ ID NO: 3042203 - RNA, 17 nt, Human
uauuuuguguuuaggaa

SEQ ID NO: 3042204 - RNA, 16 nt, Human
uauuuuguucauacau

SEQ ID NO: 3042205 - RNA, 15 nt, Human
uauuuuguucauaca

SEQ ID NO: 3042206 - RNA, 20 nt, Human
uauuuuguguuuaggaacua

SEQ ID NO: 3042207 - RNA, 17 nt, Human
uauuuuaauaaacacuc

SEQ ID NO: 3042208 - RNA, 14 nt, Human
uauuuuaauaaaca

SEQ ID NO: 3042209 - RNA, 16 nt, Human
accaaauaaaaauauu

SEQ ID NO: 3042210 - RNA, 18 nt, Human
accaaauaaaaauauugu

SEQ ID NO: 3042211 - RNA, 17 nt, Human
acauuguaaauaguauu

SEQ ID NO: 3042212 - RNA, 19 nt, Human
acauuguaaauaguauuug

SEQ ID NO: 3042213 - RNA, 21 nt, Human
acauuguaaauaguauuugag

SEQ ID NO: 3042214 - RNA, 13 nt, Human
ucuauaauuuaaa

SEQ ID NO: 3042215 - RNA, 17 nt, Human
acuucccagugaauucu

SEQ ID NO: 3042216 - RNA, 17 nt, Human
ucuagcauggcauauuu

SEQ ID NO: 3042217 - RNA, 18 nt, Human
ucuagcauggcauauuuu

SEQ ID NO: 3042218 - RNA, 15 nt, Human
ucuaccucuuggcug

SEQ ID NO: 3042219 - RNA, 17 nt, Human
acuugaaaauuaacaug

SEQ ID NO: 3042220 - RNA, 16 nt, Human
acuugaaaauuaacau

SEQ ID NO: 3042221 - RNA, 18 nt, Human
acuugaaaauuaacauga

SEQ ID NO: 3042222 - RNA, 15 nt, Human
acuuguauuaugugu

SEQ ID NO: 3042223 - RNA, 13 nt, Human
acuuguauuaugu

SEQ ID NO: 3042224 - RNA, 14 nt, Human
acuuguauuaugug

SEQ ID NO: 3042225 - RNA, 22 nt, Human
acuucccuuucugcuuguguua

SEQ ID NO: 3042226 - RNA, 14 nt, Human
acuucccuuucugc

SEQ ID NO: 3042227 - RNA, 20 nt, Human
ucggggagccgggagccuga

SEQ ID NO: 3042228 - RNA, 21 nt, Human
ucuaagauaguaacaaugaag

SEQ ID NO: 3042229 - RNA, 16 nt, Human
acuggggcaggggccg

SEQ ID NO: 3042230 - RNA, 18 nt, Human
ucgcccuggacugugugc

SEQ ID NO: 3042231 - RNA, 15 nt, Human
acuguacuugcucuu

SEQ ID NO: 3042232 - RNA, 23 nt, Human
acuguacuugcucuugaugccug

SEQ ID NO: 3042233 - RNA, 18 nt, Human
acuguacagacagaaaaa

SEQ ID NO: 3042234 - RNA, 22 nt, Human
ucuggcacagccuggcuguggc

SEQ ID NO: 3042235 - RNA, 16 nt, Human
agaaggaucuucaucu

SEQ ID NO: 3042236 - RNA, 13 nt, Human
agaauaaacuggc

SEQ ID NO: 3042237 - RNA, 21 nt, Human
ucugcaggucccuaauaaagc

SEQ ID NO: 3042238 - RNA, 19 nt, Human
ucugcaggucccuaauaaa

SEQ ID NO: 3042239 - RNA, 22 nt, Human
ucugcaggucccuaauaaagcu

SEQ ID NO: 3042240 - RNA, 23 nt, Human
ucugcaggucccuaauaaagcug

SEQ ID NO: 3042241 - RNA, 12 nt, Human
agaaauuaugug

SEQ ID NO: 3042242 - RNA, 12 nt, Human
agaaaugaaaaa

SEQ ID NO: 3042243 - RNA, 13 nt, Human
agaaaugaaaaaa

SEQ ID NO: 3042244 - RNA, 15 nt, Human
agaaaucuaaaaaac

SEQ ID NO: 3042245 - RNA, 22 nt, Human
ucucugcaggucccuaauaaag

SEQ ID NO: 3042246 - RNA, 19 nt, Human
ucucugcaggucccuaaua

SEQ ID NO: 3042247 - RNA, 20 nt, Human
ucucugcaggucccuaauaa

SEQ ID NO: 3042248 - RNA, 21 nt, Human
ucucugcaggucccuaauaaa

SEQ ID NO: 3042249 - RNA, 18 nt, Human
ucucugcaggucccuaau

SEQ ID NO: 3042250 - RNA, 19 nt, Human
acuuuguauaaaagggacu

SEQ ID NO: 3042251 - RNA, 22 nt, Human
ucuuggggaguuuagggugggg

SEQ ID NO: 3042252 - RNA, 23 nt, Human
ucuuggggaguuuaggguggggg

SEQ ID NO: 3042253 - RNA, 15 nt, Human
ucuuuaacucauaaa

SEQ ID NO: 3042254 - RNA, 21 nt, Human
ucuugaugccuggcggggugg

SEQ ID NO: 3042255 - RNA, 19 nt, Human
agacccccuggagacuaac

SEQ ID NO: 3042256 - RNA, 15 nt, Human
agacccccuggagac

SEQ ID NO: 3042257 - RNA, 14 nt, Human
agacccccuggaga

SEQ ID NO: 3042258 - RNA, 13 nt, Human
agacccccuggag

SEQ ID NO: 3042259 - RNA, 19 nt, Human
agacauucuuccaaaaaga

SEQ ID NO: 3042260 - RNA, 17 nt, Human
agagacgggcccuggug

SEQ ID NO: 3042261 - RNA, 14 nt, Human
agagagaaaauaaa

SEQ ID NO: 3042262 - RNA, 20 nt, Human
agagcaaaauugauguguuu

SEQ ID NO: 3042263 - RNA, 20 nt, Human
ugaaaagcuccauuuuuagu

SEQ ID NO: 3042264 - RNA, 14 nt, Human
ugaaaauauuuaaa

SEQ ID NO: 3042265 - RNA, 13 nt, Human
ugaaaauauuuaa

SEQ ID NO: 3042266 - RNA, 12 nt, Human
ugaaaauauuua

SEQ ID NO: 3042267 - RNA, 11 nt, Human
ugaaaauauuu

SEQ ID NO: 3042268 - RNA, 12 nt, Human
ugaaacuuggau

SEQ ID NO: 3042269 - RNA, 22 nt, Human
ugaaaaagaccuuuggagcaaa

SEQ ID NO: 3042270 - RNA, 23 nt, Human
ugaaaaaauauauaucaaauaua

SEQ ID NO: 3042271 - RNA, 23 nt, Human
agaggugugcaagagagggaugc

SEQ ID NO: 3042272 - RNA, 22 nt, Human
agaggugugcaagagagggaug

SEQ ID NO: 3042273 - RNA, 15 nt, Human
agaguauuuuugaca

SEQ ID NO: 3042274 - RNA, 14 nt, Human
agaguauuuuugac

SEQ ID NO: 3042275 - RNA, 20 nt, Human
ugaagcuaucguaaaauuaa

SEQ ID NO: 3042276 - RNA, 22 nt, Human
agagggacuguucuuuuguccc

SEQ ID NO: 3042277 - RNA, 23 nt, Human
ugaaaguacauuuggagacacaa

SEQ ID NO: 3042278 - RNA, 14 nt, Human
ugaaaguacauuug

SEQ ID NO: 3042279 - RNA, 15 nt, Human
ugaauacuuuauaaa

SEQ ID NO: 3042280 - RNA, 18 nt, Human
agaguauuuuugacagaa

SEQ ID NO: 3042281 - RNA, 17 nt, Human
agaguauuuuugacaga

SEQ ID NO: 3042282 - RNA, 23 nt, Human
ugaauguaugcuucauacaggga

SEQ ID NO: 3042283 - RNA, 20 nt, Human
ugaauguaugcuucauacag

SEQ ID NO: 3042284 - RNA, 19 nt, Human
ugaauguaugcuucauaca

SEQ ID NO: 3042285 - RNA, 14 nt, Human
ugaauguaugcuuc

SEQ ID NO: 3042286 - RNA, 20 nt, Human
agaguauuuuugacagaaua

SEQ ID NO: 3042287 - RNA, 13 nt, Human
ugaauuugugaag

SEQ ID NO: 3042288 - RNA, 21 nt, Human
ugaauuugugaagguggaaau

SEQ ID NO: 3042289 - RNA, 23 nt, Human
ugaauuugugaagguggaaauaa

SEQ ID NO: 3042290 - RNA, 18 nt, Human
agauggaaugcuguguua

SEQ ID NO: 3042291 - RNA, 13 nt, Human
agauggaaugcug

SEQ ID NO: 3042292 - RNA, 15 nt, Human
agauggaaugcugug

SEQ ID NO: 3042293 - RNA, 20 nt, Human
ugaccuuccaagagccugag

SEQ ID NO: 3042294 - RNA, 19 nt, Human
ugaccuuccaagagccuga

SEQ ID NO: 3042295 - RNA, 18 nt, Human
ugaccuuccaagagccug

SEQ ID NO: 3042296 - RNA, 17 nt, Human
agcauuucccuuccuuc

SEQ ID NO: 3042297 - RNA, 22 nt, Human
agcauggcauauuuuucacaua

SEQ ID NO: 3042298 - RNA, 21 nt, Human
agcauggcauauuuuucacau

SEQ ID NO: 3042299 - RNA, 19 nt, Human
agcauggcauauuuuucac

SEQ ID NO: 3042300 - RNA, 18 nt, Human
agcauggcauauuuuuca

SEQ ID NO: 3042301 - RNA, 20 nt, Human
agcaugucgucaaagcugaa

SEQ ID NO: 3042302 - RNA, 17 nt, Human
agcaugucgucaaagcu

SEQ ID NO: 3042303 - RNA, 21 nt, Human
ugauagaaggcuauggggaua

SEQ ID NO: 3042304 - RNA, 22 nt, Human
ugaguaacugauuuguaacaag

SEQ ID NO: 3042305 - RNA, 21 nt, Human
agcauaauacuugcuuuggaa

SEQ ID NO: 3042306 - RNA, 24 nt, Human
ugauaagcagucauccucagauca

SEQ ID NO: 3042307 - RNA, 12 nt, Human
ugauaaguaaau

SEQ ID NO: 3042308 - RNA, 19 nt, Human
ugauacgcaacauaauuaa

SEQ ID NO: 3042309 - RNA, 18 nt, Human
ugaguucauaaauuuaug

SEQ ID NO: 3042310 - RNA, 15 nt, Human
agccaggccacuggc

SEQ ID NO: 3042311 - RNA, 15 nt, Human
ugauccagcccugag

SEQ ID NO: 3042312 - RNA, 18 nt, Human
ugauccagcccugaguuc

SEQ ID NO: 3042313 - RNA, 17 nt, Human
ugauccagcccugaguu

SEQ ID NO: 3042314 - RNA, 18 nt, Human
agccugacccucaucuuu

SEQ ID NO: 3042315 - RNA, 11 nt, Human
ugcaggucccu

SEQ ID NO: 3042316 - RNA, 22 nt, Human
ugcauaacguauaaaagccugu

SEQ ID NO: 3042317 - RNA, 23 nt, Human
ugcauaacguauaaaagccuguu

SEQ ID NO: 3042318 - RNA, 12 nt, Human
ugcaggucccua

SEQ ID NO: 3042319 - RNA, 14 nt, Human
ugcaggucccuaau

SEQ ID NO: 3042320 - RNA, 15 nt, Human
ugcaggucccuaaua

SEQ ID NO: 3042321 - RNA, 16 nt, Human
ugcaggucccuaauaa

SEQ ID NO: 3042322 - RNA, 18 nt, Human
agcccaguucagcuuggg

SEQ ID NO: 3042323 - RNA, 21 nt, Human
agcucaggaaccgaggcaggg

SEQ ID NO: 3042324 - RNA, 22 nt, Human
agcucaggaaccgaggcaggga

SEQ ID NO: 3042325 - RNA, 20 nt, Human
agcucaggaaccgaggcagg

SEQ ID NO: 3042326 - RNA, 18 nt, Human
agcuaggaauuguguuua

SEQ ID NO: 3042327 - RNA, 17 nt, Human
ugccagacccccuggag

SEQ ID NO: 3042328 - RNA, 16 nt, Human
agccuggucagcccaa

SEQ ID NO: 3042329 - RNA, 15 nt, Human
agccuggucagccca

SEQ ID NO: 3042330 - RNA, 20 nt, Human
agccuggucagcccaaacca

SEQ ID NO: 3042331 - RNA, 13 nt, Human
agccuguuuaaga

SEQ ID NO: 3042332 - RNA, 16 nt, Human
uggccuaaccugccga

SEQ ID NO: 3042333 - RNA, 21 nt, Human
uggccuguucuucuauggguu

SEQ ID NO: 3042334 - RNA, 23 nt, Human
uggccaguggcuggaucugugag

SEQ ID NO: 3042335 - RNA, 17 nt, Human
uggcauauuuuucacau

SEQ ID NO: 3042336 - RNA, 16 nt, Human
uggcauauuuuucaca

SEQ ID NO: 3042337 - RNA, 17 nt, Human
uggauuauauuaugaag

SEQ ID NO: 3042338 - RNA, 19 nt, Human
aggaucccaugagcuccuu

SEQ ID NO: 3042339 - RNA, 20 nt, Human
uggaagcuucuggugaccuu

SEQ ID NO: 3042340 - RNA, 19 nt, Human
aggacaguauuugugggga

SEQ ID NO: 3042341 - RNA, 12 nt, Human
aggacaguauuu

SEQ ID NO: 3042342 - RNA, 19 nt, Human
uggaauuauuuuaaaagau

SEQ ID NO: 3042343 - RNA, 20 nt, Human
uggaauuauuuuaaaagaua

SEQ ID NO: 3042344 - RNA, 13 nt, Human
aggcaaucauggu

SEQ ID NO: 3042345 - RNA, 15 nt, Human
uggacugugugcuca

SEQ ID NO: 3042346 - RNA, 21 nt, Human
agcugggacaccccgacuuuu

SEQ ID NO: 3042347 - RNA, 18 nt, Human
agcugugugcucuccaag

SEQ ID NO: 3042348 - RNA, 14 nt, Human
agcuguguggcagu

SEQ ID NO: 3042349 - RNA, 16 nt, Human
agcuguguggcagucu

SEQ ID NO: 3042350 - RNA, 20 nt, Human
agcugugugcucuccaagcc

SEQ ID NO: 3042351 - RNA, 15 nt, Human
ugccugcccuauucu

SEQ ID NO: 3042352 - RNA, 23 nt, Human
agcuuggggacaggggcaggagg

SEQ ID NO: 3042353 - RNA, 23 nt, Human
agcuuuaucaaagggugaaaauu

SEQ ID NO: 3042354 - RNA, 14 nt, Human
ugcuucaucccuuu

SEQ ID NO: 3042355 - RNA, 15 nt, Human
ugcuguagacauuug

SEQ ID NO: 3042356 - RNA, 23 nt, Human
ugcuguauccauccauggggcug

SEQ ID NO: 3042357 - RNA, 15 nt, Human
agggggagagggcug

SEQ ID NO: 3042358 - RNA, 16 nt, Human
agggggagagggcugc

SEQ ID NO: 3042359 - RNA, 20 nt, Human
ugguaggaacugcugggcuu

SEQ ID NO: 3042360 - RNA, 13 nt, Human
ugguaggaacugc

SEQ ID NO: 3042361 - RNA, 16 nt, Human
uggguggggggcuuca

SEQ ID NO: 3042362 - RNA, 21 nt, Human
ugggucgcccuggacugugug

SEQ ID NO: 3042363 - RNA, 12 nt, Human
ugggucugugug

SEQ ID NO: 3042364 - RNA, 14 nt, Human
uggucuccacuggg

SEQ ID NO: 3042365 - RNA, 10 nt, Human
uggucagccc

SEQ ID NO: 3042366 - RNA, 12 nt, Human
uggucagcccaa

SEQ ID NO: 3042367 - RNA, 11 nt, Human
uggucagccca

SEQ ID NO: 3042368 - RNA, 16 nt, Human
aggucauauuaauaua

SEQ ID NO: 3042369 - RNA, 19 nt, Human
aggucauauuaauauauuu

SEQ ID NO: 3042370 - RNA, 18 nt, Human
aggucauauuaauauauu

SEQ ID NO: 3042371 - RNA, 23 nt, Human
agguauaauucacauuguauuca

SEQ ID NO: 3042372 - RNA, 18 nt, Human
uggggaguuuaggguggg

SEQ ID NO: 3042373 - RNA, 19 nt, Human
uggggaguuuagggugggg

SEQ ID NO: 3042374 - RNA, 15 nt, Human
ugggguagguuggga

SEQ ID NO: 3042375 - RNA, 21 nt, Human
ugggguagguugggagaaugu

SEQ ID NO: 3042376 - RNA, 14 nt, Human
uggggcugauugua

SEQ ID NO: 3042377 - RNA, 22 nt, Human
uggggacaggggcaggaggaag

SEQ ID NO: 3042378 - RNA, 20 nt, Human
uggggacaggggcaggagga

SEQ ID NO: 3042379 - RNA, 22 nt, Human
agucccugccuggaccagccuc

SEQ ID NO: 3042380 - RNA, 23 nt, Human
agucccugccuggaccagccucu

SEQ ID NO: 3042381 - RNA, 15 nt, Human
agucccugccuggac

SEQ ID NO: 3042382 - RNA, 21 nt, Human
agucccugccuggaccagccu

SEQ ID NO: 3042383 - RNA, 14 nt, Human
agucccugccugga

SEQ ID NO: 3042384 - RNA, 23 nt, Human
agucccugaggcagguccccaga

SEQ ID NO: 3042385 - RNA, 22 nt, Human
agucccugaggcagguccccag

SEQ ID NO: 3042386 - RNA, 20 nt, Human
agucccugaggcaggucccc

SEQ ID NO: 3042387 - RNA, 19 nt, Human
agucccugaggcagguccc

SEQ ID NO: 3042388 - RNA, 22 nt, Human
aguccaggcuuuuuuaucaugu

SEQ ID NO: 3042389 - RNA, 16 nt, Human
aguauuugagaguucu

SEQ ID NO: 3042390 - RNA, 19 nt, Human
aguauguggaagugugggu

SEQ ID NO: 3042391 - RNA, 17 nt, Human
aguauguggaagugugg

SEQ ID NO: 3042392 - RNA, 15 nt, Human
aguauguggaagugu

SEQ ID NO: 3042393 - RNA, 22 nt, Human
ugucaguauguggaaguguggg

SEQ ID NO: 3042394 - RNA, 18 nt, Human
ugucaguauguggaagug

SEQ ID NO: 3042395 - RNA, 20 nt, Human
ugucaguauguggaagugug

SEQ ID NO: 3042396 - RNA, 19 nt, Human
ugucaguauguggaagugu

SEQ ID NO: 3042397 - RNA, 18 nt, Human
agguccccagcuuuggcu

SEQ ID NO: 3042398 - RNA, 10 nt, Human
aggucccuaa

SEQ ID NO: 3042399 - RNA, 17 nt, Human
agguccccagcuuuggc

SEQ ID NO: 3042400 - RNA, 11 nt, Human
agguccccaga

SEQ ID NO: 3042401 - RNA, 23 nt, Human
agguugggagaaugucaguaugu

SEQ ID NO: 3042402 - RNA, 20 nt, Human
uguaauuuaaaauugugaug

SEQ ID NO: 3042403 - RNA, 18 nt, Human
uguaauuuaaaauuguga

SEQ ID NO: 3042404 - RNA, 17 nt, Human
uguaauuuaaaauugug

SEQ ID NO: 3042405 - RNA, 23 nt, Human
aguaaggaauuuuauuuuuuucu

SEQ ID NO: 3042406 - RNA, 22 nt, Human
uguaauuuaaaauugugaugug

SEQ ID NO: 3042407 - RNA, 21 nt, Human
uguaauuuaaaauugugaugu

SEQ ID NO: 3042408 - RNA, 19 nt, Human
aguacuuuuggcauuuuac

SEQ ID NO: 3042409 - RNA, 21 nt, Human
aguaauccaagcaaaugugaa

SEQ ID NO: 3042410 - RNA, 15 nt, Human
aguaauccaagcaaa

SEQ ID NO: 3042411 - RNA, 13 nt, Human
aguagaacagaua

SEQ ID NO: 3042412 - RNA, 19 nt, Human
aguagaacagauaaucagu

SEQ ID NO: 3042413 - RNA, 19 nt, Human
uguggcacuggggcagggg

SEQ ID NO: 3042414 - RNA, 13 nt, Human
uguguguguguau

SEQ ID NO: 3042415 - RNA, 16 nt, Human
uguguguguguaugug

SEQ ID NO: 3042416 - RNA, 13 nt, Human
uguguugugaaug

SEQ ID NO: 3042417 - RNA, 13 nt, Human
uguggucuccacu

SEQ ID NO: 3042418 - RNA, 19 nt, Human
aguguguguuuuucauaaa

SEQ ID NO: 3042419 - RNA, 15 nt, Human
agugugggucugugu

SEQ ID NO: 3042420 - RNA, 17 nt, Human
agugugggucugugugu

SEQ ID NO: 3042421 - RNA, 16 nt, Human
agugugggucugugug

SEQ ID NO: 3042422 - RNA, 23 nt, Human
agugugggucuguguguguguau

SEQ ID NO: 3042423 - RNA, 19 nt, Human
agugugggucugugugugu

SEQ ID NO: 3042424 - RNA, 17 nt, Human
aguuccuagccaccgcc

SEQ ID NO: 3042425 - RNA, 19 nt, Human
aguucggugagcuacaaau

SEQ ID NO: 3042426 - RNA, 15 nt, Human
aguucuacauaagua

SEQ ID NO: 3042427 - RNA, 13 nt, Human
uguuuaguaauca

SEQ ID NO: 3042428 - RNA, 14 nt, Human
uguuuaguaaucau

SEQ ID NO: 3042429 - RNA, 17 nt, Human
uguuuaguaaucauauu

SEQ ID NO: 3042430 - RNA, 16 nt, Human
uguugugugugggagu

SEQ ID NO: 3042431 - RNA, 15 nt, Human
uguugugugugggag

SEQ ID NO: 3042432 - RNA, 14 nt, Human
uguuguguguggga

SEQ ID NO: 3042433 - RNA, 12 nt, Human
uguugugaaugu

SEQ ID NO: 3042434 - RNA, 13 nt, Human
uguugugaauguu

SEQ ID NO: 3042435 - RNA, 14 nt, Human
uguugugauguauu

SEQ ID NO: 3042436 - RNA, 20 nt, Human
uguugugauguauucuagcu

SEQ ID NO: 3042437 - RNA, 19 nt, Human
auaauacuugcuuuggaaa

SEQ ID NO: 3042438 - RNA, 18 nt, Human
auaauccuaaacauauga

SEQ ID NO: 3042439 - RNA, 16 nt, Human
uuagccuuugucccag

SEQ ID NO: 3042440 - RNA, 13 nt, Human
uuaccuuugacaa

SEQ ID NO: 3042441 - RNA, 20 nt, Human
uuaccuuugacaaagguaaa

SEQ ID NO: 3042442 - RNA, 22 nt, Human
auaacgauaaaagacagugaaa

SEQ ID NO: 3042443 - RNA, 14 nt, Human
auaacguauaaaag

SEQ ID NO: 3042444 - RNA, 13 nt, Human
auaacugugaagu

SEQ ID NO: 3042445 - RNA, 18 nt, Human
auaaauauuuuugccaua

SEQ ID NO: 3042446 - RNA, 14 nt, Human
auaaauaaaaauaa

SEQ ID NO: 3042447 - RNA, 15 nt, Human
auaaagguucaugca

SEQ ID NO: 3042448 - RNA, 13 nt, Human
auaaauaaaaaua

SEQ ID NO: 3042449 - RNA, 17 nt, Human
auaaagguucaugcaaa

SEQ ID NO: 3042450 - RNA, 14 nt, Human
aguuuaaauuguaa

SEQ ID NO: 3042451 - RNA, 14 nt, Human
uuaaguauguguaa

SEQ ID NO: 3042452 - RNA, 18 nt, Human
auaaaagccuguuuaaga

SEQ ID NO: 3042453 - RNA, 13 nt, Human
auaaaagccuguu

SEQ ID NO: 3042454 - RNA, 15 nt, Human
uucuaguucugccag

SEQ ID NO: 3042455 - RNA, 16 nt, Human
uucuaguucugccagg

SEQ ID NO: 3042456 - RNA, 14 nt, Human
uucuauaauuuaaa

SEQ ID NO: 3042457 - RNA, 13 nt, Human
uucuauaauuuaa

SEQ ID NO: 3042458 - RNA, 19 nt, Human
aucagacuaugaaguuuuu

SEQ ID NO: 3042459 - RNA, 13 nt, Human
uucuaaaguaaaa

SEQ ID NO: 3042460 - RNA, 15 nt, Human
uucuaaaguaaaaac

SEQ ID NO: 3042461 - RNA, 19 nt, Human
uucuaacaaaaaaauauau

SEQ ID NO: 3042462 - RNA, 20 nt, Human
uucuaacaaaaaaauauauu

SEQ ID NO: 3042463 - RNA, 14 nt, Human
auauuuuaagacga

SEQ ID NO: 3042464 - RNA, 16 nt, Human
uucuuuguaaugaaaa

SEQ ID NO: 3042465 - RNA, 20 nt, Human
auccuagucacuaccuucau

SEQ ID NO: 3042466 - RNA, 22 nt, Human
aucauuggauucugagagcugu

SEQ ID NO: 3042467 - RNA, 21 nt, Human
aucauuggauucugagagcug

SEQ ID NO: 3042468 - RNA, 15 nt, Human
auauauauauauauu

SEQ ID NO: 3042469 - RNA, 13 nt, Human
auagucuuucagu

SEQ ID NO: 3042470 - RNA, 22 nt, Human
auagcuuuucccuuuuuuuaag

SEQ ID NO: 3042471 - RNA, 17 nt, Human
auaggcguaacuaauuu

SEQ ID NO: 3042472 - RNA, 21 nt, Human
uuauuuuguucauacauauuu

SEQ ID NO: 3042473 - RNA, 17 nt, Human
uuauuuuguucauacau

SEQ ID NO: 3042474 - RNA, 13 nt, Human
uuauuuuuuucug

SEQ ID NO: 3042475 - RNA, 17 nt, Human
uuauuuuuuucugaauu

SEQ ID NO: 3042476 - RNA, 16 nt, Human
uucaaaauuguuacaa

SEQ ID NO: 3042477 - RNA, 21 nt, Human
uucaaaauuguuacaaauugu

SEQ ID NO: 3042478 - RNA, 22 nt, Human
uuccaagagccugagagugagg

SEQ ID NO: 3042479 - RNA, 14 nt, Human
uuccaagagccuga

SEQ ID NO: 3042480 - RNA, 13 nt, Human
uuccaagagccug

SEQ ID NO: 3042481 - RNA, 19 nt, Human
uucauaauuauuauuuggc

SEQ ID NO: 3042482 - RNA, 21 nt, Human
uucauacagggaugguguuca

SEQ ID NO: 3042483 - RNA, 23 nt, Human
uucauacauauuuuuguagcacu

SEQ ID NO: 3042484 - RNA, 12 nt, Human
uucauacauauu

SEQ ID NO: 3042485 - RNA, 13 nt, Human
uucauaugcugua

SEQ ID NO: 3042486 - RNA, 19 nt, Human
uucauacauuguacgaaga

SEQ ID NO: 3042487 - RNA, 13 nt, Human
uucauacauugua

SEQ ID NO: 3042488 - RNA, 15 nt, Human
auauauuuaaugaua

SEQ ID NO: 3042489 - RNA, 13 nt, Human
auauauuuaauga

SEQ ID NO: 3042490 - RNA, 12 nt, Human
auauauuuuaag

SEQ ID NO: 3042491 - RNA, 13 nt, Human
auauauuuuaaga

SEQ ID NO: 3042492 - RNA, 13 nt, Human
auaucuuguagcu

SEQ ID NO: 3042493 - RNA, 14 nt, Human
auauauuuuaagac

SEQ ID NO: 3042494 - RNA, 17 nt, Human
auaucuaguaugaaauu

SEQ ID NO: 3042495 - RNA, 15 nt, Human
auaucuaguaugaaa

SEQ ID NO: 3042496 - RNA, 14 nt, Human
auaucuaguaugaa

SEQ ID NO: 3042497 - RNA, 16 nt, Human
augauuccagguggca

SEQ ID NO: 3042498 - RNA, 15 nt, Human
augauuccagguggc

SEQ ID NO: 3042499 - RNA, 14 nt, Human
uuuaaauguuuuuu

SEQ ID NO: 3042500 - RNA, 12 nt, Human
uuuaauuuuaca

SEQ ID NO: 3042501 - RNA, 16 nt, Human
auggccugggggaugu

SEQ ID NO: 3042502 - RNA, 16 nt, Human
auggaaugcuguguua

SEQ ID NO: 3042503 - RNA, 21 nt, Human
auggaaugaugggucaguugu

SEQ ID NO: 3042504 - RNA, 23 nt, Human
augcuucauacagggaugguguu

SEQ ID NO: 3042505 - RNA, 10 nt, Human
augcuucaua

SEQ ID NO: 3042506 - RNA, 12 nt, Human
augcuucauaca

SEQ ID NO: 3042507 - RNA, 11 nt, Human
augcuucauac

SEQ ID NO: 3042508 - RNA, 19 nt, Human
augcuucauacagggaugg

SEQ ID NO: 3042509 - RNA, 16 nt, Human
augcuucauacaggga

SEQ ID NO: 3042510 - RNA, 15 nt, Human
augcuucauacaggg

SEQ ID NO: 3042511 - RNA, 13 nt, Human
augcuucauacag

SEQ ID NO: 3042512 - RNA, 12 nt, Human
uuuaugugaugg

SEQ ID NO: 3042513 - RNA, 13 nt, Human
uuuaugugugugu

SEQ ID NO: 3042514 - RNA, 11 nt, Human
uuuaugugugu

SEQ ID NO: 3042515 - RNA, 16 nt, Human
uuuaguaucuuuuuau

SEQ ID NO: 3042516 - RNA, 16 nt, Human
aucuguaccucugccu

SEQ ID NO: 3042517 - RNA, 20 nt, Human
aucugagaggccacagugca

SEQ ID NO: 3042518 - RNA, 16 nt, Human
aucuccccaucauugg

SEQ ID NO: 3042519 - RNA, 18 nt, Human
aucucauaauuuauacag

SEQ ID NO: 3042520 - RNA, 17 nt, Human
aucucauaauuuauaca

SEQ ID NO: 3042521 - RNA, 23 nt, Human
aucucagugguuaagauuccuaa

SEQ ID NO: 3042522 - RNA, 11 nt, Human
uugauguguuu

SEQ ID NO: 3042523 - RNA, 12 nt, Human
uugaugccuggc

SEQ ID NO: 3042524 - RNA, 15 nt, Human
uugaugggauuuggu

SEQ ID NO: 3042525 - RNA, 14 nt, Human
uugcaucugaaaau

SEQ ID NO: 3042526 - RNA, 15 nt, Human
augagaaaucuaaaa

SEQ ID NO: 3042527 - RNA, 18 nt, Human
augagaaaucuaaaaaac

SEQ ID NO: 3042528 - RNA, 23 nt, Human
augagaaaucuaaaaaacgaaaa

SEQ ID NO: 3042529 - RNA, 22 nt, Human
aucuuuaauuuuacauuuccua

SEQ ID NO: 3042530 - RNA, 16 nt, Human
aucuuuaauuuuacau

SEQ ID NO: 3042531 - RNA, 21 nt, Human
aucuuuaauuuuacauuuccu

SEQ ID NO: 3042532 - RNA, 13 nt, Human
aucuuuuuauuca

SEQ ID NO: 3042533 - RNA, 16 nt, Human
auuauauuuacaaaug

SEQ ID NO: 3042534 - RNA, 13 nt, Human
auuauuuuaaaag

SEQ ID NO: 3042535 - RNA, 14 nt, Human
auuauuuuaaaaga

SEQ ID NO: 3042536 - RNA, 16 nt, Human
auuauuuuauguugca

SEQ ID NO: 3042537 - RNA, 18 nt, Human
auuauuuuauguugcaua

SEQ ID NO: 3042538 - RNA, 15 nt, Human
auuauauuuacaaau

SEQ ID NO: 3042539 - RNA, 16 nt, Human
auuaagaucucagugg

SEQ ID NO: 3042540 - RNA, 15 nt, Human
auuaauauauuucca

SEQ ID NO: 3042541 - RNA, 14 nt, Human
auucagcucaugga

SEQ ID NO: 3042542 - RNA, 20 nt, Human
auuaaaaaaucaguuguaca

SEQ ID NO: 3042543 - RNA, 19 nt, Human
auguuuacagaggacagua

SEQ ID NO: 3042544 - RNA, 17 nt, Human
auguuuacagaggacag

SEQ ID NO: 3042545 - RNA, 15 nt, Human
auguuuacagaggac

SEQ ID NO: 3042546 - RNA, 15 nt, Human
auguugugauguauu

SEQ ID NO: 3042547 - RNA, 19 nt, Human
uuuuaguugcaacuuugua

SEQ ID NO: 3042548 - RNA, 18 nt, Human
uuuuaugugaaacauguu

SEQ ID NO: 3042549 - RNA, 19 nt, Human
uuuuaugugaaacauguuu

SEQ ID NO: 3042550 - RNA, 22 nt, Human
uuuuauguugcauagaauaaaa

SEQ ID NO: 3042551 - RNA, 16 nt, Human
uuuucuauaauuuaaa

SEQ ID NO: 3042552 - RNA, 21 nt, Human
uuuuauucagcucauggacuu

SEQ ID NO: 3042553 - RNA, 17 nt, Human
uuuguagcacugacaga

SEQ ID NO: 3042554 - RNA, 19 nt, Human
uuuguagcacugacagauu

SEQ ID NO: 3042555 - RNA, 17 nt, Human
uuuguaaauuuauguga

SEQ ID NO: 3042556 - RNA, 16 nt, Human
uuuuaaguaaggaauu

SEQ ID NO: 3042557 - RNA, 11 nt, Human
uuuuaagaaau

SEQ ID NO: 3042558 - RNA, 16 nt, Human
auguaugcuucauaca

SEQ ID NO: 3042559 - RNA, 17 nt, Human
auguaugcuucauacag

SEQ ID NO: 3042560 - RNA, 20 nt, Human
auguaugcuucauacaggga

SEQ ID NO: 3042561 - RNA, 13 nt, Human
augucaguaugug

SEQ ID NO: 3042562 - RNA, 14 nt, Human
augucaguaugugg

SEQ ID NO: 3042563 - RNA, 23 nt, Human
uuugcucagugucuggcugcaga

SEQ ID NO: 3042564 - RNA, 19 nt, Human
uuugcuaugagcuggggau

SEQ ID NO: 3042565 - RNA, 22 nt, Human
auuugaauguaugcuucauaca

SEQ ID NO: 3042566 - RNA, 21 nt, Human
auuugaauguaugcuucauac

SEQ ID NO: 3042567 - RNA, 20 nt, Human
auuugaauguaugcuucaua

SEQ ID NO: 3042568 - RNA, 18 nt, Human
auuugaauguaugcuuca

SEQ ID NO: 3042569 - RNA, 17 nt, Human
auuugaauguaugcuuc

SEQ ID NO: 3042570 - RNA, 20 nt, Human
auuuggagacacaacuauuu

SEQ ID NO: 3042571 - RNA, 14 nt, Human
auuuuauguugcau

SEQ ID NO: 3042572 - RNA, 21 nt, Human
auuuuauguugcauagaauaa

SEQ ID NO: 3042573 - RNA, 18 nt, Human
auuuuauguugcauagaa

SEQ ID NO: 3042574 - RNA, 22 nt, Human
auuuuacuguacagacagaaaa

SEQ ID NO: 3042575 - RNA, 20 nt, Human
auuuuacuguacagacagaa

SEQ ID NO: 3042576 - RNA, 17 nt, Human
auuuuaccuuugacaaa

SEQ ID NO: 3042577 - RNA, 21 nt, Human
auuggcucuugaacugagcuu

SEQ ID NO: 3042578 - RNA, 21 nt, Human
auugcuaaucaccaaaggcuc

SEQ ID NO: 3042579 - RNA, 15 nt, Human
auugugaaauuauuc

SEQ ID NO: 3042580 - RNA, 14 nt, Human
auuguauuacaaau

SEQ ID NO: 3042581 - RNA, 16 nt, Human
auuuacaaaugggaaa

SEQ ID NO: 3042582 - RNA, 21 nt, Human
auuuaaaggcccuaucuguuu

SEQ ID NO: 3042583 - RNA, 20 nt, Human
auuuaaaggcccuaucuguu

SEQ ID NO: 3042584 - RNA, 18 nt, Human
auuuaaaggcccuaucug

SEQ ID NO: 3042585 - RNA, 20 nt, Human
auuuaaaauugugauguguc

SEQ ID NO: 3042586 - RNA, 19 nt, Human
auuuaaaauugugaugugu

SEQ ID NO: 3042587 - RNA, 23 nt, Human
auugcaggagucccugccaucau

SEQ ID NO: 3042588 - RNA, 23 nt, Human
agucugagagaggccauucuuuc

SEQ ID NO: 3042589 - RNA, 16 nt, Human
agucugagagaggcca

SEQ ID NO: 3042590 - RNA, 20 nt, Human
agugaauucuugaaggaaaa

SEQ ID NO: 3042591 - RNA, 13 nt, Human
aguauuuuugaca

SEQ ID NO: 3042592 - RNA, 18 nt, Human
aguauuuuugacagaaua

SEQ ID NO: 3042593 - RNA, 17 nt, Human
aguauuuuugacagaau

SEQ ID NO: 3042594 - RNA, 16 nt, Human
aguauuuuugacagaa

SEQ ID NO: 3042595 - RNA, 19 nt, Human
aguaacaaugaagauaaaa

SEQ ID NO: 3042596 - RNA, 23 nt, Human
aguaaaugcuagguuaauuccaa

SEQ ID NO: 3042597 - RNA, 11 nt, Human
aguaaaugcua

SEQ ID NO: 3042598 - RNA, 22 nt, Human
aguaaaugcuagguuaauucca

SEQ ID NO: 3042599 - RNA, 12 nt, Human
agugucuggcug

SEQ ID NO: 3042600 - RNA, 14 nt, Human
agugucuggcugca

SEQ ID NO: 3042601 - RNA, 13 nt, Human
agugucuggcugc

SEQ ID NO: 3042602 - RNA, 15 nt, Human
agugcuaauuuugaa

SEQ ID NO: 3042603 - RNA, 18 nt, Human
agugcuaauuuugaaaaa

SEQ ID NO: 3042604 - RNA, 20 nt, Human
agugcuaauuuugaaaaacu

SEQ ID NO: 3042605 - RNA, 14 nt, Human
aguucagcuugggg

SEQ ID NO: 3042606 - RNA, 13 nt, Human
aguucagcuuggg

SEQ ID NO: 3042607 - RNA, 17 nt, Human
auacccagaaaguuauu

SEQ ID NO: 3042608 - RNA, 13 nt, Human
auaauggucagag

SEQ ID NO: 3042609 - RNA, 14 nt, Human
auaacaaugaaagu

SEQ ID NO: 3042610 - RNA, 18 nt, Human
aguuuggcaaacucucca

SEQ ID NO: 3042611 - RNA, 20 nt, Human
auaaaaagccugcaauuuca

SEQ ID NO: 3042612 - RNA, 16 nt, Human
aguuuggcaaacucuc

SEQ ID NO: 3042613 - RNA, 22 nt, Human
auaaaaagccugcaauuucaua

SEQ ID NO: 3042614 - RNA, 17 nt, Human
auauuauguguuuccau

SEQ ID NO: 3042615 - RNA, 17 nt, Human
auaugcagauuuugccc

SEQ ID NO: 3042616 - RNA, 14 nt, Human
auauuauuuuaugu

SEQ ID NO: 3042617 - RNA, 15 nt, Human
auauuauuuuauguu

SEQ ID NO: 3042618 - RNA, 22 nt, Human
auauuauuuuauguugcauaga

SEQ ID NO: 3042619 - RNA, 19 nt, Human
auauuucccugaaggaacc

SEQ ID NO: 3042620 - RNA, 20 nt, Human
auccagagucccugccugga

SEQ ID NO: 3042621 - RNA, 21 nt, Human
auccagagucccugccuggac

SEQ ID NO: 3042622 - RNA, 19 nt, Human
auccagagucccugccugg

SEQ ID NO: 3042623 - RNA, 19 nt, Human
auccucaguuuuugugaaa

SEQ ID NO: 3042624 - RNA, 22 nt, Human
aucaaauauauucagccuggcu

SEQ ID NO: 3042625 - RNA, 14 nt, Human
aucaaauauauuca

SEQ ID NO: 3042626 - RNA, 21 nt, Human
auauuucccugaaggaaccaa

SEQ ID NO: 3042627 - RNA, 12 nt, Human
aucaugugaaau

SEQ ID NO: 3042628 - RNA, 16 nt, Human
augaaaauauuuaaag

SEQ ID NO: 3042629 - RNA, 14 nt, Human
augaaaauauuuaa

SEQ ID NO: 3042630 - RNA, 13 nt, Human
augaaaauauuua

SEQ ID NO: 3042631 - RNA, 12 nt, Human
augaaaauauuu

SEQ ID NO: 3042632 - RNA, 20 nt, Human
augagggucuugguuccagc

SEQ ID NO: 3042633 - RNA, 13 nt, Human
augagggucuugg

SEQ ID NO: 3042634 - RNA, 22 nt, Human
aucucugcaggaaauggcugug

SEQ ID NO: 3042635 - RNA, 18 nt, Human
aucugggggccucuucug

SEQ ID NO: 3042636 - RNA, 14 nt, Human
aucuaguaugaaau

SEQ ID NO: 3042637 - RNA, 19 nt, Human
aucuaguaugaaauuauau

SEQ ID NO: 3042638 - RNA, 18 nt, Human
aucuaguaugaaauuaua

SEQ ID NO: 3042639 - RNA, 17 nt, Human
aucuaguaugaaauuau

SEQ ID NO: 3042640 - RNA, 16 nt, Human
aucuaguaugaaauua

SEQ ID NO: 3042641 - RNA, 15 nt, Human
aucuaguaugaaauu

SEQ ID NO: 3042642 - RNA, 17 nt, Human
auggauaggcacaggaa

SEQ ID NO: 3042643 - RNA, 18 nt, Human
auggauaggcacaggaaa

SEQ ID NO: 3042644 - RNA, 15 nt, Human
augaugaaaauauuu

SEQ ID NO: 3042645 - RNA, 13 nt, Human
augaugaaaauau

SEQ ID NO: 3042646 - RNA, 19 nt, Human
augaugaaaauauuuaaag

SEQ ID NO: 3042647 - RNA, 16 nt, Human
augaugggucaguugu

SEQ ID NO: 3042648 - RNA, 23 nt, Human
augcacaaauucugucucuggau

SEQ ID NO: 3042649 - RNA, 15 nt, Human
augcacaaauucugu

SEQ ID NO: 3042650 - RNA, 22 nt, Human
augcacaaauucugucucugga

SEQ ID NO: 3042651 - RNA, 15 nt, Human
auguguaaaauguga

SEQ ID NO: 3042652 - RNA, 14 nt, Human
augugaaaucauuc

SEQ ID NO: 3042653 - RNA, 14 nt, Human
augugaaacauguu

SEQ ID NO: 3042654 - RNA, 16 nt, Human
augugaacagcggcug

SEQ ID NO: 3042655 - RNA, 17 nt, Human
augugaaaucauucauu

SEQ ID NO: 3042656 - RNA, 18 nt, Human
augugaaaucauucauuu

SEQ ID NO: 3042657 - RNA, 16 nt, Human
aggaaccgaggcaggg

SEQ ID NO: 3042658 - RNA, 16 nt, Human
aggaacugcugggcuu

SEQ ID NO: 3042659 - RNA, 22 nt, Human
aggaacugcugggcuuggcagc

SEQ ID NO: 3042660 - RNA, 16 nt, Human
aggaaccauaaucaau

SEQ ID NO: 3042661 - RNA, 15 nt, Human
aggaaccaaagcgaa

SEQ ID NO: 3042662 - RNA, 13 nt, Human
aggaaccaaagcg

SEQ ID NO: 3042663 - RNA, 15 nt, Human
agcuuuuaugugaaa

SEQ ID NO: 3042664 - RNA, 16 nt, Human
agcuccuuaaggcucu

SEQ ID NO: 3042665 - RNA, 17 nt, Human
agcuccuuaaggcucuu

SEQ ID NO: 3042666 - RNA, 15 nt, Human
agcugcgggcugggu

SEQ ID NO: 3042667 - RNA, 18 nt, Human
agccuggcuucaaauugu

SEQ ID NO: 3042668 - RNA, 17 nt, Human
agccuggcuucaaauug

SEQ ID NO: 3042669 - RNA, 19 nt, Human
agcuaauucuuugaccugu

SEQ ID NO: 3042670 - RNA, 23 nt, Human
agcuaauguaauaacugugaagu

SEQ ID NO: 3042671 - RNA, 23 nt, Human
aggucccuaauaaagcugugugg

SEQ ID NO: 3042672 - RNA, 18 nt, Human
aggggcaggaggaagggg

SEQ ID NO: 3042673 - RNA, 13 nt, Human
aggggcaggagga

SEQ ID NO: 3042674 - RNA, 12 nt, Human
aggggcaggagg

SEQ ID NO: 3042675 - RNA, 16 nt, Human
agggaugguguucaaa

SEQ ID NO: 3042676 - RNA, 14 nt, Human
agggaugguguuca

SEQ ID NO: 3042677 - RNA, 17 nt, Human
agggacugagaaauuua

SEQ ID NO: 3042678 - RNA, 10 nt, Human
agagggcugc

SEQ ID NO: 3042679 - RNA, 15 nt, Human
agagccugagaguga

SEQ ID NO: 3042680 - RNA, 22 nt, Human
agacagccaacuauggccugug

SEQ ID NO: 3042681 - RNA, 15 nt, Human
agccaagaggcugca

SEQ ID NO: 3042682 - RNA, 21 nt, Human
agcaaagcugaugacaacuuc

SEQ ID NO: 3042683 - RNA, 23 nt, Human
agcaaagcugaugacaacuuccc

SEQ ID NO: 3042684 - RNA, 18 nt, Human
agaugaugaaaauauuua

SEQ ID NO: 3042685 - RNA, 23 nt, Human
agaugaugaaaauauuuaaaggc

SEQ ID NO: 3042686 - RNA, 14 nt, Human
agaugguucuagca

SEQ ID NO: 3042687 - RNA, 13 nt, Human
aagggagggggag

SEQ ID NO: 3042688 - RNA, 15 nt, Human
aagggacugagaaau

SEQ ID NO: 3042689 - RNA, 17 nt, Human
aagggacugagaaauuu

SEQ ID NO: 3042690 - RNA, 12 nt, Human
aaggaauuuuau

SEQ ID NO: 3042691 - RNA, 15 nt, Human
aagacuuuuaugaua

SEQ ID NO: 3042692 - RNA, 18 nt, Human
aagagaagggcagggcug

SEQ ID NO: 3042693 - RNA, 21 nt, Human
aagacauucuuccaaaaagau

SEQ ID NO: 3042694 - RNA, 23 nt, Human
aagacagugaaagaaaauaacaa

SEQ ID NO: 3042695 - RNA, 13 nt, Human
aagauuuucagaa

SEQ ID NO: 3042696 - RNA, 12 nt, Human
aauaaaauuuuu

SEQ ID NO: 3042697 - RNA, 17 nt, Human
aauaaaccucaaaaugu

SEQ ID NO: 3042698 - RNA, 20 nt, Human
aauaaaccucaaaaugucua

SEQ ID NO: 3042699 - RNA, 11 nt, Human
aauaaagcugu

SEQ ID NO: 3042700 - RNA, 19 nt, Human
aauaaagcuguguggcagu

SEQ ID NO: 3042701 - RNA, 14 nt, Human
aauaauaaauauuu

SEQ ID NO: 3042702 - RNA, 15 nt, Human
aauccaaugaaauga

SEQ ID NO: 3042703 - RNA, 17 nt, Human
aaaccucaaaaugucua

SEQ ID NO: 3042704 - RNA, 22 nt, Human
aaaccucaaaaugucuaagaua

SEQ ID NO: 3042705 - RNA, 16 nt, Human
aaagauaaauauuaua

SEQ ID NO: 3042706 - RNA, 13 nt, Human
aaagaggugugca

SEQ ID NO: 3042707 - RNA, 13 nt, Human
aaagauaaauauu

SEQ ID NO: 3042708 - RNA, 15 nt, Human
aaagauaaauauuau

SEQ ID NO: 3042709 - RNA, 14 nt, Human
aaagauaaauauua

SEQ ID NO: 3042710 - RNA, 15 nt, Human
aaagccaagaggcug

SEQ ID NO: 3042711 - RNA, 19 nt, Human
aaauaaaccucaaaauguc

SEQ ID NO: 3042712 - RNA, 20 nt, Human
aaauaaaaauauuguguugu

SEQ ID NO: 3042713 - RNA, 21 nt, Human
aaaauccacuuuaucuugaau

SEQ ID NO: 3042714 - RNA, 15 nt, Human
aaaauaaaaaacacu

SEQ ID NO: 3042715 - RNA, 22 nt, Human
aaaauuaacaugaauauuuagu

SEQ ID NO: 3042716 - RNA, 12 nt, Human
aaaauuaagaaa

SEQ ID NO: 3042717 - RNA, 13 nt, Human
aaaauuaagaaag

SEQ ID NO: 3042718 - RNA, 20 nt, Human
aaaauuaagaaaggauaaag

SEQ ID NO: 3042719 - RNA, 20 nt, Human
aaaauuauuuuguucauaca

SEQ ID NO: 3042720 - RNA, 18 nt, Human
aaaauuauuuuguucaua

SEQ ID NO: 3042721 - RNA, 16 nt, Human
aaaauuauuuuguuca

SEQ ID NO: 3042722 - RNA, 15 nt, Human
aacaucccuccuggg

SEQ ID NO: 3042723 - RNA, 20 nt, Human
aacagcggcuggacuuggag

SEQ ID NO: 3042724 - RNA, 17 nt, Human
aacugagcuuggaagcu

SEQ ID NO: 3042725 - RNA, 13 nt, Human
aacugagcuugga

SEQ ID NO: 3042726 - RNA, 21 nt, Human
aacugagcuuggaagcuucug

SEQ ID NO: 3042727 - RNA, 15 nt, Human
aacguauaaaagccu

SEQ ID NO: 3042728 - RNA, 20 nt, Human
aaaugcuagguuaauuccaa

SEQ ID NO: 3042729 - RNA, 17 nt, Human
aacacuaacaugauuug

SEQ ID NO: 3042730 - RNA, 22 nt, Human
aaauguuuuuuuuuaaagacuu

SEQ ID NO: 3042731 - RNA, 14 nt, Human
aaauugauguguuu

SEQ ID NO: 3042732 - RNA, 18 nt, Human
aaauugaugggauuuggu

SEQ ID NO: 3042733 - RNA, 18 nt, Human
aaauguuuuuuuuuaaag

SEQ ID NO: 3042734 - RNA, 21 nt, Human
aaauguuuuuuuuuaaagacu

SEQ ID NO: 3042735 - RNA, 19 nt, Human
accggggccugggcaggag

SEQ ID NO: 3042736 - RNA, 22 nt, Human
acuaggugcccagaaugaggcu

SEQ ID NO: 3042737 - RNA, 15 nt, Human
acuuuauuuuguguu

SEQ ID NO: 3042738 - RNA, 15 nt, Human
acauaaguaauucaa

SEQ ID NO: 3042739 - RNA, 19 nt, Human
acauaauuaaauuuugagu

SEQ ID NO: 3042740 - RNA, 14 nt, Human
accaucucuuuacc

SEQ ID NO: 3042741 - RNA, 16 nt, Human
acauuuccuaaauaua

SEQ ID NO: 3042742 - RNA, 17 nt, Human
acauuuccuaaauauau

SEQ ID NO: 3042743 - RNA, 23 nt, Human
aauuggguggggggcuucauaca

SEQ ID NO: 3042744 - RNA, 22 nt, Human
aauuggguggggggcuucauac

SEQ ID NO: 3042745 - RNA, 21 nt, Human
aauuggguggggggcuucaua

SEQ ID NO: 3042746 - RNA, 11 nt, Human
aauugugaugu

SEQ ID NO: 3042747 - RNA, 15 nt, Human
aauugugaugugucc

SEQ ID NO: 3042748 - RNA, 14 nt, Human
aauugugauguguc

SEQ ID NO: 3042749 - RNA, 18 nt, Human
aauuuucaucuaggauuu

SEQ ID NO: 3042750 - RNA, 12 nt, Human
acaaagaaauua

SEQ ID NO: 3042751 - RNA, 14 nt, Human
acaaagaaauuaug

SEQ ID NO: 3042752 - RNA, 16 nt, Human
acaaagaaauuaugug

SEQ ID NO: 3042753 - RNA, 23 nt, Human
acagaggacaguauuugugggga

SEQ ID NO: 3042754 - RNA, 20 nt, Human
acacugggagaaaugaaaaa

SEQ ID NO: 3042755 - RNA, 20 nt, Human
acacguaaugaaacuuggau

SEQ ID NO: 3042756 - RNA, 18 nt, Human
caaggaaaaaauaacaau

SEQ ID NO: 3042757 - RNA, 20 nt, Human
caaggaaaaaauaacaauga

SEQ ID NO: 3042758 - RNA, 12 nt, Human
caagccugguca

SEQ ID NO: 3042759 - RNA, 17 nt, Human
caagccuuggcucuacc

SEQ ID NO: 3042760 - RNA, 18 nt, Human
caagccuggucagcccaa

SEQ ID NO: 3042761 - RNA, 17 nt, Human
caagccuggucagccca

SEQ ID NO: 3042762 - RNA, 16 nt, Human
caagccuggucagccc

SEQ ID NO: 3042763 - RNA, 15 nt, Human
caagccuggucagcc

SEQ ID NO: 3042764 - RNA, 19 nt, Human
caauaauaaauauuuuugc

SEQ ID NO: 3042765 - RNA, 15 nt, Human
caaauaaaaauauug

SEQ ID NO: 3042766 - RNA, 16 nt, Human
caaauaaaaauauugu

SEQ ID NO: 3042767 - RNA, 18 nt, Human
caaauaaaaauauugugu

SEQ ID NO: 3042768 - RNA, 19 nt, Human
caaagagagaaaauaaaga

SEQ ID NO: 3042769 - RNA, 15 nt, Human
caaagaaauuaugug

SEQ ID NO: 3042770 - RNA, 16 nt, Human
caaagagagaaaauaa

SEQ ID NO: 3042771 - RNA, 23 nt, Human
caaauauauucagccuggcuuca

SEQ ID NO: 3042772 - RNA, 18 nt, Human
caaaauaauuuuaagaaa

SEQ ID NO: 3042773 - RNA, 22 nt, Human
caaaauaauuuuaagaaaucaa

SEQ ID NO: 3042774 - RNA, 13 nt, Human
cacaggaaaccag

SEQ ID NO: 3042775 - RNA, 19 nt, Human
cauccuacccccugugccu

SEQ ID NO: 3042776 - RNA, 12 nt, Human
caucuaggauuu

SEQ ID NO: 3042777 - RNA, 18 nt, Human
caucuagguaaauuacag

SEQ ID NO: 3042778 - RNA, 17 nt, Human
caucuagguaaauuaca

SEQ ID NO: 3042779 - RNA, 22 nt, Human
caucaagucuuucacauuuaaa

SEQ ID NO: 3042780 - RNA, 14 nt, Human
cauauuuuucacau

SEQ ID NO: 3042781 - RNA, 21 nt, Human
cauauuuuucacauaucuagu

SEQ ID NO: 3042782 - RNA, 12 nt, Human
cauauuuauaaa

SEQ ID NO: 3042783 - RNA, 18 nt, Human
cauauuuuucacauaucu

SEQ ID NO: 3042784 - RNA, 17 nt, Human
cauauuuauaaaaauaa

SEQ ID NO: 3042785 - RNA, 21 nt, Human
cauaugauguacauguacuga

SEQ ID NO: 3042786 - RNA, 15 nt, Human
cauaugauguacaug

SEQ ID NO: 3042787 - RNA, 17 nt, Human
cauaugauguacaugua

SEQ ID NO: 3042788 - RNA, 14 nt, Human
cauagaauaaaauu

SEQ ID NO: 3042789 - RNA, 20 nt, Human
cauagaauaaaauuuuuaau

SEQ ID NO: 3042790 - RNA, 19 nt, Human
cagugucuggcugcagagc

SEQ ID NO: 3042791 - RNA, 17 nt, Human
cagugucuggcugcaga

SEQ ID NO: 3042792 - RNA, 23 nt, Human
cagugugucuaaauuugaauguu

SEQ ID NO: 3042793 - RNA, 14 nt, Human
cagugugucuaaau

SEQ ID NO: 3042794 - RNA, 11 nt, Human
cagugguuaag

SEQ ID NO: 3042795 - RNA, 16 nt, Human
caguggcuggaucugu

SEQ ID NO: 3042796 - RNA, 20 nt, Human
caguggcuggaucugugagg

SEQ ID NO: 3042797 - RNA, 18 nt, Human
caguggcuggaucuguga

SEQ ID NO: 3042798 - RNA, 16 nt, Human
caguucucuucacuca

SEQ ID NO: 3042799 - RNA, 22 nt, Human
caguucggugagcuacaaaugc

SEQ ID NO: 3042800 - RNA, 18 nt, Human
caguguuccgugguuaaa

SEQ ID NO: 3042801 - RNA, 14 nt, Human
cauaaagcaggcag

SEQ ID NO: 3042802 - RNA, 16 nt, Human
cauaaagcaggcagaa

SEQ ID NO: 3042803 - RNA, 23 nt, Human
cauaaaaagccugcaauuucaua

SEQ ID NO: 3042804 - RNA, 23 nt, Human
cauaaaaacaacuuuauacccag

SEQ ID NO: 3042805 - RNA, 21 nt, Human
cauaaaaacaacuuuauaccc

SEQ ID NO: 3042806 - RNA, 20 nt, Human
cauaaaaacaacuuuauacc

SEQ ID NO: 3042807 - RNA, 17 nt, Human
cauaaaaacaacuuuau

SEQ ID NO: 3042808 - RNA, 15 nt, Human
cauacauuguacgaa

SEQ ID NO: 3042809 - RNA, 19 nt, Human
cauacauauuuuuguagca

SEQ ID NO: 3042810 - RNA, 12 nt, Human
cauacauauuuu

SEQ ID NO: 3042811 - RNA, 15 nt, Human
cauaauacuugcuuu

SEQ ID NO: 3042812 - RNA, 11 nt, Human
cauacauauuu

SEQ ID NO: 3042813 - RNA, 18 nt, Human
cauaaucacaacccuuca

SEQ ID NO: 3042814 - RNA, 18 nt, Human
cauaaguaauucaagaaa

SEQ ID NO: 3042815 - RNA, 22 nt, Human
cauaaguaauucaagaaaacaa

SEQ ID NO: 3042816 - RNA, 16 nt, Human
cauaaguaauucaaga

SEQ ID NO: 3042817 - RNA, 17 nt, Human
cauaaguaauucaagaa

SEQ ID NO: 3042818 - RNA, 15 nt, Human
cauaaaaacaacuuu

SEQ ID NO: 3042819 - RNA, 15 nt, Human
cauaccuggcccugu

SEQ ID NO: 3042820 - RNA, 16 nt, Human
ccaagagccugagagu

SEQ ID NO: 3042821 - RNA, 13 nt, Human
ccaagaggcugca

SEQ ID NO: 3042822 - RNA, 12 nt, Human
ccaagaggcugc

SEQ ID NO: 3042823 - RNA, 12 nt, Human
ccaagagccuga

SEQ ID NO: 3042824 - RNA, 22 nt, Human
cauguuucuuuguaaugaaaac

SEQ ID NO: 3042825 - RNA, 20 nt, Human
cauguuucuuuguaaugaaa

SEQ ID NO: 3042826 - RNA, 21 nt, Human
cauguuucuuuguaaugaaaa

SEQ ID NO: 3042827 - RNA, 15 nt, Human
caugugaaaucauuc

SEQ ID NO: 3042828 - RNA, 16 nt, Human
caugugaaaucauuca

SEQ ID NO: 3042829 - RNA, 17 nt, Human
caugugaaaucauucau

SEQ ID NO: 3042830 - RNA, 20 nt, Human
cauggugacuuuugaaaaga

SEQ ID NO: 3042831 - RNA, 22 nt, Human
cauuaccucagugagaagccag

SEQ ID NO: 3042832 - RNA, 21 nt, Human
cauuaccucagugagaagcca

SEQ ID NO: 3042833 - RNA, 19 nt, Human
cauggggcugauuguauuu

SEQ ID NO: 3042834 - RNA, 21 nt, Human
cauggagauagccccacagga

SEQ ID NO: 3042835 - RNA, 22 nt, Human
cauggacuucugccagcauaau

SEQ ID NO: 3042836 - RNA, 17 nt, Human
ccuccauccuacccccu

SEQ ID NO: 3042837 - RNA, 22 nt, Human
ccuccauccuacccccugugcc

SEQ ID NO: 3042838 - RNA, 23 nt, Human
ccuccauccuacccccugugccu

SEQ ID NO: 3042839 - RNA, 13 nt, Human
ccuccacucuccu

SEQ ID NO: 3042840 - RNA, 14 nt, Human
ccucuacugggagc

SEQ ID NO: 3042841 - RNA, 18 nt, Human
ccucagccccgcguggaa

SEQ ID NO: 3042842 - RNA, 22 nt, Human
ccuaucuguuuacaguguuccg

SEQ ID NO: 3042843 - RNA, 14 nt, Human
ccucacacucaccc

SEQ ID NO: 3042844 - RNA, 19 nt, Human
ccggggccugggcaggagg

SEQ ID NO: 3042845 - RNA, 15 nt, Human
ccggggccugggcag

SEQ ID NO: 3042846 - RNA, 13 nt, Human
ccgggagcucagg

SEQ ID NO: 3042847 - RNA, 15 nt, Human
ccgggagcucaggaa

SEQ ID NO: 3042848 - RNA, 17 nt, Human
ccggcuuuguggcacug

SEQ ID NO: 3042849 - RNA, 19 nt, Human
ccggcuuuguggcacuggg

SEQ ID NO: 3042850 - RNA, 16 nt, Human
ccggcuuuguggcacu

SEQ ID NO: 3042851 - RNA, 13 nt, Human
cccuggugguuca

SEQ ID NO: 3042852 - RNA, 13 nt, Human
ccuaaacauauga

SEQ ID NO: 3042853 - RNA, 15 nt, Human
ccuacagcccaccug

SEQ ID NO: 3042854 - RNA, 22 nt, Human
ccuagguauaauucacauugua

SEQ ID NO: 3042855 - RNA, 12 nt, Human
cccugccuggac

SEQ ID NO: 3042856 - RNA, 13 nt, Human
cccugccuggacc

SEQ ID NO: 3042857 - RNA, 18 nt, Human
cccugccuggaccagccu

SEQ ID NO: 3042858 - RNA, 16 nt, Human
cccugccucucugcag

SEQ ID NO: 3042859 - RNA, 21 nt, Human
cccugccucucugcagguccc

SEQ ID NO: 3042860 - RNA, 22 nt, Human
cccugccucucugcaggucccu

SEQ ID NO: 3042861 - RNA, 21 nt, Human
cccuggacugugugcucagga

SEQ ID NO: 3042862 - RNA, 17 nt, Human
cccugggaggcucugga

SEQ ID NO: 3042863 - RNA, 18 nt, Human
cccugggaggcucuggag

SEQ ID NO: 3042864 - RNA, 15 nt, Human
cccugggaggcucug

SEQ ID NO: 3042865 - RNA, 16 nt, Human
cccugggaggcucugg

SEQ ID NO: 3042866 - RNA, 20 nt, Human
cccucuacugggagccuacc

SEQ ID NO: 3042867 - RNA, 17 nt, Human
cccucuacugggagccu

SEQ ID NO: 3042868 - RNA, 20 nt, Human
cccugccaucauguuuacag

SEQ ID NO: 3042869 - RNA, 11 nt, Human
cccugccucuc

SEQ ID NO: 3042870 - RNA, 18 nt, Human
cccugccucucugcaggu

SEQ ID NO: 3042871 - RNA, 14 nt, Human
cccucaucuuucuu

SEQ ID NO: 3042872 - RNA, 19 nt, Human
cccucauuggcucuugaac

SEQ ID NO: 3042873 - RNA, 23 nt, Human
cccucccucuacugggagccuac

SEQ ID NO: 3042874 - RNA, 12 nt, Human
cccuaauaaagc

SEQ ID NO: 3042875 - RNA, 13 nt, Human
cccuaauaaagcu

SEQ ID NO: 3042876 - RNA, 14 nt, Human
cccuaauaaagcug

SEQ ID NO: 3042877 - RNA, 15 nt, Human
cccuaauaaagcugu

SEQ ID NO: 3042878 - RNA, 18 nt, Human
cccuaauaaagcugugug

SEQ ID NO: 3042879 - RNA, 23 nt, Human
ccccuggugguucacucuuggag

SEQ ID NO: 3042880 - RNA, 23 nt, Human
ccccacaggagguggucugggac

SEQ ID NO: 3042881 - RNA, 21 nt, Human
ccccagcuggggccaggcugg

SEQ ID NO: 3042882 - RNA, 22 nt, Human
ccccagcuggggccaggcuggg

SEQ ID NO: 3042883 - RNA, 18 nt, Human
cccagaaugccuccugca

SEQ ID NO: 3042884 - RNA, 21 nt, Human
cccagcuaugguucucucgca

SEQ ID NO: 3042885 - RNA, 16 nt, Human
cccaggaccccugagu

SEQ ID NO: 3042886 - RNA, 22 nt, Human
ccaucauguuuacagaggacag

SEQ ID NO: 3042887 - RNA, 20 nt, Human
ccaucauguuuacagaggac

SEQ ID NO: 3042888 - RNA, 13 nt, Human
cuacccccugugc

SEQ ID NO: 3042889 - RNA, 14 nt, Human
cuacccccugugcc

SEQ ID NO: 3042890 - RNA, 19 nt, Human
cuaauguaauaacugugaa

SEQ ID NO: 3042891 - RNA, 12 nt, Human
cuaauaaagcug

SEQ ID NO: 3042892 - RNA, 13 nt, Human
cuaauaaagcugu

SEQ ID NO: 3042893 - RNA, 21 nt, Human
cuacuguaaggcaaucauggu

SEQ ID NO: 3042894 - RNA, 16 nt, Human
cuaguaugaaauuaua

SEQ ID NO: 3042895 - RNA, 18 nt, Human
cuaugacauaaaaacaac

SEQ ID NO: 3042896 - RNA, 21 nt, Human
cuaucuguuuacaguguuccg

SEQ ID NO: 3042897 - RNA, 17 nt, Human
cuaucuguuuacagugu

SEQ ID NO: 3042898 - RNA, 20 nt, Human
cuaucuguuuacaguguucc

SEQ ID NO: 3042899 - RNA, 21 nt, Human
cuaugacauaaaaacaacuuu

SEQ ID NO: 3042900 - RNA, 18 nt, Human
cuauuuuaauaaacacuc

SEQ ID NO: 3042901 - RNA, 22 nt, Human
cuauuuuaauaaacacucuuga

SEQ ID NO: 3042902 - RNA, 16 nt, Human
cguuguccucagcccc

SEQ ID NO: 3042903 - RNA, 17 nt, Human
cuaaauauauuuuaaga

SEQ ID NO: 3042904 - RNA, 18 nt, Human
cuaaauauauuuuaagac

SEQ ID NO: 3042905 - RNA, 20 nt, Human
cuaaauauauuuuaagacga

SEQ ID NO: 3042906 - RNA, 15 nt, Human
cuaacaugauuuggg

SEQ ID NO: 3042907 - RNA, 23 nt, Human
cuaaauuugaauguuaagcagau

SEQ ID NO: 3042908 - RNA, 23 nt, Human
cguggcuguggcauccagagucc

SEQ ID NO: 3042909 - RNA, 19 nt, Human
cggggccugggcaggaggg

SEQ ID NO: 3042910 - RNA, 17 nt, Human
cggggccugggcaggag

SEQ ID NO: 3042911 - RNA, 18 nt, Human
cgggggcagucugagaga

SEQ ID NO: 3042912 - RNA, 21 nt, Human
cgggggcagucugagagaggc

SEQ ID NO: 3042913 - RNA, 17 nt, Human
cgggggcagucugagag

SEQ ID NO: 3042914 - RNA, 17 nt, Human
cgggagccugacccuca

SEQ ID NO: 3042915 - RNA, 12 nt, Human
cggcugggagga

SEQ ID NO: 3042916 - RNA, 15 nt, Human
cgggucaucuguacc

SEQ ID NO: 3042917 - RNA, 22 nt, Human
cgggucaucuguaccucugccu

SEQ ID NO: 3042918 - RNA, 17 nt, Human
cggugagcuacaaaugc

SEQ ID NO: 3042919 - RNA, 15 nt, Human
cggcuggacuuggag

SEQ ID NO: 3042920 - RNA, 16 nt, Human
cgcccuggacugugug

SEQ ID NO: 3042921 - RNA, 23 nt, Human
cucuuggggaguuuagggugggg

SEQ ID NO: 3042922 - RNA, 21 nt, Human
cucuuggggaguuuagggugg

SEQ ID NO: 3042923 - RNA, 22 nt, Human
cucugugcccacccuccacucu

SEQ ID NO: 3042924 - RNA, 19 nt, Human
cucuggagcccacuguacu

SEQ ID NO: 3042925 - RNA, 19 nt, Human
cugaggcagguccccagac

SEQ ID NO: 3042926 - RNA, 18 nt, Human
cugaggcagguccccaga

SEQ ID NO: 3042927 - RNA, 17 nt, Human
cugaggcagguccccag

SEQ ID NO: 3042928 - RNA, 14 nt, Human
cugaggcagguccc

SEQ ID NO: 3042929 - RNA, 19 nt, Human
cugaggaucagaguaaucc

SEQ ID NO: 3042930 - RNA, 17 nt, Human
cugaggaucagaguaau

SEQ ID NO: 3042931 - RNA, 11 nt, Human
cugagaaauuu

SEQ ID NO: 3042932 - RNA, 14 nt, Human
cugagaaauuuaua

SEQ ID NO: 3042933 - RNA, 15 nt, Human
cugacuaugacauaa

SEQ ID NO: 3042934 - RNA, 15 nt, Human
cugacagauuuccau

SEQ ID NO: 3042935 - RNA, 11 nt, Human
cugacagauuu

SEQ ID NO: 3042936 - RNA, 22 nt, Human
cucuccacucaugugacucuuu

SEQ ID NO: 3042937 - RNA, 21 nt, Human
cucuccacucaugugacucuu

SEQ ID NO: 3042938 - RNA, 18 nt, Human
cucuccugucucccuccu

SEQ ID NO: 3042939 - RNA, 15 nt, Human
cucuccugucucccu

SEQ ID NO: 3042940 - RNA, 17 nt, Human
cucuccugucucccucc

SEQ ID NO: 3042941 - RNA, 21 nt, Human
cucuccugauagucuuucagu

SEQ ID NO: 3042942 - RNA, 21 nt, Human
cucuacugggagccuacccac

SEQ ID NO: 3042943 - RNA, 18 nt, Human
cucuacugggagccuacc

SEQ ID NO: 3042944 - RNA, 21 nt, Human
cuccucgagaucccaacacug

SEQ ID NO: 3042945 - RNA, 24 nt, Human
cuccucgagaucccaacacugcca

SEQ ID NO: 3042946 - RNA, 17 nt, Human
cuccucgagaucccaac

SEQ ID NO: 3042947 - RNA, 20 nt, Human
cuccauccuacccccugugc

SEQ ID NO: 3042948 - RNA, 22 nt, Human
cuccauccuacccccugugccu

SEQ ID NO: 3042949 - RNA, 23 nt, Human
cuccauccuacccccugugccuu

SEQ ID NO: 3042950 - RNA, 18 nt, Human
cuccauccuacccccugu

SEQ ID NO: 3042951 - RNA, 19 nt, Human
cugcccgggagcucaggaa

SEQ ID NO: 3042952 - RNA, 18 nt, Human
cugcccgggagcucagga

SEQ ID NO: 3042953 - RNA, 11 nt, Human
cugccaggaga

SEQ ID NO: 3042954 - RNA, 17 nt, Human
cugccagacccccugga

SEQ ID NO: 3042955 - RNA, 19 nt, Human
cugccagacccccuggaga

SEQ ID NO: 3042956 - RNA, 23 nt, Human
cugcagagcugcgggcugggugu

SEQ ID NO: 3042957 - RNA, 11 nt, Human
cugcagguccc

SEQ ID NO: 3042958 - RNA, 12 nt, Human
cugcaggucccu

SEQ ID NO: 3042959 - RNA, 13 nt, Human
cugcaggucccua

SEQ ID NO: 3042960 - RNA, 14 nt, Human
cugcaggucccuaa

SEQ ID NO: 3042961 - RNA, 15 nt, Human
cugcaggucccuaau

SEQ ID NO: 3042962 - RNA, 16 nt, Human
cugcaggucccuaaua

SEQ ID NO: 3042963 - RNA, 17 nt, Human
cugcaggucccuaauaa

SEQ ID NO: 3042964 - RNA, 18 nt, Human
cugcaggucccuaauaaa

SEQ ID NO: 3042965 - RNA, 23 nt, Human
cugcaggucccuaauaaagcugu

SEQ ID NO: 3042966 - RNA, 19 nt, Human
cugcaggucccuaauaaag

SEQ ID NO: 3042967 - RNA, 20 nt, Human
cugcaggucccuaauaaagc

SEQ ID NO: 3042968 - RNA, 21 nt, Human
cugcaggucccuaauaaagcu

SEQ ID NO: 3042969 - RNA, 22 nt, Human
cugcaggucccuaauaaagcug

SEQ ID NO: 3042970 - RNA, 22 nt, Human
cugcgggcuggguguggucucc

SEQ ID NO: 3042971 - RNA, 22 nt, Human
cugccugcuuuuuauggccugu

SEQ ID NO: 3042972 - RNA, 14 nt, Human
cugcugccugcuuu

SEQ ID NO: 3042973 - RNA, 23 nt, Human
cugcugccugcuuuuuauggccu

SEQ ID NO: 3042974 - RNA, 15 nt, Human
cugcucugugcccac

SEQ ID NO: 3042975 - RNA, 18 nt, Human
cuggcuguggccuaaccu

SEQ ID NO: 3042976 - RNA, 19 nt, Human
cugggaggagggcaggcau

SEQ ID NO: 3042977 - RNA, 16 nt, Human
cugggagccuacccac

SEQ ID NO: 3042978 - RNA, 22 nt, Human
cugggagccuacccacccccag

SEQ ID NO: 3042979 - RNA, 19 nt, Human
cugggagccuacccacccc

SEQ ID NO: 3042980 - RNA, 17 nt, Human
cugggaggcucuggagc

SEQ ID NO: 3042981 - RNA, 18 nt, Human
cugggaggcucuggagcc

SEQ ID NO: 3042982 - RNA, 20 nt, Human
cugggaggcucuggagccca

SEQ ID NO: 3042983 - RNA, 21 nt, Human
cugggaggcucuggagcccac

SEQ ID NO: 3042984 - RNA, 16 nt, Human
cuggcacagccuggcu

SEQ ID NO: 3042985 - RNA, 21 nt, Human
cuggcacagccuggcuguggc

SEQ ID NO: 3042986 - RNA, 15 nt, Human
cuggcacagccuggc

SEQ ID NO: 3042987 - RNA, 23 nt, Human
cuggcacagccuggcuguggccu

SEQ ID NO: 3042988 - RNA, 20 nt, Human
cuggaagugcuaauuuugaa

SEQ ID NO: 3042989 - RNA, 13 nt, Human
cuggucagcccaa

SEQ ID NO: 3042990 - RNA, 12 nt, Human
cuggucagccca

SEQ ID NO: 3042991 - RNA, 16 nt, Human
cugggucgcccuggac

SEQ ID NO: 3042992 - RNA, 22 nt, Human
cugggucgcccuggacugugug

SEQ ID NO: 3042993 - RNA, 17 nt, Human
cugggucgcccuggacu

SEQ ID NO: 3042994 - RNA, 18 nt, Human
cugggucgcccuggacug

SEQ ID NO: 3042995 - RNA, 18 nt, Human
cuguaaggcaaucauggu

SEQ ID NO: 3042996 - RNA, 14 nt, Human
cuguaccucugccu

SEQ ID NO: 3042997 - RNA, 21 nt, Human
gaaggaucccaugagcuccuu

SEQ ID NO: 3042998 - RNA, 21 nt, Human
gaaggugaggagcuugaaacc

SEQ ID NO: 3042999 - RNA, 22 nt, Human
gaagcuucuggugaccuuccaa

SEQ ID NO: 3043000 - RNA, 23 nt, Human
gaaggaaccaaagcgaauuuuaa

SEQ ID NO: 3043001 - RNA, 22 nt, Human
gaacuuguaaaggaauuuaaaa

SEQ ID NO: 3043002 - RNA, 13 nt, Human
gaagaaguguguc

SEQ ID NO: 3043003 - RNA, 20 nt, Human
gaagaguauuuuugacagaa

SEQ ID NO: 3043004 - RNA, 17 nt, Human
gaagauugagauguguu

SEQ ID NO: 3043005 - RNA, 22 nt, Human
gaagauugagauguguucacaa

SEQ ID NO: 3043006 - RNA, 20 nt, Human
gaaacuaggugcauauuuau

SEQ ID NO: 3043007 - RNA, 19 nt, Human
gaaacuaggugcauauuua

SEQ ID NO: 3043008 - RNA, 23 nt, Human
gaaaguuauugauaaguucauac

SEQ ID NO: 3043009 - RNA, 14 nt, Human
gaacaucccuccug

SEQ ID NO: 3043010 - RNA, 11 nt, Human
gaaccaaagcg

SEQ ID NO: 3043011 - RNA, 23 nt, Human
gaaccaaagcgaauuuuaaaaga

SEQ ID NO: 3043012 - RNA, 20 nt, Human
gaaccaaagcgaauuuuaaa

SEQ ID NO: 3043013 - RNA, 18 nt, Human
gaacagauaaucagugug

SEQ ID NO: 3043014 - RNA, 23 nt, Human
gaaauuauauaaguauucuaaau

SEQ ID NO: 3043015 - RNA, 17 nt, Human
gaaauuauauaaguauu

SEQ ID NO: 3043016 - RNA, 23 nt, Human
gaaauuaguacuccccuccuuga

SEQ ID NO: 3043017 - RNA, 23 nt, Human
cuugucacgccagacuucccacg

SEQ ID NO: 3043018 - RNA, 18 nt, Human
cuuguauuauguguguuu

SEQ ID NO: 3043019 - RNA, 13 nt, Human
cuuguauuaugug

SEQ ID NO: 3043020 - RNA, 20 nt, Human
cuuggggaguuuaggguggg

SEQ ID NO: 3043021 - RNA, 21 nt, Human
cuuggggaguuuagggugggg

SEQ ID NO: 3043022 - RNA, 13 nt, Human
cuuggagccugca

SEQ ID NO: 3043023 - RNA, 18 nt, Human
cuuggagccugcagagcu

SEQ ID NO: 3043024 - RNA, 17 nt, Human
cuuggagccugcagagc

SEQ ID NO: 3043025 - RNA, 16 nt, Human
cuuggagccugcagag

SEQ ID NO: 3043026 - RNA, 15 nt, Human
cuuggagccugcaga

SEQ ID NO: 3043027 - RNA, 20 nt, Human
cuuggagccugcagagcugc

SEQ ID NO: 3043028 - RNA, 19 nt, Human
cuuggagccugcagagcug

SEQ ID NO: 3043029 - RNA, 15 nt, Human
cuugcuuuuaaaauc

SEQ ID NO: 3043030 - RNA, 17 nt, Human
cuugccaaauauaaaua

SEQ ID NO: 3043031 - RNA, 19 nt, Human
cuugaacugagcuuggaag

SEQ ID NO: 3043032 - RNA, 17 nt, Human
cuugaacugagcuugga

SEQ ID NO: 3043033 - RNA, 12 nt, Human
cuuuggacuugu

SEQ ID NO: 3043034 - RNA, 16 nt, Human
cuuuggaacaagaugg

SEQ ID NO: 3043035 - RNA, 16 nt, Human
cuuuucuuucuaccaa

SEQ ID NO: 3043036 - RNA, 19 nt, Human
cuuuuuuaucaugugaaau

SEQ ID NO: 3043037 - RNA, 19 nt, Human
cuuucuuccaaacaggcuc

SEQ ID NO: 3043038 - RNA, 13 nt, Human
cuuucuuccaaac

SEQ ID NO: 3043039 - RNA, 21 nt, Human
cuuuauuuucuauaauuuaaa

SEQ ID NO: 3043040 - RNA, 19 nt, Human
cuuuauuuuguguuuagga

SEQ ID NO: 3043041 - RNA, 20 nt, Human
cuuuccaaagccaaugugaa

SEQ ID NO: 3043042 - RNA, 21 nt, Human
cuuuccacuccuccuagccac

SEQ ID NO: 3043043 - RNA, 23 nt, Human
cuuuccaaagccaaugugaacag

SEQ ID NO: 3043044 - RNA, 18 nt, Human
cuuuccacuccuccuagc

SEQ ID NO: 3043045 - RNA, 21 nt, Human
gagccugacccucaucuuucu

SEQ ID NO: 3043046 - RNA, 17 nt, Human
gagccuacccaccccca

SEQ ID NO: 3043047 - RNA, 15 nt, Human
gagccuacccacccc

SEQ ID NO: 3043048 - RNA, 18 nt, Human
gagcccacuguacuugcu

SEQ ID NO: 3043049 - RNA, 21 nt, Human
gagcccacuguacuugcucuu

SEQ ID NO: 3043050 - RNA, 21 nt, Human
gagcucaggaaccgaggcagg

SEQ ID NO: 3043051 - RNA, 20 nt, Human
gagcucaggaaccgaggcag

SEQ ID NO: 3043052 - RNA, 20 nt, Human
gagcuccuuaaggcucuuuu

SEQ ID NO: 3043053 - RNA, 22 nt, Human
gagcuugaaacccguggcgcuu

SEQ ID NO: 3043054 - RNA, 18 nt, Human
gacuugucccgggacacc

SEQ ID NO: 3043055 - RNA, 14 nt, Human
gagaaauuuauaaa

SEQ ID NO: 3043056 - RNA, 16 nt, Human
gagacagccaacuaug

SEQ ID NO: 3043057 - RNA, 22 nt, Human
gagaagccagcuuuccucauca

SEQ ID NO: 3043058 - RNA, 13 nt, Human
gagagaggccauu

SEQ ID NO: 3043059 - RNA, 21 nt, Human
gagagaggccauucuuuccca

SEQ ID NO: 3043060 - RNA, 15 nt, Human
gagagugagguggaa

SEQ ID NO: 3043061 - RNA, 17 nt, Human
gagauacagaauuuuau

SEQ ID NO: 3043062 - RNA, 15 nt, Human
gacaccuaggcuagg

SEQ ID NO: 3043063 - RNA, 16 nt, Human
gacaccuaggcuaggg

SEQ ID NO: 3043064 - RNA, 20 nt, Human
gacaccuaggcuaggguggg

SEQ ID NO: 3043065 - RNA, 22 nt, Human
gacagccaacuauggccugugg

SEQ ID NO: 3043066 - RNA, 19 nt, Human
gacagccaacuauggccug

SEQ ID NO: 3043067 - RNA, 17 nt, Human
gaccuuuccugaggaag

SEQ ID NO: 3043068 - RNA, 23 nt, Human
gaccugauuucugagcauuuaau

SEQ ID NO: 3043069 - RNA, 17 nt, Human
gaucccaugagcuccuu

SEQ ID NO: 3043070 - RNA, 15 nt, Human
gaucccaugagcucc

SEQ ID NO: 3043071 - RNA, 20 nt, Human
gaucauugugaaauuauuca

SEQ ID NO: 3043072 - RNA, 14 nt, Human
gaucauuaucagcc

SEQ ID NO: 3043073 - RNA, 14 nt, Human
gaucauugugaaau

SEQ ID NO: 3043074 - RNA, 22 nt, Human
gauagucuuucaguuaaggaga

SEQ ID NO: 3043075 - RNA, 15 nt, Human
gauaguaacaaugaa

SEQ ID NO: 3043076 - RNA, 14 nt, Human
gauagucuuucagu

SEQ ID NO: 3043077 - RNA, 19 nt, Human
gauaaaguugguaaaccuu

SEQ ID NO: 3043078 - RNA, 15 nt, Human
gauaaauauuauauu

SEQ ID NO: 3043079 - RNA, 22 nt, Human
gauaaauauuauauuauauaua

SEQ ID NO: 3043080 - RNA, 12 nt, Human
gauaaguucaua

SEQ ID NO: 3043081 - RNA, 16 nt, Human
gauaaguucauacauu

SEQ ID NO: 3043082 - RNA, 14 nt, Human
gauaaguucauaca

SEQ ID NO: 3043083 - RNA, 17 nt, Human
gauaggucagugcaaau

SEQ ID NO: 3043084 - RNA, 13 nt, Human
gauagaugugugg

SEQ ID NO: 3043085 - RNA, 23 nt, Human
gauagauaggucagugcaaauac

SEQ ID NO: 3043086 - RNA, 21 nt, Human
gaucugugaggggcucucuca

SEQ ID NO: 3043087 - RNA, 17 nt, Human
gaugaaaauauuuaaag

SEQ ID NO: 3043088 - RNA, 14 nt, Human
gaugaaaauauuua

SEQ ID NO: 3043089 - RNA, 16 nt, Human
gaugaaaauauuuaaa

SEQ ID NO: 3043090 - RNA, 15 nt, Human
gaugaaaauauuuaa

SEQ ID NO: 3043091 - RNA, 20 nt, Human
gauggcaaagaaggagagca

SEQ ID NO: 3043092 - RNA, 17 nt, Human
gaugacaacuucccagu

SEQ ID NO: 3043093 - RNA, 20 nt, Human
gcaaauccuugugggaaaag

SEQ ID NO: 3043094 - RNA, 17 nt, Human
gcaaaauugauguguuu

SEQ ID NO: 3043095 - RNA, 22 nt, Human
gcaaauccuugugggaaaagaa

SEQ ID NO: 3043096 - RNA, 22 nt, Human
gauuuggucaacacuaacauga

SEQ ID NO: 3043097 - RNA, 23 nt, Human
gauuugcucagugucuggcugca

SEQ ID NO: 3043098 - RNA, 20 nt, Human
gauuuggggcucagaguggg

SEQ ID NO: 3043099 - RNA, 17 nt, Human
gauuccagguggcauca

SEQ ID NO: 3043100 - RNA, 19 nt, Human
gcaggggccgggggcaguc

SEQ ID NO: 3043101 - RNA, 20 nt, Human
gcaggggccgggggcagucu

SEQ ID NO: 3043102 - RNA, 13 nt, Human
gcagguccccaga

SEQ ID NO: 3043103 - RNA, 13 nt, Human
gcauagaaguaaa

SEQ ID NO: 3043104 - RNA, 17 nt, Human
gcauagguuuaauaauu

SEQ ID NO: 3043105 - RNA, 19 nt, Human
gcauauuuauaaaaauaaa

SEQ ID NO: 3043106 - RNA, 20 nt, Human
gcauauuuuucacauaucua

SEQ ID NO: 3043107 - RNA, 19 nt, Human
gcauauuuuucacauaucu

SEQ ID NO: 3043108 - RNA, 16 nt, Human
gcauauuuuucacaua

SEQ ID NO: 3043109 - RNA, 15 nt, Human
gcauauuuuucacau

SEQ ID NO: 3043110 - RNA, 14 nt, Human
gcauauuuuucaca

SEQ ID NO: 3043111 - RNA, 18 nt, Human
gcauuauauuuguaaauu

SEQ ID NO: 3043112 - RNA, 18 nt, Human
gcauggagauagccccac

SEQ ID NO: 3043113 - RNA, 16 nt, Human
gcaucugaaaauugau

SEQ ID NO: 3043114 - RNA, 17 nt, Human
gcccgggagcucaggaa

SEQ ID NO: 3043115 - RNA, 19 nt, Human
gcccgggagcucaggaacc

SEQ ID NO: 3043116 - RNA, 15 nt, Human
gcccgggagcucagg

SEQ ID NO: 3043117 - RNA, 16 nt, Human
gccccugagaucucug

SEQ ID NO: 3043118 - RNA, 16 nt, Human
gcccagaaugaggcug

SEQ ID NO: 3043119 - RNA, 17 nt, Human
gcccagaaugaggcugc

SEQ ID NO: 3043120 - RNA, 22 nt, Human
gccagucccugaggcagguccc

SEQ ID NO: 3043121 - RNA, 16 nt, Human
gccagucccugaggca

SEQ ID NO: 3043122 - RNA, 23 nt, Human
gccaggcugggucgcccuggacu

SEQ ID NO: 3043123 - RNA, 17 nt, Human
gccaggcugggucgccc

SEQ ID NO: 3043124 - RNA, 21 nt, Human
gccaucauguuuacagaggac

SEQ ID NO: 3043125 - RNA, 17 nt, Human
gccaucauguuuacaga

SEQ ID NO: 3043126 - RNA, 17 nt, Human
gccugacccucaucuuu

SEQ ID NO: 3043127 - RNA, 21 nt, Human
gccucuccacucaugugacuc

SEQ ID NO: 3043128 - RNA, 20 nt, Human
gccucucauuccagaggaag

SEQ ID NO: 3043129 - RNA, 24 nt, Human
gccucuccacucaugugacucuuu

SEQ ID NO: 3043130 - RNA, 20 nt, Human
gccuccuacagcccaccugg

SEQ ID NO: 3043131 - RNA, 19 nt, Human
gccucucauuccagaggaa

SEQ ID NO: 3043132 - RNA, 18 nt, Human
gcgcggcugggaggaggg

SEQ ID NO: 3043133 - RNA, 12 nt, Human
gcgcggcuggga

SEQ ID NO: 3043134 - RNA, 16 nt, Human
gcuaagaauauuugaa

SEQ ID NO: 3043135 - RNA, 17 nt, Human
gcuaagaauauuugaau

SEQ ID NO: 3043136 - RNA, 18 nt, Human
gccuuuggacuugucccg

SEQ ID NO: 3043137 - RNA, 12 nt, Human
gccuguuuaaga

SEQ ID NO: 3043138 - RNA, 13 nt, Human
gccuguuuaagag

SEQ ID NO: 3043139 - RNA, 15 nt, Human
gccugcaauuucaua

SEQ ID NO: 3043140 - RNA, 23 nt, Human
gccugccacucaggcccaaagcc

SEQ ID NO: 3043141 - RNA, 15 nt, Human
gccugccacucaggc

SEQ ID NO: 3043142 - RNA, 17 nt, Human
gccugguccucacacuc

SEQ ID NO: 3043143 - RNA, 13 nt, Human
gucugagagaggc

SEQ ID NO: 3043144 - RNA, 14 nt, Human
gucugagagaggcc

SEQ ID NO: 3043145 - RNA, 15 nt, Human
gucugagagaggcca

SEQ ID NO: 3043146 - RNA, 18 nt, Human
gucugagagaggccauuc

SEQ ID NO: 3043147 - RNA, 22 nt, Human
gucuguguguuuaugugugugu

SEQ ID NO: 3043148 - RNA, 21 nt, Human
gucuguguguuuaugugugug

SEQ ID NO: 3043149 - RNA, 11 nt, Human
gucuguguguu

SEQ ID NO: 3043150 - RNA, 20 nt, Human
gucuguguguguguaugugg

SEQ ID NO: 3043151 - RNA, 16 nt, Human
gucuguguguguguau

SEQ ID NO: 3043152 - RNA, 12 nt, Human
gucugugugugu

SEQ ID NO: 3043153 - RNA, 11 nt, Human
gucugugugug

SEQ ID NO: 3043154 - RNA, 19 nt, Human
gucuugguuccagccugcc

SEQ ID NO: 3043155 - RNA, 17 nt, Human
gucuugguuccagccug

SEQ ID NO: 3043156 - RNA, 16 nt, Human
gucuugguuccagccu

SEQ ID NO: 3043157 - RNA, 13 nt, Human
gucccugccugga

SEQ ID NO: 3043158 - RNA, 13 nt, Human
gucuaaauuugaa

SEQ ID NO: 3043159 - RNA, 21 nt, Human
gucuaagauaguaacaaugaa

SEQ ID NO: 3043160 - RNA, 18 nt, Human
gucgucaaagcugaaaug

SEQ ID NO: 3043161 - RNA, 21 nt, Human
gucucuggauuauauuaugaa

SEQ ID NO: 3043162 - RNA, 17 nt, Human
gucucuggaauuugaaa

SEQ ID NO: 3043163 - RNA, 21 nt, Human
gugauuuuuaugccaccugaa

SEQ ID NO: 3043164 - RNA, 21 nt, Human
gugccaggauggaaugauggg

SEQ ID NO: 3043165 - RNA, 14 nt, Human
gugccuuuugccau

SEQ ID NO: 3043166 - RNA, 19 nt, Human
gugauauaaguguguguuu

SEQ ID NO: 3043167 - RNA, 18 nt, Human
gugaggagcuugaaaccc

SEQ ID NO: 3043168 - RNA, 21 nt, Human
gugacuauggagcugagcagg

SEQ ID NO: 3043169 - RNA, 22 nt, Human
gugaccuuccaagagccugaga

SEQ ID NO: 3043170 - RNA, 21 nt, Human
gugaccuuccaagagccugag

SEQ ID NO: 3043171 - RNA, 22 nt, Human
gugaauucuugaaggaaaauga

SEQ ID NO: 3043172 - RNA, 18 nt, Human
gugaauucuugaaggaaa

SEQ ID NO: 3043173 - RNA, 22 nt, Human
gucagcugggacaccccgacuu

SEQ ID NO: 3043174 - RNA, 18 nt, Human
gucccuaauaaagcugug

SEQ ID NO: 3043175 - RNA, 20 nt, Human
gucccuaauaaagcugugug

SEQ ID NO: 3043176 - RNA, 22 nt, Human
gucccugaggcagguccccaga

SEQ ID NO: 3043177 - RNA, 18 nt, Human
gucccugaggcagguccc

SEQ ID NO: 3043178 - RNA, 16 nt, Human
gucccugaagagaagg

SEQ ID NO: 3043179 - RNA, 15 nt, Human
gucccuaauaaagcu

SEQ ID NO: 3043180 - RNA, 16 nt, Human
gucccuaauaaagcug

SEQ ID NO: 3043181 - RNA, 17 nt, Human
gucccuaauaaagcugu

SEQ ID NO: 3043182 - RNA, 19 nt, Human
guagugauuuuuaugccac

SEQ ID NO: 3043183 - RNA, 17 nt, Human
guauaauucacauugua

SEQ ID NO: 3043184 - RNA, 14 nt, Human
guagguugggagaa

SEQ ID NO: 3043185 - RNA, 15 nt, Human
guagcacugacagau

SEQ ID NO: 3043186 - RNA, 14 nt, Human
guagcacugacaga

SEQ ID NO: 3043187 - RNA, 23 nt, Human
guaugaaauuauauaaguauucu

SEQ ID NO: 3043188 - RNA, 13 nt, Human
guaugaaauuaua

SEQ ID NO: 3043189 - RNA, 13 nt, Human
guucugccaggag

SEQ ID NO: 3043190 - RNA, 14 nt, Human
guucugccaggaga

SEQ ID NO: 3043191 - RNA, 12 nt, Human
guucugccagga

SEQ ID NO: 3043192 - RNA, 14 nt, Human
guugcaacuuugua

SEQ ID NO: 3043193 - RNA, 16 nt, Human
guugcaacuuuguaua

SEQ ID NO: 3043194 - RNA, 24 nt, Human
guucacucuuggagccugcagagc

SEQ ID NO: 3043195 - RNA, 20 nt, Human
guucacucuuggagccugca

SEQ ID NO: 3043196 - RNA, 17 nt, Human
guucacucuuggagccu

SEQ ID NO: 3043197 - RNA, 19 nt, Human
guucacucuuggagccugc

SEQ ID NO: 3043198 - RNA, 18 nt, Human
guucacucuuggagccug

SEQ ID NO: 3043199 - RNA, 16 nt, Human
guuccuagccaccgcc

SEQ ID NO: 3043200 - RNA, 15 nt, Human
guuccagccugccac

SEQ ID NO: 3043201 - RNA, 14 nt, Human
guuccagcaccaca

SEQ ID NO: 3043202 - RNA, 14 nt, Human
guuccagccugcca

SEQ ID NO: 3043203 - RNA, 13 nt, Human
guuccagccugcc

SEQ ID NO: 3043204 - RNA, 18 nt, Human
guucaauaauaaauauuu

SEQ ID NO: 3043205 - RNA, 17 nt, Human
gugucuggcacagccug

SEQ ID NO: 3043206 - RNA, 14 nt, Human
gugucuggcugcag

SEQ ID NO: 3043207 - RNA, 21 nt, Human
guguccugcaccggggccugg

SEQ ID NO: 3043208 - RNA, 17 nt, Human
gugugggaguguguaau

SEQ ID NO: 3043209 - RNA, 16 nt, Human
guguguuuaugugugu

SEQ ID NO: 3043210 - RNA, 12 nt, Human
guguguuuuaaa

SEQ ID NO: 3043211 - RNA, 15 nt, Human
guguguuuaugugug

SEQ ID NO: 3043212 - RNA, 14 nt, Human
guguguuuaugugu

SEQ ID NO: 3043213 - RNA, 17 nt, Human
guguguuguguguggga

SEQ ID NO: 3043214 - RNA, 14 nt, Human
guguguugugugug

SEQ ID NO: 3043215 - RNA, 12 nt, Human
guguguugugug

SEQ ID NO: 3043216 - RNA, 18 nt, Human
gugugcucaggagcccug

SEQ ID NO: 3043217 - RNA, 19 nt, Human
gugugcucaggagcccugg

SEQ ID NO: 3043218 - RNA, 16 nt, Human
gugugcucaggagccc

SEQ ID NO: 3043219 - RNA, 17 nt, Human
gugugcucaggagcccu

SEQ ID NO: 3043220 - RNA, 17 nt, Human
guuaaacucgcucacug

SEQ ID NO: 3043221 - RNA, 19 nt, Human
guguguuuuaaaaugagaa

SEQ ID NO: 3043222 - RNA, 13 nt, Human
guguguuuuaaaa

SEQ ID NO: 3043223 - RNA, 16 nt, Human
guguguuuuaaaauga

SEQ ID NO: 3043224 - RNA, 14 nt, Human
guguguuuuucaua

SEQ ID NO: 3043225 - RNA, 18 nt, Human
guguuuuucauaaagcag

SEQ ID NO: 3043226 - RNA, 21 nt, Human
guggggagagacgggcccugg

SEQ ID NO: 3043227 - RNA, 13 nt, Human
gugggccuggcca

SEQ ID NO: 3043228 - RNA, 13 nt, Human
gugcuaauuuuga

SEQ ID NO: 3043229 - RNA, 15 nt, Human
gugcuaauuuugaaa

SEQ ID NO: 3043230 - RNA, 17 nt, Human
guggcuggaucugugag

SEQ ID NO: 3043231 - RNA, 20 nt, Human
guguaauuuaaaauugugau

SEQ ID NO: 3043232 - RNA, 23 nt, Human
guguaauuuaaaauugugaugug

SEQ ID NO: 3043233 - RNA, 22 nt, Human
guguaauuuaaaauugugaugu

SEQ ID NO: 3043234 - RNA, 15 nt, Human
guguacuuaacuauu

SEQ ID NO: 3043235 - RNA, 18 nt, Human
guggucuccacuggggau

SEQ ID NO: 3043236 - RNA, 17 nt, Human
guuguccucagccccgc

SEQ ID NO: 3043237 - RNA, 23 nt, Human
guuguccucagccccgcguggaa

SEQ ID NO: 3043238 - RNA, 22 nt, Human
guugugugugggaguguguaau

SEQ ID NO: 3043239 - RNA, 16 nt, Human
guugugugugggagug

SEQ ID NO: 3043240 - RNA, 14 nt, Human
guugugugugggag

SEQ ID NO: 3043241 - RNA, 13 nt, Human
guuguguguggga

SEQ ID NO: 3043242 - RNA, 12 nt, Human
guuguguguggg

SEQ ID NO: 3043243 - RNA, 14 nt, Human
guugugaauguugu

SEQ ID NO: 3043244 - RNA, 16 nt, Human
guuuagaagaagugug

SEQ ID NO: 3043245 - RNA, 19 nt, Human
guuuaggaacuacugagga

SEQ ID NO: 3043246 - RNA, 15 nt, Human
guuuuaaaaugagaa

SEQ ID NO: 3043247 - RNA, 16 nt, Human
guuuuaaaaugagaaa

SEQ ID NO: 3043248 - RNA, 20 nt, Human
guuuucaaaauuguuacaaa

SEQ ID NO: 3043249 - RNA, 19 nt, Human
guuucuuuguaaugaaaac

SEQ ID NO: 3043250 - RNA, 18 nt, Human
guuucuuuguaaugaaaa

SEQ ID NO: 3043251 - RNA, 18 nt, Human
uaaagcaggcagaacuca

SEQ ID NO: 3043252 - RNA, 21 nt, Human
uaaaggcccuaucuguuuaca

SEQ ID NO: 3043253 - RNA, 14 nt, Human
uaaaguguuugaaa

SEQ ID NO: 3043254 - RNA, 18 nt, Human
uaaacacucuugaaaaau

SEQ ID NO: 3043255 - RNA, 15 nt, Human
uaaacacucuugaaa

SEQ ID NO: 3043256 - RNA, 17 nt, Human
uaaacacucuugaaaaa

SEQ ID NO: 3043257 - RNA, 22 nt, Human
uaaaacaagcacuaaacaaaga

SEQ ID NO: 3043258 - RNA, 13 nt, Human
uaaaaacaacuuu

SEQ ID NO: 3043259 - RNA, 19 nt, Human
uaaaaacaacuuuauaccc

SEQ ID NO: 3043260 - RNA, 18 nt, Human
uaaaaacaacuuuauacc

SEQ ID NO: 3043261 - RNA, 21 nt, Human
uaaaaacaaagaaauuaugug

SEQ ID NO: 3043262 - RNA, 17 nt, Human
uaaaaacaaagaaauua

SEQ ID NO: 3043263 - RNA, 21 nt, Human
uaaaaagacauucuuccaaaa

SEQ ID NO: 3043264 - RNA, 17 nt, Human
uaaaagauaaauauuau

SEQ ID NO: 3043265 - RNA, 23 nt, Human
uaauaaucauuggauucugagag

SEQ ID NO: 3043266 - RNA, 22 nt, Human
uaagugccaggauggaaugaug

SEQ ID NO: 3043267 - RNA, 22 nt, Human
uaagugauugcugguuuuaguu

SEQ ID NO: 3043268 - RNA, 11 nt, Human
uaauaaagcug

SEQ ID NO: 3043269 - RNA, 12 nt, Human
uaauaaagcugu

SEQ ID NO: 3043270 - RNA, 21 nt, Human
uaauaacugugaaguuuacau

SEQ ID NO: 3043271 - RNA, 16 nt, Human
uaaaguugguaaaccu

SEQ ID NO: 3043272 - RNA, 17 nt, Human
uaaaguugguaaaccuu

SEQ ID NO: 3043273 - RNA, 13 nt, Human
uaaauuuauguga

SEQ ID NO: 3043274 - RNA, 14 nt, Human
uaaauuugaauguu

SEQ ID NO: 3043275 - RNA, 22 nt, Human
uaaauuugaauguuaagcagau

SEQ ID NO: 3043276 - RNA, 13 nt, Human
uaaccagaucauu

SEQ ID NO: 3043277 - RNA, 19 nt, Human
uaagaaaucaaagagagaa

SEQ ID NO: 3043278 - RNA, 13 nt, Human
uaacugugaaguu

SEQ ID NO: 3043279 - RNA, 17 nt, Human
uaacugugaaguuuaca

SEQ ID NO: 3043280 - RNA, 18 nt, Human
uaacugugaaguuuacau

SEQ ID NO: 3043281 - RNA, 14 nt, Human
uacccagaaaguua

SEQ ID NO: 3043282 - RNA, 13 nt, Human
uacuugcucuuga

SEQ ID NO: 3043283 - RNA, 14 nt, Human
uacuugcucuugau

SEQ ID NO: 3043284 - RNA, 18 nt, Human
uacuugcucuugaugccu

SEQ ID NO: 3043285 - RNA, 19 nt, Human
uacuugcucuugaugccug

SEQ ID NO: 3043286 - RNA, 13 nt, Human
uacuuaacuauuc

SEQ ID NO: 3043287 - RNA, 21 nt, Human
uacugccuauuuuaauaaaca

SEQ ID NO: 3043288 - RNA, 14 nt, Human
uacugccuauuuua

SEQ ID NO: 3043289 - RNA, 15 nt, Human
uacuccccuccuuga

SEQ ID NO: 3043290 - RNA, 23 nt, Human
uacaguucggugagcuacaaaug

SEQ ID NO: 3043291 - RNA, 18 nt, Human
uacaguuccuagguauaa

SEQ ID NO: 3043292 - RNA, 20 nt, Human
uacaggaugaugacuaugga

SEQ ID NO: 3043293 - RNA, 20 nt, Human
uauauuuguaaauuuaugug

SEQ ID NO: 3043294 - RNA, 14 nt, Human
uauaucuuguagcu

SEQ ID NO: 3043295 - RNA, 22 nt, Human
uauaaacaugcuugcauuauau

SEQ ID NO: 3043296 - RNA, 15 nt, Human
uaggucucaauaccu

SEQ ID NO: 3043297 - RNA, 22 nt, Human
uagguuaauuccaauuauauga

SEQ ID NO: 3043298 - RNA, 15 nt, Human
uagcauggcauauuu

SEQ ID NO: 3043299 - RNA, 18 nt, Human
uagcauggcauauuuuuc

SEQ ID NO: 3043300 - RNA, 17 nt, Human
uagcauggcauauuuuu

SEQ ID NO: 3043301 - RNA, 16 nt, Human
uagccccucuccugga

SEQ ID NO: 3043302 - RNA, 19 nt, Human
ugacucuuuccaaccggcu

SEQ ID NO: 3043303 - RNA, 13 nt, Human
ugacucuuuccaa

SEQ ID NO: 3043304 - RNA, 14 nt, Human
ugacucuuuccaac

SEQ ID NO: 3043305 - RNA, 16 nt, Human
ugacucuuuccaaccg

SEQ ID NO: 3043306 - RNA, 13 nt, Human
ugaggcagguccc

SEQ ID NO: 3043307 - RNA, 19 nt, Human
ugaggaucagaguaaucca

SEQ ID NO: 3043308 - RNA, 13 nt, Human
ugaggaucagagu

SEQ ID NO: 3043309 - RNA, 17 nt, Human
ugaggaucagaguaauc

SEQ ID NO: 3043310 - RNA, 23 nt, Human
ugacagaauauguuucaaacuuu

SEQ ID NO: 3043311 - RNA, 22 nt, Human
ugacaacuucccagugaauucu

SEQ ID NO: 3043312 - RNA, 22 nt, Human
ugacagaauauguuucaaacuu

SEQ ID NO: 3043313 - RNA, 21 nt, Human
ugacagaauauguuucaaacu

SEQ ID NO: 3043314 - RNA, 18 nt, Human
ugacagaauauguuucaa

SEQ ID NO: 3043315 - RNA, 20 nt, Human
ugacaaagguaaaucagacu

SEQ ID NO: 3043316 - RNA, 16 nt, Human
ugaaggaaccaaagcg

SEQ ID NO: 3043317 - RNA, 15 nt, Human
ugaaggaaaaugaua

SEQ ID NO: 3043318 - RNA, 16 nt, Human
ugaagcuuuuauguga

SEQ ID NO: 3043319 - RNA, 21 nt, Human
ugaagcuuuuaugugaaacau

SEQ ID NO: 3043320 - RNA, 22 nt, Human
ugaagagaagggcagggcugag

SEQ ID NO: 3043321 - RNA, 20 nt, Human
ugaagagaagggcagggcug

SEQ ID NO: 3043322 - RNA, 13 nt, Human
ugaaacauguuuc

SEQ ID NO: 3043323 - RNA, 16 nt, Human
ugaaacacuuugcaua

SEQ ID NO: 3043324 - RNA, 14 nt, Human
ugaaguuuacauug

SEQ ID NO: 3043325 - RNA, 16 nt, Human
ugaaguuuacauugua

SEQ ID NO: 3043326 - RNA, 20 nt, Human
ugaaguuuacauuguaaaua

SEQ ID NO: 3043327 - RNA, 20 nt, Human
ugaaucucauaauuuauaca

SEQ ID NO: 3043328 - RNA, 13 nt, Human
ugaaucucauaau

SEQ ID NO: 3043329 - RNA, 19 nt, Human
ucuuuccaaccggcuuugu

SEQ ID NO: 3043330 - RNA, 19 nt, Human
ugaaaauuauuuuguucau

SEQ ID NO: 3043331 - RNA, 18 nt, Human
ugaaaaccacauuggaga

SEQ ID NO: 3043332 - RNA, 23 nt, Human
ugaaaauuauuuuguucauacau

SEQ ID NO: 3043333 - RNA, 22 nt, Human
ugaaaauuauuuuguucauaca

SEQ ID NO: 3043334 - RNA, 23 nt, Human
ugaaacacucaguuguucaauaa

SEQ ID NO: 3043335 - RNA, 15 nt, Human
ugaaacacuuugcau

SEQ ID NO: 3043336 - RNA, 19 nt, Human
ucuugccaaauauaaauaa

SEQ ID NO: 3043337 - RNA, 18 nt, Human
ucuuguagcuuuaucaaa

SEQ ID NO: 3043338 - RNA, 18 nt, Human
ucuugaacugagcuugga

SEQ ID NO: 3043339 - RNA, 17 nt, Human
ucuugaacugagcuugg

SEQ ID NO: 3043340 - RNA, 14 nt, Human
ucuuauaauuuaaa

SEQ ID NO: 3043341 - RNA, 13 nt, Human
ucuuauaauuuaa

SEQ ID NO: 3043342 - RNA, 11 nt, Human
ucugugugugu

SEQ ID NO: 3043343 - RNA, 22 nt, Human
ucuucauuaccucagugagaag

SEQ ID NO: 3043344 - RNA, 23 nt, Human
ucucauaauuuauacaggucaua

SEQ ID NO: 3043345 - RNA, 12 nt, Human
ucugagagcugu

SEQ ID NO: 3043346 - RNA, 23 nt, Human
ucuggugaccuuccaagagccug

SEQ ID NO: 3043347 - RNA, 18 nt, Human
ucuggugaccuuccaaga

SEQ ID NO: 3043348 - RNA, 16 nt, Human
ucuggugaccuuccaa

SEQ ID NO: 3043349 - RNA, 14 nt, Human
ucuggcugcagagc

SEQ ID NO: 3043350 - RNA, 15 nt, Human
ucuggcugcagagca

SEQ ID NO: 3043351 - RNA, 12 nt, Human
ucuggagcccac

SEQ ID NO: 3043352 - RNA, 16 nt, Human
ucuggagcccacugua

SEQ ID NO: 3043353 - RNA, 22 nt, Human
ucuggagcccacuguacuugcu

SEQ ID NO: 3043354 - RNA, 14 nt, Human
ucuggaauuugaaa

SEQ ID NO: 3043355 - RNA, 23 nt, Human
ucagccuccauccuacccccugu

SEQ ID NO: 3043356 - RNA, 22 nt, Human
ucaggagaguagaacagauaau

SEQ ID NO: 3043357 - RNA, 20 nt, Human
ucagaucauuaucagccugu

SEQ ID NO: 3043358 - RNA, 14 nt, Human
ucaucuuucuucca

SEQ ID NO: 3043359 - RNA, 17 nt, Human
ucaucuuucuuccaaac

SEQ ID NO: 3043360 - RNA, 24 nt, Human
ucauggacuucugccagcauaaua

SEQ ID NO: 3043361 - RNA, 17 nt, Human
ucaguucucuucacuca

SEQ ID NO: 3043362 - RNA, 14 nt, Human
ucaguucucuucac

SEQ ID NO: 3043363 - RNA, 19 nt, Human
ucagugugucuaaauuuga

SEQ ID NO: 3043364 - RNA, 15 nt, Human
uccagagucccugcc

SEQ ID NO: 3043365 - RNA, 17 nt, Human
uccacuuuaucuugaau

SEQ ID NO: 3043366 - RNA, 15 nt, Human
uccacuuuaucuuga

SEQ ID NO: 3043367 - RNA, 15 nt, Human
uccaagcaaauguga

SEQ ID NO: 3043368 - RNA, 17 nt, Human
uccaagcaaaugugaau

SEQ ID NO: 3043369 - RNA, 13 nt, Human
uccaagagccuga

SEQ ID NO: 3043370 - RNA, 14 nt, Human
uccaagagccugag

SEQ ID NO: 3043371 - RNA, 22 nt, Human
uccaagcccaguucagcuuggg

SEQ ID NO: 3043372 - RNA, 14 nt, Human
ucccaacacugcca

SEQ ID NO: 3043373 - RNA, 15 nt, Human
ucccaacacugccag

SEQ ID NO: 3043374 - RNA, 16 nt, Human
ucccaacacugccagc

SEQ ID NO: 3043375 - RNA, 16 nt, Human
uccucgagaucccaac

SEQ ID NO: 3043376 - RNA, 23 nt, Human
uccucgagaucccaacacugcca

SEQ ID NO: 3043377 - RNA, 23 nt, Human
ucccaugagcuccuuaaggcucu

SEQ ID NO: 3043378 - RNA, 22 nt, Human
ucccucuacugggagccuaccc

SEQ ID NO: 3043379 - RNA, 18 nt, Human
ucccucuacugggagccu

SEQ ID NO: 3043380 - RNA, 23 nt, Human
ucccucuacugggagccuaccca

SEQ ID NO: 3043381 - RNA, 22 nt, Human
ucucauaauuuauacaggucau

SEQ ID NO: 3043382 - RNA, 16 nt, Human
ucucauaauuuauaca

SEQ ID NO: 3043383 - RNA, 15 nt, Human
ucuagguaaauuaca

SEQ ID NO: 3043384 - RNA, 19 nt, Human
uccugucccucauccauag

SEQ ID NO: 3043385 - RNA, 18 nt, Human
uggaacucgugucuggca

SEQ ID NO: 3043386 - RNA, 22 nt, Human
uggaauaauccuaaacauauga

SEQ ID NO: 3043387 - RNA, 20 nt, Human
uggaaugaugggucaguugu

SEQ ID NO: 3043388 - RNA, 16 nt, Human
uggaaugcuguguuaa

SEQ ID NO: 3043389 - RNA, 14 nt, Human
uggaaagaguacuc

SEQ ID NO: 3043390 - RNA, 21 nt, Human
ugggacaccccgacuuuuguu

SEQ ID NO: 3043391 - RNA, 14 nt, Human
ugggagauguggaa

SEQ ID NO: 3043392 - RNA, 14 nt, Human
ugggaguacaaaag

SEQ ID NO: 3043393 - RNA, 21 nt, Human
ugggagugaggaugucugggc

SEQ ID NO: 3043394 - RNA, 20 nt, Human
uggggauugggccccugcca

SEQ ID NO: 3043395 - RNA, 11 nt, Human
ugggggaugua

SEQ ID NO: 3043396 - RNA, 15 nt, Human
ugggggucugugugu

SEQ ID NO: 3043397 - RNA, 18 nt, Human
ugggggucuguguguuua

SEQ ID NO: 3043398 - RNA, 18 nt, Human
uggguggggggcuucaua

SEQ ID NO: 3043399 - RNA, 21 nt, Human
uggguggggggcuucauacac

SEQ ID NO: 3043400 - RNA, 20 nt, Human
uggguggggggcuucauaca

SEQ ID NO: 3043401 - RNA, 16 nt, Human
ugcaccggggccuggg

SEQ ID NO: 3043402 - RNA, 22 nt, Human
ugcaccggggccugggcaggag

SEQ ID NO: 3043403 - RNA, 12 nt, Human
ugcaccggggcc

SEQ ID NO: 3043404 - RNA, 11 nt, Human
ugcagagcugc

SEQ ID NO: 3043405 - RNA, 22 nt, Human
ugcagagcagugggccuggcca

SEQ ID NO: 3043406 - RNA, 17 nt, Human
ugcccacccuccacucu

SEQ ID NO: 3043407 - RNA, 18 nt, Human
ugccaggauggaaugaug

SEQ ID NO: 3043408 - RNA, 22 nt, Human
ugccaaauauaaauaaaaauaa

SEQ ID NO: 3043409 - RNA, 19 nt, Human
ugccaaauauaaauaaaaa

SEQ ID NO: 3043410 - RNA, 18 nt, Human
ugccaaauauaaauaaaa

SEQ ID NO: 3043411 - RNA, 17 nt, Human
ugccaaauauaaauaaa

SEQ ID NO: 3043412 - RNA, 20 nt, Human
ugcauauuuauaaaaauaaa

SEQ ID NO: 3043413 - RNA, 21 nt, Human
ugcauauuuauaaaaauaaaa

SEQ ID NO: 3043414 - RNA, 15 nt, Human
ugccuggcggggugg

SEQ ID NO: 3043415 - RNA, 9 nt, Human
ugccucucu

SEQ ID NO: 3043416 - RNA, 17 nt, Human
ugcucuccaagcccagu

SEQ ID NO: 3043417 - RNA, 17 nt, Human
ugcucagagcaguguuu

SEQ ID NO: 3043418 - RNA, 21 nt, Human
uguccucagccccgcguggaa

SEQ ID NO: 3043419 - RNA, 22 nt, Human
ugucacccuuaggccagcacca

SEQ ID NO: 3043420 - RNA, 22 nt, Human
uguauaaaagggacugagaaau

SEQ ID NO: 3043421 - RNA, 22 nt, Human
uguacgaagaguauuuuugaca

SEQ ID NO: 3043422 - RNA, 14 nt, Human
uguaccucugccuc

SEQ ID NO: 3043423 - RNA, 14 nt, Human
uguacgaagaguau

SEQ ID NO: 3043424 - RNA, 18 nt, Human
uguagccccucuccugga

SEQ ID NO: 3043425 - RNA, 17 nt, Human
ugugccuugucacgcca

SEQ ID NO: 3043426 - RNA, 17 nt, Human
ugugccuuggugugcug

SEQ ID NO: 3043427 - RNA, 19 nt, Human
ugugccuugucacgccaga

SEQ ID NO: 3043428 - RNA, 20 nt, Human
ugugccuugucacgccagac

SEQ ID NO: 3043429 - RNA, 16 nt, Human
ugugccuuuugccauc

SEQ ID NO: 3043430 - RNA, 17 nt, Human
ugugcucaggagcccug

SEQ ID NO: 3043431 - RNA, 15 nt, Human
ugugcucaggagccc

SEQ ID NO: 3043432 - RNA, 16 nt, Human
ugugcucaggagcccu

SEQ ID NO: 3043433 - RNA, 15 nt, Human
uguggccuaaccugc

SEQ ID NO: 3043434 - RNA, 15 nt, Human
uguggaagugugggu

SEQ ID NO: 3043435 - RNA, 15 nt, Human
ugugggaguguguaa

SEQ ID NO: 3043436 - RNA, 14 nt, Human
ugugggagugugua

SEQ ID NO: 3043437 - RNA, 18 nt, Human
uguguaauuuaaaauugu

SEQ ID NO: 3043438 - RNA, 11 nt, Human
uguguaauuua

SEQ ID NO: 3043439 - RNA, 23 nt, Human
uguguaauuuaaaauugugaugu

SEQ ID NO: 3043440 - RNA, 22 nt, Human
uguguaauuuaaaauugugaug

SEQ ID NO: 3043441 - RNA, 19 nt, Human
uguguaauuuaaaauugug

SEQ ID NO: 3043442 - RNA, 17 nt, Human
ugucuggcacagccugg

SEQ ID NO: 3043443 - RNA, 21 nt, Human
ugucuuuccacuccuccuagc

SEQ ID NO: 3043444 - RNA, 13 nt, Human
ugugauauaagug

SEQ ID NO: 3043445 - RNA, 16 nt, Human
ugugauauaagugugu

SEQ ID NO: 3043446 - RNA, 18 nt, Human
ugugaagugaaugaaaca

SEQ ID NO: 3043447 - RNA, 21 nt, Human
ugugaauguugugauguauuc

SEQ ID NO: 3043448 - RNA, 12 nt, Human
uguucauacaua

SEQ ID NO: 3043449 - RNA, 17 nt, Human
uguucauaaauaaaguu

SEQ ID NO: 3043450 - RNA, 23 nt, Human
uguucauacauauuuuuguagca

SEQ ID NO: 3043451 - RNA, 14 nt, Human
uguucauacauauu

SEQ ID NO: 3043452 - RNA, 12 nt, Human
uguguauguggg

SEQ ID NO: 3043453 - RNA, 11 nt, Human
uguguaugugg

SEQ ID NO: 3043454 - RNA, 13 nt, Human
ugugugcucucca

SEQ ID NO: 3043455 - RNA, 15 nt, Human
ugugugggagugugu

SEQ ID NO: 3043456 - RNA, 14 nt, Human
ugugugggagugug

SEQ ID NO: 3043457 - RNA, 16 nt, Human
ugugugggagugugua

SEQ ID NO: 3043458 - RNA, 18 nt, Human
uguguuuuucauaaagca

SEQ ID NO: 3043459 - RNA, 15 nt, Human
uguguuuuucauaaa

SEQ ID NO: 3043460 - RNA, 16 nt, Human
uguucuuuugucccag

SEQ ID NO: 3043461 - RNA, 12 nt, Human
uguuuaagagac

SEQ ID NO: 3043462 - RNA, 12 nt, Human
uguuuacagugu

SEQ ID NO: 3043463 - RNA, 19 nt, Human
uguuuccauauuuuauagg

SEQ ID NO: 3043464 - RNA, 12 nt, Human
uuaagaguaaaa

SEQ ID NO: 3043465 - RNA, 12 nt, Human
uuacauuguaaa

SEQ ID NO: 3043466 - RNA, 13 nt, Human
uuacauuguaaau

SEQ ID NO: 3043467 - RNA, 16 nt, Human
uuaaugauaaguaaau

SEQ ID NO: 3043468 - RNA, 18 nt, Human
uuuuuaaagacuuuuaug

SEQ ID NO: 3043469 - RNA, 12 nt, Human
uuuuuaaagacu

SEQ ID NO: 3043470 - RNA, 13 nt, Human
uuuuuaaagacuu

SEQ ID NO: 3043471 - RNA, 19 nt, Human
uuuuguagcacugacagau

SEQ ID NO: 3043472 - RNA, 18 nt, Human
uuuuguagcacugacaga

SEQ ID NO: 3043473 - RNA, 20 nt, Human
uuuugaaucucauaauuuau

SEQ ID NO: 3043474 - RNA, 18 nt, Human
uuuucuaaaguaaaaaca

SEQ ID NO: 3043475 - RNA, 18 nt, Human
uuuuaaagacuuuuauga

SEQ ID NO: 3043476 - RNA, 20 nt, Human
uuuuaaaagaugcaauguag

SEQ ID NO: 3043477 - RNA, 15 nt, Human
uuugcaucugaaaau

SEQ ID NO: 3043478 - RNA, 22 nt, Human
uuugaauguaugcuucauacag

SEQ ID NO: 3043479 - RNA, 17 nt, Human
uuugaauguaugcuuca

SEQ ID NO: 3043480 - RNA, 18 nt, Human
uuugaaucaucaagucuu

SEQ ID NO: 3043481 - RNA, 22 nt, Human
uuugaaucucauaauuuauaca

SEQ ID NO: 3043482 - RNA, 21 nt, Human
uuugaaucucauaauuuauac

SEQ ID NO: 3043483 - RNA, 20 nt, Human
uuugaaucucauaauuuaua

SEQ ID NO: 3043484 - RNA, 19 nt, Human
uuugaaucucauaauuuau

SEQ ID NO: 3043485 - RNA, 16 nt, Human
uuugaaucucauaauu

SEQ ID NO: 3043486 - RNA, 12 nt, Human
uuucuaaaguaa

SEQ ID NO: 3043487 - RNA, 13 nt, Human
cuaguucugccag

SEQ ID NO: 3043488 - RNA, 15 nt, Human
cuaggguggggagag

SEQ ID NO: 3043489 - RNA, 14 nt, Human
cuaguucugccagg

SEQ ID NO: 3043490 - RNA, 15 nt, Human
cuaguucugccagga

SEQ ID NO: 3043491 - RNA, 16 nt, Human
cuaguucugccaggag

SEQ ID NO: 3043492 - RNA, 15 nt, Human
cuaggcuaggguggg

SEQ ID NO: 3043493 - RNA, 20 nt, Human
cuacuagggaaaugccuuug

SEQ ID NO: 3043494 - RNA, 12 nt, Human
cucagaauauug

SEQ ID NO: 3043495 - RNA, 18 nt, Human
cugacccucaucuuucuu

SEQ ID NO: 3043496 - RNA, 23 nt, Human
cugaggaagagggacuguucuuu

SEQ ID NO: 3043497 - RNA, 18 nt, Human
cugaggaagagggacugu

SEQ ID NO: 3043498 - RNA, 12 nt, Human
cugagcuuggaa

SEQ ID NO: 3043499 - RNA, 21 nt, Human
cugagcuuggaagcuucuggu

SEQ ID NO: 3043500 - RNA, 20 nt, Human
cugagcuuggaagcuucugg

SEQ ID NO: 3043501 - RNA, 14 nt, Human
cugagcuuggaagc

SEQ ID NO: 3043502 - RNA, 21 nt, Human
cugaggugggagauguggaaa

SEQ ID NO: 3043503 - RNA, 21 nt, Human
cugaguaaaaaagcugugugc

SEQ ID NO: 3043504 - RNA, 20 nt, Human
cucucuugauuaagaucuca

SEQ ID NO: 3043505 - RNA, 16 nt, Human
cuccuagccacccacc

SEQ ID NO: 3043506 - RNA, 14 nt, Human
ccauucuuucccaa

SEQ ID NO: 3043507 - RNA, 20 nt, Human
ccauucuuucccaacaccuc

SEQ ID NO: 3043508 - RNA, 12 nt, Human
ccauucuuuccc

SEQ ID NO: 3043509 - RNA, 23 nt, Human
ccagggggccagucccugaggca

SEQ ID NO: 3043510 - RNA, 15 nt, Human
ccagucccugaggca

SEQ ID NO: 3043511 - RNA, 10 nt, Human
ccccugccag

SEQ ID NO: 3043512 - RNA, 18 nt, Human
ccugacccucaucuuucu

SEQ ID NO: 3043513 - RNA, 19 nt, Human
ccugacccucaucuuucuu

SEQ ID NO: 3043514 - RNA, 17 nt, Human
ccugagaucucugcagg

SEQ ID NO: 3043515 - RNA, 18 nt, Human
ccugagaucucugcagga

SEQ ID NO: 3043516 - RNA, 19 nt, Human
ccugaguuccuagccaccg

SEQ ID NO: 3043517 - RNA, 21 nt, Human
ccugaguuccuagccaccgcc

SEQ ID NO: 3043518 - RNA, 20 nt, Human
ccugaguuccuagccaccgc

SEQ ID NO: 3043519 - RNA, 18 nt, Human
ccugaguuccuagccacc

SEQ ID NO: 3043520 - RNA, 20 nt, Human
ccugccaucauguuuacaga

SEQ ID NO: 3043521 - RNA, 18 nt, Human
ccugccaucauguuuaca

SEQ ID NO: 3043522 - RNA, 14 nt, Human
ccugccucucugca

SEQ ID NO: 3043523 - RNA, 15 nt, Human
ccugccucucugcag

SEQ ID NO: 3043524 - RNA, 13 nt, Human
ccugccucucugc

SEQ ID NO: 3043525 - RNA, 21 nt, Human
ccugucucccuccucugcccg

SEQ ID NO: 3043526 - RNA, 18 nt, Human
ccuggugguggcucggga

SEQ ID NO: 3043527 - RNA, 21 nt, Human
ccuggugguggcucgggaggc

SEQ ID NO: 3043528 - RNA, 12 nt, Human
ccuggugguuca

SEQ ID NO: 3043529 - RNA, 22 nt, Human
ccuggugguucacucuuggagc

SEQ ID NO: 3043530 - RNA, 13 nt, Human
ccuggugguucac

SEQ ID NO: 3043531 - RNA, 12 nt, Human
ccuagccaccca

SEQ ID NO: 3043532 - RNA, 16 nt, Human
ccuagccacccaccac

SEQ ID NO: 3043533 - RNA, 12 nt, Human
ccuaauaaagcu

SEQ ID NO: 3043534 - RNA, 15 nt, Human
ccuccuagccaccca

SEQ ID NO: 3043535 - RNA, 18 nt, Human
cagucugagagaggccau

SEQ ID NO: 3043536 - RNA, 15 nt, Human
cagguuugggacccc

SEQ ID NO: 3043537 - RNA, 18 nt, Human
cagguuugggaccccugg

SEQ ID NO: 3043538 - RNA, 15 nt, Human
caggccugacucuca

SEQ ID NO: 3043539 - RNA, 13 nt, Human
caggaggaagggg

SEQ ID NO: 3043540 - RNA, 14 nt, Human
caggaccccugagu

SEQ ID NO: 3043541 - RNA, 12 nt, Human
caggaccccuga

SEQ ID NO: 3043542 - RNA, 15 nt, Human
caggagguggucugg

SEQ ID NO: 3043543 - RNA, 21 nt, Human
cagcagguccccagcuuuggc

SEQ ID NO: 3043544 - RNA, 20 nt, Human
cauaauuuauacaggucaua

SEQ ID NO: 3043545 - RNA, 13 nt, Human
cauaauuuauaca

SEQ ID NO: 3043546 - RNA, 19 nt, Human
cauccauggggcugauugu

SEQ ID NO: 3043547 - RNA, 12 nt, Human
caugcacaaauu

SEQ ID NO: 3043548 - RNA, 17 nt, Human
ccaccgccuccuacagc

SEQ ID NO: 3043549 - RNA, 21 nt, Human
cauuuggagacacaacuauuu

SEQ ID NO: 3043550 - RNA, 19 nt, Human
cauuguaaauaguauuuga

SEQ ID NO: 3043551 - RNA, 22 nt, Human
cacuguuuugaaucucauaauu

SEQ ID NO: 3043552 - RNA, 19 nt, Human
cacugggagaaaugaaaaa

SEQ ID NO: 3043553 - RNA, 11 nt, Human
cagaaaguuau

SEQ ID NO: 3043554 - RNA, 16 nt, Human
cagaaaguuauugaua

SEQ ID NO: 3043555 - RNA, 17 nt, Human
auuguguugugaauguu

SEQ ID NO: 3043556 - RNA, 14 nt, Human
auuguguugugaau

SEQ ID NO: 3043557 - RNA, 16 nt, Human
auuuaugcauauuauu

SEQ ID NO: 3043558 - RNA, 22 nt, Human
auuuaugcauauuauuuuaugu

SEQ ID NO: 3043559 - RNA, 16 nt, Human
auuucauaugcuguau

SEQ ID NO: 3043560 - RNA, 20 nt, Human
auuaguacuccccuccuuga

SEQ ID NO: 3043561 - RNA, 16 nt, Human
caagaugguucuagca

SEQ ID NO: 3043562 - RNA, 13 nt, Human
caagaugguucua

SEQ ID NO: 3043563 - RNA, 18 nt, Human
caaagggugaaaauuauu

SEQ ID NO: 3043564 - RNA, 14 nt, Human
caaagguaaaucag

SEQ ID NO: 3043565 - RNA, 15 nt, Human
caaaccaaauaaaaa

SEQ ID NO: 3043566 - RNA, 14 nt, Human
caaaccaaauaaaa

SEQ ID NO: 3043567 - RNA, 21 nt, Human
caaaaggauaaugaauacuuu

SEQ ID NO: 3043568 - RNA, 16 nt, Human
auuuuauaucuuguag

SEQ ID NO: 3043569 - RNA, 14 nt, Human
auuuuauaucuugu

SEQ ID NO: 3043570 - RNA, 12 nt, Human
auuuuauaucuu

SEQ ID NO: 3043571 - RNA, 20 nt, Human
gcucaggaaccgaggcaggg

SEQ ID NO: 3043572 - RNA, 21 nt, Human
gcucaggaaccgaggcaggga

SEQ ID NO: 3043573 - RNA, 16 nt, Human
gcucaggaaccgaggc

SEQ ID NO: 3043574 - RNA, 19 nt, Human
gcucaggaaccgaggcagg

SEQ ID NO: 3043575 - RNA, 14 nt, Human
gcuaugagggccuu

SEQ ID NO: 3043576 - RNA, 22 nt, Human
gcuaauucuuugaccuguuggg

SEQ ID NO: 3043577 - RNA, 18 nt, Human
gcucccccuccaccugcu

SEQ ID NO: 3043578 - RNA, 17 nt, Human
gcucccccuccaccugc

SEQ ID NO: 3043579 - RNA, 23 nt, Human
gccuccauccuacccccugugcc

SEQ ID NO: 3043580 - RNA, 17 nt, Human
gccucgacacagagugg

SEQ ID NO: 3043581 - RNA, 16 nt, Human
gccccugccagacccc

SEQ ID NO: 3043582 - RNA, 11 nt, Human
gccccugccag

SEQ ID NO: 3043583 - RNA, 20 nt, Human
gccccugccucucugcaggu

SEQ ID NO: 3043584 - RNA, 23 nt, Human
gccccugccucucugcagguccc

SEQ ID NO: 3043585 - RNA, 16 nt, Human
gcuucuaguucugcca

SEQ ID NO: 3043586 - RNA, 17 nt, Human
gcuucuaguucugccag

SEQ ID NO: 3043587 - RNA, 23 nt, Human
gcugggccccugccucucugcag

SEQ ID NO: 3043588 - RNA, 21 nt, Human
gcugggccccugccucucugc

SEQ ID NO: 3043589 - RNA, 22 nt, Human
gcugggccccugccucucugca

SEQ ID NO: 3043590 - RNA, 12 nt, Human
ggaagugugggu

SEQ ID NO: 3043591 - RNA, 22 nt, Human
ggaagugugggucugugugugu

SEQ ID NO: 3043592 - RNA, 21 nt, Human
ggaagugugggucugugugug

SEQ ID NO: 3043593 - RNA, 20 nt, Human
ggaacugcugggcuuggcag

SEQ ID NO: 3043594 - RNA, 20 nt, Human
ggcucagaggguguccugca

SEQ ID NO: 3043595 - RNA, 14 nt, Human
ggcucagagugggg

SEQ ID NO: 3043596 - RNA, 22 nt, Human
gggacaccuaggcuaggguggg

SEQ ID NO: 3043597 - RNA, 18 nt, Human
gggacaggggcaggagga

SEQ ID NO: 3043598 - RNA, 17 nt, Human
gggacaggggcaggagg

SEQ ID NO: 3043599 - RNA, 14 nt, Human
aaaaauaacaauga

SEQ ID NO: 3043600 - RNA, 14 nt, Human
ggcugggucgcccu

SEQ ID NO: 3043601 - RNA, 17 nt, Human
ggcugggucgcccugga

SEQ ID NO: 3043602 - RNA, 20 nt, Human
ggcugggucgcccuggacug

SEQ ID NO: 3043603 - RNA, 11 nt, Human
ggcuucauaca

SEQ ID NO: 3043604 - RNA, 9 nt, Human
ggcuucaua

SEQ ID NO: 3043605 - RNA, 12 nt, Human
ggcuucauacac

SEQ ID NO: 3043606 - RNA, 21 nt, Human
aaaagauuuucagaaaauauu

SEQ ID NO: 3043607 - RNA, 18 nt, Human
aaaagccaagaggcugca

SEQ ID NO: 3043608 - RNA, 23 nt, Human
ggccagucccugaggcagguccc

SEQ ID NO: 3043609 - RNA, 17 nt, Human
ggccagucccugaggca

SEQ ID NO: 3043610 - RNA, 21 nt, Human
ggccccugccucucugcaggu

SEQ ID NO: 3043611 - RNA, 15 nt, Human
ggcagggcugaggcc

SEQ ID NO: 3043612 - RNA, 22 nt, Human
ggugcuucuaguucugccagga

SEQ ID NO: 3043613 - RNA, 15 nt, Human
gguggaauuauuuua

SEQ ID NO: 3043614 - RNA, 21 nt, Human
ggugcauauuuauaaaaauaa

SEQ ID NO: 3043615 - RNA, 11 nt, Human
ggugcugggcc

SEQ ID NO: 3043616 - RNA, 13 nt, Human
ggugcugggcccc

SEQ ID NO: 3043617 - RNA, 15 nt, Human
ggugcugggccccug

SEQ ID NO: 3043618 - RNA, 16 nt, Human
ggugcugggccccugc

SEQ ID NO: 3043619 - RNA, 14 nt, Human
ggucgcccuggacu

SEQ ID NO: 3043620 - RNA, 22 nt, Human
ggugaaaauuauuuuguucaua

SEQ ID NO: 3043621 - RNA, 14 nt, Human
ggugaaaauuauuu

SEQ ID NO: 3043622 - RNA, 13 nt, Human
ggugaaaauuauu

SEQ ID NO: 3043623 - RNA, 20 nt, Human
aaagggacugagaaauuuau

SEQ ID NO: 3043624 - RNA, 14 nt, Human
aaagguaaaucaga

SEQ ID NO: 3043625 - RNA, 17 nt, Human
aaagggugaaaauuauu

SEQ ID NO: 3043626 - RNA, 18 nt, Human
ggguggggagagacgggc

SEQ ID NO: 3043627 - RNA, 17 nt, Human
ggguggggggcuucaua

SEQ ID NO: 3043628 - RNA, 13 nt, Human
ggguggggagaga

SEQ ID NO: 3043629 - RNA, 14 nt, Human
ggguggggagagac

SEQ ID NO: 3043630 - RNA, 19 nt, Human
ggguggggggcuucauaca

SEQ ID NO: 3043631 - RNA, 19 nt, Human
aaacuuguaaauaaaggaa

SEQ ID NO: 3043632 - RNA, 16 nt, Human
aaacuuguauuaugug

SEQ ID NO: 3043633 - RNA, 13 nt, Human
aaagacagugaaa

SEQ ID NO: 3043634 - RNA, 22 nt, Human
aaagaccuuuggagcaaagcug

SEQ ID NO: 3043635 - RNA, 22 nt, Human
aaagagaugaugaaaauauuua

SEQ ID NO: 3043636 - RNA, 20 nt, Human
aaagagaugaugaaaauauu

SEQ ID NO: 3043637 - RNA, 19 nt, Human
aaagagaugaugaaaauau

SEQ ID NO: 3043638 - RNA, 18 nt, Human
gggggcgcggcugggagg

SEQ ID NO: 3043639 - RNA, 19 nt, Human
gggggugcugggccccugc

SEQ ID NO: 3043640 - RNA, 13 nt, Human
gggucgcccugga

SEQ ID NO: 3043641 - RNA, 15 nt, Human
gggucgcccuggacu

SEQ ID NO: 3043642 - RNA, 18 nt, Human
aaaccuuuguuugcaucu

SEQ ID NO: 3043643 - RNA, 18 nt, Human
aaaccuuuuauauuuagu

SEQ ID NO: 3043644 - RNA, 18 nt, Human
aaacuaggugcauauuua

SEQ ID NO: 3043645 - RNA, 22 nt, Human
aaacuaggugcauauuuauaaa

SEQ ID NO: 3043646 - RNA, 17 nt, Human
ggggccgggggcagucu

SEQ ID NO: 3043647 - RNA, 17 nt, Human
aaaguugguaaaccuuu

SEQ ID NO: 3043648 - RNA, 16 nt, Human
aaaguugguaaaccuu

SEQ ID NO: 3043649 - RNA, 14 nt, Human
aaauaaaaauauug

SEQ ID NO: 3043650 - RNA, 20 nt, Human
aaaguuauugauaaguucau

SEQ ID NO: 3043651 - RNA, 20 nt, Human
guaauaggcguaacuaauuu

SEQ ID NO: 3043652 - RNA, 19 nt, Human
guaauagagcaaaauugau

SEQ ID NO: 3043653 - RNA, 15 nt, Human
guaauaacugugaag

SEQ ID NO: 3043654 - RNA, 16 nt, Human
guaauaacugugaagu

SEQ ID NO: 3043655 - RNA, 22 nt, Human
guaauaacugugaaguuuacau

SEQ ID NO: 3043656 - RNA, 21 nt, Human
guaauccaagcaaaugugaau

SEQ ID NO: 3043657 - RNA, 23 nt, Human
guaauuuaaaauugugauguguc

SEQ ID NO: 3043658 - RNA, 20 nt, Human
guaauuuaaaauugugaugu

SEQ ID NO: 3043659 - RNA, 19 nt, Human
guaauuuaaaauugugaug

SEQ ID NO: 3043660 - RNA, 14 nt, Human
aaauauuauguguu

SEQ ID NO: 3043661 - RNA, 15 nt, Human
aaauauuauguguuu

SEQ ID NO: 3043662 - RNA, 14 nt, Human
aaaucagacuauga

SEQ ID NO: 3043663 - RNA, 21 nt, Human
aaaucagacuaugaaguuuuu

SEQ ID NO: 3043664 - RNA, 15 nt, Human
aaauccacuuuaucu

SEQ ID NO: 3043665 - RNA, 20 nt, Human
guaccaagacuacuagggaa

SEQ ID NO: 3043666 - RNA, 23 nt, Human
guaccaagacuacuagggaaaug

SEQ ID NO: 3043667 - RNA, 15 nt, Human
guacauuuggagaca

SEQ ID NO: 3043668 - RNA, 15 nt, Human
guagagccagagguc

SEQ ID NO: 3043669 - RNA, 14 nt, Human
guacuuaacuauuc

SEQ ID NO: 3043670 - RNA, 15 nt, Human
gacccucaucuuucu

SEQ ID NO: 3043671 - RNA, 19 nt, Human
gacccucaucuuucuucca

SEQ ID NO: 3043672 - RNA, 20 nt, Human
gacccucaucuuucuuccaa

SEQ ID NO: 3043673 - RNA, 15 nt, Human
gacuauggagcugag

SEQ ID NO: 3043674 - RNA, 14 nt, Human
gacugugugcucag

SEQ ID NO: 3043675 - RNA, 16 nt, Human
gacugugugcucagga

SEQ ID NO: 3043676 - RNA, 17 nt, Human
gacugugugcucaggag

SEQ ID NO: 3043677 - RNA, 20 nt, Human
gacugugugcucaggagccc

SEQ ID NO: 3043678 - RNA, 20 nt, Human
gacaggggcaggaggaaggg

SEQ ID NO: 3043679 - RNA, 18 nt, Human
gacaggggcaggaggaag

SEQ ID NO: 3043680 - RNA, 19 nt, Human
gacagguuugggaccccug

SEQ ID NO: 3043681 - RNA, 22 nt, Human
gacagguuugggaccccuggug

SEQ ID NO: 3043682 - RNA, 18 nt, Human
gagguggaauuauuuuaa

SEQ ID NO: 3043683 - RNA, 19 nt, Human
gaggcugcagccaggccac

SEQ ID NO: 3043684 - RNA, 14 nt, Human
gaggcucuggagcc

SEQ ID NO: 3043685 - RNA, 19 nt, Human
gaggcucuggagcccacug

SEQ ID NO: 3043686 - RNA, 18 nt, Human
gagcagugggccuggcca

SEQ ID NO: 3043687 - RNA, 17 nt, Human
gagcagugggccuggcc

SEQ ID NO: 3043688 - RNA, 15 nt, Human
gagcagugggccugg

SEQ ID NO: 3043689 - RNA, 20 nt, Human
gagcugugcaucagcuagaa

SEQ ID NO: 3043690 - RNA, 18 nt, Human
gcauuucccuuccuuccu

SEQ ID NO: 3043691 - RNA, 12 nt, Human
gccaagaggcug

SEQ ID NO: 3043692 - RNA, 14 nt, Human
gccaagaggcugca

SEQ ID NO: 3043693 - RNA, 13 nt, Human
gccaagaggcugc

SEQ ID NO: 3043694 - RNA, 14 nt, Human
gccaacuauggccu

SEQ ID NO: 3043695 - RNA, 15 nt, Human
gccaacuauggccug

SEQ ID NO: 3043696 - RNA, 19 nt, Human
gccaacuauggccugugga

SEQ ID NO: 3043697 - RNA, 18 nt, Human
gcauggcauauuuuucac

SEQ ID NO: 3043698 - RNA, 17 nt, Human
gccaagaggcugcagcc

SEQ ID NO: 3043699 - RNA, 14 nt, Human
gaugaugacuaugg

SEQ ID NO: 3043700 - RNA, 17 nt, Human
cuucuaguucugccagg

SEQ ID NO: 3043701 - RNA, 18 nt, Human
cuucuaguucugccagga

SEQ ID NO: 3043702 - RNA, 16 nt, Human
cuucuaguucugccag

SEQ ID NO: 3043703 - RNA, 19 nt, Human
cuucuaguucugccaggag

SEQ ID NO: 3043704 - RNA, 20 nt, Human
cuucucacauuuauauuuuu

SEQ ID NO: 3043705 - RNA, 13 nt, Human
cuucucacauuua

SEQ ID NO: 3043706 - RNA, 20 nt, Human
cuugauuaagaucucagugg

SEQ ID NO: 3043707 - RNA, 13 nt, Human
cuuuguaaugaaa

SEQ ID NO: 3043708 - RNA, 16 nt, Human
cuuuguaaugaaaacc

SEQ ID NO: 3043709 - RNA, 14 nt, Human
cuuuguaaugaaaa

SEQ ID NO: 3043710 - RNA, 15 nt, Human
cuuuguaaugaaaac

SEQ ID NO: 3043711 - RNA, 14 nt, Human
cuuugaccuguugg

SEQ ID NO: 3043712 - RNA, 23 nt, Human
gaaaauuauuuuguucauacaua

SEQ ID NO: 3043713 - RNA, 18 nt, Human
gaaaacuuguauuaugug

SEQ ID NO: 3043714 - RNA, 19 nt, Human
gaaaacuuguauuaugugu

SEQ ID NO: 3043715 - RNA, 22 nt, Human
gaaaacuuguauuauguguguu

SEQ ID NO: 3043716 - RNA, 22 nt, Human
gaaaauuauuuuguucauacau

SEQ ID NO: 3043717 - RNA, 21 nt, Human
gaaaauuauuuuguucauaca

SEQ ID NO: 3043718 - RNA, 20 nt, Human
gaaaauuauuuuguucauac

SEQ ID NO: 3043719 - RNA, 22 nt, Human
gaaaagaaaucuaugauuccag

SEQ ID NO: 3043720 - RNA, 18 nt, Human
gaaaucuaugauuccagg

SEQ ID NO: 3043721 - RNA, 20 nt, Human
gaaaucuaugauuccaggug

SEQ ID NO: 3043722 - RNA, 11 nt, Human
gaaaugaaaaa

SEQ ID NO: 3043723 - RNA, 22 nt, Human
gaaccccuggcuccaggccagg

SEQ ID NO: 3043724 - RNA, 18 nt, Human
gaaccccuggcuccaggc

SEQ ID NO: 3043725 - RNA, 14 nt, Human
gaacugagcuugga

SEQ ID NO: 3043726 - RNA, 22 nt, Human
gaacugagcuuggaagcuucug

SEQ ID NO: 3043727 - RNA, 21 nt, Human
gaacugagcuuggaagcuucu

SEQ ID NO: 3043728 - RNA, 16 nt, Human
gaacugagcuuggaag

SEQ ID NO: 3043729 - RNA, 15 nt, Human
gaacugagcuuggaa

SEQ ID NO: 3043730 - RNA, 20 nt, Human
cugugccuugucacgccaga

SEQ ID NO: 3043731 - RNA, 16 nt, Human
cugugccuuuugccau

SEQ ID NO: 3043732 - RNA, 15 nt, Human
cuuaggccagcacca

SEQ ID NO: 3043733 - RNA, 14 nt, Human
cuguuuaagagaca

SEQ ID NO: 3043734 - RNA, 12 nt, Human
cuguuuaagaga

SEQ ID NO: 3043735 - RNA, 13 nt, Human
cuggacuuggagg

SEQ ID NO: 3043736 - RNA, 16 nt, Human
cugccugguccucaca

SEQ ID NO: 3043737 - RNA, 23 nt, Human
cugccugguccucacacucaccc

SEQ ID NO: 3043738 - RNA, 19 nt, Human
cugccugguccucacacuc

SEQ ID NO: 3043739 - RNA, 17 nt, Human
cugccugguccucacac

SEQ ID NO: 3043740 - RNA, 23 nt, Human
cuggccccugagaucucugcagg

SEQ ID NO: 3043741 - RNA, 22 nt, Human
cuggccccugagaucucugcag

SEQ ID NO: 3043742 - RNA, 18 nt, Human
cuggccccugagaucucu

SEQ ID NO: 3043743 - RNA, 18 nt, Human
cugggaauaagugccagg

SEQ ID NO: 3043744 - RNA, 15 nt, Human
cuggggccaggcugg

SEQ ID NO: 3043745 - RNA, 16 nt, Human
cuggggaugucucuca

SEQ ID NO: 3043746 - RNA, 17 nt, Human
guggcacuggggcaggg

SEQ ID NO: 3043747 - RNA, 18 nt, Human
guggcacuggggcagggg

SEQ ID NO: 3043748 - RNA, 11 nt, Human
aagaauauuug

SEQ ID NO: 3043749 - RNA, 15 nt, Human
aagaauauuugaaug

SEQ ID NO: 3043750 - RNA, 16 nt, Human
gugcugggccccugcc

SEQ ID NO: 3043751 - RNA, 19 nt, Human
gugcugggccccugccucu

SEQ ID NO: 3043752 - RNA, 20 nt, Human
guggaauuauuuuaaaagau

SEQ ID NO: 3043753 - RNA, 14 nt, Human
guggaagagggcug

SEQ ID NO: 3043754 - RNA, 17 nt, Human
guggaagagggcugcaa

SEQ ID NO: 3043755 - RNA, 20 nt, Human
aagagaugaugaaaauauuu

SEQ ID NO: 3043756 - RNA, 18 nt, Human
guggggggggugcugggc

SEQ ID NO: 3043757 - RNA, 14 nt, Human
gugggggucugugu

SEQ ID NO: 3043758 - RNA, 16 nt, Human
gugggggucugugugu

SEQ ID NO: 3043759 - RNA, 15 nt, Human
gugggggucugugug

SEQ ID NO: 3043760 - RNA, 20 nt, Human
gugguucacucuuggagccu

SEQ ID NO: 3043761 - RNA, 13 nt, Human
aagcaaaugugaa

SEQ ID NO: 3043762 - RNA, 14 nt, Human
aagcaaaugugaau

SEQ ID NO: 3043763 - RNA, 15 nt, Human
aagaugcaauguaga

SEQ ID NO: 3043764 - RNA, 16 nt, Human
gugugugggagugugu

SEQ ID NO: 3043765 - RNA, 13 nt, Human
guguguguaugug

SEQ ID NO: 3043766 - RNA, 14 nt, Human
guguguguaugugg

SEQ ID NO: 3043767 - RNA, 17 nt, Human
guguguguugugugugg

SEQ ID NO: 3043768 - RNA, 13 nt, Human
guguucugugaua

SEQ ID NO: 3043769 - RNA, 15 nt, Human
guccugcaccggggc

SEQ ID NO: 3043770 - RNA, 19 nt, Human
guccugcaccggggccugg

SEQ ID NO: 3043771 - RNA, 20 nt, Human
guccugcaccggggccuggg

SEQ ID NO: 3043772 - RNA, 14 nt, Human
gucgcccuggacug

SEQ ID NO: 3043773 - RNA, 22 nt, Human
aacauuuguucuauagcuuuuc

SEQ ID NO: 3043774 - RNA, 12 nt, Human
aacauaauuaaa

SEQ ID NO: 3043775 - RNA, 16 nt, Human
gugaagugaaugaaac

SEQ ID NO: 3043776 - RNA, 21 nt, Human
gugagguggaauuauuuuaaa

SEQ ID NO: 3043777 - RNA, 18 nt, Human
uaaaccucaaaaugucua

SEQ ID NO: 3043778 - RNA, 19 nt, Human
uaaaccucaaaaugucuaa

SEQ ID NO: 3043779 - RNA, 16 nt, Human
uaaagacuuuuaugau

SEQ ID NO: 3043780 - RNA, 17 nt, Human
guuuuuuuuuaaagacu

SEQ ID NO: 3043781 - RNA, 20 nt, Human
aaguuauugauaaguucaua

SEQ ID NO: 3043782 - RNA, 19 nt, Human
aaguuauugauaaguucau

SEQ ID NO: 3043783 - RNA, 15 nt, Human
aaguucauacauugu

SEQ ID NO: 3043784 - RNA, 13 nt, Human
aaguucauacauu

SEQ ID NO: 3043785 - RNA, 12 nt, Human
aaguucauacau

SEQ ID NO: 3043786 - RNA, 23 nt, Human
aaguuauugauaaguucauacau

SEQ ID NO: 3043787 - RNA, 22 nt, Human
aaguuauugauaaguucauaca

SEQ ID NO: 3043788 - RNA, 18 nt, Human
aaguuuacauuguaaaua

SEQ ID NO: 3043789 - RNA, 19 nt, Human
aaguuuacauuguaaauag

SEQ ID NO: 3043790 - RNA, 17 nt, Human
uaaaauuuuuaaucuuu

SEQ ID NO: 3043791 - RNA, 19 nt, Human
uaaaauuuuuaaucuuuaa

SEQ ID NO: 3043792 - RNA, 22 nt, Human
aauaaaaauauuguguugugaa

SEQ ID NO: 3043793 - RNA, 12 nt, Human
aauaaaaauaau

SEQ ID NO: 3043794 - RNA, 15 nt, Human
aauaacgauaaaaga

SEQ ID NO: 3043795 - RNA, 15 nt, Human
aauaacaauaaaaga

SEQ ID NO: 3043796 - RNA, 18 nt, Human
uaaauaguauuugagagu

SEQ ID NO: 3043797 - RNA, 14 nt, Human
uaaauuuuauaucu

SEQ ID NO: 3043798 - RNA, 16 nt, Human
uaaauuuugaguucua

SEQ ID NO: 3043799 - RNA, 20 nt, Human
uaacaaaaaaauauauuuaa

SEQ ID NO: 3043800 - RNA, 23 nt, Human
uaacaaaaaaauauauuuaauga

SEQ ID NO: 3043801 - RNA, 20 nt, Human
uaaauguuuuuuuuuaaaga

SEQ ID NO: 3043802 - RNA, 16 nt, Human
aaggaaaaaauaacaa

SEQ ID NO: 3043803 - RNA, 16 nt, Human
aagcuuuuaugugaaa

SEQ ID NO: 3043804 - RNA, 13 nt, Human
guguuuauuuaua

SEQ ID NO: 3043805 - RNA, 12 nt, Human
guguuuaugugu

SEQ ID NO: 3043806 - RNA, 16 nt, Human
guguuuaugugugugu

SEQ ID NO: 3043807 - RNA, 21 nt, Human
aaggauaaaguugguaaaccu

SEQ ID NO: 3043808 - RNA, 23 nt, Human
aaggauaaaguugguaaaccuuu

SEQ ID NO: 3043809 - RNA, 14 nt, Human
aaggaucuucaucu

SEQ ID NO: 3043810 - RNA, 11 nt, Human
aaggauaaagu

SEQ ID NO: 3043811 - RNA, 22 nt, Human
aaggagcaagucagaauagaaa

SEQ ID NO: 3043812 - RNA, 14 nt, Human
aaggaaaaugauac

SEQ ID NO: 3043813 - RNA, 12 nt, Human
aaggaaaaugau

SEQ ID NO: 3043814 - RNA, 21 nt, Human
guugggagaaugucaguaugu

SEQ ID NO: 3043815 - RNA, 14 nt, Human
guugggagaauguc

SEQ ID NO: 3043816 - RNA, 15 nt, Human
guuuuuuuuuaaaga

SEQ ID NO: 3043817 - RNA, 15 nt, Human
aaguauucuaaauuu

SEQ ID NO: 3043818 - RNA, 13 nt, Human
aaguauucuaaau

SEQ ID NO: 3043819 - RNA, 22 nt, Human
aaguaaaaacaaagaaauuaug

SEQ ID NO: 3043820 - RNA, 14 nt, Human
uaguucugccagga

SEQ ID NO: 3043821 - RNA, 13 nt, Human
uaguucugccagg

SEQ ID NO: 3043822 - RNA, 14 nt, Human
uauaaaagccuguu

SEQ ID NO: 3043823 - RNA, 17 nt, Human
uauaaaagccuguuuaa

SEQ ID NO: 3043824 - RNA, 12 nt, Human
uauaaaagccug

SEQ ID NO: 3043825 - RNA, 23 nt, Human
acaccuaggcuaggguggggaga

SEQ ID NO: 3043826 - RNA, 20 nt, Human
acaccuaggcuagggugggg

SEQ ID NO: 3043827 - RNA, 16 nt, Human
uauauccuuucuaaca

SEQ ID NO: 3043828 - RNA, 13 nt, Human
uauauaucaaaua

SEQ ID NO: 3043829 - RNA, 12 nt, Human
acagccuggcug

SEQ ID NO: 3043830 - RNA, 19 nt, Human
uauggggauagaugugugg

SEQ ID NO: 3043831 - RNA, 18 nt, Human
uauggggauagaugugug

SEQ ID NO: 3043832 - RNA, 17 nt, Human
uauggggauagaugugu

SEQ ID NO: 3043833 - RNA, 22 nt, Human
uauggccugugagcuaggaauu

SEQ ID NO: 3043834 - RNA, 14 nt, Human
uauggccuguggau

SEQ ID NO: 3043835 - RNA, 15 nt, Human
uaucuugaauaaugu

SEQ ID NO: 3043836 - RNA, 18 nt, Human
uaugagcuuccuucugug

SEQ ID NO: 3043837 - RNA, 21 nt, Human
uaugagcuuccuucugugaaa

SEQ ID NO: 3043838 - RNA, 13 nt, Human
acagcccaccugg

SEQ ID NO: 3043839 - RNA, 22 nt, Human
acagaguggacuguucccugag

SEQ ID NO: 3043840 - RNA, 17 nt, Human
uaucuaguaugaaauua

SEQ ID NO: 3043841 - RNA, 16 nt, Human
uaucuaguaugaaauu

SEQ ID NO: 3043842 - RNA, 14 nt, Human
uaucuaguaugaaa

SEQ ID NO: 3043843 - RNA, 15 nt, Human
uauauuuacaaaugg

SEQ ID NO: 3043844 - RNA, 14 nt, Human
uauauuuacaaaug

SEQ ID NO: 3043845 - RNA, 21 nt, Human
acagacacucccacuuggcau

SEQ ID NO: 3043846 - RNA, 16 nt, Human
uauauugauccagaaa

SEQ ID NO: 3043847 - RNA, 11 nt, Human
acaguguuccg

SEQ ID NO: 3043848 - RNA, 20 nt, Human
acagugaaagaaaauaacaa

SEQ ID NO: 3043849 - RNA, 16 nt, Human
uauucaggagaguaga

SEQ ID NO: 3043850 - RNA, 14 nt, Human
uauucauaauuauu

SEQ ID NO: 3043851 - RNA, 23 nt, Human
uauguguguguguuguguguggg

SEQ ID NO: 3043852 - RNA, 11 nt, Human
uaugugugugu

SEQ ID NO: 3043853 - RNA, 22 nt, Human
uauguguguguguugugugugg

SEQ ID NO: 3043854 - RNA, 14 nt, Human
uauguguguguguu

SEQ ID NO: 3043855 - RNA, 19 nt, Human
uauuuaguguucauaaaua

SEQ ID NO: 3043856 - RNA, 14 nt, Human
uauuuaauucaugu

SEQ ID NO: 3043857 - RNA, 19 nt, Human
uauuuaaugauaaguaaau

SEQ ID NO: 3043858 - RNA, 23 nt, Human
acaguucggugagcuacaaaugc

SEQ ID NO: 3043859 - RNA, 22 nt, Human
acaguucggugagcuacaaaug

SEQ ID NO: 3043860 - RNA, 19 nt, Human
acaguucggugagcuacaa

SEQ ID NO: 3043861 - RNA, 21 nt, Human
aauucuugccaaauauaaaua

SEQ ID NO: 3043862 - RNA, 15 nt, Human
aauucuugaaggaaa

SEQ ID NO: 3043863 - RNA, 16 nt, Human
aauucuugaaggaaaa

SEQ ID NO: 3043864 - RNA, 21 nt, Human
aauucuugaaggaaaaugaua

SEQ ID NO: 3043865 - RNA, 22 nt, Human
aauucuuugaccuguugggagu

SEQ ID NO: 3043866 - RNA, 18 nt, Human
aauucuuugaccuguugg

SEQ ID NO: 3043867 - RNA, 14 nt, Human
aauuuaugugaugg

SEQ ID NO: 3043868 - RNA, 15 nt, Human
aauuugaaacacuuu

SEQ ID NO: 3043869 - RNA, 20 nt, Human
aauuugaaacacuuugcaua

SEQ ID NO: 3043870 - RNA, 18 nt, Human
uagcaugucgucaaagcu

SEQ ID NO: 3043871 - RNA, 21 nt, Human
uagcaugucgucaaagcugaa

SEQ ID NO: 3043872 - RNA, 18 nt, Human
acaagcacuaaacaaaga

SEQ ID NO: 3043873 - RNA, 20 nt, Human
acaaaaaaauauauuuaaug

SEQ ID NO: 3043874 - RNA, 13 nt, Human
acaaaaaaauaua

SEQ ID NO: 3043875 - RNA, 17 nt, Human
acaaaaaaauauauuua

SEQ ID NO: 3043876 - RNA, 18 nt, Human
uaauacuugcuuuggaaa

SEQ ID NO: 3043877 - RNA, 17 nt, Human
uaaucagugugucuaaa

SEQ ID NO: 3043878 - RNA, 18 nt, Human
uaaucagugugucuaaau

SEQ ID NO: 3043879 - RNA, 22 nt, Human
uaauccaagcaaaugugaauca

SEQ ID NO: 3043880 - RNA, 17 nt, Human
uaaucuuuaauuuuaca

SEQ ID NO: 3043881 - RNA, 17 nt, Human
uaauguaauaacuguga

SEQ ID NO: 3043882 - RNA, 15 nt, Human
uaauguaagacaaau

SEQ ID NO: 3043883 - RNA, 13 nt, Human
uaauucauguugc

SEQ ID NO: 3043884 - RNA, 17 nt, Human
uacauguacugauuacu

SEQ ID NO: 3043885 - RNA, 23 nt, Human
uacauuguacgaagaguauuuuu

SEQ ID NO: 3043886 - RNA, 22 nt, Human
uacauuguacgaagaguauuuu

SEQ ID NO: 3043887 - RNA, 20 nt, Human
uacauuguacgaagaguauu

SEQ ID NO: 3043888 - RNA, 19 nt, Human
aauuaacaugaauauuuag

SEQ ID NO: 3043889 - RNA, 19 nt, Human
aaugugaacagcggcugga

SEQ ID NO: 3043890 - RNA, 13 nt, Human
aauguaagacaaa

SEQ ID NO: 3043891 - RNA, 15 nt, Human
uacauaaguaauuca

SEQ ID NO: 3043892 - RNA, 16 nt, Human
uacauaaguaauucaa

SEQ ID NO: 3043893 - RNA, 17 nt, Human
uacauaaguaauucaag

SEQ ID NO: 3043894 - RNA, 19 nt, Human
uacauaaguaauucaagaa

SEQ ID NO: 3043895 - RNA, 16 nt, Human
aauguaugcuucauac

SEQ ID NO: 3043896 - RNA, 15 nt, Human
aauguaugcuucaua

SEQ ID NO: 3043897 - RNA, 12 nt, Human
aauguagagggg

SEQ ID NO: 3043898 - RNA, 20 nt, Human
uccugcaccggggccugggc

SEQ ID NO: 3043899 - RNA, 21 nt, Human
uccugcaccggggccugggca

SEQ ID NO: 3043900 - RNA, 17 nt, Human
acugagcuuggaagcuu

SEQ ID NO: 3043901 - RNA, 12 nt, Human
acugagcuugga

SEQ ID NO: 3043902 - RNA, 16 nt, Human
acugagcuuggaagcu

SEQ ID NO: 3043903 - RNA, 13 nt, Human
acugagcuuggaa

SEQ ID NO: 3043904 - RNA, 14 nt, Human
acugaggaucagag

SEQ ID NO: 3043905 - RNA, 22 nt, Human
ucgagaucccaacacugccagc

SEQ ID NO: 3043906 - RNA, 23 nt, Human
ucgagaucccaacacugccagca

SEQ ID NO: 3043907 - RNA, 12 nt, Human
ucgacacagagu

SEQ ID NO: 3043908 - RNA, 14 nt, Human
acuggggcaggggc

SEQ ID NO: 3043909 - RNA, 16 nt, Human
acuguaaggcaaucau

SEQ ID NO: 3043910 - RNA, 23 nt, Human
acugggagccuacccacccccag

SEQ ID NO: 3043911 - RNA, 12 nt, Human
acugggagccua

SEQ ID NO: 3043912 - RNA, 17 nt, Human
acugggagaaaugaaaa

SEQ ID NO: 3043913 - RNA, 20 nt, Human
acuguacagacagaaaaaac

SEQ ID NO: 3043914 - RNA, 11 nt, Human
uccucagcccc

SEQ ID NO: 3043915 - RNA, 21 nt, Human
acucuggagguuuguuuagaa

SEQ ID NO: 3043916 - RNA, 15 nt, Human
acucaugugacucuu

SEQ ID NO: 3043917 - RNA, 16 nt, Human
acucaugugacucuuu

SEQ ID NO: 3043918 - RNA, 17 nt, Human
acucaugugacucuuuc

SEQ ID NO: 3043919 - RNA, 16 nt, Human
acucaucuagguaaau

SEQ ID NO: 3043920 - RNA, 18 nt, Human
acucaucuagguaaauua

SEQ ID NO: 3043921 - RNA, 22 nt, Human
acuaugaaguuuuuuuuauaca

SEQ ID NO: 3043922 - RNA, 15 nt, Human
ucccagugaauucuu

SEQ ID NO: 3043923 - RNA, 16 nt, Human
ucagccccgcguggaa

SEQ ID NO: 3043924 - RNA, 22 nt, Human
acccagcuaugguucucucgca

SEQ ID NO: 3043925 - RNA, 22 nt, Human
ucagauuugccuuauuggcagc

SEQ ID NO: 3043926 - RNA, 19 nt, Human
ucagccuggcuucaaauug

SEQ ID NO: 3043927 - RNA, 22 nt, Human
accccuggcuccaggccagggg

SEQ ID NO: 3043928 - RNA, 20 nt, Human
accccuggcuccaggccagg

SEQ ID NO: 3043929 - RNA, 19 nt, Human
accccuggcuccaggccag

SEQ ID NO: 3043930 - RNA, 16 nt, Human
acccccaggaccccug

SEQ ID NO: 3043931 - RNA, 17 nt, Human
ucaggaaccgaggcagg

SEQ ID NO: 3043932 - RNA, 18 nt, Human
ucaggaaccgaggcaggg

SEQ ID NO: 3043933 - RNA, 14 nt, Human
ucaggcccaaagcc

SEQ ID NO: 3043934 - RNA, 15 nt, Human
ucaggccgaaggagg

SEQ ID NO: 3043935 - RNA, 23 nt, Human
acccucccucuacugggagccua

SEQ ID NO: 3043936 - RNA, 15 nt, Human
acccuccacucuccu

SEQ ID NO: 3043937 - RNA, 20 nt, Human
accagagaaaaagggagggg

SEQ ID NO: 3043938 - RNA, 18 nt, Human
accagagaaaaagggagg

SEQ ID NO: 3043939 - RNA, 19 nt, Human
acccacuugcuuuuaaaau

SEQ ID NO: 3043940 - RNA, 18 nt, Human
accugaauaaagaaugaa

SEQ ID NO: 3043941 - RNA, 23 nt, Human
uccaaagucucuggaauuugaaa

SEQ ID NO: 3043942 - RNA, 18 nt, Human
uccaccaagccuggucag

SEQ ID NO: 3043943 - RNA, 23 nt, Human
uccaccaagccuggucagcccaa

SEQ ID NO: 3043944 - RNA, 22 nt, Human
uccaccaagccuggucagccca

SEQ ID NO: 3043945 - RNA, 17 nt, Human
accuuccaagagccuga

SEQ ID NO: 3043946 - RNA, 16 nt, Human
accgccuccuacagcc

SEQ ID NO: 3043947 - RNA, 19 nt, Human
ucauauuaauauauuucca

SEQ ID NO: 3043948 - RNA, 22 nt, Human
ucaugauagaaggcuaugggga

SEQ ID NO: 3043949 - RNA, 14 nt, Human
ucaugugaaaucau

SEQ ID NO: 3043950 - RNA, 21 nt, Human
ucauuggauucugagagcugu

SEQ ID NO: 3043951 - RNA, 22 nt, Human
accugaagcuaucguaaaauua

SEQ ID NO: 3043952 - RNA, 20 nt, Human
agaauugucuuucugucucu

SEQ ID NO: 3043953 - RNA, 14 nt, Human
ucuugaugccuggc

SEQ ID NO: 3043954 - RNA, 20 nt, Human
ucuugaugccuggcggggug

SEQ ID NO: 3043955 - RNA, 12 nt, Human
ucuuggagccug

SEQ ID NO: 3043956 - RNA, 14 nt, Human
ucuuggagccugca

SEQ ID NO: 3043957 - RNA, 13 nt, Human
ucuuggagccugc

SEQ ID NO: 3043958 - RNA, 14 nt, Human
agacuuaucaacau

SEQ ID NO: 3043959 - RNA, 19 nt, Human
ucuuggagccugcagagcu

SEQ ID NO: 3043960 - RNA, 18 nt, Human
ucuuggagccugcagagc

SEQ ID NO: 3043961 - RNA, 15 nt, Human
ucuuggagccugcag

SEQ ID NO: 3043962 - RNA, 14 nt, Human
acuuuuggcauuuu

SEQ ID NO: 3043963 - RNA, 22 nt, Human
acuuuuuuuuuuuaagaguaaa

SEQ ID NO: 3043964 - RNA, 11 nt, Human
ucuggcccuau

SEQ ID NO: 3043965 - RNA, 12 nt, Human
ucuggauuauau

SEQ ID NO: 3043966 - RNA, 18 nt, Human
ucuggauuauauuaugaa

SEQ ID NO: 3043967 - RNA, 19 nt, Human
agauaaucagugugucuaa

SEQ ID NO: 3043968 - RNA, 18 nt, Human
ugaagguggaaauaaacu

SEQ ID NO: 3043969 - RNA, 22 nt, Human
ugaacuuguaaaggaauuuaaa

SEQ ID NO: 3043970 - RNA, 13 nt, Human
ucuuuguaaugaa

SEQ ID NO: 3043971 - RNA, 15 nt, Human
ucuuuguaaugaaaa

SEQ ID NO: 3043972 - RNA, 12 nt, Human
ucuuuguaauga

SEQ ID NO: 3043973 - RNA, 21 nt, Human
agaggcgcaugaauuugugaa

SEQ ID NO: 3043974 - RNA, 15 nt, Human
agauguguucacaau

SEQ ID NO: 3043975 - RNA, 18 nt, Human
agauguguucacaaugga

SEQ ID NO: 3043976 - RNA, 17 nt, Human
ugacagguuugggaccc

SEQ ID NO: 3043977 - RNA, 12 nt, Human
agaucauuguga

SEQ ID NO: 3043978 - RNA, 21 nt, Human
agaucauugugaaauuauuca

SEQ ID NO: 3043979 - RNA, 14 nt, Human
agauuuaugcauau

SEQ ID NO: 3043980 - RNA, 12 nt, Human
agauuuucagaa

SEQ ID NO: 3043981 - RNA, 17 nt, Human
agauuuucagaaaauau

SEQ ID NO: 3043982 - RNA, 21 nt, Human
agcagauggaaugcuguguua

SEQ ID NO: 3043983 - RNA, 22 nt, Human
ugagggugacuauggagcugag

SEQ ID NO: 3043984 - RNA, 17 nt, Human
ugaggaagagggacugu

SEQ ID NO: 3043985 - RNA, 16 nt, Human
ugagcuacaaaugcau

SEQ ID NO: 3043986 - RNA, 14 nt, Human
ugagcuaggaauug

SEQ ID NO: 3043987 - RNA, 14 nt, Human
ugagcuacaaaugc

SEQ ID NO: 3043988 - RNA, 13 nt, Human
ugagcuacaaaug

SEQ ID NO: 3043989 - RNA, 17 nt, Human
ugccuugucacgccaga

SEQ ID NO: 3043990 - RNA, 19 nt, Human
ugccuugugaaggaauuau

SEQ ID NO: 3043991 - RNA, 15 nt, Human
agcuggggaugucuc

SEQ ID NO: 3043992 - RNA, 20 nt, Human
agcuggggccaggcuggguc

SEQ ID NO: 3043993 - RNA, 17 nt, Human
agcuggggccaggcugg

SEQ ID NO: 3043994 - RNA, 16 nt, Human
ugccucucugcagguc

SEQ ID NO: 3043995 - RNA, 18 nt, Human
ugccucucugcagguccc

SEQ ID NO: 3043996 - RNA, 19 nt, Human
ugccucucugcaggucccu

SEQ ID NO: 3043997 - RNA, 20 nt, Human
ugccucucugcaggucccua

SEQ ID NO: 3043998 - RNA, 23 nt, Human
aggaaaccaguuaggucucaaua

SEQ ID NO: 3043999 - RNA, 19 nt, Human
ugcucugugcccacccucc

SEQ ID NO: 3044000 - RNA, 20 nt, Human
aggaauuuuauuuuuuucug

SEQ ID NO: 3044001 - RNA, 22 nt, Human
aggaauuuuauuuuuuucugaa

SEQ ID NO: 3044002 - RNA, 19 nt, Human
agccugacccucaucuuuc

SEQ ID NO: 3044003 - RNA, 17 nt, Human
ugcaggucccuaauaaa

SEQ ID NO: 3044004 - RNA, 18 nt, Human
ugcaggucccuaauaaag

SEQ ID NO: 3044005 - RNA, 19 nt, Human
ugcaggucccuaauaaagc

SEQ ID NO: 3044006 - RNA, 20 nt, Human
ugcaggucccuaauaaagcu

SEQ ID NO: 3044007 - RNA, 15 nt, Human
ugcauaauggucaga

SEQ ID NO: 3044008 - RNA, 19 nt, Human
agccugcaauuucauaugc

SEQ ID NO: 3044009 - RNA, 21 nt, Human
agccugcaauuucauaugcug

SEQ ID NO: 3044010 - RNA, 15 nt, Human
agccugcagagcugc

SEQ ID NO: 3044011 - RNA, 14 nt, Human
agccugcagagcug

SEQ ID NO: 3044012 - RNA, 13 nt, Human
agccugcagagcu

SEQ ID NO: 3044013 - RNA, 12 nt, Human
agccugcagagc

SEQ ID NO: 3044014 - RNA, 18 nt, Human
agccugccacucaggccc

SEQ ID NO: 3044015 - RNA, 19 nt, Human
agcuacuaauuuuaaaaug

SEQ ID NO: 3044016 - RNA, 20 nt, Human
agcggcuggaauuggguggg

SEQ ID NO: 3044017 - RNA, 20 nt, Human
uggcuguggccuaaccugcc

SEQ ID NO: 3044018 - RNA, 17 nt, Human
uggcuguggcauccaga

SEQ ID NO: 3044019 - RNA, 16 nt, Human
uggcuguggagugugg

SEQ ID NO: 3044020 - RNA, 22 nt, Human
uggcugcagagcagugggccug

SEQ ID NO: 3044021 - RNA, 18 nt, Human
uggcugcagagcaguggg

SEQ ID NO: 3044022 - RNA, 15 nt, Human
uggcugcagagcagu

SEQ ID NO: 3044023 - RNA, 18 nt, Human
ugggaaacaaaaggauaa

SEQ ID NO: 3044024 - RNA, 10 nt, Human
aggcuggguc

SEQ ID NO: 3044025 - RNA, 15 nt, Human
aggcugggucgcccu

SEQ ID NO: 3044026 - RNA, 18 nt, Human
aggcugggucgcccugga

SEQ ID NO: 3044027 - RNA, 20 nt, Human
aggcugggucgcccuggacu

SEQ ID NO: 3044028 - RNA, 21 nt, Human
aggcugggucgcccuggacug

SEQ ID NO: 3044029 - RNA, 15 nt, Human
aggcuuuuuuaucau

SEQ ID NO: 3044030 - RNA, 18 nt, Human
aggcuuuuuuaucaugug

SEQ ID NO: 3044031 - RNA, 21 nt, Human
aggcuuuuuuaucaugugaaa

SEQ ID NO: 3044032 - RNA, 16 nt, Human
ugggagaaaugaaaaa

SEQ ID NO: 3044033 - RNA, 14 nt, Human
ugggaggcucugga

SEQ ID NO: 3044034 - RNA, 17 nt, Human
ugggaggcucuggagcc

SEQ ID NO: 3044035 - RNA, 23 nt, Human
ugggaggcucuggagcccacugu

SEQ ID NO: 3044036 - RNA, 16 nt, Human
ugggauuuggucaaca

SEQ ID NO: 3044037 - RNA, 15 nt, Human
ugggagaaaugaaaa

SEQ ID NO: 3044038 - RNA, 18 nt, Human
aggcgaagcguuguccuc

SEQ ID NO: 3044039 - RNA, 18 nt, Human
aggcucagaggguguccu

SEQ ID NO: 3044040 - RNA, 19 nt, Human
aggcucagaggguguccug

SEQ ID NO: 3044041 - RNA, 20 nt, Human
aggcucagaggguguccugc

SEQ ID NO: 3044042 - RNA, 14 nt, Human
aggccauucuuucc

SEQ ID NO: 3044043 - RNA, 22 nt, Human
uggcacagccuggcuguggccu

SEQ ID NO: 3044044 - RNA, 21 nt, Human
uggcauccagagucccugccu

SEQ ID NO: 3044045 - RNA, 22 nt, Human
uggcauccagagucccugccug

SEQ ID NO: 3044046 - RNA, 20 nt, Human
uggcauccagagucccugcc

SEQ ID NO: 3044047 - RNA, 16 nt, Human
aggccugacucucagc

SEQ ID NO: 3044048 - RNA, 11 nt, Human
aggcagguccc

SEQ ID NO: 3044049 - RNA, 16 nt, Human
aggcagguccccagac

SEQ ID NO: 3044050 - RNA, 15 nt, Human
aggcagguccccaga

SEQ ID NO: 3044051 - RNA, 14 nt, Human
aggcagguccccag

SEQ ID NO: 3044052 - RNA, 13 nt, Human
aggcaggucccca

SEQ ID NO: 3044053 - RNA, 12 nt, Human
aggcaggucccc

SEQ ID NO: 3044054 - RNA, 20 nt, Human
aggcaggaguuucguuuuca

SEQ ID NO: 3044055 - RNA, 16 nt, Human
uggagcccacuguacu

SEQ ID NO: 3044056 - RNA, 19 nt, Human
uggagcccacuguacuugc

SEQ ID NO: 3044057 - RNA, 23 nt, Human
uggagcccacuguacuugcucuu

SEQ ID NO: 3044058 - RNA, 16 nt, Human
uggagccugcagagcu

SEQ ID NO: 3044059 - RNA, 11 nt, Human
uggagccugca

SEQ ID NO: 3044060 - RNA, 14 nt, Human
uggaauuugaaaca

SEQ ID NO: 3044061 - RNA, 21 nt, Human
uggaacaagaugguucuagca

SEQ ID NO: 3044062 - RNA, 20 nt, Human
uggaagugugggucugugug

SEQ ID NO: 3044063 - RNA, 14 nt, Human
uggaagugcuaauu

SEQ ID NO: 3044064 - RNA, 14 nt, Human
uggaaguguggguc

SEQ ID NO: 3044065 - RNA, 13 nt, Human
uggaagugugggu

SEQ ID NO: 3044066 - RNA, 19 nt, Human
aggaguuucguuuucaaaa

SEQ ID NO: 3044067 - RNA, 16 nt, Human
agugauuuuuaugcca

SEQ ID NO: 3044068 - RNA, 20 nt, Human
agugauuuuuaugccaccug

SEQ ID NO: 3044069 - RNA, 21 nt, Human
agugauuuuuaugccaccuga

SEQ ID NO: 3044070 - RNA, 14 nt, Human
agugaggaugucug

SEQ ID NO: 3044071 - RNA, 18 nt, Human
agugccaggauggaauga

SEQ ID NO: 3044072 - RNA, 21 nt, Human
uguggaucaaauccagccugc

SEQ ID NO: 3044073 - RNA, 14 nt, Human
ugugcucuccaagc

SEQ ID NO: 3044074 - RNA, 19 nt, Human
ugugcucuccaagcccagu

SEQ ID NO: 3044075 - RNA, 21 nt, Human
ugugcucaggagcccugggag

SEQ ID NO: 3044076 - RNA, 20 nt, Human
ugugcucaggagcccuggga

SEQ ID NO: 3044077 - RNA, 16 nt, Human
agucuuucacauuuaa

SEQ ID NO: 3044078 - RNA, 17 nt, Human
aguguggcaguuuggca

SEQ ID NO: 3044079 - RNA, 16 nt, Human
aguguggcaguuuggc

SEQ ID NO: 3044080 - RNA, 9 nt, Human
aguguguaa

SEQ ID NO: 3044081 - RNA, 21 nt, Human
aguguuccgugguuaaacucg

SEQ ID NO: 3044082 - RNA, 18 nt, Human
aguguguguuuuucauaa

SEQ ID NO: 3044083 - RNA, 21 nt, Human
aguguucauaaauaaaguuug

SEQ ID NO: 3044084 - RNA, 15 nt, Human
uguugcauagaauaa

SEQ ID NO: 3044085 - RNA, 17 nt, Human
uguuacaaauuguagaa

SEQ ID NO: 3044086 - RNA, 18 nt, Human
uguuacaaauuguagaag

SEQ ID NO: 3044087 - RNA, 14 nt, Human
uguuacaaauugua

SEQ ID NO: 3044088 - RNA, 22 nt, Human
uguguuaaguauguguaaaaug

SEQ ID NO: 3044089 - RNA, 23 nt, Human
uguuaagcagauggaaugcugug

SEQ ID NO: 3044090 - RNA, 16 nt, Human
agugggguagguuggg

SEQ ID NO: 3044091 - RNA, 21 nt, Human
aguggacuguucccugaggug

SEQ ID NO: 3044092 - RNA, 19 nt, Human
ugugucuaaauuugaaugu

SEQ ID NO: 3044093 - RNA, 22 nt, Human
ugugucuaaauuugaauguuaa

SEQ ID NO: 3044094 - RNA, 18 nt, Human
uguguguuguguguggga

SEQ ID NO: 3044095 - RNA, 14 nt, Human
uguguaaaauguga

SEQ ID NO: 3044096 - RNA, 20 nt, Human
uguagugauuuuuaugccac

SEQ ID NO: 3044097 - RNA, 18 nt, Human
uguauauccuuucuaaca

SEQ ID NO: 3044098 - RNA, 19 nt, Human
aguacauuuggagacacaa

SEQ ID NO: 3044099 - RNA, 19 nt, Human
aguaauucaagaaaacaac

SEQ ID NO: 3044100 - RNA, 16 nt, Human
aguaaaaacaaagaaa

SEQ ID NO: 3044101 - RNA, 23 nt, Human
aguaaaaacaaagaaauuaugug

SEQ ID NO: 3044102 - RNA, 13 nt, Human
aguaauagagcaa

SEQ ID NO: 3044103 - RNA, 14 nt, Human
aggugugcaagaga

SEQ ID NO: 3044104 - RNA, 14 nt, Human
aguauuugugggga

SEQ ID NO: 3044105 - RNA, 12 nt, Human
uuauucauaauu

SEQ ID NO: 3044106 - RNA, 15 nt, Human
uuauuauauuuacaa

SEQ ID NO: 3044107 - RNA, 14 nt, Human
uuauuauauuuaca

SEQ ID NO: 3044108 - RNA, 13 nt, Human
auagaaguaaaaa

SEQ ID NO: 3044109 - RNA, 19 nt, Human
auagaaggcuauggggaua

SEQ ID NO: 3044110 - RNA, 22 nt, Human
auagaauaaaauuuuuaaucuu

SEQ ID NO: 3044111 - RNA, 14 nt, Human
auagaauaaaauuu

SEQ ID NO: 3044112 - RNA, 19 nt, Human
auagaauaaaauuuuuaau

SEQ ID NO: 3044113 - RNA, 15 nt, Human
auagagcaaaauuga

SEQ ID NO: 3044114 - RNA, 17 nt, Human
auagagcaaaauugaug

SEQ ID NO: 3044115 - RNA, 21 nt, Human
auagagcaaaauugauguguu

SEQ ID NO: 3044116 - RNA, 22 nt, Human
auagagcaaaauugauguguuu

SEQ ID NO: 3044117 - RNA, 21 nt, Human
auagaguguacuuaacuauuc

SEQ ID NO: 3044118 - RNA, 14 nt, Human
auagaguguacuua

SEQ ID NO: 3044119 - RNA, 19 nt, Human
auagaguguacuuaacuau

SEQ ID NO: 3044120 - RNA, 18 nt, Human
auagauaggucagugcaa

SEQ ID NO: 3044121 - RNA, 14 nt, Human
auagauguguggac

SEQ ID NO: 3044122 - RNA, 11 nt, Human
auagaugugug

SEQ ID NO: 3044123 - RNA, 13 nt, Human
auagaugugugga

SEQ ID NO: 3044124 - RNA, 12 nt, Human
auagaugugugg

SEQ ID NO: 3044125 - RNA, 20 nt, Human
uuaugauacuugaaaauuaa

SEQ ID NO: 3044126 - RNA, 20 nt, Human
uuaugaagcuuuuaugugaa

SEQ ID NO: 3044127 - RNA, 10 nt, Human
uuaugugugu

SEQ ID NO: 3044128 - RNA, 14 nt, Human
uuaugugugugugu

SEQ ID NO: 3044129 - RNA, 12 nt, Human
uuaugugugugu

SEQ ID NO: 3044130 - RNA, 15 nt, Human
uuaugugaaacaugu

SEQ ID NO: 3044131 - RNA, 22 nt, Human
uuaugugccagauuuaugcaua

SEQ ID NO: 3044132 - RNA, 13 nt, Human
uuaugugaaacau

SEQ ID NO: 3044133 - RNA, 12 nt, Human
uuauaaacuuuu

SEQ ID NO: 3044134 - RNA, 16 nt, Human
uuauaaacuuuuuucu

SEQ ID NO: 3044135 - RNA, 22 nt, Human
uuauaaacuuuuuucuuacugu

SEQ ID NO: 3044136 - RNA, 16 nt, Human
auacagggaugguguu

SEQ ID NO: 3044137 - RNA, 21 nt, Human
auacaggaugaugacuaugga

SEQ ID NO: 3044138 - RNA, 23 nt, Human
auacgcaacauaauuaaauuuug

SEQ ID NO: 3044139 - RNA, 19 nt, Human
auaaaagccuguuuaagag

SEQ ID NO: 3044140 - RNA, 20 nt, Human
auaaaagccuguuuaagaga

SEQ ID NO: 3044141 - RNA, 19 nt, Human
uuaagacgaaacauuuguu

SEQ ID NO: 3044142 - RNA, 15 nt, Human
aguuuuuuuuauaca

SEQ ID NO: 3044143 - RNA, 22 nt, Human
uuaagacgaaacauuuguucua

SEQ ID NO: 3044144 - RNA, 17 nt, Human
uuaaucuuuaauuuuac

SEQ ID NO: 3044145 - RNA, 13 nt, Human
uuaaucuuuaauu

SEQ ID NO: 3044146 - RNA, 12 nt, Human
uuaaaaugagaa

SEQ ID NO: 3044147 - RNA, 19 nt, Human
uuaaaaugagaaaucuaaa

SEQ ID NO: 3044148 - RNA, 20 nt, Human
aguuuaaauuguaauaggcg

SEQ ID NO: 3044149 - RNA, 17 nt, Human
aguuuaaauuguaauag

SEQ ID NO: 3044150 - RNA, 15 nt, Human
aguuuacauuguaaa

SEQ ID NO: 3044151 - RNA, 17 nt, Human
aguuuacauuguaaaua

SEQ ID NO: 3044152 - RNA, 13 nt, Human
aguuuacauugua

SEQ ID NO: 3044153 - RNA, 15 nt, Human
uuaaauuuugaguuc

SEQ ID NO: 3044154 - RNA, 20 nt, Human
uuaaauuuugaguucuacau

SEQ ID NO: 3044155 - RNA, 15 nt, Human
aguuuguugaaacac

SEQ ID NO: 3044156 - RNA, 17 nt, Human
auaauucagaaggaucu

SEQ ID NO: 3044157 - RNA, 21 nt, Human
auaauuuauacaggucauauu

SEQ ID NO: 3044158 - RNA, 19 nt, Human
auaauuuauacaggucaua

SEQ ID NO: 3044159 - RNA, 23 nt, Human
auaauucacauuguauucagagu

SEQ ID NO: 3044160 - RNA, 14 nt, Human
auaauuuuaaaugu

SEQ ID NO: 3044161 - RNA, 12 nt, Human
auaauuuuaaau

SEQ ID NO: 3044162 - RNA, 13 nt, Human
auaauuuuaaaug

SEQ ID NO: 3044163 - RNA, 18 nt, Human
auaaucacaacccuucag

SEQ ID NO: 3044164 - RNA, 14 nt, Human
uuaguaaucauauu

SEQ ID NO: 3044165 - RNA, 13 nt, Human
uuaguaaucauau

SEQ ID NO: 3044166 - RNA, 19 nt, Human
uuaguacuccccuccuuga

SEQ ID NO: 3044167 - RNA, 15 nt, Human
uuauaaaaauaaaaa

SEQ ID NO: 3044168 - RNA, 21 nt, Human
uuauaaaaauaaaaaacacug

SEQ ID NO: 3044169 - RNA, 22 nt, Human
uuauaaaaauaaaaaacacugg

SEQ ID NO: 3044170 - RNA, 13 nt, Human
uuacaguguuccg

SEQ ID NO: 3044171 - RNA, 23 nt, Human
uuacuguacagacagaaaaaacu

SEQ ID NO: 3044172 - RNA, 16 nt, Human
auuucccuuccuuccu

SEQ ID NO: 3044173 - RNA, 23 nt, Human
auuucccugaaggaaccaaagcg

SEQ ID NO: 3044174 - RNA, 17 nt, Human
auuucccugaaggaacc

SEQ ID NO: 3044175 - RNA, 18 nt, Human
auuugaaacacuuugcau

SEQ ID NO: 3044176 - RNA, 18 nt, Human
auuugugaagguggaaau

SEQ ID NO: 3044177 - RNA, 21 nt, Human
auuugugaagguggaaauaaa

SEQ ID NO: 3044178 - RNA, 20 nt, Human
auuuuaaaagauaaauauua

SEQ ID NO: 3044179 - RNA, 20 nt, Human
auuuuaaaagaugcaaugua

SEQ ID NO: 3044180 - RNA, 18 nt, Human
auuuguaaauuuauguga

SEQ ID NO: 3044181 - RNA, 19 nt, Human
auuuguaaauuuaugugau

SEQ ID NO: 3044182 - RNA, 16 nt, Human
auuguacgaagaguau

SEQ ID NO: 3044183 - RNA, 14 nt, Human
auugcuuuggucau

SEQ ID NO: 3044184 - RNA, 18 nt, Human
auugcuuuggucauauga

SEQ ID NO: 3044185 - RNA, 19 nt, Human
auuggacaguaaaauccac

SEQ ID NO: 3044186 - RNA, 23 nt, Human
auuggguggggggcuucauacac

SEQ ID NO: 3044187 - RNA, 22 nt, Human
auuggauucugagagcugugca

SEQ ID NO: 3044188 - RNA, 19 nt, Human
auuggauucugagagcugu

SEQ ID NO: 3044189 - RNA, 15 nt, Human
auuuucuauaauuua

SEQ ID NO: 3044190 - RNA, 14 nt, Human
auuuucuauaauuu

SEQ ID NO: 3044191 - RNA, 15 nt, Human
auuuuaauaaacacu

SEQ ID NO: 3044192 - RNA, 16 nt, Human
auuuuaauaaacacuc

SEQ ID NO: 3044193 - RNA, 17 nt, Human
auuuuaauaaacacucu

SEQ ID NO: 3044194 - RNA, 23 nt, Human
auuuugcccuugacaaagucaag

SEQ ID NO: 3044195 - RNA, 15 nt, Human
auuuugcccuugaca

SEQ ID NO: 3044196 - RNA, 18 nt, Human
auuuuguucauacauauu

SEQ ID NO: 3044197 - RNA, 16 nt, Human
auuuuguucauacaua

SEQ ID NO: 3044198 - RNA, 15 nt, Human
auuuuguucauacau

SEQ ID NO: 3044199 - RNA, 14 nt, Human
auuuuguucauaca

SEQ ID NO: 3044200 - RNA, 12 nt, Human
auuuuguucaua

SEQ ID NO: 3044201 - RNA, 17 nt, Human
auuuuguguuuaggaac

SEQ ID NO: 3044202 - RNA, 21 nt, Human
auuuuuguagcacugacagau

SEQ ID NO: 3044203 - RNA, 20 nt, Human
auuuuuguagcacugacaga

SEQ ID NO: 3044204 - RNA, 22 nt, Human
auuuuugugauuuugugauuga

SEQ ID NO: 3044205 - RNA, 12 nt, Human
auuuuucucaug

SEQ ID NO: 3044206 - RNA, 15 nt, Human
auuuuuccaaaauaa

SEQ ID NO: 3044207 - RNA, 15 nt, Human
auuuuucacauaucu

SEQ ID NO: 3044208 - RNA, 21 nt, Human
auuuuucacauaucuaguaug

SEQ ID NO: 3044209 - RNA, 18 nt, Human
auuuuucacauaucuagu

SEQ ID NO: 3044210 - RNA, 15 nt, Human
auuuuugacagaaua

SEQ ID NO: 3044211 - RNA, 14 nt, Human
auuuuugacagaau

SEQ ID NO: 3044212 - RNA, 13 nt, Human
auuuuugacagaa

SEQ ID NO: 3044213 - RNA, 12 nt, Human
auuuuugacaga

SEQ ID NO: 3044214 - RNA, 22 nt, Human
auuuuugacagaauauguuuca

SEQ ID NO: 3044215 - RNA, 15 nt, Human
auucuagcuaaugua

SEQ ID NO: 3044216 - RNA, 18 nt, Human
auucuagcuaauguaaua

SEQ ID NO: 3044217 - RNA, 14 nt, Human
auuauauuaugaag

SEQ ID NO: 3044218 - RNA, 17 nt, Human
auuauauuuacaaaugg

SEQ ID NO: 3044219 - RNA, 12 nt, Human
auuccagaggaa

SEQ ID NO: 3044220 - RNA, 14 nt, Human
auucuaaauuuuau

SEQ ID NO: 3044221 - RNA, 24 nt, Human
auucagaaggaucuucaucugacu

SEQ ID NO: 3044222 - RNA, 18 nt, Human
auucagaaggaucuucau

SEQ ID NO: 3044223 - RNA, 13 nt, Human
auucacauuguau

SEQ ID NO: 3044224 - RNA, 20 nt, Human
auucacauuguauucagagu

SEQ ID NO: 3044225 - RNA, 15 nt, Human
auuauuauuuggccc

SEQ ID NO: 3044226 - RNA, 21 nt, Human
auuauuuuguucauacauauu

SEQ ID NO: 3044227 - RNA, 19 nt, Human
auuauuuuguucauacaua

SEQ ID NO: 3044228 - RNA, 18 nt, Human
auuauuuuguucauacau

SEQ ID NO: 3044229 - RNA, 17 nt, Human
auuauuuuguucauaca

SEQ ID NO: 3044230 - RNA, 16 nt, Human
auuauuuuguucauac

SEQ ID NO: 3044231 - RNA, 15 nt, Human
auuauuuuguucaua

SEQ ID NO: 3044232 - RNA, 14 nt, Human
auccuacccccugu

SEQ ID NO: 3044233 - RNA, 16 nt, Human
auccuacccccugugc

SEQ ID NO: 3044234 - RNA, 17 nt, Human
uugaaauuguauuacaa

SEQ ID NO: 3044235 - RNA, 23 nt, Human
uucuuaaccagaucauugugaaa

SEQ ID NO: 3044236 - RNA, 15 nt, Human
uucuuuguaaugaaa

SEQ ID NO: 3044237 - RNA, 13 nt, Human
uucugccaggaga

SEQ ID NO: 3044238 - RNA, 19 nt, Human
auccauagcaccuccacau

SEQ ID NO: 3044239 - RNA, 18 nt, Human
auccaagcaaaugugaau

SEQ ID NO: 3044240 - RNA, 20 nt, Human
aucauuuuaccuuugacaaa

SEQ ID NO: 3044241 - RNA, 17 nt, Human
auauuuuucacauaucu

SEQ ID NO: 3044242 - RNA, 15 nt, Human
auauuuuucacauau

SEQ ID NO: 3044243 - RNA, 14 nt, Human
auauuuuucacaua

SEQ ID NO: 3044244 - RNA, 13 nt, Human
auauuuuucacau

SEQ ID NO: 3044245 - RNA, 12 nt, Human
auauuuuucaca

SEQ ID NO: 3044246 - RNA, 19 nt, Human
uuccguagguuauuuucag

SEQ ID NO: 3044247 - RNA, 16 nt, Human
aucaggccauuguccc

SEQ ID NO: 3044248 - RNA, 13 nt, Human
aucaggccauugu

SEQ ID NO: 3044249 - RNA, 22 nt, Human
uucuagcauggcauauuuuuca

SEQ ID NO: 3044250 - RNA, 17 nt, Human
uucuagcuaauguaaua

SEQ ID NO: 3044251 - RNA, 14 nt, Human
uucuagcauggcau

SEQ ID NO: 3044252 - RNA, 21 nt, Human
uucuagcauggcauauuuuuc

SEQ ID NO: 3044253 - RNA, 20 nt, Human
uucuagcauggcauauuuuu

SEQ ID NO: 3044254 - RNA, 18 nt, Human
uucuagcauggcauauuu

SEQ ID NO: 3044255 - RNA, 15 nt, Human
uucuagcauggcaua

SEQ ID NO: 3044256 - RNA, 14 nt, Human
uucuaaauuuuaua

SEQ ID NO: 3044257 - RNA, 23 nt, Human
uuggggacaggggcaggaggaag

SEQ ID NO: 3044258 - RNA, 21 nt, Human
augaauauuuaguguucauaa

SEQ ID NO: 3044259 - RNA, 19 nt, Human
augaaauuauauaaguauu

SEQ ID NO: 3044260 - RNA, 21 nt, Human
augaaauuauauaaguauucu

SEQ ID NO: 3044261 - RNA, 16 nt, Human
augaauauuuaguguu

SEQ ID NO: 3044262 - RNA, 20 nt, Human
uuggagacacaacuauuuuu

SEQ ID NO: 3044263 - RNA, 12 nt, Human
aucuguuuacag

SEQ ID NO: 3044264 - RNA, 17 nt, Human
aucuguuuacaguguuc

SEQ ID NO: 3044265 - RNA, 15 nt, Human
aucuguuuacagugu

SEQ ID NO: 3044266 - RNA, 18 nt, Human
aucuuguagcuuuaucaa

SEQ ID NO: 3044267 - RNA, 20 nt, Human
aucuuguagcuuuaucaaag

SEQ ID NO: 3044268 - RNA, 19 nt, Human
aucuuguagcuuuaucaaa

SEQ ID NO: 3044269 - RNA, 20 nt, Human
uugacagaauauguuucaaa

SEQ ID NO: 3044270 - RNA, 16 nt, Human
uugagauguguucaca

SEQ ID NO: 3044271 - RNA, 17 nt, Human
uugacagaauauguuuc

SEQ ID NO: 3044272 - RNA, 22 nt, Human
uugauuaagaucucagugguua

SEQ ID NO: 3044273 - RNA, 12 nt, Human
augugacucuuu

SEQ ID NO: 3044274 - RNA, 16 nt, Human
augugacucuuuccaa

SEQ ID NO: 3044275 - RNA, 21 nt, Human
augugacucuuuccaaccggc

SEQ ID NO: 3044276 - RNA, 20 nt, Human
uuugugaagguggaaauaaa

SEQ ID NO: 3044277 - RNA, 12 nt, Human
uuuguauaaaag

SEQ ID NO: 3044278 - RNA, 13 nt, Human
uuuguaaugaaaa

SEQ ID NO: 3044279 - RNA, 14 nt, Human
uuuguaaugaaaac

SEQ ID NO: 3044280 - RNA, 15 nt, Human
auguaugcuucauac

SEQ ID NO: 3044281 - RNA, 14 nt, Human
auguaugcuucaua

SEQ ID NO: 3044282 - RNA, 16 nt, Human
augucaguauguggaa

SEQ ID NO: 3044283 - RNA, 23 nt, Human
uuuggcaaacucuccaccacacg

SEQ ID NO: 3044284 - RNA, 22 nt, Human
uuugacagaauauguuucaaac

SEQ ID NO: 3044285 - RNA, 19 nt, Human
auguagccccucuccugga

SEQ ID NO: 3044286 - RNA, 19 nt, Human
auguagaggggaaaagaga

SEQ ID NO: 3044287 - RNA, 20 nt, Human
auggggauagauguguggac

SEQ ID NO: 3044288 - RNA, 19 nt, Human
augguguucaaaaaacuug

SEQ ID NO: 3044289 - RNA, 16 nt, Human
augguucucaggccug

SEQ ID NO: 3044290 - RNA, 13 nt, Human
augguuguacaua

SEQ ID NO: 3044291 - RNA, 17 nt, Human
auguacauguacugauu

SEQ ID NO: 3044292 - RNA, 22 nt, Human
augcagauuuugcccuugacaa

SEQ ID NO: 3044293 - RNA, 17 nt, Human
augauaaguaaaugcua

SEQ ID NO: 3044294 - RNA, 20 nt, Human
uuguguuaaguauguguaaa

SEQ ID NO: 3044295 - RNA, 21 nt, Human
augauacuugaaaauuaacau

SEQ ID NO: 3044296 - RNA, 17 nt, Human
augauacuugaaaauua

SEQ ID NO: 3044297 - RNA, 22 nt, Human
uuucaaaauuguuacaaauugu

SEQ ID NO: 3044298 - RNA, 16 nt, Human
uuuauuuuguguuuag

SEQ ID NO: 3044299 - RNA, 20 nt, Human
uuuauuuuguguuuaggaac

SEQ ID NO: 3044300 - RNA, 18 nt, Human
augcuagguuaauuccaa

SEQ ID NO: 3044301 - RNA, 17 nt, Human
uuuaucaugugaaauca

SEQ ID NO: 3044302 - RNA, 18 nt, Human
uuuaucaugugaaaucau

SEQ ID NO: 3044303 - RNA, 21 nt, Human
uuuaucaaagggugaaaauua

SEQ ID NO: 3044304 - RNA, 18 nt, Human
auggcauauuuuucacau

SEQ ID NO: 3044305 - RNA, 23 nt, Human
auggcauauuuuucacauaucua

SEQ ID NO: 3044306 - RNA, 22 nt, Human
auggcauauuuuucacauaucu

SEQ ID NO: 3044307 - RNA, 21 nt, Human
auggcauauuuuucacauauc

SEQ ID NO: 3044308 - RNA, 20 nt, Human
auggcauauuuuucacauau

SEQ ID NO: 3044309 - RNA, 14 nt, Human
uuucaaacuuugga

SEQ ID NO: 3044310 - RNA, 16 nt, Human
accugccgagagucca

SEQ ID NO: 3044311 - RNA, 23 nt, Human
accugccgagaguccaucagccu

SEQ ID NO: 3044312 - RNA, 22 nt, Human
acuauucaggagaguagaacag

SEQ ID NO: 3044313 - RNA, 16 nt, Human
acucaggcccaaagcc

SEQ ID NO: 3044314 - RNA, 17 nt, Human
acucagcccucauuggc

SEQ ID NO: 3044315 - RNA, 21 nt, Human
acucagcccucauuggcucuu

SEQ ID NO: 3044316 - RNA, 12 nt, Human
acugccagcauu

SEQ ID NO: 3044317 - RNA, 18 nt, Human
acugguaggaaacuaggu

SEQ ID NO: 3044318 - RNA, 22 nt, Human
acugugaaguuuacauuguaaa

SEQ ID NO: 3044319 - RNA, 14 nt, Human
agaaaauaacaaua

SEQ ID NO: 3044320 - RNA, 23 nt, Human
acuuuuaugauacuugaaaauua

SEQ ID NO: 3044321 - RNA, 12 nt, Human
acuuuuaugaua

SEQ ID NO: 3044322 - RNA, 16 nt, Human
acuuuuaugauacuug

SEQ ID NO: 3044323 - RNA, 22 nt, Human
acuuuauuuucuauaauuuaaa

SEQ ID NO: 3044324 - RNA, 22 nt, Human
acuuuaucuugaauaauguaag

SEQ ID NO: 3044325 - RNA, 22 nt, Human
acuuuauacccagaaaguuauu

SEQ ID NO: 3044326 - RNA, 20 nt, Human
acuuuauacccagaaaguua

SEQ ID NO: 3044327 - RNA, 16 nt, Human
agaaaggauaaaguug

SEQ ID NO: 3044328 - RNA, 23 nt, Human
agaaaguuauugauaaguucaua

SEQ ID NO: 3044329 - RNA, 11 nt, Human
agaaaguuauu

SEQ ID NO: 3044330 - RNA, 11 nt, Human
acacugccagc

SEQ ID NO: 3044331 - RNA, 19 nt, Human
acagccaacuauggccugu

SEQ ID NO: 3044332 - RNA, 17 nt, Human
acagccaacuauggccu

SEQ ID NO: 3044333 - RNA, 21 nt, Human
acaggaugaugacuauggaaa

SEQ ID NO: 3044334 - RNA, 13 nt, Human
acccccugugccu

SEQ ID NO: 3044335 - RNA, 19 nt, Human
acauguuucuuuguaauga

SEQ ID NO: 3044336 - RNA, 22 nt, Human
acauguuucuuuguaaugaaaa

SEQ ID NO: 3044337 - RNA, 19 nt, Human
acauuuguucuauagcuuu

SEQ ID NO: 3044338 - RNA, 13 nt, Human
accagaucauugu

SEQ ID NO: 3044339 - RNA, 17 nt, Human
aauauguuucaaacuuu

SEQ ID NO: 3044340 - RNA, 16 nt, Human
aauauguuucaaacuu

SEQ ID NO: 3044341 - RNA, 15 nt, Human
aauauguuucaaacu

SEQ ID NO: 3044342 - RNA, 13 nt, Human
aauauguuucaaa

SEQ ID NO: 3044343 - RNA, 16 nt, Human
aauauauaucaaauau

SEQ ID NO: 3044344 - RNA, 15 nt, Human
aaucaccaaaggcuc

SEQ ID NO: 3044345 - RNA, 13 nt, Human
aauccagccugcu

SEQ ID NO: 3044346 - RNA, 17 nt, Human
aauccaagcaaauguga

SEQ ID NO: 3044347 - RNA, 18 nt, Human
aauccaagcaaaugugaa

SEQ ID NO: 3044348 - RNA, 18 nt, Human
aaugcuagguuaauucca

SEQ ID NO: 3044349 - RNA, 19 nt, Human
aaugcuagguuaauuccaa

SEQ ID NO: 3044350 - RNA, 15 nt, Human
aaugucaguaugugg

SEQ ID NO: 3044351 - RNA, 13 nt, Human
aaugucaguaugu

SEQ ID NO: 3044352 - RNA, 21 nt, Human
aaugcuagguuaauuccaauu

SEQ ID NO: 3044353 - RNA, 22 nt, Human
aauguuuuuuuuuaaagacuuu

SEQ ID NO: 3044354 - RNA, 15 nt, Human
aauguuuuuuuuuaa

SEQ ID NO: 3044355 - RNA, 20 nt, Human
aauguuuuuuuuuaaagacu

SEQ ID NO: 3044356 - RNA, 15 nt, Human
aagucuccaaagucu

SEQ ID NO: 3044357 - RNA, 14 nt, Human
aagucuccaaaguc

SEQ ID NO: 3044358 - RNA, 20 nt, Human
aaggugaggagcuugaaacc

SEQ ID NO: 3044359 - RNA, 21 nt, Human
aagcugugugcucuccaagcc

SEQ ID NO: 3044360 - RNA, 18 nt, Human
aagcuguguggcagucug

SEQ ID NO: 3044361 - RNA, 17 nt, Human
aagcagauggaaugcug

SEQ ID NO: 3044362 - RNA, 19 nt, Human
aagcagauggaaugcugug

SEQ ID NO: 3044363 - RNA, 20 nt, Human
aagcagauggaaugcugugu

SEQ ID NO: 3044364 - RNA, 17 nt, Human
aaaaucaguuguacagu

SEQ ID NO: 3044365 - RNA, 21 nt, Human
aaaauugauguguuuauuuau

SEQ ID NO: 3044366 - RNA, 12 nt, Human
aaaauugaugug

SEQ ID NO: 3044367 - RNA, 14 nt, Human
aaaauugauguguu

SEQ ID NO: 3044368 - RNA, 21 nt, Human
aaaauugaugggauuugguca

SEQ ID NO: 3044369 - RNA, 22 nt, Human
aaacacugggagaaaugaaaaa

SEQ ID NO: 3044370 - RNA, 24 nt, Human
aaacacucaguuguucaauaauaa

SEQ ID NO: 3044371 - RNA, 21 nt, Human
aaacacugggagaaaugaaaa

SEQ ID NO: 3044372 - RNA, 15 nt, Human
aaagaaauauaccua

SEQ ID NO: 3044373 - RNA, 17 nt, Human
aaagaaauauaccuaaa

SEQ ID NO: 3044374 - RNA, 17 nt, Human
aaagccaaugugaacag

SEQ ID NO: 3044375 - RNA, 15 nt, Human
aaagccaaugugaac

SEQ ID NO: 3044376 - RNA, 23 nt, Human
aacuuuauacccagaaaguuauu

SEQ ID NO: 3044377 - RNA, 22 nt, Human
aacuuuauacccagaaaguuau

SEQ ID NO: 3044378 - RNA, 17 nt, Human
aaaucuuauaauuuaaa

SEQ ID NO: 3044379 - RNA, 15 nt, Human
aaaugccuuuguacu

SEQ ID NO: 3044380 - RNA, 22 nt, Human
aaccacuggaaaguuuaugguu

SEQ ID NO: 3044381 - RNA, 19 nt, Human
aaccaccagaagcccagaa

SEQ ID NO: 3044382 - RNA, 18 nt, Human
aaccaccagaagcccaga

SEQ ID NO: 3044383 - RNA, 14 nt, Human
agcugcuccccacg

SEQ ID NO: 3044384 - RNA, 17 nt, Human
agcugcuccccacguca

SEQ ID NO: 3044385 - RNA, 22 nt, Human
agcuucuggugaccuuccaaga

SEQ ID NO: 3044386 - RNA, 21 nt, Human
agcuucuggugaccuuccaag

SEQ ID NO: 3044387 - RNA, 22 nt, Human
agcuccuuaaggcucuuuugua

SEQ ID NO: 3044388 - RNA, 18 nt, Human
agcuccuuaaggcucuuu

SEQ ID NO: 3044389 - RNA, 14 nt, Human
agcugagcaggugu

SEQ ID NO: 3044390 - RNA, 21 nt, Human
agcuuuucccuuuuuuuaagu

SEQ ID NO: 3044391 - RNA, 21 nt, Human
aggagucccugccaucauguu

SEQ ID NO: 3044392 - RNA, 23 nt, Human
aggcuacuguaaggcaaucaugg

SEQ ID NO: 3044393 - RNA, 21 nt, Human
agguggaauuauuuuaaaaga

SEQ ID NO: 3044394 - RNA, 17 nt, Human
agguggaauuauuuuaa

SEQ ID NO: 3044395 - RNA, 16 nt, Human
aggucccuaauaaagc

SEQ ID NO: 3044396 - RNA, 13 nt, Human
aggucccuaauaa

SEQ ID NO: 3044397 - RNA, 15 nt, Human
aggucccuaauaaag

SEQ ID NO: 3044398 - RNA, 20 nt, Human
agguaaaagcaucacaugaa

SEQ ID NO: 3044399 - RNA, 18 nt, Human
agguaaaucagacuauga

SEQ ID NO: 3044400 - RNA, 12 nt, Human
aggucccuaaua

SEQ ID NO: 3044401 - RNA, 11 nt, Human
aggucccuaau

SEQ ID NO: 3044402 - RNA, 23 nt, Human
agguaaaucagacuaugaaguuu

SEQ ID NO: 3044403 - RNA, 14 nt, Human
agccgggagccuga

SEQ ID NO: 3044404 - RNA, 14 nt, Human
agcacugacagauu

SEQ ID NO: 3044405 - RNA, 13 nt, Human
agcacugacagau

SEQ ID NO: 3044406 - RNA, 18 nt, Human
agcacugacagauuucca

SEQ ID NO: 3044407 - RNA, 18 nt, Human
agcagugggccuggccag

SEQ ID NO: 3044408 - RNA, 20 nt, Human
agaggacaguauuugugggg

SEQ ID NO: 3044409 - RNA, 17 nt, Human
agagggaugcauggaga

SEQ ID NO: 3044410 - RNA, 19 nt, Human
augagcuccuuaaggcucu

SEQ ID NO: 3044411 - RNA, 23 nt, Human
augaaaaaauauauaucaaauau

SEQ ID NO: 3044412 - RNA, 19 nt, Human
augaaguuuuuuuuauaca

SEQ ID NO: 3044413 - RNA, 22 nt, Human
augaagcuuuuaugugaaacau

SEQ ID NO: 3044414 - RNA, 18 nt, Human
aucuugaauaauguaaga

SEQ ID NO: 3044415 - RNA, 18 nt, Human
auccagaaagaaaacuug

SEQ ID NO: 3044416 - RNA, 16 nt, Human
auccagaaagaaaacu

SEQ ID NO: 3044417 - RNA, 14 nt, Human
aucagccugugcca

SEQ ID NO: 3044418 - RNA, 15 nt, Human
aucaugugaaaucau

SEQ ID NO: 3044419 - RNA, 14 nt, Human
aucaugugaaauca

SEQ ID NO: 3044420 - RNA, 16 nt, Human
aucaugugaaaucauu

SEQ ID NO: 3044421 - RNA, 16 nt, Human
auggcuguggagugug

SEQ ID NO: 3044422 - RNA, 17 nt, Human
augcauagguuuagcag

SEQ ID NO: 3044423 - RNA, 21 nt, Human
augcauagguuuagcaguaua

SEQ ID NO: 3044424 - RNA, 16 nt, Human
augcauauuauuuuau

SEQ ID NO: 3044425 - RNA, 19 nt, Human
auguauucuagcuaaugua

SEQ ID NO: 3044426 - RNA, 20 nt, Human
auguauucuagcuaauguaa

SEQ ID NO: 3044427 - RNA, 15 nt, Human
augugaaacauguuu

SEQ ID NO: 3044428 - RNA, 13 nt, Human
auguuucaaacuu

SEQ ID NO: 3044429 - RNA, 12 nt, Human
auguuucaaacu

SEQ ID NO: 3044430 - RNA, 17 nt, Human
auguuucaaacuuugga

SEQ ID NO: 3044431 - RNA, 14 nt, Human
auguuucaaacuuu

SEQ ID NO: 3044432 - RNA, 14 nt, Human
auaaaaauauugug

SEQ ID NO: 3044433 - RNA, 20 nt, Human
auaaacuuuuuucuuacugu

SEQ ID NO: 3044434 - RNA, 15 nt, Human
auaaagcaggcagaa

SEQ ID NO: 3044435 - RNA, 18 nt, Human
auaaagcuguguggcagu

SEQ ID NO: 3044436 - RNA, 18 nt, Human
auaaaggauuaaugucaa

SEQ ID NO: 3044437 - RNA, 20 nt, Human
auaauuaaauuuugaguucu

SEQ ID NO: 3044438 - RNA, 23 nt, Human
auaguauuugagaguucuaaauu

SEQ ID NO: 3044439 - RNA, 20 nt, Human
auaguauuugagaguucuaa

SEQ ID NO: 3044440 - RNA, 21 nt, Human
auaguauuugagaguucuaaa

SEQ ID NO: 3044441 - RNA, 15 nt, Human
auagguuuaauaauu

SEQ ID NO: 3044442 - RNA, 13 nt, Human
auauuauguguuu

SEQ ID NO: 3044443 - RNA, 23 nt, Human
auauuaugaagcuuuuaugugaa

SEQ ID NO: 3044444 - RNA, 16 nt, Human
auaucaaauauauuca

SEQ ID NO: 3044445 - RNA, 16 nt, Human
aguggcuggaucugug

SEQ ID NO: 3044446 - RNA, 15 nt, Human
aguucauacauugua

SEQ ID NO: 3044447 - RNA, 22 nt, Human
aguugaaaaucuuauaauuuaa

SEQ ID NO: 3044448 - RNA, 11 nt, Human
aguucauacau

SEQ ID NO: 3044449 - RNA, 10 nt, Human
aguucauaca

SEQ ID NO: 3044450 - RNA, 18 nt, Human
aguucauaaauuuauggu

SEQ ID NO: 3044451 - RNA, 23 nt, Human
aguugaaaaucuuauaauuuaaa

SEQ ID NO: 3044452 - RNA, 16 nt, Human
aguaugaaauuauaua

SEQ ID NO: 3044453 - RNA, 14 nt, Human
aguaugaaauuaua

SEQ ID NO: 3044454 - RNA, 16 nt, Human
aguaucuuuuuauuca

SEQ ID NO: 3044455 - RNA, 12 nt, Human
aguccuguaaug

SEQ ID NO: 3044456 - RNA, 16 nt, Human
caccccgacuuuuguu

SEQ ID NO: 3044457 - RNA, 17 nt, Human
caccagaagcccagaau

SEQ ID NO: 3044458 - RNA, 16 nt, Human
caccagaagcccagaa

SEQ ID NO: 3044459 - RNA, 15 nt, Human
caccagaagcccaga

SEQ ID NO: 3044460 - RNA, 14 nt, Human
caccagaagcccag

SEQ ID NO: 3044461 - RNA, 13 nt, Human
caccagaagccca

SEQ ID NO: 3044462 - RNA, 14 nt, Human
cacaacuauuuuuc

SEQ ID NO: 3044463 - RNA, 19 nt, Human
cacaacuauuuuuccaaaa

SEQ ID NO: 3044464 - RNA, 21 nt, Human
cacaaauucugucucuggauu

SEQ ID NO: 3044465 - RNA, 23 nt, Human
cacauaucuaguaugaaauuaua

SEQ ID NO: 3044466 - RNA, 19 nt, Human
caccaagccuggucagccc

SEQ ID NO: 3044467 - RNA, 21 nt, Human
caccaagccuggucagcccaa

SEQ ID NO: 3044468 - RNA, 20 nt, Human
caccaagccuggucagccca

SEQ ID NO: 3044469 - RNA, 18 nt, Human
cacauuggagauguuuag

SEQ ID NO: 3044470 - RNA, 22 nt, Human
caccaagccuggucagcccaaa

SEQ ID NO: 3044471 - RNA, 22 nt, Human
cacauggugacuuuugaaaaga

SEQ ID NO: 3044472 - RNA, 12 nt, Human
caaauauauuca

SEQ ID NO: 3044473 - RNA, 23 nt, Human
caaaaaaauauauuuaaugauaa

SEQ ID NO: 3044474 - RNA, 17 nt, Human
caagcacuaaacaaaga

SEQ ID NO: 3044475 - RNA, 11 nt, Human
caacuuuguau

SEQ ID NO: 3044476 - RNA, 18 nt, Human
caagaaaacaacuucaau

SEQ ID NO: 3044477 - RNA, 12 nt, Human
caacuuuguaua

SEQ ID NO: 3044478 - RNA, 12 nt, Human
caacuuuauacc

SEQ ID NO: 3044479 - RNA, 15 nt, Human
caaauucugucucug

SEQ ID NO: 3044480 - RNA, 20 nt, Human
ccgagaguccaucagccucc

SEQ ID NO: 3044481 - RNA, 21 nt, Human
ccgagaguccaucagccucca

SEQ ID NO: 3044482 - RNA, 21 nt, Human
ccgggggcagucugagagagg

SEQ ID NO: 3044483 - RNA, 20 nt, Human
ccggggccugggcaggaggg

SEQ ID NO: 3044484 - RNA, 17 nt, Human
ccgccuccuacagccca

SEQ ID NO: 3044485 - RNA, 16 nt, Human
ccuaggcuaggguggg

SEQ ID NO: 3044486 - RNA, 12 nt, Human
ccuaaccugccg

SEQ ID NO: 3044487 - RNA, 13 nt, Human
ccuaaccugccga

SEQ ID NO: 3044488 - RNA, 23 nt, Human
ccguggcuguggcauccagaguc

SEQ ID NO: 3044489 - RNA, 22 nt, Human
ccgggucaucuguaccucugcc

SEQ ID NO: 3044490 - RNA, 15 nt, Human
cccugccucucugca

SEQ ID NO: 3044491 - RNA, 13 nt, Human
cccugccucucug

SEQ ID NO: 3044492 - RNA, 14 nt, Human
cccugccucucugc

SEQ ID NO: 3044493 - RNA, 20 nt, Human
cccugaggcagguccccaga

SEQ ID NO: 3044494 - RNA, 18 nt, Human
cccugaggcaggucccca

SEQ ID NO: 3044495 - RNA, 17 nt, Human
cccugaggcaggucccc

SEQ ID NO: 3044496 - RNA, 21 nt, Human
cccugaggcagguccccagac

SEQ ID NO: 3044497 - RNA, 14 nt, Human
ccccugugccuugu

SEQ ID NO: 3044498 - RNA, 12 nt, Human
ccccuggugguu

SEQ ID NO: 3044499 - RNA, 20 nt, Human
ccccuggcuccaggccaggg

SEQ ID NO: 3044500 - RNA, 14 nt, Human
ccccugccucucug

SEQ ID NO: 3044501 - RNA, 15 nt, Human
ccccugccucucugc

SEQ ID NO: 3044502 - RNA, 19 nt, Human
ccccugccucucugcaggu

SEQ ID NO: 3044503 - RNA, 16 nt, Human
ccccugccucucugca

SEQ ID NO: 3044504 - RNA, 17 nt, Human
ccccugccucucugcag

SEQ ID NO: 3044505 - RNA, 17 nt, Human
ccccaucauugguaccc

SEQ ID NO: 3044506 - RNA, 13 nt, Human
ccccuccaccugc

SEQ ID NO: 3044507 - RNA, 14 nt, Human
cccaugagcuccuu

SEQ ID NO: 3044508 - RNA, 15 nt, Human
cccaugagcuccuua

SEQ ID NO: 3044509 - RNA, 22 nt, Human
cccaugagcuccuuaaggcucu

SEQ ID NO: 3044510 - RNA, 13 nt, Human
cccaugagcuccu

SEQ ID NO: 3044511 - RNA, 17 nt, Human
cccagaaugaggcugcu

SEQ ID NO: 3044512 - RNA, 15 nt, Human
cccaacacugccagc

SEQ ID NO: 3044513 - RNA, 16 nt, Human
cccaacacugccagca

SEQ ID NO: 3044514 - RNA, 14 nt, Human
cccaacacugccag

SEQ ID NO: 3044515 - RNA, 15 nt, Human
cccacgucagcuggg

SEQ ID NO: 3044516 - RNA, 15 nt, Human
cccacggcuccucga

SEQ ID NO: 3044517 - RNA, 16 nt, Human
cccagaaugaggcugc

SEQ ID NO: 3044518 - RNA, 22 nt, Human
cccagaauaaacuggcagcuca

SEQ ID NO: 3044519 - RNA, 24 nt, Human
cccagaauaaacuggcagcucagc

SEQ ID NO: 3044520 - RNA, 23 nt, Human
ccagugaauucuugaaggaaaau

SEQ ID NO: 3044521 - RNA, 12 nt, Human
ccaggcuggguc

SEQ ID NO: 3044522 - RNA, 16 nt, Human
ccaggcugggucgccc

SEQ ID NO: 3044523 - RNA, 21 nt, Human
ccaggcugggucgcccuggac

SEQ ID NO: 3044524 - RNA, 22 nt, Human
ccaggcugggucgcccuggacu

SEQ ID NO: 3044525 - RNA, 23 nt, Human
ccaggcugggucgcccuggacug

SEQ ID NO: 3044526 - RNA, 24 nt, Human
ccaggcugggucgcccuggacugu

SEQ ID NO: 3044527 - RNA, 16 nt, Human
ccaggccacuggcccc

SEQ ID NO: 3044528 - RNA, 23 nt, Human
ccaggccacuggccccugagauc

SEQ ID NO: 3044529 - RNA, 19 nt, Human
ccacccccaggaccccuga

SEQ ID NO: 3044530 - RNA, 18 nt, Human
ccacccccaggaccccug

SEQ ID NO: 3044531 - RNA, 16 nt, Human
ccacccccaggacccc

SEQ ID NO: 3044532 - RNA, 15 nt, Human
ccagaaugaggcugc

SEQ ID NO: 3044533 - RNA, 15 nt, Human
ccagaagcccagaau

SEQ ID NO: 3044534 - RNA, 18 nt, Human
ccagaaaccuuuguuugc

SEQ ID NO: 3044535 - RNA, 10 nt, Human
ccagccugcc

SEQ ID NO: 3044536 - RNA, 18 nt, Human
ccagcccugaguuccuag

SEQ ID NO: 3044537 - RNA, 14 nt, Human
ccagcccugaguuc

SEQ ID NO: 3044538 - RNA, 17 nt, Human
ccugcaccggggccugg

SEQ ID NO: 3044539 - RNA, 15 nt, Human
ccugcaccggggccu

SEQ ID NO: 3044540 - RNA, 19 nt, Human
ccugaagagaagggcaggg

SEQ ID NO: 3044541 - RNA, 15 nt, Human
ccucuuccaggcccc

SEQ ID NO: 3044542 - RNA, 22 nt, Human
ccugccgagaguccaucagccu

SEQ ID NO: 3044543 - RNA, 23 nt, Human
ccugccgagaguccaucagccuc

SEQ ID NO: 3044544 - RNA, 14 nt, Human
ccugccgagagucc

SEQ ID NO: 3044545 - RNA, 20 nt, Human
ccugguccucacacucaccc

SEQ ID NO: 3044546 - RNA, 19 nt, Human
cgggacaccuaggcuaggg

SEQ ID NO: 3044547 - RNA, 20 nt, Human
cgggaauuuucaucuaggau

SEQ ID NO: 3044548 - RNA, 18 nt, Human
cgggacaccuaggcuagg

SEQ ID NO: 3044549 - RNA, 18 nt, Human
cgggaauuuucaucuagg

SEQ ID NO: 3044550 - RNA, 11 nt, Human
cgcggcuggga

SEQ ID NO: 3044551 - RNA, 12 nt, Human
cgcggcugggag

SEQ ID NO: 3044552 - RNA, 16 nt, Human
cgcggcugggaggagg

SEQ ID NO: 3044553 - RNA, 15 nt, Human
cgaagcguuguccuc

SEQ ID NO: 3044554 - RNA, 16 nt, Human
cgaagcguuguccuca

SEQ ID NO: 3044555 - RNA, 17 nt, Human
cgaagcguuguccucag

SEQ ID NO: 3044556 - RNA, 21 nt, Human
cgaagcguuguccucagcccc

SEQ ID NO: 3044557 - RNA, 23 nt, Human
cgaagaguauuuuugacagaaua

SEQ ID NO: 3044558 - RNA, 14 nt, Human
ccuuugucccagaa

SEQ ID NO: 3044559 - RNA, 18 nt, Human
ccuguggaucaaauccag

SEQ ID NO: 3044560 - RNA, 17 nt, Human
ccugugccuuuugccau

SEQ ID NO: 3044561 - RNA, 22 nt, Human
cuccacucaugugacucuuucc

SEQ ID NO: 3044562 - RNA, 16 nt, Human
cuccacucaugugacu

SEQ ID NO: 3044563 - RNA, 14 nt, Human
cuccacucuccucu

SEQ ID NO: 3044564 - RNA, 17 nt, Human
cucaguucucuucacuc

SEQ ID NO: 3044565 - RNA, 16 nt, Human
cucaguucucuucacu

SEQ ID NO: 3044566 - RNA, 21 nt, Human
cucauaaaaagccugcaauuu

SEQ ID NO: 3044567 - RNA, 20 nt, Human
cuccccacgucagcugggac

SEQ ID NO: 3044568 - RNA, 16 nt, Human
cucagaggguguccug

SEQ ID NO: 3044569 - RNA, 23 nt, Human
cucacugcuaagaauauuugaau

SEQ ID NO: 3044570 - RNA, 22 nt, Human
cucacugcuaagaauauuugaa

SEQ ID NO: 3044571 - RNA, 21 nt, Human
cucacugcuaagaauauuuga

SEQ ID NO: 3044572 - RNA, 20 nt, Human
cucacugcuaagaauauuug

SEQ ID NO: 3044573 - RNA, 17 nt, Human
cucagccccgcguggaa

SEQ ID NO: 3044574 - RNA, 18 nt, Human
cucaggaaccgaggcagg

SEQ ID NO: 3044575 - RNA, 19 nt, Human
cucaggaaccgaggcaggg

SEQ ID NO: 3044576 - RNA, 17 nt, Human
cucaggaaccgaggcag

SEQ ID NO: 3044577 - RNA, 12 nt, Human
cucaggagcccu

SEQ ID NO: 3044578 - RNA, 13 nt, Human
cucaggagcccug

SEQ ID NO: 3044579 - RNA, 14 nt, Human
cucaggagcccugg

SEQ ID NO: 3044580 - RNA, 15 nt, Human
cucaggagcccuggg

SEQ ID NO: 3044581 - RNA, 16 nt, Human
cucaggagcccuggga

SEQ ID NO: 3044582 - RNA, 17 nt, Human
cucaggagcccugggag

SEQ ID NO: 3044583 - RNA, 20 nt, Human
cucaggagcccugggaggcu

SEQ ID NO: 3044584 - RNA, 21 nt, Human
cucaggagcccugggaggcuc

SEQ ID NO: 3044585 - RNA, 22 nt, Human
cucaggagcccugggaggcucu

SEQ ID NO: 3044586 - RNA, 23 nt, Human
cucaggagcccugggaggcucug

SEQ ID NO: 3044587 - RNA, 24 nt, Human
cucaggagcccugggaggcucugg

SEQ ID NO: 3044588 - RNA, 22 nt, Human
cuacucuggagguuuguuuaga

SEQ ID NO: 3044589 - RNA, 18 nt, Human
cuacugggagccuaccca

SEQ ID NO: 3044590 - RNA, 15 nt, Human
cuacugggagccuac

SEQ ID NO: 3044591 - RNA, 14 nt, Human
cuacugggagccua

SEQ ID NO: 3044592 - RNA, 22 nt, Human
cuagcuaauguaauaacuguga

SEQ ID NO: 3044593 - RNA, 12 nt, Human
cuauaauuuaaa

SEQ ID NO: 3044594 - RNA, 22 nt, Human
cuaugaaguuuuuuuuauacag

SEQ ID NO: 3044595 - RNA, 21 nt, Human
cuauucaggagaguagaacag

SEQ ID NO: 3044596 - RNA, 21 nt, Human
cuauggggauagaugugugga

SEQ ID NO: 3044597 - RNA, 20 nt, Human
cuauggggauagaugugugg

SEQ ID NO: 3044598 - RNA, 19 nt, Human
cuauggggauagaugugug

SEQ ID NO: 3044599 - RNA, 13 nt, Human
cucacacucaccc

SEQ ID NO: 3044600 - RNA, 12 nt, Human
cucaaauuugga

SEQ ID NO: 3044601 - RNA, 23 nt, Human
cuacacgagauacagaauuuuau

SEQ ID NO: 3044602 - RNA, 14 nt, Human
cuaauaaagcugug

SEQ ID NO: 3044603 - RNA, 18 nt, Human
cuaauaaucauuggauuc

SEQ ID NO: 3044604 - RNA, 21 nt, Human
cuaagcuucacuguaaaauaa

SEQ ID NO: 3044605 - RNA, 16 nt, Human
cuaagauaguaacaau

SEQ ID NO: 3044606 - RNA, 20 nt, Human
cuaaauuuuauaucuuguag

SEQ ID NO: 3044607 - RNA, 13 nt, Human
cuaaauuuuauau

SEQ ID NO: 3044608 - RNA, 16 nt, Human
cuaaauuuuauaucuu

SEQ ID NO: 3044609 - RNA, 15 nt, Human
cuaaauuuuauaucu

SEQ ID NO: 3044610 - RNA, 13 nt, Human
cguuuucaaaauu

SEQ ID NO: 3044611 - RNA, 13 nt, Human
cuuucccaacacc

SEQ ID NO: 3044612 - RNA, 22 nt, Human
cuuucuuccaaacaggcucaga

SEQ ID NO: 3044613 - RNA, 16 nt, Human
cuuucugcuuguguua

SEQ ID NO: 3044614 - RNA, 19 nt, Human
cuuuggcuaugagggccuu

SEQ ID NO: 3044615 - RNA, 16 nt, Human
cuugucacgccagacu

SEQ ID NO: 3044616 - RNA, 18 nt, Human
cuugucacgccagacuuc

SEQ ID NO: 3044617 - RNA, 13 nt, Human
cuugucacgccag

SEQ ID NO: 3044618 - RNA, 19 nt, Human
cuugaguuuaaauuguaau

SEQ ID NO: 3044619 - RNA, 23 nt, Human
cuuuaucuugaauaauguaagac

SEQ ID NO: 3044620 - RNA, 18 nt, Human
cuuuaucuugaauaaugu

SEQ ID NO: 3044621 - RNA, 21 nt, Human
cuuuaucuugaauaauguaag

SEQ ID NO: 3044622 - RNA, 22 nt, Human
cuuuaucaaagggugaaaauua

SEQ ID NO: 3044623 - RNA, 21 nt, Human
cuuuaucaaagggugaaaauu

SEQ ID NO: 3044624 - RNA, 14 nt, Human
cuuuguggcacugg

SEQ ID NO: 3044625 - RNA, 17 nt, Human
cuuuuuauggccuguga

SEQ ID NO: 3044626 - RNA, 21 nt, Human
gaaaauauuauguguuuccau

SEQ ID NO: 3044627 - RNA, 13 nt, Human
gaaaauauuuaaa

SEQ ID NO: 3044628 - RNA, 18 nt, Human
gaaaaucuuauaauuuaa

SEQ ID NO: 3044629 - RNA, 20 nt, Human
gaaaaugauacgcaacauaa

SEQ ID NO: 3044630 - RNA, 21 nt, Human
gaaagaguacucuuguuuccu

SEQ ID NO: 3044631 - RNA, 21 nt, Human
cuucuggugaccuuccaagag

SEQ ID NO: 3044632 - RNA, 20 nt, Human
cuucuggugaccuuccaaga

SEQ ID NO: 3044633 - RNA, 18 nt, Human
cuucuggugaccuuccaa

SEQ ID NO: 3044634 - RNA, 14 nt, Human
cuucugugaaagua

SEQ ID NO: 3044635 - RNA, 12 nt, Human
cuugaaaaaugc

SEQ ID NO: 3044636 - RNA, 18 nt, Human
cuugaaaaaugcauguug

SEQ ID NO: 3044637 - RNA, 18 nt, Human
cuugaaaauuaacaugaa

SEQ ID NO: 3044638 - RNA, 12 nt, Human
cuugaaaauuaa

SEQ ID NO: 3044639 - RNA, 13 nt, Human
cuugaaaauuaac

SEQ ID NO: 3044640 - RNA, 13 nt, Human
cuucccuuucugc

SEQ ID NO: 3044641 - RNA, 13 nt, Human
cuuauauuaugga

SEQ ID NO: 3044642 - RNA, 14 nt, Human
cuggaccagccucu

SEQ ID NO: 3044643 - RNA, 18 nt, Human
cuggaccagccucuccac

SEQ ID NO: 3044644 - RNA, 13 nt, Human
cuggaauuugaaa

SEQ ID NO: 3044645 - RNA, 17 nt, Human
cuggagguuuguuuaga

SEQ ID NO: 3044646 - RNA, 12 nt, Human
cuggagguuugu

SEQ ID NO: 3044647 - RNA, 23 nt, Human
cuggcugcagagcagugggccug

SEQ ID NO: 3044648 - RNA, 21 nt, Human
cuggccaguggcuggaucugu

SEQ ID NO: 3044649 - RNA, 23 nt, Human
cugccgagaguccaucagccucc

SEQ ID NO: 3044650 - RNA, 22 nt, Human
cugccgagaguccaucagccuc

SEQ ID NO: 3044651 - RNA, 22 nt, Human
cugccucucugcaggucccuaa

SEQ ID NO: 3044652 - RNA, 20 nt, Human
cugccucucugcaggucccu

SEQ ID NO: 3044653 - RNA, 21 nt, Human
cugccucucugcaggucccua

SEQ ID NO: 3044654 - RNA, 19 nt, Human
cugccucucugcagguccc

SEQ ID NO: 3044655 - RNA, 11 nt, Human
cugcugggcuu

SEQ ID NO: 3044656 - RNA, 21 nt, Human
cugucucccuccucugcccgg

SEQ ID NO: 3044657 - RNA, 19 nt, Human
cugugaggggcucucucau

SEQ ID NO: 3044658 - RNA, 21 nt, Human
cuguguguguguauguggggg

SEQ ID NO: 3044659 - RNA, 17 nt, Human
cuguguguuuaugugug

SEQ ID NO: 3044660 - RNA, 16 nt, Human
cuguguguuuaugugu

SEQ ID NO: 3044661 - RNA, 15 nt, Human
cuguguggcagucug

SEQ ID NO: 3044662 - RNA, 23 nt, Human
cugugugcucaggagcccuggga

SEQ ID NO: 3044663 - RNA, 19 nt, Human
cugugugcucaggagcccu

SEQ ID NO: 3044664 - RNA, 16 nt, Human
cugugugcucaggagc

SEQ ID NO: 3044665 - RNA, 20 nt, Human
cugugugcucaggagcccug

SEQ ID NO: 3044666 - RNA, 21 nt, Human
cugugugcucaggagcccugg

SEQ ID NO: 3044667 - RNA, 18 nt, Human
gagaucccaacacugcca

SEQ ID NO: 3044668 - RNA, 19 nt, Human
gagaucccaacacugccag

SEQ ID NO: 3044669 - RNA, 20 nt, Human
gagaucccaacacugccagc

SEQ ID NO: 3044670 - RNA, 18 nt, Human
gagaugaugaaaauauuu

SEQ ID NO: 3044671 - RNA, 23 nt, Human
gagcccacuguacuugcucuuga

SEQ ID NO: 3044672 - RNA, 13 nt, Human
gagagacgggccc

SEQ ID NO: 3044673 - RNA, 15 nt, Human
gagaguagaacagau

SEQ ID NO: 3044674 - RNA, 17 nt, Human
gagaaugucaguaugug

SEQ ID NO: 3044675 - RNA, 21 nt, Human
gagaaaugaaaaaauauauau

SEQ ID NO: 3044676 - RNA, 12 nt, Human
gagaaaugaaaa

SEQ ID NO: 3044677 - RNA, 14 nt, Human
gaccagccucucca

SEQ ID NO: 3044678 - RNA, 13 nt, Human
gacacaacuauuu

SEQ ID NO: 3044679 - RNA, 16 nt, Human
gacaaggaaaaaauaa

SEQ ID NO: 3044680 - RNA, 23 nt, Human
gaauuggguggggggcuucauac

SEQ ID NO: 3044681 - RNA, 22 nt, Human
gaauuggguggggggcuucaua

SEQ ID NO: 3044682 - RNA, 20 nt, Human
gaauuggguggggggcuuca

SEQ ID NO: 3044683 - RNA, 13 nt, Human
gaaugcuguguua

SEQ ID NO: 3044684 - RNA, 14 nt, Human
gaaugcuguguuaa

SEQ ID NO: 3044685 - RNA, 19 nt, Human
gaaucucauaauuuauaca

SEQ ID NO: 3044686 - RNA, 18 nt, Human
gaaucucauaauuuauac

SEQ ID NO: 3044687 - RNA, 18 nt, Human
gaauucuugaaggaaaau

SEQ ID NO: 3044688 - RNA, 15 nt, Human
gaauguuaagcagau

SEQ ID NO: 3044689 - RNA, 19 nt, Human
gaaugucaguauguggaag

SEQ ID NO: 3044690 - RNA, 14 nt, Human
gaauguuaagcaga

SEQ ID NO: 3044691 - RNA, 13 nt, Human
gaaugucaguaug

SEQ ID NO: 3044692 - RNA, 18 nt, Human
gaaugucaguauguggaa

SEQ ID NO: 3044693 - RNA, 16 nt, Human
gaaugucaguaugugg

SEQ ID NO: 3044694 - RNA, 21 nt, Human
gagucccugccuggaccagcc

SEQ ID NO: 3044695 - RNA, 23 nt, Human
gagucccugccuggaccagccuc

SEQ ID NO: 3044696 - RNA, 22 nt, Human
gaguaauccaagcaaaugugaa

SEQ ID NO: 3044697 - RNA, 15 nt, Human
gauauaagugugugu

SEQ ID NO: 3044698 - RNA, 14 nt, Human
gauagaugugugga

SEQ ID NO: 3044699 - RNA, 22 nt, Human
gauagauguguggacacauugg

SEQ ID NO: 3044700 - RNA, 13 nt, Human
gaguguguaauuu

SEQ ID NO: 3044701 - RNA, 18 nt, Human
gaguguacuuaacuauuc

SEQ ID NO: 3044702 - RNA, 14 nt, Human
gaggcagggaagga

SEQ ID NO: 3044703 - RNA, 21 nt, Human
gaggcgaagcguuguccucag

SEQ ID NO: 3044704 - RNA, 21 nt, Human
gaggcgcaugaauuugugaag

SEQ ID NO: 3044705 - RNA, 20 nt, Human
gaggcgaagcguuguccuca

SEQ ID NO: 3044706 - RNA, 22 nt, Human
gaggccucucauuccagaggaa

SEQ ID NO: 3044707 - RNA, 13 nt, Human
gaggguguccugc

SEQ ID NO: 3044708 - RNA, 21 nt, Human
gagguagcuuugagguggaag

SEQ ID NO: 3044709 - RNA, 23 nt, Human
gagggucuugguuccagccugcc

SEQ ID NO: 3044710 - RNA, 14 nt, Human
gagggggagagggc

SEQ ID NO: 3044711 - RNA, 23 nt, Human
gcacuggggcaggggccgggggc

SEQ ID NO: 3044712 - RNA, 15 nt, Human
gcacuggggcagggg

SEQ ID NO: 3044713 - RNA, 18 nt, Human
gcacuggggcaggggccg

SEQ ID NO: 3044714 - RNA, 22 nt, Human
gcaccccagcuggggccaggcu

SEQ ID NO: 3044715 - RNA, 23 nt, Human
gcacaaauucugucucuggauua

SEQ ID NO: 3044716 - RNA, 14 nt, Human
gcaauuucauaugc

SEQ ID NO: 3044717 - RNA, 22 nt, Human
gcaauguagaggggaaaagaga

SEQ ID NO: 3044718 - RNA, 21 nt, Human
gaugggucaguuguaucagca

SEQ ID NO: 3044719 - RNA, 15 nt, Human
gaugggucaguugua

SEQ ID NO: 3044720 - RNA, 24 nt, Human
gaugguguucaaaaaacuuguaaa

SEQ ID NO: 3044721 - RNA, 16 nt, Human
gauguuuaguaaucau

SEQ ID NO: 3044722 - RNA, 21 nt, Human
gcaaagcugaugacaacuucc

SEQ ID NO: 3044723 - RNA, 23 nt, Human
gcaaaugugaaucauuuuaccuu

SEQ ID NO: 3044724 - RNA, 17 nt, Human
gauugggccccugccag

SEQ ID NO: 3044725 - RNA, 23 nt, Human
gauugcaggagucccugccauca

SEQ ID NO: 3044726 - RNA, 22 nt, Human
gcuuuguggcacuggggcaggg

SEQ ID NO: 3044727 - RNA, 14 nt, Human
gcuuuguggcacug

SEQ ID NO: 3044728 - RNA, 20 nt, Human
ggaaaagccaagaggcugca

SEQ ID NO: 3044729 - RNA, 21 nt, Human
ggaaccaaagcgaauuuuaaa

SEQ ID NO: 3044730 - RNA, 22 nt, Human
ggaaccaaagcgaauuuuaaaa

SEQ ID NO: 3044731 - RNA, 22 nt, Human
gcuucauacagggaugguguuc

SEQ ID NO: 3044732 - RNA, 11 nt, Human
gcuucauacag

SEQ ID NO: 3044733 - RNA, 22 nt, Human
ggaaggaucccaugagcuccuu

SEQ ID NO: 3044734 - RNA, 23 nt, Human
ggaagggacaccaagccuuggcu

SEQ ID NO: 3044735 - RNA, 18 nt, Human
ggaagugcuaauuuugaa

SEQ ID NO: 3044736 - RNA, 15 nt, Human
ggaauuauuuuaaaa

SEQ ID NO: 3044737 - RNA, 14 nt, Human
ggaauuauuuuaaa

SEQ ID NO: 3044738 - RNA, 17 nt, Human
ggaauuauuuuaaaaga

SEQ ID NO: 3044739 - RNA, 16 nt, Human
ggaauuauuuuaaaag

SEQ ID NO: 3044740 - RNA, 14 nt, Human
ggaaugcuguguua

SEQ ID NO: 3044741 - RNA, 19 nt, Human
ggaauuuucaucuaggauu

SEQ ID NO: 3044742 - RNA, 23 nt, Human
ggaauuggguggggggcuucaua

SEQ ID NO: 3044743 - RNA, 12 nt, Human
ggaauuguguuu

SEQ ID NO: 3044744 - RNA, 17 nt, Human
ggacugugugcucagga

SEQ ID NO: 3044745 - RNA, 22 nt, Human
ggagaaugucaguauguggaag

SEQ ID NO: 3044746 - RNA, 21 nt, Human
ggagauagccccacaggaggu

SEQ ID NO: 3044747 - RNA, 20 nt, Human
ggagauagccccacaggagg

SEQ ID NO: 3044748 - RNA, 20 nt, Human
ggccauucuuucccaacacc

SEQ ID NO: 3044749 - RNA, 12 nt, Human
ggcagcucagcu

SEQ ID NO: 3044750 - RNA, 19 nt, Human
ggcaaucauggugcucaga

SEQ ID NO: 3044751 - RNA, 17 nt, Human
ggauugggccccugcca

SEQ ID NO: 3044752 - RNA, 18 nt, Human
ggauugggccccugccag

SEQ ID NO: 3044753 - RNA, 17 nt, Human
ggauggaaugauggguc

SEQ ID NO: 3044754 - RNA, 16 nt, Human
ggaugcauggagauag

SEQ ID NO: 3044755 - RNA, 22 nt, Human
ggccuaaccugccgagagucca

SEQ ID NO: 3044756 - RNA, 12 nt, Human
ggcccugugccu

SEQ ID NO: 3044757 - RNA, 16 nt, Human
ggcuaggguggggaga

SEQ ID NO: 3044758 - RNA, 21 nt, Human
ggcuauggggauagaugugug

SEQ ID NO: 3044759 - RNA, 16 nt, Human
ggcuccaggccagggg

SEQ ID NO: 3044760 - RNA, 14 nt, Human
ggcuccaggccagg

SEQ ID NO: 3044761 - RNA, 18 nt, Human
ggcuccaggccagggggc

SEQ ID NO: 3044762 - RNA, 16 nt, Human
ggcgcggcugggagga

SEQ ID NO: 3044763 - RNA, 13 nt, Human
ggccugggcagga

SEQ ID NO: 3044764 - RNA, 14 nt, Human
ggccugggcaggag

SEQ ID NO: 3044765 - RNA, 11 nt, Human
ggccugugagc

SEQ ID NO: 3044766 - RNA, 23 nt, Human
gcccuggugguggcucgggaggc

SEQ ID NO: 3044767 - RNA, 13 nt, Human
gcccugggaggcu

SEQ ID NO: 3044768 - RNA, 14 nt, Human
gcccugggaggcuc

SEQ ID NO: 3044769 - RNA, 15 nt, Human
gcccugggaggcucu

SEQ ID NO: 3044770 - RNA, 16 nt, Human
gcccugggaggcucug

SEQ ID NO: 3044771 - RNA, 23 nt, Human
gcccugggaggcucuggagccca

SEQ ID NO: 3044772 - RNA, 17 nt, Human
gcccugggaggcucugg

SEQ ID NO: 3044773 - RNA, 18 nt, Human
gcccugggaggcucugga

SEQ ID NO: 3044774 - RNA, 19 nt, Human
gcccugggaggcucuggag

SEQ ID NO: 3044775 - RNA, 21 nt, Human
gcccugggaggcucuggagcc

SEQ ID NO: 3044776 - RNA, 12 nt, Human
gcccuggacugu

SEQ ID NO: 3044777 - RNA, 16 nt, Human
gcccuggacugugugc

SEQ ID NO: 3044778 - RNA, 22 nt, Human
gcccuggacugugugcucagga

SEQ ID NO: 3044779 - RNA, 18 nt, Human
gcccugaguuccuagcca

SEQ ID NO: 3044780 - RNA, 16 nt, Human
gcccugaguuccuagc

SEQ ID NO: 3044781 - RNA, 15 nt, Human
gccugcagagcugcg

SEQ ID NO: 3044782 - RNA, 12 nt, Human
gccugcagagcu

SEQ ID NO: 3044783 - RNA, 18 nt, Human
gccugcuuuuuauggccu

SEQ ID NO: 3044784 - RNA, 19 nt, Human
gccugcuuuuuauggccug

SEQ ID NO: 3044785 - RNA, 22 nt, Human
gccugcuuuuuauggccuguga

SEQ ID NO: 3044786 - RNA, 23 nt, Human
gccucucugcaggucccuaauaa

SEQ ID NO: 3044787 - RNA, 18 nt, Human
gccucucugcaggucccu

SEQ ID NO: 3044788 - RNA, 20 nt, Human
gccucucugcaggucccuaa

SEQ ID NO: 3044789 - RNA, 21 nt, Human
gccucucugcaggucccuaau

SEQ ID NO: 3044790 - RNA, 23 nt, Human
gccuggccagcagguccccagcu

SEQ ID NO: 3044791 - RNA, 19 nt, Human
gccucucugcaggucccua

SEQ ID NO: 3044792 - RNA, 21 nt, Human
gcucagaggguguccugcacc

SEQ ID NO: 3044793 - RNA, 17 nt, Human
gcuaugagcuggggaug

SEQ ID NO: 3044794 - RNA, 22 nt, Human
gcucagugucuggcugcagagc

SEQ ID NO: 3044795 - RNA, 23 nt, Human
gccugugagcuaggaauuguguu

SEQ ID NO: 3044796 - RNA, 14 nt, Human
gcucuugaugccug

SEQ ID NO: 3044797 - RNA, 15 nt, Human
gcucuugaugccugg

SEQ ID NO: 3044798 - RNA, 16 nt, Human
gcucuugaugccuggc

SEQ ID NO: 3044799 - RNA, 17 nt, Human
gcucuugaugccuggcg

SEQ ID NO: 3044800 - RNA, 14 nt, Human
gggcgcggcuggga

SEQ ID NO: 3044801 - RNA, 18 nt, Human
ggggaguuuagggugggg

SEQ ID NO: 3044802 - RNA, 13 nt, Human
ggggauagaugug

SEQ ID NO: 3044803 - RNA, 13 nt, Human
gggcuucauacac

SEQ ID NO: 3044804 - RNA, 19 nt, Human
gggcuucauacacaugaga

SEQ ID NO: 3044805 - RNA, 20 nt, Human
ggugcccagaaugaggcugc

SEQ ID NO: 3044806 - RNA, 18 nt, Human
ggucccuaauaaagcugu

SEQ ID NO: 3044807 - RNA, 12 nt, Human
ggucccuaauaa

SEQ ID NO: 3044808 - RNA, 13 nt, Human
ggucccuaauaaa

SEQ ID NO: 3044809 - RNA, 16 nt, Human
ggucccuaauaaagcu

SEQ ID NO: 3044810 - RNA, 17 nt, Human
ggucccuaauaaagcug

SEQ ID NO: 3044811 - RNA, 18 nt, Human
gggugcugggccccugcc

SEQ ID NO: 3044812 - RNA, 19 nt, Human
gggugcugggccccugccu

SEQ ID NO: 3044813 - RNA, 19 nt, Human
ggguuccagcaccacacuc

SEQ ID NO: 3044814 - RNA, 23 nt, Human
ggucagcccaaaccaccagaagc

SEQ ID NO: 3044815 - RNA, 16 nt, Human
guaaauaaaggaacca

SEQ ID NO: 3044816 - RNA, 16 nt, Human
guaaauaguauuugag

SEQ ID NO: 3044817 - RNA, 17 nt, Human
guaaauaguauuugaga

SEQ ID NO: 3044818 - RNA, 15 nt, Human
guaaauaguauuuga

SEQ ID NO: 3044819 - RNA, 20 nt, Human
guaaaaacaaagaaauuaug

SEQ ID NO: 3044820 - RNA, 18 nt, Human
guaaaaacaaagaaauua

SEQ ID NO: 3044821 - RNA, 14 nt, Human
guacuugcucuuga

SEQ ID NO: 3044822 - RNA, 22 nt, Human
guacuugcucuugaugccuggc

SEQ ID NO: 3044823 - RNA, 15 nt, Human
guacuugcucuugau

SEQ ID NO: 3044824 - RNA, 16 nt, Human
guacuugcucuugaug

SEQ ID NO: 3044825 - RNA, 18 nt, Human
guacuugcucuugaugcc

SEQ ID NO: 3044826 - RNA, 19 nt, Human
guacuugcucuugaugccu

SEQ ID NO: 3044827 - RNA, 23 nt, Human
guacuuuauuuucuauaauuuaa

SEQ ID NO: 3044828 - RNA, 15 nt, Human
guacgaagaguauuu

SEQ ID NO: 3044829 - RNA, 13 nt, Human
guaauucaagaaa

SEQ ID NO: 3044830 - RNA, 14 nt, Human
guaauucaagaaaa

SEQ ID NO: 3044831 - RNA, 16 nt, Human
guaaugaaacuuggau

SEQ ID NO: 3044832 - RNA, 15 nt, Human
guaaugaaacuugga

SEQ ID NO: 3044833 - RNA, 11 nt, Human
guaaugaaaac

SEQ ID NO: 3044834 - RNA, 13 nt, Human
guaaugaaaacca

SEQ ID NO: 3044835 - RNA, 15 nt, Human
guacagacagaaaaa

SEQ ID NO: 3044836 - RNA, 14 nt, Human
gucacgccagacuu

SEQ ID NO: 3044837 - RNA, 22 nt, Human
gucagcccaaaccaccagaagc

SEQ ID NO: 3044838 - RNA, 23 nt, Human
gucagcccaaaccaccagaagcc

SEQ ID NO: 3044839 - RNA, 20 nt, Human
gucccagaaugccuccugca

SEQ ID NO: 3044840 - RNA, 15 nt, Human
guauuauguguguuu

SEQ ID NO: 3044841 - RNA, 19 nt, Human
guauuugagaguucuaaau

SEQ ID NO: 3044842 - RNA, 21 nt, Human
guauuugagaguucuaaauuu

SEQ ID NO: 3044843 - RNA, 22 nt, Human
gucccugccuggaccagccucu

SEQ ID NO: 3044844 - RNA, 23 nt, Human
gucccugccuggaccagccucuc

SEQ ID NO: 3044845 - RNA, 20 nt, Human
gucccugccuggaccagccu

SEQ ID NO: 3044846 - RNA, 21 nt, Human
gucccugccuggaccagccuc

SEQ ID NO: 3044847 - RNA, 14 nt, Human
gucccugccuggac

SEQ ID NO: 3044848 - RNA, 12 nt, Human
guccucagcccc

SEQ ID NO: 3044849 - RNA, 13 nt, Human
guccucacacuca

SEQ ID NO: 3044850 - RNA, 23 nt, Human
gucuaagauaguaacaaugaaga

SEQ ID NO: 3044851 - RNA, 21 nt, Human
gugcuucuaguucugccagga

SEQ ID NO: 3044852 - RNA, 22 nt, Human
gugcuucuaguucugccaggag

SEQ ID NO: 3044853 - RNA, 20 nt, Human
gugcuucuaguucugccagg

SEQ ID NO: 3044854 - RNA, 23 nt, Human
guggaaaagccaagaggcugcag

SEQ ID NO: 3044855 - RNA, 19 nt, Human
gugccuugucacgccagac

SEQ ID NO: 3044856 - RNA, 16 nt, Human
guggcucgggaggcga

SEQ ID NO: 3044857 - RNA, 18 nt, Human
guggcucgggaggcgaag

SEQ ID NO: 3044858 - RNA, 14 nt, Human
guggcauccagagu

SEQ ID NO: 3044859 - RNA, 15 nt, Human
guggcaguuuggcaa

SEQ ID NO: 3044860 - RNA, 11 nt, Human
guggcagucug

SEQ ID NO: 3044861 - RNA, 12 nt, Human
gugacucuuucc

SEQ ID NO: 3044862 - RNA, 20 nt, Human
gugaccuuccaagagccuga

SEQ ID NO: 3044863 - RNA, 19 nt, Human
gugaccuuccaagagccug

SEQ ID NO: 3044864 - RNA, 14 nt, Human
gugagcuacaaaug

SEQ ID NO: 3044865 - RNA, 19 nt, Human
gugaaagaaaauaacaaua

SEQ ID NO: 3044866 - RNA, 15 nt, Human
gugaaaauuauuuug

SEQ ID NO: 3044867 - RNA, 12 nt, Human
gugaaaauuauu

SEQ ID NO: 3044868 - RNA, 17 nt, Human
gugaaaguacauuugga

SEQ ID NO: 3044869 - RNA, 13 nt, Human
gugaaaucauuca

SEQ ID NO: 3044870 - RNA, 18 nt, Human
gugaaauuauucauaauu

SEQ ID NO: 3044871 - RNA, 20 nt, Human
gugaaauuauucauaauuau

SEQ ID NO: 3044872 - RNA, 17 nt, Human
gugauuuuuaugccacc

SEQ ID NO: 3044873 - RNA, 19 nt, Human
gugauuuuuaugccaccug

SEQ ID NO: 3044874 - RNA, 20 nt, Human
gugauuuuuaugccaccuga

SEQ ID NO: 3044875 - RNA, 16 nt, Human
gugauuuuuaugccac

SEQ ID NO: 3044876 - RNA, 15 nt, Human
gugaggaugucuggg

SEQ ID NO: 3044877 - RNA, 23 nt, Human
uccugucucccuccucugcccgg

SEQ ID NO: 3044878 - RNA, 15 nt, Human
uccugucucccuccu

SEQ ID NO: 3044879 - RNA, 13 nt, Human
uccuacccccugu

SEQ ID NO: 3044880 - RNA, 15 nt, Human
uccuacccccugugc

SEQ ID NO: 3044881 - RNA, 16 nt, Human
uccuacccccugugcc

SEQ ID NO: 3044882 - RNA, 17 nt, Human
uccuacccccugugccu

SEQ ID NO: 3044883 - RNA, 18 nt, Human
ucucccuccucugcccgg

SEQ ID NO: 3044884 - RNA, 19 nt, Human
ucuacugggagccuaccca

SEQ ID NO: 3044885 - RNA, 16 nt, Human
ucuacugggagccuac

SEQ ID NO: 3044886 - RNA, 12 nt, Human
ucaucuuucuuc

SEQ ID NO: 3044887 - RNA, 16 nt, Human
ucaucuccccaucauu

SEQ ID NO: 3044888 - RNA, 14 nt, Human
uccaaacaggcuca

SEQ ID NO: 3044889 - RNA, 16 nt, Human
uccaaaccaaauaaaa

SEQ ID NO: 3044890 - RNA, 22 nt, Human
uccaaaaagauuuucagaaaau

SEQ ID NO: 3044891 - RNA, 14 nt, Human
ucauggugcucaga

SEQ ID NO: 3044892 - RNA, 11 nt, Human
ucaggagcccu

SEQ ID NO: 3044893 - RNA, 12 nt, Human
ucaggagcccug

SEQ ID NO: 3044894 - RNA, 14 nt, Human
ucaggagcccuggg

SEQ ID NO: 3044895 - RNA, 15 nt, Human
ucaggagcccuggga

SEQ ID NO: 3044896 - RNA, 22 nt, Human
ucagucuuuaaucugagaggcc

SEQ ID NO: 3044897 - RNA, 18 nt, Human
uccagagucccugccugg

SEQ ID NO: 3044898 - RNA, 19 nt, Human
uccagagucccugccugga

SEQ ID NO: 3044899 - RNA, 20 nt, Human
uccagagucccugccuggac

SEQ ID NO: 3044900 - RNA, 21 nt, Human
uccagagucccugccuggacc

SEQ ID NO: 3044901 - RNA, 23 nt, Human
uccagaaagaaaacuuguauuau

SEQ ID NO: 3044902 - RNA, 14 nt, Human
uccagcaccacacu

SEQ ID NO: 3044903 - RNA, 20 nt, Human
uccaugggccauaugaaaag

SEQ ID NO: 3044904 - RNA, 15 nt, Human
uaggcuagggugggg

SEQ ID NO: 3044905 - RNA, 16 nt, Human
uaggcuagggugggga

SEQ ID NO: 3044906 - RNA, 16 nt, Human
uaggucagugcaaaua

SEQ ID NO: 3044907 - RNA, 16 nt, Human
uagguaaauuacaguu

SEQ ID NO: 3044908 - RNA, 16 nt, Human
uaggaauuguguuuau

SEQ ID NO: 3044909 - RNA, 23 nt, Human
uaguaugaaauuauauaaguauu

SEQ ID NO: 3044910 - RNA, 15 nt, Human
uaguaugaaauuaua

SEQ ID NO: 3044911 - RNA, 13 nt, Human
uaguaugaaauua

SEQ ID NO: 3044912 - RNA, 20 nt, Human
uaguugcaacuuuguauaaa

SEQ ID NO: 3044913 - RNA, 15 nt, Human
uauaauucacauugu

SEQ ID NO: 3044914 - RNA, 15 nt, Human
uaucguaaaauuaag

SEQ ID NO: 3044915 - RNA, 18 nt, Human
uaucguaaaauuaagaaa

SEQ ID NO: 3044916 - RNA, 17 nt, Human
uauccuuucuaacaaaa

SEQ ID NO: 3044917 - RNA, 23 nt, Human
uaugacauaaaaacaacuuuaua

SEQ ID NO: 3044918 - RNA, 22 nt, Human
uaugacauaaaaacaacuuuau

SEQ ID NO: 3044919 - RNA, 19 nt, Human
uaugacauaaaaacaacuu

SEQ ID NO: 3044920 - RNA, 16 nt, Human
uaucuguuuacagugu

SEQ ID NO: 3044921 - RNA, 17 nt, Human
uaucuguuuacaguguu

SEQ ID NO: 3044922 - RNA, 20 nt, Human
uaugaaguuuuuuuuauaca

SEQ ID NO: 3044923 - RNA, 17 nt, Human
uaugcuucauacaggga

SEQ ID NO: 3044924 - RNA, 16 nt, Human
uaugcuucauacaggg

SEQ ID NO: 3044925 - RNA, 14 nt, Human
uaugcuucauacag

SEQ ID NO: 3044926 - RNA, 13 nt, Human
uaugcuucauaca

SEQ ID NO: 3044927 - RNA, 12 nt, Human
uaugcuucauac

SEQ ID NO: 3044928 - RNA, 20 nt, Human
uaugcauauuauuuuauguu

SEQ ID NO: 3044929 - RNA, 23 nt, Human
uaugagcuggggaugucucucau

SEQ ID NO: 3044930 - RNA, 12 nt, Human
ucacauuuaaau

SEQ ID NO: 3044931 - RNA, 22 nt, Human
ucacauuguauucagaguugau

SEQ ID NO: 3044932 - RNA, 20 nt, Human
ucaaagagagaaaauaaaga

SEQ ID NO: 3044933 - RNA, 15 nt, Human
ucaaagagagaaaau

SEQ ID NO: 3044934 - RNA, 23 nt, Human
uauuugaauguaugcuucauaca

SEQ ID NO: 3044935 - RNA, 22 nt, Human
uauuugaauguaugcuucauac

SEQ ID NO: 3044936 - RNA, 21 nt, Human
uauuugaauguaugcuucaua

SEQ ID NO: 3044937 - RNA, 23 nt, Human
uauugauaaguucauacauugua

SEQ ID NO: 3044938 - RNA, 16 nt, Human
uauugauaaguucaua

SEQ ID NO: 3044939 - RNA, 14 nt, Human
uauugauaaguuca

SEQ ID NO: 3044940 - RNA, 17 nt, Human
uauuauauuuacaaaug

SEQ ID NO: 3044941 - RNA, 12 nt, Human
uauuauguguuu

SEQ ID NO: 3044942 - RNA, 20 nt, Human
uauuauggaggcaggaguuu

SEQ ID NO: 3044943 - RNA, 13 nt, Human
uauguguguuuua

SEQ ID NO: 3044944 - RNA, 14 nt, Human
uauggaggcaggag

SEQ ID NO: 3044945 - RNA, 19 nt, Human
ugagcuccuuaaggcucuu

SEQ ID NO: 3044946 - RNA, 21 nt, Human
ugagcuccuuaaggcucuuuu

SEQ ID NO: 3044947 - RNA, 17 nt, Human
ugagaaauuuauaaacu

SEQ ID NO: 3044948 - RNA, 23 nt, Human
ugagacguuuuuggaagaguagu

SEQ ID NO: 3044949 - RNA, 14 nt, Human
ugaggugggagaug

SEQ ID NO: 3044950 - RNA, 20 nt, Human
ugagcuggggaugucucuca

SEQ ID NO: 3044951 - RNA, 16 nt, Human
ugaggagcuugaaacc

SEQ ID NO: 3044952 - RNA, 17 nt, Human
ugaggcagguccccaga

SEQ ID NO: 3044953 - RNA, 16 nt, Human
ugaggcagguccccag

SEQ ID NO: 3044954 - RNA, 14 nt, Human
ugaggcaggucccc

SEQ ID NO: 3044955 - RNA, 22 nt, Human
ugaguucuacauaaguaauuca

SEQ ID NO: 3044956 - RNA, 13 nt, Human
ugaugguuguaca

SEQ ID NO: 3044957 - RNA, 14 nt, Human
ugaugguuguacau

SEQ ID NO: 3044958 - RNA, 14 nt, Human
ugauguguuuauuu

SEQ ID NO: 3044959 - RNA, 18 nt, Human
ugauguguuuauuuauag

SEQ ID NO: 3044960 - RNA, 23 nt, Human
ugaugcuacaggauuugaaauug

SEQ ID NO: 3044961 - RNA, 20 nt, Human
ugaugcuacaggauuugaaa

SEQ ID NO: 3044962 - RNA, 11 nt, Human
ugaugccuggc

SEQ ID NO: 3044963 - RNA, 13 nt, Human
ugauuauauguca

SEQ ID NO: 3044964 - RNA, 19 nt, Human
ugaaauggacuuuuguaca

SEQ ID NO: 3044965 - RNA, 12 nt, Human
ugaaauuauuca

SEQ ID NO: 3044966 - RNA, 15 nt, Human
ugaacagcggcugga

SEQ ID NO: 3044967 - RNA, 22 nt, Human
ugaacagcggcuggacuuggag

SEQ ID NO: 3044968 - RNA, 21 nt, Human
ugaacagcggcuggacuugga

SEQ ID NO: 3044969 - RNA, 22 nt, Human
ucuuuccacuccuccuagccac

SEQ ID NO: 3044970 - RNA, 21 nt, Human
ucuuuccacuccuccuagcca

SEQ ID NO: 3044971 - RNA, 12 nt, Human
ucuuugccaagu

SEQ ID NO: 3044972 - RNA, 17 nt, Human
ucuuucacauuuaaaua

SEQ ID NO: 3044973 - RNA, 22 nt, Human
ugaaucauuuuaccuuugacaa

SEQ ID NO: 3044974 - RNA, 23 nt, Human
ugaaucauuuuaccuuugacaaa

SEQ ID NO: 3044975 - RNA, 16 nt, Human
ugaauuauuuucucuc

SEQ ID NO: 3044976 - RNA, 16 nt, Human
ugacagaauauguuuc

SEQ ID NO: 3044977 - RNA, 17 nt, Human
ugacauacauccaacau

SEQ ID NO: 3044978 - RNA, 23 nt, Human
ugacauaaguauuuaauucaugu

SEQ ID NO: 3044979 - RNA, 15 nt, Human
uggaccagccucucc

SEQ ID NO: 3044980 - RNA, 19 nt, Human
uggaucugugaggggcucu

SEQ ID NO: 3044981 - RNA, 19 nt, Human
uggcaaacucuccaccaca

SEQ ID NO: 3044982 - RNA, 15 nt, Human
uggaucugugagggg

SEQ ID NO: 3044983 - RNA, 20 nt, Human
uggcuccauugguguugaca

SEQ ID NO: 3044984 - RNA, 15 nt, Human
uggcgggguggggug

SEQ ID NO: 3044985 - RNA, 20 nt, Human
uggggaguuuaggguggggg

SEQ ID NO: 3044986 - RNA, 20 nt, Human
uggggauagauguguggaca

SEQ ID NO: 3044987 - RNA, 18 nt, Human
uggggauagaugugugga

SEQ ID NO: 3044988 - RNA, 17 nt, Human
uggggauagaugugugg

SEQ ID NO: 3044989 - RNA, 16 nt, Human
uggggauagaugugug

SEQ ID NO: 3044990 - RNA, 21 nt, Human
uggggccaggcugggucgccc

SEQ ID NO: 3044991 - RNA, 22 nt, Human
uggggccaggcugggucgcccu

SEQ ID NO: 3044992 - RNA, 20 nt, Human
uggggccaggcugggucgcc

SEQ ID NO: 3044993 - RNA, 13 nt, Human
uggggggggugcu

SEQ ID NO: 3044994 - RNA, 14 nt, Human
ugggggucugugug

SEQ ID NO: 3044995 - RNA, 15 nt, Human
ugggcaggagggagg

SEQ ID NO: 3044996 - RNA, 16 nt, Human
ugggcaggagggaggu

SEQ ID NO: 3044997 - RNA, 18 nt, Human
ugggcaggagggaggugc

SEQ ID NO: 3044998 - RNA, 13 nt, Human
ugggcaggaggga

SEQ ID NO: 3044999 - RNA, 20 nt, Human
ugggccccugccucucugca

SEQ ID NO: 3045000 - RNA, 21 nt, Human
ugggccccugccucucugcag

SEQ ID NO: 3045001 - RNA, 23 nt, Human
ugggccccugccucucugcaggu

SEQ ID NO: 3045002 - RNA, 22 nt, Human
ugggagugaggaugucugggcc

SEQ ID NO: 3045003 - RNA, 13 nt, Human
ugggaguguguaa

SEQ ID NO: 3045004 - RNA, 11 nt, Human
ugggagugugu

SEQ ID NO: 3045005 - RNA, 14 nt, Human
ugguccucacacuc

SEQ ID NO: 3045006 - RNA, 22 nt, Human
uggugaccuuccaagagccuga

SEQ ID NO: 3045007 - RNA, 21 nt, Human
uggugaccuuccaagagccug

SEQ ID NO: 3045008 - RNA, 16 nt, Human
ugcuguuaucccugcc

SEQ ID NO: 3045009 - RNA, 11 nt, Human
ugcuguguuaa

SEQ ID NO: 3045010 - RNA, 18 nt, Human
ugcuguguuaaauaaacc

SEQ ID NO: 3045011 - RNA, 13 nt, Human
ugcugguuuuagu

SEQ ID NO: 3045012 - RNA, 14 nt, Human
ugcugggccccugc

SEQ ID NO: 3045013 - RNA, 16 nt, Human
ugcugggccccugccu

SEQ ID NO: 3045014 - RNA, 17 nt, Human
ugcugggccccugccuc

SEQ ID NO: 3045015 - RNA, 18 nt, Human
ugcugggccccugccucu

SEQ ID NO: 3045016 - RNA, 19 nt, Human
ugcugggccccugccucuc

SEQ ID NO: 3045017 - RNA, 21 nt, Human
ugcugggccccugccucucug

SEQ ID NO: 3045018 - RNA, 22 nt, Human
ugcugggccccugccucucugc

SEQ ID NO: 3045019 - RNA, 23 nt, Human
ugcugggccccugccucucugca

SEQ ID NO: 3045020 - RNA, 24 nt, Human
ugcugggccccugccucucugcag

SEQ ID NO: 3045021 - RNA, 15 nt, Human
ugcugccugcuuuuu

SEQ ID NO: 3045022 - RNA, 17 nt, Human
ugcugccugcuuuuuau

SEQ ID NO: 3045023 - RNA, 22 nt, Human
ugcuaagaauauuugaauguau

SEQ ID NO: 3045024 - RNA, 21 nt, Human
ugcuaagaauauuugaaugua

SEQ ID NO: 3045025 - RNA, 17 nt, Human
ugcuaagaauauuugaa

SEQ ID NO: 3045026 - RNA, 20 nt, Human
ugccuugcauaauggucaga

SEQ ID NO: 3045027 - RNA, 15 nt, Human
ugcucaggagcccug

SEQ ID NO: 3045028 - RNA, 19 nt, Human
ugcucagugucuggcugca

SEQ ID NO: 3045029 - RNA, 20 nt, Human
ugcucaggagcccugggagg

SEQ ID NO: 3045030 - RNA, 18 nt, Human
ugcucaggagcccuggga

SEQ ID NO: 3045031 - RNA, 19 nt, Human
ugcucaggagcccugggag

SEQ ID NO: 3045032 - RNA, 17 nt, Human
ugcucuugaugccuggc

SEQ ID NO: 3045033 - RNA, 19 nt, Human
ugcccagaaugaggcugcu

SEQ ID NO: 3045034 - RNA, 16 nt, Human
ugcauagguuuagcag

SEQ ID NO: 3045035 - RNA, 18 nt, Human
ugcauauuauuuuauguu

SEQ ID NO: 3045036 - RNA, 13 nt, Human
uuaugccaccuga

SEQ ID NO: 3045037 - RNA, 16 nt, Human
uuaugccaccugaaua

SEQ ID NO: 3045038 - RNA, 20 nt, Human
uuaucuugaauaauguaaga

SEQ ID NO: 3045039 - RNA, 20 nt, Human
uuaguugcaacuuuguauaa

SEQ ID NO: 3045040 - RNA, 13 nt, Human
uuaguugcaacuu

SEQ ID NO: 3045041 - RNA, 20 nt, Human
uuauugauaaguucauacau

SEQ ID NO: 3045042 - RNA, 19 nt, Human
uuauugauaaguucauaca

SEQ ID NO: 3045043 - RNA, 15 nt, Human
uuauugauaaguuca

SEQ ID NO: 3045044 - RNA, 21 nt, Human
uucagaguugaugguuguaca

SEQ ID NO: 3045045 - RNA, 22 nt, Human
uucagaguugaugguuguacau

SEQ ID NO: 3045046 - RNA, 20 nt, Human
uuauuuuauguugcauagaa

SEQ ID NO: 3045047 - RNA, 12 nt, Human
uuccaaaauaau

SEQ ID NO: 3045048 - RNA, 19 nt, Human
uucaugcauagguuuagca

SEQ ID NO: 3045049 - RNA, 17 nt, Human
uucaugcaaacuuuauu

SEQ ID NO: 3045050 - RNA, 13 nt, Human
uuccaaaauaauu

SEQ ID NO: 3045051 - RNA, 21 nt, Human
uuccaaaauaauuuuaagaaa

SEQ ID NO: 3045052 - RNA, 21 nt, Human
uuccacuccuccuagccaccc

SEQ ID NO: 3045053 - RNA, 18 nt, Human
uuccacuccuccuagcca

SEQ ID NO: 3045054 - RNA, 16 nt, Human
uuccacuccuccuagc

SEQ ID NO: 3045055 - RNA, 16 nt, Human
uucccugaaggaacca

SEQ ID NO: 3045056 - RNA, 12 nt, Human
uucccugaggug

SEQ ID NO: 3045057 - RNA, 21 nt, Human
uuacuaggugcccagaaugag

SEQ ID NO: 3045058 - RNA, 19 nt, Human
uuacugucuuuuuucuaaa

SEQ ID NO: 3045059 - RNA, 17 nt, Human
uuacugucuuuuuucua

SEQ ID NO: 3045060 - RNA, 14 nt, Human
uuaguguucauaaa

SEQ ID NO: 3045061 - RNA, 14 nt, Human
uuaauauauuucca

SEQ ID NO: 3045062 - RNA, 13 nt, Human
uuaauauauuucc

SEQ ID NO: 3045063 - RNA, 17 nt, Human
uuaaugauaaguaaaug

SEQ ID NO: 3045064 - RNA, 21 nt, Human
uuaaugauaaguaaaugcuag

SEQ ID NO: 3045065 - RNA, 21 nt, Human
uuaagcagauggaaugcugug

SEQ ID NO: 3045066 - RNA, 12 nt, Human
uuaacucagucu

SEQ ID NO: 3045067 - RNA, 21 nt, Human
uuaaauguuuuuuuuuaaaga

SEQ ID NO: 3045068 - RNA, 23 nt, Human
uuaaauguuuuuuuuuaaagacu

SEQ ID NO: 3045069 - RNA, 19 nt, Human
uguuuagaagaaguguguc

SEQ ID NO: 3045070 - RNA, 16 nt, Human
uguuuagaagaagugu

SEQ ID NO: 3045071 - RNA, 18 nt, Human
uguuuuuuuuuaaagacu

SEQ ID NO: 3045072 - RNA, 21 nt, Human
uuaaaagaugcaauguagagg

SEQ ID NO: 3045073 - RNA, 14 nt, Human
uuuaugccaccuga

SEQ ID NO: 3045074 - RNA, 21 nt, Human
uuucacauaucuaguaugaaa

SEQ ID NO: 3045075 - RNA, 15 nt, Human
uuucacauaucuagu

SEQ ID NO: 3045076 - RNA, 20 nt, Human
uuuccuaaauauauuuuaag

SEQ ID NO: 3045077 - RNA, 19 nt, Human
uuuccacuccuccuagcca

SEQ ID NO: 3045078 - RNA, 18 nt, Human
uuuccacuccuccuagcc

SEQ ID NO: 3045079 - RNA, 22 nt, Human
uuucuaaaguaaaaacaaagaa

SEQ ID NO: 3045080 - RNA, 17 nt, Human
uuucuaaaguaaaaaca

SEQ ID NO: 3045081 - RNA, 14 nt, Human
uuucuaaaguaaaa

SEQ ID NO: 3045082 - RNA, 21 nt, Human
uuucuaacaaaaaaauauauu

SEQ ID NO: 3045083 - RNA, 18 nt, Human
uuucuuaaccagaucauu

SEQ ID NO: 3045084 - RNA, 21 nt, Human
uuugaaauuguauuacaaauc

SEQ ID NO: 3045085 - RNA, 14 nt, Human
uuugagaguucuaa

SEQ ID NO: 3045086 - RNA, 16 nt, Human
uuugagaguucuaaau

SEQ ID NO: 3045087 - RNA, 13 nt, Human
uuugaguucuaca

SEQ ID NO: 3045088 - RNA, 14 nt, Human
uuuaauaaacacuc

SEQ ID NO: 3045089 - RNA, 15 nt, Human
uuuaauaaacacucu

SEQ ID NO: 3045090 - RNA, 22 nt, Human
uuuaauaaacacucuugaaaaa

SEQ ID NO: 3045091 - RNA, 20 nt, Human
uuuacagaggacaguauuug

SEQ ID NO: 3045092 - RNA, 17 nt, Human
uuuaguugcaacuuugu

SEQ ID NO: 3045093 - RNA, 18 nt, Human
uuuaguugcaacuuugua

SEQ ID NO: 3045094 - RNA, 15 nt, Human
uuuauacaggucaua

SEQ ID NO: 3045095 - RNA, 19 nt, Human
uuguucaauaauaaauauu

SEQ ID NO: 3045096 - RNA, 18 nt, Human
uuguuuagaagaagugug

SEQ ID NO: 3045097 - RNA, 15 nt, Human
uuguuuagaagaagu

SEQ ID NO: 3045098 - RNA, 20 nt, Human
uuuaaaagauaaauauuaua

SEQ ID NO: 3045099 - RNA, 18 nt, Human
uuuaaaagaugcaaugua

SEQ ID NO: 3045100 - RNA, 16 nt, Human
uuuaaaauugugaugu

SEQ ID NO: 3045101 - RNA, 12 nt, Human
uuuaaaaugucu

SEQ ID NO: 3045102 - RNA, 16 nt, Human
uuuaaaaugagaaauc

SEQ ID NO: 3045103 - RNA, 14 nt, Human
uugaauguuaagca

SEQ ID NO: 3045104 - RNA, 17 nt, Human
uugaauguuaagcagau

SEQ ID NO: 3045105 - RNA, 21 nt, Human
uugaaaaucuuauaauuuaaa

SEQ ID NO: 3045106 - RNA, 18 nt, Human
uugaaaauuaacaugaau

SEQ ID NO: 3045107 - RNA, 17 nt, Human
uugauccagaaagaaaa

SEQ ID NO: 3045108 - RNA, 16 nt, Human
uugcauaacguauaaa

SEQ ID NO: 3045109 - RNA, 22 nt, Human
uuguagcacugacagauuucca

SEQ ID NO: 3045110 - RNA, 18 nt, Human
uuguagcacugacagauu

SEQ ID NO: 3045111 - RNA, 17 nt, Human
uuguagcacugacagau

SEQ ID NO: 3045112 - RNA, 16 nt, Human
uuguagcacugacaga

SEQ ID NO: 3045113 - RNA, 14 nt, Human
uuguagcacugaca

SEQ ID NO: 3045114 - RNA, 18 nt, Human
uuguacuuuagggaagua

SEQ ID NO: 3045115 - RNA, 19 nt, Human
uuguacgaagaguauuuuu

SEQ ID NO: 3045116 - RNA, 16 nt, Human
uuguacgaagaguauu

SEQ ID NO: 3045117 - RNA, 20 nt, Human
uugggaccccuggugguuca

SEQ ID NO: 3045118 - RNA, 16 nt, Human
uugggaccccuggugg

SEQ ID NO: 3045119 - RNA, 15 nt, Human
uugggaccccuggug

SEQ ID NO: 3045120 - RNA, 14 nt, Human
uugggaccccuggu

SEQ ID NO: 3045121 - RNA, 16 nt, Human
uuggcagcucuacucu

SEQ ID NO: 3045122 - RNA, 11 nt, Human
uuuguggggag

SEQ ID NO: 3045123 - RNA, 13 nt, Human
caaccggcuuugu

SEQ ID NO: 3045124 - RNA, 22 nt, Human
caaccggcuuuguggcacuggg

SEQ ID NO: 3045125 - RNA, 13 nt, Human
caacacugccagc

SEQ ID NO: 3045126 - RNA, 14 nt, Human
caacacugccagca

SEQ ID NO: 3045127 - RNA, 12 nt, Human
caacacugccag

SEQ ID NO: 3045128 - RNA, 15 nt, Human
caagaaaacaacuuc

SEQ ID NO: 3045129 - RNA, 16 nt, Human
caagaggcugcagcca

SEQ ID NO: 3045130 - RNA, 14 nt, Human
caagaggcugcagc

SEQ ID NO: 3045131 - RNA, 19 nt, Human
caauguagaggggaaaaga

SEQ ID NO: 3045132 - RNA, 16 nt, Human
caaaaauucucaguuc

SEQ ID NO: 3045133 - RNA, 21 nt, Human
caaauuguaagcaugcacaaa

SEQ ID NO: 3045134 - RNA, 17 nt, Human
caaauuguaagcaugca

SEQ ID NO: 3045135 - RNA, 22 nt, Human
caaaauugauguguuuauuuau

SEQ ID NO: 3045136 - RNA, 16 nt, Human
caaaauuguuacaaau

SEQ ID NO: 3045137 - RNA, 15 nt, Human
caaaauugauguguu

SEQ ID NO: 3045138 - RNA, 16 nt, Human
caaaauugauguguuu

SEQ ID NO: 3045139 - RNA, 20 nt, Human
caaagcgaauuuuaaaagau

SEQ ID NO: 3045140 - RNA, 19 nt, Human
caaagcugaugacaacuuc

SEQ ID NO: 3045141 - RNA, 19 nt, Human
caaagcgaauuuuaaaaga

SEQ ID NO: 3045142 - RNA, 14 nt, Human
caaagcgaauuuua

SEQ ID NO: 3045143 - RNA, 15 nt, Human
cuuccucuccugucu

SEQ ID NO: 3045144 - RNA, 19 nt, Human
cuuccucuccugucucccu

SEQ ID NO: 3045145 - RNA, 17 nt, Human
cuucuaccucuuggcug

SEQ ID NO: 3045146 - RNA, 20 nt, Human
cuugguuccagccugccacu

SEQ ID NO: 3045147 - RNA, 19 nt, Human
cuugguuccagccugccac

SEQ ID NO: 3045148 - RNA, 17 nt, Human
cuugguuccagccugcc

SEQ ID NO: 3045149 - RNA, 13 nt, Human
cuugaugccuggc

SEQ ID NO: 3045150 - RNA, 19 nt, Human
gaaaucaaagagagaaaau

SEQ ID NO: 3045151 - RNA, 16 nt, Human
gaacaagaugguucua

SEQ ID NO: 3045152 - RNA, 11 nt, Human
gaaacuuggau

SEQ ID NO: 3045153 - RNA, 18 nt, Human
cuuuuaugugaaacaugu

SEQ ID NO: 3045154 - RNA, 19 nt, Human
cuuuuaugugaaacauguu

SEQ ID NO: 3045155 - RNA, 14 nt, Human
gaaaauuaacauga

SEQ ID NO: 3045156 - RNA, 14 nt, Human
gaaaaaauauauau

SEQ ID NO: 3045157 - RNA, 14 nt, Human
cuuuugucccagaa

SEQ ID NO: 3045158 - RNA, 16 nt, Human
cuguacuugcucuuga

SEQ ID NO: 3045159 - RNA, 19 nt, Human
cuguacuugcucuugaugc

SEQ ID NO: 3045160 - RNA, 20 nt, Human
cuguacuugcucuugaugcc

SEQ ID NO: 3045161 - RNA, 23 nt, Human
cuggugaccuuccaagagccuga

SEQ ID NO: 3045162 - RNA, 22 nt, Human
cuggugaccuuccaagagccug

SEQ ID NO: 3045163 - RNA, 18 nt, Human
cugugaaguuuacauugu

SEQ ID NO: 3045164 - RNA, 23 nt, Human
cugugaaguuuacauuguaaaua

SEQ ID NO: 3045165 - RNA, 19 nt, Human
cuguuaucccugccugguc

SEQ ID NO: 3045166 - RNA, 23 nt, Human
cuggcccuaugcuuccggccucc

SEQ ID NO: 3045167 - RNA, 17 nt, Human
gaucccaacacugccag

SEQ ID NO: 3045168 - RNA, 23 nt, Human
gauccagcccugaguuccuagcc

SEQ ID NO: 3045169 - RNA, 18 nt, Human
gaucccaacacugccagc

SEQ ID NO: 3045170 - RNA, 19 nt, Human
gaucccaacacugccagca

SEQ ID NO: 3045171 - RNA, 23 nt, Human
gaucucugcaggaaauggcugug

SEQ ID NO: 3045172 - RNA, 12 nt, Human
gaucucugcagg

SEQ ID NO: 3045173 - RNA, 17 nt, Human
gauacuugaaaauuaac

SEQ ID NO: 3045174 - RNA, 13 nt, Human
gauggaaugaugg

SEQ ID NO: 3045175 - RNA, 17 nt, Human
gcaucggggagccggga

SEQ ID NO: 3045176 - RNA, 22 nt, Human
gcauccagagucccugccugga

SEQ ID NO: 3045177 - RNA, 23 nt, Human
gcauccagagucccugccuggac

SEQ ID NO: 3045178 - RNA, 21 nt, Human
gcauccagagucccugccugg

SEQ ID NO: 3045179 - RNA, 19 nt, Human
gcagagcugcgggcugggu

SEQ ID NO: 3045180 - RNA, 17 nt, Human
gcagagcugcgggcugg

SEQ ID NO: 3045181 - RNA, 20 nt, Human
gcagccaggccacuggcccc

SEQ ID NO: 3045182 - RNA, 16 nt, Human
gagacgggcccuggug

SEQ ID NO: 3045183 - RNA, 22 nt, Human
gaggacaguauuuguggggagg

SEQ ID NO: 3045184 - RNA, 20 nt, Human
gaggcucuggagcccacugu

SEQ ID NO: 3045185 - RNA, 12 nt, Human
gagcccugggag

SEQ ID NO: 3045186 - RNA, 16 nt, Human
gagcccugggaggcuc

SEQ ID NO: 3045187 - RNA, 18 nt, Human
gagcccugggaggcucug

SEQ ID NO: 3045188 - RNA, 19 nt, Human
gagcccugggaggcucugg

SEQ ID NO: 3045189 - RNA, 20 nt, Human
gagcccugggaggcucugga

SEQ ID NO: 3045190 - RNA, 22 nt, Human
gaauauugcuuuggucauauga

SEQ ID NO: 3045191 - RNA, 15 nt, Human
gacaaagucaagcca

SEQ ID NO: 3045192 - RNA, 18 nt, Human
gaauuauuuuaaaagaua

SEQ ID NO: 3045193 - RNA, 16 nt, Human
gaauuauuuuaaaaga

SEQ ID NO: 3045194 - RNA, 13 nt, Human
gaauuauuuuaaa

SEQ ID NO: 3045195 - RNA, 16 nt, Human
ggacaccccgacuuuu

SEQ ID NO: 3045196 - RNA, 18 nt, Human
ggaaugaagcaaugcuuc

SEQ ID NO: 3045197 - RNA, 16 nt, Human
ggacaccuaggcuagg

SEQ ID NO: 3045198 - RNA, 19 nt, Human
ggacaguauuuguggggag

SEQ ID NO: 3045199 - RNA, 18 nt, Human
ggacaguauuugugggga

SEQ ID NO: 3045200 - RNA, 17 nt, Human
ggacaggggcaggagga

SEQ ID NO: 3045201 - RNA, 17 nt, Human
gcuuuucuuucuaccaa

SEQ ID NO: 3045202 - RNA, 22 nt, Human
gcuuuuccucaaagggagagag

SEQ ID NO: 3045203 - RNA, 21 nt, Human
gcuuuucccuuuuuuuaagua

SEQ ID NO: 3045204 - RNA, 20 nt, Human
gcuuuucccuuuuuuuaagu

SEQ ID NO: 3045205 - RNA, 16 nt, Human
ggaaaaaauaacaaug

SEQ ID NO: 3045206 - RNA, 21 nt, Human
ggaaacuaggugcauauuuau

SEQ ID NO: 3045207 - RNA, 15 nt, Human
gcugcagccaggcca

SEQ ID NO: 3045208 - RNA, 23 nt, Human
gcugcagccaggccacuggcccc

SEQ ID NO: 3045209 - RNA, 20 nt, Human
gcugggccccugccucucug

SEQ ID NO: 3045210 - RNA, 18 nt, Human
gcugggccccugccucuc

SEQ ID NO: 3045211 - RNA, 12 nt, Human
gcugggccccug

SEQ ID NO: 3045212 - RNA, 13 nt, Human
gcugggccccugc

SEQ ID NO: 3045213 - RNA, 14 nt, Human
gcugggccccugcc

SEQ ID NO: 3045214 - RNA, 20 nt, Human
gcugggaauaagugccagga

SEQ ID NO: 3045215 - RNA, 13 nt, Human
gcuggacuuggag

SEQ ID NO: 3045216 - RNA, 19 nt, Human
gccauucuuucccaacacc

SEQ ID NO: 3045217 - RNA, 12 nt, Human
gccauucuuucc

SEQ ID NO: 3045218 - RNA, 22 nt, Human
gcccacuguacuugcucuugau

SEQ ID NO: 3045219 - RNA, 15 nt, Human
gcccacuguacuugc

SEQ ID NO: 3045220 - RNA, 20 nt, Human
gcccacuguacuugcucuug

SEQ ID NO: 3045221 - RNA, 17 nt, Human
gcuaggguggggagaga

SEQ ID NO: 3045222 - RNA, 18 nt, Human
gcuaggguggggagagac

SEQ ID NO: 3045223 - RNA, 21 nt, Human
gcuaggaauuguguuuauaau

SEQ ID NO: 3045224 - RNA, 18 nt, Human
gcucagaggguguccugc

SEQ ID NO: 3045225 - RNA, 19 nt, Human
gcucagaggguguccugca

SEQ ID NO: 3045226 - RNA, 22 nt, Human
gcucaggagcccugggaggcuc

SEQ ID NO: 3045227 - RNA, 21 nt, Human
gcucaggagcccugggaggcu

SEQ ID NO: 3045228 - RNA, 23 nt, Human
gcucaggagcccugggaggcucu

SEQ ID NO: 3045229 - RNA, 21 nt, Human
gcucacugcuaagaauauuug

SEQ ID NO: 3045230 - RNA, 16 nt, Human
gcucagagcaguguuu

SEQ ID NO: 3045231 - RNA, 21 nt, Human
gcguggaacucgugucuggca

SEQ ID NO: 3045232 - RNA, 16 nt, Human
gcggcuggacuuggag

SEQ ID NO: 3045233 - RNA, 15 nt, Human
gcggcuggacuugga

SEQ ID NO: 3045234 - RNA, 14 nt, Human
ggagggggagaggg

SEQ ID NO: 3045235 - RNA, 22 nt, Human
ggaguguguaauuuaaaauugu

SEQ ID NO: 3045236 - RNA, 11 nt, Human
ggaguguguaa

SEQ ID NO: 3045237 - RNA, 23 nt, Human
ggaucuucaucugacuaugacau

SEQ ID NO: 3045238 - RNA, 14 nt, Human
ggauuguaguccca

SEQ ID NO: 3045239 - RNA, 22 nt, Human
ggcaucggggagccgggagccu

SEQ ID NO: 3045240 - RNA, 16 nt, Human
ggcauccagagucccu

SEQ ID NO: 3045241 - RNA, 18 nt, Human
ggcauccagagucccugc

SEQ ID NO: 3045242 - RNA, 23 nt, Human
ggcaucggggagccgggagccug

SEQ ID NO: 3045243 - RNA, 12 nt, Human
ggcaggggccgg

SEQ ID NO: 3045244 - RNA, 14 nt, Human
ggcaggagggaggu

SEQ ID NO: 3045245 - RNA, 20 nt, Human
aaaaagccugcaauuucaua

SEQ ID NO: 3045246 - RNA, 14 nt, Human
aaaaauaaaaaaca

SEQ ID NO: 3045247 - RNA, 23 nt, Human
aaaaagauuuucagaaaauauua

SEQ ID NO: 3045248 - RNA, 20 nt, Human
ggcucuugaacugagcuugg

SEQ ID NO: 3045249 - RNA, 19 nt, Human
ggcucuugaacugagcuug

SEQ ID NO: 3045250 - RNA, 18 nt, Human
ggcucuugaacugagcuu

SEQ ID NO: 3045251 - RNA, 13 nt, Human
ggccccugccucu

SEQ ID NO: 3045252 - RNA, 17 nt, Human
ggccccugccucucugc

SEQ ID NO: 3045253 - RNA, 18 nt, Human
ggccccugccucucugca

SEQ ID NO: 3045254 - RNA, 19 nt, Human
ggccccugccucucugcag

SEQ ID NO: 3045255 - RNA, 20 nt, Human
ggcuaagcuucacuguaaaa

SEQ ID NO: 3045256 - RNA, 21 nt, Human
gguggggagagacgggcccug

SEQ ID NO: 3045257 - RNA, 18 nt, Human
gguggggggcuucauaca

SEQ ID NO: 3045258 - RNA, 16 nt, Human
gguggggggcuucaua

SEQ ID NO: 3045259 - RNA, 22 nt, Human
gguggggggggggcgcggcugg

SEQ ID NO: 3045260 - RNA, 20 nt, Human
gguucuagcauggcauauuu

SEQ ID NO: 3045261 - RNA, 17 nt, Human
gguguuuuaaaaaaucu

SEQ ID NO: 3045262 - RNA, 14 nt, Human
gguuccagccugcc

SEQ ID NO: 3045263 - RNA, 16 nt, Human
gguuccagccugccac

SEQ ID NO: 3045264 - RNA, 15 nt, Human
gguuccagccugcca

SEQ ID NO: 3045265 - RNA, 14 nt, Human
gguuugggaccccu

SEQ ID NO: 3045266 - RNA, 22 nt, Human
gguuuguuuagaagaagugugu

SEQ ID NO: 3045267 - RNA, 14 nt, Human
aaagcuguguggca

SEQ ID NO: 3045268 - RNA, 21 nt, Human
aaaguaaaaacaaagaaauua

SEQ ID NO: 3045269 - RNA, 18 nt, Human
aaagguucaugcaaacuu

SEQ ID NO: 3045270 - RNA, 15 nt, Human
guaauagagcaaaau

SEQ ID NO: 3045271 - RNA, 13 nt, Human
guaaaccuuuuau

SEQ ID NO: 3045272 - RNA, 20 nt, Human
aaauauuguguugugaaugu

SEQ ID NO: 3045273 - RNA, 15 nt, Human
aaauauauuuaauga

SEQ ID NO: 3045274 - RNA, 16 nt, Human
aaauauauuuuaagac

SEQ ID NO: 3045275 - RNA, 22 nt, Human
aaauauauuuuaagacgaaaca

SEQ ID NO: 3045276 - RNA, 18 nt, Human
aaauauaugcuaagucuu

SEQ ID NO: 3045277 - RNA, 14 nt, Human
aaauauauaucaaa

SEQ ID NO: 3045278 - RNA, 14 nt, Human
aaauauauuuaaug

SEQ ID NO: 3045279 - RNA, 17 nt, Human
ggguguccugcaccggg

SEQ ID NO: 3045280 - RNA, 21 nt, Human
ggguguccugcaccggggccu

SEQ ID NO: 3045281 - RNA, 22 nt, Human
gguaaaucagacuaugaaguuu

SEQ ID NO: 3045282 - RNA, 14 nt, Human
ggucagugcaaaua

SEQ ID NO: 3045283 - RNA, 21 nt, Human
aaacuucccuuucugcuugug

SEQ ID NO: 3045284 - RNA, 16 nt, Human
gguaggaacugcuggg

SEQ ID NO: 3045285 - RNA, 18 nt, Human
gguaggaacugcugggcu

SEQ ID NO: 3045286 - RNA, 22 nt, Human
gggggcagucugagagaggcca

SEQ ID NO: 3045287 - RNA, 22 nt, Human
gggggcuucauacacaugagau

SEQ ID NO: 3045288 - RNA, 19 nt, Human
aaaccaccagaagcccaga

SEQ ID NO: 3045289 - RNA, 18 nt, Human
aaaccaccagaagcccag

SEQ ID NO: 3045290 - RNA, 15 nt, Human
aaaccaccagaagcc

SEQ ID NO: 3045291 - RNA, 21 nt, Human
gggucaucuguaccucugccu

SEQ ID NO: 3045292 - RNA, 18 nt, Human
gggucauucauggccugg

SEQ ID NO: 3045293 - RNA, 14 nt, Human
aaaauauuuaaagg

SEQ ID NO: 3045294 - RNA, 15 nt, Human
aaaauauauuuaaug

SEQ ID NO: 3045295 - RNA, 16 nt, Human
aaaauauauuuaauga

SEQ ID NO: 3045296 - RNA, 11 nt, Human
aaaaugagaaa

SEQ ID NO: 3045297 - RNA, 12 nt, Human
aaaaugagaaau

SEQ ID NO: 3045298 - RNA, 14 nt, Human
cugagagaggccau

SEQ ID NO: 3045299 - RNA, 21 nt, Human
cugagagaggccauucuuucc

SEQ ID NO: 3045300 - RNA, 22 nt, Human
cugagagaggccauucuuuccc

SEQ ID NO: 3045301 - RNA, 13 nt, Human
cugagagaggcca

SEQ ID NO: 3045302 - RNA, 12 nt, Human
cugagaggccac

SEQ ID NO: 3045303 - RNA, 16 nt, Human
cugagaucucugcagg

SEQ ID NO: 3045304 - RNA, 18 nt, Human
cugagaucucugcaggaa

SEQ ID NO: 3045305 - RNA, 17 nt, Human
cugagaucucugcagga

SEQ ID NO: 3045306 - RNA, 21 nt, Human
cugaagcuaucguaaaauuaa

SEQ ID NO: 3045307 - RNA, 22 nt, Human
cugaagcuaucguaaaauuaag

SEQ ID NO: 3045308 - RNA, 22 nt, Human
cugaaaauugaugggauuuggu

SEQ ID NO: 3045309 - RNA, 13 nt, Human
cugaaacuucccu

SEQ ID NO: 3045310 - RNA, 13 nt, Human
cucuugaugccug

SEQ ID NO: 3045311 - RNA, 15 nt, Human
cucuugaugccuggc

SEQ ID NO: 3045312 - RNA, 16 nt, Human
cucuugaugccuggcg

SEQ ID NO: 3045313 - RNA, 21 nt, Human
cucuugaugccuggcggggug

SEQ ID NO: 3045314 - RNA, 14 nt, Human
cucugcaggucccu

SEQ ID NO: 3045315 - RNA, 15 nt, Human
cucugcaggucccua

SEQ ID NO: 3045316 - RNA, 16 nt, Human
cucugcaggucccuaa

SEQ ID NO: 3045317 - RNA, 17 nt, Human
cucugcaggucccuaau

SEQ ID NO: 3045318 - RNA, 13 nt, Human
cucugcagguccc

SEQ ID NO: 3045319 - RNA, 18 nt, Human
cucaugugacucuuucca

SEQ ID NO: 3045320 - RNA, 23 nt, Human
cuccaagcccaguucagcuuggg

SEQ ID NO: 3045321 - RNA, 15 nt, Human
cucgugucuggcaca

SEQ ID NO: 3045322 - RNA, 12 nt, Human
cuccuacagccc

SEQ ID NO: 3045323 - RNA, 14 nt, Human
cguaaaauuaagaa

SEQ ID NO: 3045324 - RNA, 23 nt, Human
cgccacuguuuugaaucucauaa

SEQ ID NO: 3045325 - RNA, 16 nt, Human
cgaauuuuaaaagaug

SEQ ID NO: 3045326 - RNA, 22 nt, Human
cuaauucuuugaccuguuggga

SEQ ID NO: 3045327 - RNA, 21 nt, Human
cuaauucuuugaccuguuggg

SEQ ID NO: 3045328 - RNA, 17 nt, Human
cuaucguaaaauuaaga

SEQ ID NO: 3045329 - RNA, 18 nt, Human
cuaucguaaaauuaagaa

SEQ ID NO: 3045330 - RNA, 19 nt, Human
cuagccaccgccuccuaca

SEQ ID NO: 3045331 - RNA, 22 nt, Human
ccagggggccagucccugaggc

SEQ ID NO: 3045332 - RNA, 13 nt, Human
cacuggggcaggg

SEQ ID NO: 3045333 - RNA, 23 nt, Human
cacuggggauugggccccugcca

SEQ ID NO: 3045334 - RNA, 15 nt, Human
cacuggggcaggggc

SEQ ID NO: 3045335 - RNA, 18 nt, Human
cacuggggauugggcccc

SEQ ID NO: 3045336 - RNA, 17 nt, Human
cacuggggauugggccc

SEQ ID NO: 3045337 - RNA, 16 nt, Human
cacuggggauugggcc

SEQ ID NO: 3045338 - RNA, 15 nt, Human
cacuggggauugggc

SEQ ID NO: 3045339 - RNA, 21 nt, Human
cagaauaaacuggcagcucag

SEQ ID NO: 3045340 - RNA, 12 nt, Human
cagaauauguuu

SEQ ID NO: 3045341 - RNA, 13 nt, Human
cagaauauugcuu

SEQ ID NO: 3045342 - RNA, 20 nt, Human
cagaauauguuucaaacuuu

SEQ ID NO: 3045343 - RNA, 18 nt, Human
cagaauauguuucaaacu

SEQ ID NO: 3045344 - RNA, 17 nt, Human
cagaauauguuucaaac

SEQ ID NO: 3045345 - RNA, 15 nt, Human
cagaauauguuucaa

SEQ ID NO: 3045346 - RNA, 14 nt, Human
cagaauauguuuca

SEQ ID NO: 3045347 - RNA, 13 nt, Human
cagaauauguuuc

SEQ ID NO: 3045348 - RNA, 17 nt, Human
cacucuugaaaaaugca

SEQ ID NO: 3045349 - RNA, 14 nt, Human
cacucuuggagccu

SEQ ID NO: 3045350 - RNA, 16 nt, Human
cacucuuggagccugc

SEQ ID NO: 3045351 - RNA, 15 nt, Human
cacucuuggagccug

SEQ ID NO: 3045352 - RNA, 19 nt, Human
cacucuuggagccugcaga

SEQ ID NO: 3045353 - RNA, 17 nt, Human
cacucuuggagccugca

SEQ ID NO: 3045354 - RNA, 18 nt, Human
caacaccucuuggggagu

SEQ ID NO: 3045355 - RNA, 16 nt, Human
caaagucaagccacau

SEQ ID NO: 3045356 - RNA, 22 nt, Human
caaauccagccugcugccugcu

SEQ ID NO: 3045357 - RNA, 20 nt, Human
caaauccuugugggaaaaga

SEQ ID NO: 3045358 - RNA, 22 nt, Human
caaaugagggucuugguuccag

SEQ ID NO: 3045359 - RNA, 20 nt, Human
caacuauuuuuccaaaauaa

SEQ ID NO: 3045360 - RNA, 22 nt, Human
caaaccaccagaagcccagaau

SEQ ID NO: 3045361 - RNA, 20 nt, Human
caaaccaccagaagcccaga

SEQ ID NO: 3045362 - RNA, 16 nt, Human
caaaccaccagaagcc

SEQ ID NO: 3045363 - RNA, 15 nt, Human
caaaccaccagaagc

SEQ ID NO: 3045364 - RNA, 18 nt, Human
caaaaaaauauauuuaau

SEQ ID NO: 3045365 - RNA, 18 nt, Human
auuguaagcaugcacaaa

SEQ ID NO: 3045366 - RNA, 22 nt, Human
auugauccagaaagaaaacuug

SEQ ID NO: 3045367 - RNA, 18 nt, Human
auugauccagaaagaaaa

SEQ ID NO: 3045368 - RNA, 19 nt, Human
auugauccagaaagaaaac

SEQ ID NO: 3045369 - RNA, 22 nt, Human
auuuaaugauaaguaaaugcua

SEQ ID NO: 3045370 - RNA, 19 nt, Human
auuuauacaggucauauua

SEQ ID NO: 3045371 - RNA, 18 nt, Human
auuaaauuuugaguucua

SEQ ID NO: 3045372 - RNA, 23 nt, Human
auuaugugccagauuuaugcaua

SEQ ID NO: 3045373 - RNA, 15 nt, Human
auuauguguguuuua

SEQ ID NO: 3045374 - RNA, 20 nt, Human
auuauguguguuuuaaaaug

SEQ ID NO: 3045375 - RNA, 21 nt, Human
auuauguguguuuuaaaauga

SEQ ID NO: 3045376 - RNA, 22 nt, Human
auucaagaaaacaacuucaaua

SEQ ID NO: 3045377 - RNA, 19 nt, Human
auucuuugaccuguuggga

SEQ ID NO: 3045378 - RNA, 14 nt, Human
auucugagagcugu

SEQ ID NO: 3045379 - RNA, 13 nt, Human
auucugagagcug

SEQ ID NO: 3045380 - RNA, 17 nt, Human
auucuugccaaauauaa

SEQ ID NO: 3045381 - RNA, 16 nt, Human
auugauccagaaagaa

SEQ ID NO: 3045382 - RNA, 17 nt, Human
auugauccagaaagaaa

SEQ ID NO: 3045383 - RNA, 17 nt, Human
cagaggguguccugcac

SEQ ID NO: 3045384 - RNA, 21 nt, Human
cagaguaauccaagcaaaugu

SEQ ID NO: 3045385 - RNA, 13 nt, Human
cagcauaauacuu

SEQ ID NO: 3045386 - RNA, 17 nt, Human
cagucugagagaggcca

SEQ ID NO: 3045387 - RNA, 21 nt, Human
cagugggccuggccagcaggu

SEQ ID NO: 3045388 - RNA, 15 nt, Human
cagugggccuggcca

SEQ ID NO: 3045389 - RNA, 14 nt, Human
cagugggccuggcc

SEQ ID NO: 3045390 - RNA, 23 nt, Human
cagguuugggaccccuggugguu

SEQ ID NO: 3045391 - RNA, 23 nt, Human
caguaaagaacaucccuccuggg

SEQ ID NO: 3045392 - RNA, 16 nt, Human
cagggaugguguucaa

SEQ ID NO: 3045393 - RNA, 18 nt, Human
cagggcugaggccucuca

SEQ ID NO: 3045394 - RNA, 16 nt, Human
cagggcugaggccucu

SEQ ID NO: 3045395 - RNA, 21 nt, Human
ccaccacacugauccagcccu

SEQ ID NO: 3045396 - RNA, 13 nt, Human
ccaccgccuccua

SEQ ID NO: 3045397 - RNA, 14 nt, Human
ccacuccuccuagc

SEQ ID NO: 3045398 - RNA, 19 nt, Human
ccaaugugaacagcggcug

SEQ ID NO: 3045399 - RNA, 15 nt, Human
cauauuaauauauuu

SEQ ID NO: 3045400 - RNA, 14 nt, Human
cauauuaauauauu

SEQ ID NO: 3045401 - RNA, 19 nt, Human
cauauuaauauauuuccau

SEQ ID NO: 3045402 - RNA, 23 nt, Human
cauaugcuguauauccuuucuaa

SEQ ID NO: 3045403 - RNA, 17 nt, Human
cauggcucccccuccac

SEQ ID NO: 3045404 - RNA, 22 nt, Human
gucccgggacaccuaggcuagg

SEQ ID NO: 3045405 - RNA, 12 nt, Human
gucccuaauaaa

SEQ ID NO: 3045406 - RNA, 15 nt, Human
guccaucagccucca

SEQ ID NO: 3045407 - RNA, 22 nt, Human
guccccagacuccaccaagccu

SEQ ID NO: 3045408 - RNA, 21 nt, Human
aacacugggagaaaugaaaaa

SEQ ID NO: 3045409 - RNA, 18 nt, Human
gucgcccuggacugugug

SEQ ID NO: 3045410 - RNA, 19 nt, Human
guauucuagcuaauguaau

SEQ ID NO: 3045411 - RNA, 24 nt, Human
guauucuaaauuuuauaucuugua

SEQ ID NO: 3045412 - RNA, 21 nt, Human
guauucuaaauuuuauaucuu

SEQ ID NO: 3045413 - RNA, 16 nt, Human
aaaucauucauuuucu

SEQ ID NO: 3045414 - RNA, 17 nt, Human
aaauuccaagugauuga

SEQ ID NO: 3045415 - RNA, 17 nt, Human
aaauuguauuacaaauc

SEQ ID NO: 3045416 - RNA, 23 nt, Human
aaauuaugugccagauuuaugca

SEQ ID NO: 3045417 - RNA, 19 nt, Human
gugccagauuuaugcauau

SEQ ID NO: 3045418 - RNA, 14 nt, Human
aagaaaacaacuuc

SEQ ID NO: 3045419 - RNA, 19 nt, Human
aagaagugugucacccuua

SEQ ID NO: 3045420 - RNA, 15 nt, Human
gugcucuccaagccc

SEQ ID NO: 3045421 - RNA, 19 nt, Human
gugcucaggagcccuggga

SEQ ID NO: 3045422 - RNA, 18 nt, Human
gugcucaggagcccuggg

SEQ ID NO: 3045423 - RNA, 16 nt, Human
gugcucaggagcccug

SEQ ID NO: 3045424 - RNA, 10 nt, Human
gugauguguc

SEQ ID NO: 3045425 - RNA, 17 nt, Human
aacugugaaguuuacau

SEQ ID NO: 3045426 - RNA, 19 nt, Human
aacugugaaguuuacauug

SEQ ID NO: 3045427 - RNA, 14 nt, Human
gugaaguuuacauu

SEQ ID NO: 3045428 - RNA, 19 nt, Human
gucuuauauauuguagaua

SEQ ID NO: 3045429 - RNA, 22 nt, Human
gucuuuccacuccuccuagcca

SEQ ID NO: 3045430 - RNA, 21 nt, Human
aacuaggugcauauuuauaaa

SEQ ID NO: 3045431 - RNA, 23 nt, Human
aacuauucaggagaguagaacag

SEQ ID NO: 3045432 - RNA, 12 nt, Human
aacuauggccug

SEQ ID NO: 3045433 - RNA, 22 nt, Human
guucuagcauggcauauuuuuc

SEQ ID NO: 3045434 - RNA, 19 nt, Human
guucuagcauggcauauuu

SEQ ID NO: 3045435 - RNA, 19 nt, Human
aagcuuuuaugugaaacau

SEQ ID NO: 3045436 - RNA, 21 nt, Human
aagcuuuuaugugaaacaugu

SEQ ID NO: 3045437 - RNA, 19 nt, Human
aaggaaaaaauaacaauga

SEQ ID NO: 3045438 - RNA, 18 nt, Human
aagccuggucagcccaaa

SEQ ID NO: 3045439 - RNA, 17 nt, Human
aagccuggucagcccaa

SEQ ID NO: 3045440 - RNA, 15 nt, Human
aagccuguuuaagag

SEQ ID NO: 3045441 - RNA, 18 nt, Human
aagccuguuuaagagaca

SEQ ID NO: 3045442 - RNA, 12 nt, Human
guucagcuuggg

SEQ ID NO: 3045443 - RNA, 19 nt, Human
guuauuauauuuacaaaug

SEQ ID NO: 3045444 - RNA, 17 nt, Human
guuauuauauuuacaaa

SEQ ID NO: 3045445 - RNA, 21 nt, Human
guuauugauaaguucauacau

SEQ ID NO: 3045446 - RNA, 22 nt, Human
guuauugauaaguucauacauu

SEQ ID NO: 3045447 - RNA, 19 nt, Human
guuaauuccaauuauauga

SEQ ID NO: 3045448 - RNA, 23 nt, Human
aagcaugcacaaauucugucucu

SEQ ID NO: 3045449 - RNA, 16 nt, Human
aagcacuaaacaaaga

SEQ ID NO: 3045450 - RNA, 21 nt, Human
guguaugugggggucugugug

SEQ ID NO: 3045451 - RNA, 13 nt, Human
guguauguggggg

SEQ ID NO: 3045452 - RNA, 20 nt, Human
aagcaaaugugaaucauuuu

SEQ ID NO: 3045453 - RNA, 21 nt, Human
gugguucacucuuggagccug

SEQ ID NO: 3045454 - RNA, 23 nt, Human
gugguucacucuuggagccugca

SEQ ID NO: 3045455 - RNA, 22 nt, Human
gugguucacucuuggagccugc

SEQ ID NO: 3045456 - RNA, 15 nt, Human
guguaaaaugugaag

SEQ ID NO: 3045457 - RNA, 18 nt, Human
aagaggugugcaagagag

SEQ ID NO: 3045458 - RNA, 16 nt, Human
aagaggugugcaagag

SEQ ID NO: 3045459 - RNA, 21 nt, Human
uaaaaauauuguguugugaau

SEQ ID NO: 3045460 - RNA, 22 nt, Human
uaaaaauauuguguugugaaug

SEQ ID NO: 3045461 - RNA, 14 nt, Human
uaaaaauauugugu

SEQ ID NO: 3045462 - RNA, 19 nt, Human
uaaaaagccugcaauuuca

SEQ ID NO: 3045463 - RNA, 22 nt, Human
uaaaaagccugcaauuucauau

SEQ ID NO: 3045464 - RNA, 20 nt, Human
aagugugggucugugugugu

SEQ ID NO: 3045465 - RNA, 12 nt, Human
aaguguguguuu

SEQ ID NO: 3045466 - RNA, 18 nt, Human
aagugugggucugugugu

SEQ ID NO: 3045467 - RNA, 17 nt, Human
aagugugggucugugug

SEQ ID NO: 3045468 - RNA, 10 nt, Human
aagugugggu

SEQ ID NO: 3045469 - RNA, 16 nt, Human
aaguguguguuuuuca

SEQ ID NO: 3045470 - RNA, 21 nt, Human
aaguguguguuuuucauaaag

SEQ ID NO: 3045471 - RNA, 11 nt, Human
uaaaaugugaa

SEQ ID NO: 3045472 - RNA, 13 nt, Human
uaaaaugugaagu

SEQ ID NO: 3045473 - RNA, 16 nt, Human
uaaaauugugaugugu

SEQ ID NO: 3045474 - RNA, 15 nt, Human
uaaaauugugaugug

SEQ ID NO: 3045475 - RNA, 19 nt, Human
aaguauguguaaaauguga

SEQ ID NO: 3045476 - RNA, 21 nt, Human
aagucacuggccaguggcugg

SEQ ID NO: 3045477 - RNA, 17 nt, Human
guuuuaaaaugagaaau

SEQ ID NO: 3045478 - RNA, 12 nt, Human
aaguaaaugcua

SEQ ID NO: 3045479 - RNA, 16 nt, Human
acaccucuuggggagu

SEQ ID NO: 3045480 - RNA, 15 nt, Human
uauaaguguguguuu

SEQ ID NO: 3045481 - RNA, 19 nt, Human
uauaaaagccuguuuaaga

SEQ ID NO: 3045482 - RNA, 22 nt, Human
uauaaaagggacugagaaauuu

SEQ ID NO: 3045483 - RNA, 19 nt, Human
uauaaaaauaaaaaacacu

SEQ ID NO: 3045484 - RNA, 20 nt, Human
uauaaaagccuguuuaagag

SEQ ID NO: 3045485 - RNA, 19 nt, Human
acaauggauaggcacagga

SEQ ID NO: 3045486 - RNA, 16 nt, Human
aauuguuacaaauugu

SEQ ID NO: 3045487 - RNA, 20 nt, Human
aauuguguuuauaauuuuaa

SEQ ID NO: 3045488 - RNA, 21 nt, Human
aauuguguuuauaauuuuaaa

SEQ ID NO: 3045489 - RNA, 22 nt, Human
uagagcaaaauugauguguuua

SEQ ID NO: 3045490 - RNA, 14 nt, Human
uagagcaaaauuga

SEQ ID NO: 3045491 - RNA, 21 nt, Human
uagagcaaaauugauguguuu

SEQ ID NO: 3045492 - RNA, 22 nt, Human
uagcauggcauauuuuucacau

SEQ ID NO: 3045493 - RNA, 21 nt, Human
uagcauggcauauuuuucaca

SEQ ID NO: 3045494 - RNA, 12 nt, Human
uagcuaauguaa

SEQ ID NO: 3045495 - RNA, 19 nt, Human
uagcuaauguaauaacugu

SEQ ID NO: 3045496 - RNA, 18 nt, Human
uaggcaaccuuuauuuuu

SEQ ID NO: 3045497 - RNA, 15 nt, Human
uauucagcucaugga

SEQ ID NO: 3045498 - RNA, 21 nt, Human
uauucagcucauggacuucug

SEQ ID NO: 3045499 - RNA, 21 nt, Human
acagcggcuggacuuggaggu

SEQ ID NO: 3045500 - RNA, 22 nt, Human
acagcggcuggacuuggaggua

SEQ ID NO: 3045501 - RNA, 16 nt, Human
uauguggaaguguggg

SEQ ID NO: 3045502 - RNA, 12 nt, Human
uauguggaagug

SEQ ID NO: 3045503 - RNA, 23 nt, Human
uaugugccagauuuaugcauauu

SEQ ID NO: 3045504 - RNA, 17 nt, Human
uaugugaaacauguuuc

SEQ ID NO: 3045505 - RNA, 14 nt, Human
uaugugaaacaugu

SEQ ID NO: 3045506 - RNA, 17 nt, Human
uauguguaaaaugugaa

SEQ ID NO: 3045507 - RNA, 17 nt, Human
uauaaguguguguuuuu

SEQ ID NO: 3045508 - RNA, 23 nt, Human
uauaaguguguguuuuucauaaa

SEQ ID NO: 3045509 - RNA, 16 nt, Human
uauauuuaguaucuuu

SEQ ID NO: 3045510 - RNA, 19 nt, Human
uauccaaaccaaauaaaaa

SEQ ID NO: 3045511 - RNA, 20 nt, Human
uauggggauagaugugugga

SEQ ID NO: 3045512 - RNA, 19 nt, Human
acagcggcuggacuuggag

SEQ ID NO: 3045513 - RNA, 19 nt, Human
uaugaaauuauauaaguau

SEQ ID NO: 3045514 - RNA, 20 nt, Human
acagauuuccauccuaguca

SEQ ID NO: 3045515 - RNA, 12 nt, Human
aauccgcccauc

SEQ ID NO: 3045516 - RNA, 19 nt, Human
aaucuuauaauuuaaaaua

SEQ ID NO: 3045517 - RNA, 16 nt, Human
uaaguauucuaaauuu

SEQ ID NO: 3045518 - RNA, 13 nt, Human
uaaguaaaugcua

SEQ ID NO: 3045519 - RNA, 12 nt, Human
uaauaaacacuc

SEQ ID NO: 3045520 - RNA, 18 nt, Human
uaauaaacacucuugaaa

SEQ ID NO: 3045521 - RNA, 19 nt, Human
aaugaaacacucaguuguu

SEQ ID NO: 3045522 - RNA, 14 nt, Human
aaugaaacuuggau

SEQ ID NO: 3045523 - RNA, 18 nt, Human
uaauguaauaacugugaa

SEQ ID NO: 3045524 - RNA, 15 nt, Human
aaucuuuaauuuuac

SEQ ID NO: 3045525 - RNA, 16 nt, Human
aaucuuuaauuuuaca

SEQ ID NO: 3045526 - RNA, 16 nt, Human
aaucuuauaauuuaaa

SEQ ID NO: 3045527 - RNA, 12 nt, Human
uaauagagcaaa

SEQ ID NO: 3045528 - RNA, 21 nt, Human
uaauagagcaaaauugaugug

SEQ ID NO: 3045529 - RNA, 23 nt, Human
aauaguauuugagaguucuaaau

SEQ ID NO: 3045530 - RNA, 20 nt, Human
aauaguauuugagaguucua

SEQ ID NO: 3045531 - RNA, 22 nt, Human
aauaguauuugagaguucuaaa

SEQ ID NO: 3045532 - RNA, 14 nt, Human
aauauauuuuaaga

SEQ ID NO: 3045533 - RNA, 15 nt, Human
aauauauuuuaagac

SEQ ID NO: 3045534 - RNA, 13 nt, Human
uaagacaaauaug

SEQ ID NO: 3045535 - RNA, 14 nt, Human
uaagaauauuugaa

SEQ ID NO: 3045536 - RNA, 13 nt, Human
uaagaauauuuga

SEQ ID NO: 3045537 - RNA, 22 nt, Human
uaacuuaaaagaacauguauau

SEQ ID NO: 3045538 - RNA, 20 nt, Human
uaacgauaaaagacagugaa

SEQ ID NO: 3045539 - RNA, 12 nt, Human
aauauuuagugu

SEQ ID NO: 3045540 - RNA, 14 nt, Human
aauauuugaaugua

SEQ ID NO: 3045541 - RNA, 23 nt, Human
aauauuugaauguaugcuucaua

SEQ ID NO: 3045542 - RNA, 21 nt, Human
aauauuugaauguaugcuuca

SEQ ID NO: 3045543 - RNA, 17 nt, Human
aauauuguguugugaau

SEQ ID NO: 3045544 - RNA, 17 nt, Human
uacauuguaaauaguau

SEQ ID NO: 3045545 - RNA, 20 nt, Human
aauuaagaaaggauaaaguu

SEQ ID NO: 3045546 - RNA, 21 nt, Human
aauuaagaaaggauaaaguug

SEQ ID NO: 3045547 - RNA, 13 nt, Human
aauguuaagcaga

SEQ ID NO: 3045548 - RNA, 23 nt, Human
uacaggucauauuaauauauuuc

SEQ ID NO: 3045549 - RNA, 22 nt, Human
uacauauaagugauugcugguu

SEQ ID NO: 3045550 - RNA, 12 nt, Human
aaugcuguguua

SEQ ID NO: 3045551 - RNA, 13 nt, Human
aaugcuguguuaa

SEQ ID NO: 3045552 - RNA, 16 nt, Human
aaugcuucaucccuuu

SEQ ID NO: 3045553 - RNA, 19 nt, Human
aauugaugggauuugguca

SEQ ID NO: 3045554 - RNA, 13 nt, Human
aauugauguguuu

SEQ ID NO: 3045555 - RNA, 14 nt, Human
aauugauguguuua

SEQ ID NO: 3045556 - RNA, 19 nt, Human
uacuguaaggcaaucaugg

SEQ ID NO: 3045557 - RNA, 18 nt, Human
uacuguaaggcaaucaug

SEQ ID NO: 3045558 - RNA, 19 nt, Human
uacauuguacgaagaguau

SEQ ID NO: 3045559 - RNA, 18 nt, Human
aauuccaagugauugaaa

SEQ ID NO: 3045560 - RNA, 20 nt, Human
aauuauuuuguucauacaua

SEQ ID NO: 3045561 - RNA, 19 nt, Human
aauuauuuuguucauacau

SEQ ID NO: 3045562 - RNA, 18 nt, Human
aauuauuuuguucauaca

SEQ ID NO: 3045563 - RNA, 16 nt, Human
aauuauuuuguucaua

SEQ ID NO: 3045564 - RNA, 22 nt, Human
aauuauuuuguucauacauauu

SEQ ID NO: 3045565 - RNA, 21 nt, Human
aauuauuuuguucauacauau

SEQ ID NO: 3045566 - RNA, 16 nt, Human
aauuauuauuuggccc

SEQ ID NO: 3045567 - RNA, 13 nt, Human
accgaggcaggga

SEQ ID NO: 3045568 - RNA, 16 nt, Human
ucauaaauuuaugguu

SEQ ID NO: 3045569 - RNA, 15 nt, Human
ucaguuuuugugaaa

SEQ ID NO: 3045570 - RNA, 17 nt, Human
ucaguuuuugugaaaag

SEQ ID NO: 3045571 - RNA, 22 nt, Human
ucauaaaaagccugcaauuuca

SEQ ID NO: 3045572 - RNA, 12 nt, Human
ucaguaugugga

SEQ ID NO: 3045573 - RNA, 16 nt, Human
ucaguauguggaagug

SEQ ID NO: 3045574 - RNA, 14 nt, Human
ucaguauguggaag

SEQ ID NO: 3045575 - RNA, 14 nt, Human
ucaugugacucuuu

SEQ ID NO: 3045576 - RNA, 17 nt, Human
ucaugugacucuuucca

SEQ ID NO: 3045577 - RNA, 17 nt, Human
ucaugugaaaucauuca

SEQ ID NO: 3045578 - RNA, 16 nt, Human
ucaugugaaaucauuc

SEQ ID NO: 3045579 - RNA, 23 nt, Human
ucaugcaaacuuuauuuuguguu

SEQ ID NO: 3045580 - RNA, 18 nt, Human
ucaugugacucuuuccaa

SEQ ID NO: 3045581 - RNA, 19 nt, Human
ucaugugacucuuuccaac

SEQ ID NO: 3045582 - RNA, 17 nt, Human
ucauguuuacagaggac

SEQ ID NO: 3045583 - RNA, 14 nt, Human
ucaugcaaacuuua

SEQ ID NO: 3045584 - RNA, 13 nt, Human
ucaucuaggauuu

SEQ ID NO: 3045585 - RNA, 12 nt, Human
accuaggcuagg

SEQ ID NO: 3045586 - RNA, 17 nt, Human
accuaggcuaggguggg

SEQ ID NO: 3045587 - RNA, 16 nt, Human
accccuggugguucac

SEQ ID NO: 3045588 - RNA, 12 nt, Human
ucagcucaugga

SEQ ID NO: 3045589 - RNA, 14 nt, Human
accccugcuucuga

SEQ ID NO: 3045590 - RNA, 17 nt, Human
ucagauuugccuuauug

SEQ ID NO: 3045591 - RNA, 24 nt, Human
accacauuggagauguuuaguaau

SEQ ID NO: 3045592 - RNA, 14 nt, Human
ucacauaucuagua

SEQ ID NO: 3045593 - RNA, 16 nt, Human
ucaauucuugccaaau

SEQ ID NO: 3045594 - RNA, 16 nt, Human
accaaagcgaauuuua

SEQ ID NO: 3045595 - RNA, 23 nt, Human
ucacagcaagucacuggccagug

SEQ ID NO: 3045596 - RNA, 20 nt, Human
acaugaauauuuaguguuca

SEQ ID NO: 3045597 - RNA, 19 nt, Human
acauuguacgaagaguauu

SEQ ID NO: 3045598 - RNA, 17 nt, Human
ucaagaaaacaacuuca

SEQ ID NO: 3045599 - RNA, 18 nt, Human
ucaauauccaaaccaaau

SEQ ID NO: 3045600 - RNA, 19 nt, Human
acauucuuccaaaaagauu

SEQ ID NO: 3045601 - RNA, 18 nt, Human
uccugcaccggggccugg

SEQ ID NO: 3045602 - RNA, 19 nt, Human
uccugcaccggggccuggg

SEQ ID NO: 3045603 - RNA, 23 nt, Human
uccuggaagugcuaauuuugaaa

SEQ ID NO: 3045604 - RNA, 12 nt, Human
acugagaaauuu

SEQ ID NO: 3045605 - RNA, 17 nt, Human
acugagaaauuuauaaa

SEQ ID NO: 3045606 - RNA, 21 nt, Human
acugagaaauuuauaaacuuu

SEQ ID NO: 3045607 - RNA, 15 nt, Human
acucuuguuuccuua

SEQ ID NO: 3045608 - RNA, 16 nt, Human
ucccuuuuuuuaagua

SEQ ID NO: 3045609 - RNA, 21 nt, Human
ucccuuuuuuuaaguaaggaa

SEQ ID NO: 3045610 - RNA, 13 nt, Human
ucccuuuuuuuaa

SEQ ID NO: 3045611 - RNA, 14 nt, Human
acucuuggagccug

SEQ ID NO: 3045612 - RNA, 16 nt, Human
acucuuggagccugca

SEQ ID NO: 3045613 - RNA, 15 nt, Human
acucuuggagccugc

SEQ ID NO: 3045614 - RNA, 23 nt, Human
acucuuggagccugcagagcugc

SEQ ID NO: 3045615 - RNA, 22 nt, Human
acucuuggagccugcagagcug

SEQ ID NO: 3045616 - RNA, 21 nt, Human
acucuugaaaaaugcauguug

SEQ ID NO: 3045617 - RNA, 18 nt, Human
acguaaugaaacuuggau

SEQ ID NO: 3045618 - RNA, 15 nt, Human
acuaauuuuaaaaug

SEQ ID NO: 3045619 - RNA, 22 nt, Human
uccagcccugaguuccuagcca

SEQ ID NO: 3045620 - RNA, 20 nt, Human
uccagcccugaguuccuagc

SEQ ID NO: 3045621 - RNA, 20 nt, Human
uccagccugcugccugcuuu

SEQ ID NO: 3045622 - RNA, 13 nt, Human
uccagccugccac

SEQ ID NO: 3045623 - RNA, 11 nt, Human
uccagccugcc

SEQ ID NO: 3045624 - RNA, 17 nt, Human
accuuugacaaagguaa

SEQ ID NO: 3045625 - RNA, 18 nt, Human
accuuugacaaagguaaa

SEQ ID NO: 3045626 - RNA, 18 nt, Human
accuuuggagcaaagcug

SEQ ID NO: 3045627 - RNA, 22 nt, Human
accuuuguuugcaucugaaaau

SEQ ID NO: 3045628 - RNA, 21 nt, Human
uccacuccuccuagccaccca

SEQ ID NO: 3045629 - RNA, 15 nt, Human
ucuaguucugccagg

SEQ ID NO: 3045630 - RNA, 16 nt, Human
ucuaguucugccagga

SEQ ID NO: 3045631 - RNA, 17 nt, Human
ucuaguucugccaggag

SEQ ID NO: 3045632 - RNA, 14 nt, Human
ucuaguucugccag

SEQ ID NO: 3045633 - RNA, 23 nt, Human
ucuagcauggcauauuuuucaca

SEQ ID NO: 3045634 - RNA, 22 nt, Human
ucuagcauggcauauuuuucac

SEQ ID NO: 3045635 - RNA, 21 nt, Human
ucuagcauggcauauuuuuca

SEQ ID NO: 3045636 - RNA, 23 nt, Human
acuuaacuauucaggagaguaga

SEQ ID NO: 3045637 - RNA, 15 nt, Human
acuuuggaacaagau

SEQ ID NO: 3045638 - RNA, 16 nt, Human
acuugcucuugaugcc

SEQ ID NO: 3045639 - RNA, 14 nt, Human
acuugcucuugaug

SEQ ID NO: 3045640 - RNA, 20 nt, Human
acuugcucuugaugccuggc

SEQ ID NO: 3045641 - RNA, 17 nt, Human
acuugcucuugaugccu

SEQ ID NO: 3045642 - RNA, 18 nt, Human
acuugcucuugaugccug

SEQ ID NO: 3045643 - RNA, 18 nt, Human
acuuguauuauguguguu

SEQ ID NO: 3045644 - RNA, 19 nt, Human
acuuguauuauguguguuu

SEQ ID NO: 3045645 - RNA, 14 nt, Human
acuugcuuuuaaaa

SEQ ID NO: 3045646 - RNA, 14 nt, Human
ucugcuuguguuaa

SEQ ID NO: 3045647 - RNA, 21 nt, Human
agaauauguuucaaacuuugg

SEQ ID NO: 3045648 - RNA, 19 nt, Human
agaauauguuucaaacuuu

SEQ ID NO: 3045649 - RNA, 18 nt, Human
agaauauguuucaaacuu

SEQ ID NO: 3045650 - RNA, 17 nt, Human
agaauauguuucaaacu

SEQ ID NO: 3045651 - RNA, 13 nt, Human
agaauauguuuca

SEQ ID NO: 3045652 - RNA, 17 nt, Human
agaauaaaauuuuuaau

SEQ ID NO: 3045653 - RNA, 12 nt, Human
agaauaaaauuu

SEQ ID NO: 3045654 - RNA, 14 nt, Human
agaauaaaauuuuu

SEQ ID NO: 3045655 - RNA, 14 nt, Human
ucuguuuacagugu

SEQ ID NO: 3045656 - RNA, 16 nt, Human
ucugugaaaguacauu

SEQ ID NO: 3045657 - RNA, 11 nt, Human
agaagcccaga

SEQ ID NO: 3045658 - RNA, 13 nt, Human
agaagcccagaau

SEQ ID NO: 3045659 - RNA, 12 nt, Human
agaagcccagaa

SEQ ID NO: 3045660 - RNA, 14 nt, Human
agaagaaguguguc

SEQ ID NO: 3045661 - RNA, 10 nt, Human
ucugaauuau

SEQ ID NO: 3045662 - RNA, 15 nt, Human
ucugaauuauuuucu

SEQ ID NO: 3045663 - RNA, 13 nt, Human
ucugcaggucccu

SEQ ID NO: 3045664 - RNA, 11 nt, Human
ucugcaggucc

SEQ ID NO: 3045665 - RNA, 12 nt, Human
ucugcagguccc

SEQ ID NO: 3045666 - RNA, 13 nt, Human
ugagagaggccau

SEQ ID NO: 3045667 - RNA, 17 nt, Human
ugagagcugugcaucag

SEQ ID NO: 3045668 - RNA, 23 nt, Human
ugagauguagccccucuccugga

SEQ ID NO: 3045669 - RNA, 14 nt, Human
ugagauguguucac

SEQ ID NO: 3045670 - RNA, 15 nt, Human
agcaagucagaauag

SEQ ID NO: 3045671 - RNA, 14 nt, Human
ugacuaugacauaa

SEQ ID NO: 3045672 - RNA, 15 nt, Human
ugacagguuugggac

SEQ ID NO: 3045673 - RNA, 22 nt, Human
agauguagccccucuccuggaa

SEQ ID NO: 3045674 - RNA, 21 nt, Human
agauguagccccucuccugga

SEQ ID NO: 3045675 - RNA, 13 nt, Human
ugaaagaaaauaa

SEQ ID NO: 3045676 - RNA, 14 nt, Human
ugaaaauuaacaug

SEQ ID NO: 3045677 - RNA, 20 nt, Human
ugaaaaucuuauaauuuaaa

SEQ ID NO: 3045678 - RNA, 16 nt, Human
agacuccaccaagccu

SEQ ID NO: 3045679 - RNA, 12 nt, Human
agacuccaccaa

SEQ ID NO: 3045680 - RNA, 16 nt, Human
ucuuuguaaugaaaac

SEQ ID NO: 3045681 - RNA, 21 nt, Human
ucuuuuuucuaaaguaaaaac

SEQ ID NO: 3045682 - RNA, 22 nt, Human
ucuuuuuucuaaaguaaaaaca

SEQ ID NO: 3045683 - RNA, 15 nt, Human
agacuuuuaugauac

SEQ ID NO: 3045684 - RNA, 12 nt, Human
agacuuuuauga

SEQ ID NO: 3045685 - RNA, 16 nt, Human
agaggcugcagccagg

SEQ ID NO: 3045686 - RNA, 18 nt, Human
agaguaauccaagcaaau

SEQ ID NO: 3045687 - RNA, 20 nt, Human
agaguaauccaagcaaaugu

SEQ ID NO: 3045688 - RNA, 23 nt, Human
ugaauaauguaagacaaauaugu

SEQ ID NO: 3045689 - RNA, 18 nt, Human
ugaauauuuaguguucau

SEQ ID NO: 3045690 - RNA, 13 nt, Human
agucccugccugg

SEQ ID NO: 3045691 - RNA, 22 nt, Human
ugucucuggauuauauuaugaa

SEQ ID NO: 3045692 - RNA, 19 nt, Human
agucuccaaagucucugga

SEQ ID NO: 3045693 - RNA, 17 nt, Human
agugaaagaaaauaaca

SEQ ID NO: 3045694 - RNA, 16 nt, Human
ugugauguauucuagc

SEQ ID NO: 3045695 - RNA, 11 nt, Human
ugugauguguc

SEQ ID NO: 3045696 - RNA, 16 nt, Human
aguccaucagccucca

SEQ ID NO: 3045697 - RNA, 13 nt, Human
aguccaucagccu

SEQ ID NO: 3045698 - RNA, 14 nt, Human
aguccaucagccuc

SEQ ID NO: 3045699 - RNA, 18 nt, Human
ugucuaaauuugaauguu

SEQ ID NO: 3045700 - RNA, 15 nt, Human
ugucuaagauaguaa

SEQ ID NO: 3045701 - RNA, 14 nt, Human
ugucuaagauagua

SEQ ID NO: 3045702 - RNA, 14 nt, Human
aguauguguaaaau

SEQ ID NO: 3045703 - RNA, 21 nt, Human
aguauuuaauucauguugccu

SEQ ID NO: 3045704 - RNA, 22 nt, Human
uguaugugggggucuguguguu

SEQ ID NO: 3045705 - RNA, 21 nt, Human
uguaugugggggucugugugu

SEQ ID NO: 3045706 - RNA, 20 nt, Human
uguaugugggggucugugug

SEQ ID NO: 3045707 - RNA, 22 nt, Human
uguauccauccauggggcugau

SEQ ID NO: 3045708 - RNA, 21 nt, Human
agguuugggaccccugguggu

SEQ ID NO: 3045709 - RNA, 16 nt, Human
agguuugggaccccug

SEQ ID NO: 3045710 - RNA, 11 nt, Human
uguauuaugug

SEQ ID NO: 3045711 - RNA, 15 nt, Human
agggugaaaauuauu

SEQ ID NO: 3045712 - RNA, 13 nt, Human
ugggucugugugu

SEQ ID NO: 3045713 - RNA, 15 nt, Human
ugggucugugugugu

SEQ ID NO: 3045714 - RNA, 21 nt, Human
agggucuugguuccagccugc

SEQ ID NO: 3045715 - RNA, 22 nt, Human
agggucuugguuccagccugcc

SEQ ID NO: 3045716 - RNA, 23 nt, Human
ugggaauaagugccaggauggaa

SEQ ID NO: 3045717 - RNA, 22 nt, Human
ugguccaugggccauaugaaaa

SEQ ID NO: 3045718 - RNA, 16 nt, Human
uggucugggacucucu

SEQ ID NO: 3045719 - RNA, 15 nt, Human
aggucagugcaaaua

SEQ ID NO: 3045720 - RNA, 23 nt, Human
agguagcuuugagguggaagagg

SEQ ID NO: 3045721 - RNA, 18 nt, Human
ugguuuuaguugcaacuu

SEQ ID NO: 3045722 - RNA, 21 nt, Human
ugguguucaaaaaacuuguaa

SEQ ID NO: 3045723 - RNA, 22 nt, Human
ugguguucaaaaaacuuguaaa

SEQ ID NO: 3045724 - RNA, 22 nt, Human
ugguucacucuuggagccugca

SEQ ID NO: 3045725 - RNA, 21 nt, Human
ugguucacucuuggagccugc

SEQ ID NO: 3045726 - RNA, 20 nt, Human
ugguucacucuuggagccug

SEQ ID NO: 3045727 - RNA, 17 nt, Human
ugguucacucuuggagc

SEQ ID NO: 3045728 - RNA, 14 nt, Human
uguacauauaagug

SEQ ID NO: 3045729 - RNA, 15 nt, Human
uguaaggcaaucaug

SEQ ID NO: 3045730 - RNA, 15 nt, Human
uguacuuaacuauuc

SEQ ID NO: 3045731 - RNA, 15 nt, Human
uguacuugcucuuga

SEQ ID NO: 3045732 - RNA, 13 nt, Human
auaaauaaaguuu

SEQ ID NO: 3045733 - RNA, 19 nt, Human
auaaauaaaguuuguugaa

SEQ ID NO: 3045734 - RNA, 12 nt, Human
auaacugugaag

SEQ ID NO: 3045735 - RNA, 18 nt, Human
auaaacuggcagcucagc

SEQ ID NO: 3045736 - RNA, 23 nt, Human
auaaacacucuugaaaaaugcau

SEQ ID NO: 3045737 - RNA, 16 nt, Human
auaaaccucaaaaugu

SEQ ID NO: 3045738 - RNA, 18 nt, Human
auaaacacucuugaaaaa

SEQ ID NO: 3045739 - RNA, 21 nt, Human
auaaguucauacauuguacga

SEQ ID NO: 3045740 - RNA, 15 nt, Human
auaaguucauacauu

SEQ ID NO: 3045741 - RNA, 14 nt, Human
auaaguucauacau

SEQ ID NO: 3045742 - RNA, 13 nt, Human
auaaguucauaca

SEQ ID NO: 3045743 - RNA, 11 nt, Human
auaaguucaua

SEQ ID NO: 3045744 - RNA, 14 nt, Human
auaaugaauacuuu

SEQ ID NO: 3045745 - RNA, 20 nt, Human
auaaucagugugucuaaauu

SEQ ID NO: 3045746 - RNA, 23 nt, Human
uuauacccagaaaguuauugaua

SEQ ID NO: 3045747 - RNA, 19 nt, Human
uuauacccagaaaguuauu

SEQ ID NO: 3045748 - RNA, 18 nt, Human
uuauacccagaaaguuau

SEQ ID NO: 3045749 - RNA, 23 nt, Human
uuauagaguguacuuaacuauuc

SEQ ID NO: 3045750 - RNA, 19 nt, Human
uuauauauauauauauuuc

SEQ ID NO: 3045751 - RNA, 14 nt, Human
auaauuuuaagaaa

SEQ ID NO: 3045752 - RNA, 15 nt, Human
auaauuuuaagaaau

SEQ ID NO: 3045753 - RNA, 21 nt, Human
auaauuuuaagaaaucaaaga

SEQ ID NO: 3045754 - RNA, 13 nt, Human
uuauauaaguauu

SEQ ID NO: 3045755 - RNA, 16 nt, Human
uuauauaaguauucua

SEQ ID NO: 3045756 - RNA, 14 nt, Human
uuauauaaguauuc

SEQ ID NO: 3045757 - RNA, 22 nt, Human
auacauuguacgaagaguauuu

SEQ ID NO: 3045758 - RNA, 21 nt, Human
auacauuguacgaagaguauu

SEQ ID NO: 3045759 - RNA, 14 nt, Human
auacauuguacgaa

SEQ ID NO: 3045760 - RNA, 19 nt, Human
auacauauuuuuguagcac

SEQ ID NO: 3045761 - RNA, 21 nt, Human
auacaguucggugagcuacaa

SEQ ID NO: 3045762 - RNA, 21 nt, Human
auacaggucauauuaauauau

SEQ ID NO: 3045763 - RNA, 15 nt, Human
auacaggucauauua

SEQ ID NO: 3045764 - RNA, 14 nt, Human
uuaucaacauuugu

SEQ ID NO: 3045765 - RNA, 22 nt, Human
uuaucaaagggugaaaauuauu

SEQ ID NO: 3045766 - RNA, 22 nt, Human
uuaucaugugaaaucauucauu

SEQ ID NO: 3045767 - RNA, 18 nt, Human
uuaucaugugaaaucauu

SEQ ID NO: 3045768 - RNA, 20 nt, Human
uuaucaugugaaaucauuca

SEQ ID NO: 3045769 - RNA, 17 nt, Human
uuaucaugugaaaucau

SEQ ID NO: 3045770 - RNA, 18 nt, Human
uguugggagugaggaugu

SEQ ID NO: 3045771 - RNA, 15 nt, Human
aguucuaaauuuugu

SEQ ID NO: 3045772 - RNA, 20 nt, Human
aguucggugagcuacaaaug

SEQ ID NO: 3045773 - RNA, 23 nt, Human
aguuauugauaaguucauacauu

SEQ ID NO: 3045774 - RNA, 22 nt, Human
aguuauugauaaguucauacau

SEQ ID NO: 3045775 - RNA, 21 nt, Human
aguuauugauaaguucauaca

SEQ ID NO: 3045776 - RNA, 19 nt, Human
aguuauugauaaguucaua

SEQ ID NO: 3045777 - RNA, 17 nt, Human
aguuauugauaaguuca

SEQ ID NO: 3045778 - RNA, 20 nt, Human
aguuauuauauuuacaaaug

SEQ ID NO: 3045779 - RNA, 19 nt, Human
aguugcaacuuuguauaaa

SEQ ID NO: 3045780 - RNA, 15 nt, Human
uguuugcaucugaaa

SEQ ID NO: 3045781 - RNA, 20 nt, Human
aguucucuucacucaaggau

SEQ ID NO: 3045782 - RNA, 22 nt, Human
aguugcauagguuuaauaauuu

SEQ ID NO: 3045783 - RNA, 16 nt, Human
aguuucguuuucaaaa

SEQ ID NO: 3045784 - RNA, 15 nt, Human
aguuucguuuucaaa

SEQ ID NO: 3045785 - RNA, 13 nt, Human
ugcuccccacguc

SEQ ID NO: 3045786 - RNA, 18 nt, Human
ugcuauuguagagccaga

SEQ ID NO: 3045787 - RNA, 22 nt, Human
ugcuauuguagagccagagguc

SEQ ID NO: 3045788 - RNA, 11 nt, Human
aggaauuuaaa

SEQ ID NO: 3045789 - RNA, 23 nt, Human
aggaauuguguuuauaauuuuaa

SEQ ID NO: 3045790 - RNA, 16 nt, Human
ugcuucauacagggau

SEQ ID NO: 3045791 - RNA, 15 nt, Human
ugcuucauacaggga

SEQ ID NO: 3045792 - RNA, 14 nt, Human
ugcuucauacaggg

SEQ ID NO: 3045793 - RNA, 11 nt, Human
ugcuucauaca

SEQ ID NO: 3045794 - RNA, 16 nt, Human
uggaccagccucucca

SEQ ID NO: 3045795 - RNA, 22 nt, Human
uggaccagccucuccacucaug

SEQ ID NO: 3045796 - RNA, 22 nt, Human
uggaauuggguggggggcuuca

SEQ ID NO: 3045797 - RNA, 18 nt, Human
aggagcccugggaggcuc

SEQ ID NO: 3045798 - RNA, 19 nt, Human
aggagcccugggaggcucu

SEQ ID NO: 3045799 - RNA, 17 nt, Human
aggccauucuuucccaa

SEQ ID NO: 3045800 - RNA, 18 nt, Human
aggccauucuuucccaac

SEQ ID NO: 3045801 - RNA, 19 nt, Human
aggccauucuuucccaaca

SEQ ID NO: 3045802 - RNA, 12 nt, Human
aggcccaaagcc

SEQ ID NO: 3045803 - RNA, 15 nt, Human
aggcccaaagccucg

SEQ ID NO: 3045804 - RNA, 13 nt, Human
aggcccaaagccu

SEQ ID NO: 3045805 - RNA, 21 nt, Human
aggccucucauuccagaggaa

SEQ ID NO: 3045806 - RNA, 16 nt, Human
uggccaguggcuggau

SEQ ID NO: 3045807 - RNA, 15 nt, Human
uggccaguggcugga

SEQ ID NO: 3045808 - RNA, 14 nt, Human
uggccaguggcugg

SEQ ID NO: 3045809 - RNA, 15 nt, Human
aggccauucuuuccc

SEQ ID NO: 3045810 - RNA, 18 nt, Human
uggacgagaaaacaauaa

SEQ ID NO: 3045811 - RNA, 22 nt, Human
uggaccuuuccugaggaagagg

SEQ ID NO: 3045812 - RNA, 22 nt, Human
uggcugccuugugaaggaauua

SEQ ID NO: 3045813 - RNA, 22 nt, Human
uggcucuugaacugagcuugga

SEQ ID NO: 3045814 - RNA, 16 nt, Human
uggcucuugaacugag

SEQ ID NO: 3045815 - RNA, 16 nt, Human
uggcuaugagggccuu

SEQ ID NO: 3045816 - RNA, 13 nt, Human
aggcucuggagcc

SEQ ID NO: 3045817 - RNA, 14 nt, Human
aggcucuggagccc

SEQ ID NO: 3045818 - RNA, 15 nt, Human
aggcucuggagccca

SEQ ID NO: 3045819 - RNA, 18 nt, Human
aggcucuggagcccacug

SEQ ID NO: 3045820 - RNA, 19 nt, Human
aggcucuggagcccacugu

SEQ ID NO: 3045821 - RNA, 14 nt, Human
aggcugcuuuccaa

SEQ ID NO: 3045822 - RNA, 13 nt, Human
aggcugcuuucca

SEQ ID NO: 3045823 - RNA, 21 nt, Human
aggcugcuuuccaaagccaau

SEQ ID NO: 3045824 - RNA, 19 nt, Human
aggcugcuuuccaaagcca

SEQ ID NO: 3045825 - RNA, 18 nt, Human
aggcugcuuuccaaagcc

SEQ ID NO: 3045826 - RNA, 17 nt, Human
aggcugcuuuccaaagc

SEQ ID NO: 3045827 - RNA, 15 nt, Human
aggcugcuuuccaaa

SEQ ID NO: 3045828 - RNA, 21 nt, Human
ugccucucugcaggucccuaa

SEQ ID NO: 3045829 - RNA, 15 nt, Human
ugccucucugcaggu

SEQ ID NO: 3045830 - RNA, 23 nt, Human
ugccucucugcaggucccuaaua

SEQ ID NO: 3045831 - RNA, 14 nt, Human
agcugccugugccu

SEQ ID NO: 3045832 - RNA, 11 nt, Human
ugccucucugc

SEQ ID NO: 3045833 - RNA, 12 nt, Human
ugccucucugca

SEQ ID NO: 3045834 - RNA, 19 nt, Human
agcuauggugucauaggcu

SEQ ID NO: 3045835 - RNA, 17 nt, Human
agcuaucguaaaauuaa

SEQ ID NO: 3045836 - RNA, 21 nt, Human
agcggcuggacuuggagguag

SEQ ID NO: 3045837 - RNA, 17 nt, Human
agcggcuggacuuggag

SEQ ID NO: 3045838 - RNA, 14 nt, Human
agcccacuguacuu

SEQ ID NO: 3045839 - RNA, 16 nt, Human
agcccacuguacuugc

SEQ ID NO: 3045840 - RNA, 15 nt, Human
agccacgguguucug

SEQ ID NO: 3045841 - RNA, 14 nt, Human
ugaugggauuuggu

SEQ ID NO: 3045842 - RNA, 13 nt, Human
uugucacgccaga

SEQ ID NO: 3045843 - RNA, 20 nt, Human
uugucacgccagacuuccca

SEQ ID NO: 3045844 - RNA, 22 nt, Human
uuguccucagccccgcguggaa

SEQ ID NO: 3045845 - RNA, 18 nt, Human
uugucccugaagagaagg

SEQ ID NO: 3045846 - RNA, 13 nt, Human
uugugaaauuauu

SEQ ID NO: 3045847 - RNA, 19 nt, Human
augacauaaaaacaacuuu

SEQ ID NO: 3045848 - RNA, 17 nt, Human
uugugaagguggaaaua

SEQ ID NO: 3045849 - RNA, 18 nt, Human
uugugaagguggaaauaa

SEQ ID NO: 3045850 - RNA, 16 nt, Human
uugugugugggagugu

SEQ ID NO: 3045851 - RNA, 13 nt, Human
uugugugugggag

SEQ ID NO: 3045852 - RNA, 10 nt, Human
uugugugugg

SEQ ID NO: 3045853 - RNA, 22 nt, Human
augcaaacuuuauuuuguguuu

SEQ ID NO: 3045854 - RNA, 12 nt, Human
uuguaaugaaaa

SEQ ID NO: 3045855 - RNA, 13 nt, Human
uuguaaugaaaac

SEQ ID NO: 3045856 - RNA, 22 nt, Human
uuguaagcaugcacaaauucug

SEQ ID NO: 3045857 - RNA, 20 nt, Human
uugcuaugagcuggggaugu

SEQ ID NO: 3045858 - RNA, 16 nt, Human
uugcuuuuaaaaucca

SEQ ID NO: 3045859 - RNA, 17 nt, Human
uuugaaacacuuugcau

SEQ ID NO: 3045860 - RNA, 19 nt, Human
uuugaaacacuuugcauaa

SEQ ID NO: 3045861 - RNA, 15 nt, Human
uuucauaugcuguau

SEQ ID NO: 3045862 - RNA, 22 nt, Human
uuucagaaaauauuauguguuu

SEQ ID NO: 3045863 - RNA, 12 nt, Human
uuucauaaagca

SEQ ID NO: 3045864 - RNA, 17 nt, Human
uuuauuuuuuucugaau

SEQ ID NO: 3045865 - RNA, 19 nt, Human
augcuguauauccuuucua

SEQ ID NO: 3045866 - RNA, 17 nt, Human
uuuaaaggcccuaucug

SEQ ID NO: 3045867 - RNA, 15 nt, Human
uuuaugugaaacaug

SEQ ID NO: 3045868 - RNA, 14 nt, Human
uuuaugugaaacau

SEQ ID NO: 3045869 - RNA, 18 nt, Human
aucggggagccgggagcc

SEQ ID NO: 3045870 - RNA, 12 nt, Human
aucguaaaauua

SEQ ID NO: 3045871 - RNA, 16 nt, Human
aucggggagccgggag

SEQ ID NO: 3045872 - RNA, 17 nt, Human
aucguaaaauuaagaaa

SEQ ID NO: 3045873 - RNA, 13 nt, Human
aucguaaaauuaa

SEQ ID NO: 3045874 - RNA, 14 nt, Human
aucguaaaauuaag

SEQ ID NO: 3045875 - RNA, 16 nt, Human
uugauaaguucauaca

SEQ ID NO: 3045876 - RNA, 17 nt, Human
uugauaaguucauacau

SEQ ID NO: 3045877 - RNA, 14 nt, Human
uugagaguucuaaa

SEQ ID NO: 3045878 - RNA, 17 nt, Human
uugaaggaaaaugauac

SEQ ID NO: 3045879 - RNA, 17 nt, Human
uugaagggaaauuucag

SEQ ID NO: 3045880 - RNA, 19 nt, Human
aucauugugaaauuauuca

SEQ ID NO: 3045881 - RNA, 13 nt, Human
aucauugugaaau

SEQ ID NO: 3045882 - RNA, 15 nt, Human
aucauugugaaauua

SEQ ID NO: 3045883 - RNA, 20 nt, Human
aucauuaucagccugugcca

SEQ ID NO: 3045884 - RNA, 23 nt, Human
aucagugugucuaaauuugaaug

SEQ ID NO: 3045885 - RNA, 20 nt, Human
auccauggggcugauuguau

SEQ ID NO: 3045886 - RNA, 16 nt, Human
auccaagcaaauguga

SEQ ID NO: 3045887 - RNA, 22 nt, Human
uucuuaaccagaucauugugaa

SEQ ID NO: 3045888 - RNA, 20 nt, Human
uuccuaaauauauuuuaaga

SEQ ID NO: 3045889 - RNA, 21 nt, Human
uuccuaaauauauuuuaagac

SEQ ID NO: 3045890 - RNA, 21 nt, Human
auauuugaauguaugcuucau

SEQ ID NO: 3045891 - RNA, 15 nt, Human
uucccuuuuuuuaag

SEQ ID NO: 3045892 - RNA, 23 nt, Human
auauuuuuguagcacugacagau

SEQ ID NO: 3045893 - RNA, 16 nt, Human
auauuuuuguagcacu

SEQ ID NO: 3045894 - RNA, 15 nt, Human
auauuuuuguagcac

SEQ ID NO: 3045895 - RNA, 18 nt, Human
auauuuuucacauaucua

SEQ ID NO: 3045896 - RNA, 16 nt, Human
auauguuucaaacuuu

SEQ ID NO: 3045897 - RNA, 14 nt, Human
auauguuucaaacu

SEQ ID NO: 3045898 - RNA, 13 nt, Human
auauguuucaaac

SEQ ID NO: 3045899 - RNA, 16 nt, Human
auauguucugacauaa

SEQ ID NO: 3045900 - RNA, 17 nt, Human
uucccagugaauucuug

SEQ ID NO: 3045901 - RNA, 22 nt, Human
auauuuaaaggcccuaucuguu

SEQ ID NO: 3045902 - RNA, 12 nt, Human
auauuuaaugau

SEQ ID NO: 3045903 - RNA, 13 nt, Human
auauuuaaugaua

SEQ ID NO: 3045904 - RNA, 23 nt, Human
auauuuaaugauaaguaaaugcu

SEQ ID NO: 3045905 - RNA, 13 nt, Human
auauuuacaaaug

SEQ ID NO: 3045906 - RNA, 16 nt, Human
auauauuuaaugauaa

SEQ ID NO: 3045907 - RNA, 9 nt, Human
auauauuuc

SEQ ID NO: 3045908 - RNA, 15 nt, Human
auauauuuuaagacg

SEQ ID NO: 3045909 - RNA, 13 nt, Human
auauaugcuaagu

SEQ ID NO: 3045910 - RNA, 16 nt, Human
uucagauuugccuuau

SEQ ID NO: 3045911 - RNA, 22 nt, Human
auaugagcuuccuucugugaaa

SEQ ID NO: 3045912 - RNA, 21 nt, Human
auaugagcuuccuucugugaa

SEQ ID NO: 3045913 - RNA, 20 nt, Human
auuucccuuccuuccucucc

SEQ ID NO: 3045914 - RNA, 17 nt, Human
auuuauaaaaauaaaaa

SEQ ID NO: 3045915 - RNA, 22 nt, Human
auuuauaaaaauaaaaaacacu

SEQ ID NO: 3045916 - RNA, 20 nt, Human
auuuaguaucuuuuuauuca

SEQ ID NO: 3045917 - RNA, 13 nt, Human
auuuaguguucau

SEQ ID NO: 3045918 - RNA, 15 nt, Human
auugugauguguccu

SEQ ID NO: 3045919 - RNA, 14 nt, Human
auugugaugugucc

SEQ ID NO: 3045920 - RNA, 13 nt, Human
auugugauguguc

SEQ ID NO: 3045921 - RNA, 15 nt, Human
auuguauuacaaauc

SEQ ID NO: 3045922 - RNA, 12 nt, Human
auugguguugac

SEQ ID NO: 3045923 - RNA, 13 nt, Human
auuguauucagag

SEQ ID NO: 3045924 - RNA, 24 nt, Human
auucugucucuggauuauauuaug

SEQ ID NO: 3045925 - RNA, 16 nt, Human
auugggccccugccag

SEQ ID NO: 3045926 - RNA, 15 nt, Human
auugggccccugcca

SEQ ID NO: 3045927 - RNA, 22 nt, Human
auuggguggggggcuucauaca

SEQ ID NO: 3045928 - RNA, 21 nt, Human
auuggguggggggcuucauac

SEQ ID NO: 3045929 - RNA, 20 nt, Human
auuggguggggggcuucaua

SEQ ID NO: 3045930 - RNA, 23 nt, Human
auuugugaagguggaaauaaacu

SEQ ID NO: 3045931 - RNA, 22 nt, Human
auuuucaguuauuauauuuaca

SEQ ID NO: 3045932 - RNA, 14 nt, Human
auuuucagaaaaua

SEQ ID NO: 3045933 - RNA, 17 nt, Human
auuuucagaaaauauua

SEQ ID NO: 3045934 - RNA, 21 nt, Human
auuuuauuuuuuucugaauua

SEQ ID NO: 3045935 - RNA, 16 nt, Human
uuuuguuuaccagaga

SEQ ID NO: 3045936 - RNA, 17 nt, Human
uuuuguucauacauauu

SEQ ID NO: 3045937 - RNA, 14 nt, Human
uuuuguucauacau

SEQ ID NO: 3045938 - RNA, 12 nt, Human
uuuuuaucaugu

SEQ ID NO: 3045939 - RNA, 14 nt, Human
uuuugaguucuaca

SEQ ID NO: 3045940 - RNA, 19 nt, Human
uuuuugugaaaagcuccau

SEQ ID NO: 3045941 - RNA, 17 nt, Human
auuauauaaguauucua

SEQ ID NO: 3045942 - RNA, 14 nt, Human
auuauauaaguauu

SEQ ID NO: 3045943 - RNA, 20 nt, Human
auuauauaaguauucuaaau

SEQ ID NO: 3045944 - RNA, 14 nt, Human
uuuuaauaaacacu

SEQ ID NO: 3045945 - RNA, 13 nt, Human
auguggaagugug

SEQ ID NO: 3045946 - RNA, 16 nt, Human
auguggaagugugggu

SEQ ID NO: 3045947 - RNA, 15 nt, Human
auguggaaguguggg

SEQ ID NO: 3045948 - RNA, 23 nt, Human
auguggaagugugggucugugug

SEQ ID NO: 3045949 - RNA, 22 nt, Human
auguggaagugugggucugugu

SEQ ID NO: 3045950 - RNA, 10 nt, Human
augugugugu

SEQ ID NO: 3045951 - RNA, 15 nt, Human
auguguguuuuaaaa

SEQ ID NO: 3045952 - RNA, 23 nt, Human
auguguguuuuaaaaugagaaau

SEQ ID NO: 3045953 - RNA, 15 nt, Human
auguugcauagaaua

SEQ ID NO: 3045954 - RNA, 17 nt, Human
auguugcauagaauaaa

SEQ ID NO: 3045955 - RNA, 18 nt, Human
auguugcauagaauaaaa

SEQ ID NO: 3045956 - RNA, 20 nt, Human
auguugcccuguugcugccu

SEQ ID NO: 3045957 - RNA, 15 nt, Human
uuuuccaaaauaauu

SEQ ID NO: 3045958 - RNA, 17 nt, Human
auguuuaguaaucauau

SEQ ID NO: 3045959 - RNA, 17 nt, Human
auucagaguugaugguu

SEQ ID NO: 3045960 - RNA, 12 nt, Human
accccgacuuuu

SEQ ID NO: 3045961 - RNA, 15 nt, Human
accccgacuuuuguu

SEQ ID NO: 3045962 - RNA, 15 nt, Human
acagguuagcugcuc

SEQ ID NO: 3045963 - RNA, 18 nt, Human
acagguuugggaccccug

SEQ ID NO: 3045964 - RNA, 15 nt, Human
acagguuugggaccc

SEQ ID NO: 3045965 - RNA, 20 nt, Human
accaagccuggucagcccaa

SEQ ID NO: 3045966 - RNA, 19 nt, Human
accaagccuggucagccca

SEQ ID NO: 3045967 - RNA, 20 nt, Human
aauuuugaguucuacauaag

SEQ ID NO: 3045968 - RNA, 15 nt, Human
aauuuuauaucuugu

SEQ ID NO: 3045969 - RNA, 13 nt, Human
aauuuugaaaaac

SEQ ID NO: 3045970 - RNA, 14 nt, Human
acaacuuuauaccc

SEQ ID NO: 3045971 - RNA, 13 nt, Human
acaacuuuauacc

SEQ ID NO: 3045972 - RNA, 18 nt, Human
acaacuucccagugaauu

SEQ ID NO: 3045973 - RNA, 17 nt, Human
acaacuucaauauccaa

SEQ ID NO: 3045974 - RNA, 16 nt, Human
acaacuauuuuuccaa

SEQ ID NO: 3045975 - RNA, 15 nt, Human
acaggggcaggagga

SEQ ID NO: 3045976 - RNA, 19 nt, Human
acaggucauauuaauauau

SEQ ID NO: 3045977 - RNA, 21 nt, Human
acagaauauguuucaaacuuu

SEQ ID NO: 3045978 - RNA, 19 nt, Human
acagaauauguuucaaacu

SEQ ID NO: 3045979 - RNA, 17 nt, Human
acagaauauguuucaaa

SEQ ID NO: 3045980 - RNA, 16 nt, Human
acagaauauguuucaa

SEQ ID NO: 3045981 - RNA, 15 nt, Human
acacugauccagccc

SEQ ID NO: 3045982 - RNA, 16 nt, Human
acgccagacuucccac

SEQ ID NO: 3045983 - RNA, 22 nt, Human
acgccagacuucccacggcucc

SEQ ID NO: 3045984 - RNA, 12 nt, Human
acuccccuccuu

SEQ ID NO: 3045985 - RNA, 21 nt, Human
acucauaaaaagccugcaauu

SEQ ID NO: 3045986 - RNA, 17 nt, Human
acucaggcccaaagccu

SEQ ID NO: 3045987 - RNA, 13 nt, Human
acucagucuuuaa

SEQ ID NO: 3045988 - RNA, 14 nt, Human
acuagcuauggugu

SEQ ID NO: 3045989 - RNA, 23 nt, Human
agaaaauauuauguguuuccaua

SEQ ID NO: 3045990 - RNA, 13 nt, Human
acuuuagggaagu

SEQ ID NO: 3045991 - RNA, 23 nt, Human
acuuuagggaaguacuuuuggca

SEQ ID NO: 3045992 - RNA, 19 nt, Human
acuuuauacccagaaaguu

SEQ ID NO: 3045993 - RNA, 22 nt, Human
acuucugccagcauaauacuug

SEQ ID NO: 3045994 - RNA, 18 nt, Human
acuuguaaaggaauuuaa

SEQ ID NO: 3045995 - RNA, 20 nt, Human
acuuguaaaggaauuuaaaa

SEQ ID NO: 3045996 - RNA, 19 nt, Human
acuuguaaaggaauuuaaa

SEQ ID NO: 3045997 - RNA, 12 nt, Human
acuguuuugaau

SEQ ID NO: 3045998 - RNA, 12 nt, Human
aaagaaaacuug

SEQ ID NO: 3045999 - RNA, 20 nt, Human
aaagaaaacuuguauuaugu

SEQ ID NO: 3046000 - RNA, 13 nt, Human
aaagaaauuaugu

SEQ ID NO: 3046001 - RNA, 11 nt, Human
aaagaacaucc

SEQ ID NO: 3046002 - RNA, 15 nt, Human
aaagaaauuaugugc

SEQ ID NO: 3046003 - RNA, 17 nt, Human
aaagaguacucuuguuu

SEQ ID NO: 3046004 - RNA, 12 nt, Human
aaagaguacucu

SEQ ID NO: 3046005 - RNA, 14 nt, Human
aaacacucuugaaa

SEQ ID NO: 3046006 - RNA, 17 nt, Human
aaacacucuugaaaaau

SEQ ID NO: 3046007 - RNA, 13 nt, Human
aaacacucuugaa

SEQ ID NO: 3046008 - RNA, 21 nt, Human
aaaauuauuuuguucauacau

SEQ ID NO: 3046009 - RNA, 14 nt, Human
aaauaguauuugag

SEQ ID NO: 3046010 - RNA, 12 nt, Human
aaauaacaauga

SEQ ID NO: 3046011 - RNA, 13 nt, Human
aaauaaaggaacc

SEQ ID NO: 3046012 - RNA, 20 nt, Human
aaagucucuggaauuugaaa

SEQ ID NO: 3046013 - RNA, 22 nt, Human
aaagucucuggaauuugaaaca

SEQ ID NO: 3046014 - RNA, 19 nt, Human
aaagucucuggaauuugaa

SEQ ID NO: 3046015 - RNA, 16 nt, Human
aaagggacugagaaau

SEQ ID NO: 3046016 - RNA, 16 nt, Human
aacuuuggaacaagau

SEQ ID NO: 3046017 - RNA, 14 nt, Human
aaccagaucauugu

SEQ ID NO: 3046018 - RNA, 12 nt, Human
aaccagaucauu

SEQ ID NO: 3046019 - RNA, 13 nt, Human
aacaugauuuggg

SEQ ID NO: 3046020 - RNA, 15 nt, Human
aacaaagaaauuaug

SEQ ID NO: 3046021 - RNA, 17 nt, Human
aacaaagaaauuaugug

SEQ ID NO: 3046022 - RNA, 21 nt, Human
aaauugauguguuuauuuaua

SEQ ID NO: 3046023 - RNA, 14 nt, Human
aauauuauguguuu

SEQ ID NO: 3046024 - RNA, 21 nt, Human
aaugauaaguaaaugcuaggu

SEQ ID NO: 3046025 - RNA, 18 nt, Human
aaugauaaguaaaugcua

SEQ ID NO: 3046026 - RNA, 18 nt, Human
aaucucauaauuuauaca

SEQ ID NO: 3046027 - RNA, 14 nt, Human
aauuaaauuuugag

SEQ ID NO: 3046028 - RNA, 22 nt, Human
aauuaaauuuugaguucuacau

SEQ ID NO: 3046029 - RNA, 22 nt, Human
aaugucaguauguggaagugug

SEQ ID NO: 3046030 - RNA, 16 nt, Human
aaugucaguaugugga

SEQ ID NO: 3046031 - RNA, 22 nt, Human
aagaaauuaugugccagauuua

SEQ ID NO: 3046032 - RNA, 13 nt, Human
aagaaauuaugug

SEQ ID NO: 3046033 - RNA, 17 nt, Human
aauaagugccaggaugg

SEQ ID NO: 3046034 - RNA, 18 nt, Human
aauaaacuggcagcucag

SEQ ID NO: 3046035 - RNA, 19 nt, Human
aauaaacuauuuguaaagu

SEQ ID NO: 3046036 - RNA, 12 nt, Human
aauaauguaaga

SEQ ID NO: 3046037 - RNA, 19 nt, Human
aauaauguaagacaaauau

SEQ ID NO: 3046038 - RNA, 21 nt, Human
aauaauccuaaacauaugaau

SEQ ID NO: 3046039 - RNA, 13 nt, Human
aauaaucauugga

SEQ ID NO: 3046040 - RNA, 23 nt, Human
aaguccaggcuuuuuuaucaugu

SEQ ID NO: 3046041 - RNA, 18 nt, Human
aaguauguguaaaaugug

SEQ ID NO: 3046042 - RNA, 14 nt, Human
aaguacuuuuggca

SEQ ID NO: 3046043 - RNA, 15 nt, Human
aaguacuuuuggcau

SEQ ID NO: 3046044 - RNA, 19 nt, Human
aagucucuggaauuugaaa

SEQ ID NO: 3046045 - RNA, 17 nt, Human
aggggccgggggcaguc

SEQ ID NO: 3046046 - RNA, 17 nt, Human
aggucccuaauaaagcu

SEQ ID NO: 3046047 - RNA, 18 nt, Human
aggucccuaauaaagcug

SEQ ID NO: 3046048 - RNA, 19 nt, Human
aggucccuaauaaagcugu

SEQ ID NO: 3046049 - RNA, 20 nt, Human
aggucccuaauaaagcugug

SEQ ID NO: 3046050 - RNA, 21 nt, Human
aggugcuucuaguucugccag

SEQ ID NO: 3046051 - RNA, 22 nt, Human
aggugcuucuaguucugccagg

SEQ ID NO: 3046052 - RNA, 15 nt, Human
agguggaaauaaacu

SEQ ID NO: 3046053 - RNA, 23 nt, Human
aggugcuucuaguucugccagga

SEQ ID NO: 3046054 - RNA, 16 nt, Human
agguggaagagggcug

SEQ ID NO: 3046055 - RNA, 17 nt, Human
agguucaugcaaacuuu

SEQ ID NO: 3046056 - RNA, 23 nt, Human
agguggcaucagugucuuuccac

SEQ ID NO: 3046057 - RNA, 22 nt, Human
agguggcaucagugucuuucca

SEQ ID NO: 3046058 - RNA, 15 nt, Human
agguuaauuccaauu

SEQ ID NO: 3046059 - RNA, 22 nt, Human
agguuaauuccaauuauaugag

SEQ ID NO: 3046060 - RNA, 19 nt, Human
aggcuauggggauagaugu

SEQ ID NO: 3046061 - RNA, 22 nt, Human
aggcuauggggauagaugugug

SEQ ID NO: 3046062 - RNA, 21 nt, Human
aggcuauggggauagaugugu

SEQ ID NO: 3046063 - RNA, 18 nt, Human
aggcugcagccaggccac

SEQ ID NO: 3046064 - RNA, 19 nt, Human
agcuuccuucugugaaagu

SEQ ID NO: 3046065 - RNA, 18 nt, Human
agcuucacuguaaaauaa

SEQ ID NO: 3046066 - RNA, 21 nt, Human
agcuuuuaugugaaacauguu

SEQ ID NO: 3046067 - RNA, 15 nt, Human
agcuuuucccuuuuu

SEQ ID NO: 3046068 - RNA, 20 nt, Human
aggaaauggcuguggagugu

SEQ ID NO: 3046069 - RNA, 15 nt, Human
aggaacuacugagga

SEQ ID NO: 3046070 - RNA, 14 nt, Human
agacgggcccuggu

SEQ ID NO: 3046071 - RNA, 14 nt, Human
agacacaacuauuu

SEQ ID NO: 3046072 - RNA, 16 nt, Human
agaggguguccugcac

SEQ ID NO: 3046073 - RNA, 18 nt, Human
agaggggaaaagagauga

SEQ ID NO: 3046074 - RNA, 16 nt, Human
agaggggaaaagagau

SEQ ID NO: 3046075 - RNA, 21 nt, Human
agauaggucagugcaaauacu

SEQ ID NO: 3046076 - RNA, 13 nt, Human
agccagaggucug

SEQ ID NO: 3046077 - RNA, 14 nt, Human
agcaugcacaaauu

SEQ ID NO: 3046078 - RNA, 20 nt, Human
augaaacacucaguuguuca

SEQ ID NO: 3046079 - RNA, 22 nt, Human
augaaaaaauauauaucaaaua

SEQ ID NO: 3046080 - RNA, 14 nt, Human
augaaaaaauauau

SEQ ID NO: 3046081 - RNA, 17 nt, Human
augaaaaaauauauauc

SEQ ID NO: 3046082 - RNA, 18 nt, Human
augaagcuuuuaugugaa

SEQ ID NO: 3046083 - RNA, 19 nt, Human
augaagcuuuuaugugaaa

SEQ ID NO: 3046084 - RNA, 20 nt, Human
augaagcuuuuaugugaaac

SEQ ID NO: 3046085 - RNA, 21 nt, Human
augaagcuuuuaugugaaaca

SEQ ID NO: 3046086 - RNA, 14 nt, Human
augacucagaauau

SEQ ID NO: 3046087 - RNA, 22 nt, Human
aucuuauaauuuaaaauaugcu

SEQ ID NO: 3046088 - RNA, 13 nt, Human
auccuuucuaaca

SEQ ID NO: 3046089 - RNA, 17 nt, Human
auguaauaacugugaag

SEQ ID NO: 3046090 - RNA, 23 nt, Human
auggugacuuuugaaaagaggug

SEQ ID NO: 3046091 - RNA, 16 nt, Human
augugggggucugugu

SEQ ID NO: 3046092 - RNA, 18 nt, Human
augugggggucugugugu

SEQ ID NO: 3046093 - RNA, 17 nt, Human
augugggggucugugug

SEQ ID NO: 3046094 - RNA, 18 nt, Human
auguuucuuuguaaugaa

SEQ ID NO: 3046095 - RNA, 21 nt, Human
augccuuuguacuuuagggaa

SEQ ID NO: 3046096 - RNA, 23 nt, Human
aguuguaucagcacguguggccu

SEQ ID NO: 3046097 - RNA, 20 nt, Human
aguuguaucagcacgugugg

SEQ ID NO: 3046098 - RNA, 16 nt, Human
agugucuuuccacucc

SEQ ID NO: 3046099 - RNA, 19 nt, Human
auaaguguguguuuuucau

SEQ ID NO: 3046100 - RNA, 22 nt, Human
auaaguguguguuuuucauaaa

SEQ ID NO: 3046101 - RNA, 19 nt, Human
auaaguauuuaauucaugu

SEQ ID NO: 3046102 - RNA, 18 nt, Human
auauuuaguguucauaaa

SEQ ID NO: 3046103 - RNA, 16 nt, Human
auauuuauaaaaauaa

SEQ ID NO: 3046104 - RNA, 15 nt, Human
auauccuuucuaaca

SEQ ID NO: 3046105 - RNA, 16 nt, Human
auauccuuucuaacaa

SEQ ID NO: 3046106 - RNA, 15 nt, Human
auacuugaaaauuaa

SEQ ID NO: 3046107 - RNA, 16 nt, Human
auacuugaaaauuaac

SEQ ID NO: 3046108 - RNA, 15 nt, Human
auauaagugauugcu

SEQ ID NO: 3046109 - RNA, 22 nt, Human
auauaaguauucuaaauuuuau

SEQ ID NO: 3046110 - RNA, 15 nt, Human
auauaaguguguguu

SEQ ID NO: 3046111 - RNA, 12 nt, Human
aaaaacaacuuu

SEQ ID NO: 3046112 - RNA, 12 nt, Human
aaaacaacuuua

SEQ ID NO: 3046113 - RNA, 16 nt, Human
cacucaugugacucuu

SEQ ID NO: 3046114 - RNA, 22 nt, Human
cacucaugugacucuuuccaac

SEQ ID NO: 3046115 - RNA, 13 nt, Human
cacuccuccuagc

SEQ ID NO: 3046116 - RNA, 18 nt, Human
cacuccuccuagccaccc

SEQ ID NO: 3046117 - RNA, 16 nt, Human
cacuaacaugauuugg

SEQ ID NO: 3046118 - RNA, 20 nt, Human
cacggcuccucgagauccca

SEQ ID NO: 3046119 - RNA, 22 nt, Human
cacggcuccucgagaucccaac

SEQ ID NO: 3046120 - RNA, 19 nt, Human
cacguaaugaaacuuggau

SEQ ID NO: 3046121 - RNA, 16 nt, Human
cacguaaugaaacuug

SEQ ID NO: 3046122 - RNA, 19 nt, Human
cacguguggccuguucuuc

SEQ ID NO: 3046123 - RNA, 13 nt, Human
cacuaaacaaaga

SEQ ID NO: 3046124 - RNA, 17 nt, Human
cacuggccccugagauc

SEQ ID NO: 3046125 - RNA, 19 nt, Human
cacuguacuugcucuugau

SEQ ID NO: 3046126 - RNA, 15 nt, Human
cacuguacuugcucu

SEQ ID NO: 3046127 - RNA, 18 nt, Human
cacuguacuugcucuuga

SEQ ID NO: 3046128 - RNA, 18 nt, Human
cacugcuaagaauauuug

SEQ ID NO: 3046129 - RNA, 22 nt, Human
cacugacagauuuccauccuag

SEQ ID NO: 3046130 - RNA, 17 nt, Human
cacugacagauuuccau

SEQ ID NO: 3046131 - RNA, 13 nt, Human
cacugacagauuu

SEQ ID NO: 3046132 - RNA, 16 nt, Human
cacugauccagcccug

SEQ ID NO: 3046133 - RNA, 15 nt, Human
cacugauccagcccu

SEQ ID NO: 3046134 - RNA, 14 nt, Human
cacugauccagccc

SEQ ID NO: 3046135 - RNA, 14 nt, Human
caccggggccuggg

SEQ ID NO: 3046136 - RNA, 21 nt, Human
caccggggccugggcaggagg

SEQ ID NO: 3046137 - RNA, 22 nt, Human
caccggggccugggcaggaggg

SEQ ID NO: 3046138 - RNA, 17 nt, Human
caccgccuccuacagcc

SEQ ID NO: 3046139 - RNA, 12 nt, Human
cagacuucccac

SEQ ID NO: 3046140 - RNA, 22 nt, Human
cagacuucccacggcuccucga

SEQ ID NO: 3046141 - RNA, 17 nt, Human
cagagaaaaagggaggg

SEQ ID NO: 3046142 - RNA, 18 nt, Human
cagagaaaaagggagggg

SEQ ID NO: 3046143 - RNA, 12 nt, Human
cagagaaaaagg

SEQ ID NO: 3046144 - RNA, 15 nt, Human
cagacccccuggaga

SEQ ID NO: 3046145 - RNA, 15 nt, Human
cagaaugaggcugcu

SEQ ID NO: 3046146 - RNA, 14 nt, Human
cagaaugaggcugc

SEQ ID NO: 3046147 - RNA, 19 nt, Human
cagaaaauauuauguguuu

SEQ ID NO: 3046148 - RNA, 12 nt, Human
cacuuugcauaa

SEQ ID NO: 3046149 - RNA, 17 nt, Human
cagaaggaucuucaucu

SEQ ID NO: 3046150 - RNA, 11 nt, Human
cagaagcccag

SEQ ID NO: 3046151 - RNA, 14 nt, Human
cagaagcccagaau

SEQ ID NO: 3046152 - RNA, 12 nt, Human
cagaagcccaga

SEQ ID NO: 3046153 - RNA, 23 nt, Human
cagaaccccuggcuccaggccag

SEQ ID NO: 3046154 - RNA, 14 nt, Human
cagagucccugccu

SEQ ID NO: 3046155 - RNA, 18 nt, Human
cagagucccugccuggac

SEQ ID NO: 3046156 - RNA, 23 nt, Human
cagaggcgcaugaauuugugaag

SEQ ID NO: 3046157 - RNA, 22 nt, Human
cagauaaagguucaugcaaacu

SEQ ID NO: 3046158 - RNA, 14 nt, Human
cagauaaucagugu

SEQ ID NO: 3046159 - RNA, 22 nt, Human
cagagcagugggccuggccagc

SEQ ID NO: 3046160 - RNA, 21 nt, Human
cagagcagugggccuggccag

SEQ ID NO: 3046161 - RNA, 20 nt, Human
cagagcagugggccuggcca

SEQ ID NO: 3046162 - RNA, 17 nt, Human
cagagcagugggccugg

SEQ ID NO: 3046163 - RNA, 15 nt, Human
cagagcagugggccu

SEQ ID NO: 3046164 - RNA, 22 nt, Human
cagaggacaguauuugugggga

SEQ ID NO: 3046165 - RNA, 18 nt, Human
cagccuccauccuacccc

SEQ ID NO: 3046166 - RNA, 21 nt, Human
cagccuccauccuacccccug

SEQ ID NO: 3046167 - RNA, 21 nt, Human
cagcccugaguuccuagccac

SEQ ID NO: 3046168 - RNA, 19 nt, Human
cagcccugaguuccuagcc

SEQ ID NO: 3046169 - RNA, 18 nt, Human
cagcccugaguuccuagc

SEQ ID NO: 3046170 - RNA, 18 nt, Human
cagcccucauuggcucuu

SEQ ID NO: 3046171 - RNA, 23 nt, Human
cagccuggcuguggccuaaccug

SEQ ID NO: 3046172 - RNA, 23 nt, Human
cagccucuccacucaugugacuc

SEQ ID NO: 3046173 - RNA, 15 nt, Human
caggaaccgaggcag

SEQ ID NO: 3046174 - RNA, 17 nt, Human
caggaaccgaggcaggg

SEQ ID NO: 3046175 - RNA, 18 nt, Human
caggaaccgaggcaggga

SEQ ID NO: 3046176 - RNA, 21 nt, Human
cagcuggggccaggcuggguc

SEQ ID NO: 3046177 - RNA, 22 nt, Human
cagcuggggccaggcugggucg

SEQ ID NO: 3046178 - RNA, 18 nt, Human
cagcuggggccaggcugg

SEQ ID NO: 3046179 - RNA, 19 nt, Human
cagcuggggccaggcuggg

SEQ ID NO: 3046180 - RNA, 20 nt, Human
cagcuggggccaggcugggu

SEQ ID NO: 3046181 - RNA, 15 nt, Human
cagcauuucccuucc

SEQ ID NO: 3046182 - RNA, 18 nt, Human
cagccaacuauggccugu

SEQ ID NO: 3046183 - RNA, 16 nt, Human
cagcccaccuggcuuu

SEQ ID NO: 3046184 - RNA, 19 nt, Human
cagcccaaaccaccagaag

SEQ ID NO: 3046185 - RNA, 16 nt, Human
cagcccaaaccaccag

SEQ ID NO: 3046186 - RNA, 23 nt, Human
cagcccaaaccaccagaagccca

SEQ ID NO: 3046187 - RNA, 21 nt, Human
cagcccaaaccaccagaagcc

SEQ ID NO: 3046188 - RNA, 20 nt, Human
cagcccaaaccaccagaagc

SEQ ID NO: 3046189 - RNA, 16 nt, Human
cagauggaaugcugug

SEQ ID NO: 3046190 - RNA, 17 nt, Human
cagauggaaugcugugu

SEQ ID NO: 3046191 - RNA, 19 nt, Human
cagauggaaugcuguguua

SEQ ID NO: 3046192 - RNA, 21 nt, Human
cagauggaaugcuguguuaaa

SEQ ID NO: 3046193 - RNA, 23 nt, Human
caggagacagguuagcugcuccc

SEQ ID NO: 3046194 - RNA, 12 nt, Human
caggagaguaga

SEQ ID NO: 3046195 - RNA, 14 nt, Human
caggagucccugcc

SEQ ID NO: 3046196 - RNA, 21 nt, Human
caggagucccugccaucaugu

SEQ ID NO: 3046197 - RNA, 15 nt, Human
caggagucccugcca

SEQ ID NO: 3046198 - RNA, 21 nt, Human
caggagcccugggaggcucug

SEQ ID NO: 3046199 - RNA, 11 nt, Human
caggagcccug

SEQ ID NO: 3046200 - RNA, 14 nt, Human
caggagcccuggga

SEQ ID NO: 3046201 - RNA, 16 nt, Human
caggagcccugggagg

SEQ ID NO: 3046202 - RNA, 18 nt, Human
caggagcccugggaggcu

SEQ ID NO: 3046203 - RNA, 19 nt, Human
caggagcccugggaggcuc

SEQ ID NO: 3046204 - RNA, 19 nt, Human
caggaguuucguuuucaaa

SEQ ID NO: 3046205 - RNA, 20 nt, Human
caggcaucggggagccggga

SEQ ID NO: 3046206 - RNA, 21 nt, Human
caggcaucggggagccgggag

SEQ ID NO: 3046207 - RNA, 22 nt, Human
caggaugaugacuauggaaaga

SEQ ID NO: 3046208 - RNA, 18 nt, Human
caggaugaugacuaugga

SEQ ID NO: 3046209 - RNA, 20 nt, Human
caggaugaugacuauggaaa

SEQ ID NO: 3046210 - RNA, 21 nt, Human
caggcccccagaaccccuggc

SEQ ID NO: 3046211 - RNA, 21 nt, Human
caggccagggggccagucccu

SEQ ID NO: 3046212 - RNA, 15 nt, Human
caggcucagagggug

SEQ ID NO: 3046213 - RNA, 11 nt, Human
caggcucagag

SEQ ID NO: 3046214 - RNA, 23 nt, Human
caggcuuuuuuaucaugugaaau

SEQ ID NO: 3046215 - RNA, 21 nt, Human
caggcugggucgcccuggacu

SEQ ID NO: 3046216 - RNA, 23 nt, Human
caggcugggucgcccuggacugu

SEQ ID NO: 3046217 - RNA, 13 nt, Human
cagggaaggaucc

SEQ ID NO: 3046218 - RNA, 18 nt, Human
cagggaaggaucccauga

SEQ ID NO: 3046219 - RNA, 22 nt, Human
cagggggccagucccugaggca

SEQ ID NO: 3046220 - RNA, 14 nt, Human
caggggcaggagga

SEQ ID NO: 3046221 - RNA, 12 nt, Human
cagugaauucuu

SEQ ID NO: 3046222 - RNA, 20 nt, Human
cagugaaagaaaauaacaau

SEQ ID NO: 3046223 - RNA, 16 nt, Human
cagugaaagaaaauaa

SEQ ID NO: 3046224 - RNA, 22 nt, Human
cagucuuuaaucugagaggcca

SEQ ID NO: 3046225 - RNA, 23 nt, Human
cagucccugaggcagguccccag

SEQ ID NO: 3046226 - RNA, 20 nt, Human
cagucccugaggcagguccc

SEQ ID NO: 3046227 - RNA, 14 nt, Human
cagucccugaggca

SEQ ID NO: 3046228 - RNA, 12 nt, Human
caguauguggaa

SEQ ID NO: 3046229 - RNA, 19 nt, Human
caggucccuaauaaagcug

SEQ ID NO: 3046230 - RNA, 20 nt, Human
caggucccuaauaaagcugu

SEQ ID NO: 3046231 - RNA, 21 nt, Human
caggucccuaauaaagcugug

SEQ ID NO: 3046232 - RNA, 22 nt, Human
caggucccuaauaaagcugugu

SEQ ID NO: 3046233 - RNA, 20 nt, Human
caggucauauuaauauauuu

SEQ ID NO: 3046234 - RNA, 21 nt, Human
caggucauauuaauauauuuc

SEQ ID NO: 3046235 - RNA, 12 nt, Human
cagguccccaga

SEQ ID NO: 3046236 - RNA, 18 nt, Human
cagguccccagcuuuggc

SEQ ID NO: 3046237 - RNA, 13 nt, Human
cagguccccagac

SEQ ID NO: 3046238 - RNA, 11 nt, Human
caggucccuaa

SEQ ID NO: 3046239 - RNA, 12 nt, Human
caggucccuaau

SEQ ID NO: 3046240 - RNA, 13 nt, Human
caggucccuaaua

SEQ ID NO: 3046241 - RNA, 14 nt, Human
caggucccuaauaa

SEQ ID NO: 3046242 - RNA, 15 nt, Human
caggucccuaauaaa

SEQ ID NO: 3046243 - RNA, 16 nt, Human
caggucccuaauaaag

SEQ ID NO: 3046244 - RNA, 17 nt, Human
caggucccuaauaaagc

SEQ ID NO: 3046245 - RNA, 18 nt, Human
caggucccuaauaaagcu

SEQ ID NO: 3046246 - RNA, 12 nt, Human
cagguguucuuc

SEQ ID NO: 3046247 - RNA, 21 nt, Human
cauccagagucccugccugga

SEQ ID NO: 3046248 - RNA, 13 nt, Human
cauccagaguccc

SEQ ID NO: 3046249 - RNA, 17 nt, Human
cauccagagucccugcc

SEQ ID NO: 3046250 - RNA, 18 nt, Human
cauccagagucccugccu

SEQ ID NO: 3046251 - RNA, 20 nt, Human
cauccagagucccugccugg

SEQ ID NO: 3046252 - RNA, 13 nt, Human
caucccuccuggg

SEQ ID NO: 3046253 - RNA, 13 nt, Human
caucauguuuaca

SEQ ID NO: 3046254 - RNA, 21 nt, Human
caucauguuuacagaggacag

SEQ ID NO: 3046255 - RNA, 19 nt, Human
caucauguuuacagaggac

SEQ ID NO: 3046256 - RNA, 16 nt, Human
cauagguuuaauaauu

SEQ ID NO: 3046257 - RNA, 16 nt, Human
cauauaagugauugcu

SEQ ID NO: 3046258 - RNA, 15 nt, Human
cauaucuaguaugaa

SEQ ID NO: 3046259 - RNA, 18 nt, Human
cauaucuaguaugaaauu

SEQ ID NO: 3046260 - RNA, 17 nt, Human
cauaucuaguaugaaau

SEQ ID NO: 3046261 - RNA, 19 nt, Human
cauauuguuacugguacca

SEQ ID NO: 3046262 - RNA, 13 nt, Human
cauauuguuacug

SEQ ID NO: 3046263 - RNA, 21 nt, Human
cauaucuaguaugaaauuaua

SEQ ID NO: 3046264 - RNA, 23 nt, Human
caugagcuccuuaaggcucuuuu

SEQ ID NO: 3046265 - RNA, 19 nt, Human
caugaguuggcugggaaua

SEQ ID NO: 3046266 - RNA, 18 nt, Human
caugagauaauaugcaga

SEQ ID NO: 3046267 - RNA, 15 nt, Human
cauccuacccccugu

SEQ ID NO: 3046268 - RNA, 18 nt, Human
cauccuacccccugugcc

SEQ ID NO: 3046269 - RNA, 16 nt, Human
caucucuuguuuaaau

SEQ ID NO: 3046270 - RNA, 17 nt, Human
caucugacuaugacaua

SEQ ID NO: 3046271 - RNA, 14 nt, Human
cauucuuucccaac

SEQ ID NO: 3046272 - RNA, 12 nt, Human
cauucuuuccca

SEQ ID NO: 3046273 - RNA, 13 nt, Human
cauucuggaauaa

SEQ ID NO: 3046274 - RNA, 14 nt, Human
cauuccagaggaag

SEQ ID NO: 3046275 - RNA, 13 nt, Human
cauuccagaggaa

SEQ ID NO: 3046276 - RNA, 19 nt, Human
cauucauuuucuggguguu

SEQ ID NO: 3046277 - RNA, 17 nt, Human
ccaaaccaccagaagcc

SEQ ID NO: 3046278 - RNA, 23 nt, Human
cauuuuaccuuugacaaagguaa

SEQ ID NO: 3046279 - RNA, 19 nt, Human
cauuguacgaagaguauuu

SEQ ID NO: 3046280 - RNA, 20 nt, Human
cauuguacgaagaguauuuu

SEQ ID NO: 3046281 - RNA, 16 nt, Human
caugugacucuuucca

SEQ ID NO: 3046282 - RNA, 17 nt, Human
caugugacucuuuccaa

SEQ ID NO: 3046283 - RNA, 14 nt, Human
caugugacucuuuc

SEQ ID NO: 3046284 - RNA, 21 nt, Human
cauuaaaaaaucaguuguaca

SEQ ID NO: 3046285 - RNA, 13 nt, Human
cauggcauauuuu

SEQ ID NO: 3046286 - RNA, 19 nt, Human
cauggcauauuuuucacau

SEQ ID NO: 3046287 - RNA, 15 nt, Human
cauggcauauuuuuc

SEQ ID NO: 3046288 - RNA, 23 nt, Human
cauggcauauuuuucacauaucu

SEQ ID NO: 3046289 - RNA, 16 nt, Human
ccagcauuucccuucc

SEQ ID NO: 3046290 - RNA, 21 nt, Human
ccagcauuucccuuccuuccu

SEQ ID NO: 3046291 - RNA, 23 nt, Human
ccagcauaauacuugcuuuggaa

SEQ ID NO: 3046292 - RNA, 18 nt, Human
ccagacccccuggagacu

SEQ ID NO: 3046293 - RNA, 16 nt, Human
ccagacccccuggaga

SEQ ID NO: 3046294 - RNA, 12 nt, Human
ccagacccccug

SEQ ID NO: 3046295 - RNA, 20 nt, Human
ccacuguacuugcucuugau

SEQ ID NO: 3046296 - RNA, 17 nt, Human
ccacuguacuugcucuu

SEQ ID NO: 3046297 - RNA, 18 nt, Human
ccacuguacuugcucuug

SEQ ID NO: 3046298 - RNA, 19 nt, Human
ccacuguacuugcucuuga

SEQ ID NO: 3046299 - RNA, 22 nt, Human
ccagauuuaugcauauuauuuu

SEQ ID NO: 3046300 - RNA, 13 nt, Human
ccagauuuaugca

SEQ ID NO: 3046301 - RNA, 22 nt, Human
ccacucaugugacucuuuccaa

SEQ ID NO: 3046302 - RNA, 19 nt, Human
ccacucaugugacucuuuc

SEQ ID NO: 3046303 - RNA, 20 nt, Human
ccaccugaauaaagaaugaa

SEQ ID NO: 3046304 - RNA, 15 nt, Human
ccacccuccacucuc

SEQ ID NO: 3046305 - RNA, 20 nt, Human
ccaaaccaccagaagcccag

SEQ ID NO: 3046306 - RNA, 21 nt, Human
ccaccaagccuggucagccca

SEQ ID NO: 3046307 - RNA, 22 nt, Human
ccaccaagccuggucagcccaa

SEQ ID NO: 3046308 - RNA, 19 nt, Human
ccacacugauccagcccug

SEQ ID NO: 3046309 - RNA, 22 nt, Human
ccacacugauccagcccugagu

SEQ ID NO: 3046310 - RNA, 18 nt, Human
ccauccuacccccugugc

SEQ ID NO: 3046311 - RNA, 17 nt, Human
ccauccuacccccugug

SEQ ID NO: 3046312 - RNA, 19 nt, Human
cccaaaacaccggguucca

SEQ ID NO: 3046313 - RNA, 21 nt, Human
cccaaaacaccggguuccagc

SEQ ID NO: 3046314 - RNA, 13 nt, Human
ccaggagacaggu

SEQ ID NO: 3046315 - RNA, 19 nt, Human
ccaggccagggggccaguc

SEQ ID NO: 3046316 - RNA, 14 nt, Human
ccugggcaggaggg

SEQ ID NO: 3046317 - RNA, 12 nt, Human
ccugggcaggag

SEQ ID NO: 3046318 - RNA, 12 nt, Human
ccuggucagccc

SEQ ID NO: 3046319 - RNA, 14 nt, Human
ccuggucagcccaa

SEQ ID NO: 3046320 - RNA, 15 nt, Human
ccuggcuccaggcca

SEQ ID NO: 3046321 - RNA, 17 nt, Human
ccuggcuccaggccagg

SEQ ID NO: 3046322 - RNA, 16 nt, Human
ccuggcuccaggccag

SEQ ID NO: 3046323 - RNA, 19 nt, Human
ccuggagacuaaccccacc

SEQ ID NO: 3046324 - RNA, 18 nt, Human
ccugccugguccucacac

SEQ ID NO: 3046325 - RNA, 19 nt, Human
ccugcaauuucauaugcug

SEQ ID NO: 3046326 - RNA, 14 nt, Human
ccugccacucaggc

SEQ ID NO: 3046327 - RNA, 14 nt, Human
ccugccagaccccc

SEQ ID NO: 3046328 - RNA, 23 nt, Human
ccugccacucaggcccaaagccu

SEQ ID NO: 3046329 - RNA, 22 nt, Human
ccugccacucaggcccaaagcc

SEQ ID NO: 3046330 - RNA, 19 nt, Human
ccugaggaagagggacugu

SEQ ID NO: 3046331 - RNA, 22 nt, Human
cgagaucccaacacugccagca

SEQ ID NO: 3046332 - RNA, 15 nt, Human
cgagaucccaacacu

SEQ ID NO: 3046333 - RNA, 21 nt, Human
cgagaucccaacacugccagc

SEQ ID NO: 3046334 - RNA, 13 nt, Human
cgagaucccaaca

SEQ ID NO: 3046335 - RNA, 21 nt, Human
cgaagaguauuuuugacagaa

SEQ ID NO: 3046336 - RNA, 15 nt, Human
ccuugucacgccaga

SEQ ID NO: 3046337 - RNA, 18 nt, Human
ccuugucacgccagacuu

SEQ ID NO: 3046338 - RNA, 15 nt, Human
ccuucugugaaagua

SEQ ID NO: 3046339 - RNA, 13 nt, Human
ccuugaacuagga

SEQ ID NO: 3046340 - RNA, 15 nt, Human
ccuuccaagagccug

SEQ ID NO: 3046341 - RNA, 17 nt, Human
ccuuccaagagccugag

SEQ ID NO: 3046342 - RNA, 16 nt, Human
ccuuccaagagccuga

SEQ ID NO: 3046343 - RNA, 16 nt, Human
ccuuaaggcucuuuug

SEQ ID NO: 3046344 - RNA, 18 nt, Human
ccuuaaggcucuuuugua

SEQ ID NO: 3046345 - RNA, 13 nt, Human
ccuuaaggcucuu

SEQ ID NO: 3046346 - RNA, 12 nt, Human
ccuguuuaagag

SEQ ID NO: 3046347 - RNA, 15 nt, Human
ccuguuuaagagaca

SEQ ID NO: 3046348 - RNA, 20 nt, Human
ccgggacaccuaggcuaggg

SEQ ID NO: 3046349 - RNA, 19 nt, Human
ccgggacaccuaggcuagg

SEQ ID NO: 3046350 - RNA, 15 nt, Human
ccggguuccagcacc

SEQ ID NO: 3046351 - RNA, 12 nt, Human
ccggguuccagc

SEQ ID NO: 3046352 - RNA, 15 nt, Human
ccgaggcagggaagg

SEQ ID NO: 3046353 - RNA, 18 nt, Human
ccuaaauauauuuuaaga

SEQ ID NO: 3046354 - RNA, 16 nt, Human
ccuaaauauauuuuaa

SEQ ID NO: 3046355 - RNA, 18 nt, Human
ccucuccacucaugugac

SEQ ID NO: 3046356 - RNA, 18 nt, Human
ccucucauuccagaggaa

SEQ ID NO: 3046357 - RNA, 21 nt, Human
ccucaucuccccaucauuggu

SEQ ID NO: 3046358 - RNA, 23 nt, Human
cccuccacucuccucuuccaggc

SEQ ID NO: 3046359 - RNA, 13 nt, Human
cccuccaccugcu

SEQ ID NO: 3046360 - RNA, 21 nt, Human
cccugccagacccccuggaga

SEQ ID NO: 3046361 - RNA, 13 nt, Human
cccugccagaccc

SEQ ID NO: 3046362 - RNA, 15 nt, Human
cccuggacugugugc

SEQ ID NO: 3046363 - RNA, 16 nt, Human
cccacaggaggugguc

SEQ ID NO: 3046364 - RNA, 21 nt, Human
cccacaggagguggucuggga

SEQ ID NO: 3046365 - RNA, 17 nt, Human
cccaccacacccucccu

SEQ ID NO: 3046366 - RNA, 14 nt, Human
cuggugguggcucg

SEQ ID NO: 3046367 - RNA, 22 nt, Human
cuggugguggcucgggaggcga

SEQ ID NO: 3046368 - RNA, 23 nt, Human
cuggugguucacucuuggagccu

SEQ ID NO: 3046369 - RNA, 21 nt, Human
cuggugguucacucuuggagc

SEQ ID NO: 3046370 - RNA, 20 nt, Human
cuggugguucacucuuggag

SEQ ID NO: 3046371 - RNA, 12 nt, Human
cuggugguucac

SEQ ID NO: 3046372 - RNA, 19 nt, Human
cugggccccugccucucug

SEQ ID NO: 3046373 - RNA, 20 nt, Human
cugggccccugccucucugc

SEQ ID NO: 3046374 - RNA, 23 nt, Human
cugggccccugccucucugcagg

SEQ ID NO: 3046375 - RNA, 16 nt, Human
cugggggccucuucug

SEQ ID NO: 3046376 - RNA, 13 nt, Human
cugggucgcccug

SEQ ID NO: 3046377 - RNA, 15 nt, Human
cugggucgcccugga

SEQ ID NO: 3046378 - RNA, 18 nt, Human
cuguggccuaaccugccg

SEQ ID NO: 3046379 - RNA, 14 nt, Human
cuguggaucaaauc

SEQ ID NO: 3046380 - RNA, 24 nt, Human
cuguggaucaaauccagccugcug

SEQ ID NO: 3046381 - RNA, 14 nt, Human
cugugugcucagga

SEQ ID NO: 3046382 - RNA, 14 nt, Human
cuguguguguguau

SEQ ID NO: 3046383 - RNA, 16 nt, Human
cuguguguguguaugu

SEQ ID NO: 3046384 - RNA, 15 nt, Human
cuguguguguguaug

SEQ ID NO: 3046385 - RNA, 20 nt, Human
cuguguguuuaugugugugu

SEQ ID NO: 3046386 - RNA, 18 nt, Human
cuguguguuuaugugugu

SEQ ID NO: 3046387 - RNA, 20 nt, Human
cuguguguguguaugugggg

SEQ ID NO: 3046388 - RNA, 18 nt, Human
cuguguguguguaugugg

SEQ ID NO: 3046389 - RNA, 23 nt, Human
cugugcccacccuccacucuccu

SEQ ID NO: 3046390 - RNA, 17 nt, Human
cugugcccacccuccac

SEQ ID NO: 3046391 - RNA, 18 nt, Human
cugugaaaguacauuugg

SEQ ID NO: 3046392 - RNA, 21 nt, Human
cugucuuuuuucuaaaguaaa

SEQ ID NO: 3046393 - RNA, 19 nt, Human
cuuccaaacaggcucagag

SEQ ID NO: 3046394 - RNA, 15 nt, Human
cuuaaggcucuuuug

SEQ ID NO: 3046395 - RNA, 17 nt, Human
cuuaaccagaucauugu

SEQ ID NO: 3046396 - RNA, 19 nt, Human
gaaggaucccaugagcucc

SEQ ID NO: 3046397 - RNA, 14 nt, Human
gaaggaaaaugaua

SEQ ID NO: 3046398 - RNA, 22 nt, Human
gaagccacgguguucugugaua

SEQ ID NO: 3046399 - RNA, 12 nt, Human
gaagcccagaau

SEQ ID NO: 3046400 - RNA, 10 nt, Human
gaagcccaga

SEQ ID NO: 3046401 - RNA, 18 nt, Human
gaagcuuuuaugugaaac

SEQ ID NO: 3046402 - RNA, 17 nt, Human
gaauaaagaaugaaugg

SEQ ID NO: 3046403 - RNA, 12 nt, Human
gaauaaaauuuu

SEQ ID NO: 3046404 - RNA, 16 nt, Human
gaaguuuacauuguaa

SEQ ID NO: 3046405 - RNA, 17 nt, Human
gaaguuuacauuguaaa

SEQ ID NO: 3046406 - RNA, 20 nt, Human
gaauaauccuaaacauauga

SEQ ID NO: 3046407 - RNA, 20 nt, Human
gaauaagugccaggauggaa

SEQ ID NO: 3046408 - RNA, 14 nt, Human
gaauacuuuauaaa

SEQ ID NO: 3046409 - RNA, 14 nt, Human
gaaugccuccugca

SEQ ID NO: 3046410 - RNA, 18 nt, Human
gaaauuguauuacaaauc

SEQ ID NO: 3046411 - RNA, 13 nt, Human
gaacuauuagagc

SEQ ID NO: 3046412 - RNA, 22 nt, Human
gaacucaucuagguaaauuaca

SEQ ID NO: 3046413 - RNA, 21 nt, Human
gaacuuguaaaggaauuuaaa

SEQ ID NO: 3046414 - RNA, 17 nt, Human
cuuucccaacaccucuu

SEQ ID NO: 3046415 - RNA, 19 nt, Human
cuuguguuaaguaugugua

SEQ ID NO: 3046416 - RNA, 18 nt, Human
cuuguaaaggaauuuaaa

SEQ ID NO: 3046417 - RNA, 19 nt, Human
cuuguaaaggaauuuaaaa

SEQ ID NO: 3046418 - RNA, 20 nt, Human
cuuggggacaggggcaggag

SEQ ID NO: 3046419 - RNA, 17 nt, Human
cuuggagguagcuuuga

SEQ ID NO: 3046420 - RNA, 17 nt, Human
gaaaauauuauguguuu

SEQ ID NO: 3046421 - RNA, 19 nt, Human
gaaaaucuuauaauuuaaa

SEQ ID NO: 3046422 - RNA, 19 nt, Human
gaaaauaacgauaaaagac

SEQ ID NO: 3046423 - RNA, 16 nt, Human
gaaacacuuugcauaa

SEQ ID NO: 3046424 - RNA, 20 nt, Human
gaaaaucuuauaauuuaaaa

SEQ ID NO: 3046425 - RNA, 22 nt, Human
gaaaacaauaacgauaaaagac

SEQ ID NO: 3046426 - RNA, 14 nt, Human
cuuuuuucuaaagu

SEQ ID NO: 3046427 - RNA, 20 nt, Human
cuuuuacguccaucucuugu

SEQ ID NO: 3046428 - RNA, 13 nt, Human
cucgagaucccaa

SEQ ID NO: 3046429 - RNA, 21 nt, Human
cucgagaucccaacacugcca

SEQ ID NO: 3046430 - RNA, 22 nt, Human
cucgagaucccaacacugccag

SEQ ID NO: 3046431 - RNA, 23 nt, Human
cucgagaucccaacacugccagc

SEQ ID NO: 3046432 - RNA, 12 nt, Human
cuccuccuagcc

SEQ ID NO: 3046433 - RNA, 13 nt, Human
cuccaccugcucu

SEQ ID NO: 3046434 - RNA, 23 nt, Human
cuccaccaagccuggucagccca

SEQ ID NO: 3046435 - RNA, 21 nt, Human
cuccaaugcuguuaucccugc

SEQ ID NO: 3046436 - RNA, 22 nt, Human
cuagguaaauuacaguuccuag

SEQ ID NO: 3046437 - RNA, 13 nt, Human
cuauaauuuaaau

SEQ ID NO: 3046438 - RNA, 13 nt, Human
cuauggccugugg

SEQ ID NO: 3046439 - RNA, 17 nt, Human
cuaugagggccuugagu

SEQ ID NO: 3046440 - RNA, 15 nt, Human
cuaugagggccuuga

SEQ ID NO: 3046441 - RNA, 16 nt, Human
cuaucuguuuacagug

SEQ ID NO: 3046442 - RNA, 13 nt, Human
cuaugagggccuu

SEQ ID NO: 3046443 - RNA, 14 nt, Human
cuauuguagagcca

SEQ ID NO: 3046444 - RNA, 13 nt, Human
cucacauuuauau

SEQ ID NO: 3046445 - RNA, 20 nt, Human
cucugcccgggagcucagga

SEQ ID NO: 3046446 - RNA, 14 nt, Human
cucugcccgggagc

SEQ ID NO: 3046447 - RNA, 19 nt, Human
cucugcaggucccuaauaa

SEQ ID NO: 3046448 - RNA, 20 nt, Human
cucugcaggucccuaauaaa

SEQ ID NO: 3046449 - RNA, 21 nt, Human
cucugcaggucccuaauaaag

SEQ ID NO: 3046450 - RNA, 18 nt, Human
cucugcaggucccuaaua

SEQ ID NO: 3046451 - RNA, 19 nt, Human
cucuggauuauauuaugaa

SEQ ID NO: 3046452 - RNA, 20 nt, Human
cucuggauuauauuaugaag

SEQ ID NO: 3046453 - RNA, 12 nt, Human
cugaauuauuuu

SEQ ID NO: 3046454 - RNA, 12 nt, Human
cugagcaggugu

SEQ ID NO: 3046455 - RNA, 17 nt, Human
cugccuggaccagccuc

SEQ ID NO: 3046456 - RNA, 15 nt, Human
cugccucucugcagg

SEQ ID NO: 3046457 - RNA, 16 nt, Human
cugccucucugcaggu

SEQ ID NO: 3046458 - RNA, 17 nt, Human
cugccucucugcagguc

SEQ ID NO: 3046459 - RNA, 18 nt, Human
cugccucucugcaggucc

SEQ ID NO: 3046460 - RNA, 23 nt, Human
cugccacucaggcccaaagccuc

SEQ ID NO: 3046461 - RNA, 16 nt, Human
cugccacucaggccca

SEQ ID NO: 3046462 - RNA, 18 nt, Human
cugaguuccuagccaccg

SEQ ID NO: 3046463 - RNA, 17 nt, Human
cugaguuccuagccacc

SEQ ID NO: 3046464 - RNA, 16 nt, Human
cugaguuccuagccac

SEQ ID NO: 3046465 - RNA, 15 nt, Human
cugaguuccuagcca

SEQ ID NO: 3046466 - RNA, 13 nt, Human
cugauuguauuua

SEQ ID NO: 3046467 - RNA, 14 nt, Human
gagucccugccugg

SEQ ID NO: 3046468 - RNA, 15 nt, Human
gagucccugccugga

SEQ ID NO: 3046469 - RNA, 14 nt, Human
gagucccugccauc

SEQ ID NO: 3046470 - RNA, 17 nt, Human
gaguauuuuugacagaa

SEQ ID NO: 3046471 - RNA, 16 nt, Human
gaguauuuuugacaga

SEQ ID NO: 3046472 - RNA, 14 nt, Human
gaguauuuuugaca

SEQ ID NO: 3046473 - RNA, 18 nt, Human
gaguauuuuugacagaau

SEQ ID NO: 3046474 - RNA, 16 nt, Human
gagucccugccuggac

SEQ ID NO: 3046475 - RNA, 19 nt, Human
gagucccugccuggaccag

SEQ ID NO: 3046476 - RNA, 22 nt, Human
gagguuuguuuagaagaagugu

SEQ ID NO: 3046477 - RNA, 21 nt, Human
gauaaucagugugucuaaauu

SEQ ID NO: 3046478 - RNA, 17 nt, Human
gauauaaguguguguuu

SEQ ID NO: 3046479 - RNA, 21 nt, Human
gauauaaguguguguuuuuca

SEQ ID NO: 3046480 - RNA, 13 nt, Human
gaguuccuagcca

SEQ ID NO: 3046481 - RNA, 21 nt, Human
gaguugaaaaucuuauaauuu

SEQ ID NO: 3046482 - RNA, 23 nt, Human
gaucuucaucugacuaugacaua

SEQ ID NO: 3046483 - RNA, 16 nt, Human
gaucuucaucugacua

SEQ ID NO: 3046484 - RNA, 21 nt, Human
gaugccuggcgggguggggug

SEQ ID NO: 3046485 - RNA, 14 nt, Human
gaugacuauggaaa

SEQ ID NO: 3046486 - RNA, 13 nt, Human
gaugcauggagau

SEQ ID NO: 3046487 - RNA, 20 nt, Human
gaugcauggagauagcccca

SEQ ID NO: 3046488 - RNA, 17 nt, Human
gaugcaauguagagggg

SEQ ID NO: 3046489 - RNA, 21 nt, Human
gauguguccugauaagcugag

SEQ ID NO: 3046490 - RNA, 23 nt, Human
gauguggaaaagccaagaggcug

SEQ ID NO: 3046491 - RNA, 21 nt, Human
gauguggaaaagccaagaggc

SEQ ID NO: 3046492 - RNA, 22 nt, Human
gauuaagaucucagugguuaag

SEQ ID NO: 3046493 - RNA, 23 nt, Human
gagcucaggaaccgaggcaggga

SEQ ID NO: 3046494 - RNA, 22 nt, Human
gagcucaggaaccgaggcaggg

SEQ ID NO: 3046495 - RNA, 14 nt, Human
gagcuacaaaugca

SEQ ID NO: 3046496 - RNA, 13 nt, Human
gagcuacaaaugc

SEQ ID NO: 3046497 - RNA, 12 nt, Human
gagcuacaaaug

SEQ ID NO: 3046498 - RNA, 12 nt, Human
gagccugcagag

SEQ ID NO: 3046499 - RNA, 15 nt, Human
gagccugcagagcug

SEQ ID NO: 3046500 - RNA, 13 nt, Human
gagcaaagcugau

SEQ ID NO: 3046501 - RNA, 13 nt, Human
gaggagggcaggc

SEQ ID NO: 3046502 - RNA, 14 nt, Human
gaggagggcaggca

SEQ ID NO: 3046503 - RNA, 15 nt, Human
gaggagggcaggcau

SEQ ID NO: 3046504 - RNA, 15 nt, Human
gaggaugucugggcc

SEQ ID NO: 3046505 - RNA, 21 nt, Human
gccagacuucccacggcuccu

SEQ ID NO: 3046506 - RNA, 16 nt, Human
gccaccugaauaaaga

SEQ ID NO: 3046507 - RNA, 19 nt, Human
gccaccgccuccuacagcc

SEQ ID NO: 3046508 - RNA, 15 nt, Human
gccacgauugcagga

SEQ ID NO: 3046509 - RNA, 20 nt, Human
gccaaugugaacagcggcug

SEQ ID NO: 3046510 - RNA, 23 nt, Human
gcccaaaccaccagaagcccaga

SEQ ID NO: 3046511 - RNA, 22 nt, Human
gcccaaaccaccagaagcccag

SEQ ID NO: 3046512 - RNA, 21 nt, Human
gcccaaaccaccagaagccca

SEQ ID NO: 3046513 - RNA, 13 nt, Human
gccaggcuggguc

SEQ ID NO: 3046514 - RNA, 23 nt, Human
gcaggcaucggggagccgggagc

SEQ ID NO: 3046515 - RNA, 21 nt, Human
gcaggcaucggggagccggga

SEQ ID NO: 3046516 - RNA, 22 nt, Human
gcaggcaucggggagccgggag

SEQ ID NO: 3046517 - RNA, 14 nt, Human
gcaggucccuaaua

SEQ ID NO: 3046518 - RNA, 15 nt, Human
gcaggucccuaauaa

SEQ ID NO: 3046519 - RNA, 17 nt, Human
gcagugggccuggccag

SEQ ID NO: 3046520 - RNA, 15 nt, Human
gcagugggccuggcc

SEQ ID NO: 3046521 - RNA, 16 nt, Human
gcagugggccuggcca

SEQ ID NO: 3046522 - RNA, 23 nt, Human
gcaggucccuaauaaagcugugu

SEQ ID NO: 3046523 - RNA, 20 nt, Human
gcaggucccuaauaaagcug

SEQ ID NO: 3046524 - RNA, 21 nt, Human
gcaggucccuaauaaagcugu

SEQ ID NO: 3046525 - RNA, 16 nt, Human
gcaggucccuaauaaa

SEQ ID NO: 3046526 - RNA, 17 nt, Human
gcaggucccuaauaaag

SEQ ID NO: 3046527 - RNA, 18 nt, Human
gcaggucccuaauaaagc

SEQ ID NO: 3046528 - RNA, 19 nt, Human
gcaggucccuaauaaagcu

SEQ ID NO: 3046529 - RNA, 20 nt, Human
gcaucuagcaugucgucaaa

SEQ ID NO: 3046530 - RNA, 22 nt, Human
gcagauggaaugcuguguuaaa

SEQ ID NO: 3046531 - RNA, 18 nt, Human
gcaggaaauggcugugga

SEQ ID NO: 3046532 - RNA, 17 nt, Human
gcaccacacucagcccu

SEQ ID NO: 3046533 - RNA, 15 nt, Human
gcaccacacucagcc

SEQ ID NO: 3046534 - RNA, 21 nt, Human
gcugggaggagggcaggcauc

SEQ ID NO: 3046535 - RNA, 22 nt, Human
gcugggcuuggcagcccggguc

SEQ ID NO: 3046536 - RNA, 14 nt, Human
gcuggggaugucuc

SEQ ID NO: 3046537 - RNA, 19 nt, Human
gcuguggccuaaccugccg

SEQ ID NO: 3046538 - RNA, 20 nt, Human
gcuguggccuaaccugccga

SEQ ID NO: 3046539 - RNA, 16 nt, Human
gcugugugcucuccaa

SEQ ID NO: 3046540 - RNA, 16 nt, Human
gcuguguggcagucug

SEQ ID NO: 3046541 - RNA, 18 nt, Human
gcuguguuaaauaaaccu

SEQ ID NO: 3046542 - RNA, 11 nt, Human
gcuucauacac

SEQ ID NO: 3046543 - RNA, 10 nt, Human
gcuucauaca

SEQ ID NO: 3046544 - RNA, 12 nt, Human
gcuuguguuaag

SEQ ID NO: 3046545 - RNA, 14 nt, Human
gcuuuccaaagcca

SEQ ID NO: 3046546 - RNA, 13 nt, Human
gcuuuuaugugaa

SEQ ID NO: 3046547 - RNA, 15 nt, Human
gcuuuuaugugaaac

SEQ ID NO: 3046548 - RNA, 14 nt, Human
gcugauuguauuua

SEQ ID NO: 3046549 - RNA, 15 nt, Human
gcucuccaagcccag

SEQ ID NO: 3046550 - RNA, 19 nt, Human
gcucuugaugccuggcggg

SEQ ID NO: 3046551 - RNA, 15 nt, Human
gcuccuuaaggcucu

SEQ ID NO: 3046552 - RNA, 17 nt, Human
gcuccuuaaggcucuuu

SEQ ID NO: 3046553 - RNA, 21 nt, Human
gcuccuuaaggcucuuuugua

SEQ ID NO: 3046554 - RNA, 20 nt, Human
gcuccauuuuuagugaaaua

SEQ ID NO: 3046555 - RNA, 17 nt, Human
gcuccaggccagggggc

SEQ ID NO: 3046556 - RNA, 18 nt, Human
gcuccaggccagggggcc

SEQ ID NO: 3046557 - RNA, 17 nt, Human
gcuaucguaaaauuaag

SEQ ID NO: 3046558 - RNA, 15 nt, Human
gcuaucguaaaauua

SEQ ID NO: 3046559 - RNA, 16 nt, Human
gcuaucguaaaauuaa

SEQ ID NO: 3046560 - RNA, 18 nt, Human
gcucauggacuucugcca

SEQ ID NO: 3046561 - RNA, 16 nt, Human
gccugggcaggaggga

SEQ ID NO: 3046562 - RNA, 13 nt, Human
gccuggucagccc

SEQ ID NO: 3046563 - RNA, 15 nt, Human
gccuggucagcccaa

SEQ ID NO: 3046564 - RNA, 14 nt, Human
gccuggucagccca

SEQ ID NO: 3046565 - RNA, 17 nt, Human
gccuggaccagccucuc

SEQ ID NO: 3046566 - RNA, 16 nt, Human
gccuggaccagccucu

SEQ ID NO: 3046567 - RNA, 17 nt, Human
gcgaagcguuguccuca

SEQ ID NO: 3046568 - RNA, 14 nt, Human
gcgaauuuuaaaag

SEQ ID NO: 3046569 - RNA, 16 nt, Human
gcgaauuuuaaaagau

SEQ ID NO: 3046570 - RNA, 15 nt, Human
gcgaauuuuaaaaga

SEQ ID NO: 3046571 - RNA, 15 nt, Human
gccuugucacgccag

SEQ ID NO: 3046572 - RNA, 16 nt, Human
gccuugucacgccaga

SEQ ID NO: 3046573 - RNA, 17 nt, Human
gccuugucacgccagac

SEQ ID NO: 3046574 - RNA, 12 nt, Human
ggaccagccucu

SEQ ID NO: 3046575 - RNA, 21 nt, Human
gcuuuuaugugaaacauguuu

SEQ ID NO: 3046576 - RNA, 19 nt, Human
gcuuuuaugugaaacaugu

SEQ ID NO: 3046577 - RNA, 20 nt, Human
gcuuuuaugugaaacauguu

SEQ ID NO: 3046578 - RNA, 19 nt, Human
ggagacagguuagcugcuc

SEQ ID NO: 3046579 - RNA, 18 nt, Human
ggacugagaaauuuauaa

SEQ ID NO: 3046580 - RNA, 14 nt, Human
ggacugagaaauuu

SEQ ID NO: 3046581 - RNA, 21 nt, Human
ggagcucaggaaccgaggcag

SEQ ID NO: 3046582 - RNA, 17 nt, Human
ggagccugcagagcugc

SEQ ID NO: 3046583 - RNA, 20 nt, Human
ggagcccugggaggcucugg

SEQ ID NO: 3046584 - RNA, 16 nt, Human
ggagccuacccacccc

SEQ ID NO: 3046585 - RNA, 16 nt, Human
ggagcccugggaggcu

SEQ ID NO: 3046586 - RNA, 19 nt, Human
ggagcccugggaggcucug

SEQ ID NO: 3046587 - RNA, 14 nt, Human
ggagggcaggcauc

SEQ ID NO: 3046588 - RNA, 17 nt, Human
ggaggcaggaguuucgu

SEQ ID NO: 3046589 - RNA, 12 nt, Human
ggauuauauuau

SEQ ID NO: 3046590 - RNA, 16 nt, Human
ggauucugagagcugu

SEQ ID NO: 3046591 - RNA, 18 nt, Human
ggaugaugacuauggaaa

SEQ ID NO: 3046592 - RNA, 21 nt, Human
ggcuguggcauccagaguccc

SEQ ID NO: 3046593 - RNA, 23 nt, Human
ggcuguggcauccagagucccug

SEQ ID NO: 3046594 - RNA, 20 nt, Human
ggcugggaggagggcaggca

SEQ ID NO: 3046595 - RNA, 21 nt, Human
ggcugggaggagggcaggcau

SEQ ID NO: 3046596 - RNA, 13 nt, Human
ggcugggaggagg

SEQ ID NO: 3046597 - RNA, 13 nt, Human
ggcuggacuugga

SEQ ID NO: 3046598 - RNA, 18 nt, Human
ggcuggacuuggagguag

SEQ ID NO: 3046599 - RNA, 23 nt, Human
ggcucuggagcccacuguacuug

SEQ ID NO: 3046600 - RNA, 12 nt, Human
gggagcucagga

SEQ ID NO: 3046601 - RNA, 22 nt, Human
gggagcucaggaaccgaggcag

SEQ ID NO: 3046602 - RNA, 23 nt, Human
gggagcucaggaaccgaggcagg

SEQ ID NO: 3046603 - RNA, 13 nt, Human
gggagccgggagc

SEQ ID NO: 3046604 - RNA, 12 nt, Human
gggaggagggca

SEQ ID NO: 3046605 - RNA, 16 nt, Human
gggaggagggcaggca

SEQ ID NO: 3046606 - RNA, 14 nt, Human
gggacaccuaggcu

SEQ ID NO: 3046607 - RNA, 20 nt, Human
gggacaccaagccuuggcuc

SEQ ID NO: 3046608 - RNA, 15 nt, Human
gggacugagaaauuu

SEQ ID NO: 3046609 - RNA, 19 nt, Human
ggccugggcaggagggagg

SEQ ID NO: 3046610 - RNA, 15 nt, Human
ggccugggcaggagg

SEQ ID NO: 3046611 - RNA, 17 nt, Human
ggccugggcaggaggga

SEQ ID NO: 3046612 - RNA, 16 nt, Human
ggccugacucucagca

SEQ ID NO: 3046613 - RNA, 15 nt, Human
ggccuaaccugccga

SEQ ID NO: 3046614 - RNA, 16 nt, Human
ggccuaaccugccgag

SEQ ID NO: 3046615 - RNA, 21 nt, Human
ggccuaaccugccgagagucc

SEQ ID NO: 3046616 - RNA, 20 nt, Human
ggccucucauuccagaggaa

SEQ ID NO: 3046617 - RNA, 16 nt, Human
ggcucuggagcccacu

SEQ ID NO: 3046618 - RNA, 17 nt, Human
ggcucuggagcccacug

SEQ ID NO: 3046619 - RNA, 19 nt, Human
ggcucuggagcccacugua

SEQ ID NO: 3046620 - RNA, 19 nt, Human
ucagaggguguccugcacc

SEQ ID NO: 3046621 - RNA, 21 nt, Human
ucagaguaauccaagcaaaug

SEQ ID NO: 3046622 - RNA, 22 nt, Human
ucagaguaauccaagcaaaugu

SEQ ID NO: 3046623 - RNA, 19 nt, Human
ucacugcuaagaauauuug

SEQ ID NO: 3046624 - RNA, 20 nt, Human
ucaggagcccugggaggcuc

SEQ ID NO: 3046625 - RNA, 23 nt, Human
ucaggagcccugggaggcucugg

SEQ ID NO: 3046626 - RNA, 19 nt, Human
ucaggagcccugggaggcu

SEQ ID NO: 3046627 - RNA, 18 nt, Human
ucaggagcccugggaggc

SEQ ID NO: 3046628 - RNA, 15 nt, Human
uccaaaauaauuuua

SEQ ID NO: 3046629 - RNA, 19 nt, Human
uccaaaauaauuuuaagaa

SEQ ID NO: 3046630 - RNA, 14 nt, Human
uccagguggcauca

SEQ ID NO: 3046631 - RNA, 18 nt, Human
ucaucugacuaugacaua

SEQ ID NO: 3046632 - RNA, 17 nt, Human
ucaucugacuaugacau

SEQ ID NO: 3046633 - RNA, 12 nt, Human
ucauugugaaau

SEQ ID NO: 3046634 - RNA, 15 nt, Human
ucauugugaaauuau

SEQ ID NO: 3046635 - RNA, 17 nt, Human
ucauugugaaauuauuc

SEQ ID NO: 3046636 - RNA, 18 nt, Human
ucauugugaaauuauuca

SEQ ID NO: 3046637 - RNA, 14 nt, Human
ucauuccagaggaa

SEQ ID NO: 3046638 - RNA, 16 nt, Human
uauguugcauagaaua

SEQ ID NO: 3046639 - RNA, 16 nt, Human
uauguuucaaacuuug

SEQ ID NO: 3046640 - RNA, 15 nt, Human
uauguuucaaacuuu

SEQ ID NO: 3046641 - RNA, 13 nt, Human
uauguuucaaacu

SEQ ID NO: 3046642 - RNA, 12 nt, Human
uauguugcauag

SEQ ID NO: 3046643 - RNA, 12 nt, Human
uauuaauauauu

SEQ ID NO: 3046644 - RNA, 24 nt, Human
uauuuauaaaaauaaaaaacacug

SEQ ID NO: 3046645 - RNA, 14 nt, Human
uauuguguugugaa

SEQ ID NO: 3046646 - RNA, 19 nt, Human
uauucuagcuaauguaaua

SEQ ID NO: 3046647 - RNA, 20 nt, Human
uauucuaaauuuuauaucuu

SEQ ID NO: 3046648 - RNA, 19 nt, Human
uauucuaaauuuuauaucu

SEQ ID NO: 3046649 - RNA, 15 nt, Human
uauucuaaauuuuau

SEQ ID NO: 3046650 - RNA, 14 nt, Human
uauucuaaauuuua

SEQ ID NO: 3046651 - RNA, 12 nt, Human
uauucccaugag

SEQ ID NO: 3046652 - RNA, 17 nt, Human
ucaaauuguaagcaugc

SEQ ID NO: 3046653 - RNA, 20 nt, Human
ucaaauuguaagcaugcaca

SEQ ID NO: 3046654 - RNA, 21 nt, Human
ucaaauauauucagccuggcu

SEQ ID NO: 3046655 - RNA, 22 nt, Human
ucaaauauauucagccuggcuu

SEQ ID NO: 3046656 - RNA, 23 nt, Human
ucaaauauauucagccuggcuuc

SEQ ID NO: 3046657 - RNA, 15 nt, Human
ucaaaaaacuuguaa

SEQ ID NO: 3046658 - RNA, 14 nt, Human
ucaaaaaacuugua

SEQ ID NO: 3046659 - RNA, 17 nt, Human
uauuuuauguugcauag

SEQ ID NO: 3046660 - RNA, 22 nt, Human
uauuuuuuucugaauuauuuuc

SEQ ID NO: 3046661 - RNA, 15 nt, Human
ucugccaggagacag

SEQ ID NO: 3046662 - RNA, 22 nt, Human
ucugucucuggauuauauuaug

SEQ ID NO: 3046663 - RNA, 19 nt, Human
ucuucaucugacuaugaca

SEQ ID NO: 3046664 - RNA, 13 nt, Human
ucuugaaaaaugc

SEQ ID NO: 3046665 - RNA, 16 nt, Human
ucuuaaccagaucauu

SEQ ID NO: 3046666 - RNA, 17 nt, Human
ucuuaaccagaucauug

SEQ ID NO: 3046667 - RNA, 22 nt, Human
ucuuaaccagaucauugugaaa

SEQ ID NO: 3046668 - RNA, 15 nt, Human
ucugacauaaguauu

SEQ ID NO: 3046669 - RNA, 14 nt, Human
ucugaaaauugaug

SEQ ID NO: 3046670 - RNA, 22 nt, Human
ucugaaaauugaugggauuugg

SEQ ID NO: 3046671 - RNA, 21 nt, Human
ucuccuggaagugcuaauuuu

SEQ ID NO: 3046672 - RNA, 13 nt, Human
ucucugcaggucc

SEQ ID NO: 3046673 - RNA, 14 nt, Human
ucucugcagguccc

SEQ ID NO: 3046674 - RNA, 15 nt, Human
ucucugcaggucccu

SEQ ID NO: 3046675 - RNA, 16 nt, Human
ucucugcaggucccua

SEQ ID NO: 3046676 - RNA, 16 nt, Human
ucccuccucugcccgg

SEQ ID NO: 3046677 - RNA, 11 nt, Human
ucccuccuggg

SEQ ID NO: 3046678 - RNA, 19 nt, Human
ucccuccugggaaugaagc

SEQ ID NO: 3046679 - RNA, 15 nt, Human
ucccucuacugggag

SEQ ID NO: 3046680 - RNA, 17 nt, Human
ucccucuacugggagcc

SEQ ID NO: 3046681 - RNA, 16 nt, Human
ucccuaauaaagcugu

SEQ ID NO: 3046682 - RNA, 14 nt, Human
ucccuaauaaagcu

SEQ ID NO: 3046683 - RNA, 15 nt, Human
ucccuaauaaagcug

SEQ ID NO: 3046684 - RNA, 13 nt, Human
ucccugccuggac

SEQ ID NO: 3046685 - RNA, 23 nt, Human
ucccugccugguccucacacuca

SEQ ID NO: 3046686 - RNA, 16 nt, Human
ucccuuccuuccucuc

SEQ ID NO: 3046687 - RNA, 19 nt, Human
ucccuuccuuccucuccug

SEQ ID NO: 3046688 - RNA, 20 nt, Human
uccuaauaaucauuggauuc

SEQ ID NO: 3046689 - RNA, 14 nt, Human
ucgugucuggcaca

SEQ ID NO: 3046690 - RNA, 21 nt, Human
ucgugucuggcacagccuggc

SEQ ID NO: 3046691 - RNA, 22 nt, Human
ucuaugauuccagguggcauca

SEQ ID NO: 3046692 - RNA, 18 nt, Human
ugauuuuuaugccaccug

SEQ ID NO: 3046693 - RNA, 18 nt, Human
ugcaacuuuguauaaaag

SEQ ID NO: 3046694 - RNA, 14 nt, Human
ugcaauuucauaug

SEQ ID NO: 3046695 - RNA, 20 nt, Human
ugcaauuucauaugcuguau

SEQ ID NO: 3046696 - RNA, 22 nt, Human
ugcaauguagaggggaaaagag

SEQ ID NO: 3046697 - RNA, 18 nt, Human
ugcccgggagcucaggaa

SEQ ID NO: 3046698 - RNA, 17 nt, Human
ugcccgggagcucagga

SEQ ID NO: 3046699 - RNA, 18 nt, Human
ugcccagaaugaggcugc

SEQ ID NO: 3046700 - RNA, 17 nt, Human
ugcccagaaugaggcug

SEQ ID NO: 3046701 - RNA, 17 nt, Human
ugccugguccucacacu

SEQ ID NO: 3046702 - RNA, 22 nt, Human
ugccaucauguuuacagaggac

SEQ ID NO: 3046703 - RNA, 21 nt, Human
ugcauuauauuuguaaauuua

SEQ ID NO: 3046704 - RNA, 21 nt, Human
ugacccucaucuuucuuccaa

SEQ ID NO: 3046705 - RNA, 19 nt, Human
ucuugaaggaaaaugauac

SEQ ID NO: 3046706 - RNA, 16 nt, Human
ucuugaauaauguaag

SEQ ID NO: 3046707 - RNA, 13 nt, Human
ugagaaaucuaaa

SEQ ID NO: 3046708 - RNA, 17 nt, Human
ugagaaaucuaaaaaac

SEQ ID NO: 3046709 - RNA, 23 nt, Human
ugaggcugcuuuccaaagccaau

SEQ ID NO: 3046710 - RNA, 20 nt, Human
ugaggcugcuuuccaaagcc

SEQ ID NO: 3046711 - RNA, 16 nt, Human
ugaggcugcuuuccaa

SEQ ID NO: 3046712 - RNA, 19 nt, Human
ugagguggaagagggcugc

SEQ ID NO: 3046713 - RNA, 16 nt, Human
ugaguuggcugggaau

SEQ ID NO: 3046714 - RNA, 14 nt, Human
ugaguuggcuggga

SEQ ID NO: 3046715 - RNA, 17 nt, Human
ugaguuggcugggaaua

SEQ ID NO: 3046716 - RNA, 17 nt, Human
ugauauaaguguguguu

SEQ ID NO: 3046717 - RNA, 23 nt, Human
ugauauaaguguguguuuuucau

SEQ ID NO: 3046718 - RNA, 14 nt, Human
ugaugaaaauauuu

SEQ ID NO: 3046719 - RNA, 13 nt, Human
ugauguacaugua

SEQ ID NO: 3046720 - RNA, 21 nt, Human
ugaugguuguacauauaagug

SEQ ID NO: 3046721 - RNA, 13 nt, Human
ugauguauucuag

SEQ ID NO: 3046722 - RNA, 21 nt, Human
ugauguauucuagcuaaugua

SEQ ID NO: 3046723 - RNA, 14 nt, Human
ugauguauucuagc

SEQ ID NO: 3046724 - RNA, 20 nt, Human
ugauguauucuagcuaaugu

SEQ ID NO: 3046725 - RNA, 13 nt, Human
uguccucagcccc

SEQ ID NO: 3046726 - RNA, 18 nt, Human
uguccugcaccggggccu

SEQ ID NO: 3046727 - RNA, 19 nt, Human
uguaugcuucauacaggga

SEQ ID NO: 3046728 - RNA, 16 nt, Human
uguaugcuucauacag

SEQ ID NO: 3046729 - RNA, 14 nt, Human
uguaugcuucauac

SEQ ID NO: 3046730 - RNA, 13 nt, Human
uguaugcuucaua

SEQ ID NO: 3046731 - RNA, 15 nt, Human
uguagcuuuaucaaa

SEQ ID NO: 3046732 - RNA, 14 nt, Human
uguagcuuuaucaa

SEQ ID NO: 3046733 - RNA, 16 nt, Human
ugguuccagccugcca

SEQ ID NO: 3046734 - RNA, 15 nt, Human
ugguuccagccugcc

SEQ ID NO: 3046735 - RNA, 20 nt, Human
ugguuguacauauaagugau

SEQ ID NO: 3046736 - RNA, 11 nt, Human
uguaaugaaaa

SEQ ID NO: 3046737 - RNA, 12 nt, Human
uguaaugaaaac

SEQ ID NO: 3046738 - RNA, 13 nt, Human
uguaaugaaaacc

SEQ ID NO: 3046739 - RNA, 17 nt, Human
uguaaugaaaaccacau

SEQ ID NO: 3046740 - RNA, 17 nt, Human
uguaaauuuaugugaug

SEQ ID NO: 3046741 - RNA, 14 nt, Human
uguaauaacuguga

SEQ ID NO: 3046742 - RNA, 22 nt, Human
uguaauaacugugaaguuuaca

SEQ ID NO: 3046743 - RNA, 23 nt, Human
uggccuaaccugccgagagucca

SEQ ID NO: 3046744 - RNA, 14 nt, Human
uggccccugagauc

SEQ ID NO: 3046745 - RNA, 15 nt, Human
uggcuccaggccagg

SEQ ID NO: 3046746 - RNA, 21 nt, Human
uggcuugaguuuaaauuguaa

SEQ ID NO: 3046747 - RNA, 14 nt, Human
ugggaaugaagcaa

SEQ ID NO: 3046748 - RNA, 14 nt, Human
ugggaggagggcag

SEQ ID NO: 3046749 - RNA, 17 nt, Human
ugggaggagggcaggca

SEQ ID NO: 3046750 - RNA, 18 nt, Human
ugggaggagggcaggcau

SEQ ID NO: 3046751 - RNA, 17 nt, Human
uggggggcuucauacac

SEQ ID NO: 3046752 - RNA, 17 nt, Human
uggggccaggcuggguc

SEQ ID NO: 3046753 - RNA, 12 nt, Human
ugcuuguguuaa

SEQ ID NO: 3046754 - RNA, 15 nt, Human
ugcuuguguuaagua

SEQ ID NO: 3046755 - RNA, 19 nt, Human
uggaaaagccaagaggcug

SEQ ID NO: 3046756 - RNA, 16 nt, Human
uggaaaagccaagagg

SEQ ID NO: 3046757 - RNA, 17 nt, Human
ugcuuuggaaaacccag

SEQ ID NO: 3046758 - RNA, 19 nt, Human
uggaucaaauccagccugc

SEQ ID NO: 3046759 - RNA, 17 nt, Human
uggagacacaacuauuu

SEQ ID NO: 3046760 - RNA, 19 nt, Human
uuuccaaccggcuuugugg

SEQ ID NO: 3046761 - RNA, 19 nt, Human
uuuaacucuauaauguguu

SEQ ID NO: 3046762 - RNA, 21 nt, Human
uuuauaaaaauaaaaaacacu

SEQ ID NO: 3046763 - RNA, 23 nt, Human
uuuauaaaaauaaaaaacacugg

SEQ ID NO: 3046764 - RNA, 20 nt, Human
uuuacauuguaaauaguauu

SEQ ID NO: 3046765 - RNA, 13 nt, Human
uuguguugugaau

SEQ ID NO: 3046766 - RNA, 17 nt, Human
uuguaaauaguauuuga

SEQ ID NO: 3046767 - RNA, 21 nt, Human
uuguauucagaguugaugguu

SEQ ID NO: 3046768 - RNA, 21 nt, Human
uuguacgaagaguauuuuuga

SEQ ID NO: 3046769 - RNA, 23 nt, Human
uuguacgaagaguauuuuugaca

SEQ ID NO: 3046770 - RNA, 18 nt, Human
uucugcuuguguuaagua

SEQ ID NO: 3046771 - RNA, 21 nt, Human
uugaaaagaggugugcaagag

SEQ ID NO: 3046772 - RNA, 14 nt, Human
uugaaaagaggugu

SEQ ID NO: 3046773 - RNA, 13 nt, Human
uugaaaagaggug

SEQ ID NO: 3046774 - RNA, 17 nt, Human
uucuuccaaaaagauuu

SEQ ID NO: 3046775 - RNA, 20 nt, Human
uugacaaagucaagccacau

SEQ ID NO: 3046776 - RNA, 19 nt, Human
uugacaaagucaagccaca

SEQ ID NO: 3046777 - RNA, 18 nt, Human
uucggugagcuacaaaug

SEQ ID NO: 3046778 - RNA, 21 nt, Human
uuccugaggaagagggacugu

SEQ ID NO: 3046779 - RNA, 22 nt, Human
uucuacauaaguaauucaagaa

SEQ ID NO: 3046780 - RNA, 14 nt, Human
uucuauagcuuuuc

SEQ ID NO: 3046781 - RNA, 19 nt, Human
uucugagagcugugcauca

SEQ ID NO: 3046782 - RNA, 13 nt, Human
uucugagagcugu

SEQ ID NO: 3046783 - RNA, 21 nt, Human
uuccaaaaagauuuucagaaa

SEQ ID NO: 3046784 - RNA, 23 nt, Human
uucaguuauuauauuuacaaaug

SEQ ID NO: 3046785 - RNA, 20 nt, Human
uucauaaauaaaguuuguug

SEQ ID NO: 3046786 - RNA, 13 nt, Human
uucagcuugggga

SEQ ID NO: 3046787 - RNA, 16 nt, Human
uuauuuuguucauaca

SEQ ID NO: 3046788 - RNA, 14 nt, Human
uuauuuuguucaua

SEQ ID NO: 3046789 - RNA, 16 nt, Human
uucaauaauaaauauu

SEQ ID NO: 3046790 - RNA, 13 nt, Human
uuauuuuaaaaga

SEQ ID NO: 3046791 - RNA, 17 nt, Human
uuauguugcauagaaua

SEQ ID NO: 3046792 - RNA, 16 nt, Human
uuaucuugaauaaugu

SEQ ID NO: 3046793 - RNA, 14 nt, Human
uuaucuugaauaau

SEQ ID NO: 3046794 - RNA, 16 nt, Human
uuauauuuacaaaugg

SEQ ID NO: 3046795 - RNA, 22 nt, Human
uuauacaggucauauuaauaua

SEQ ID NO: 3046796 - RNA, 14 nt, Human
uuauacaggucaua

SEQ ID NO: 3046797 - RNA, 16 nt, Human
uuauauuaugaagcuu

SEQ ID NO: 3046798 - RNA, 15 nt, Human
uuauaucuuguagcu

SEQ ID NO: 3046799 - RNA, 22 nt, Human
uuauaucuuguagcuuuaucaa

SEQ ID NO: 3046800 - RNA, 17 nt, Human
uuauaauuuuaaauguu

SEQ ID NO: 3046801 - RNA, 21 nt, Human
uuauaauuuuaaauguuuuuu

SEQ ID NO: 3046802 - RNA, 12 nt, Human
uuauaauuuaaa

SEQ ID NO: 3046803 - RNA, 12 nt, Human
uuauaauuuuaa

SEQ ID NO: 3046804 - RNA, 19 nt, Human
uuuuacguccaucucuugu

SEQ ID NO: 3046805 - RNA, 21 nt, Human
uuuuaaaguaacccuacaaaa

SEQ ID NO: 3046806 - RNA, 21 nt, Human
uuuuauuuuucucaugaugag

SEQ ID NO: 3046807 - RNA, 23 nt, Human
uuuucagaaaauauuauguguuu

SEQ ID NO: 3046808 - RNA, 21 nt, Human
uuuucaaaauuguuacaaauu

SEQ ID NO: 3046809 - RNA, 22 nt, Human
uuuucagaaaauauuauguguu

SEQ ID NO: 3046810 - RNA, 21 nt, Human
uuuucuuaaccagaucauugu

SEQ ID NO: 3046811 - RNA, 12 nt, Human
uuugaguucuac

SEQ ID NO: 3046812 - RNA, 18 nt, Human
uuugcauaacguauaaaa

SEQ ID NO: 3046813 - RNA, 14 nt, Human
uuuuaaaauccacu

SEQ ID NO: 3046814 - RNA, 23 nt, Human
uuuuaaaauccacuuuaucuuga

SEQ ID NO: 3046815 - RNA, 15 nt, Human
uuuggucaacacuaa

SEQ ID NO: 3046816 - RNA, 11 nt, Human
uuuugacagaa

SEQ ID NO: 3046817 - RNA, 22 nt, Human
uuuugacagaauauguuucaaa

SEQ ID NO: 3046818 - RNA, 23 nt, Human
uuuugacagaauauguuucaaac

SEQ ID NO: 3046819 - RNA, 13 nt, Human
uuuuuaaucuuua

SEQ ID NO: 3046820 - RNA, 23 nt, Human
aguuacuugcugcccugugcucc

SEQ ID NO: 3046821 - RNA, 13 nt, Human
gacugugugcuca

SEQ ID NO: 3046822 - RNA, 22 nt, Human
ggaucugugaggggcucucuca

SEQ ID NO: 3046823 - RNA, 22 nt, Human
ggagcugagcagguguucuuca

SEQ ID NO: 3046824 - RNA, 21 nt, Marburg virus
aacuaauauuacuaacaaaag

SEQ ID NO: 3046825 - RNA, 22 nt, Marburg virus
augccaccacacucaacaccac

SEQ ID NO: 3046826 - RNA, 21 nt, Marburg virus
uaauucucauuguuaacaguu

SEQ ID NO: 3046827 - RNA, 12 nt, Marburg virus
auuuaagggaac

SEQ ID NO: 3046828 - RNA, 21 nt, Marburg virus
auccuugaucaacaccaugac

SEQ ID NO: 3046829 - RNA, 21 nt, Marburg virus
auucaauuguuaucauaguca

SEQ ID NO: 3046830 - RNA, 15 nt, Marburg virus
auauaucaugaaacu

SEQ ID NO: 3046831 - RNA, 20 nt, Marburg virus
ugcuuugaaggaucaagaau

SEQ ID NO: 3046832 - RNA, 19 nt, Marburg virus
uuaauauaauguaagaaau

SEQ ID NO: 3046833 - RNA, 14 nt, Marburg virus
ucuucaagaauaca

SEQ ID NO: 3046834 - RNA, 20 nt, Marburg virus
caacaccacagacccaaaca

SEQ ID NO: 3046835 - RNA, 20 nt, Marburg virus
acuagauuauauaaaagaaa

SEQ ID NO: 3046836 - RNA, 20 nt, Marburg virus
ucaaaaaagaugaacaaaaa

SEQ ID NO: 3046837 - RNA, 23 nt, Marburg virus
augcaaaccauaaggaaaaauga

SEQ ID NO: 3046838 - RNA, 17 nt, Marburg virus
gcucgacgucuuaaaag

SEQ ID NO: 3046839 - RNA, 17 nt, Marburg virus
cacuccauuccauaucc

SEQ ID NO: 3046840 - RNA, 20 nt, Marburg virus
ucggaacaaauugaccaaau

SEQ ID NO: 3046841 - RNA, 15 nt, Marburg virus
ggacauguauaucau

SEQ ID NO: 3046842 - RNA, 13 nt, Marburg virus
aaagucauguuug

SEQ ID NO: 3046843 - RNA, 22 nt, Marburg virus
gcauuuaacuccauaucuuaga

SEQ ID NO: 3046844 - RNA, 14 nt, Marburg virus
gaaaggccccacca

SEQ ID NO: 3046845 - RNA, 16 nt, Marburg virus
uuaaauuugaccaaag

SEQ ID NO: 3046846 - RNA, 14 nt, Marburg virus
ugaagaacauuaau

SEQ ID NO: 3046847 - RNA, 21 nt, Marburg virus
ucaauaugaugcaauuaauca

SEQ ID NO: 3046848 - RNA, 17 nt, Marburg virus
agcuuuuauucagaaua

SEQ ID NO: 3046849 - RNA, 21 nt, Marburg virus
gcaaucuguaaaaaucuuaaa

SEQ ID NO: 3046850 - RNA, 20 nt, Marburg virus
cuugaacucagugaggagac

SEQ ID NO: 3046851 - RNA, 12 nt, Marburg virus
auuauaugauuu

SEQ ID NO: 3046852 - RNA, 14 nt, Marburg virus
cggagaacaggaac

SEQ ID NO: 3046853 - RNA, 20 nt, Marburg virus
gugagacaguccucucagaa

SEQ ID NO: 3046854 - RNA, 15 nt, Marburg virus
ugccaugcuuucacu

SEQ ID NO: 3046855 - RNA, 14 nt, Marburg virus
aaagguuuucuuua

SEQ ID NO: 3046856 - RNA, 16 nt, Marburg virus
aauaucccuugugaau

SEQ ID NO: 3046857 - RNA, 14 nt, Marburg virus
ccacaaccaagcac

SEQ ID NO: 3046858 - RNA, 22 nt, Marburg virus
ccucguaauuucaacuggaaga

SEQ ID NO: 3046859 - RNA, 16 nt, Marburg virus
acugaaaaugaacaaa

SEQ ID NO: 3046860 - RNA, 22 nt, Marburg virus
ucaguucaaagggaaugucugc

SEQ ID NO: 3046861 - RNA, 22 nt, Marburg virus
uagcaacaugaugguuguuacu

SEQ ID NO: 3046862 - RNA, 21 nt, Marburg virus
auuaaguguucuuuguuagaa

SEQ ID NO: 3046863 - RNA, 15 nt, Marburg virus
aucaagcauauuuca

SEQ ID NO: 3046864 - RNA, 13 nt, Marburg virus
uuuaauauucaga

SEQ ID NO: 3046865 - RNA, 23 nt, Marburg virus
aaggaugggucuguguuuauuca

SEQ ID NO: 3046866 - RNA, 22 nt, Marburg virus
uuaauauggccaguuccagcaa

SEQ ID NO: 3046867 - RNA, 20 nt, Marburg virus
uacacaaguagggaaaucac

SEQ ID NO: 3046868 - RNA, 16 nt, Marburg virus
aauuagggaaauacug

SEQ ID NO: 3046869 - RNA, 20 nt, Marburg virus
uauuaaagguuuucuuuaau

SEQ ID NO: 3046870 - RNA, 14 nt, Marburg virus
aacuugaugaugca

SEQ ID NO: 3046871 - RNA, 19 nt, Marburg virus
uuaaaauuaauucacacaa

SEQ ID NO: 3046872 - RNA, 16 nt, Marburg virus
gaugcauuaauguuuu

SEQ ID NO: 3046873 - RNA, 13 nt, Marburg virus
cgucucuuucuaa

SEQ ID NO: 3046874 - RNA, 12 nt, Marburg virus
aaguaauguuuu

SEQ ID NO: 3046875 - RNA, 23 nt, Marburg virus
auggcaucuuuacaccaggaaaa

SEQ ID NO: 3046876 - RNA, 16 nt, Marburg virus
acaugcaauacuugaa

SEQ ID NO: 3046877 - RNA, 14 nt, Marburg virus
uucaccuacaaucu

SEQ ID NO: 3046878 - RNA, 21 nt, Marburg virus
aauuauccuaacaugaagacc

SEQ ID NO: 3046879 - RNA, 14 nt, Marburg virus
cuaacaacacgaaa

SEQ ID NO: 3046880 - RNA, 13 nt, Marburg virus
caauguauaacaa

SEQ ID NO: 3046881 - RNA, 18 nt, Marburg virus
ucucaaaccguacacaag

SEQ ID NO: 3046882 - RNA, 17 nt, Marburg virus
acagcuugcuuuacaca

SEQ ID NO: 3046883 - RNA, 21 nt, Marburg virus
aggauuuuucuccuaaggaaa

SEQ ID NO: 3046884 - RNA, 16 nt, Marburg virus
caccuccaagaacaac

SEQ ID NO: 3046885 - RNA, 17 nt, Marburg virus
uaaaaaucgaagaauau

SEQ ID NO: 3046886 - RNA, 23 nt, Marburg virus
cguaguguucuuuuacuggaagg

SEQ ID NO: 3046887 - RNA, 23 nt, Marburg virus
gacaaguaacaauggaacacaaa

SEQ ID NO: 3046888 - RNA, 21 nt, Marburg virus
aauauaccuacccugauuuau

SEQ ID NO: 3046889 - RNA, 17 nt, Marburg virus
auauuucauucaaacac

SEQ ID NO: 3046890 - RNA, 13 nt, Marburg virus
uuuauaaacaauu

SEQ ID NO: 3046891 - RNA, 20 nt, Marburg virus
accacuauguuauaugcaug

SEQ ID NO: 3046892 - RNA, 14 nt, Marburg virus
aaccuagaugauca

SEQ ID NO: 3046893 - RNA, 15 nt, Marburg virus
auaaguuuaagauau

SEQ ID NO: 3046894 - RNA, 12 nt, Marburg virus
uuacacauuaac

SEQ ID NO: 3046895 - RNA, 16 nt, Marburg virus
uggagaaaaugagaac

SEQ ID NO: 3046896 - RNA, 13 nt, Marburg virus
aucuacugaaauc

SEQ ID NO: 3046897 - RNA, 18 nt, Marburg virus
gaaaaacuaaugaagaac

SEQ ID NO: 3046898 - RNA, 14 nt, Marburg virus
uugucaauaagaca

SEQ ID NO: 3046899 - RNA, 14 nt, Marburg virus
uugccauguuuacu

SEQ ID NO: 3046900 - RNA, 22 nt, Marburg virus
uugugugucagcuguauacaaa

SEQ ID NO: 3046901 - RNA, 11 nt, Marburg virus
augaacaaaaa

SEQ ID NO: 3046902 - RNA, 18 nt, Marburg virus
gcaagaaggaaacaacac

SEQ ID NO: 3046903 - RNA, 20 nt, Marburg virus
cuugaagacauaguuaagac

SEQ ID NO: 3046904 - RNA, 16 nt, Marburg virus
gaaaaacuaugaagaa

SEQ ID NO: 3046905 - RNA, 22 nt, Marburg virus
aagacuuguccaggaauauuuc

SEQ ID NO: 3046906 - RNA, 21 nt, Marburg virus
uuuucacauagguucugauuu

SEQ ID NO: 3046907 - RNA, 10 nt, Marburg virus
uacuggaagg

SEQ ID NO: 3046908 - RNA, 18 nt, Marburg virus
aauuaacuuuuguugcaa

SEQ ID NO: 3046909 - RNA, 20 nt, Marburg virus
aguaaacucaacugaugaug

SEQ ID NO: 3046910 - RNA, 18 nt, Marburg virus
acccauuguucuaccaac

SEQ ID NO: 3046911 - RNA, 20 nt, Marburg virus
auguugaugauuuuaaauac

SEQ ID NO: 3046912 - RNA, 19 nt, Marburg virus
aagaauuuggagcguucag

SEQ ID NO: 3046913 - RNA, 19 nt, Marburg virus
ccugcgauuuucaaagauc

SEQ ID NO: 3046914 - RNA, 14 nt, Marburg virus
aauuaaucauguug

SEQ ID NO: 3046915 - RNA, 15 nt, Marburg virus
gaaaucaacuuggga

SEQ ID NO: 3046916 - RNA, 16 nt, Marburg virus
uuaacuccauaucuua

SEQ ID NO: 3046917 - RNA, 17 nt, Marburg virus
auguuacggaaaaaagc

SEQ ID NO: 3046918 - RNA, 19 nt, Marburg virus
uuauaggaacagauuuaga

SEQ ID NO: 3046919 - RNA, 22 nt, Marburg virus
auguucacucuucauguuguaa

SEQ ID NO: 3046920 - RNA, 14 nt, Marburg virus
cugaaaucaacuug

SEQ ID NO: 3046921 - RNA, 22 nt, Marburg virus
aauauaaaagaacgaucugcug

SEQ ID NO: 3046922 - RNA, 21 nt, Marburg virus
cucacaagauuaguuuguauu

SEQ ID NO: 3046923 - RNA, 20 nt, Marburg virus
ucaaacaccccaaauuuuca

SEQ ID NO: 3046924 - RNA, 22 nt, Marburg virus
auugggacaacgaguucuugaa

SEQ ID NO: 3046925 - RNA, 18 nt, Marburg virus
auuauccuaacaugaaga

SEQ ID NO: 3046926 - RNA, 16 nt, Marburg virus
uacacguuauaucuuu

SEQ ID NO: 3046927 - RNA, 22 nt, Marburg virus
cuaggaggguuaucauuuuuga

SEQ ID NO: 3046928 - RNA, 16 nt, Marburg virus
cuuugauuuacuaaca

SEQ ID NO: 3046929 - RNA, 12 nt, Marburg virus
uaauagaaguag

SEQ ID NO: 3046930 - RNA, 14 nt, Marburg virus
ucuauuugaugcau

SEQ ID NO: 3046931 - RNA, 19 nt, Marburg virus
uguugaauuaauuguuacu

SEQ ID NO: 3046932 - RNA, 13 nt, Marburg virus
cuucaauaugcag

SEQ ID NO: 3046933 - RNA, 15 nt, Marburg virus
aucagcuaucaaauc

SEQ ID NO: 3046934 - RNA, 21 nt, Marburg virus
ucauucaaacaccccaaauuu

SEQ ID NO: 3046935 - RNA, 14 nt, Marburg virus
ucaacaacagacaa

SEQ ID NO: 3046936 - RNA, 18 nt, Marburg virus
caagaacgccuaguggaa

SEQ ID NO: 3046937 - RNA, 20 nt, Marburg virus
aaaucaacuugggagauuuu

SEQ ID NO: 3046938 - RNA, 18 nt, Marburg virus
uuacauaggauuauauca

SEQ ID NO: 3046939 - RNA, 19 nt, Marburg virus
acuaaaaaucgaagaauau

SEQ ID NO: 3046940 - RNA, 23 nt, Marburg virus
gauaagagucaaaaacuuccaaa

SEQ ID NO: 3046941 - RNA, 14 nt, Marburg virus
uaaaucuugaccuu

SEQ ID NO: 3046942 - RNA, 12 nt, Marburg virus
caaucuguaaaa

SEQ ID NO: 3046943 - RNA, 19 nt, Marburg virus
gaauauuucggaacaaauu

SEQ ID NO: 3046944 - RNA, 18 nt, Marburg virus
gaccaaauaauagugcau

SEQ ID NO: 3046945 - RNA, 20 nt, Marburg virus
ggaguccaucugcauaagaa

SEQ ID NO: 3046946 - RNA, 18 nt, Marburg virus
agugugcugaaaauguua

SEQ ID NO: 3046947 - RNA, 15 nt, Marburg virus
gcaaacauauugaaa

SEQ ID NO: 3046948 - RNA, 12 nt, Marburg virus
agaagaaaaaac

SEQ ID NO: 3046949 - RNA, 23 nt, Marburg virus
aaucaugaagaacauuaagaaaa

SEQ ID NO: 3046950 - RNA, 15 nt, Marburg virus
aagauagacagaaca

SEQ ID NO: 3046951 - RNA, 13 nt, Marburg virus
agauuauaugauu

SEQ ID NO: 3046952 - RNA, 22 nt, Marburg virus
ucaacaauacugugaauuauuc

SEQ ID NO: 3046953 - RNA, 22 nt, Marburg virus
guuaucguugagauuaaaaaga

SEQ ID NO: 3046954 - RNA, 22 nt, Marburg virus
guaguguucuuuuacuggaagg

SEQ ID NO: 3046955 - RNA, 20 nt, Marburg virus
uuaauugggaacaccaugca

SEQ ID NO: 3046956 - RNA, 18 nt, Marburg virus
gcuuaaauguaccaggau

SEQ ID NO: 3046957 - RNA, 18 nt, Marburg virus
cucaauuggaaauuuaaa

SEQ ID NO: 3046958 - RNA, 16 nt, Marburg virus
uguauagauucaauua

SEQ ID NO: 3046959 - RNA, 20 nt, Marburg virus
ugaugcgagggcauuauuca

SEQ ID NO: 3046960 - RNA, 16 nt, Marburg virus
acacuggaagcaauuu

SEQ ID NO: 3046961 - RNA, 15 nt, Marburg virus
ucaaguaugcaaauu

SEQ ID NO: 3046962 - RNA, 20 nt, Marburg virus
agauacgagguuauauaauu

SEQ ID NO: 3046963 - RNA, 22 nt, Marburg virus
aucagucuuaucuuaauccaag

SEQ ID NO: 3046964 - RNA, 22 nt, Marburg virus
auaucgucucaaaccguacaca

SEQ ID NO: 3046965 - RNA, 17 nt, Marburg virus
ggauauuaaauauccau

SEQ ID NO: 3046966 - RNA, 13 nt, Marburg virus
uuucaacuggaag

SEQ ID NO: 3046967 - RNA, 18 nt, Marburg virus
aaauuaauucacacaagg

SEQ ID NO: 3046968 - RNA, 17 nt, Marburg virus
gaaaaaggauguucuua

SEQ ID NO: 3046969 - RNA, 21 nt, Marburg virus
aaaugcuccccaauacagaca

SEQ ID NO: 3046970 - RNA, 13 nt, Marburg virus
auauaucaugaaa

SEQ ID NO: 3046971 - RNA, 13 nt, Marburg virus
uaaucauguugau

SEQ ID NO: 3046972 - RNA, 13 nt, Marburg virus
gucagugauuuuu

SEQ ID NO: 3046973 - RNA, 19 nt, Marburg virus
cuaauauuacuaacaaaag

SEQ ID NO: 3046974 - RNA, 15 nt, Marburg virus
ucgaagaacauuaag

SEQ ID NO: 3046975 - RNA, 23 nt, Marburg virus
ccacaugucucuuuaucagucuu

SEQ ID NO: 3046976 - RNA, 13 nt, Marburg virus
cuccuaaggaaaa

SEQ ID NO: 3046977 - RNA, 17 nt, Marburg virus
acucugaacuaaggaaa

SEQ ID NO: 3046978 - RNA, 22 nt, Marburg virus
ucaacaccacagacccaaacaa

SEQ ID NO: 3046979 - RNA, 22 nt, Marburg virus
uaguuaugaauguuuuaucaug

SEQ ID NO: 3046980 - RNA, 13 nt, Marburg virus
aauaguugucaua

SEQ ID NO: 3046981 - RNA, 18 nt, Marburg virus
cauugagagguauaacac

SEQ ID NO: 3046982 - RNA, 14 nt, Marburg virus
aaaaggaagaauua

SEQ ID NO: 3046983 - RNA, 21 nt, Marburg virus
uucaauaugaugcaauuaauc

SEQ ID NO: 3046984 - RNA, 22 nt, Marburg virus
cagauggacuagcaaaagcauu

SEQ ID NO: 3046985 - RNA, 21 nt, Marburg virus
cagcaaagagcacuaacaaca

SEQ ID NO: 3046986 - RNA, 14 nt, Marburg virus
agacuuccaaacau

SEQ ID NO: 3046987 - RNA, 16 nt, Marburg virus
acgccacagcaagaag

SEQ ID NO: 3046988 - RNA, 20 nt, Marburg virus
uugcaagcgaugugugcuug

SEQ ID NO: 3046989 - RNA, 13 nt, Marburg virus
cuuuauuaagaaa

SEQ ID NO: 3046990 - RNA, 15 nt, Marburg virus
ucugacacaauacau

SEQ ID NO: 3046991 - RNA, 17 nt, Marburg virus
uaguuacucaaauauua

SEQ ID NO: 3046992 - RNA, 21 nt, Marburg virus
aucuugagggacaaauuauug

SEQ ID NO: 3046993 - RNA, 15 nt, Marburg virus
agugguaucaucuua

SEQ ID NO: 3046994 - RNA, 15 nt, Marburg virus
aacuaaacuugcaua

SEQ ID NO: 3046995 - RNA, 14 nt, Marburg virus
aaaauccaguguua

SEQ ID NO: 3046996 - RNA, 23 nt, Marburg virus
auuuaacuccauaucuuagacaa

SEQ ID NO: 3046997 - RNA, 17 nt, Marburg virus
uaaaaaugaaacaacag

SEQ ID NO: 3046998 - RNA, 16 nt, Marburg virus
agaagaagaaaaaacu

SEQ ID NO: 3046999 - RNA, 18 nt, Marburg virus
acucuucauguuguaaau

SEQ ID NO: 3047000 - RNA, 15 nt, Marburg virus
auuaauuccuugaau

SEQ ID NO: 3047001 - RNA, 18 nt, Marburg virus
agauaaccccaguguuaa

SEQ ID NO: 3047002 - RNA, 12 nt, Marburg virus
cucuaaggaaaa

SEQ ID NO: 3047003 - RNA, 16 nt, Marburg virus
cauuguugcaucauuu

SEQ ID NO: 3047004 - RNA, 15 nt, Marburg virus
uaguuaaauuucuag

SEQ ID NO: 3047005 - RNA, 12 nt, Marburg virus
uaaaccaagcaa

SEQ ID NO: 3047006 - RNA, 17 nt, Marburg virus
augcagccgacaagaug

SEQ ID NO: 3047007 - RNA, 18 nt, Marburg virus
aaaucuuacauaggauua

SEQ ID NO: 3047008 - RNA, 19 nt, Marburg virus
gacuucuacuaauaaauau

SEQ ID NO: 3047009 - RNA, 19 nt, Marburg virus
cagugauaagagucaaaaa

SEQ ID NO: 3047010 - RNA, 22 nt, Marburg virus
uaaagcuuuaggacaauugcua

SEQ ID NO: 3047011 - RNA, 19 nt, Marburg virus
caagaagaagaaaaaacua

SEQ ID NO: 3047012 - RNA, 14 nt, Marburg virus
ugaaacaacagaug

SEQ ID NO: 3047013 - RNA, 19 nt, Marburg virus
aaauuagcauggauauuca

SEQ ID NO: 3047014 - RNA, 23 nt, Marburg virus
aaucagcaggguauaacuccaaa

SEQ ID NO: 3047015 - RNA, 18 nt, Marburg virus
augucgaaaguucuugaa

SEQ ID NO: 3047016 - RNA, 18 nt, Marburg virus
gaaaagguuuuuuauucu

SEQ ID NO: 3047017 - RNA, 13 nt, Marburg virus
cuacaaaacacca

SEQ ID NO: 3047018 - RNA, 15 nt, Marburg virus
uguugauuucaaugu

SEQ ID NO: 3047019 - RNA, 23 nt, Marburg virus
acuuucccucuacucugaacuaa

SEQ ID NO: 3047020 - RNA, 15 nt, Marburg virus
ucauauuugauucaa

SEQ ID NO: 3047021 - RNA, 23 nt, Marburg virus
cucccucaccacaaccaagcacg

SEQ ID NO: 3047022 - RNA, 20 nt, Marburg virus
uugaaaaggaagaauuauuc

SEQ ID NO: 3047023 - RNA, 14 nt, Marburg virus
uauucucucuacaa

SEQ ID NO: 3047024 - RNA, 16 nt, Marburg virus
auucaccuacaaucuc

SEQ ID NO: 3047025 - RNA, 14 nt, Marburg virus
acuaacuucaauaa

SEQ ID NO: 3047026 - RNA, 18 nt, Marburg virus
gaggauaaaaggacaaag

SEQ ID NO: 3047027 - RNA, 13 nt, Marburg virus
uaggaacaugaaa

SEQ ID NO: 3047028 - RNA, 19 nt, Marburg virus
ugaauggcuucaacaacag

SEQ ID NO: 3047029 - RNA, 16 nt, Marburg virus
acaguuuuuuguauua

SEQ ID NO: 3047030 - RNA, 13 nt, Marburg virus
ugaacucagugag

SEQ ID NO: 3047031 - RNA, 19 nt, Marburg virus
ucauugcuaaguaaacuca

SEQ ID NO: 3047032 - RNA, 13 nt, Marburg virus
cagcauggcugcc

SEQ ID NO: 3047033 - RNA, 17 nt, Marburg virus
ccaagccaaaucuuuca

SEQ ID NO: 3047034 - RNA, 19 nt, Marburg virus
caaaacuauccaucauauu

SEQ ID NO: 3047035 - RNA, 16 nt, Marburg virus
gguuaccuacuuaucu

SEQ ID NO: 3047036 - RNA, 18 nt, Marburg virus
auggcccgaaaaaugcuc

SEQ ID NO: 3047037 - RNA, 20 nt, Marburg virus
auuaacgacuugucuuaauu

SEQ ID NO: 3047038 - RNA, 14 nt, Marburg virus
uuguugauacccuu

SEQ ID NO: 3047039 - RNA, 15 nt, Marburg virus
auaagcuaucaaaua

SEQ ID NO: 3047040 - RNA, 18 nt, Marburg virus
ucaucaacaaugccaccc

SEQ ID NO: 3047041 - RNA, 22 nt, Marburg virus
gcuucaaaaccaggguuaagag

SEQ ID NO: 3047042 - RNA, 21 nt, Marburg virus
ucuauuuuugaugaucuucaa

SEQ ID NO: 3047043 - RNA, 19 nt, Marburg virus
aacgacuugucuuaauuca

SEQ ID NO: 3047044 - RNA, 21 nt, Marburg virus
caaagacgaucuuugaugaau

SEQ ID NO: 3047045 - RNA, 20 nt, Marburg virus
caggaaaucuuaccacagca

SEQ ID NO: 3047046 - RNA, 18 nt, Marburg virus
aaaacuaaauuaaaauua

SEQ ID NO: 3047047 - RNA, 16 nt, Marburg virus
ugagccacuuucccuc

SEQ ID NO: 3047048 - RNA, 18 nt, Marburg virus
aaauccuugcuguuggau

SEQ ID NO: 3047049 - RNA, 15 nt, Marburg virus
uugacaaucaaauca

SEQ ID NO: 3047050 - RNA, 21 nt, Marburg virus
uaauuaacuguuggcuuagau

SEQ ID NO: 3047051 - RNA, 22 nt, Marburg virus
ugagacaacauaagcuaucaaa

SEQ ID NO: 3047052 - RNA, 13 nt, Marburg virus
guauccucuggag

SEQ ID NO: 3047053 - RNA, 16 nt, Marburg virus
aguuacucaaauauua

SEQ ID NO: 3047054 - RNA, 14 nt, Marburg virus
agaguuaaaaacua

SEQ ID NO: 3047055 - RNA, 19 nt, Marburg virus
aucuaauucucauuguuaa

SEQ ID NO: 3047056 - RNA, 16 nt, Marburg virus
uugaggaucuugcuug

SEQ ID NO: 3047057 - RNA, 14 nt, Marburg virus
auuaagaaaaacua

SEQ ID NO: 3047058 - RNA, 16 nt, Marburg virus
cgacacacagagcaca

SEQ ID NO: 3047059 - RNA, 14 nt, Marburg virus
ggaccugauuguug

SEQ ID NO: 3047060 - RNA, 12 nt, Marburg virus
gaaaauaaucua

SEQ ID NO: 3047061 - RNA, 18 nt, Marburg virus
augguuugauauucaauu

SEQ ID NO: 3047062 - RNA, 15 nt, Marburg virus
ccgaggaaaggacau

SEQ ID NO: 3047063 - RNA, 17 nt, Marburg virus
aucuaugcgaugaugag

SEQ ID NO: 3047064 - RNA, 19 nt, Marburg virus
uauagauucaauuauccuu

SEQ ID NO: 3047065 - RNA, 17 nt, Marburg virus
aaaaaucccaacaaugg

SEQ ID NO: 3047066 - RNA, 14 nt, Marburg virus
cagcaaagagcacu

SEQ ID NO: 3047067 - RNA, 23 nt, Marburg virus
uguuauaugcaugucagugauuu

SEQ ID NO: 3047068 - RNA, 14 nt, Marburg virus
aguaagaaaaacua

SEQ ID NO: 3047069 - RNA, 15 nt, Marburg virus
cguugcucacaggca

SEQ ID NO: 3047070 - RNA, 14 nt, Marburg virus
uuaauucaaucuuu

SEQ ID NO: 3047071 - RNA, 15 nt, Marburg virus
cauauucaaggucaa

SEQ ID NO: 3047072 - RNA, 19 nt, Marburg virus
ucuguaaaaaucuuaaaac

SEQ ID NO: 3047073 - RNA, 22 nt, Marburg virus
uuucguggagcaugaaccucuu

SEQ ID NO: 3047074 - RNA, 13 nt, Marburg virus
agcacgccacagc

SEQ ID NO: 3047075 - RNA, 13 nt, Marburg virus
uccaugccccccc

SEQ ID NO: 3047076 - RNA, 14 nt, Marburg virus
caaucaaaucacuu

SEQ ID NO: 3047077 - RNA, 13 nt, Marburg virus
uuagaauuauuca

SEQ ID NO: 3047078 - RNA, 17 nt, Marburg virus
uccagaguggcaacaaa

SEQ ID NO: 3047079 - RNA, 16 nt, Marburg virus
ucaagacgcuuauuca

SEQ ID NO: 3047080 - RNA, 21 nt, Marburg virus
aaauuaaaauccaguguuaug

SEQ ID NO: 3047081 - RNA, 21 nt, Marburg virus
cauguugaugauuuuaaauac

SEQ ID NO: 3047082 - RNA, 15 nt, Marburg virus
aucuugagaaauaca

SEQ ID NO: 3047083 - RNA, 20 nt, Marburg virus
uacagcaaucauuaauuccu

SEQ ID NO: 3047084 - RNA, 16 nt, Marburg virus
uccuugaucaacacca

SEQ ID NO: 3047085 - RNA, 17 nt, Marburg virus
cagucccucccccaccc

SEQ ID NO: 3047086 - RNA, 17 nt, Marburg virus
aaagauguguugaccuu

SEQ ID NO: 3047087 - RNA, 19 nt, Marburg virus
auuacacauuaaccaugaa

SEQ ID NO: 3047088 - RNA, 15 nt, Marburg virus
gauccuccuaccaac

SEQ ID NO: 3047089 - RNA, 13 nt, Marburg virus
aguuaauuauccu

SEQ ID NO: 3047090 - RNA, 18 nt, Marburg virus
auggacuagcaaaagcau

SEQ ID NO: 3047091 - RNA, 23 nt, Marburg virus
auacgucgauauaauacauacua

SEQ ID NO: 3047092 - RNA, 13 nt, Marburg virus
aggauuauaucau

SEQ ID NO: 3047093 - RNA, 14 nt, Marburg virus
uuuuggaugcaaac

SEQ ID NO: 3047094 - RNA, 19 nt, Marburg virus
uuugaugaaucuucuaguu

SEQ ID NO: 3047095 - RNA, 22 nt, Marburg virus
accuuucuguugauuucaaugu

SEQ ID NO: 3047096 - RNA, 11 nt, Marburg virus
ucccaacaaug

SEQ ID NO: 3047097 - RNA, 22 nt, Marburg virus
aucacccuuguagaguuaaaaa

SEQ ID NO: 3047098 - RNA, 22 nt, Marburg virus
aaaacauauuuauccuugugua

SEQ ID NO: 3047099 - RNA, 17 nt, Marburg virus
uaaugaaccaacaguca

SEQ ID NO: 3047100 - RNA, 12 nt, Marburg virus
uaauaauuuuca

SEQ ID NO: 3047101 - RNA, 15 nt, Marburg virus
aauagccuugucaug

SEQ ID NO: 3047102 - RNA, 13 nt, Marburg virus
caacaccacagac

SEQ ID NO: 3047103 - RNA, 19 nt, Marburg virus
uuuauaucuagaacaaauu

SEQ ID NO: 3047104 - RNA, 14 nt, Marburg virus
aacaaagaauauac

SEQ ID NO: 3047105 - RNA, 19 nt, Marburg virus
cauuguucuaccaacaguc

SEQ ID NO: 3047106 - RNA, 19 nt, Marburg virus
aauaguugucauauaacag

SEQ ID NO: 3047107 - RNA, 15 nt, Marburg virus
cucucagaaucaguu

SEQ ID NO: 3047108 - RNA, 15 nt, Marburg virus
aaggaaacaacacag

SEQ ID NO: 3047109 - RNA, 19 nt, Marburg virus
cacuauguuauaugcaugu

SEQ ID NO: 3047110 - RNA, 18 nt, Marburg virus
uuuuuccacuaaucaauu

SEQ ID NO: 3047111 - RNA, 15 nt, Marburg virus
augcaaaacuaucca

SEQ ID NO: 3047112 - RNA, 14 nt, Marburg virus
aaaacuaugaagaa

SEQ ID NO: 3047113 - RNA, 23 nt, Marburg virus
gcaaagagcacuaacaacacgaa

SEQ ID NO: 3047114 - RNA, 20 nt, Marburg virus
uucgauacacguuauaucuu

SEQ ID NO: 3047115 - RNA, 15 nt, Marburg virus
aggaucaagaauuac

SEQ ID NO: 3047116 - RNA, 14 nt, Marburg virus
aaucaccaauucau

SEQ ID NO: 3047117 - RNA, 20 nt, Marburg virus
agucccucgcccaugucaaa

SEQ ID NO: 3047118 - RNA, 15 nt, Marburg virus
ugagauuaaaaagac

SEQ ID NO: 3047119 - RNA, 20 nt, Marburg virus
gauuuagaucuauuguucau

SEQ ID NO: 3047120 - RNA, 17 nt, Marburg virus
ccaaaccgcaucaucua

SEQ ID NO: 3047121 - RNA, 18 nt, Marburg virus
ucgauauaauacauacua

SEQ ID NO: 3047122 - RNA, 14 nt, Marburg virus
augaucaguucaaa

SEQ ID NO: 3047123 - RNA, 13 nt, Marburg virus
uauaaaauuaaaa

SEQ ID NO: 3047124 - RNA, 17 nt, Marburg virus
guauagucauuauucac

SEQ ID NO: 3047125 - RNA, 17 nt, Marburg virus
caugcccccccacaaca

SEQ ID NO: 3047126 - RNA, 23 nt, Marburg virus
uuauacccacaagagauacuguu

SEQ ID NO: 3047127 - RNA, 15 nt, Marburg virus
cagaguggcaacaaa

SEQ ID NO: 3047128 - RNA, 19 nt, Marburg virus
uggcucgacgucuuaaaag

SEQ ID NO: 3047129 - RNA, 15 nt, Marburg virus
aggacaaagaggguc

SEQ ID NO: 3047130 - RNA, 20 nt, Marburg virus
aaaugggaaggacacuggaa

SEQ ID NO: 3047131 - RNA, 15 nt, Marburg virus
aaaacaugcuacaau

SEQ ID NO: 3047132 - RNA, 17 nt, Marburg virus
gccucauacgaucauuu

SEQ ID NO: 3047133 - RNA, 12 nt, Marburg virus
cccuccaaaccu

SEQ ID NO: 3047134 - RNA, 17 nt, Marburg virus
auuauaaacuuguagaa

SEQ ID NO: 3047135 - RNA, 21 nt, Marburg virus
uacaacuucccuucauauuug

SEQ ID NO: 3047136 - RNA, 22 nt, Marburg virus
gaaauacaaccuugccuuccga

SEQ ID NO: 3047137 - RNA, 23 nt, Marburg virus
gugagacaacauaagcuaucaaa

SEQ ID NO: 3047138 - RNA, 17 nt, Marburg virus
gaaucaaacaugugcuc

SEQ ID NO: 3047139 - RNA, 16 nt, Marburg virus
uaucauucucaaggau

SEQ ID NO: 3047140 - RNA, 20 nt, Marburg virus
augcccccccacaacaccac

SEQ ID NO: 3047141 - RNA, 16 nt, Marburg virus
ugaggaagaucaacau

SEQ ID NO: 3047142 - RNA, 19 nt, Marburg virus
uguaauaugccaauuaaga

SEQ ID NO: 3047143 - RNA, 12 nt, Marburg virus
gcacgccacagc

SEQ ID NO: 3047144 - RNA, 13 nt, Marburg virus
gccaauuaagaaa

SEQ ID NO: 3047145 - RNA, 17 nt, Marburg virus
ucauugugcccuucauu

SEQ ID NO: 3047146 - RNA, 19 nt, Marburg virus
auugccauguacuuggaag

SEQ ID NO: 3047147 - RNA, 23 nt, Marburg virus
uuaaagguuuucuuuaauauuca

SEQ ID NO: 3047148 - RNA, 20 nt, Marburg virus
uauucuuaagcuaucuuaaa

SEQ ID NO: 3047149 - RNA, 23 nt, Marburg virus
uacucuaaugauuguaauaauua

SEQ ID NO: 3047150 - RNA, 18 nt, Marburg virus
aaaaagaugaacaaaaag

SEQ ID NO: 3047151 - RNA, 14 nt, Marburg virus
cuacuaacaacacc

SEQ ID NO: 3047152 - RNA, 21 nt, Marburg virus
aauuaaaaaauuaaaaaacuu

SEQ ID NO: 3047153 - RNA, 23 nt, Marburg virus
auaaucaccaauucauuguaaau

SEQ ID NO: 3047154 - RNA, 16 nt, Marburg virus
auauuucagaaagaaa

SEQ ID NO: 3047155 - RNA, 14 nt, Marburg virus
uuaucauucucaag

SEQ ID NO: 3047156 - RNA, 12 nt, Marburg virus
auaagagucaaa

SEQ ID NO: 3047157 - RNA, 22 nt, Marburg virus
aauugauaaaauauuacuuuga

SEQ ID NO: 3047158 - RNA, 19 nt, Marburg virus
gaagguaugaugaagaaaa

SEQ ID NO: 3047159 - RNA, 22 nt, Marburg virus
aaaauauuacuuugaucaauuu

SEQ ID NO: 3047160 - RNA, 14 nt, Marburg virus
uguugcauaucuuc

SEQ ID NO: 3047161 - RNA, 23 nt, Marburg virus
caguaaaagaagguaugaugaag

SEQ ID NO: 3047162 - RNA, 13 nt, Marburg virus
auaaguuuaagau

SEQ ID NO: 3047163 - RNA, 17 nt, Marburg virus
aucuacauuaauuccuu

SEQ ID NO: 3047164 - RNA, 22 nt, Marburg virus
uuguaagaauuaauuuacucuu

SEQ ID NO: 3047165 - RNA, 11 nt, Marburg virus
uuguaccucua

SEQ ID NO: 3047166 - RNA, 12 nt, Marburg virus
augaucuucaag

SEQ ID NO: 3047167 - RNA, 15 nt, Marburg virus
gcauuggaauagaag

SEQ ID NO: 3047168 - RNA, 14 nt, Marburg virus
aggcauaucuuaau

SEQ ID NO: 3047169 - RNA, 19 nt, Marburg virus
uaaaagaacgaucugcugu

SEQ ID NO: 3047170 - RNA, 13 nt, Marburg virus
uuugauucaagau

SEQ ID NO: 3047171 - RNA, 16 nt, Marburg virus
acagccacugaaaaug

SEQ ID NO: 3047172 - RNA, 14 nt, Marburg virus
ucaacuuaagaaug

SEQ ID NO: 3047173 - RNA, 19 nt, Marburg virus
agaaccacugcaccagcug

SEQ ID NO: 3047174 - RNA, 17 nt, Marburg virus
uacuugggcuugaagac

SEQ ID NO: 3047175 - RNA, 21 nt, Marburg virus
uaguaauguuuuauaaacaau

SEQ ID NO: 3047176 - RNA, 18 nt, Marburg virus
ccuccaaaagacaugugu

SEQ ID NO: 3047177 - RNA, 21 nt, Marburg virus
acagaagggacaauguugaug

SEQ ID NO: 3047178 - RNA, 21 nt, Marburg virus
ggauuuuucuccuaaggaaaa

SEQ ID NO: 3047179 - RNA, 18 nt, Marburg virus
aucaagggaaauaauaac

SEQ ID NO: 3047180 - RNA, 12 nt, Marburg virus
auuaaaaacaag

SEQ ID NO: 3047181 - RNA, 13 nt, Marburg virus
cauauuuuaacuu

SEQ ID NO: 3047182 - RNA, 15 nt, Marburg virus
gacaaguaacaaugg

SEQ ID NO: 3047183 - RNA, 15 nt, Marburg virus
aaguuuuguuacuga

SEQ ID NO: 3047184 - RNA, 16 nt, Marburg virus
auuaaaagaaaaagag

SEQ ID NO: 3047185 - RNA, 21 nt, Marburg virus
ucaauacaacuucccuucaua

SEQ ID NO: 3047186 - RNA, 20 nt, Marburg virus
uauuccuucugaaauaguaa

SEQ ID NO: 3047187 - RNA, 14 nt, Marburg virus
aguucuuuaaauuu

SEQ ID NO: 3047188 - RNA, 20 nt, Marburg virus
guuagacgccaguuauccau

SEQ ID NO: 3047189 - RNA, 15 nt, Marburg virus
uggaauagcagauuu

SEQ ID NO: 3047190 - RNA, 17 nt, Marburg virus
caaucugggaucauauu

SEQ ID NO: 3047191 - RNA, 22 nt, Marburg virus
auuuuuggaugcauuucaccag

SEQ ID NO: 3047192 - RNA, 13 nt, Marburg virus
auaaucugauugu

SEQ ID NO: 3047193 - RNA, 16 nt, Marburg virus
uagagaucaugaccuu

SEQ ID NO: 3047194 - RNA, 19 nt, Marburg virus
aaucuuuuggaugcaaacc

SEQ ID NO: 3047195 - RNA, 15 nt, Marburg virus
uucaacuaaacuugc

SEQ ID NO: 3047196 - RNA, 17 nt, Marburg virus
gacauguauaucaugug

SEQ ID NO: 3047197 - RNA, 12 nt, Marburg virus
ucuuuucucaac

SEQ ID NO: 3047198 - RNA, 19 nt, Marburg virus
ucauucaaacaccccaaau

SEQ ID NO: 3047199 - RNA, 23 nt, Marburg virus
gccuacucuggagaaaaugagaa

SEQ ID NO: 3047200 - RNA, 14 nt, Marburg virus
aucgaugagcucaa

SEQ ID NO: 3047201 - RNA, 18 nt, Marburg virus
gcauauccuuuguugaua

SEQ ID NO: 3047202 - RNA, 19 nt, Marburg virus
uacaaucacccaauuuacu

SEQ ID NO: 3047203 - RNA, 24 nt, Marburg virus
caaaauauaucuuuugcaagcgau

SEQ ID NO: 3047204 - RNA, 16 nt, Marburg virus
ucgggcuguuccuccc

SEQ ID NO: 3047205 - RNA, 18 nt, Marburg virus
auauaaguggcuuaaauu

SEQ ID NO: 3047206 - RNA, 19 nt, Marburg virus
uaauuucaacuggaagaac

SEQ ID NO: 3047207 - RNA, 11 nt, Marburg virus
uaaaagggaaa

SEQ ID NO: 3047208 - RNA, 13 nt, Marburg virus
uuucauucaaugu

SEQ ID NO: 3047209 - RNA, 16 nt, Marburg virus
uacuuaagucauucuu

SEQ ID NO: 3047210 - RNA, 20 nt, Marburg virus
guuucaccuuucuguugauu

SEQ ID NO: 3047211 - RNA, 16 nt, Marburg virus
agaagcauuauugcau

SEQ ID NO: 3047212 - RNA, 12 nt, Marburg virus
uaauaaaugcuc

SEQ ID NO: 3047213 - RNA, 14 nt, Marburg virus
uuaaucauguugau

SEQ ID NO: 3047214 - RNA, 13 nt, Marburg virus
cucauaacauccg

SEQ ID NO: 3047215 - RNA, 20 nt, Marburg virus
aucuauuugaccucagacau

SEQ ID NO: 3047216 - RNA, 17 nt, Marburg virus
gagauuaaaaagacuac

SEQ ID NO: 3047217 - RNA, 23 nt, Marburg virus
cuggaagaaccacugcaccagcu

SEQ ID NO: 3047218 - RNA, 17 nt, Marburg virus
gaaaaacuaugaagaac

SEQ ID NO: 3047219 - RNA, 19 nt, Marburg virus
gauuaguuuguauugauuu

SEQ ID NO: 3047220 - RNA, 15 nt, Marburg virus
gcaugaauguugauc

SEQ ID NO: 3047221 - RNA, 14 nt, Marburg virus
auaauuuucacaau

SEQ ID NO: 3047222 - RNA, 15 nt, Marburg virus
auguaaugaacaaua

SEQ ID NO: 3047223 - RNA, 13 nt, Marburg virus
aaucaccaauuca

SEQ ID NO: 3047224 - RNA, 14 nt, Marburg virus
aacuccauuccccc

SEQ ID NO: 3047225 - RNA, 20 nt, Marburg virus
accuugaaagaguuaaaugg

SEQ ID NO: 3047226 - RNA, 14 nt, Marburg virus
caauuaaucauguu

SEQ ID NO: 3047227 - RNA, 16 nt, Marburg virus
gacgucuucauugaga

SEQ ID NO: 3047228 - RNA, 16 nt, Marburg virus
uucuuuaauauucaga

SEQ ID NO: 3047229 - RNA, 16 nt, Marburg virus
uauuucaacuuaagaa

SEQ ID NO: 3047230 - RNA, 12 nt, Marburg virus
aaccaaaacaau

SEQ ID NO: 3047231 - RNA, 20 nt, Marburg virus
gaauacaacuccacgaagaa

SEQ ID NO: 3047232 - RNA, 19 nt, Marburg virus
accaccucguaauuucaac

SEQ ID NO: 3047233 - RNA, 16 nt, Marburg virus
accucuaaggaaaauc

SEQ ID NO: 3047234 - RNA, 22 nt, Marburg virus
acaauggauuugcauuuaacuc

SEQ ID NO: 3047235 - RNA, 12 nt, Marburg virus
cugguuuucuua

SEQ ID NO: 3047236 - RNA, 14 nt, Marburg virus
uaaauaguugucau

SEQ ID NO: 3047237 - RNA, 15 nt, Marburg virus
uaauugggaacacca

SEQ ID NO: 3047238 - RNA, 13 nt, Marburg virus
aauuuucaaucau

SEQ ID NO: 3047239 - RNA, 18 nt, Marburg virus
aguauacuguaacauaua

SEQ ID NO: 3047240 - RNA, 21 nt, Marburg virus
aauaaaugcuccaauugauuu

SEQ ID NO: 3047241 - RNA, 14 nt, Marburg virus
ucuuauugcgagac

SEQ ID NO: 3047242 - RNA, 18 nt, Marburg virus
aaaccauaaggaaaaaug

SEQ ID NO: 3047243 - RNA, 14 nt, Marburg virus
ugcauaucuuccaa

SEQ ID NO: 3047244 - RNA, 18 nt, Marburg virus
uccaucugcauaagaagc

SEQ ID NO: 3047245 - RNA, 22 nt, Marburg virus
cuguaaucaacacugcuguauc

SEQ ID NO: 3047246 - RNA, 19 nt, Marburg virus
cacauagguucugauuuag

SEQ ID NO: 3047247 - RNA, 16 nt, Marburg virus
gaaguauccucuggag

SEQ ID NO: 3047248 - RNA, 18 nt, Marburg virus
aauacaacuccacgaaga

SEQ ID NO: 3047249 - RNA, 19 nt, Marburg virus
ccacugaaaaugaacaaac

SEQ ID NO: 3047250 - RNA, 19 nt, Marburg virus
uucaauguuaguuacucaa

SEQ ID NO: 3047251 - RNA, 12 nt, Marburg virus
gaagggacaaug

SEQ ID NO: 3047252 - RNA, 22 nt, Marburg virus
ugcaacaaccccguggaaggag

SEQ ID NO: 3047253 - RNA, 20 nt, Marburg virus
uuuuugcaaacauauugaaa

SEQ ID NO: 3047254 - RNA, 12 nt, Marburg virus
guugcccuccaa

SEQ ID NO: 3047255 - RNA, 14 nt, Marburg virus
aauuucaacuggaa

SEQ ID NO: 3047256 - RNA, 16 nt, Marburg virus
auuuuccuuaauuaau

SEQ ID NO: 3047257 - RNA, 15 nt, Marburg virus
auacaaagacacuaa

SEQ ID NO: 3047258 - RNA, 21 nt, Marburg virus
caggaaaucuuaccacagcaa

SEQ ID NO: 3047259 - RNA, 23 nt, Marburg virus
ccagagaucaaacccacaagcac

SEQ ID NO: 3047260 - RNA, 19 nt, Marburg virus
uauaggaacagauuuagag

SEQ ID NO: 3047261 - RNA, 14 nt, Marburg virus
uauaagcaucucuu

SEQ ID NO: 3047262 - RNA, 16 nt, Marburg virus
aguauaaaguauaauu

SEQ ID NO: 3047263 - RNA, 13 nt, Marburg virus
auugauauugaac

SEQ ID NO: 3047264 - RNA, 15 nt, Marburg virus
cauagaaaacauauu

SEQ ID NO: 3047265 - RNA, 12 nt, Marburg virus
aacaugaaaauu

SEQ ID NO: 3047266 - RNA, 19 nt, Marburg virus
auuacuacggguuaugaug

SEQ ID NO: 3047267 - RNA, 17 nt, Marburg virus
aucaacaaugccaccca

SEQ ID NO: 3047268 - RNA, 15 nt, Marburg virus
auuaauccuugaagu

SEQ ID NO: 3047269 - RNA, 13 nt, Marburg virus
aauccgaaauugc

SEQ ID NO: 3047270 - RNA, 17 nt, Marburg virus
ucaacuggaagaaccac

SEQ ID NO: 3047271 - RNA, 17 nt, Marburg virus
uaaacuugcauauccuu

SEQ ID NO: 3047272 - RNA, 16 nt, Marburg virus
uauuucggaacaaauu

SEQ ID NO: 3047273 - RNA, 15 nt, Marburg virus
aaacagacauauaca

SEQ ID NO: 3047274 - RNA, 15 nt, Marburg virus
uucauaaucuguuug

SEQ ID NO: 3047275 - RNA, 16 nt, Marburg virus
cauuuuuggaugcauu

SEQ ID NO: 3047276 - RNA, 13 nt, Marburg virus
aaaaacuaaauua

SEQ ID NO: 3047277 - RNA, 23 nt, Marburg virus
acagaggauugagucauauuaug

SEQ ID NO: 3047278 - RNA, 16 nt, Marburg virus
cuaauauuacuaacaa

SEQ ID NO: 3047279 - RNA, 21 nt, Marburg virus
agauauugggaaauuggauga

SEQ ID NO: 3047280 - RNA, 12 nt, Marburg virus
uuucuucaauau

SEQ ID NO: 3047281 - RNA, 15 nt, Marburg virus
ucucgaggcaaggac

SEQ ID NO: 3047282 - RNA, 13 nt, Marburg virus
ugucaauaagaca

SEQ ID NO: 3047283 - RNA, 22 nt, Marburg virus
cuuucacuuuagaggcaauaau

SEQ ID NO: 3047284 - RNA, 19 nt, Marburg virus
cagagaaguuacacaagag

SEQ ID NO: 3047285 - RNA, 14 nt, Marburg virus
aacaacacagacca

SEQ ID NO: 3047286 - RNA, 23 nt, Marburg virus
agaauuauucauccaaguuguuu

SEQ ID NO: 3047287 - RNA, 22 nt, Marburg virus
auuuauucgauuggaugcacuu

SEQ ID NO: 3047288 - RNA, 16 nt, Marburg virus
cuuguaguaaggggac

SEQ ID NO: 3047289 - RNA, 20 nt, Marburg virus
acuugcauauccuuuguuga

SEQ ID NO: 3047290 - RNA, 14 nt, Marburg virus
uacuauugugugag

SEQ ID NO: 3047291 - RNA, 18 nt, Marburg virus
caguucuaagagaacaca

SEQ ID NO: 3047292 - RNA, 18 nt, Marburg virus
uagaucacggaucaagca

SEQ ID NO: 3047293 - RNA, 18 nt, Marburg virus
uaagagaacacagucaaa

SEQ ID NO: 3047294 - RNA, 15 nt, Marburg virus
auuguggacauguau

SEQ ID NO: 3047295 - RNA, 13 nt, Marburg virus
caaacacuuggaa

SEQ ID NO: 3047296 - RNA, 14 nt, Marburg virus
ccaagcaauugacu

SEQ ID NO: 3047297 - RNA, 18 nt, Marburg virus
aucauauuuuaacuucca

SEQ ID NO: 3047298 - RNA, 19 nt, Marburg virus
auuaagaaaaacuaugaag

SEQ ID NO: 3047299 - RNA, 18 nt, Marburg virus
uugagggacaaauuauug

SEQ ID NO: 3047300 - RNA, 16 nt, Marburg virus
cacagcaaagagcacu

SEQ ID NO: 3047301 - RNA, 18 nt, Marburg virus
auuaaaaaauuaaaaaac

SEQ ID NO: 3047302 - RNA, 18 nt, Marburg virus
cguaguuaaauuucuaga

SEQ ID NO: 3047303 - RNA, 22 nt, Marburg virus
uuaaauuagcauggauauucau

SEQ ID NO: 3047304 - RNA, 17 nt, Marburg virus
cuguuuuaauuaagaaa

SEQ ID NO: 3047305 - RNA, 13 nt, Marburg virus
caccacaauucag

SEQ ID NO: 3047306 - RNA, 18 nt, Marburg virus
uguguuuucaaauuuaua

SEQ ID NO: 3047307 - RNA, 17 nt, Marburg virus
gcuccggaacucuccag

SEQ ID NO: 3047308 - RNA, 16 nt, Marburg virus
cugaaauaguaagaaa

SEQ ID NO: 3047309 - RNA, 14 nt, Marburg virus
aacauuucuucaga

SEQ ID NO: 3047310 - RNA, 18 nt, Marburg virus
uccagcaauuacaacaca

SEQ ID NO: 3047311 - RNA, 15 nt, Marburg virus
acuaaucaauucacc

SEQ ID NO: 3047312 - RNA, 22 nt, Marburg virus
gcagacuuuuccuugaaucaaa

SEQ ID NO: 3047313 - RNA, 20 nt, Marburg virus
uggaugcauuucaccagauu

SEQ ID NO: 3047314 - RNA, 15 nt, Marburg virus
cuuucuuuuugcaaa

SEQ ID NO: 3047315 - RNA, 14 nt, Marburg virus
auauuaaagguuuu

SEQ ID NO: 3047316 - RNA, 15 nt, Marburg virus
cauacuguggcugcg

SEQ ID NO: 3047317 - RNA, 20 nt, Marburg virus
cucuaaugauuguaauaauu

SEQ ID NO: 3047318 - RNA, 18 nt, Marburg virus
aaaguugcugauuccccu

SEQ ID NO: 3047319 - RNA, 15 nt, Marburg virus
uaacuuuucaauguu

SEQ ID NO: 3047320 - RNA, 11 nt, Marburg virus
auuugaugcau

SEQ ID NO: 3047321 - RNA, 17 nt, Marburg virus
aauagauccuugaucaa

SEQ ID NO: 3047322 - RNA, 18 nt, Marburg virus
ugaugcagaguuaagaau

SEQ ID NO: 3047323 - RNA, 22 nt, Marburg virus
acugcugguuuaauuaaaaacc

SEQ ID NO: 3047324 - RNA, 21 nt, Marburg virus
guguaacggaucccucuggaa

SEQ ID NO: 3047325 - RNA, 20 nt, Marburg virus
ucuuaaacuugaugaugcag

SEQ ID NO: 3047326 - RNA, 17 nt, Marburg virus
caccucguaauuucaac

SEQ ID NO: 3047327 - RNA, 15 nt, Marburg virus
auaguaauguuuuau

SEQ ID NO: 3047328 - RNA, 19 nt, Marburg virus
acuugaugaugcagcucug

SEQ ID NO: 3047329 - RNA, 13 nt, Marburg virus
gccuacucuggag

SEQ ID NO: 3047330 - RNA, 15 nt, Marburg virus
aucuugaccuuaauu

SEQ ID NO: 3047331 - RNA, 23 nt, Marburg virus
cacaagguggggaggaacaugca

SEQ ID NO: 3047332 - RNA, 13 nt, Marburg virus
ggucauuaagaag

SEQ ID NO: 3047333 - RNA, 22 nt, Marburg virus
uaauuguaggauuccacaucau

SEQ ID NO: 3047334 - RNA, 18 nt, Marburg virus
uuaagaaucaacuaacaa

SEQ ID NO: 3047335 - RNA, 13 nt, Marburg virus
aauuucuugaaaa

SEQ ID NO: 3047336 - RNA, 20 nt, Marburg virus
cuugggagauuuuuaagaag

SEQ ID NO: 3047337 - RNA, 17 nt, Marburg virus
ccaagcacgccacagca

SEQ ID NO: 3047338 - RNA, 15 nt, Marburg virus
cuaagugaaggagag

SEQ ID NO: 3047339 - RNA, 23 nt, Marburg virus
aacuauaauucaggggaaauuga

SEQ ID NO: 3047340 - RNA, 21 nt, Marburg virus
uaaaaacccaaagucaacaau

SEQ ID NO: 3047341 - RNA, 12 nt, Marburg virus
acugagagggaa

SEQ ID NO: 3047342 - RNA, 22 nt, Marburg virus
acugaaaaugaacaaaccagug

SEQ ID NO: 3047343 - RNA, 16 nt, Marburg virus
cuguuuuaauuaagaa

SEQ ID NO: 3047344 - RNA, 13 nt, Marburg virus
uugagucauauua

SEQ ID NO: 3047345 - RNA, 13 nt, Marburg virus
guugacaaucaaa

SEQ ID NO: 3047346 - RNA, 16 nt, Marburg virus
aauauaaaugaaaaca

SEQ ID NO: 3047347 - RNA, 15 nt, Marburg virus
caucuuauuaaauag

SEQ ID NO: 3047348 - RNA, 19 nt, Marburg virus
uaagaaauuagggaaauac

SEQ ID NO: 3047349 - RNA, 20 nt, Marburg virus
ugacuuauuagccagaaguu

SEQ ID NO: 3047350 - RNA, 21 nt, Marburg virus
agcuuuauauguaaugaacaa

SEQ ID NO: 3047351 - RNA, 19 nt, Marburg virus
cucaccacugcccacagcc

SEQ ID NO: 3047352 - RNA, 22 nt, Marburg virus
uauuauagaggaacuaauauua

SEQ ID NO: 3047353 - RNA, 22 nt, Marburg virus
aaacaauuuggucugcagguug

SEQ ID NO: 3047354 - RNA, 14 nt, Marburg virus
auuguaagaauuaa

SEQ ID NO: 3047355 - RNA, 15 nt, Marburg virus
ggacaaugauuauug

SEQ ID NO: 3047356 - RNA, 18 nt, Marburg virus
acucuggagaaaaugaga

SEQ ID NO: 3047357 - RNA, 22 nt, Marburg virus
cuaaacgaaguaacaacaagag

SEQ ID NO: 3047358 - RNA, 18 nt, Marburg virus
cuagaugaucaguucaaa

SEQ ID NO: 3047359 - RNA, 17 nt, Marburg virus
caguagugcagaaagca

SEQ ID NO: 3047360 - RNA, 21 nt, Marburg virus
ugcaagcgaugugugcuugaa

SEQ ID NO: 3047361 - RNA, 23 nt, Marburg virus
caaagagcacuaacaacacgaaa

SEQ ID NO: 3047362 - RNA, 15 nt, Marburg virus
auaaggaaaaaugag

SEQ ID NO: 3047363 - RNA, 16 nt, Marburg virus
ugugucaaauucauuu

SEQ ID NO: 3047364 - RNA, 16 nt, Marburg virus
ucaaacccacaagcac

SEQ ID NO: 3047365 - RNA, 16 nt, Marburg virus
guucacucuucauguu

SEQ ID NO: 3047366 - RNA, 14 nt, Marburg virus
acaaucaaaucacu

SEQ ID NO: 3047367 - RNA, 17 nt, Marburg virus
ugacuauccuaaaugca

SEQ ID NO: 3047368 - RNA, 15 nt, Marburg virus
aggauaaaaggacaa

SEQ ID NO: 3047369 - RNA, 16 nt, Marburg virus
caaagagcacuaacaa

SEQ ID NO: 3047370 - RNA, 14 nt, Marburg virus
gcaauuacaugaga

SEQ ID NO: 3047371 - RNA, 13 nt, Marburg virus
cuauuugaugcau

SEQ ID NO: 3047372 - RNA, 20 nt, Marburg virus
uaugaauguuuuaucaugau

SEQ ID NO: 3047373 - RNA, 16 nt, Marburg virus
agugauaagagucaaa

SEQ ID NO: 3047374 - RNA, 13 nt, Marburg virus
auaccaaauacug

SEQ ID NO: 3047375 - RNA, 16 nt, Marburg virus
uaauucucauuguuaa

SEQ ID NO: 3047376 - RNA, 21 nt, Marburg virus
guaagaaaaacuaaugaagaa

SEQ ID NO: 3047377 - RNA, 22 nt, Marburg virus
cuugaaggcauaucuuaauaag

SEQ ID NO: 3047378 - RNA, 13 nt, Marburg virus
aacuaugaagaac

SEQ ID NO: 3047379 - RNA, 12 nt, Marburg virus
uuauuaagaaaa

SEQ ID NO: 3047380 - RNA, 23 nt, Marburg virus
uaaaagaagguaugaugaagaaa

SEQ ID NO: 3047381 - RNA, 18 nt, Marburg virus
augcaacaagucagugag

SEQ ID NO: 3047382 - RNA, 15 nt, Marburg virus
caugguauaaaacca

SEQ ID NO: 3047383 - RNA, 15 nt, Marburg virus
cuaauauuacuaaca

SEQ ID NO: 3047384 - RNA, 21 nt, Marburg virus
aaucuuuuggaugcaaaccau

SEQ ID NO: 3047385 - RNA, 18 nt, Marburg virus
auacacccgaauuugcca

SEQ ID NO: 3047386 - RNA, 15 nt, Marburg virus
gcuuacuuaaaugag

SEQ ID NO: 3047387 - RNA, 22 nt, Marburg virus
uggaugcaaaccauaaggaaaa

SEQ ID NO: 3047388 - RNA, 14 nt, Marburg virus
uugugaaucaucaa

SEQ ID NO: 3047389 - RNA, 14 nt, Marburg virus
accaaauacuggga

SEQ ID NO: 3047390 - RNA, 19 nt, Marburg virus
cagaacauuugaugcuuuc

SEQ ID NO: 3047391 - RNA, 15 nt, Marburg virus
cuuucaucaacaaug

SEQ ID NO: 3047392 - RNA, 19 nt, Marburg virus
agcuugcuuuacacaagau

SEQ ID NO: 3047393 - RNA, 21 nt, Marburg virus
ucauuaauuccuggauuuaga

SEQ ID NO: 3047394 - RNA, 20 nt, Marburg virus
aucaucuuauuaaauaguug

SEQ ID NO: 3047395 - RNA, 22 nt, Marburg virus
gaauacauucuuauauugcuug

SEQ ID NO: 3047396 - RNA, 22 nt, Marburg virus
uuccuccagugauaagagucaa

SEQ ID NO: 3047397 - RNA, 21 nt, Marburg virus
aggaguguugggacaguguuu

SEQ ID NO: 3047398 - RNA, 22 nt, Marburg virus
ugcagaaagcagucccaccaau

SEQ ID NO: 3047399 - RNA, 13 nt, Marburg virus
ugaaagaguuaaa

SEQ ID NO: 3047400 - RNA, 23 nt, Marburg virus
auugauuaagaaaaaccaaugau

SEQ ID NO: 3047401 - RNA, 13 nt, Marburg virus
auugaucaaacac

SEQ ID NO: 3047402 - RNA, 17 nt, Marburg virus
uauuugaauauucaaac

SEQ ID NO: 3047403 - RNA, 18 nt, Marburg virus
caacaccuccaagaacaa

SEQ ID NO: 3047404 - RNA, 13 nt, Marburg virus
uucaacuggaaga

SEQ ID NO: 3047405 - RNA, 21 nt, Marburg virus
auuuaucugaguccuuagaaa

SEQ ID NO: 3047406 - RNA, 17 nt, Marburg virus
agcauggauauucauag

SEQ ID NO: 3047407 - RNA, 22 nt, Marburg virus
agagucacaaccgaggaaagga

SEQ ID NO: 3047408 - RNA, 12 nt, Marburg virus
auuaaguucuuu

SEQ ID NO: 3047409 - RNA, 14 nt, Marburg virus
caccaggaaaauac

SEQ ID NO: 3047410 - RNA, 20 nt, Marburg virus
aauguuacggaaaaaagcau

SEQ ID NO: 3047411 - RNA, 22 nt, Marburg virus
auaagugauuuacuugauagaa

SEQ ID NO: 3047412 - RNA, 14 nt, Marburg virus
uaaaaugcaacaac

SEQ ID NO: 3047413 - RNA, 19 nt, Marburg virus
uuuucuuuaauauucagaa

SEQ ID NO: 3047414 - RNA, 19 nt, Marburg virus
uacuauugugugagacaac

SEQ ID NO: 3047415 - RNA, 13 nt, Marburg virus
uucaauuauccuu

SEQ ID NO: 3047416 - RNA, 22 nt, Marburg virus
caaaaaagucuucgggcuguuc

SEQ ID NO: 3047417 - RNA, 13 nt, Marburg virus
gccaucugauuua

SEQ ID NO: 3047418 - RNA, 23 nt, Marburg virus
aaacuauaauucaggggaaauug

SEQ ID NO: 3047419 - RNA, 17 nt, Marburg virus
ucauaugcuuucagaau

SEQ ID NO: 3047420 - RNA, 23 nt, Marburg virus
aacuuguaccucuaaggaaaauc

SEQ ID NO: 3047421 - RNA, 14 nt, Marburg virus
caaacccacaagca

SEQ ID NO: 3047422 - RNA, 23 nt, Marburg virus
aggauuauaucauucucuucgau

SEQ ID NO: 3047423 - RNA, 13 nt, Marburg virus
gcaucccgcaguc

SEQ ID NO: 3047424 - RNA, 14 nt, Marburg virus
acacauacaugcaa

SEQ ID NO: 3047425 - RNA, 14 nt, Marburg virus
ugaacuaaggaaau

SEQ ID NO: 3047426 - RNA, 12 nt, Marburg virus
uuuccuucucau

SEQ ID NO: 3047427 - RNA, 14 nt, Marburg virus
aagcaccugagaac

SEQ ID NO: 3047428 - RNA, 22 nt, Marburg virus
gcauuuguauagauucaauuau

SEQ ID NO: 3047429 - RNA, 19 nt, Marburg virus
acaacauagaaaacauauu

SEQ ID NO: 3047430 - RNA, 16 nt, Marburg virus
gacaagugacaaaauu

SEQ ID NO: 3047431 - RNA, 12 nt, Marburg virus
uugauuaagaaa

SEQ ID NO: 3047432 - RNA, 16 nt, Marburg virus
ugauauucaauuguua

SEQ ID NO: 3047433 - RNA, 16 nt, Marburg virus
aucccucuggaaaauc

SEQ ID NO: 3047434 - RNA, 21 nt, Marburg virus
auugacuccucaacaauacug

SEQ ID NO: 3047435 - RNA, 16 nt, Marburg virus
uuaaaacuauaauuca

SEQ ID NO: 3047436 - RNA, 16 nt, Marburg virus
uaugcaugucagugau

SEQ ID NO: 3047437 - RNA, 19 nt, Marburg virus
uuaaaaccuaaagucaugu

SEQ ID NO: 3047438 - RNA, 22 nt, Marburg virus
ccaucugauuuaacuuaauaaa

SEQ ID NO: 3047439 - RNA, 14 nt, Marburg virus
uauugaaauaaagu

SEQ ID NO: 3047440 - RNA, 23 nt, Marburg virus
agguuuuuuauucucuucuuucu

SEQ ID NO: 3047441 - RNA, 14 nt, Marburg virus
ucccagagaagaca

SEQ ID NO: 3047442 - RNA, 21 nt, Marburg virus
uaagaaaaacuaaugaagaac

SEQ ID NO: 3047443 - RNA, 11 nt, Marburg virus
ccaacaggaaa

SEQ ID NO: 3047444 - RNA, 14 nt, Marburg virus
aaucauuaauuccu

SEQ ID NO: 3047445 - RNA, 22 nt, Marburg virus
aucuaggugauugugaaaagac

SEQ ID NO: 3047446 - RNA, 23 nt, Marburg virus
uuccuucugaaauaguaagaaaa

SEQ ID NO: 3047447 - RNA, 23 nt, Marburg virus
acaacauauugugucaaauucau

SEQ ID NO: 3047448 - RNA, 20 nt, Marburg virus
uugugagauuauaaacuugu

SEQ ID NO: 3047449 - RNA, 23 nt, Marburg virus
aauauggccaguuccagcaauua

SEQ ID NO: 3047450 - RNA, 22 nt, Marburg virus
gcaauaccucaacgguguucaa

SEQ ID NO: 3047451 - RNA, 17 nt, Marburg virus
aagcgaugggcuuucag

SEQ ID NO: 3047452 - RNA, 12 nt, Marburg virus
acuguggcugcg

SEQ ID NO: 3047453 - RNA, 17 nt, Marburg virus
uaaaaaucccaacaaug

SEQ ID NO: 3047454 - RNA, 16 nt, Marburg virus
uccucaacaauacugu

SEQ ID NO: 3047455 - RNA, 23 nt, Marburg virus
aaaucuuaccacagcaaagagca

SEQ ID NO: 3047456 - RNA, 13 nt, Marburg virus
uauuaaauaucca

SEQ ID NO: 3047457 - RNA, 13 nt, Marburg virus
uuaaaauauucuu

SEQ ID NO: 3047458 - RNA, 19 nt, Marburg virus
gaaaaacuaugaagaacau

SEQ ID NO: 3047459 - RNA, 18 nt, Marburg virus
gaacaaauugaccaaauc

SEQ ID NO: 3047460 - RNA, 16 nt, Marburg virus
uuagaucuauuguuca

SEQ ID NO: 3047461 - RNA, 17 nt, Marburg virus
aacagaucauuaucacu

SEQ ID NO: 3047462 - RNA, 14 nt, Marburg virus
uuaaaauuaauuca

SEQ ID NO: 3047463 - RNA, 14 nt, Marburg virus
aauaguaauguuuu

SEQ ID NO: 3047464 - RNA, 21 nt, Marburg virus
caauaugaugcaauuaaucau

SEQ ID NO: 3047465 - RNA, 17 nt, Marburg virus
cuguuacucgugcauuu

SEQ ID NO: 3047466 - RNA, 12 nt, Marburg virus
cugaugccacca

SEQ ID NO: 3047467 - RNA, 12 nt, Marburg virus
aagaugaacaaa

SEQ ID NO: 3047468 - RNA, 15 nt, Marburg virus
aauugaccaaaucaa

SEQ ID NO: 3047469 - RNA, 19 nt, Marburg virus
cugaacuaccuccacagau

SEQ ID NO: 3047470 - RNA, 24 nt, Marburg virus
aauacugggauggcauuguugcau

SEQ ID NO: 3047471 - RNA, 15 nt, Marburg virus
aauaacgauugauua

SEQ ID NO: 3047472 - RNA, 22 nt, Marburg virus
caagggcuuucaucaacaaugc

SEQ ID NO: 3047473 - RNA, 16 nt, Marburg virus
cgcaaccaccaaaccg

SEQ ID NO: 3047474 - RNA, 15 nt, Marburg virus
uuauggugugaagaa

SEQ ID NO: 3047475 - RNA, 18 nt, Marburg virus
augugaauguaaauuaag

SEQ ID NO: 3047476 - RNA, 23 nt, Marburg virus
gcuacugagcccuucuucuaauc

SEQ ID NO: 3047477 - RNA, 15 nt, Marburg virus
augcauuaauguuuu

SEQ ID NO: 3047478 - RNA, 17 nt, Marburg virus
uuucuucagaacuguuc

SEQ ID NO: 3047479 - RNA, 16 nt, Marburg virus
uagacagaacacaaag

SEQ ID NO: 3047480 - RNA, 23 nt, Marburg virus
acuacguuacguuuucucugaug

SEQ ID NO: 3047481 - RNA, 22 nt, Marburg virus
uguuaugggugauaaucaaugu

SEQ ID NO: 3047482 - RNA, 15 nt, Marburg virus
uaguguucuuuuacu

SEQ ID NO: 3047483 - RNA, 21 nt, Marburg virus
cuuaaauuauacccacaagag

SEQ ID NO: 3047484 - RNA, 23 nt, Marburg virus
aaguaacuggaaguuuauaggaa

SEQ ID NO: 3047485 - RNA, 17 nt, Marburg virus
aauagugguaucaucuu

SEQ ID NO: 3047486 - RNA, 13 nt, Marburg virus
auguuauaugcau

SEQ ID NO: 3047487 - RNA, 14 nt, Marburg virus
cugcauaagaagca

SEQ ID NO: 3047488 - RNA, 20 nt, Marburg virus
ccaauuacgacacacagagc

SEQ ID NO: 3047489 - RNA, 13 nt, Marburg virus
ccgucacaugaau

SEQ ID NO: 3047490 - RNA, 14 nt, Marburg virus
uauccuaaaugcaa

SEQ ID NO: 3047491 - RNA, 11 nt, Marburg virus
ucaccuugaaa

SEQ ID NO: 3047492 - RNA, 20 nt, Marburg virus
cuuacuugggcuugaagaca

SEQ ID NO: 3047493 - RNA, 15 nt, Marburg virus
aaacuuguagaauua

SEQ ID NO: 3047494 - RNA, 14 nt, Marburg virus
ucaaaugaccaaau

SEQ ID NO: 3047495 - RNA, 22 nt, Marburg virus
aacuaaugaagaacauuaauug

SEQ ID NO: 3047496 - RNA, 18 nt, Marburg virus
aauugcuauaaugauaca

SEQ ID NO: 3047497 - RNA, 18 nt, Marburg virus
gucucaaaccguacacaa

SEQ ID NO: 3047498 - RNA, 12 nt, Marburg virus
aacuaaggaaau

SEQ ID NO: 3047499 - RNA, 21 nt, Marburg virus
cagaauguugcgugaaggaaa

SEQ ID NO: 3047500 - RNA, 20 nt, Marburg virus
agccgacaagaugucgaaag

SEQ ID NO: 3047501 - RNA, 13 nt, Marburg virus
uuaaaauuucagg

SEQ ID NO: 3047502 - RNA, 13 nt, Marburg virus
uuuaacuuccauu

SEQ ID NO: 3047503 - RNA, 21 nt, Marburg virus
uauuuucaagcaccugagaac

SEQ ID NO: 3047504 - RNA, 14 nt, Marburg virus
agcacgccacagca

SEQ ID NO: 3047505 - RNA, 18 nt, Marburg virus
acuugauagaaugucaag

SEQ ID NO: 3047506 - RNA, 21 nt, Marburg virus
uguaagcuuacaagcuucaaa

SEQ ID NO: 3047507 - RNA, 21 nt, Marburg virus
auugugcuaaugcuuaucauu

SEQ ID NO: 3047508 - RNA, 15 nt, Marburg virus
agacccaaacaauga

SEQ ID NO: 3047509 - RNA, 16 nt, Marburg virus
accaucuuaauagaag

SEQ ID NO: 3047510 - RNA, 13 nt, Marburg virus
cuuuuacuggaag

SEQ ID NO: 3047511 - RNA, 13 nt, Marburg virus
uaaauuaagaaaa

SEQ ID NO: 3047512 - RNA, 19 nt, Marburg virus
auuucaggcaauaaagcug

SEQ ID NO: 3047513 - RNA, 15 nt, Marburg virus
aaaccauaaggaaaa

SEQ ID NO: 3047514 - RNA, 21 nt, Marburg virus
aaaaagaguugaauauaggaa

SEQ ID NO: 3047515 - RNA, 19 nt, Marburg virus
uagcugucuugauugcucu

SEQ ID NO: 3047516 - RNA, 13 nt, Marburg virus
ucaaauugaucaa

SEQ ID NO: 3047517 - RNA, 19 nt, Marburg virus
gguaugacugagugaucag

SEQ ID NO: 3047518 - RNA, 22 nt, Marburg virus
gugaguggcuuuuaucaucaaa

SEQ ID NO: 3047519 - RNA, 14 nt, Marburg virus
aaguaaugaaaaua

SEQ ID NO: 3047520 - RNA, 13 nt, Marburg virus
ucuccuaaggaaa

SEQ ID NO: 3047521 - RNA, 22 nt, Marburg virus
aauuuugcgaggaauuauaaaa

SEQ ID NO: 3047522 - RNA, 16 nt, Marburg virus
uaucauagucaagagu

SEQ ID NO: 3047523 - RNA, 13 nt, Marburg virus
agacuugaacaca

SEQ ID NO: 3047524 - RNA, 16 nt, Marburg virus
uaaucuaacaaaucgu

SEQ ID NO: 3047525 - RNA, 19 nt, Marburg virus
aaagcauucccuagcaaca

SEQ ID NO: 3047526 - RNA, 12 nt, Marburg virus
ccauaaggaaaa

SEQ ID NO: 3047527 - RNA, 23 nt, Marburg virus
uugccucuguuucuucuguuuuc

SEQ ID NO: 3047528 - RNA, 13 nt, Marburg virus
ucuccagaagaca

SEQ ID NO: 3047529 - RNA, 14 nt, Marburg virus
acaaguaacaaugg

SEQ ID NO: 3047530 - RNA, 17 nt, Marburg virus
aaggggaugucagaaau

SEQ ID NO: 3047531 - RNA, 19 nt, Marburg virus
aauacagacaagacuuuua

SEQ ID NO: 3047532 - RNA, 14 nt, Marburg virus
ggacaaauuaauug

SEQ ID NO: 3047533 - RNA, 17 nt, Marburg virus
guaucuuuaccaaauau

SEQ ID NO: 3047534 - RNA, 16 nt, Marburg virus
cugaucccacuuguaa

SEQ ID NO: 3047535 - RNA, 14 nt, Marburg virus
ucuccuaaggaaaa

SEQ ID NO: 3047536 - RNA, 15 nt, Marburg virus
gaaaauguuauugau

SEQ ID NO: 3047537 - RNA, 13 nt, Marburg virus
cuugauuaaaaac

SEQ ID NO: 3047538 - RNA, 20 nt, Marburg virus
cuggcgcccauccaaggaca

SEQ ID NO: 3047539 - RNA, 13 nt, Marburg virus
ugggcuuucagga

SEQ ID NO: 3047540 - RNA, 15 nt, Marburg virus
uucaacagaaauugu

SEQ ID NO: 3047541 - RNA, 17 nt, Marburg virus
gaggcaguucuaagaga

SEQ ID NO: 3047542 - RNA, 15 nt, Marburg virus
agaucaaacccacaa

SEQ ID NO: 3047543 - RNA, 13 nt, Marburg virus
uacauuaauuccu

SEQ ID NO: 3047544 - RNA, 19 nt, Marburg virus
aucaaacugccaaauccuu

SEQ ID NO: 3047545 - RNA, 12 nt, Marburg virus
aauaagauguuc

SEQ ID NO: 3047546 - RNA, 11 nt, Marburg virus
cauucaacuua

SEQ ID NO: 3047547 - RNA, 17 nt, Marburg virus
aauaccacuauguuaua

SEQ ID NO: 3047548 - RNA, 19 nt, Marburg virus
aauugcuauaaugauacaa

SEQ ID NO: 3047549 - RNA, 21 nt, Marburg virus
ggaacauagcagcuaugauug

SEQ ID NO: 3047550 - RNA, 15 nt, Marburg virus
uuggagcguucagga

SEQ ID NO: 3047551 - RNA, 16 nt, Marburg virus
caagcacgccacagca

SEQ ID NO: 3047552 - RNA, 17 nt, Marburg virus
gcccacagcccguccag

SEQ ID NO: 3047553 - RNA, 16 nt, Marburg virus
cccagcacacccacuc

SEQ ID NO: 3047554 - RNA, 21 nt, Marburg virus
cuaaucuacugaaaucaacuu

SEQ ID NO: 3047555 - RNA, 16 nt, Marburg virus
uaaccauuguaagaau

SEQ ID NO: 3047556 - RNA, 12 nt, Marburg virus
aucgugaagaaa

SEQ ID NO: 3047557 - RNA, 22 nt, Marburg virus
aggacagguguaccucccaaga

SEQ ID NO: 3047558 - RNA, 13 nt, Marburg virus
uugcuuuacacaa

SEQ ID NO: 3047559 - RNA, 14 nt, Marburg virus
gaggagacguucuc

SEQ ID NO: 3047560 - RNA, 16 nt, Marburg virus
cauugccuccacaaca

SEQ ID NO: 3047561 - RNA, 18 nt, Marburg virus
ugaaaacaauggcaagau

SEQ ID NO: 3047562 - RNA, 14 nt, Marburg virus
auuucagaaagaaa

SEQ ID NO: 3047563 - RNA, 15 nt, Marburg virus
aaauauaaaagaacg

SEQ ID NO: 3047564 - RNA, 22 nt, Marburg virus
caaaauacccucaccacugccc

SEQ ID NO: 3047565 - RNA, 18 nt, Marburg virus
augcuccggaacucucca

SEQ ID NO: 3047566 - RNA, 19 nt, Marburg virus
aauucaagacgcuuauuca

SEQ ID NO: 3047567 - RNA, 20 nt, Marburg virus
uuuuauauauuauagaggaa

SEQ ID NO: 3047568 - RNA, 14 nt, Marburg virus
accaaucauauucc

SEQ ID NO: 3047569 - RNA, 14 nt, Marburg virus
ucugaggauuuaag

SEQ ID NO: 3047570 - RNA, 23 nt, Marburg virus
gaaccaggaguguugggacagug

SEQ ID NO: 3047571 - RNA, 18 nt, Marburg virus
uuguaccucuaaggaaaa

SEQ ID NO: 3047572 - RNA, 22 nt, Marburg virus
caagaaaccgauggaaaagcug

SEQ ID NO: 3047573 - RNA, 18 nt, Marburg virus
agcguaugcgaauccaac

SEQ ID NO: 3047574 - RNA, 23 nt, Marburg virus
uuuugcaagcgaugugugcuuga

SEQ ID NO: 3047575 - RNA, 17 nt, Marburg virus
uguaccucuaaggaaaa

SEQ ID NO: 3047576 - RNA, 22 nt, Marburg virus
agcaccccaacugaugccacca

SEQ ID NO: 3047577 - RNA, 14 nt, Marburg virus
agaaucaguuguuu

SEQ ID NO: 3047578 - RNA, 15 nt, Marburg virus
uaaucaccaauucau

SEQ ID NO: 3047579 - RNA, 17 nt, Marburg virus
guguugaccuuggaaaa

SEQ ID NO: 3047580 - RNA, 18 nt, Marburg virus
accaacugaucgugaaga

SEQ ID NO: 3047581 - RNA, 20 nt, Marburg virus
caugcccccccacaacacca

SEQ ID NO: 3047582 - RNA, 22 nt, Marburg virus
aggcagauaucggacauucaaa

SEQ ID NO: 3047583 - RNA, 11 nt, Marburg virus
auauuaaauau

SEQ ID NO: 3047584 - RNA, 19 nt, Marburg virus
aauucgacagcauuaaaaa

SEQ ID NO: 3047585 - RNA, 16 nt, Marburg virus
uagagucgaagaacau

SEQ ID NO: 3047586 - RNA, 20 nt, Marburg virus
uuguccaggaauauuucgga

SEQ ID NO: 3047587 - RNA, 23 nt, Marburg virus
agaagccuugcuagcagauggac

SEQ ID NO: 3047588 - RNA, 21 nt, Marburg virus
uacauuugccgcaauacugua

SEQ ID NO: 3047589 - RNA, 20 nt, Marburg virus
uuguuacugagagggaacag

SEQ ID NO: 3047590 - RNA, 21 nt, Marburg virus
uccaugcccccccacaacacc

SEQ ID NO: 3047591 - RNA, 13 nt, Marburg virus
uucuuguuucaaa

SEQ ID NO: 3047592 - RNA, 22 nt, Marburg virus
aaucaacuaacaacauagaaaa

SEQ ID NO: 3047593 - RNA, 16 nt, Marburg virus
uuaaaaaccaaaacaa

SEQ ID NO: 3047594 - RNA, 15 nt, Marburg virus
uccagaagacagaag

SEQ ID NO: 3047595 - RNA, 14 nt, Marburg virus
ggagaaaaugagaa

SEQ ID NO: 3047596 - RNA, 20 nt, Marburg virus
augggugauaaucaauguau

SEQ ID NO: 3047597 - RNA, 19 nt, Marburg virus
cacaagagauacuguuuua

SEQ ID NO: 3047598 - RNA, 20 nt, Marburg virus
acacaacaucuuguauauuu

SEQ ID NO: 3047599 - RNA, 17 nt, Marburg virus
agaaugcauuagaauuu

SEQ ID NO: 3047600 - RNA, 19 nt, Marburg virus
gaaaaggaagaauuauucu

SEQ ID NO: 3047601 - RNA, 18 nt, Marburg virus
gucuuaagugugauuuuc

SEQ ID NO: 3047602 - RNA, 21 nt, Marburg virus
uucaccagauucuaagugaag

SEQ ID NO: 3047603 - RNA, 20 nt, Marburg virus
uuagaaaaauucacauguac

SEQ ID NO: 3047604 - RNA, 13 nt, Marburg virus
cccacaacaccac

SEQ ID NO: 3047605 - RNA, 15 nt, Marburg virus
ucuacuaacaacacc

SEQ ID NO: 3047606 - RNA, 23 nt, Marburg virus
agugaucuuuccgaguugauaca

SEQ ID NO: 3047607 - RNA, 15 nt, Marburg virus
caaauuuauuugaau

SEQ ID NO: 3047608 - RNA, 13 nt, Marburg virus
cagaaagaagcau

SEQ ID NO: 3047609 - RNA, 19 nt, Marburg virus
gauguguugaccuuggaaa

SEQ ID NO: 3047610 - RNA, 22 nt, Marburg virus
ggauagcuucauuucauucaau

SEQ ID NO: 3047611 - RNA, 20 nt, Marburg virus
ucaaagagagugccagagca

SEQ ID NO: 3047612 - RNA, 12 nt, Marburg virus
uucaacuggaag

SEQ ID NO: 3047613 - RNA, 14 nt, Marburg virus
aucagccuaaaauc

SEQ ID NO: 3047614 - RNA, 22 nt, Marburg virus
aggauuuuucuccuaaggaaaa

SEQ ID NO: 3047615 - RNA, 13 nt, Marburg virus
uaguauaaaguau

SEQ ID NO: 3047616 - RNA, 21 nt, Marburg virus
guauucccuauaagugauuua

SEQ ID NO: 3047617 - RNA, 16 nt, Marburg virus
aagcaagggcuuucau

SEQ ID NO: 3047618 - RNA, 18 nt, Marburg virus
aaugaaacaacagaugca

SEQ ID NO: 3047619 - RNA, 17 nt, Marburg virus
gugaucaguauauuuua

SEQ ID NO: 3047620 - RNA, 21 nt, Marburg virus
augccaccacacucaacacca

SEQ ID NO: 3047621 - RNA, 14 nt, Marburg virus
uguuuacuagagca

SEQ ID NO: 3047622 - RNA, 17 nt, Marburg virus
uauaaaguauaauucuu

SEQ ID NO: 3047623 - RNA, 14 nt, Marburg virus
guaccucuaaggaa

SEQ ID NO: 3047624 - RNA, 10 nt, Marburg virus
acaacaaugu

SEQ ID NO: 3047625 - RNA, 12 nt, Marburg virus
uuagaauuauuc

SEQ ID NO: 3047626 - RNA, 13 nt, Marburg virus
uccacaacaaugu

SEQ ID NO: 3047627 - RNA, 15 nt, Marburg virus
cuuauauugaugcau

SEQ ID NO: 3047628 - RNA, 23 nt, Marburg virus
cauacacccgaauuugccaccca

SEQ ID NO: 3047629 - RNA, 22 nt, Marburg virus
aauauuaaguguguauugauua

SEQ ID NO: 3047630 - RNA, 14 nt, Marburg virus
uucccauagaucaa

SEQ ID NO: 3047631 - RNA, 14 nt, Marburg virus
ugaauuaauuguua

SEQ ID NO: 3047632 - RNA, 15 nt, Marburg virus
uuugauuuacuaaca

SEQ ID NO: 3047633 - RNA, 15 nt, Marburg virus
caagcuucaaaacca

SEQ ID NO: 3047634 - RNA, 13 nt, Marburg virus
gguuuuuuauucu

SEQ ID NO: 3047635 - RNA, 23 nt, Marburg virus
gaaaauaaucuauuuaaaaauga

SEQ ID NO: 3047636 - RNA, 13 nt, Marburg virus
gguugaugacugg

SEQ ID NO: 3047637 - RNA, 22 nt, Marburg virus
aaauacugggauggcauuguug

SEQ ID NO: 3047638 - RNA, 21 nt, Marburg virus
aauuauugccauguacuugga

SEQ ID NO: 3047639 - RNA, 19 nt, Marburg virus
aucagauauugggaaauug

SEQ ID NO: 3047640 - RNA, 17 nt, Marburg virus
aaucaucaaccagugug

SEQ ID NO: 3047641 - RNA, 15 nt, Marburg virus
agggacaaauuauug

SEQ ID NO: 3047642 - RNA, 19 nt, Marburg virus
caagauguaaucucuuuug

SEQ ID NO: 3047643 - RNA, 21 nt, Marburg virus
ugcaaucucuacuaacaacac

SEQ ID NO: 3047644 - RNA, 17 nt, Marburg virus
ccacagcaagaaggaaa

SEQ ID NO: 3047645 - RNA, 17 nt, Marburg virus
uagauuaauccuugaag

SEQ ID NO: 3047646 - RNA, 16 nt, Marburg virus
gccaguuccagcaauu

SEQ ID NO: 3047647 - RNA, 19 nt, Marburg virus
uucugaaauaguaagaaaa

SEQ ID NO: 3047648 - RNA, 13 nt, Marburg virus
ugaagaauuuauu

SEQ ID NO: 3047649 - RNA, 18 nt, Marburg virus
agggagaucaaauuauug

SEQ ID NO: 3047650 - RNA, 22 nt, Marburg virus
aauacccucaccacugcccaca

SEQ ID NO: 3047651 - RNA, 16 nt, Marburg virus
ucaacaaugccaccca

SEQ ID NO: 3047652 - RNA, 19 nt, Marburg virus
aaaaccaggguuaagagua

SEQ ID NO: 3047653 - RNA, 18 nt, Marburg virus
aaucuugagggacaaauu

SEQ ID NO: 3047654 - RNA, 18 nt, Marburg virus
ucaaggucaaaacccuca

SEQ ID NO: 3047655 - RNA, 14 nt, Marburg virus
gcugugaaccagga

SEQ ID NO: 3047656 - RNA, 13 nt, Marburg virus
ugugauuuucacc

SEQ ID NO: 3047657 - RNA, 18 nt, Marburg virus
ggaaaauccuuauuauug

SEQ ID NO: 3047658 - RNA, 16 nt, Marburg virus
agcauaaaaaucccaa

SEQ ID NO: 3047659 - RNA, 22 nt, Marburg virus
uuccuguaugaucgcauugccu

SEQ ID NO: 3047660 - RNA, 15 nt, Marburg virus
gcuaauuucuugagg

SEQ ID NO: 3047661 - RNA, 20 nt, Marburg virus
ucaaacccacaagcacccca

SEQ ID NO: 3047662 - RNA, 16 nt, Marburg virus
gaugcauuggacgaug

SEQ ID NO: 3047663 - RNA, 16 nt, Marburg virus
caauauccugaugcaa

SEQ ID NO: 3047664 - RNA, 21 nt, Marburg virus
uguaauaugccaauuaagaaa

SEQ ID NO: 3047665 - RNA, 21 nt, Marburg virus
gaugggucuguguuuauucau

SEQ ID NO: 3047666 - RNA, 20 nt, Marburg virus
gcagauaucggacauucaaa

SEQ ID NO: 3047667 - RNA, 20 nt, Marburg virus
caaacaguucgugaaaauau

SEQ ID NO: 3047668 - RNA, 13 nt, Marburg virus
agaguccaugaaa

SEQ ID NO: 3047669 - RNA, 19 nt, Marburg virus
auaaaaaucccaacaaugg

SEQ ID NO: 3047670 - RNA, 14 nt, Marburg virus
ccauccaaggacaa

SEQ ID NO: 3047671 - RNA, 17 nt, Marburg virus
auagauucaauuauccu

SEQ ID NO: 3047672 - RNA, 20 nt, Marburg virus
aagacauguguaggaacaug

SEQ ID NO: 3047673 - RNA, 13 nt, Marburg virus
gcaagaaggaaac

SEQ ID NO: 3047674 - RNA, 23 nt, Marburg virus
aauaacgauugauuaagaaaaac

SEQ ID NO: 3047675 - RNA, 15 nt, Marburg virus
uguuuaggauuucac

SEQ ID NO: 3047676 - RNA, 16 nt, Marburg virus
gagcacuaacaacacg

SEQ ID NO: 3047677 - RNA, 17 nt, Marburg virus
augauuuuaaauaccua

SEQ ID NO: 3047678 - RNA, 18 nt, Marburg virus
uaauaaucaccaauucau

SEQ ID NO: 3047679 - RNA, 23 nt, Marburg virus
ucaugaaacucaguugcccucca

SEQ ID NO: 3047680 - RNA, 16 nt, Marburg virus
auuaaguucuuuaaau

SEQ ID NO: 3047681 - RNA, 12 nt, Marburg virus
uguuagaauuau

SEQ ID NO: 3047682 - RNA, 16 nt, Marburg virus
cauuuaucucaacuug

SEQ ID NO: 3047683 - RNA, 23 nt, Marburg virus
aucuuuacaccaggaaaauacug

SEQ ID NO: 3047684 - RNA, 22 nt, Marburg virus
aacauauugugucaaauucauu

SEQ ID NO: 3047685 - RNA, 18 nt, Marburg virus
gacccaaacaaugaugau

SEQ ID NO: 3047686 - RNA, 12 nt, Marburg virus
uggaaggaacaa

SEQ ID NO: 3047687 - RNA, 15 nt, Marburg virus
acagcaagaaggaaa

SEQ ID NO: 3047688 - RNA, 12 nt, Marburg virus
cuuuuucacaua

SEQ ID NO: 3047689 - RNA, 18 nt, Marburg virus
uacguuacguuuucucug

SEQ ID NO: 3047690 - RNA, 19 nt, Marburg virus
accauaaggaaaaaugagc

SEQ ID NO: 3047691 - RNA, 12 nt, Marburg virus
ugugaauuauuc

SEQ ID NO: 3047692 - RNA, 22 nt, Marburg virus
aaaaacccaaagucaacaauua

SEQ ID NO: 3047693 - RNA, 20 nt, Marburg virus
cugcugguuuaauuaaaaac

SEQ ID NO: 3047694 - RNA, 20 nt, Marburg virus
uaaucauguugaugauuuua

SEQ ID NO: 3047695 - RNA, 20 nt, Marburg virus
gcauccaacucaauauccug

SEQ ID NO: 3047696 - RNA, 23 nt, Marburg virus
auuuaaguauuuuuauaaaagac

SEQ ID NO: 3047697 - RNA, 16 nt, Marburg virus
gauuccacaucauauu

SEQ ID NO: 3047698 - RNA, 22 nt, Marburg virus
uguuggaggcacaguacauuau

SEQ ID NO: 3047699 - RNA, 20 nt, Marburg virus
agaauauggugauccccaga

SEQ ID NO: 3047700 - RNA, 17 nt, Marburg virus
uucauugcuaaguaaac

SEQ ID NO: 3047701 - RNA, 13 nt, Marburg virus
ugaggaccucaua

SEQ ID NO: 3047702 - RNA, 15 nt, Marburg virus
uuucaccuugaaaga

SEQ ID NO: 3047703 - RNA, 13 nt, Marburg virus
uagaauuucuuga

SEQ ID NO: 3047704 - RNA, 19 nt, Marburg virus
uucggcugaggaagaucaa

SEQ ID NO: 3047705 - RNA, 19 nt, Marburg virus
aggcgucuagccaaucaaa

SEQ ID NO: 3047706 - RNA, 18 nt, Marburg virus
agucuucgggcuguuccu

SEQ ID NO: 3047707 - RNA, 13 nt, Marburg virus
aauauucagaaaa

SEQ ID NO: 3047708 - RNA, 21 nt, Marburg virus
uagauuaauccuugaaguaac

SEQ ID NO: 3047709 - RNA, 17 nt, Marburg virus
ggaugcuucggugcucu

SEQ ID NO: 3047710 - RNA, 16 nt, Marburg virus
uaagaauuaauuuacu

SEQ ID NO: 3047711 - RNA, 19 nt, Marburg virus
uuuauauguaaugaacaau

SEQ ID NO: 3047712 - RNA, 18 nt, Marburg virus
ucauauuugauucaagau

SEQ ID NO: 3047713 - RNA, 13 nt, Marburg virus
ugcuugaauacgu

SEQ ID NO: 3047714 - RNA, 13 nt, Marburg virus
uuccauucaauau

SEQ ID NO: 3047715 - RNA, 14 nt, Marburg virus
uuauccuaacauga

SEQ ID NO: 3047716 - RNA, 15 nt, Marburg virus
ugaaauuaagggaau

SEQ ID NO: 3047717 - RNA, 14 nt, Marburg virus
auaaagcugagugu

SEQ ID NO: 3047718 - RNA, 16 nt, Marburg virus
auaccuacccugauuu

SEQ ID NO: 3047719 - RNA, 13 nt, Marburg virus
gcuucaauacaac

SEQ ID NO: 3047720 - RNA, 22 nt, Marburg virus
aaagagcacuaacaacacgaaa

SEQ ID NO: 3047721 - RNA, 16 nt, Marburg virus
guuacagcuauaucua

SEQ ID NO: 3047722 - RNA, 20 nt, Marburg virus
cuagcucaaguccuuucaaa

SEQ ID NO: 3047723 - RNA, 23 nt, Marburg virus
aaccgaggaaaggacauuuuccu

SEQ ID NO: 3047724 - RNA, 13 nt, Marburg virus
cauuauucacaua

SEQ ID NO: 3047725 - RNA, 20 nt, Marburg virus
ugcacuauccuacuguuuug

SEQ ID NO: 3047726 - RNA, 17 nt, Marburg virus
guucauaugcuuucaga

SEQ ID NO: 3047727 - RNA, 20 nt, Marburg virus
uauaucuugauugcuaaaaa

SEQ ID NO: 3047728 - RNA, 17 nt, Marburg virus
uuccuauaaucugauug

SEQ ID NO: 3047729 - RNA, 20 nt, Marburg virus
caaagugcuuggaccugauu

SEQ ID NO: 3047730 - RNA, 21 nt, Marburg virus
auccaucuuaagugaauccuu

SEQ ID NO: 3047731 - RNA, 14 nt, Marburg virus
cagcuguauacaaa

SEQ ID NO: 3047732 - RNA, 17 nt, Marburg virus
acuggccgaaaaugcuc

SEQ ID NO: 3047733 - RNA, 15 nt, Marburg virus
auucgacagcauuaa

SEQ ID NO: 3047734 - RNA, 15 nt, Marburg virus
agugaauacauucuu

SEQ ID NO: 3047735 - RNA, 19 nt, Marburg virus
ucaaaggcgacaagcacug

SEQ ID NO: 3047736 - RNA, 16 nt, Marburg virus
aagauaaacaggagca

SEQ ID NO: 3047737 - RNA, 23 nt, Marburg virus
auccaagggauaaaaacucuccc

SEQ ID NO: 3047738 - RNA, 21 nt, Marburg virus
auugauugagcuucucaaaug

SEQ ID NO: 3047739 - RNA, 17 nt, Marburg virus
guauuacuuacuugggc

SEQ ID NO: 3047740 - RNA, 16 nt, Marburg virus
gcacaaaaugauuuuc

SEQ ID NO: 3047741 - RNA, 23 nt, Marburg virus
uuacgacacacagagcacagcca

SEQ ID NO: 3047742 - RNA, 15 nt, Marburg virus
agacaagacuuuuag

SEQ ID NO: 3047743 - RNA, 22 nt, Marburg virus
accuugccuuccgauaugaauu

SEQ ID NO: 3047744 - RNA, 19 nt, Marburg virus
ugguuuauuuucaagcacc

SEQ ID NO: 3047745 - RNA, 22 nt, Marburg virus
gaaaacacugccuacucuggag

SEQ ID NO: 3047746 - RNA, 20 nt, Marburg virus
uccucggaguaguuccucca

SEQ ID NO: 3047747 - RNA, 15 nt, Marburg virus
aagagaacuucauuu

SEQ ID NO: 3047748 - RNA, 22 nt, Marburg virus
ucguaauuucaacuggaagaac

SEQ ID NO: 3047749 - RNA, 13 nt, Marburg virus
aacaauacuguga

SEQ ID NO: 3047750 - RNA, 21 nt, Marburg virus
uugauccaguuccaaauacaa

SEQ ID NO: 3047751 - RNA, 15 nt, Marburg virus
caauggaacacaaac

SEQ ID NO: 3047752 - RNA, 16 nt, Marburg virus
ccacacucaacaccac

SEQ ID NO: 3047753 - RNA, 18 nt, Marburg virus
agucucaauuggaaauuu

SEQ ID NO: 3047754 - RNA, 17 nt, Marburg virus
aaucacgcgcacaaauu

SEQ ID NO: 3047755 - RNA, 19 nt, Marburg virus
uaucagccuaaaaucugau

SEQ ID NO: 3047756 - RNA, 19 nt, Marburg virus
uaccucuaaggaaaaucau

SEQ ID NO: 3047757 - RNA, 18 nt, Marburg virus
uugauuaaagcuuuagga

SEQ ID NO: 3047758 - RNA, 15 nt, Marburg virus
uaaaauuaauucaca

SEQ ID NO: 3047759 - RNA, 15 nt, Marburg virus
ccaguuauccaucuu

SEQ ID NO: 3047760 - RNA, 15 nt, Marburg virus
aaucaaacugccaaa

SEQ ID NO: 3047761 - RNA, 19 nt, Marburg virus
gaaucuauuugaccucaga

SEQ ID NO: 3047762 - RNA, 23 nt, Marburg virus
aguucucacaagauuaguuugua

SEQ ID NO: 3047763 - RNA, 12 nt, Marburg virus
aaucauuaucau

SEQ ID NO: 3047764 - RNA, 18 nt, Marburg virus
acagaaggggaggaagcc

SEQ ID NO: 3047765 - RNA, 19 nt, Marburg virus
auauaucaugaaacucagu

SEQ ID NO: 3047766 - RNA, 17 nt, Marburg virus
auaaguggcuuaaauua

SEQ ID NO: 3047767 - RNA, 17 nt, Marburg virus
cacaauucagcaagcau

SEQ ID NO: 3047768 - RNA, 15 nt, Marburg virus
aacauggcagaauua

SEQ ID NO: 3047769 - RNA, 15 nt, Marburg virus
ucuuaauagaaguag

SEQ ID NO: 3047770 - RNA, 21 nt, Marburg virus
ugggaaggacacuggaagcaa

SEQ ID NO: 3047771 - RNA, 15 nt, Marburg virus
caauaugaugcaauu

SEQ ID NO: 3047772 - RNA, 16 nt, Marburg virus
gguuacauuuucuaga

SEQ ID NO: 3047773 - RNA, 12 nt, Marburg virus
aaaagaaauagu

SEQ ID NO: 3047774 - RNA, 16 nt, Marburg virus
cuccuaccaacauccg

SEQ ID NO: 3047775 - RNA, 14 nt, Marburg virus
auaucauaaauaua

SEQ ID NO: 3047776 - RNA, 18 nt, Marburg virus
uaaccuuacauugcugcu

SEQ ID NO: 3047777 - RNA, 14 nt, Marburg virus
ccagcauggcugcc

SEQ ID NO: 3047778 - RNA, 23 nt, Marburg virus
cagucccucgcccaugucaaaaa

SEQ ID NO: 3047779 - RNA, 17 nt, Marburg virus
cuaagugaaggagagaa

SEQ ID NO: 3047780 - RNA, 13 nt, Marburg virus
uguuaucaaacag

SEQ ID NO: 3047781 - RNA, 17 nt, Marburg virus
aggcaguucuaagagaa

SEQ ID NO: 3047782 - RNA, 19 nt, Marburg virus
uguuuggaauagcagauuu

SEQ ID NO: 3047783 - RNA, 15 nt, Marburg virus
aagacuuccaaacau

SEQ ID NO: 3047784 - RNA, 22 nt, Marburg virus
ugguaccgugaccaaaacuuga

SEQ ID NO: 3047785 - RNA, 20 nt, Marburg virus
acaaugcagcccuugucuaa

SEQ ID NO: 3047786 - RNA, 13 nt, Marburg virus
acaagauaaucuu

SEQ ID NO: 3047787 - RNA, 11 nt, Marburg virus
augacuggaaa

SEQ ID NO: 3047788 - RNA, 13 nt, Marburg virus
aucuuauuaaaua

SEQ ID NO: 3047789 - RNA, 13 nt, Marburg virus
guuaccuacuuau

SEQ ID NO: 3047790 - RNA, 18 nt, Marburg virus
cauuggacgaugauuuau

SEQ ID NO: 3047791 - RNA, 19 nt, Marburg virus
cgaaaggccccaccacaac

SEQ ID NO: 3047792 - RNA, 20 nt, Marburg virus
cuucagcacccucucuguau

SEQ ID NO: 3047793 - RNA, 18 nt, Marburg virus
ccaauauauaaaauuaaa

SEQ ID NO: 3047794 - RNA, 14 nt, Marburg virus
uucuugaacucagu

SEQ ID NO: 3047795 - RNA, 17 nt, Marburg virus
acaaucuaggugauugu

SEQ ID NO: 3047796 - RNA, 11 nt, Marburg virus
uuacuggaagg

SEQ ID NO: 3047797 - RNA, 19 nt, Marburg virus
agcacacccacucagaaug

SEQ ID NO: 3047798 - RNA, 23 nt, Marburg virus
uuuaauuaaaaaccaaaacaauu

SEQ ID NO: 3047799 - RNA, 21 nt, Marburg virus
auuuacugguauaaaauagug

SEQ ID NO: 3047800 - RNA, 16 nt, Marburg virus
auuaauuccuugaaug

SEQ ID NO: 3047801 - RNA, 19 nt, Marburg virus
aaucuaggugauugugaaa

SEQ ID NO: 3047802 - RNA, 17 nt, Marburg virus
aacacgugggaaauaug

SEQ ID NO: 3047803 - RNA, 22 nt, Marburg virus
agcaagggcuuucaucaacaau

SEQ ID NO: 3047804 - RNA, 21 nt, Marburg virus
uugauacaaagacacuaaaca

SEQ ID NO: 3047805 - RNA, 17 nt, Marburg virus
aucggacauucaaagca

SEQ ID NO: 3047806 - RNA, 17 nt, Marburg virus
aauauuacuuugaucaa

SEQ ID NO: 3047807 - RNA, 22 nt, Marburg virus
caaguccuuucaaaaauugcuu

SEQ ID NO: 3047808 - RNA, 16 nt, Marburg virus
accacugcaccagcug

SEQ ID NO: 3047809 - RNA, 15 nt, Marburg virus
guaagagugauuaag

SEQ ID NO: 3047810 - RNA, 17 nt, Marburg virus
aaucgaaggacuuuaua

SEQ ID NO: 3047811 - RNA, 21 nt, Marburg virus
aucuuaaacuugaugaugcag

SEQ ID NO: 3047812 - RNA, 17 nt, Marburg virus
acucuggagaaaaugag

SEQ ID NO: 3047813 - RNA, 13 nt, Marburg virus
auuucuuuaauaa

SEQ ID NO: 3047814 - RNA, 22 nt, Marburg virus
uguuccucccaacccaacaauu

SEQ ID NO: 3047815 - RNA, 20 nt, Marburg virus
auaaucugauugugagauua

SEQ ID NO: 3047816 - RNA, 16 nt, Marburg virus
agggguuucauaugcu

SEQ ID NO: 3047817 - RNA, 14 nt, Marburg virus
uuguauauuucaga

SEQ ID NO: 3047818 - RNA, 12 nt, Marburg virus
uauuucaacuua

SEQ ID NO: 3047819 - RNA, 13 nt, Marburg virus
aauucagcaagca

SEQ ID NO: 3047820 - RNA, 19 nt, Marburg virus
aacaauggcaagaugugga

SEQ ID NO: 3047821 - RNA, 19 nt, Marburg virus
caugacuugauucagagag

SEQ ID NO: 3047822 - RNA, 15 nt, Marburg virus
ucugcauaagaagca

SEQ ID NO: 3047823 - RNA, 17 nt, Marburg virus
acaacuugccugcaaau

SEQ ID NO: 3047824 - RNA, 14 nt, Marburg virus
ucacuaagcaaggg

SEQ ID NO: 3047825 - RNA, 20 nt, Marburg virus
guguucuuacuaacuugggc

SEQ ID NO: 3047826 - RNA, 20 nt, Marburg virus
ggaacaugaaaauuggauug

SEQ ID NO: 3047827 - RNA, 21 nt, Marburg virus
auuugaccaaaguaauguuuu

SEQ ID NO: 3047828 - RNA, 22 nt, Marburg virus
cagugauaagagucaaaaacuu

SEQ ID NO: 3047829 - RNA, 21 nt, Marburg virus
gguuuggaguuuccuuacucu

SEQ ID NO: 3047830 - RNA, 20 nt, Marburg virus
auuucaaaagcauauaugug

SEQ ID NO: 3047831 - RNA, 18 nt, Marburg virus
acugcugguuuaauuaaa

SEQ ID NO: 3047832 - RNA, 18 nt, Marburg virus
cuucucacuuuuuaagaa

SEQ ID NO: 3047833 - RNA, 21 nt, Marburg virus
cuaugaagaacauuaagaaga

SEQ ID NO: 3047834 - RNA, 18 nt, Marburg virus
auaauagugcauuuguau

SEQ ID NO: 3047835 - RNA, 15 nt, Marburg virus
aguaaaggacaauga

SEQ ID NO: 3047836 - RNA, 13 nt, Marburg virus
uaugaugaagaaa

SEQ ID NO: 3047837 - RNA, 14 nt, Marburg virus
cuacaaaacaccac

SEQ ID NO: 3047838 - RNA, 21 nt, Marburg virus
cugcaaucucuacuaacaaca

SEQ ID NO: 3047839 - RNA, 14 nt, Marburg virus
auugaucaaacacu

SEQ ID NO: 3047840 - RNA, 17 nt, Marburg virus
ucacaaaauagaauaau

SEQ ID NO: 3047841 - RNA, 16 nt, Marburg virus
uauaaacuuguagaau

SEQ ID NO: 3047842 - RNA, 17 nt, Marburg virus
guuauauaauuacucau

SEQ ID NO: 3047843 - RNA, 18 nt, Marburg virus
gcuggccauaucuggcau

SEQ ID NO: 3047844 - RNA, 14 nt, Marburg virus
uauucuauaucuug

SEQ ID NO: 3047845 - RNA, 18 nt, Marburg virus
gaacuuuugcuauugaug

SEQ ID NO: 3047846 - RNA, 17 nt, Marburg virus
aauagugcauuuguaua

SEQ ID NO: 3047847 - RNA, 18 nt, Marburg virus
guuuacguauuguugauu

SEQ ID NO: 3047848 - RNA, 11 nt, Marburg virus
ugaugaugcag

SEQ ID NO: 3047849 - RNA, 18 nt, Marburg virus
cuuaguuggaauuaacuu

SEQ ID NO: 3047850 - RNA, 15 nt, Marburg virus
uacugugacugaacc

SEQ ID NO: 3047851 - RNA, 16 nt, Marburg virus
aacaagaaauuauccu

SEQ ID NO: 3047852 - RNA, 13 nt, Marburg virus
uccccaauacaga

SEQ ID NO: 3047853 - RNA, 17 nt, Marburg virus
agcuguauacaaacaca

SEQ ID NO: 3047854 - RNA, 14 nt, Marburg virus
agaucgauaucuuu

SEQ ID NO: 3047855 - RNA, 15 nt, Marburg virus
guuagaauuauucau

SEQ ID NO: 3047856 - RNA, 17 nt, Marburg virus
guuaaaaacuaaauuaa

SEQ ID NO: 3047857 - RNA, 18 nt, Marburg virus
uucaagacgcuuauucau

SEQ ID NO: 3047858 - RNA, 23 nt, Marburg virus
caaccagggagaucaaauuauug

SEQ ID NO: 3047859 - RNA, 16 nt, Marburg virus
cagcaauuacaacaca

SEQ ID NO: 3047860 - RNA, 23 nt, Marburg virus
ugcugaucacggugcaaaccagu

SEQ ID NO: 3047861 - RNA, 15 nt, Marburg virus
aguuccaaauacaaa

SEQ ID NO: 3047862 - RNA, 15 nt, Marburg virus
gaauugauaaaauau

SEQ ID NO: 3047863 - RNA, 15 nt, Marburg virus
gaaaaucuaauucuc

SEQ ID NO: 3047864 - RNA, 13 nt, Marburg virus
aacaccuccaaga

SEQ ID NO: 3047865 - RNA, 15 nt, Marburg virus
acauaccaaauacug

SEQ ID NO: 3047866 - RNA, 19 nt, Marburg virus
uguuuauucaucugagcaa

SEQ ID NO: 3047867 - RNA, 21 nt, Marburg virus
auacuguuuuaauuaagaaaa

SEQ ID NO: 3047868 - RNA, 12 nt, Marburg virus
ucaacuggaaga

SEQ ID NO: 3047869 - RNA, 17 nt, Marburg virus
accaggaucaagggaaa

SEQ ID NO: 3047870 - RNA, 22 nt, Marburg virus
ucacaccagugguaacuuuuca

SEQ ID NO: 3047871 - RNA, 15 nt, Marburg virus
auuguuugggaccaa

SEQ ID NO: 3047872 - RNA, 14 nt, Marburg virus
ccauguacuuggaa

SEQ ID NO: 3047873 - RNA, 14 nt, Marburg virus
acaccaggaaaaua

SEQ ID NO: 3047874 - RNA, 16 nt, Marburg virus
ucgcuaguuaugaaug

SEQ ID NO: 3047875 - RNA, 17 nt, Marburg virus
cccaacaauggaccacu

SEQ ID NO: 3047876 - RNA, 13 nt, Marburg virus
aacagaagauaac

SEQ ID NO: 3047877 - RNA, 23 nt, Marburg virus
agacuuuuccuugaaucaaauau

SEQ ID NO: 3047878 - RNA, 20 nt, Marburg virus
agacgugccguucaaagagu

SEQ ID NO: 3047879 - RNA, 19 nt, Marburg virus
auaguagcaaagaaucauu

SEQ ID NO: 3047880 - RNA, 23 nt, Marburg virus
ucguaguguucuuuuacuggaag

SEQ ID NO: 3047881 - RNA, 18 nt, Marburg virus
accaaauaugacaaaugg

SEQ ID NO: 3047882 - RNA, 17 nt, Marburg virus
caacuguugcauaucuu

SEQ ID NO: 3047883 - RNA, 19 nt, Marburg virus
auucaagacgcuuauucau

SEQ ID NO: 3047884 - RNA, 19 nt, Marburg virus
uucucacuuuuuaagaauc

SEQ ID NO: 3047885 - RNA, 17 nt, Marburg virus
agcaauuacaacacaua

SEQ ID NO: 3047886 - RNA, 14 nt, Marburg virus
ucacaguaaucaaa

SEQ ID NO: 3047887 - RNA, 13 nt, Marburg virus
accuuggaaaauc

SEQ ID NO: 3047888 - RNA, 17 nt, Marburg virus
gaagguaugaugaagaa

SEQ ID NO: 3047889 - RNA, 12 nt, Marburg virus
cugauaauuuaa

SEQ ID NO: 3047890 - RNA, 16 nt, Marburg virus
acaauaaguuuaacua

SEQ ID NO: 3047891 - RNA, 14 nt, Marburg virus
aggaagaauuauuc

SEQ ID NO: 3047892 - RNA, 13 nt, Marburg virus
ggacaaauuauug

SEQ ID NO: 3047893 - RNA, 13 nt, Marburg virus
auguccaaacacu

SEQ ID NO: 3047894 - RNA, 15 nt, Marburg virus
uuggacaaguaacaa

SEQ ID NO: 3047895 - RNA, 21 nt, Marburg virus
ccaaugauggauauuaaauau

SEQ ID NO: 3047896 - RNA, 16 nt, Marburg virus
cccccuccuccuccaa

SEQ ID NO: 3047897 - RNA, 21 nt, Marburg virus
cuuaaaaccuaaagucauguu

SEQ ID NO: 3047898 - RNA, 20 nt, Marburg virus
uuguauagucauuauucaca

SEQ ID NO: 3047899 - RNA, 12 nt, Marburg virus
acaaaacaccac

SEQ ID NO: 3047900 - RNA, 17 nt, Marburg virus
auaacccaccggauugu

SEQ ID NO: 3047901 - RNA, 12 nt, Marburg virus
aacuguugcaua

SEQ ID NO: 3047902 - RNA, 19 nt, Marburg virus
acuuacuugggcuugaaga

SEQ ID NO: 3047903 - RNA, 20 nt, Marburg virus
ugaacuaaggaaauuucucu

SEQ ID NO: 3047904 - RNA, 16 nt, Marburg virus
gugaauguaaauuaag

SEQ ID NO: 3047905 - RNA, 15 nt, Marburg virus
auuaagaaaaacuau

SEQ ID NO: 3047906 - RNA, 16 nt, Marburg virus
agcaaacgaaagaugu

SEQ ID NO: 3047907 - RNA, 23 nt, Marburg virus
cacagcaagaaggaaacaacaca

SEQ ID NO: 3047908 - RNA, 16 nt, Marburg virus
ggagauuuuuaagaag

SEQ ID NO: 3047909 - RNA, 16 nt, Marburg virus
aaguauuuuuauaaaa

SEQ ID NO: 3047910 - RNA, 18 nt, Marburg virus
aauuauccuguauaacaa

SEQ ID NO: 3047911 - RNA, 15 nt, Marburg virus
auuacaugagauaac

SEQ ID NO: 3047912 - RNA, 22 nt, Marburg virus
aucguugagauuaaaaagacua

SEQ ID NO: 3047913 - RNA, 17 nt, Marburg virus
ucaaaggcgacaagcac

SEQ ID NO: 3047914 - RNA, 22 nt, Marburg virus
gaauccuuucuucaauaugcag

SEQ ID NO: 3047915 - RNA, 17 nt, Marburg virus
cagaaauguuagccaaa

SEQ ID NO: 3047916 - RNA, 20 nt, Marburg virus
aucugagcaaggugagacac

SEQ ID NO: 3047917 - RNA, 14 nt, Marburg virus
ucaauaugaugcaa

SEQ ID NO: 3047918 - RNA, 20 nt, Marburg virus
gcaaagagcacuaacaacac

SEQ ID NO: 3047919 - RNA, 21 nt, Marburg virus
ugggucaccgucucuuucuaa

SEQ ID NO: 3047920 - RNA, 20 nt, Marburg virus
ggaaaggacauuuuccuuaa

SEQ ID NO: 3047921 - RNA, 13 nt, Marburg virus
ccuaaggaaaauc

SEQ ID NO: 3047922 - RNA, 20 nt, Marburg virus
aaaacccagcaguauugaaa

SEQ ID NO: 3047923 - RNA, 15 nt, Marburg virus
guugagauuaaaaag

SEQ ID NO: 3047924 - RNA, 17 nt, Marburg virus
auaucggacauucaaag

SEQ ID NO: 3047925 - RNA, 20 nt, Marburg virus
aagcugaucagcuugcaaga

SEQ ID NO: 3047926 - RNA, 22 nt, Marburg virus
cuaaugcuuaucauuaucacuu

SEQ ID NO: 3047927 - RNA, 23 nt, Marburg virus
caacuacgaaccuccauacauuu

SEQ ID NO: 3047928 - RNA, 20 nt, Marburg virus
uagcuucauuucauucaaug

SEQ ID NO: 3047929 - RNA, 16 nt, Marburg virus
ccaugcuuucacuuua

SEQ ID NO: 3047930 - RNA, 12 nt, Marburg virus
caaauauuggau

SEQ ID NO: 3047931 - RNA, 15 nt, Marburg virus
cucaacaccacagac

SEQ ID NO: 3047932 - RNA, 15 nt, Marburg virus
ugguuaaaaaugaaa

SEQ ID NO: 3047933 - RNA, 14 nt, Marburg virus
auuucaacuggaag

SEQ ID NO: 3047934 - RNA, 13 nt, Marburg virus
uauaaaaaucuug

SEQ ID NO: 3047935 - RNA, 23 nt, Marburg virus
aaaugaggguuacauuuucuaga

SEQ ID NO: 3047936 - RNA, 14 nt, Marburg virus
cccacaacaccacu

SEQ ID NO: 3047937 - RNA, 17 nt, Marburg virus
gcgucuagccaaucaaa

SEQ ID NO: 3047938 - RNA, 16 nt, Marburg virus
cccccucgaaaacaac

SEQ ID NO: 3047939 - RNA, 13 nt, Marburg virus
cacugcccacagc

SEQ ID NO: 3047940 - RNA, 20 nt, Marburg virus
aacaacaagaguccaugaaa

SEQ ID NO: 3047941 - RNA, 14 nt, Marburg virus
uuaauuuacucuuu

SEQ ID NO: 3047942 - RNA, 19 nt, Marburg virus
uccaaggggaugucagaaa

SEQ ID NO: 3047943 - RNA, 10 nt, Marburg virus
aaaacaugcu

SEQ ID NO: 3047944 - RNA, 14 nt, Marburg virus
auuucauucaaugu

SEQ ID NO: 3047945 - RNA, 13 nt, Marburg virus
auuauagaggaac

SEQ ID NO: 3047946 - RNA, 15 nt, Marburg virus
uaaaaucugauccgu

SEQ ID NO: 3047947 - RNA, 15 nt, Marburg virus
aacuugaugaugcag

SEQ ID NO: 3047948 - RNA, 23 nt, Marburg virus
ucaauguuagcaauaaauuuauu

SEQ ID NO: 3047949 - RNA, 18 nt, Marburg virus
acggguuaauaaaugcuc

SEQ ID NO: 3047950 - RNA, 18 nt, Marburg virus
ugaacuaccuccacagau

SEQ ID NO: 3047951 - RNA, 20 nt, Marburg virus
aaucuugagggacaaauuau

SEQ ID NO: 3047952 - RNA, 22 nt, Marburg virus
auuucguaguuaaauuucuaga

SEQ ID NO: 3047953 - RNA, 14 nt, Marburg virus
aucuagaacaaauu

SEQ ID NO: 3047954 - RNA, 20 nt, Marburg virus
ucauaguuuaaccacauaau

SEQ ID NO: 3047955 - RNA, 16 nt, Marburg virus
caauggaacacaaacg

SEQ ID NO: 3047956 - RNA, 21 nt, Marburg virus
auucucccaccucuuuaaaaa

SEQ ID NO: 3047957 - RNA, 13 nt, Marburg virus
gacagaacacaaa

SEQ ID NO: 3047958 - RNA, 16 nt, Marburg virus
aagcacgccacagcaa

SEQ ID NO: 3047959 - RNA, 19 nt, Marburg virus
aacuccacgaagaaucaaa

SEQ ID NO: 3047960 - RNA, 19 nt, Marburg virus
ugggacaacgaguucuuga

SEQ ID NO: 3047961 - RNA, 21 nt, Marburg virus
cauuauucagugcuacaaauu

SEQ ID NO: 3047962 - RNA, 21 nt, Marburg virus
aauguugaucaaaugaccaaa

SEQ ID NO: 3047963 - RNA, 15 nt, Marburg virus
agggaacaauuuaau

SEQ ID NO: 3047964 - RNA, 12 nt, Marburg virus
acuaaacauuuc

SEQ ID NO: 3047965 - RNA, 16 nt, Marburg virus
agcuucucggacaaua

SEQ ID NO: 3047966 - RNA, 18 nt, Marburg virus
guuuauaggaacagauuu

SEQ ID NO: 3047967 - RNA, 21 nt, Marburg virus
acaaagaauugauaaaauauu

SEQ ID NO: 3047968 - RNA, 22 nt, Marburg virus
uagacagcuugcuuuacacaag

SEQ ID NO: 3047969 - RNA, 15 nt, Marburg virus
uaauaauuuucacaa

SEQ ID NO: 3047970 - RNA, 20 nt, Marburg virus
aguaagaaaaacuaaugaag

SEQ ID NO: 3047971 - RNA, 13 nt, Marburg virus
uuuauaggaacag

SEQ ID NO: 3047972 - RNA, 12 nt, Marburg virus
guauagagggac

SEQ ID NO: 3047973 - RNA, 14 nt, Marburg virus
aacaacacgaaagg

SEQ ID NO: 3047974 - RNA, 11 nt, Marburg virus
ucaacaagcuu

SEQ ID NO: 3047975 - RNA, 15 nt, Marburg virus
uuuguugcaauucaa

SEQ ID NO: 3047976 - RNA, 13 nt, Marburg virus
uccuaacaugaag

SEQ ID NO: 3047977 - RNA, 21 nt, Marburg virus
ucuacucugaacuaaggaaau

SEQ ID NO: 3047978 - RNA, 21 nt, Marburg virus
cguaugcgaauccaacgcuca

SEQ ID NO: 3047979 - RNA, 22 nt, Marburg virus
cugcuuuaaaugguuaauuaag

SEQ ID NO: 3047980 - RNA, 17 nt, Marburg virus
ucaagauuuaaaaugca

SEQ ID NO: 3047981 - RNA, 14 nt, Marburg virus
agaaaaaccaauga

SEQ ID NO: 3047982 - RNA, 18 nt, Marburg virus
guucauaugcuuucagaa

SEQ ID NO: 3047983 - RNA, 13 nt, Marburg virus
aaaacuaugaaga

SEQ ID NO: 3047984 - RNA, 15 nt, Marburg virus
uuuuguguuuucaaa

SEQ ID NO: 3047985 - RNA, 22 nt, Marburg virus
gcauuaaaaacauuucuucaga

SEQ ID NO: 3047986 - RNA, 18 nt, Marburg virus
auucaagauuuaaaaugc

SEQ ID NO: 3047987 - RNA, 22 nt, Marburg virus
auguugaugaaauuaagggaau

SEQ ID NO: 3047988 - RNA, 23 nt, Marburg virus
ugauuuuuuauaaguuuaagaua

SEQ ID NO: 3047989 - RNA, 15 nt, Marburg virus
ucauaugcuuucaga

SEQ ID NO: 3047990 - RNA, 18 nt, Marburg virus
cgaaauugcguaauugua

SEQ ID NO: 3047991 - RNA, 19 nt, Marburg virus
caucucuuuuacauacauu

SEQ ID NO: 3047992 - RNA, 18 nt, Marburg virus
aacgccuaguggaaaacg

SEQ ID NO: 3047993 - RNA, 17 nt, Marburg virus
caagaugucgaaaguuc

SEQ ID NO: 3047994 - RNA, 13 nt, Marburg virus
ucgcccaugucaa

SEQ ID NO: 3047995 - RNA, 13 nt, Marburg virus
uagucauuauuca

SEQ ID NO: 3047996 - RNA, 18 nt, Marburg virus
caacccgaccacacaaca

SEQ ID NO: 3047997 - RNA, 21 nt, Marburg virus
aaaauucacauguacuguuga

SEQ ID NO: 3047998 - RNA, 12 nt, Marburg virus
gaacucagugag

SEQ ID NO: 3047999 - RNA, 17 nt, Marburg virus
caggaguguugggacag

SEQ ID NO: 3048000 - RNA, 15 nt, Marburg virus
auuugucguaucuuu

SEQ ID NO: 3048001 - RNA, 23 nt, Marburg virus
cacccacucccucaccacaacca

SEQ ID NO: 3048002 - RNA, 18 nt, Marburg virus
uucaaguuuacugaagac

SEQ ID NO: 3048003 - RNA, 16 nt, Marburg virus
agaucaacaugccucc

SEQ ID NO: 3048004 - RNA, 13 nt, Marburg virus
aaucgauguuaug

SEQ ID NO: 3048005 - RNA, 18 nt, Marburg virus
guuacacaagagaaggaa

SEQ ID NO: 3048006 - RNA, 16 nt, Marburg virus
auucaauuguuaucau

SEQ ID NO: 3048007 - RNA, 16 nt, Marburg virus
aacuuuauuaaaacua

SEQ ID NO: 3048008 - RNA, 22 nt, Marburg virus
acauucuuauauugcuugauua

SEQ ID NO: 3048009 - RNA, 20 nt, Marburg virus
guaugcaaauugggacaacg

SEQ ID NO: 3048010 - RNA, 17 nt, Marburg virus
uguaauaauuaacuguu

SEQ ID NO: 3048011 - RNA, 22 nt, Marburg virus
ugcuacaaauucuuuuuucaau

SEQ ID NO: 3048012 - RNA, 15 nt, Marburg virus
acgacacacagagca

SEQ ID NO: 3048013 - RNA, 13 nt, Marburg virus
aauaauagugcau

SEQ ID NO: 3048014 - RNA, 12 nt, Marburg virus
aguaaucaaauu

SEQ ID NO: 3048015 - RNA, 11 nt, Marburg virus
gaacuaaggaa

SEQ ID NO: 3048016 - RNA, 16 nt, Marburg virus
uccucucagaaucagu

SEQ ID NO: 3048017 - RNA, 22 nt, Marburg virus
cuaaagucauguuugaaacuuu

SEQ ID NO: 3048018 - RNA, 13 nt, Marburg virus
cuaaacauuucaa

SEQ ID NO: 3048019 - RNA, 17 nt, Marburg virus
gauuucagucaaagaga

SEQ ID NO: 3048020 - RNA, 15 nt, Marburg virus
aguuaaauuucuaga

SEQ ID NO: 3048021 - RNA, 13 nt, Marburg virus
auucaaagcacuc

SEQ ID NO: 3048022 - RNA, 20 nt, Marburg virus
auuaaaaaauuaaaaaacuu

SEQ ID NO: 3048023 - RNA, 12 nt, Marburg virus
cagcauugacuc

SEQ ID NO: 3048024 - RNA, 13 nt, Marburg virus
gagcaauuuaagg

SEQ ID NO: 3048025 - RNA, 16 nt, Marburg virus
uaucggacauucaaag

SEQ ID NO: 3048026 - RNA, 14 nt, Marburg virus
uaauaauuuucaca

SEQ ID NO: 3048027 - RNA, 19 nt, Marburg virus
uauuuacuaaaucuuacau

SEQ ID NO: 3048028 - RNA, 17 nt, Marburg virus
uuucacuuuagaggcaa

SEQ ID NO: 3048029 - RNA, 17 nt, Marburg virus
uuuguauagauucaauu

SEQ ID NO: 3048030 - RNA, 18 nt, Marburg virus
cagcaggguauaacucca

SEQ ID NO: 3048031 - RNA, 22 nt, Marburg virus
auagauccuugaucaacaccau

SEQ ID NO: 3048032 - RNA, 22 nt, Marburg virus
cugugacugaacccaacaaaac

SEQ ID NO: 3048033 - RNA, 18 nt, Marburg virus
uauuagccccaaucuguu

SEQ ID NO: 3048034 - RNA, 13 nt, Marburg virus
ccggaacucucca

SEQ ID NO: 3048035 - RNA, 23 nt, Marburg virus
auuuaaagagauuucuuguugca

SEQ ID NO: 3048036 - RNA, 21 nt, Marburg virus
aauaacgauugauuaagaaaa

SEQ ID NO: 3048037 - RNA, 21 nt, Marburg virus
aaucacagaggauugagucau

SEQ ID NO: 3048038 - RNA, 17 nt, Marburg virus
gaucaaaugaccaaaua

SEQ ID NO: 3048039 - RNA, 16 nt, Marburg virus
aaccguacacaaguag

SEQ ID NO: 3048040 - RNA, 16 nt, Marburg virus
auccuuucuucaauau

SEQ ID NO: 3048041 - RNA, 15 nt, Marburg virus
aauaugaugcaauua

SEQ ID NO: 3048042 - RNA, 22 nt, Marburg virus
agacaugccauugacuuucuac

SEQ ID NO: 3048043 - RNA, 14 nt, Marburg virus
acaauacugugaau

SEQ ID NO: 3048044 - RNA, 15 nt, Marburg virus
auugauauugaaccu

SEQ ID NO: 3048045 - RNA, 21 nt, Marburg virus
uaaggaaaauccuuauuauug

SEQ ID NO: 3048046 - RNA, 22 nt, Marburg virus
uugcauuuaacuccauaucuua

SEQ ID NO: 3048047 - RNA, 15 nt, Marburg virus
ugaaggcauaucuua

SEQ ID NO: 3048048 - RNA, 14 nt, Marburg virus
ggaucccucuggaa

SEQ ID NO: 3048049 - RNA, 15 nt, Marburg virus
gcaauuaaucauguu

SEQ ID NO: 3048050 - RNA, 15 nt, Marburg virus
acauguuuaagauuc

SEQ ID NO: 3048051 - RNA, 17 nt, Marburg virus
gucaugggcccuucaua

SEQ ID NO: 3048052 - RNA, 23 nt, Marburg virus
uccuaaggaaaauccuuauuauu

SEQ ID NO: 3048053 - RNA, 12 nt, Marburg virus
aaaacacugccu

SEQ ID NO: 3048054 - RNA, 13 nt, Marburg virus
cuccacaacaaug

SEQ ID NO: 3048055 - RNA, 20 nt, Marburg virus
augugcguagagguuaauuu

SEQ ID NO: 3048056 - RNA, 13 nt, Marburg virus
uuugaaggaucaa

SEQ ID NO: 3048057 - RNA, 21 nt, Marburg virus
auuuuaacuuccauucaauau

SEQ ID NO: 3048058 - RNA, 18 nt, Marburg virus
guccaaacacucgcagaa

SEQ ID NO: 3048059 - RNA, 19 nt, Marburg virus
auauuacuuugaucaauuu

SEQ ID NO: 3048060 - RNA, 15 nt, Marburg virus
augugugcuugaaua

SEQ ID NO: 3048061 - RNA, 22 nt, Marburg virus
uccaugcccccccacaacacca

SEQ ID NO: 3048062 - RNA, 16 nt, Marburg virus
cugaugccaccacacu

SEQ ID NO: 3048063 - RNA, 17 nt, Marburg virus
auaaaaaucccaacaau

SEQ ID NO: 3048064 - RNA, 16 nt, Marburg virus
ucaugggcccuucaua

SEQ ID NO: 3048065 - RNA, 14 nt, Marburg virus
cacagagcacagcc

SEQ ID NO: 3048066 - RNA, 22 nt, Marburg virus
aggaaaucuuaccacagcaaag

SEQ ID NO: 3048067 - RNA, 21 nt, Marburg virus
ucaaucugggaucauauuuua

SEQ ID NO: 3048068 - RNA, 20 nt, Marburg virus
aaugaaaauagccuugucau

SEQ ID NO: 3048069 - RNA, 19 nt, Marburg virus
uucaaguuuacugaagacu

SEQ ID NO: 3048070 - RNA, 20 nt, Marburg virus
aucgucucaaaccguacaca

SEQ ID NO: 3048071 - RNA, 17 nt, Marburg virus
ugcaacaagucagugag

SEQ ID NO: 3048072 - RNA, 14 nt, Marburg virus
ucaauaugcagcau

SEQ ID NO: 3048073 - RNA, 22 nt, Marburg virus
aauuaacuuuuguugcaauuca

SEQ ID NO: 3048074 - RNA, 21 nt, Marburg virus
agcuuguaguaaggggaccau

SEQ ID NO: 3048075 - RNA, 14 nt, Marburg virus
aaccgauggaaaag

SEQ ID NO: 3048076 - RNA, 22 nt, Marburg virus
ugcagcccuugucuaaugucaa

SEQ ID NO: 3048077 - RNA, 15 nt, Marburg virus
uauagauucaauuau

SEQ ID NO: 3048078 - RNA, 13 nt, Marburg virus
gaauuugccaccc

SEQ ID NO: 3048079 - RNA, 20 nt, Marburg virus
caauuacgacacacagagca

SEQ ID NO: 3048080 - RNA, 23 nt, Marburg virus
auacccucaccacugcccacagc

SEQ ID NO: 3048081 - RNA, 19 nt, Marburg virus
gucguaucuuuaccaaaua

SEQ ID NO: 3048082 - RNA, 14 nt, Marburg virus
ugguauauuuuuga

SEQ ID NO: 3048083 - RNA, 13 nt, Marburg virus
aucagcuaucaaa

SEQ ID NO: 3048084 - RNA, 15 nt, Marburg virus
guuuuaauuaagaaa

SEQ ID NO: 3048085 - RNA, 20 nt, Marburg virus
aucuauuguucauaugcuuu

SEQ ID NO: 3048086 - RNA, 21 nt, Marburg virus
cagcaagaaggaaacaacaca

SEQ ID NO: 3048087 - RNA, 20 nt, Marburg virus
gaaaaacuaaugaagaacau

SEQ ID NO: 3048088 - RNA, 12 nt, Marburg virus
aaacaacagaug

SEQ ID NO: 3048089 - RNA, 17 nt, Marburg virus
uaacaauggaacacaaa

SEQ ID NO: 3048090 - RNA, 15 nt, Marburg virus
cuccuccuccaaaag

SEQ ID NO: 3048091 - RNA, 17 nt, Marburg virus
ucuaauuaacaacuugu

SEQ ID NO: 3048092 - RNA, 20 nt, Marburg virus
auuucguggagcaugaaccu

SEQ ID NO: 3048093 - RNA, 15 nt, Marburg virus
augaauguugaucaa

SEQ ID NO: 3048094 - RNA, 14 nt, Marburg virus
uuaaagguuuucuu

SEQ ID NO: 3048095 - RNA, 13 nt, Marburg virus
aaaaguuagaaua

SEQ ID NO: 3048096 - RNA, 21 nt, Marburg virus
aaucaucauccacgugcaaga

SEQ ID NO: 3048097 - RNA, 21 nt, Marburg virus
uugaauccggagaaauuguuc

SEQ ID NO: 3048098 - RNA, 17 nt, Marburg virus
cucucuacaaaagcauu

SEQ ID NO: 3048099 - RNA, 22 nt, Marburg virus
ggccaagcagacuuuuccuuga

SEQ ID NO: 3048100 - RNA, 12 nt, Marburg virus
ucuuguuucaaa

SEQ ID NO: 3048101 - RNA, 13 nt, Marburg virus
cagaaagaaacga

SEQ ID NO: 3048102 - RNA, 20 nt, Marburg virus
gaugcgagggcauuauucag

SEQ ID NO: 3048103 - RNA, 22 nt, Marburg virus
gauuuucucgaggcaaggacag

SEQ ID NO: 3048104 - RNA, 18 nt, Marburg virus
agaucaaacccacaagca

SEQ ID NO: 3048105 - RNA, 16 nt, Marburg virus
cuagaacaaauuuuaa

SEQ ID NO: 3048106 - RNA, 17 nt, Marburg virus
aucacgcgcacaaauua

SEQ ID NO: 3048107 - RNA, 21 nt, Marburg virus
guuuaaccacauaauaauguu

SEQ ID NO: 3048108 - RNA, 14 nt, Marburg virus
auuaaguguucuuu

SEQ ID NO: 3048109 - RNA, 23 nt, Marburg virus
uucuuaagcuaucuuaaacuuga

SEQ ID NO: 3048110 - RNA, 21 nt, Marburg virus
uuaaauuagcauggauauuca

SEQ ID NO: 3048111 - RNA, 19 nt, Marburg virus
uuugacgugcgcuggaauu

SEQ ID NO: 3048112 - RNA, 17 nt, Marburg virus
aucuguuugagcaugaa

SEQ ID NO: 3048113 - RNA, 15 nt, Marburg virus
acuagaccaucuuaa

SEQ ID NO: 3048114 - RNA, 14 nt, Marburg virus
uuaucuacauuaau

SEQ ID NO: 3048115 - RNA, 13 nt, Marburg virus
aaccaagcaauug

SEQ ID NO: 3048116 - RNA, 23 nt, Marburg virus
auugacuucucacuuuuuaagaa

SEQ ID NO: 3048117 - RNA, 20 nt, Marburg virus
accucaacgguguucaacug

SEQ ID NO: 3048118 - RNA, 17 nt, Marburg virus
guuagauuucagucaaa

SEQ ID NO: 3048119 - RNA, 22 nt, Marburg virus
ugugugaguggcuuuuaucauc

SEQ ID NO: 3048120 - RNA, 19 nt, Marburg virus
aagggauaaaaacucuccc

SEQ ID NO: 3048121 - RNA, 13 nt, Marburg virus
ccagagaagacaa

SEQ ID NO: 3048122 - RNA, 24 nt, Marburg virus
agguauaacacgugggaaauaugu

SEQ ID NO: 3048123 - RNA, 13 nt, Marburg virus
cuaaugauuguaa

SEQ ID NO: 3048124 - RNA, 19 nt, Marburg virus
aauaacguuccuuagacaa

SEQ ID NO: 3048125 - RNA, 17 nt, Marburg virus
caacuuaagaaugcauu

SEQ ID NO: 3048126 - RNA, 12 nt, Marburg virus
caauugauuuug

SEQ ID NO: 3048127 - RNA, 12 nt, Marburg virus
aauaugaugcaa

SEQ ID NO: 3048128 - RNA, 17 nt, Marburg virus
accaaucauauuccccg

SEQ ID NO: 3048129 - RNA, 16 nt, Marburg virus
uuuauaacuaaccauu

SEQ ID NO: 3048130 - RNA, 12 nt, Marburg virus
aauuacaugaga

SEQ ID NO: 3048131 - RNA, 13 nt, Marburg virus
aaacacuuggaac

SEQ ID NO: 3048132 - RNA, 23 nt, Marburg virus
gugugaaaaauuucuuuaauaag

SEQ ID NO: 3048133 - RNA, 16 nt, Marburg virus
aaagaacccaguguug

SEQ ID NO: 3048134 - RNA, 22 nt, Marburg virus
auuccuugaauguccagcauca

SEQ ID NO: 3048135 - RNA, 15 nt, Marburg virus
augaucaguucaaag

SEQ ID NO: 3048136 - RNA, 16 nt, Marburg virus
guuacugaucuugaga

SEQ ID NO: 3048137 - RNA, 19 nt, Marburg virus
guuaacuggacaacagauc

SEQ ID NO: 3048138 - RNA, 14 nt, Marburg virus
aauuaauucacaca

SEQ ID NO: 3048139 - RNA, 19 nt, Marburg virus
accaagcaauugacuucuc

SEQ ID NO: 3048140 - RNA, 20 nt, Marburg virus
gaauacauucuuauauugcu

SEQ ID NO: 3048141 - RNA, 16 nt, Marburg virus
aggugaguuauacaac

SEQ ID NO: 3048142 - RNA, 14 nt, Marburg virus
uugaugacuggaaa

SEQ ID NO: 3048143 - RNA, 16 nt, Marburg virus
uauucagugcuacaaa

SEQ ID NO: 3048144 - RNA, 17 nt, Marburg virus
aacaccuccaagaacaa

SEQ ID NO: 3048145 - RNA, 14 nt, Marburg virus
ggcugcguugcuca

SEQ ID NO: 3048146 - RNA, 15 nt, Marburg virus
ucaaauaacaaucac

SEQ ID NO: 3048147 - RNA, 13 nt, Marburg virus
gucuaaugucaaa

SEQ ID NO: 3048148 - RNA, 19 nt, Marburg virus
accaacugaucgugaagaa

SEQ ID NO: 3048149 - RNA, 17 nt, Marburg virus
ucaauauccugaugcaa

SEQ ID NO: 3048150 - RNA, 14 nt, Marburg virus
cacagcaagaagga

SEQ ID NO: 3048151 - RNA, 16 nt, Marburg virus
aauuacgacacacaga

SEQ ID NO: 3048152 - RNA, 18 nt, Marburg virus
ccuaacaugaagaccaca

SEQ ID NO: 3048153 - RNA, 15 nt, Marburg virus
aaucccucagagaag

SEQ ID NO: 3048154 - RNA, 20 nt, Marburg virus
guaugaucgcauugccucca

SEQ ID NO: 3048155 - RNA, 12 nt, Marburg virus
uuaccacagcaa

SEQ ID NO: 3048156 - RNA, 19 nt, Marburg virus
uccauucaauaugaugcaa

SEQ ID NO: 3048157 - RNA, 14 nt, Marburg virus
gauugauuaagaaa

SEQ ID NO: 3048158 - RNA, 21 nt, Marburg virus
gaggauaaaaggacaaagagg

SEQ ID NO: 3048159 - RNA, 14 nt, Marburg virus
uguuagauuucagu

SEQ ID NO: 3048160 - RNA, 19 nt, Marburg virus
uuacaccaggaaaauacug

SEQ ID NO: 3048161 - RNA, 15 nt, Marburg virus
aaaaucccaacaaug

SEQ ID NO: 3048162 - RNA, 20 nt, Marburg virus
uaaauuugaccaaaguaaug

SEQ ID NO: 3048163 - RNA, 23 nt, Marburg virus
ugcuguaagcuuacaagcuucaa

SEQ ID NO: 3048164 - RNA, 22 nt, Marburg virus
auacuuaucuacauuaauuccu

SEQ ID NO: 3048165 - RNA, 18 nt, Marburg virus
ucuacccggcaacaacac

SEQ ID NO: 3048166 - RNA, 19 nt, Marburg virus
ucaauaagugaccccaaau

SEQ ID NO: 3048167 - RNA, 13 nt, Marburg virus
aaccaugaaaauc

SEQ ID NO: 3048168 - RNA, 22 nt, Marburg virus
uguaacguagagucgaagaaca

SEQ ID NO: 3048169 - RNA, 15 nt, Marburg virus
auaaaauaaacaaga

SEQ ID NO: 3048170 - RNA, 14 nt, Marburg virus
uuuucauucaaucu

SEQ ID NO: 3048171 - RNA, 13 nt, Marburg virus
acuuaaaugagca

SEQ ID NO: 3048172 - RNA, 19 nt, Marburg virus
agucuuaucuuaauccaag

SEQ ID NO: 3048173 - RNA, 19 nt, Marburg virus
aaguugacaaucaaaucac

SEQ ID NO: 3048174 - RNA, 12 nt, Marburg virus
ucugauuuagag

SEQ ID NO: 3048175 - RNA, 15 nt, Marburg virus
uugagagaggaacaa

SEQ ID NO: 3048176 - RNA, 16 nt, Marburg virus
gaaggacacuggaagc

SEQ ID NO: 3048177 - RNA, 18 nt, Marburg virus
acucaucauauaugcaac

SEQ ID NO: 3048178 - RNA, 11 nt, Marburg virus
cauuuucuaga

SEQ ID NO: 3048179 - RNA, 19 nt, Marburg virus
uauacucgcuucaauacaa

SEQ ID NO: 3048180 - RNA, 22 nt, Marburg virus
aauucacauguacuguugauau

SEQ ID NO: 3048181 - RNA, 12 nt, Marburg virus
uaacaugaagac

SEQ ID NO: 3048182 - RNA, 20 nt, Marburg virus
ugaaaauguuauugauugag

SEQ ID NO: 3048183 - RNA, 21 nt, Marburg virus
agacauguguaggaacaugaa

SEQ ID NO: 3048184 - RNA, 19 nt, Marburg virus
augaagaacauuaagaaaa

SEQ ID NO: 3048185 - RNA, 15 nt, Marburg virus
cuucauaaucuguuu

SEQ ID NO: 3048186 - RNA, 17 nt, Marburg virus
guuuauaucuagaacaa

SEQ ID NO: 3048187 - RNA, 22 nt, Marburg virus
aaucauacacauaauaaccauu

SEQ ID NO: 3048188 - RNA, 16 nt, Marburg virus
caccaaucaucaucca

SEQ ID NO: 3048189 - RNA, 19 nt, Marburg virus
uggcuuaaauuagcaugga

SEQ ID NO: 3048190 - RNA, 20 nt, Marburg virus
aaauugaucaaacacuugga

SEQ ID NO: 3048191 - RNA, 17 nt, Marburg virus
acaugcuacaauauaag

SEQ ID NO: 3048192 - RNA, 15 nt, Marburg virus
cuucaagaauacaac

SEQ ID NO: 3048193 - RNA, 13 nt, Marburg virus
augacuugauuca

SEQ ID NO: 3048194 - RNA, 15 nt, Marburg virus
cugaacccaacaaaa

SEQ ID NO: 3048195 - RNA, 15 nt, Marburg virus
augucagaaauguua

SEQ ID NO: 3048196 - RNA, 15 nt, Marburg virus
aagccgaaauuuauc

SEQ ID NO: 3048197 - RNA, 23 nt, Marburg virus
uggguuuauaucuagaacaaauu

SEQ ID NO: 3048198 - RNA, 23 nt, Marburg virus
aaaaugggaaggacacuggaagc

SEQ ID NO: 3048199 - RNA, 17 nt, Marburg virus
ugaauggcuucaacaac

SEQ ID NO: 3048200 - RNA, 20 nt, Marburg virus
ucuucaagguucccuggcca

SEQ ID NO: 3048201 - RNA, 24 nt, Marburg virus
cuuuguugauacccuugagagaca

SEQ ID NO: 3048202 - RNA, 21 nt, Marburg virus
gacaaugauuauuguuugaaa

SEQ ID NO: 3048203 - RNA, 20 nt, Marburg virus
aaucaucaaccagugugcaa

SEQ ID NO: 3048204 - RNA, 15 nt, Marburg virus
gaaaauccuuauuau

SEQ ID NO: 3048205 - RNA, 23 nt, Marburg virus
ucacaggcagcuauacaaucacc

SEQ ID NO: 3048206 - RNA, 15 nt, Marburg virus
agaugauaacagaua

SEQ ID NO: 3048207 - RNA, 20 nt, Marburg virus
cccucgaucugacacaauac

SEQ ID NO: 3048208 - RNA, 12 nt, Marburg virus
gcacaaaaugau

SEQ ID NO: 3048209 - RNA, 20 nt, Marburg virus
ugaaaaggaagaauuauucu

SEQ ID NO: 3048210 - RNA, 17 nt, Marburg virus
auaucuuccaaaauaua

SEQ ID NO: 3048211 - RNA, 20 nt, Marburg virus
uaguagcguuaccuuucaau

SEQ ID NO: 3048212 - RNA, 16 nt, Marburg virus
caagaauacaacucca

SEQ ID NO: 3048213 - RNA, 19 nt, Marburg virus
ccaacaauggaccacugcu

SEQ ID NO: 3048214 - RNA, 16 nt, Marburg virus
ugcuuacuuaaaugag

SEQ ID NO: 3048215 - RNA, 14 nt, Marburg virus
auugauuaagaaaa

SEQ ID NO: 3048216 - RNA, 22 nt, Marburg virus
uauccaucuuaagugaauccuu

SEQ ID NO: 3048217 - RNA, 19 nt, Marburg virus
aaaaaugaggguuacauuu

SEQ ID NO: 3048218 - RNA, 22 nt, Marburg virus
auuccccggugguuuauuuuca

SEQ ID NO: 3048219 - RNA, 13 nt, Marburg virus
auaguauaaagua

SEQ ID NO: 3048220 - RNA, 21 nt, Marburg virus
uccaaacauggcagaauuauc

SEQ ID NO: 3048221 - RNA, 20 nt, Marburg virus
aauaagugaccccaaauuca

SEQ ID NO: 3048222 - RNA, 12 nt, Marburg virus
gacgcuuauuca

SEQ ID NO: 3048223 - RNA, 16 nt, Marburg virus
aaaauagccuugucau

SEQ ID NO: 3048224 - RNA, 15 nt, Marburg virus
aacaagaagaagaaa

SEQ ID NO: 3048225 - RNA, 15 nt, Marburg virus
auauuaaguguguau

SEQ ID NO: 3048226 - RNA, 21 nt, Marburg virus
gacaagaugucgaaaguucuu

SEQ ID NO: 3048227 - RNA, 13 nt, Marburg virus
cuaucaaaucagc

SEQ ID NO: 3048228 - RNA, 16 nt, Marburg virus
uccuccaaaagacaug

SEQ ID NO: 3048229 - RNA, 20 nt, Marburg virus
ugaaaauagccuugucaugu

SEQ ID NO: 3048230 - RNA, 20 nt, Marburg virus
gucuauuucaacuuaagaau

SEQ ID NO: 3048231 - RNA, 17 nt, Marburg virus
caaaguaaugaaaauag

SEQ ID NO: 3048232 - RNA, 13 nt, Marburg virus
uaauagugcauuu

SEQ ID NO: 3048233 - RNA, 21 nt, Marburg virus
ccaauuacgacacacagagca

SEQ ID NO: 3048234 - RNA, 14 nt, Marburg virus
ugaagaacauuaag

SEQ ID NO: 3048235 - RNA, 20 nt, Marburg virus
uuuauacugcugguuuaauu

SEQ ID NO: 3048236 - RNA, 13 nt, Marburg virus
uuaaaaaccaaaa

SEQ ID NO: 3048237 - RNA, 20 nt, Marburg virus
ucaagcauauuucauucaaa

SEQ ID NO: 3048238 - RNA, 17 nt, Marburg virus
uaacagguaugacugag

SEQ ID NO: 3048239 - RNA, 21 nt, Marburg virus
aacuuguaccucuaaggaaaa

SEQ ID NO: 3048240 - RNA, 22 nt, Marburg virus
aauaugcagcauccaacucaau

SEQ ID NO: 3048241 - RNA, 22 nt, Marburg virus
ugaaacuuuuuguguuuucaaa

SEQ ID NO: 3048242 - RNA, 13 nt, Marburg virus
aaauguccaaaca

SEQ ID NO: 3048243 - RNA, 13 nt, Marburg virus
uauccugaugcaa

SEQ ID NO: 3048244 - RNA, 13 nt, Marburg virus
uuuacugaagacu

SEQ ID NO: 3048245 - RNA, 21 nt, Marburg virus
uaagacuggccgaaaaugcuc

SEQ ID NO: 3048246 - RNA, 16 nt, Marburg virus
ugaauccuuucuucaa

SEQ ID NO: 3048247 - RNA, 20 nt, Marburg virus
uggaaauuuaaaauuucagg

SEQ ID NO: 3048248 - RNA, 17 nt, Marburg virus
acagacccaaacaauga

SEQ ID NO: 3048249 - RNA, 16 nt, Marburg virus
aaaugcuguaagcuua

SEQ ID NO: 3048250 - RNA, 19 nt, Marburg virus
ccuuagaaaaauucacaug

SEQ ID NO: 3048251 - RNA, 16 nt, Marburg virus
aacauggcagaauuau

SEQ ID NO: 3048252 - RNA, 15 nt, Marburg virus
acacuggaagcaauu

SEQ ID NO: 3048253 - RNA, 14 nt, Marburg virus
accgucacaugaau

SEQ ID NO: 3048254 - RNA, 18 nt, Marburg virus
ugggaaggacacuggaag

SEQ ID NO: 3048255 - RNA, 13 nt, Marburg virus
cauuugaugcuuu

SEQ ID NO: 3048256 - RNA, 18 nt, Marburg virus
acagccacugaaaaugaa

SEQ ID NO: 3048257 - RNA, 23 nt, Marburg virus
gcaagggcuuucaucaacaaugc

SEQ ID NO: 3048258 - RNA, 18 nt, Marburg virus
gcauuagaauuucuugaa

SEQ ID NO: 3048259 - RNA, 19 nt, Marburg virus
accacaacggcaccaaaua

SEQ ID NO: 3048260 - RNA, 16 nt, Marburg virus
gauccuauuacuuguu

SEQ ID NO: 3048261 - RNA, 14 nt, Marburg virus
uaauauuacuaaca

SEQ ID NO: 3048262 - RNA, 12 nt, Marburg virus
caagaaggaaac

SEQ ID NO: 3048263 - RNA, 17 nt, Marburg virus
agcacagccacugaaaa

SEQ ID NO: 3048264 - RNA, 20 nt, Marburg virus
aucuuuccgaguugauacaa

SEQ ID NO: 3048265 - RNA, 19 nt, Marburg virus
guugaucccggcggaucag

SEQ ID NO: 3048266 - RNA, 17 nt, Marburg virus
uggaagacgguuucaaa

SEQ ID NO: 3048267 - RNA, 12 nt, Marburg virus
cgguacaggaau

SEQ ID NO: 3048268 - RNA, 14 nt, Marburg virus
cuuuacaccaggaa

SEQ ID NO: 3048269 - RNA, 23 nt, Marburg virus
agcaagggcuuucaucaacaaug

SEQ ID NO: 3048270 - RNA, 19 nt, Marburg virus
caaucucuacuaacaacac

SEQ ID NO: 3048271 - RNA, 17 nt, Marburg virus
uuaagaaucaacuaaca

SEQ ID NO: 3048272 - RNA, 16 nt, Marburg virus
ccaaaccgcaucaucu

SEQ ID NO: 3048273 - RNA, 11 nt, Marburg virus
acacuggaagc

SEQ ID NO: 3048274 - RNA, 15 nt, Marburg virus
caaaaccaacacaac

SEQ ID NO: 3048275 - RNA, 16 nt, Marburg virus
aaaucuuaccacagca

SEQ ID NO: 3048276 - RNA, 17 nt, Marburg virus
cuuguuguggugagaca

SEQ ID NO: 3048277 - RNA, 19 nt, Marburg virus
caggaaaucuuaccacagc

SEQ ID NO: 3048278 - RNA, 17 nt, Marburg virus
uaaauauccaucaagca

SEQ ID NO: 3048279 - RNA, 23 nt, Marburg virus
aucuugaccuuaauuccacagca

SEQ ID NO: 3048280 - RNA, 13 nt, Marburg virus
uaaauauaaaaga

SEQ ID NO: 3048281 - RNA, 20 nt, Marburg virus
ugugaauguaaauuaagaaa

SEQ ID NO: 3048282 - RNA, 22 nt, Marburg virus
uguuagcaauaaauuuauuaaa

SEQ ID NO: 3048283 - RNA, 14 nt, Marburg virus
uuugauauucaauu

SEQ ID NO: 3048284 - RNA, 15 nt, Marburg virus
ggaucagcuaucaaa

SEQ ID NO: 3048285 - RNA, 16 nt, Marburg virus
gaccugauuguugcau

SEQ ID NO: 3048286 - RNA, 16 nt, Marburg virus
uuuuuguguuuucaaa

SEQ ID NO: 3048287 - RNA, 23 nt, Marburg virus
caaauguuacggaaaaaagcaua

SEQ ID NO: 3048288 - RNA, 24 nt, Marburg virus
ggugacuuaaaccuagaugaucag

SEQ ID NO: 3048289 - RNA, 19 nt, Marburg virus
agacacuaaacauuucaaa

SEQ ID NO: 3048290 - RNA, 15 nt, Marburg virus
caaucucuacuaaca

SEQ ID NO: 3048291 - RNA, 16 nt, Marburg virus
aguuccaguaaaaaca

SEQ ID NO: 3048292 - RNA, 16 nt, Marburg virus
uuauuugaauauucaa

SEQ ID NO: 3048293 - RNA, 16 nt, Marburg virus
uuuuaaacuaccucuu

SEQ ID NO: 3048294 - RNA, 15 nt, Marburg virus
auuuauauuuacugg

SEQ ID NO: 3048295 - RNA, 19 nt, Marburg virus
uauauaaaagaaauaguaa

SEQ ID NO: 3048296 - RNA, 14 nt, Marburg virus
cuucauaaucuguu

SEQ ID NO: 3048297 - RNA, 14 nt, Marburg virus
ucaacuaacaacau

SEQ ID NO: 3048298 - RNA, 13 nt, Marburg virus
auccuauuuuccu

SEQ ID NO: 3048299 - RNA, 18 nt, Marburg virus
uuacaacacauacaugca

SEQ ID NO: 3048300 - RNA, 23 nt, Marburg virus
acuuaagucauucuuuuuaaaau

SEQ ID NO: 3048301 - RNA, 23 nt, Marburg virus
cuuaauccaagggauaaaaacuc

SEQ ID NO: 3048302 - RNA, 18 nt, Marburg virus
agcauggccuaaaugggu

SEQ ID NO: 3048303 - RNA, 20 nt, Marburg virus
caacacgaaaggccccacca

SEQ ID NO: 3048304 - RNA, 22 nt, Marburg virus
caaaagcauucccuagcaacau

SEQ ID NO: 3048305 - RNA, 15 nt, Marburg virus
ugcauaucuuccaaa

SEQ ID NO: 3048306 - RNA, 22 nt, Marburg virus
auuacuuguuacuauuguguga

SEQ ID NO: 3048307 - RNA, 14 nt, Marburg virus
gcauuggaauagaa

SEQ ID NO: 3048308 - RNA, 18 nt, Marburg virus
cuuagaugauaacagaua

SEQ ID NO: 3048309 - RNA, 23 nt, Marburg virus
uauauuuuauaaaccaagcaauu

SEQ ID NO: 3048310 - RNA, 20 nt, Marburg virus
uaagaaaaacuaugaagaac

SEQ ID NO: 3048311 - RNA, 19 nt, Marburg virus
uuucacauagguucugauu

SEQ ID NO: 3048312 - RNA, 19 nt, Marburg virus
aucccucuggaaaauccuu

SEQ ID NO: 3048313 - RNA, 17 nt, Marburg virus
auuuauaacuaaccauu

SEQ ID NO: 3048314 - RNA, 18 nt, Marburg virus
auauucaaggucaaaacc

SEQ ID NO: 3048315 - RNA, 16 nt, Marburg virus
auaauccgaaaugcug

SEQ ID NO: 3048316 - RNA, 21 nt, Marburg virus
ucauacgaucauuuuauucuu

SEQ ID NO: 3048317 - RNA, 21 nt, Marburg virus
auucuaagugaaggagagaau

SEQ ID NO: 3048318 - RNA, 23 nt, Marburg virus
cucaaauauuauugcucauaauu

SEQ ID NO: 3048319 - RNA, 19 nt, Marburg virus
accuugauaaucuaacaaa

SEQ ID NO: 3048320 - RNA, 14 nt, Marburg virus
aagaucaacaugcc

SEQ ID NO: 3048321 - RNA, 13 nt, Marburg virus
uauuacuaacaaa

SEQ ID NO: 3048322 - RNA, 18 nt, Marburg virus
augcaaaccauaaggaaa

SEQ ID NO: 3048323 - RNA, 19 nt, Marburg virus
uucuaggaggguuaucauu

SEQ ID NO: 3048324 - RNA, 22 nt, Marburg virus
agcuaugauugucaauaagaca

SEQ ID NO: 3048325 - RNA, 22 nt, Marburg virus
ccagagaucaaacccacaagca

SEQ ID NO: 3048326 - RNA, 23 nt, Marburg virus
ucuuaagugaauccuuucuucaa

SEQ ID NO: 3048327 - RNA, 16 nt, Marburg virus
auuaacuuuuguugca

SEQ ID NO: 3048328 - RNA, 18 nt, Marburg virus
cucaccacugcccacagc

SEQ ID NO: 3048329 - RNA, 16 nt, Marburg virus
auuaaauaguugucau

SEQ ID NO: 3048330 - RNA, 18 nt, Marburg virus
uuuaguagcguuaccuuu

SEQ ID NO: 3048331 - RNA, 14 nt, Marburg virus
ggcagcagggcuca

SEQ ID NO: 3048332 - RNA, 23 nt, Marburg virus
auguuguaaaugaccacggaaaa

SEQ ID NO: 3048333 - RNA, 12 nt, Marburg virus
uaagcuaucaaa

SEQ ID NO: 3048334 - RNA, 19 nt, Marburg virus
agugaauccuuucuucaau

SEQ ID NO: 3048335 - RNA, 16 nt, Marburg virus
uacccggcaacaacac

SEQ ID NO: 3048336 - RNA, 14 nt, Marburg virus
aggaucaagggaaa

SEQ ID NO: 3048337 - RNA, 18 nt, Marburg virus
ugauauuucuuguuucaa

SEQ ID NO: 3048338 - RNA, 23 nt, Marburg virus
cagagaucaaacccacaagcacc

SEQ ID NO: 3048339 - RNA, 20 nt, Marburg virus
aaauuaauugggaacaccau

SEQ ID NO: 3048340 - RNA, 20 nt, Marburg virus
uggcuuagaugauaacagau

SEQ ID NO: 3048341 - RNA, 17 nt, Marburg virus
gauuaguuuguauugau

SEQ ID NO: 3048342 - RNA, 16 nt, Marburg virus
auuucauucaaacacc

SEQ ID NO: 3048343 - RNA, 22 nt, Marburg virus
acacagagcacagccacugaaa

SEQ ID NO: 3048344 - RNA, 17 nt, Marburg virus
ucuuuaauauucagaaa

SEQ ID NO: 3048345 - RNA, 19 nt, Marburg virus
uaacuggacaacagaucau

SEQ ID NO: 3048346 - RNA, 19 nt, Marburg virus
aacuacagaagggacaaug

SEQ ID NO: 3048347 - RNA, 21 nt, Marburg virus
uaacaacaagaguccaugaaa

SEQ ID NO: 3048348 - RNA, 21 nt, Marburg virus
guuucauaugcugccauauuu

SEQ ID NO: 3048349 - RNA, 24 nt, Marburg virus
caaauuauugccauguacuuggaa

SEQ ID NO: 3048350 - RNA, 20 nt, Marburg virus
uuauuaaauaguugucauau

SEQ ID NO: 3048351 - RNA, 21 nt, Marburg virus
uucacugaagggaacauagca

SEQ ID NO: 3048352 - RNA, 14 nt, Marburg virus
caacggcacaaccg

SEQ ID NO: 3048353 - RNA, 16 nt, Marburg virus
cuuauauugaugcauu

SEQ ID NO: 3048354 - RNA, 23 nt, Marburg virus
ccaacccgaccacacaacaucuu

SEQ ID NO: 3048355 - RNA, 20 nt, Marburg virus
caauaucccuugugaaucau

SEQ ID NO: 3048356 - RNA, 16 nt, Marburg virus
cuagaaugucaaugug

SEQ ID NO: 3048357 - RNA, 19 nt, Marburg virus
ucauaaucuguuugagcau

SEQ ID NO: 3048358 - RNA, 23 nt, Marburg virus
ggaucaagcauauuucauucaaa

SEQ ID NO: 3048359 - RNA, 15 nt, Marburg virus
gaugcaauuaaucau

SEQ ID NO: 3048360 - RNA, 15 nt, Marburg virus
uaccacagcaaagag

SEQ ID NO: 3048361 - RNA, 16 nt, Marburg virus
aucucagcuuguugaa

SEQ ID NO: 3048362 - RNA, 12 nt, Marburg virus
uaguauacugua

SEQ ID NO: 3048363 - RNA, 19 nt, Marburg virus
aaucuugaccuuaauucca

SEQ ID NO: 3048364 - RNA, 21 nt, Marburg virus
cucugaugacaagugacaaaa

SEQ ID NO: 3048365 - RNA, 16 nt, Marburg virus
aauucaaguuuacuga

SEQ ID NO: 3048366 - RNA, 11 nt, Marburg virus
gguaugacuga

SEQ ID NO: 3048367 - RNA, 14 nt, Marburg virus
cuuucacuuuagag

SEQ ID NO: 3048368 - RNA, 21 nt, Marburg virus
agucaaagguguuccagcaug

SEQ ID NO: 3048369 - RNA, 23 nt, Marburg virus
acacuagaucacggaucaagcau

SEQ ID NO: 3048370 - RNA, 14 nt, Marburg virus
uucuuauauugcuu

SEQ ID NO: 3048371 - RNA, 22 nt, Marburg virus
aaguuaacuggacaacagauca

SEQ ID NO: 3048372 - RNA, 22 nt, Marburg virus
aacaacauagaaaacauauuua

SEQ ID NO: 3048373 - RNA, 14 nt, Marburg virus
aaaacaccaccaau

SEQ ID NO: 3048374 - RNA, 13 nt, Marburg virus
ucagaucacagua

SEQ ID NO: 3048375 - RNA, 19 nt, Marburg virus
caugaagaacauuaagaaa

SEQ ID NO: 3048376 - RNA, 18 nt, Marburg virus
guagauuauaugauuuuu

SEQ ID NO: 3048377 - RNA, 21 nt, Marburg virus
gaaugucugccaugcuuucac

SEQ ID NO: 3048378 - RNA, 20 nt, Marburg virus
ucuaaacgaaguaacaacaa

SEQ ID NO: 3048379 - RNA, 23 nt, Marburg virus
gggaggauuuuucuccuaaggaa

SEQ ID NO: 3048380 - RNA, 14 nt, Marburg virus
ucuuaaaagggaaa

SEQ ID NO: 3048381 - RNA, 19 nt, Marburg virus
caggguccggagaacagga

SEQ ID NO: 3048382 - RNA, 17 nt, Marburg virus
aacggcaccaaauauga

SEQ ID NO: 3048383 - RNA, 18 nt, Marburg virus
aauacugugaauuauucu

SEQ ID NO: 3048384 - RNA, 19 nt, Marburg virus
uagcucaaguccuuucaaa

SEQ ID NO: 3048385 - RNA, 15 nt, Marburg virus
caugcgcaaucugua

SEQ ID NO: 3048386 - RNA, 22 nt, Marburg virus
gaugcaauuaaucauguugaug

SEQ ID NO: 3048387 - RNA, 13 nt, Marburg virus
ugauauuucuugu

SEQ ID NO: 3048388 - RNA, 22 nt, Marburg virus
uguugcauuggaauagaagacu

SEQ ID NO: 3048389 - RNA, 15 nt, Marburg virus
uuauauaauuacuca

SEQ ID NO: 3048390 - RNA, 22 nt, Marburg virus
cucuacucugaacuaaggaaau

SEQ ID NO: 3048391 - RNA, 21 nt, Marburg virus
aguaauuuauuucugucuuaa

SEQ ID NO: 3048392 - RNA, 21 nt, Marburg virus
augaacaauaucccuugugaa

SEQ ID NO: 3048393 - RNA, 17 nt, Marburg virus
cuuuguuagaauuauuc

SEQ ID NO: 3048394 - RNA, 15 nt, Marburg virus
uguuuuaucaugauu

SEQ ID NO: 3048395 - RNA, 13 nt, Marburg virus
uucagaaagaaac

SEQ ID NO: 3048396 - RNA, 15 nt, Marburg virus
ccaccucuuuaaaaa

SEQ ID NO: 3048397 - RNA, 14 nt, Marburg virus
cacaaguagggaaa

SEQ ID NO: 3048398 - RNA, 19 nt, Marburg virus
augacaagugacaaaauuu

SEQ ID NO: 3048399 - RNA, 13 nt, Marburg virus
ugaggauuuaagg

SEQ ID NO: 3048400 - RNA, 19 nt, Marburg virus
agggaacagaaagaagcau

SEQ ID NO: 3048401 - RNA, 14 nt, Marburg virus
aaaacuaaugaaga

SEQ ID NO: 3048402 - RNA, 21 nt, Marburg virus
guauaacaaagaauauaccua

SEQ ID NO: 3048403 - RNA, 17 nt, Marburg virus
gcagucccaccaaucau

SEQ ID NO: 3048404 - RNA, 22 nt, Marburg virus
agcagauggacuagcaaaagca

SEQ ID NO: 3048405 - RNA, 11 nt, Marburg virus
aagaaggaaac

SEQ ID NO: 3048406 - RNA, 14 nt, Marburg virus
uacaagucaggaaa

SEQ ID NO: 3048407 - RNA, 20 nt, Marburg virus
uucaaacaccccaaauuuuc

SEQ ID NO: 3048408 - RNA, 17 nt, Marburg virus
ugcccccccacaacacc

SEQ ID NO: 3048409 - RNA, 16 nt, Marburg virus
aauuacagcaaucauu

SEQ ID NO: 3048410 - RNA, 16 nt, Marburg virus
gaauuacagcaaucau

SEQ ID NO: 3048411 - RNA, 21 nt, Marburg virus
gcaagaaggaaacaacacaga

SEQ ID NO: 3048412 - RNA, 11 nt, Marburg virus
uagaauuauuc

SEQ ID NO: 3048413 - RNA, 13 nt, Marburg virus
caauaugaugcaa

SEQ ID NO: 3048414 - RNA, 14 nt, Marburg virus
aauauccugaugca

SEQ ID NO: 3048415 - RNA, 14 nt, Marburg virus
aaaauuaaaaaacu

SEQ ID NO: 3048416 - RNA, 23 nt, Marburg virus
uguaagaaauuagggaaauacug

SEQ ID NO: 3048417 - RNA, 16 nt, Marburg virus
auucagaaaagguuuu

SEQ ID NO: 3048418 - RNA, 19 nt, Marburg virus
acauuggggaaagaacuag

SEQ ID NO: 3048419 - RNA, 13 nt, Marburg virus
caucuuaauagaa

SEQ ID NO: 3048420 - RNA, 13 nt, Marburg virus
aaaccaagcaauu

SEQ ID NO: 3048421 - RNA, 16 nt, Marburg virus
ugaaaagacuuccaaa

SEQ ID NO: 3048422 - RNA, 23 nt, Marburg virus
uugacuucucacuuuuuaagaau

SEQ ID NO: 3048423 - RNA, 18 nt, Marburg virus
cacaauggauuugcauuu

SEQ ID NO: 3048424 - RNA, 22 nt, Marburg virus
aacuguuggcuuagaugauaac

SEQ ID NO: 3048425 - RNA, 15 nt, Marburg virus
cuagagcaauuuaag

SEQ ID NO: 3048426 - RNA, 23 nt, Marburg virus
gacuggccgaaaaugcucuccag

SEQ ID NO: 3048427 - RNA, 14 nt, Marburg virus
acaacaucuuguau

SEQ ID NO: 3048428 - RNA, 20 nt, Marburg virus
ucaagaauuacagcaaucau

SEQ ID NO: 3048429 - RNA, 18 nt, Marburg virus
aauuauccuaacaugaag

SEQ ID NO: 3048430 - RNA, 20 nt, Marburg virus
caaagagcacuaacaacacg

SEQ ID NO: 3048431 - RNA, 21 nt, Marburg virus
uagcaaagaaucauuaucauu

SEQ ID NO: 3048432 - RNA, 23 nt, Marburg virus
uguugauauagcuaauuucuuga

SEQ ID NO: 3048433 - RNA, 14 nt, Marburg virus
agaauuaccgugga

SEQ ID NO: 3048434 - RNA, 10 nt, Marburg virus
cucacaggca

SEQ ID NO: 3048435 - RNA, 21 nt, Marburg virus
cauauugugucaaauucauuu

SEQ ID NO: 3048436 - RNA, 13 nt, Marburg virus
cuucagaacuguu

SEQ ID NO: 3048437 - RNA, 12 nt, Marburg virus
ucaggcaauaaa

SEQ ID NO: 3048438 - RNA, 14 nt, Marburg virus
auaaaugcuccaau

SEQ ID NO: 3048439 - RNA, 14 nt, Marburg virus
aaugaacaaaccag

SEQ ID NO: 3048440 - RNA, 17 nt, Marburg virus
augccauugacuuucua

SEQ ID NO: 3048441 - RNA, 17 nt, Marburg virus
auacaaagacgaucuuu

SEQ ID NO: 3048442 - RNA, 14 nt, Marburg virus
ucuuuuacuggaag

SEQ ID NO: 3048443 - RNA, 20 nt, Marburg virus
caacugaugccaccacacuc

SEQ ID NO: 3048444 - RNA, 18 nt, Marburg virus
uucacauguacuguugau

SEQ ID NO: 3048445 - RNA, 23 nt, Marburg virus
gacuuccaaacauggcagaauua

SEQ ID NO: 3048446 - RNA, 14 nt, Marburg virus
ccaacccaacaauu

SEQ ID NO: 3048447 - RNA, 14 nt, Marburg virus
gcgcacaaauuaac

SEQ ID NO: 3048448 - RNA, 17 nt, Marburg virus
aguauacucgcuucaau

SEQ ID NO: 3048449 - RNA, 15 nt, Marburg virus
acuauggugaugcga

SEQ ID NO: 3048450 - RNA, 12 nt, Marburg virus
cuucauuucauu

SEQ ID NO: 3048451 - RNA, 15 nt, Marburg virus
agugcacaaaaugau

SEQ ID NO: 3048452 - RNA, 12 nt, Marburg virus
ucaugaaacuca

SEQ ID NO: 3048453 - RNA, 13 nt, Marburg virus
aggacacuggaag

SEQ ID NO: 3048454 - RNA, 18 nt, Marburg virus
aacuaccuccacagauca

SEQ ID NO: 3048455 - RNA, 15 nt, Marburg virus
aggauuuaagggaac

SEQ ID NO: 3048456 - RNA, 20 nt, Marburg virus
cugauuguugcauuggaaua

SEQ ID NO: 3048457 - RNA, 12 nt, Marburg virus
cuuuuuaagaau

SEQ ID NO: 3048458 - RNA, 15 nt, Marburg virus
acuguuuuaauuaag

SEQ ID NO: 3048459 - RNA, 21 nt, Marburg virus
aauuauccuuuauuaagaaaa

SEQ ID NO: 3048460 - RNA, 16 nt, Marburg virus
aauccggagaaauugu

SEQ ID NO: 3048461 - RNA, 20 nt, Marburg virus
acaugaagaccacaugucuc

SEQ ID NO: 3048462 - RNA, 22 nt, Marburg virus
cuuauugcgagacuugaacaca

SEQ ID NO: 3048463 - RNA, 20 nt, Marburg virus
uucauaugcugccauauuua

SEQ ID NO: 3048464 - RNA, 22 nt, Marburg virus
aaauauuggacaaguaacaaug

SEQ ID NO: 3048465 - RNA, 20 nt, Marburg virus
aagguggggaggaacaugca

SEQ ID NO: 3048466 - RNA, 14 nt, Marburg virus
agaaucaaacaugu

SEQ ID NO: 3048467 - RNA, 21 nt, Marburg virus
gaaauuauccuaacaugaaga

SEQ ID NO: 3048468 - RNA, 16 nt, Marburg virus
uaucuuuaccaaauau

SEQ ID NO: 3048469 - RNA, 23 nt, Marburg virus
aaucaaauuuauuugaauauuca

SEQ ID NO: 3048470 - RNA, 19 nt, Marburg virus
cucaccgucccuuuucauu

SEQ ID NO: 3048471 - RNA, 12 nt, Marburg virus
aacagaaauugu

SEQ ID NO: 3048472 - RNA, 21 nt, Marburg virus
cauaguuuaaccacauaauaa

SEQ ID NO: 3048473 - RNA, 19 nt, Marburg virus
agaaagcagucccaccaau

SEQ ID NO: 3048474 - RNA, 14 nt, Marburg virus
ugcuuuaaaugguu

SEQ ID NO: 3048475 - RNA, 15 nt, Marburg virus
guauacucgcuucaa

SEQ ID NO: 3048476 - RNA, 23 nt, Marburg virus
cucugaugacaagugacaaaauu

SEQ ID NO: 3048477 - RNA, 13 nt, Marburg virus
agggcauuauuca

SEQ ID NO: 3048478 - RNA, 18 nt, Marburg virus
caaucauacacauaauaa

SEQ ID NO: 3048479 - RNA, 21 nt, Marburg virus
agacagggcuacugcugugaa

SEQ ID NO: 3048480 - RNA, 13 nt, Marburg virus
uuaauuaagaaaa

SEQ ID NO: 3048481 - RNA, 14 nt, Marburg virus
aauuauacccacaa

SEQ ID NO: 3048482 - RNA, 14 nt, Marburg virus
augcaauuaaucau

SEQ ID NO: 3048483 - RNA, 18 nt, Marburg virus
auaaacuuguagaauuac

SEQ ID NO: 3048484 - RNA, 13 nt, Marburg virus
gaucgcccuccau

SEQ ID NO: 3048485 - RNA, 20 nt, Marburg virus
ucccucagagaaguuacaca

SEQ ID NO: 3048486 - RNA, 18 nt, Marburg virus
aauaaucaccaauucauu

SEQ ID NO: 3048487 - RNA, 16 nt, Marburg virus
uaugccaauuaagaaa

SEQ ID NO: 3048488 - RNA, 15 nt, Marburg virus
uacaugcaauacuug

SEQ ID NO: 3048489 - RNA, 19 nt, Marburg virus
aauaugccaauuaagaaaa

SEQ ID NO: 3048490 - RNA, 17 nt, Marburg virus
ugcauaucuuccaaaau

SEQ ID NO: 3048491 - RNA, 20 nt, Marburg virus
cauuguucuaccaacaguca

SEQ ID NO: 3048492 - RNA, 19 nt, Marburg virus
ucuccuaaggaaaauccuu

SEQ ID NO: 3048493 - RNA, 14 nt, Marburg virus
uccacgugcaagau

SEQ ID NO: 3048494 - RNA, 20 nt, Marburg virus
uagagaucaugaccuugaua

SEQ ID NO: 3048495 - RNA, 13 nt, Marburg virus
gaaguaacaacaa

SEQ ID NO: 3048496 - RNA, 20 nt, Marburg virus
guaagaaaaacuaaugaaga

SEQ ID NO: 3048497 - RNA, 12 nt, Marburg virus
gaucuacuuaua

SEQ ID NO: 3048498 - RNA, 20 nt, Marburg virus
aaauagccuugucauguuag

SEQ ID NO: 3048499 - RNA, 14 nt, Marburg virus
gcccuggaaucgaa

SEQ ID NO: 3048500 - RNA, 18 nt, Marburg virus
cuacuuaucuacuuugau

SEQ ID NO: 3048501 - RNA, 20 nt, Marburg virus
auaaguuuaagauaucuuaa

SEQ ID NO: 3048502 - RNA, 17 nt, Marburg virus
aaggaauucgacagcau

SEQ ID NO: 3048503 - RNA, 16 nt, Marburg virus
uuuacguauuguugau

SEQ ID NO: 3048504 - RNA, 20 nt, Marburg virus
ugauggcccgaaaaaugcuc

SEQ ID NO: 3048505 - RNA, 21 nt, Marburg virus
cuaaaauaauaagugauuuaa

SEQ ID NO: 3048506 - RNA, 13 nt, Marburg virus
aguauaaaguaua

SEQ ID NO: 3048507 - RNA, 17 nt, Marburg virus
acaugaaaauuggauug

SEQ ID NO: 3048508 - RNA, 19 nt, Marburg virus
caaaagcuuccugaugaug

SEQ ID NO: 3048509 - RNA, 15 nt, Marburg virus
auaagguuaaaaaac

SEQ ID NO: 3048510 - RNA, 15 nt, Marburg virus
aauauccugaugcaa

SEQ ID NO: 3048511 - RNA, 20 nt, Marburg virus
auaacauccgguucaggguc

SEQ ID NO: 3048512 - RNA, 20 nt, Marburg virus
ggaugcuucggugcucuuca

SEQ ID NO: 3048513 - RNA, 17 nt, Marburg virus
gacccaaacaaugauga

SEQ ID NO: 3048514 - RNA, 19 nt, Marburg virus
aagaaucaaacaugugcuc

SEQ ID NO: 3048515 - RNA, 19 nt, Human
cuccgcuuucuacccagcg

SEQ ID NO: 3048516 - RNA, 12 nt, Human
cucccaccucag

SEQ ID NO: 3048517 - RNA, 16 nt, Human
cuccagacacaugucc

SEQ ID NO: 3048518 - RNA, 17 nt, Human
cuccagacacaugucca

SEQ ID NO: 3048519 - RNA, 19 nt, Human
cuccagacacauguccaag

SEQ ID NO: 3048520 - RNA, 15 nt, Human
cuccagaauuuccca

SEQ ID NO: 3048521 - RNA, 18 nt, Human
cuccagaauuucccaaag

SEQ ID NO: 3048522 - RNA, 17 nt, Human
cuccaagaccuucuccu

SEQ ID NO: 3048523 - RNA, 18 nt, Human
cuccaagaccuucuccuu

SEQ ID NO: 3048524 - RNA, 16 nt, Human
cuccaagaccuucucc

SEQ ID NO: 3048525 - RNA, 15 nt, Human
cuccaagaccuucuc

SEQ ID NO: 3048526 - RNA, 22 nt, Human
cuccacuuucuagccagaggag

SEQ ID NO: 3048527 - RNA, 20 nt, Human
cuccacuuucuagccagagg

SEQ ID NO: 3048528 - RNA, 11 nt, Human
cuccaggugca

SEQ ID NO: 3048529 - RNA, 13 nt, Human
cucaggccugggg

SEQ ID NO: 3048530 - RNA, 14 nt, Human
cucaggccuggggg

SEQ ID NO: 3048531 - RNA, 20 nt, Human
cucaggccugggggcugggc

SEQ ID NO: 3048532 - RNA, 21 nt, Human
cucaggccugggggcugggca

SEQ ID NO: 3048533 - RNA, 14 nt, Human
cucaggccagcugc

SEQ ID NO: 3048534 - RNA, 20 nt, Human
cucaggccagcugcuugggc

SEQ ID NO: 3048535 - RNA, 21 nt, Human
cucaggccagcugcuugggcu

SEQ ID NO: 3048536 - RNA, 22 nt, Human
cucaggccagcugcuugggcuu

SEQ ID NO: 3048537 - RNA, 13 nt, Human
cucaggccagcug

SEQ ID NO: 3048538 - RNA, 13 nt, Human
cucagccucccaa

SEQ ID NO: 3048539 - RNA, 16 nt, Human
cucagccucccaaagu

SEQ ID NO: 3048540 - RNA, 14 nt, Human
cucagccucccaaa

SEQ ID NO: 3048541 - RNA, 21 nt, Human
cucagccucccaaagugcugg

SEQ ID NO: 3048542 - RNA, 13 nt, Human
cucagccucccga

SEQ ID NO: 3048543 - RNA, 22 nt, Human
cucagccucccaaagugcuggg

SEQ ID NO: 3048544 - RNA, 23 nt, Human
cucagccucccgaauagcuggga

SEQ ID NO: 3048545 - RNA, 16 nt, Human
cuccaaagucucugga

SEQ ID NO: 3048546 - RNA, 19 nt, Human
cucauguucuuaauucuua

SEQ ID NO: 3048547 - RNA, 18 nt, Human
cucauguucuuaauucuu

SEQ ID NO: 3048548 - RNA, 14 nt, Human
cucauguucuuaau

SEQ ID NO: 3048549 - RNA, 12 nt, Human
cucauguucuua

SEQ ID NO: 3048550 - RNA, 13 nt, Human
cucagugccacua

SEQ ID NO: 3048551 - RNA, 18 nt, Human
cucagucuggcccuuccu

SEQ ID NO: 3048552 - RNA, 17 nt, Human
cucagucuggcccuucc

SEQ ID NO: 3048553 - RNA, 13 nt, Human
cugaaggccccgc

SEQ ID NO: 3048554 - RNA, 14 nt, Human
cugaaggccccgcc

SEQ ID NO: 3048555 - RNA, 17 nt, Human
cugaaggcuggguucug

SEQ ID NO: 3048556 - RNA, 17 nt, Human
cugaaggccccgcccag

SEQ ID NO: 3048557 - RNA, 20 nt, Human
cugaaggacauugcggacag

SEQ ID NO: 3048558 - RNA, 19 nt, Human
cugaaggacauugcggaca

SEQ ID NO: 3048559 - RNA, 16 nt, Human
cugaaaauguaugugu

SEQ ID NO: 3048560 - RNA, 14 nt, Human
cugaaaauguaugu

SEQ ID NO: 3048561 - RNA, 20 nt, Human
cucuuagaugcaguucugaa

SEQ ID NO: 3048562 - RNA, 18 nt, Human
cugacccaugcugcccug

SEQ ID NO: 3048563 - RNA, 17 nt, Human
cugacccaugcugcccu

SEQ ID NO: 3048564 - RNA, 19 nt, Human
cugacccaugcugcccugu

SEQ ID NO: 3048565 - RNA, 20 nt, Human
cugacccaugcugcccugug

SEQ ID NO: 3048566 - RNA, 23 nt, Human
cugacccugcuucaaauauuucc

SEQ ID NO: 3048567 - RNA, 14 nt, Human
cugacagacacagg

SEQ ID NO: 3048568 - RNA, 12 nt, Human
cugacagacaca

SEQ ID NO: 3048569 - RNA, 17 nt, Human
cucuguacagagcccac

SEQ ID NO: 3048570 - RNA, 21 nt, Human
cucuguacagagcccacgccc

SEQ ID NO: 3048571 - RNA, 15 nt, Human
cucuuagaugcaguu

SEQ ID NO: 3048572 - RNA, 15 nt, Human
cucugguccauagag

SEQ ID NO: 3048573 - RNA, 19 nt, Human
cucugcugacagacacagg

SEQ ID NO: 3048574 - RNA, 18 nt, Human
cucugcugacagacacag

SEQ ID NO: 3048575 - RNA, 17 nt, Human
cucugcugacagacaca

SEQ ID NO: 3048576 - RNA, 16 nt, Human
cucugguccauagaga

SEQ ID NO: 3048577 - RNA, 18 nt, Human
cucugguccauagagagc

SEQ ID NO: 3048578 - RNA, 19 nt, Human
cucugguccauagagagca

SEQ ID NO: 3048579 - RNA, 15 nt, Human
cucugguuaucuaau

SEQ ID NO: 3048580 - RNA, 19 nt, Human
cucugcagcaauaaagcag

SEQ ID NO: 3048581 - RNA, 18 nt, Human
cucugcagcaauaaagca

SEQ ID NO: 3048582 - RNA, 23 nt, Human
cucugcagcaauaaagcagcguu

SEQ ID NO: 3048583 - RNA, 23 nt, Human
cucugcggagcacacuggcucac

SEQ ID NO: 3048584 - RNA, 13 nt, Human
cucugcagcaaua

SEQ ID NO: 3048585 - RNA, 21 nt, Human
cucuccgaccagacaccuuga

SEQ ID NO: 3048586 - RNA, 15 nt, Human
cucugaaggacauug

SEQ ID NO: 3048587 - RNA, 11 nt, Human
cucucuggccu

SEQ ID NO: 3048588 - RNA, 12 nt, Human
cucucuggccuu

SEQ ID NO: 3048589 - RNA, 19 nt, Human
cucucagauuguaccauug

SEQ ID NO: 3048590 - RNA, 15 nt, Human
cucucacuccuugaa

SEQ ID NO: 3048591 - RNA, 21 nt, Human
cucucacuuguuuuauuuaac

SEQ ID NO: 3048592 - RNA, 12 nt, Human
cucucacuccuu

SEQ ID NO: 3048593 - RNA, 14 nt, Human
cucucacuccuuga

SEQ ID NO: 3048594 - RNA, 23 nt, Human
cuagcagcagggagggcuucugc

SEQ ID NO: 3048595 - RNA, 17 nt, Human
cuagcauggcugccaau

SEQ ID NO: 3048596 - RNA, 16 nt, Human
cuagcaugaagacaga

SEQ ID NO: 3048597 - RNA, 22 nt, Human
cuagcagcagggagggcuucug

SEQ ID NO: 3048598 - RNA, 12 nt, Human
cuagcagcaggg

SEQ ID NO: 3048599 - RNA, 13 nt, Human
cuagaacucccuu

SEQ ID NO: 3048600 - RNA, 16 nt, Human
cuagaacucccuuuca

SEQ ID NO: 3048601 - RNA, 17 nt, Human
cuagaacucccuuucaa

SEQ ID NO: 3048602 - RNA, 18 nt, Human
cuagaacucccuuucaac

SEQ ID NO: 3048603 - RNA, 19 nt, Human
cuagaacucccuuucaaca

SEQ ID NO: 3048604 - RNA, 19 nt, Human
cuagaaauuccccacccug

SEQ ID NO: 3048605 - RNA, 11 nt, Human
cuaccugaggg

SEQ ID NO: 3048606 - RNA, 14 nt, Human
cuaccugaggggcc

SEQ ID NO: 3048607 - RNA, 19 nt, Human
cuagggaaaaaccagcgug

SEQ ID NO: 3048608 - RNA, 21 nt, Human
cuagggaaaaaccagcgugug

SEQ ID NO: 3048609 - RNA, 18 nt, Human
cuaguuccaccaucaagc

SEQ ID NO: 3048610 - RNA, 20 nt, Human
cuaguuccaccaucaagcca

SEQ ID NO: 3048611 - RNA, 14 nt, Human
cuaguuccaccauc

SEQ ID NO: 3048612 - RNA, 22 nt, Human
cuaguuccaccaucaagccacc

SEQ ID NO: 3048613 - RNA, 23 nt, Human
cuaguugaucagcuuauugucua

SEQ ID NO: 3048614 - RNA, 22 nt, Human
cuacauaaguaauucaagaaaa

SEQ ID NO: 3048615 - RNA, 23 nt, Human
cuacauaaguaauucaagaaaac

SEQ ID NO: 3048616 - RNA, 15 nt, Human
cuacaugagguacug

SEQ ID NO: 3048617 - RNA, 15 nt, Human
cuacaguccucccau

SEQ ID NO: 3048618 - RNA, 16 nt, Human
cuacaguccucccauc

SEQ ID NO: 3048619 - RNA, 17 nt, Human
cuacaguccucccaucu

SEQ ID NO: 3048620 - RNA, 13 nt, Human
cuacaguugaaaa

SEQ ID NO: 3048621 - RNA, 22 nt, Human
cuaagugauccucccaccucag

SEQ ID NO: 3048622 - RNA, 20 nt, Human
cuaagugauccucccaccuc

SEQ ID NO: 3048623 - RNA, 18 nt, Human
cuaagugaggaugaaaaa

SEQ ID NO: 3048624 - RNA, 20 nt, Human
cuaagugaaauaagccagac

SEQ ID NO: 3048625 - RNA, 23 nt, Human
cuaagugaaauaagccagacauc

SEQ ID NO: 3048626 - RNA, 15 nt, Human
cuaacuucaccauau

SEQ ID NO: 3048627 - RNA, 14 nt, Human
cuaacuggacuggu

SEQ ID NO: 3048628 - RNA, 16 nt, Human
cuaacuuuccuucauu

SEQ ID NO: 3048629 - RNA, 16 nt, Human
cuaacuucaccauauu

SEQ ID NO: 3048630 - RNA, 18 nt, Human
cggcucacugcagccuca

SEQ ID NO: 3048631 - RNA, 19 nt, Human
cggcucacugcagccucaa

SEQ ID NO: 3048632 - RNA, 17 nt, Human
cggcucacugcagccuc

SEQ ID NO: 3048633 - RNA, 15 nt, Human
cggccuuuggcuuca

SEQ ID NO: 3048634 - RNA, 17 nt, Human
cggagcacacuggcuca

SEQ ID NO: 3048635 - RNA, 13 nt, Human
cgccaaggcuggg

SEQ ID NO: 3048636 - RNA, 16 nt, Human
cgccaaggcuggggga

SEQ ID NO: 3048637 - RNA, 12 nt, Human
cgccaaggcugg

SEQ ID NO: 3048638 - RNA, 15 nt, Human
cgaguagcugggacu

SEQ ID NO: 3048639 - RNA, 14 nt, Human
cgaguagcugggac

SEQ ID NO: 3048640 - RNA, 13 nt, Human
cgaguagcuggga

SEQ ID NO: 3048641 - RNA, 17 nt, Human
cgaguuacagacaaagc

SEQ ID NO: 3048642 - RNA, 18 nt, Human
cgaguuacagacaaagcg

SEQ ID NO: 3048643 - RNA, 21 nt, Human
ccuucugacccaugcugcccu

SEQ ID NO: 3048644 - RNA, 22 nt, Human
ccuucugacccaugcugcccug

SEQ ID NO: 3048645 - RNA, 23 nt, Human
ccuucugacccaugcugcccugu

SEQ ID NO: 3048646 - RNA, 22 nt, Human
ccuucuggaauaaggagaauga

SEQ ID NO: 3048647 - RNA, 12 nt, Human
ccuucugaccca

SEQ ID NO: 3048648 - RNA, 16 nt, Human
ccuucugacccaugcu

SEQ ID NO: 3048649 - RNA, 17 nt, Human
ccuucugacccaugcug

SEQ ID NO: 3048650 - RNA, 20 nt, Human
ccuucugacccaugcugccc

SEQ ID NO: 3048651 - RNA, 14 nt, Human
ccuggccugagcug

SEQ ID NO: 3048652 - RNA, 15 nt, Human
ccuggccugagcugg

SEQ ID NO: 3048653 - RNA, 17 nt, Human
ccuugccgucuaccuga

SEQ ID NO: 3048654 - RNA, 14 nt, Human
ccuugcccagccug

SEQ ID NO: 3048655 - RNA, 16 nt, Human
ccuugcccagccugga

SEQ ID NO: 3048656 - RNA, 13 nt, Human
ccuugcccagccu

SEQ ID NO: 3048657 - RNA, 20 nt, Human
ccuugccgucuaccugaggg

SEQ ID NO: 3048658 - RNA, 17 nt, Human
ccuugcccagccuggau

SEQ ID NO: 3048659 - RNA, 18 nt, Human
ccuuuuuuauacauaaac

SEQ ID NO: 3048660 - RNA, 17 nt, Human
ccuuuuuuauacauaaa

SEQ ID NO: 3048661 - RNA, 15 nt, Human
cgacagugagacucu

SEQ ID NO: 3048662 - RNA, 16 nt, Human
cgacagugagacucug

SEQ ID NO: 3048663 - RNA, 23 nt, Human
cgaccagacaccuugacagggca

SEQ ID NO: 3048664 - RNA, 21 nt, Human
ccuuuuuuagaguugauacua

SEQ ID NO: 3048665 - RNA, 12 nt, Human
ccuuuuuuauac

SEQ ID NO: 3048666 - RNA, 20 nt, Human
ccuuuucgcaggauucuucc

SEQ ID NO: 3048667 - RNA, 20 nt, Human
ccuuuagcgcccaguugggu

SEQ ID NO: 3048668 - RNA, 14 nt, Human
ccuuuagcgcccag

SEQ ID NO: 3048669 - RNA, 21 nt, Human
ccccaaaacucuccucugcug

SEQ ID NO: 3048670 - RNA, 23 nt, Human
ccccaaaacucuccucugcugcu

SEQ ID NO: 3048671 - RNA, 22 nt, Human
ccccaaaacucuccucugcugc

SEQ ID NO: 3048672 - RNA, 23 nt, Human
cccauuguggucacaggaaguag

SEQ ID NO: 3048673 - RNA, 22 nt, Human
cccauuguggucacaggaagua

SEQ ID NO: 3048674 - RNA, 22 nt, Human
ccccagcaagugagagcugggu

SEQ ID NO: 3048675 - RNA, 21 nt, Human
ccccagcaagugagagcuggg

SEQ ID NO: 3048676 - RNA, 22 nt, Human
cccccaaauggaaaugggcaga

SEQ ID NO: 3048677 - RNA, 23 nt, Human
ccccgacccuugccgucuaccug

SEQ ID NO: 3048678 - RNA, 14 nt, Human
ccccaucugcgggg

SEQ ID NO: 3048679 - RNA, 22 nt, Human
cccgggaagggggcugggacau

SEQ ID NO: 3048680 - RNA, 18 nt, Human
cccuauuagagaagagau

SEQ ID NO: 3048681 - RNA, 23 nt, Human
cccgggaggcagagguugcagug

SEQ ID NO: 3048682 - RNA, 16 nt, Human
cccggcuccaggcucc

SEQ ID NO: 3048683 - RNA, 15 nt, Human
cccggcuccaggcuc

SEQ ID NO: 3048684 - RNA, 14 nt, Human
cccggcuccaggcu

SEQ ID NO: 3048685 - RNA, 13 nt, Human
cccggcuccaggc

SEQ ID NO: 3048686 - RNA, 13 nt, Human
cccggccaccugc

SEQ ID NO: 3048687 - RNA, 14 nt, Human
cccggccaccugcg

SEQ ID NO: 3048688 - RNA, 12 nt, Human
cccggcuccagg

SEQ ID NO: 3048689 - RNA, 11 nt, Human
cccggcuccag

SEQ ID NO: 3048690 - RNA, 14 nt, Human
cccgaauagcuggg

SEQ ID NO: 3048691 - RNA, 23 nt, Human
cccagcucugguccauagagagc

SEQ ID NO: 3048692 - RNA, 22 nt, Human
cccagcuuaaaggggcuagagu

SEQ ID NO: 3048693 - RNA, 13 nt, Human
cccauccucugua

SEQ ID NO: 3048694 - RNA, 17 nt, Human
cccaggcuggcgugcag

SEQ ID NO: 3048695 - RNA, 13 nt, Human
cccaggcuggcgu

SEQ ID NO: 3048696 - RNA, 13 nt, Human
cccacugcucugg

SEQ ID NO: 3048697 - RNA, 12 nt, Human
cccacugcucug

SEQ ID NO: 3048698 - RNA, 19 nt, Human
cccacugcuuuuggucugu

SEQ ID NO: 3048699 - RNA, 20 nt, Human
cccacccaagggccuggccu

SEQ ID NO: 3048700 - RNA, 21 nt, Human
cccacccaagggccuggccug

SEQ ID NO: 3048701 - RNA, 22 nt, Human
cccacccaagggccuggccuga

SEQ ID NO: 3048702 - RNA, 18 nt, Human
cccacccugaaagcccug

SEQ ID NO: 3048703 - RNA, 18 nt, Human
cccacccaagggccuggc

SEQ ID NO: 3048704 - RNA, 12 nt, Human
cccacccccacc

SEQ ID NO: 3048705 - RNA, 15 nt, Human
cccacccccacccaa

SEQ ID NO: 3048706 - RNA, 17 nt, Human
cccacccccacccaagg

SEQ ID NO: 3048707 - RNA, 18 nt, Human
ccagagggccugcaaggg

SEQ ID NO: 3048708 - RNA, 19 nt, Human
ccagagggccugcaaggga

SEQ ID NO: 3048709 - RNA, 17 nt, Human
ccagagggccugcaagg

SEQ ID NO: 3048710 - RNA, 16 nt, Human
ccaccuuggcucaagu

SEQ ID NO: 3048711 - RNA, 15 nt, Human
ccagauccuggaaau

SEQ ID NO: 3048712 - RNA, 15 nt, Human
ccagaugcaccagcc

SEQ ID NO: 3048713 - RNA, 17 nt, Human
ccagaugcaccagcccu

SEQ ID NO: 3048714 - RNA, 18 nt, Human
ccagaugcaccagcccuu

SEQ ID NO: 3048715 - RNA, 13 nt, Human
ccagcaggcucuc

SEQ ID NO: 3048716 - RNA, 15 nt, Human
ccagcaggcucucag

SEQ ID NO: 3048717 - RNA, 20 nt, Human
ccagcagccuggacccugug

SEQ ID NO: 3048718 - RNA, 11 nt, Human
ccagccccugg

SEQ ID NO: 3048719 - RNA, 12 nt, Human
ccagccccugga

SEQ ID NO: 3048720 - RNA, 16 nt, Human
ccagcucaccagcccc

SEQ ID NO: 3048721 - RNA, 15 nt, Human
ccagcucaccagccc

SEQ ID NO: 3048722 - RNA, 16 nt, Human
ccagcuguucagcugg

SEQ ID NO: 3048723 - RNA, 22 nt, Human
ccagcucaccagccccagugcc

SEQ ID NO: 3048724 - RNA, 17 nt, Human
ccagcuguucagcuggu

SEQ ID NO: 3048725 - RNA, 19 nt, Human
ccagcuuaaaggggcuaga

SEQ ID NO: 3048726 - RNA, 13 nt, Human
ccaggaagccagc

SEQ ID NO: 3048727 - RNA, 12 nt, Human
ccaggaagccag

SEQ ID NO: 3048728 - RNA, 14 nt, Human
ccaggaaaggcucc

SEQ ID NO: 3048729 - RNA, 15 nt, Human
ccaggaaaggcucca

SEQ ID NO: 3048730 - RNA, 16 nt, Human
ccaggaaaggcuccag

SEQ ID NO: 3048731 - RNA, 20 nt, Human
ccaguuggguggaugccugg

SEQ ID NO: 3048732 - RNA, 19 nt, Human
ccaguuggguggaugccug

SEQ ID NO: 3048733 - RNA, 17 nt, Human
ccaguuggguggaugcc

SEQ ID NO: 3048734 - RNA, 23 nt, Human
ccaugagccucagcauccuggca

SEQ ID NO: 3048735 - RNA, 21 nt, Human
ccaugagccucagcauccugg

SEQ ID NO: 3048736 - RNA, 20 nt, Human
ccauggucggaaaacaugcu

SEQ ID NO: 3048737 - RNA, 14 nt, Human
ccaucccagcccca

SEQ ID NO: 3048738 - RNA, 13 nt, Human
ccaucccagcccc

SEQ ID NO: 3048739 - RNA, 15 nt, Human
ccaucccagccccaa

SEQ ID NO: 3048740 - RNA, 23 nt, Human
ccaguuggucccccuuccaugga

SEQ ID NO: 3048741 - RNA, 14 nt, Human
ccaucccugaaggc

SEQ ID NO: 3048742 - RNA, 15 nt, Human
ccaucccugaaggcc

SEQ ID NO: 3048743 - RNA, 17 nt, Human
ccaucccugaaggcccc

SEQ ID NO: 3048744 - RNA, 20 nt, Human
ccaucccugaaggccccgcc

SEQ ID NO: 3048745 - RNA, 23 nt, Human
ccaggggugggacacccugugau

SEQ ID NO: 3048746 - RNA, 14 nt, Human
ccaggggugggaca

SEQ ID NO: 3048747 - RNA, 17 nt, Human
ccaggggugggacaccc

SEQ ID NO: 3048748 - RNA, 20 nt, Human
ccaggggaaaaucagccugc

SEQ ID NO: 3048749 - RNA, 13 nt, Human
ccaggggugggac

SEQ ID NO: 3048750 - RNA, 19 nt, Human
ccaggggaaaaucagccug

SEQ ID NO: 3048751 - RNA, 21 nt, Human
ccaggcuccuuuagcgcccag

SEQ ID NO: 3048752 - RNA, 20 nt, Human
ccaggcuccuuuagcgccca

SEQ ID NO: 3048753 - RNA, 16 nt, Human
ccaggcuggcgugcag

SEQ ID NO: 3048754 - RNA, 18 nt, Human
ccaggcuggcgugcagug

SEQ ID NO: 3048755 - RNA, 17 nt, Human
ccaggcuggcgugcagu

SEQ ID NO: 3048756 - RNA, 22 nt, Human
ccucucugcaggucccuaauaa

SEQ ID NO: 3048757 - RNA, 21 nt, Human
ccucucugcaggucccuaaua

SEQ ID NO: 3048758 - RNA, 23 nt, Human
ccucucugcaggucccuaauaaa

SEQ ID NO: 3048759 - RNA, 21 nt, Human
ccucugccugaagucacacag

SEQ ID NO: 3048760 - RNA, 22 nt, Human
ccucugccugaagucacacagu

SEQ ID NO: 3048761 - RNA, 15 nt, Human
ccucugcugcuggcu

SEQ ID NO: 3048762 - RNA, 16 nt, Human
ccucugcugcuggcug

SEQ ID NO: 3048763 - RNA, 17 nt, Human
ccucugcugcuggcugg

SEQ ID NO: 3048764 - RNA, 18 nt, Human
ccucugcugcuggcuggu

SEQ ID NO: 3048765 - RNA, 13 nt, Human
ccucugcugcugg

SEQ ID NO: 3048766 - RNA, 14 nt, Human
ccucugcugcuggc

SEQ ID NO: 3048767 - RNA, 15 nt, Human
ccucucugcaggucc

SEQ ID NO: 3048768 - RNA, 20 nt, Human
ccucucugcaggucccuaau

SEQ ID NO: 3048769 - RNA, 13 nt, Human
ccucucugcaggu

SEQ ID NO: 3048770 - RNA, 14 nt, Human
ccucucucaggcca

SEQ ID NO: 3048771 - RNA, 12 nt, Human
ccucucucacuc

SEQ ID NO: 3048772 - RNA, 13 nt, Human
ccucucucacucc

SEQ ID NO: 3048773 - RNA, 14 nt, Human
ccucucucacuccu

SEQ ID NO: 3048774 - RNA, 15 nt, Human
ccucucucacuccuu

SEQ ID NO: 3048775 - RNA, 17 nt, Human
ccucucucacuccuuga

SEQ ID NO: 3048776 - RNA, 12 nt, Human
ccucucucaggc

SEQ ID NO: 3048777 - RNA, 22 nt, Human
ccugcacuugcagacucuacag

SEQ ID NO: 3048778 - RNA, 19 nt, Human
ccugcacuugcagacucua

SEQ ID NO: 3048779 - RNA, 13 nt, Human
ccucuuggguuca

SEQ ID NO: 3048780 - RNA, 19 nt, Human
ccucuugagccuugaacuu

SEQ ID NO: 3048781 - RNA, 13 nt, Human
ccucuugagccuu

SEQ ID NO: 3048782 - RNA, 14 nt, Human
ccuggccucugcac

SEQ ID NO: 3048783 - RNA, 15 nt, Human
ccuggccucugcacu

SEQ ID NO: 3048784 - RNA, 13 nt, Human
ccuggccugagcu

SEQ ID NO: 3048785 - RNA, 12 nt, Human
ccuggccucugc

SEQ ID NO: 3048786 - RNA, 16 nt, Human
ccugcccaggccccug

SEQ ID NO: 3048787 - RNA, 22 nt, Human
ccugcccaggccccugccaccc

SEQ ID NO: 3048788 - RNA, 15 nt, Human
ccugcccaggccccu

SEQ ID NO: 3048789 - RNA, 14 nt, Human
ccugcccaggcccc

SEQ ID NO: 3048790 - RNA, 12 nt, Human
ccugcugggugu

SEQ ID NO: 3048791 - RNA, 14 nt, Human
ccugcugggugugg

SEQ ID NO: 3048792 - RNA, 20 nt, Human
ccugcuggguguggcgcagc

SEQ ID NO: 3048793 - RNA, 14 nt, Human
ccuggaugcagccu

SEQ ID NO: 3048794 - RNA, 17 nt, Human
ccuggaugcagccucac

SEQ ID NO: 3048795 - RNA, 19 nt, Human
ccuggaugcagccucacag

SEQ ID NO: 3048796 - RNA, 13 nt, Human
ccuggaugcagcc

SEQ ID NO: 3048797 - RNA, 16 nt, Human
ccuggaguucugguuc

SEQ ID NO: 3048798 - RNA, 17 nt, Human
ccuggaguucugguucc

SEQ ID NO: 3048799 - RNA, 15 nt, Human
ccuggaguucugguu

SEQ ID NO: 3048800 - RNA, 23 nt, Human
ccuaauaaagcuguguggcaguc

SEQ ID NO: 3048801 - RNA, 14 nt, Human
ccuaauaaagcugu

SEQ ID NO: 3048802 - RNA, 13 nt, Human
ccuaauaaagcug

SEQ ID NO: 3048803 - RNA, 16 nt, Human
ccguagguuauuuuca

SEQ ID NO: 3048804 - RNA, 24 nt, Human
ccguagacgugcacgcacacuguc

SEQ ID NO: 3048805 - RNA, 15 nt, Human
ccgucuccagcugcu

SEQ ID NO: 3048806 - RNA, 19 nt, Human
ccuaggacccgucuccagc

SEQ ID NO: 3048807 - RNA, 20 nt, Human
ccuaggacccgucuccagcu

SEQ ID NO: 3048808 - RNA, 21 nt, Human
ccuaggacccgucuccagcug

SEQ ID NO: 3048809 - RNA, 22 nt, Human
ccuaggacccgucuccagcugc

SEQ ID NO: 3048810 - RNA, 18 nt, Human
ccuaggacccgucuccag

SEQ ID NO: 3048811 - RNA, 15 nt, Human
ccuauuuuaauaaac

SEQ ID NO: 3048812 - RNA, 16 nt, Human
ccucaaccuccugggc

SEQ ID NO: 3048813 - RNA, 15 nt, Human
ccucaacucuccucc

SEQ ID NO: 3048814 - RNA, 15 nt, Human
ccucaagagaaggca

SEQ ID NO: 3048815 - RNA, 22 nt, Human
ccucagccucccaaagugcugg

SEQ ID NO: 3048816 - RNA, 11 nt, Human
ccucagccucc

SEQ ID NO: 3048817 - RNA, 22 nt, Human
ccucagccucccgaauagcugg

SEQ ID NO: 3048818 - RNA, 23 nt, Human
ccucagccucccaaagugcuggg

SEQ ID NO: 3048819 - RNA, 15 nt, Human
ccucauguccacugg

SEQ ID NO: 3048820 - RNA, 13 nt, Human
ccucauguucuua

SEQ ID NO: 3048821 - RNA, 20 nt, Human
ccucauguccacugguucuu

SEQ ID NO: 3048822 - RNA, 22 nt, Human
ccucccaaggggcccaaauucu

SEQ ID NO: 3048823 - RNA, 23 nt, Human
ccucccaacucaccccagcccca

SEQ ID NO: 3048824 - RNA, 19 nt, Human
ccucauguucuuaauucuu

SEQ ID NO: 3048825 - RNA, 20 nt, Human
ccuccaagaccuucuccuuc

SEQ ID NO: 3048826 - RNA, 14 nt, Human
cccuggcagccccu

SEQ ID NO: 3048827 - RNA, 16 nt, Human
cccuggcagccccugu

SEQ ID NO: 3048828 - RNA, 21 nt, Human
cccugcccugugggcccccaa

SEQ ID NO: 3048829 - RNA, 20 nt, Human
cccuggcacuggcaaacagg

SEQ ID NO: 3048830 - RNA, 12 nt, Human
cccuggcagccc

SEQ ID NO: 3048831 - RNA, 13 nt, Human
cccuggcagcccc

SEQ ID NO: 3048832 - RNA, 16 nt, Human
cccugcccugugggcc

SEQ ID NO: 3048833 - RNA, 20 nt, Human
cccugcccugugggccccca

SEQ ID NO: 3048834 - RNA, 15 nt, Human
cccugcccugugggc

SEQ ID NO: 3048835 - RNA, 14 nt, Human
cccugcccuguggg

SEQ ID NO: 3048836 - RNA, 11 nt, Human
cccugcccugu

SEQ ID NO: 3048837 - RNA, 12 nt, Human
cccugcccugug

SEQ ID NO: 3048838 - RNA, 13 nt, Human
cccugcccugugg

SEQ ID NO: 3048839 - RNA, 16 nt, Human
cccuucuaccuuccug

SEQ ID NO: 3048840 - RNA, 18 nt, Human
cccuucgcuccugugucu

SEQ ID NO: 3048841 - RNA, 16 nt, Human
cccuucgcuccugugu

SEQ ID NO: 3048842 - RNA, 22 nt, Human
cccuucugacccaugcugcccu

SEQ ID NO: 3048843 - RNA, 23 nt, Human
cccuucugacccaugcugcccug

SEQ ID NO: 3048844 - RNA, 21 nt, Human
cccuucugacccaugcugccc

SEQ ID NO: 3048845 - RNA, 13 nt, Human
cccuucucuguau

SEQ ID NO: 3048846 - RNA, 17 nt, Human
ccgccaaggcuggggga

SEQ ID NO: 3048847 - RNA, 16 nt, Human
ccgacccuugccgucu

SEQ ID NO: 3048848 - RNA, 17 nt, Human
ccgaauagcugggacua

SEQ ID NO: 3048849 - RNA, 20 nt, Human
ccgaauagcugggacuacag

SEQ ID NO: 3048850 - RNA, 18 nt, Human
ccgaccagacaccuugac

SEQ ID NO: 3048851 - RNA, 20 nt, Human
ccgcccaggcuuagucacug

SEQ ID NO: 3048852 - RNA, 16 nt, Human
ccgccaugcuccuggc

SEQ ID NO: 3048853 - RNA, 14 nt, Human
caugaauuugugaa

SEQ ID NO: 3048854 - RNA, 14 nt, Human
caugacacgaauau

SEQ ID NO: 3048855 - RNA, 16 nt, Human
caugaauuaguuuuau

SEQ ID NO: 3048856 - RNA, 17 nt, Human
caugacacgaauauugc

SEQ ID NO: 3048857 - RNA, 18 nt, Human
caugacacgaauauugcu

SEQ ID NO: 3048858 - RNA, 18 nt, Human
caugcaaggucauuuuuu

SEQ ID NO: 3048859 - RNA, 17 nt, Human
caugcaaggucauuuuu

SEQ ID NO: 3048860 - RNA, 15 nt, Human
caugcaaggucauuu

SEQ ID NO: 3048861 - RNA, 22 nt, Human
caugcaaggucauuuuuuuuaa

SEQ ID NO: 3048862 - RNA, 19 nt, Human
cauggccuuugcuugaaag

SEQ ID NO: 3048863 - RNA, 22 nt, Human
cauggccuuugcuugaaagaaa

SEQ ID NO: 3048864 - RNA, 16 nt, Human
caugcugcccugugag

SEQ ID NO: 3048865 - RNA, 18 nt, Human
caugcugcccugugagua

SEQ ID NO: 3048866 - RNA, 13 nt, Human
caucaggccaggc

SEQ ID NO: 3048867 - RNA, 20 nt, Human
caucagcuugcccuguuaaa

SEQ ID NO: 3048868 - RNA, 13 nt, Human
caucagcugcuga

SEQ ID NO: 3048869 - RNA, 15 nt, Human
caucagcugcugaaa

SEQ ID NO: 3048870 - RNA, 18 nt, Human
caucagcugcugaaacaa

SEQ ID NO: 3048871 - RNA, 17 nt, Human
caucagcugcugaaaca

SEQ ID NO: 3048872 - RNA, 18 nt, Human
caucagcacgauuucugu

SEQ ID NO: 3048873 - RNA, 17 nt, Human
caucagcacgauuucug

SEQ ID NO: 3048874 - RNA, 20 nt, Human
caucaggccaggcccucugc

SEQ ID NO: 3048875 - RNA, 21 nt, Human
caucaggccaggcccucugcc

SEQ ID NO: 3048876 - RNA, 22 nt, Human
caucaggccaggcccucugccc

SEQ ID NO: 3048877 - RNA, 23 nt, Human
caucaggccaggcccucugccca

SEQ ID NO: 3048878 - RNA, 12 nt, Human
caucccagcccc

SEQ ID NO: 3048879 - RNA, 16 nt, Human
caucccagccccaaug

SEQ ID NO: 3048880 - RNA, 14 nt, Human
caucccagccccaa

SEQ ID NO: 3048881 - RNA, 13 nt, Human
caucccagcccca

SEQ ID NO: 3048882 - RNA, 23 nt, Human
cauccuggcacccggccccugcu

SEQ ID NO: 3048883 - RNA, 15 nt, Human
cauccuggcccaggg

SEQ ID NO: 3048884 - RNA, 16 nt, Human
cauccuggcccagggc

SEQ ID NO: 3048885 - RNA, 18 nt, Human
cauccuggcccagggcau

SEQ ID NO: 3048886 - RNA, 19 nt, Human
cauccuggcccagggcauc

SEQ ID NO: 3048887 - RNA, 18 nt, Human
caucugugaaaggaaaga

SEQ ID NO: 3048888 - RNA, 19 nt, Human
caucugugaaaggaaagag

SEQ ID NO: 3048889 - RNA, 21 nt, Human
caucuuagguuggcaaaaagg

SEQ ID NO: 3048890 - RNA, 22 nt, Human
caucuuagguuggcaaaaaggc

SEQ ID NO: 3048891 - RNA, 17 nt, Human
cauaaugcgugcauacc

SEQ ID NO: 3048892 - RNA, 14 nt, Human
cauaaugcgugcau

SEQ ID NO: 3048893 - RNA, 18 nt, Human
cauagauucccugagcag

SEQ ID NO: 3048894 - RNA, 17 nt, Human
cauagauucccugagca

SEQ ID NO: 3048895 - RNA, 15 nt, Human
cauacaauuccaaac

SEQ ID NO: 3048896 - RNA, 21 nt, Human
cauaaugcgugcauaccacuu

SEQ ID NO: 3048897 - RNA, 20 nt, Human
cauagcagcuuauucacaag

SEQ ID NO: 3048898 - RNA, 16 nt, Human
cauauuaccacagaca

SEQ ID NO: 3048899 - RNA, 17 nt, Human
cauauuaccacagacau

SEQ ID NO: 3048900 - RNA, 21 nt, Human
cauauuaccacagacauacua

SEQ ID NO: 3048901 - RNA, 20 nt, Human
cauauuaccacagacauacu

SEQ ID NO: 3048902 - RNA, 18 nt, Human
cagucaccccggccaccu

SEQ ID NO: 3048903 - RNA, 15 nt, Human
cauuuauucugcuca

SEQ ID NO: 3048904 - RNA, 16 nt, Human
cauuuauucugcucac

SEQ ID NO: 3048905 - RNA, 19 nt, Human
ccaaaaagauuuucagaaa

SEQ ID NO: 3048906 - RNA, 17 nt, Human
ccaaaacucuccucugc

SEQ ID NO: 3048907 - RNA, 17 nt, Human
ccaaaaaaugcuugcuu

SEQ ID NO: 3048908 - RNA, 23 nt, Human
cauuuuucuuagggaaggauaca

SEQ ID NO: 3048909 - RNA, 23 nt, Human
cauuuggugguuucagaaaugug

SEQ ID NO: 3048910 - RNA, 22 nt, Human
cauuuggugguuucagaaaugu

SEQ ID NO: 3048911 - RNA, 21 nt, Human
cauuuggugguuucagaaaug

SEQ ID NO: 3048912 - RNA, 21 nt, Human
cauugcggacagccacggcca

SEQ ID NO: 3048913 - RNA, 17 nt, Human
cauugcggacagccacg

SEQ ID NO: 3048914 - RNA, 15 nt, Human
cauugcggacagcca

SEQ ID NO: 3048915 - RNA, 14 nt, Human
cauugcggacagcc

SEQ ID NO: 3048916 - RNA, 18 nt, Human
cauugcugggcuugucug

SEQ ID NO: 3048917 - RNA, 17 nt, Human
cauuaucuagauacugu

SEQ ID NO: 3048918 - RNA, 16 nt, Human
cauuaucuagauacug

SEQ ID NO: 3048919 - RNA, 12 nt, Human
cauuaucuagau

SEQ ID NO: 3048920 - RNA, 15 nt, Human
cauuaggauggcuag

SEQ ID NO: 3048921 - RNA, 15 nt, Human
cauguucucugagga

SEQ ID NO: 3048922 - RNA, 17 nt, Human
cauggcugccaauggga

SEQ ID NO: 3048923 - RNA, 22 nt, Human
cauggcuggagcuagaauuuga

SEQ ID NO: 3048924 - RNA, 22 nt, Human
cauggcugccaaugggagcuca

SEQ ID NO: 3048925 - RNA, 22 nt, Human
cauggccucuucagaucucuaa

SEQ ID NO: 3048926 - RNA, 16 nt, Human
cauucuccuuguguua

SEQ ID NO: 3048927 - RNA, 18 nt, Human
cauuaucuagauacugua

SEQ ID NO: 3048928 - RNA, 16 nt, Human
ccaccaucaagccacc

SEQ ID NO: 3048929 - RNA, 17 nt, Human
ccaccaucaagccacca

SEQ ID NO: 3048930 - RNA, 14 nt, Human
ccaccgcagacagg

SEQ ID NO: 3048931 - RNA, 17 nt, Human
ccaccgcagacaggacc

SEQ ID NO: 3048932 - RNA, 20 nt, Human
ccaccaucaagccaccaaca

SEQ ID NO: 3048933 - RNA, 15 nt, Human
ccaccaucaagccac

SEQ ID NO: 3048934 - RNA, 13 nt, Human
ccacccugcucuc

SEQ ID NO: 3048935 - RNA, 18 nt, Human
ccaccgcagacaggacca

SEQ ID NO: 3048936 - RNA, 13 nt, Human
ccaccgcagacag

SEQ ID NO: 3048937 - RNA, 15 nt, Human
ccaccuuggcucaag

SEQ ID NO: 3048938 - RNA, 14 nt, Human
ccaccuuggcucaa

SEQ ID NO: 3048939 - RNA, 13 nt, Human
ccaccuuggcuca

SEQ ID NO: 3048940 - RNA, 18 nt, Human
ccaaauguucaucaauga

SEQ ID NO: 3048941 - RNA, 12 nt, Human
ccaaauuaagag

SEQ ID NO: 3048942 - RNA, 16 nt, Human
ccaaaucauaguggcu

SEQ ID NO: 3048943 - RNA, 16 nt, Human
ccaacgucugugccau

SEQ ID NO: 3048944 - RNA, 14 nt, Human
ccaaagugcuggga

SEQ ID NO: 3048945 - RNA, 20 nt, Human
ccaagcuggucccacucagu

SEQ ID NO: 3048946 - RNA, 20 nt, Human
ccaaugcacuuuguucuggc

SEQ ID NO: 3048947 - RNA, 22 nt, Human
ccaaugcacuuuguucuggcuc

SEQ ID NO: 3048948 - RNA, 23 nt, Human
ccaaugcacuuuguucuggcucu

SEQ ID NO: 3048949 - RNA, 20 nt, Human
ccaauguucucucuucucca

SEQ ID NO: 3048950 - RNA, 16 nt, Human
cagucaccccggccac

SEQ ID NO: 3048951 - RNA, 17 nt, Human
cagucaccccggccacc

SEQ ID NO: 3048952 - RNA, 14 nt, Human
cagucaccccggcc

SEQ ID NO: 3048953 - RNA, 19 nt, Human
caguaaaugggggugcauu

SEQ ID NO: 3048954 - RNA, 19 nt, Human
caguauuacuucugcuaca

SEQ ID NO: 3048955 - RNA, 18 nt, Human
caguaaaugggggugcau

SEQ ID NO: 3048956 - RNA, 21 nt, Human
caggguuggccccugcccggc

SEQ ID NO: 3048957 - RNA, 17 nt, Human
caggguuggccccugcc

SEQ ID NO: 3048958 - RNA, 14 nt, Human
caggguuggccccu

SEQ ID NO: 3048959 - RNA, 22 nt, Human
caggguggccacaccucuaucc

SEQ ID NO: 3048960 - RNA, 14 nt, Human
caggugcugccauc

SEQ ID NO: 3048961 - RNA, 13 nt, Human
caggugcugccau

SEQ ID NO: 3048962 - RNA, 23 nt, Human
cagguuuuuggucugacccacug

SEQ ID NO: 3048963 - RNA, 23 nt, Human
cagggucucacucugucgcccag

SEQ ID NO: 3048964 - RNA, 22 nt, Human
cagggucucacucugucgccca

SEQ ID NO: 3048965 - RNA, 21 nt, Human
cagggucucuaccauccccug

SEQ ID NO: 3048966 - RNA, 16 nt, Human
caggguuggccccugc

SEQ ID NO: 3048967 - RNA, 15 nt, Human
caggguuggccccug

SEQ ID NO: 3048968 - RNA, 14 nt, Human
caggguggccacac

SEQ ID NO: 3048969 - RNA, 14 nt, Human
caggcugggcuuca

SEQ ID NO: 3048970 - RNA, 15 nt, Human
caggcugggagagcc

SEQ ID NO: 3048971 - RNA, 22 nt, Human
cagggaggacgcucucuggccu

SEQ ID NO: 3048972 - RNA, 19 nt, Human
cagggaggacgcucucugg

SEQ ID NO: 3048973 - RNA, 16 nt, Human
cagggagggcuucugc

SEQ ID NO: 3048974 - RNA, 15 nt, Human
cagggcucagcgggg

SEQ ID NO: 3048975 - RNA, 12 nt, Human
cagggcucagcg

SEQ ID NO: 3048976 - RNA, 20 nt, Human
caggccugggggcugggcag

SEQ ID NO: 3048977 - RNA, 22 nt, Human
caggccugggggcugggcagag

SEQ ID NO: 3048978 - RNA, 19 nt, Human
caggcuggcgugcaguggu

SEQ ID NO: 3048979 - RNA, 18 nt, Human
caggcuggcgugcagugg

SEQ ID NO: 3048980 - RNA, 23 nt, Human
caggccugggggcugggcagagg

SEQ ID NO: 3048981 - RNA, 17 nt, Human
caggcuggcgugcagug

SEQ ID NO: 3048982 - RNA, 16 nt, Human
caggcugggagagccu

SEQ ID NO: 3048983 - RNA, 18 nt, Human
caggcugggagagccuuc

SEQ ID NO: 3048984 - RNA, 19 nt, Human
caggcugggagagccuucc

SEQ ID NO: 3048985 - RNA, 15 nt, Human
caggcuggcgugcag

SEQ ID NO: 3048986 - RNA, 16 nt, Human
cagcuguucagcuggu

SEQ ID NO: 3048987 - RNA, 15 nt, Human
cagcuguucagcugg

SEQ ID NO: 3048988 - RNA, 16 nt, Human
cagcuuauucacaaga

SEQ ID NO: 3048989 - RNA, 20 nt, Human
caggaaaagcugcugacagu

SEQ ID NO: 3048990 - RNA, 19 nt, Human
caggaaaagcugcugacag

SEQ ID NO: 3048991 - RNA, 21 nt, Human
caggaaaggcuccaggagcag

SEQ ID NO: 3048992 - RNA, 22 nt, Human
caggaaaggcuccaggagcagc

SEQ ID NO: 3048993 - RNA, 23 nt, Human
caggaaaggcuccaggagcagcc

SEQ ID NO: 3048994 - RNA, 19 nt, Human
caggaaaucaaauaugcaa

SEQ ID NO: 3048995 - RNA, 21 nt, Human
caggaaaucaaauaugcaaag

SEQ ID NO: 3048996 - RNA, 13 nt, Human
caggccagcugcu

SEQ ID NO: 3048997 - RNA, 15 nt, Human
caggccagcugcuug

SEQ ID NO: 3048998 - RNA, 12 nt, Human
caggaggccagc

SEQ ID NO: 3048999 - RNA, 13 nt, Human
caggaggccagcc

SEQ ID NO: 3049000 - RNA, 20 nt, Human
caggcaaugcuggcuguugg

SEQ ID NO: 3049001 - RNA, 19 nt, Human
caggcaaugcuggcuguug

SEQ ID NO: 3049002 - RNA, 21 nt, Human
caggcaaugcuggcuguuggc

SEQ ID NO: 3049003 - RNA, 17 nt, Human
caggcaaugcuggcugu

SEQ ID NO: 3049004 - RNA, 13 nt, Human
caggccaggcccu

SEQ ID NO: 3049005 - RNA, 14 nt, Human
caggccaggcccuc

SEQ ID NO: 3049006 - RNA, 15 nt, Human
caggccaggcccucu

SEQ ID NO: 3049007 - RNA, 16 nt, Human
caggccaggcccucug

SEQ ID NO: 3049008 - RNA, 13 nt, Human
caggaccagggau

SEQ ID NO: 3049009 - RNA, 13 nt, Human
caggaccucaggu

SEQ ID NO: 3049010 - RNA, 23 nt, Human
caggacagcccuucuuuccacag

SEQ ID NO: 3049011 - RNA, 24 nt, Human
caggacagcccuucuuuccacaga

SEQ ID NO: 3049012 - RNA, 16 nt, Human
cagaucauugugaaau

SEQ ID NO: 3049013 - RNA, 22 nt, Human
cagaucauugugaaauuauuca

SEQ ID NO: 3049014 - RNA, 23 nt, Human
cagauacaggaaaagcugcugac

SEQ ID NO: 3049015 - RNA, 17 nt, Human
cagagcuacacagggga

SEQ ID NO: 3049016 - RNA, 22 nt, Human
cagagcuacacaggggaaaaga

SEQ ID NO: 3049017 - RNA, 16 nt, Human
cagagagggugggagu

SEQ ID NO: 3049018 - RNA, 13 nt, Human
cagagaggguggg

SEQ ID NO: 3049019 - RNA, 20 nt, Human
cagagagggugggagugggc

SEQ ID NO: 3049020 - RNA, 22 nt, Human
cagagagggugggagugggccc

SEQ ID NO: 3049021 - RNA, 14 nt, Human
cagagccugcaguu

SEQ ID NO: 3049022 - RNA, 21 nt, Human
cagagacuccugcaggcagcc

SEQ ID NO: 3049023 - RNA, 22 nt, Human
cagagacuccugcaggcagcca

SEQ ID NO: 3049024 - RNA, 20 nt, Human
cagagacuccugcaggcagc

SEQ ID NO: 3049025 - RNA, 14 nt, Human
cagcguuucuauga

SEQ ID NO: 3049026 - RNA, 16 nt, Human
cagcguuucuaugaca

SEQ ID NO: 3049027 - RNA, 13 nt, Human
cagcccuuagcag

SEQ ID NO: 3049028 - RNA, 23 nt, Human
cagccgccaugcuccuggcccac

SEQ ID NO: 3049029 - RNA, 22 nt, Human
cagccugagcgacagugagacu

SEQ ID NO: 3049030 - RNA, 23 nt, Human
cagccugagcgacagugagacuc

SEQ ID NO: 3049031 - RNA, 19 nt, Human
cagccccgugggguuccuc

SEQ ID NO: 3049032 - RNA, 22 nt, Human
cagccccauucugccugcccag

SEQ ID NO: 3049033 - RNA, 20 nt, Human
cagccccauucugccugccc

SEQ ID NO: 3049034 - RNA, 19 nt, Human
cagccccauucugccugcc

SEQ ID NO: 3049035 - RNA, 24 nt, Human
cagccccauucugccugcccaggc

SEQ ID NO: 3049036 - RNA, 23 nt, Human
cagccccauucugccugcccagg

SEQ ID NO: 3049037 - RNA, 17 nt, Human
cagcauagaaguaacuu

SEQ ID NO: 3049038 - RNA, 16 nt, Human
cagcauauucaggaag

SEQ ID NO: 3049039 - RNA, 17 nt, Human
cagcauauucaggaagc

SEQ ID NO: 3049040 - RNA, 18 nt, Human
cagcauauucaggaagcu

SEQ ID NO: 3049041 - RNA, 20 nt, Human
cagccagacuggcacaguuu

SEQ ID NO: 3049042 - RNA, 22 nt, Human
cagcacagccucuuagaugcag

SEQ ID NO: 3049043 - RNA, 15 nt, Human
cagauuucacucucc

SEQ ID NO: 3049044 - RNA, 16 nt, Human
cagauuucacucuccu

SEQ ID NO: 3049045 - RNA, 19 nt, Human
cagauuugaacucuucaau

SEQ ID NO: 3049046 - RNA, 18 nt, Human
cagauuucacucuccuug

SEQ ID NO: 3049047 - RNA, 13 nt, Human
cagauuucacucu

SEQ ID NO: 3049048 - RNA, 21 nt, Human
cagauugcaacaggcugggcu

SEQ ID NO: 3049049 - RNA, 15 nt, Human
caauucuugccaaau

SEQ ID NO: 3049050 - RNA, 12 nt, Human
caauggcagccu

SEQ ID NO: 3049051 - RNA, 11 nt, Human
caauggcagcc

SEQ ID NO: 3049052 - RNA, 16 nt, Human
caaugcuguauuuuaa

SEQ ID NO: 3049053 - RNA, 17 nt, Human
caaugcuguauuuuaaa

SEQ ID NO: 3049054 - RNA, 15 nt, Human
caaugcuguauuuua

SEQ ID NO: 3049055 - RNA, 17 nt, Human
cacaagcugcacccuca

SEQ ID NO: 3049056 - RNA, 23 nt, Human
cacaagcugcacccucaggcagg

SEQ ID NO: 3049057 - RNA, 17 nt, Human
cacaagcuccaagcucc

SEQ ID NO: 3049058 - RNA, 23 nt, Human
cacaagcuccaagcucccaggca

SEQ ID NO: 3049059 - RNA, 21 nt, Human
cacaagcuccaagcucccagg

SEQ ID NO: 3049060 - RNA, 16 nt, Human
cacaagagcccaggcc

SEQ ID NO: 3049061 - RNA, 13 nt, Human
cacaagcuccaag

SEQ ID NO: 3049062 - RNA, 14 nt, Human
cacaagcuccaagc

SEQ ID NO: 3049063 - RNA, 15 nt, Human
cacaagcuccaagcu

SEQ ID NO: 3049064 - RNA, 14 nt, Human
cacaagagcccagg

SEQ ID NO: 3049065 - RNA, 18 nt, Human
cacaagacugcacaucaa

SEQ ID NO: 3049066 - RNA, 20 nt, Human
cacacagcucuguccuggga

SEQ ID NO: 3049067 - RNA, 17 nt, Human
cacacagcucuguccug

SEQ ID NO: 3049068 - RNA, 18 nt, Human
cacagacauacuaaccag

SEQ ID NO: 3049069 - RNA, 23 nt, Human
cacagaaaauggaagacagcucu

SEQ ID NO: 3049070 - RNA, 19 nt, Human
cacagaaaauucuucucca

SEQ ID NO: 3049071 - RNA, 21 nt, Human
cacagacauacuaaccagcag

SEQ ID NO: 3049072 - RNA, 19 nt, Human
cacagacauacuaaccagc

SEQ ID NO: 3049073 - RNA, 13 nt, Human
cacagacccugcc

SEQ ID NO: 3049074 - RNA, 11 nt, Human
cacagccucug

SEQ ID NO: 3049075 - RNA, 21 nt, Human
cacacaugagcaucaggccag

SEQ ID NO: 3049076 - RNA, 22 nt, Human
cacacaugagcaucaggccagg

SEQ ID NO: 3049077 - RNA, 18 nt, Human
cacagaaaauggaagaca

SEQ ID NO: 3049078 - RNA, 19 nt, Human
cacagaaaauggaagacag

SEQ ID NO: 3049079 - RNA, 20 nt, Human
cacagaaaauggaagacagc

SEQ ID NO: 3049080 - RNA, 22 nt, Human
cacagaaaauggaagacagcuc

SEQ ID NO: 3049081 - RNA, 16 nt, Human
cacacagcucuguccu

SEQ ID NO: 3049082 - RNA, 23 nt, Human
cacacaguauuacuucugcuaca

SEQ ID NO: 3049083 - RNA, 20 nt, Human
cacacaguauuacuucugcu

SEQ ID NO: 3049084 - RNA, 18 nt, Human
cacacagugagucgagga

SEQ ID NO: 3049085 - RNA, 20 nt, Human
cacacaugagcaucaggcca

SEQ ID NO: 3049086 - RNA, 22 nt, Human
cacacaugaaguccaagcauuu

SEQ ID NO: 3049087 - RNA, 17 nt, Human
cacacaugaaguccaag

SEQ ID NO: 3049088 - RNA, 23 nt, Human
cacacagugagucgaggacaggg

SEQ ID NO: 3049089 - RNA, 21 nt, Human
cacacagugagucgaggacag

SEQ ID NO: 3049090 - RNA, 15 nt, Human
cacacauacacacac

SEQ ID NO: 3049091 - RNA, 17 nt, Human
cacaggggaaaagagga

SEQ ID NO: 3049092 - RNA, 18 nt, Human
cacaggggaaaagaggag

SEQ ID NO: 3049093 - RNA, 19 nt, Human
cacaggggaaaagaggagu

SEQ ID NO: 3049094 - RNA, 21 nt, Human
cacagccucuuagaugcaguu

SEQ ID NO: 3049095 - RNA, 17 nt, Human
cacagccucuuagaugc

SEQ ID NO: 3049096 - RNA, 22 nt, Human
cacagcgcuggccgggaccccg

SEQ ID NO: 3049097 - RNA, 19 nt, Human
cacagcgcuggccgggacc

SEQ ID NO: 3049098 - RNA, 19 nt, Human
cacaguauuacuucugcua

SEQ ID NO: 3049099 - RNA, 21 nt, Human
cacaguauuacuucugcuaca

SEQ ID NO: 3049100 - RNA, 20 nt, Human
cacaguauuacuucugcuac

SEQ ID NO: 3049101 - RNA, 18 nt, Human
caagcgugagccacugca

SEQ ID NO: 3049102 - RNA, 13 nt, Human
caagucaagugaa

SEQ ID NO: 3049103 - RNA, 17 nt, Human
caagucaagugaaaaag

SEQ ID NO: 3049104 - RNA, 14 nt, Human
caaguccaagcaua

SEQ ID NO: 3049105 - RNA, 15 nt, Human
caaggccaaaggaag

SEQ ID NO: 3049106 - RNA, 16 nt, Human
caaggccaaaggaagc

SEQ ID NO: 3049107 - RNA, 17 nt, Human
caaggccaaaggaagca

SEQ ID NO: 3049108 - RNA, 18 nt, Human
caaggccaaaggaagcac

SEQ ID NO: 3049109 - RNA, 14 nt, Human
caagcugcacccuc

SEQ ID NO: 3049110 - RNA, 18 nt, Human
caagcugcacccucaggc

SEQ ID NO: 3049111 - RNA, 13 nt, Human
caagcugcacccu

SEQ ID NO: 3049112 - RNA, 14 nt, Human
caagcucugcuccu

SEQ ID NO: 3049113 - RNA, 12 nt, Human
caagcuccaagc

SEQ ID NO: 3049114 - RNA, 13 nt, Human
caagcucugcucc

SEQ ID NO: 3049115 - RNA, 19 nt, Human
caauaaagcagcguuucua

SEQ ID NO: 3049116 - RNA, 11 nt, Human
cacugacagau

SEQ ID NO: 3049117 - RNA, 14 nt, Human
cacuccccugcugg

SEQ ID NO: 3049118 - RNA, 12 nt, Human
cacuccccugcu

SEQ ID NO: 3049119 - RNA, 13 nt, Human
cacuccccugcug

SEQ ID NO: 3049120 - RNA, 16 nt, Human
cacuccagccugggug

SEQ ID NO: 3049121 - RNA, 21 nt, Human
cacuagggcagggacaggaua

SEQ ID NO: 3049122 - RNA, 20 nt, Human
cacuagggcagggacaggau

SEQ ID NO: 3049123 - RNA, 16 nt, Human
cacugcauguuuguga

SEQ ID NO: 3049124 - RNA, 13 nt, Human
cacugcagccuca

SEQ ID NO: 3049125 - RNA, 18 nt, Human
cacugggagaaaugaaaa

SEQ ID NO: 3049126 - RNA, 12 nt, Human
cacugcagccuc

SEQ ID NO: 3049127 - RNA, 21 nt, Human
cacugcagaagacaguauggc

SEQ ID NO: 3049128 - RNA, 20 nt, Human
cacugcacuccagccugggu

SEQ ID NO: 3049129 - RNA, 19 nt, Human
cacugcacuccagccuggg

SEQ ID NO: 3049130 - RNA, 18 nt, Human
cacugcacuccagccugg

SEQ ID NO: 3049131 - RNA, 15 nt, Human
cacugcacuccagcc

SEQ ID NO: 3049132 - RNA, 16 nt, Human
cacugcacuccagccu

SEQ ID NO: 3049133 - RNA, 19 nt, Human
cacugcacuauagccuagg

SEQ ID NO: 3049134 - RNA, 18 nt, Human
cacuuacacuuuaugcac

SEQ ID NO: 3049135 - RNA, 16 nt, Human
cacuuacacuuuaugc

SEQ ID NO: 3049136 - RNA, 22 nt, Human
cacugguucuucuuggucucag

SEQ ID NO: 3049137 - RNA, 16 nt, Human
cacuugucaauaaaau

SEQ ID NO: 3049138 - RNA, 19 nt, Human
cacuuguguuuugcaagcc

SEQ ID NO: 3049139 - RNA, 17 nt, Human
cacuuguguuuugcaag

SEQ ID NO: 3049140 - RNA, 22 nt, Human
cacuuguguuuugcaagccaga

SEQ ID NO: 3049141 - RNA, 11 nt, Human
caccccagccc

SEQ ID NO: 3049142 - RNA, 14 nt, Human
cacccucaggcagg

SEQ ID NO: 3049143 - RNA, 16 nt, Human
cacccuggggagaaag

SEQ ID NO: 3049144 - RNA, 15 nt, Human
cacccuggggagaaa

SEQ ID NO: 3049145 - RNA, 17 nt, Human
cacccugaaagcccuga

SEQ ID NO: 3049146 - RNA, 15 nt, Human
caccugccccucaac

SEQ ID NO: 3049147 - RNA, 16 nt, Human
caccugccccucaacu

SEQ ID NO: 3049148 - RNA, 14 nt, Human
caccugccccucaa

SEQ ID NO: 3049149 - RNA, 13 nt, Human
caccucagccucc

SEQ ID NO: 3049150 - RNA, 12 nt, Human
caccucagccuc

SEQ ID NO: 3049151 - RNA, 14 nt, Human
caccucagccuccc

SEQ ID NO: 3049152 - RNA, 13 nt, Human
caccuuggcugca

SEQ ID NO: 3049153 - RNA, 15 nt, Human
caccuuggcucaagu

SEQ ID NO: 3049154 - RNA, 14 nt, Human
caccuuggcucaag

SEQ ID NO: 3049155 - RNA, 14 nt, Human
caccuuggcugcag

SEQ ID NO: 3049156 - RNA, 19 nt, Human
caccugccuguugggccag

SEQ ID NO: 3049157 - RNA, 24 nt, Human
caccugccuguugggccaggagcc

SEQ ID NO: 3049158 - RNA, 17 nt, Human
caccugccuguugggcc

SEQ ID NO: 3049159 - RNA, 23 nt, Human
auuuguuugaacugauaaagaug

SEQ ID NO: 3049160 - RNA, 22 nt, Human
auuuguuugaacugauaaagau

SEQ ID NO: 3049161 - RNA, 17 nt, Human
auuuuauagcuacuaau

SEQ ID NO: 3049162 - RNA, 19 nt, Human
auuuuauagcuacuaauuu

SEQ ID NO: 3049163 - RNA, 20 nt, Human
auuuguuugaacugauaaag

SEQ ID NO: 3049164 - RNA, 20 nt, Human
auuugugauacaaugcugug

SEQ ID NO: 3049165 - RNA, 17 nt, Human
auuugugauacaaugcu

SEQ ID NO: 3049166 - RNA, 15 nt, Human
auuugugauacaaug

SEQ ID NO: 3049167 - RNA, 13 nt, Human
auuugcuccuuuc

SEQ ID NO: 3049168 - RNA, 14 nt, Human
auuugcucauggaa

SEQ ID NO: 3049169 - RNA, 17 nt, Human
auuugcucauggaauug

SEQ ID NO: 3049170 - RNA, 14 nt, Human
caacacuaacauga

SEQ ID NO: 3049171 - RNA, 23 nt, Human
caacacgagcaggcuacugucag

SEQ ID NO: 3049172 - RNA, 15 nt, Human
caacacgagcaggcu

SEQ ID NO: 3049173 - RNA, 21 nt, Human
caaauggaaaugggcagagca

SEQ ID NO: 3049174 - RNA, 20 nt, Human
caaauggaaaugggcagagc

SEQ ID NO: 3049175 - RNA, 21 nt, Human
caaagucucuggaauuugaaa

SEQ ID NO: 3049176 - RNA, 21 nt, Human
caaaguagaagucuuagaugu

SEQ ID NO: 3049177 - RNA, 14 nt, Human
caaaguagaagucu

SEQ ID NO: 3049178 - RNA, 22 nt, Human
caaagguaaaucagacuaugaa

SEQ ID NO: 3049179 - RNA, 15 nt, Human
caaagcagugcaugc

SEQ ID NO: 3049180 - RNA, 17 nt, Human
caaagcagugcaugcug

SEQ ID NO: 3049181 - RNA, 22 nt, Human
caaaguacacuguuucaaacuu

SEQ ID NO: 3049182 - RNA, 23 nt, Human
caaagauauuuugcuuugugauu

SEQ ID NO: 3049183 - RNA, 22 nt, Human
caaagauauuuugcuuugugau

SEQ ID NO: 3049184 - RNA, 14 nt, Human
caaagaugcagccg

SEQ ID NO: 3049185 - RNA, 22 nt, Human
caaagcacugacuucuaaguaa

SEQ ID NO: 3049186 - RNA, 20 nt, Human
caaagcacugacuucuaagu

SEQ ID NO: 3049187 - RNA, 12 nt, Human
caaacagggccu

SEQ ID NO: 3049188 - RNA, 14 nt, Human
caaacagggccucu

SEQ ID NO: 3049189 - RNA, 15 nt, Human
caaacagaggccgcc

SEQ ID NO: 3049190 - RNA, 21 nt, Human
caaaccaucauugaaaucuuu

SEQ ID NO: 3049191 - RNA, 19 nt, Human
caaaccaucauugaaaucu

SEQ ID NO: 3049192 - RNA, 13 nt, Human
caaacccaguguu

SEQ ID NO: 3049193 - RNA, 15 nt, Human
caaacagggccucug

SEQ ID NO: 3049194 - RNA, 19 nt, Human
caaacagggccucugcgga

SEQ ID NO: 3049195 - RNA, 16 nt, Human
caaaagaugcuucuca

SEQ ID NO: 3049196 - RNA, 20 nt, Human
caaaaaaaaaaaaaaauuag

SEQ ID NO: 3049197 - RNA, 18 nt, Human
caaaagaugcuucucacu

SEQ ID NO: 3049198 - RNA, 15 nt, Human
caaaaggcagaagca

SEQ ID NO: 3049199 - RNA, 23 nt, Human
auuuuuuuuuccuucagugccuu

SEQ ID NO: 3049200 - RNA, 20 nt, Human
caaagauauuuugcuuugug

SEQ ID NO: 3049201 - RNA, 18 nt, Human
caaagauauuuugcuuug

SEQ ID NO: 3049202 - RNA, 21 nt, Human
auucauaauuauuauuuggcc

SEQ ID NO: 3049203 - RNA, 19 nt, Human
auucauaaugacuuaagca

SEQ ID NO: 3049204 - RNA, 19 nt, Human
auucauagcagcuuauuca

SEQ ID NO: 3049205 - RNA, 22 nt, Human
auucauagcagcuuauucacaa

SEQ ID NO: 3049206 - RNA, 14 nt, Human
auucauaaugacuu

SEQ ID NO: 3049207 - RNA, 15 nt, Human
auucauaaugacuua

SEQ ID NO: 3049208 - RNA, 23 nt, Human
auuaugcaugaaguaauaugcac

SEQ ID NO: 3049209 - RNA, 18 nt, Human
auuaugaauuacauuugu

SEQ ID NO: 3049210 - RNA, 22 nt, Human
auuaugaauuacauuuguauaa

SEQ ID NO: 3049211 - RNA, 18 nt, Human
auucaaugccccugaauu

SEQ ID NO: 3049212 - RNA, 20 nt, Human
auucaaugccccugaauuua

SEQ ID NO: 3049213 - RNA, 16 nt, Human
auucaaauguauuaca

SEQ ID NO: 3049214 - RNA, 19 nt, Human
auucacaagacccaaaagg

SEQ ID NO: 3049215 - RNA, 18 nt, Human
auuaggugugacugaauu

SEQ ID NO: 3049216 - RNA, 16 nt, Human
auuaggugugacugaa

SEQ ID NO: 3049217 - RNA, 16 nt, Human
auuagggagagaagau

SEQ ID NO: 3049218 - RNA, 21 nt, Human
auuaggugugacugaauuucu

SEQ ID NO: 3049219 - RNA, 14 nt, Human
auuaugaauuacau

SEQ ID NO: 3049220 - RNA, 17 nt, Human
auuaugaauuacauuug

SEQ ID NO: 3049221 - RNA, 18 nt, Human
auuaugaaacuuuuggaa

SEQ ID NO: 3049222 - RNA, 16 nt, Human
auuacaggugugaacc

SEQ ID NO: 3049223 - RNA, 17 nt, Human
auuacaggaaguacugg

SEQ ID NO: 3049224 - RNA, 19 nt, Human
auuacaguggggaaugaag

SEQ ID NO: 3049225 - RNA, 14 nt, Human
auuguaaauaguau

SEQ ID NO: 3049226 - RNA, 23 nt, Human
auuguaauaggcguaacuaauuu

SEQ ID NO: 3049227 - RNA, 13 nt, Human
auuguaaaauggu

SEQ ID NO: 3049228 - RNA, 14 nt, Human
auuguaaaauggug

SEQ ID NO: 3049229 - RNA, 21 nt, Human
auugugucucuugguccugcu

SEQ ID NO: 3049230 - RNA, 23 nt, Human
auugugucucuugguccugcugc

SEQ ID NO: 3049231 - RNA, 16 nt, Human
auuguuagucucuuga

SEQ ID NO: 3049232 - RNA, 15 nt, Human
auugcugauggugca

SEQ ID NO: 3049233 - RNA, 16 nt, Human
auugcugauggugcaa

SEQ ID NO: 3049234 - RNA, 18 nt, Human
auugcugauggugcaaug

SEQ ID NO: 3049235 - RNA, 19 nt, Human
auugcugauggugcaauga

SEQ ID NO: 3049236 - RNA, 14 nt, Human
auugcuugagcuca

SEQ ID NO: 3049237 - RNA, 23 nt, Human
auugcugauggugcaaugaccuu

SEQ ID NO: 3049238 - RNA, 12 nt, Human
auugcugcuuga

SEQ ID NO: 3049239 - RNA, 22 nt, Human
auugauaaguucauacauugua

SEQ ID NO: 3049240 - RNA, 21 nt, Human
auugauaaguucauacauugu

SEQ ID NO: 3049241 - RNA, 21 nt, Human
auugauaagaaccuuuugagu

SEQ ID NO: 3049242 - RNA, 22 nt, Human
auugcuacuguccuacccaccc

SEQ ID NO: 3049243 - RNA, 20 nt, Human
auugcuacuguccuacccac

SEQ ID NO: 3049244 - RNA, 17 nt, Human
auugauaugcuuauaca

SEQ ID NO: 3049245 - RNA, 15 nt, Human
auugcuacuguccua

SEQ ID NO: 3049246 - RNA, 14 nt, Human
auugcuacuguccu

SEQ ID NO: 3049247 - RNA, 18 nt, Human
auucuugaaggaaaauga

SEQ ID NO: 3049248 - RNA, 15 nt, Human
auucuugaaggaaaa

SEQ ID NO: 3049249 - RNA, 11 nt, Human
auucuuuccug

SEQ ID NO: 3049250 - RNA, 12 nt, Human
auucuucugcuu

SEQ ID NO: 3049251 - RNA, 11 nt, Human
auucuucugcu

SEQ ID NO: 3049252 - RNA, 20 nt, Human
gccuccuuugugaggaagcc

SEQ ID NO: 3049253 - RNA, 21 nt, Human
gccuccuuugugaggaagccg

SEQ ID NO: 3049254 - RNA, 19 nt, Human
gccuccuuugugaggaagc

SEQ ID NO: 3049255 - RNA, 15 nt, Human
gccuccauccugagg

SEQ ID NO: 3049256 - RNA, 16 nt, Human
gccuccauccugaggc

SEQ ID NO: 3049257 - RNA, 20 nt, Human
gccuccauccugaggcucca

SEQ ID NO: 3049258 - RNA, 13 nt, Human
gccugcuccagcu

SEQ ID NO: 3049259 - RNA, 23 nt, Human
gccugcuaauuccccagauugca

SEQ ID NO: 3049260 - RNA, 17 nt, Human
gccugcuaauuccccag

SEQ ID NO: 3049261 - RNA, 14 nt, Human
gcgauucuucugcu

SEQ ID NO: 3049262 - RNA, 13 nt, Human
gcgauucuucugc

SEQ ID NO: 3049263 - RNA, 24 nt, Human
gcgagccauuugucccaagugcca

SEQ ID NO: 3049264 - RNA, 20 nt, Human
gcgagccauuugucccaagu

SEQ ID NO: 3049265 - RNA, 17 nt, Human
gcggagcacacuggcuc

SEQ ID NO: 3049266 - RNA, 20 nt, Human
gcgugguggacaugcacagc

SEQ ID NO: 3049267 - RNA, 18 nt, Human
gcgugcacacaccagagc

SEQ ID NO: 3049268 - RNA, 14 nt, Human
gcgugcacacacca

SEQ ID NO: 3049269 - RNA, 19 nt, Human
gcuacuguaaggcaaucau

SEQ ID NO: 3049270 - RNA, 18 nt, Human
gcuacuguaaggcaauca

SEQ ID NO: 3049271 - RNA, 15 nt, Human
gcuacugucagcucc

SEQ ID NO: 3049272 - RNA, 20 nt, Human
gcuacuguccuacccacccu

SEQ ID NO: 3049273 - RNA, 19 nt, Human
gcuacuguccuacccaccc

SEQ ID NO: 3049274 - RNA, 17 nt, Human
gcuacuugggaggcuga

SEQ ID NO: 3049275 - RNA, 18 nt, Human
gcuaauuuugaaaaacug

SEQ ID NO: 3049276 - RNA, 16 nt, Human
gcuaauuuuucauuuu

SEQ ID NO: 3049277 - RNA, 17 nt, Human
gcguuucuaugacacau

SEQ ID NO: 3049278 - RNA, 17 nt, Human
gcuacugccauccuggc

SEQ ID NO: 3049279 - RNA, 13 nt, Human
gcuacugccaucc

SEQ ID NO: 3049280 - RNA, 21 nt, Human
gcuacugccauccuggcccag

SEQ ID NO: 3049281 - RNA, 18 nt, Human
gcuacugccauccuggcc

SEQ ID NO: 3049282 - RNA, 20 nt, Human
gcuacugccauccuggccca

SEQ ID NO: 3049283 - RNA, 17 nt, Human
gcuacaaaaacacagca

SEQ ID NO: 3049284 - RNA, 19 nt, Human
gcuacaaaaacacagcaag

SEQ ID NO: 3049285 - RNA, 18 nt, Human
gcuacaaaaacacagcaa

SEQ ID NO: 3049286 - RNA, 17 nt, Human
gcccaggccccugccac

SEQ ID NO: 3049287 - RNA, 14 nt, Human
gccaugugccaggu

SEQ ID NO: 3049288 - RNA, 22 nt, Human
gccaugugcuaguaauuggaaa

SEQ ID NO: 3049289 - RNA, 13 nt, Human
gcccaggccccug

SEQ ID NO: 3049290 - RNA, 15 nt, Human
gcccaggccccugcc

SEQ ID NO: 3049291 - RNA, 14 nt, Human
gcccaggcaggucu

SEQ ID NO: 3049292 - RNA, 12 nt, Human
gcccaggcaggu

SEQ ID NO: 3049293 - RNA, 13 nt, Human
gcccaggcagguc

SEQ ID NO: 3049294 - RNA, 15 nt, Human
gccccuggaugcagc

SEQ ID NO: 3049295 - RNA, 16 nt, Human
gccccugccucucugc

SEQ ID NO: 3049296 - RNA, 15 nt, Human
gccccugccucucug

SEQ ID NO: 3049297 - RNA, 15 nt, Human
gccccugcccggcug

SEQ ID NO: 3049298 - RNA, 18 nt, Human
gccccugccucucugcag

SEQ ID NO: 3049299 - RNA, 17 nt, Human
gccccugccucucugca

SEQ ID NO: 3049300 - RNA, 22 nt, Human
gccccugcugguucaggguugg

SEQ ID NO: 3049301 - RNA, 21 nt, Human
gccccugcugguucaggguug

SEQ ID NO: 3049302 - RNA, 18 nt, Human
gccccacccucagaugca

SEQ ID NO: 3049303 - RNA, 15 nt, Human
gccccacccucagau

SEQ ID NO: 3049304 - RNA, 13 nt, Human
gccagugugacaa

SEQ ID NO: 3049305 - RNA, 13 nt, Human
gccaguugguccc

SEQ ID NO: 3049306 - RNA, 22 nt, Human
gccaguuauggcuauaggugcu

SEQ ID NO: 3049307 - RNA, 16 nt, Human
gccaguuggucccccu

SEQ ID NO: 3049308 - RNA, 18 nt, Human
gccaguuggucccccuuc

SEQ ID NO: 3049309 - RNA, 20 nt, Human
gccaguuggucccccuucca

SEQ ID NO: 3049310 - RNA, 21 nt, Human
gccaguuggucccccuuccau

SEQ ID NO: 3049311 - RNA, 22 nt, Human
gccaguuggucccccuuccaug

SEQ ID NO: 3049312 - RNA, 23 nt, Human
gccaguuggucccccuuccaugg

SEQ ID NO: 3049313 - RNA, 13 nt, Human
gccaggcccucug

SEQ ID NO: 3049314 - RNA, 14 nt, Human
gccaggcccucugc

SEQ ID NO: 3049315 - RNA, 21 nt, Human
gccaggccacaagacccuugu

SEQ ID NO: 3049316 - RNA, 15 nt, Human
gccaggccagaggga

SEQ ID NO: 3049317 - RNA, 22 nt, Human
gccaggccagagggagugacag

SEQ ID NO: 3049318 - RNA, 13 nt, Human
gccaggccacaag

SEQ ID NO: 3049319 - RNA, 18 nt, Human
gccaggccacaagacccu

SEQ ID NO: 3049320 - RNA, 23 nt, Human
gccagcaggcucucaggccagcu

SEQ ID NO: 3049321 - RNA, 16 nt, Human
gcucuggagcccacug

SEQ ID NO: 3049322 - RNA, 15 nt, Human
gcucuggagcccacu

SEQ ID NO: 3049323 - RNA, 21 nt, Human
gcucugcccauccugccccug

SEQ ID NO: 3049324 - RNA, 22 nt, Human
gcucugaucauccacugugcca

SEQ ID NO: 3049325 - RNA, 21 nt, Human
gcucugaucauccacugugcc

SEQ ID NO: 3049326 - RNA, 15 nt, Human
gcucugcccauccug

SEQ ID NO: 3049327 - RNA, 20 nt, Human
gcucugaucauccacugugc

SEQ ID NO: 3049328 - RNA, 17 nt, Human
gcucuggagcccacugu

SEQ ID NO: 3049329 - RNA, 23 nt, Human
gcucugguccauagagagcaaga

SEQ ID NO: 3049330 - RNA, 12 nt, Human
gcugaacaucac

SEQ ID NO: 3049331 - RNA, 16 nt, Human
gcugaaacaacaaaua

SEQ ID NO: 3049332 - RNA, 20 nt, Human
gcucuguggcgagccauuug

SEQ ID NO: 3049333 - RNA, 13 nt, Human
gcugacagacaca

SEQ ID NO: 3049334 - RNA, 23 nt, Human
gcugaaggcucgagcaugccugg

SEQ ID NO: 3049335 - RNA, 17 nt, Human
gcugaauacagaggcaa

SEQ ID NO: 3049336 - RNA, 15 nt, Human
gcuccucuccccagc

SEQ ID NO: 3049337 - RNA, 23 nt, Human
gcucccaggcauuccccaggagg

SEQ ID NO: 3049338 - RNA, 14 nt, Human
gcuccagcucacca

SEQ ID NO: 3049339 - RNA, 13 nt, Human
gcuccagcucacc

SEQ ID NO: 3049340 - RNA, 18 nt, Human
gcuccagacacaugucca

SEQ ID NO: 3049341 - RNA, 21 nt, Human
gcuccagacacauguccaaga

SEQ ID NO: 3049342 - RNA, 23 nt, Human
gcuccagacacauguccaagaag

SEQ ID NO: 3049343 - RNA, 19 nt, Human
gcuccacuuggucugugag

SEQ ID NO: 3049344 - RNA, 9 nt, Human
gcuccagac

SEQ ID NO: 3049345 - RNA, 20 nt, Human
gcuccacuuggucugugaga

SEQ ID NO: 3049346 - RNA, 18 nt, Human
gcucucaaguuaucaggg

SEQ ID NO: 3049347 - RNA, 19 nt, Human
gcuccucuccccagcaagu

SEQ ID NO: 3049348 - RNA, 16 nt, Human
gcuccucuccccagca

SEQ ID NO: 3049349 - RNA, 19 nt, Human
gcucuacugaggugcuaug

SEQ ID NO: 3049350 - RNA, 17 nt, Human
gcucucaggccagcugc

SEQ ID NO: 3049351 - RNA, 18 nt, Human
gcucucaggccagcugcu

SEQ ID NO: 3049352 - RNA, 19 nt, Human
gcucucaggccagcugcuu

SEQ ID NO: 3049353 - RNA, 16 nt, Human
gcugccccugcacagc

SEQ ID NO: 3049354 - RNA, 11 nt, Human
gcugcucccac

SEQ ID NO: 3049355 - RNA, 15 nt, Human
gcugcucccaccugg

SEQ ID NO: 3049356 - RNA, 20 nt, Human
gcugccccugcacagcaggc

SEQ ID NO: 3049357 - RNA, 24 nt, Human
gcugcucccaccuggcucuguggc

SEQ ID NO: 3049358 - RNA, 20 nt, Human
gcugcucccaccuggcucug

SEQ ID NO: 3049359 - RNA, 22 nt, Human
gcugcucccaccuggcucugug

SEQ ID NO: 3049360 - RNA, 15 nt, Human
gcugccccuggcagc

SEQ ID NO: 3049361 - RNA, 16 nt, Human
gcugccccuggcagcc

SEQ ID NO: 3049362 - RNA, 13 nt, Human
gcugccccuggca

SEQ ID NO: 3049363 - RNA, 17 nt, Human
gcugccauccagguuca

SEQ ID NO: 3049364 - RNA, 12 nt, Human
gcugcugacagu

SEQ ID NO: 3049365 - RNA, 18 nt, Human
gcugcugaaggcucgagc

SEQ ID NO: 3049366 - RNA, 20 nt, Human
gcugcugagauccuggacug

SEQ ID NO: 3049367 - RNA, 18 nt, Human
gcugcugagauccuggac

SEQ ID NO: 3049368 - RNA, 15 nt, Human
gcugaggugggagga

SEQ ID NO: 3049369 - RNA, 13 nt, Human
gcugcacccucag

SEQ ID NO: 3049370 - RNA, 15 nt, Human
gcugcacccucaggc

SEQ ID NO: 3049371 - RNA, 13 nt, Human
gcugccauccagg

SEQ ID NO: 3049372 - RNA, 12 nt, Human
gcugccauccag

SEQ ID NO: 3049373 - RNA, 13 nt, Human
gcugccagugccu

SEQ ID NO: 3049374 - RNA, 14 nt, Human
gcugccagugccug

SEQ ID NO: 3049375 - RNA, 22 nt, Human
gcuuccagugaggcucugcccu

SEQ ID NO: 3049376 - RNA, 23 nt, Human
gcuuucuacccagcgagcccugg

SEQ ID NO: 3049377 - RNA, 23 nt, Human
gcuugaccgugaggccagagaca

SEQ ID NO: 3049378 - RNA, 18 nt, Human
gcuugaccuuuaagagaa

SEQ ID NO: 3049379 - RNA, 17 nt, Human
gcuuguaaauagcucag

SEQ ID NO: 3049380 - RNA, 19 nt, Human
gcuuguaaauagcucaggu

SEQ ID NO: 3049381 - RNA, 18 nt, Human
gcuuguaaauagcucagg

SEQ ID NO: 3049382 - RNA, 19 nt, Human
gcuuccuggcaauagucaa

SEQ ID NO: 3049383 - RNA, 23 nt, Human
gcuuccagugaggcucugcccuu

SEQ ID NO: 3049384 - RNA, 12 nt, Human
gcuucuucagag

SEQ ID NO: 3049385 - RNA, 15 nt, Human
gcuucuucagagacu

SEQ ID NO: 3049386 - RNA, 19 nt, Human
gcuugaaacccguggcgcu

SEQ ID NO: 3049387 - RNA, 20 nt, Human
gcuugaccgugaggccagag

SEQ ID NO: 3049388 - RNA, 23 nt, Human
gcugguucaggguuggccccugc

SEQ ID NO: 3049389 - RNA, 12 nt, Human
gcuguauuuuaa

SEQ ID NO: 3049390 - RNA, 13 nt, Human
gcuguauuuuaaa

SEQ ID NO: 3049391 - RNA, 16 nt, Human
gcuucaaauuguaagc

SEQ ID NO: 3049392 - RNA, 14 nt, Human
gcuucaaggauccu

SEQ ID NO: 3049393 - RNA, 14 nt, Human
gcuucaguggcagc

SEQ ID NO: 3049394 - RNA, 13 nt, Human
gcuguuggcuggg

SEQ ID NO: 3049395 - RNA, 17 nt, Human
gcuuauuuccucauuuu

SEQ ID NO: 3049396 - RNA, 17 nt, Human
ggaagacuucaucccuc

SEQ ID NO: 3049397 - RNA, 20 nt, Human
ggaagacuucaucccucugg

SEQ ID NO: 3049398 - RNA, 14 nt, Human
ggaagacaauguga

SEQ ID NO: 3049399 - RNA, 16 nt, Human
ggaagacaaugugaaa

SEQ ID NO: 3049400 - RNA, 15 nt, Human
ggaacacuccuucac

SEQ ID NO: 3049401 - RNA, 23 nt, Human
ggaacaaggcaaggcugucaauu

SEQ ID NO: 3049402 - RNA, 13 nt, Human
ggaacaccuccuc

SEQ ID NO: 3049403 - RNA, 17 nt, Human
ggaacaaggcaaggcug

SEQ ID NO: 3049404 - RNA, 21 nt, Human
ggaacaaggcaaggcugucaa

SEQ ID NO: 3049405 - RNA, 15 nt, Human
ggaacaaggcaaggc

SEQ ID NO: 3049406 - RNA, 16 nt, Human
ggaaaugggcagagca

SEQ ID NO: 3049407 - RNA, 17 nt, Human
ggaaaugggcagagcag

SEQ ID NO: 3049408 - RNA, 18 nt, Human
ggaaaugggcagagcaga

SEQ ID NO: 3049409 - RNA, 22 nt, Human
ggaaaugggcagagcagagacc

SEQ ID NO: 3049410 - RNA, 14 nt, Human
ggaaaugggcagag

SEQ ID NO: 3049411 - RNA, 14 nt, Human
gcuuugaucccuuc

SEQ ID NO: 3049412 - RNA, 17 nt, Human
gcuuugaucccuucuua

SEQ ID NO: 3049413 - RNA, 18 nt, Human
gcuuuugucuaugggacu

SEQ ID NO: 3049414 - RNA, 15 nt, Human
gcuuuuggucugugu

SEQ ID NO: 3049415 - RNA, 20 nt, Human
gcuuuuuuaucaugugaaau

SEQ ID NO: 3049416 - RNA, 18 nt, Human
gcuuuuuuaucaugugaa

SEQ ID NO: 3049417 - RNA, 15 nt, Human
gcuuuuuuaucaugu

SEQ ID NO: 3049418 - RNA, 12 nt, Human
gcuuuugugcau

SEQ ID NO: 3049419 - RNA, 16 nt, Human
ggaaacccagcucugg

SEQ ID NO: 3049420 - RNA, 18 nt, Human
ggaaaauuuuaaaaauac

SEQ ID NO: 3049421 - RNA, 22 nt, Human
gcuuuuuucucugauacagaaa

SEQ ID NO: 3049422 - RNA, 23 nt, Human
ggcucagcaaaagaugcuucuca

SEQ ID NO: 3049423 - RNA, 19 nt, Human
ggcucagcaaaagaugcuu

SEQ ID NO: 3049424 - RNA, 23 nt, Human
ggcucagcggggacagcuccuuc

SEQ ID NO: 3049425 - RNA, 22 nt, Human
ggcucagcggggacagcuccuu

SEQ ID NO: 3049426 - RNA, 21 nt, Human
ggcucagcggggacagcuccu

SEQ ID NO: 3049427 - RNA, 17 nt, Human
ggcucacugcagccuca

SEQ ID NO: 3049428 - RNA, 16 nt, Human
ggcucacugcagccuc

SEQ ID NO: 3049429 - RNA, 14 nt, Human
ggcgugcaguggug

SEQ ID NO: 3049430 - RNA, 19 nt, Human
ggcgugcaguggugcgauc

SEQ ID NO: 3049431 - RNA, 15 nt, Human
ggccugagcugggau

SEQ ID NO: 3049432 - RNA, 12 nt, Human
ggccugagcugg

SEQ ID NO: 3049433 - RNA, 20 nt, Human
ggccuguggaucaaauccag

SEQ ID NO: 3049434 - RNA, 21 nt, Human
ggccugugucuaguuguuuga

SEQ ID NO: 3049435 - RNA, 12 nt, Human
ggccuucucuga

SEQ ID NO: 3049436 - RNA, 23 nt, Human
ggccuucggccuccauccugagg

SEQ ID NO: 3049437 - RNA, 22 nt, Human
ggccuucggccuccauccugag

SEQ ID NO: 3049438 - RNA, 21 nt, Human
ggccuggccagaugcaccagc

SEQ ID NO: 3049439 - RNA, 16 nt, Human
ggccuggccagaugca

SEQ ID NO: 3049440 - RNA, 16 nt, Human
ggccuucucugaagga

SEQ ID NO: 3049441 - RNA, 15 nt, Human
ggccuucucugaagg

SEQ ID NO: 3049442 - RNA, 13 nt, Human
ggccuuuggcuuc

SEQ ID NO: 3049443 - RNA, 14 nt, Human
ggccuuuggcuuca

SEQ ID NO: 3049444 - RNA, 17 nt, Human
ggcagugggagcugccu

SEQ ID NO: 3049445 - RNA, 24 nt, Human
ggcacugcuuccagugaggcucug

SEQ ID NO: 3049446 - RNA, 22 nt, Human
ggcacuggcaaacagggccucu

SEQ ID NO: 3049447 - RNA, 23 nt, Human
ggcacuggcaaacagggccucug

SEQ ID NO: 3049448 - RNA, 15 nt, Human
ggcaccagcagccug

SEQ ID NO: 3049449 - RNA, 16 nt, Human
ggcaccagcagccugg

SEQ ID NO: 3049450 - RNA, 22 nt, Human
ggcacugcuuccagugaggcuc

SEQ ID NO: 3049451 - RNA, 15 nt, Human
ggcauauuuuucaca

SEQ ID NO: 3049452 - RNA, 17 nt, Human
ggcauauuuuucacaua

SEQ ID NO: 3049453 - RNA, 18 nt, Human
ggcauccaguaucuugaa

SEQ ID NO: 3049454 - RNA, 19 nt, Human
ggcagugggagcugccugu

SEQ ID NO: 3049455 - RNA, 18 nt, Human
ggcagugggagcugccug

SEQ ID NO: 3049456 - RNA, 18 nt, Human
ggcauuuuacuguacaga

SEQ ID NO: 3049457 - RNA, 16 nt, Human
ggccagugugacaagg

SEQ ID NO: 3049458 - RNA, 14 nt, Human
ggccaggcuggucu

SEQ ID NO: 3049459 - RNA, 12 nt, Human
ggccaggcuggu

SEQ ID NO: 3049460 - RNA, 18 nt, Human
ggccaggcuggucucaaa

SEQ ID NO: 3049461 - RNA, 16 nt, Human
ggccaggcuggucuca

SEQ ID NO: 3049462 - RNA, 17 nt, Human
ggccaaacucaccugcc

SEQ ID NO: 3049463 - RNA, 16 nt, Human
ggcccuucucuccagc

SEQ ID NO: 3049464 - RNA, 17 nt, Human
ggcccuucucuccagcc

SEQ ID NO: 3049465 - RNA, 14 nt, Human
ggcccuuccuuuuc

SEQ ID NO: 3049466 - RNA, 18 nt, Human
ggcccuucucuccagccc

SEQ ID NO: 3049467 - RNA, 19 nt, Human
ggcccaggguggccacacc

SEQ ID NO: 3049468 - RNA, 17 nt, Human
ggccccaccagugccuc

SEQ ID NO: 3049469 - RNA, 18 nt, Human
ggccccaccagugccucu

SEQ ID NO: 3049470 - RNA, 13 nt, Human
ggauguucuggga

SEQ ID NO: 3049471 - RNA, 16 nt, Human
ggauguucugggacac

SEQ ID NO: 3049472 - RNA, 15 nt, Human
ggauguucugggaca

SEQ ID NO: 3049473 - RNA, 24 nt, Human
ggcacagaaaauggaagacagcuc

SEQ ID NO: 3049474 - RNA, 15 nt, Human
ggagugcagugagcc

SEQ ID NO: 3049475 - RNA, 22 nt, Human
ggaucuucaucugacuaugaca

SEQ ID NO: 3049476 - RNA, 18 nt, Human
ggaucucuugagccuggg

SEQ ID NO: 3049477 - RNA, 15 nt, Human
ggauccuccaggugc

SEQ ID NO: 3049478 - RNA, 14 nt, Human
ggauccuccaggug

SEQ ID NO: 3049479 - RNA, 13 nt, Human
ggauccugagcca

SEQ ID NO: 3049480 - RNA, 14 nt, Human
ggauccugagccag

SEQ ID NO: 3049481 - RNA, 18 nt, Human
ggauggauuuccagccaa

SEQ ID NO: 3049482 - RNA, 12 nt, Human
ggauggcaagau

SEQ ID NO: 3049483 - RNA, 16 nt, Human
ggauggggcugcaccg

SEQ ID NO: 3049484 - RNA, 14 nt, Human
ggaguggccacaga

SEQ ID NO: 3049485 - RNA, 15 nt, Human
ggaguucugguuccu

SEQ ID NO: 3049486 - RNA, 16 nt, Human
ggaggggggagguggg

SEQ ID NO: 3049487 - RNA, 20 nt, Human
ggaggucaaggcugcaguga

SEQ ID NO: 3049488 - RNA, 14 nt, Human
ggaggugaccccag

SEQ ID NO: 3049489 - RNA, 22 nt, Human
ggagcccacuguacuugcucuu

SEQ ID NO: 3049490 - RNA, 22 nt, Human
ggagccccgaggccuucucuga

SEQ ID NO: 3049491 - RNA, 16 nt, Human
ggagccccgaggccuu

SEQ ID NO: 3049492 - RNA, 12 nt, Human
ggagcugccugu

SEQ ID NO: 3049493 - RNA, 16 nt, Human
ggagcugaguggggga

SEQ ID NO: 3049494 - RNA, 22 nt, Human
ggagcugaucgcuucuccccca

SEQ ID NO: 3049495 - RNA, 21 nt, Human
ggagcugccuguucagcucca

SEQ ID NO: 3049496 - RNA, 20 nt, Human
ggaggccaaggugggaggau

SEQ ID NO: 3049497 - RNA, 11 nt, Human
ggaggccagcc

SEQ ID NO: 3049498 - RNA, 20 nt, Human
ggaggaaggaaacccagcuc

SEQ ID NO: 3049499 - RNA, 23 nt, Human
ggaggaaggaaacccagcucugg

SEQ ID NO: 3049500 - RNA, 19 nt, Human
ggaggaaggaaacccagcu

SEQ ID NO: 3049501 - RNA, 18 nt, Human
aaagccuguuuaagagac

SEQ ID NO: 3049502 - RNA, 16 nt, Human
aaagccuguuuaagag

SEQ ID NO: 3049503 - RNA, 14 nt, Human
ggugggauccucca

SEQ ID NO: 3049504 - RNA, 15 nt, Human
ggugggauccuccag

SEQ ID NO: 3049505 - RNA, 20 nt, Human
ggugggaggauugcuugagc

SEQ ID NO: 3049506 - RNA, 20 nt, Human
ggugggaggaucucuugagc

SEQ ID NO: 3049507 - RNA, 19 nt, Human
ggugggauccuccaggugc

SEQ ID NO: 3049508 - RNA, 13 nt, Human
gguggggcagcuu

SEQ ID NO: 3049509 - RNA, 17 nt, Human
gguggggcagcuugagg

SEQ ID NO: 3049510 - RNA, 17 nt, Human
gguggggggggugcugg

SEQ ID NO: 3049511 - RNA, 15 nt, Human
gguggggucacucug

SEQ ID NO: 3049512 - RNA, 23 nt, Human
gguggggucacucuggcagcuca

SEQ ID NO: 3049513 - RNA, 13 nt, Human
ggugucgggcaug

SEQ ID NO: 3049514 - RNA, 16 nt, Human
ggugucgggcaugaca

SEQ ID NO: 3049515 - RNA, 16 nt, Human
ggugugacugaauuuc

SEQ ID NO: 3049516 - RNA, 16 nt, Human
ggugugaccacugcag

SEQ ID NO: 3049517 - RNA, 18 nt, Human
ggugugagucaccaagcc

SEQ ID NO: 3049518 - RNA, 21 nt, Human
ggugugcggccuuuggcuuca

SEQ ID NO: 3049519 - RNA, 13 nt, Human
ggugugcucugau

SEQ ID NO: 3049520 - RNA, 12 nt, Human
gguguggaagag

SEQ ID NO: 3049521 - RNA, 12 nt, Human
gguucagcuugu

SEQ ID NO: 3049522 - RNA, 21 nt, Human
gguucaggguuggccccugcc

SEQ ID NO: 3049523 - RNA, 18 nt, Human
gguucaggguuggccccu

SEQ ID NO: 3049524 - RNA, 22 nt, Human
gguucaggguuggccccugccc

SEQ ID NO: 3049525 - RNA, 21 nt, Human
gguucccuuugacgccauccc

SEQ ID NO: 3049526 - RNA, 13 nt, Human
gguuucagaaaug

SEQ ID NO: 3049527 - RNA, 12 nt, Human
gguuucagaaau

SEQ ID NO: 3049528 - RNA, 14 nt, Human
gguuucagaaaugu

SEQ ID NO: 3049529 - RNA, 12 nt, Human
gguuucuagcau

SEQ ID NO: 3049530 - RNA, 16 nt, Human
gguuuagaaagcuugc

SEQ ID NO: 3049531 - RNA, 22 nt, Human
guaaaaugugaagugaaugaaa

SEQ ID NO: 3049532 - RNA, 20 nt, Human
guaaaaugugaagugaauga

SEQ ID NO: 3049533 - RNA, 19 nt, Human
guaaaaugugaagugaaug

SEQ ID NO: 3049534 - RNA, 12 nt, Human
guaaaaugugaa

SEQ ID NO: 3049535 - RNA, 17 nt, Human
guaacaaugaagauaaa

SEQ ID NO: 3049536 - RNA, 13 nt, Human
aaauaaugugaaa

SEQ ID NO: 3049537 - RNA, 15 nt, Human
aaauaauuuuuauau

SEQ ID NO: 3049538 - RNA, 18 nt, Human
aaauaauuuuuauauuug

SEQ ID NO: 3049539 - RNA, 20 nt, Human
aaauaauuuuuauauuugaa

SEQ ID NO: 3049540 - RNA, 12 nt, Human
aaauaaugugaa

SEQ ID NO: 3049541 - RNA, 23 nt, Human
aaaguuauugauaaguucauaca

SEQ ID NO: 3049542 - RNA, 12 nt, Human
aaaguggugaga

SEQ ID NO: 3049543 - RNA, 15 nt, Human
gguuuggagcugauc

SEQ ID NO: 3049544 - RNA, 20 nt, Human
gguuuggacaaaauggaaua

SEQ ID NO: 3049545 - RNA, 13 nt, Human
gguuuggagcuga

SEQ ID NO: 3049546 - RNA, 16 nt, Human
aaaguuuguugaaaca

SEQ ID NO: 3049547 - RNA, 23 nt, Human
aaaguuucucuuuucaaaacauu

SEQ ID NO: 3049548 - RNA, 21 nt, Human
aaaguuucucuuuucaaaaca

SEQ ID NO: 3049549 - RNA, 16 nt, Human
aaaguugaauuuuaca

SEQ ID NO: 3049550 - RNA, 13 nt, Human
aaagauuuucaga

SEQ ID NO: 3049551 - RNA, 13 nt, Human
aaagcaaaggaga

SEQ ID NO: 3049552 - RNA, 15 nt, Human
aaagacuauucaaac

SEQ ID NO: 3049553 - RNA, 21 nt, Human
gguccugcugcaguugccagu

SEQ ID NO: 3049554 - RNA, 23 nt, Human
gguccugcugcaguugccaguca

SEQ ID NO: 3049555 - RNA, 23 nt, Human
gguccuagaaauuccccacccug

SEQ ID NO: 3049556 - RNA, 24 nt, Human
ggucugugagaugcuagaacuccc

SEQ ID NO: 3049557 - RNA, 17 nt, Human
ggucuacacugugcuga

SEQ ID NO: 3049558 - RNA, 14 nt, Human
ggucggaaaacaug

SEQ ID NO: 3049559 - RNA, 20 nt, Human
ggucgcccuggacugugugc

SEQ ID NO: 3049560 - RNA, 13 nt, Human
ggucggaaaacau

SEQ ID NO: 3049561 - RNA, 14 nt, Human
gguccugcugcagu

SEQ ID NO: 3049562 - RNA, 19 nt, Human
ggugcugggccccugccuc

SEQ ID NO: 3049563 - RNA, 20 nt, Human
ggugcugggccccugccucu

SEQ ID NO: 3049564 - RNA, 21 nt, Human
ggugcauuugaggucuguucu

SEQ ID NO: 3049565 - RNA, 16 nt, Human
ggugcaaugaccuuuc

SEQ ID NO: 3049566 - RNA, 19 nt, Human
ggugcaaugaccuuucaau

SEQ ID NO: 3049567 - RNA, 20 nt, Human
ggugcaaugaccuuucaaua

SEQ ID NO: 3049568 - RNA, 18 nt, Human
ggugcaaugaccuuucaa

SEQ ID NO: 3049569 - RNA, 19 nt, Human
aaagcaggcagaacucauc

SEQ ID NO: 3049570 - RNA, 17 nt, Human
aaagcagggacuugaac

SEQ ID NO: 3049571 - RNA, 17 nt, Human
aaagcaggcagaacuca

SEQ ID NO: 3049572 - RNA, 15 nt, Human
aaagcagcguuucua

SEQ ID NO: 3049573 - RNA, 14 nt, Human
gguggaugccuggu

SEQ ID NO: 3049574 - RNA, 21 nt, Human
gguggaugccugguggcagcu

SEQ ID NO: 3049575 - RNA, 22 nt, Human
aaagcagcguuucuaugacaca

SEQ ID NO: 3049576 - RNA, 18 nt, Human
aaagcagcguuucuauga

SEQ ID NO: 3049577 - RNA, 16 nt, Human
aaagcagcguuucuau

SEQ ID NO: 3049578 - RNA, 14 nt, Human
gguaugcaaucaaa

SEQ ID NO: 3049579 - RNA, 22 nt, Human
gguaugaucacggcucacugca

SEQ ID NO: 3049580 - RNA, 16 nt, Human
gguccacccaggagcc

SEQ ID NO: 3049581 - RNA, 15 nt, Human
gguccacccaggagc

SEQ ID NO: 3049582 - RNA, 13 nt, Human
gguccacccagga

SEQ ID NO: 3049583 - RNA, 12 nt, Human
gguccacccagg

SEQ ID NO: 3049584 - RNA, 17 nt, Human
gguccacccaggagccc

SEQ ID NO: 3049585 - RNA, 22 nt, Human
aaacuuuaccuuuuuuauacau

SEQ ID NO: 3049586 - RNA, 17 nt, Human
aaacuuuaccuuuuuua

SEQ ID NO: 3049587 - RNA, 15 nt, Human
gguccauagagagca

SEQ ID NO: 3049588 - RNA, 12 nt, Human
aaacuuuacuau

SEQ ID NO: 3049589 - RNA, 17 nt, Human
aaagacuaucuaaaugu

SEQ ID NO: 3049590 - RNA, 14 nt, Human
aaagacuauucaaa

SEQ ID NO: 3049591 - RNA, 18 nt, Human
ggguggggggggugcugg

SEQ ID NO: 3049592 - RNA, 15 nt, Human
ggguggggggggugc

SEQ ID NO: 3049593 - RNA, 17 nt, Human
ggguguggcgcagcaua

SEQ ID NO: 3049594 - RNA, 20 nt, Human
ggguggggaccucaggccug

SEQ ID NO: 3049595 - RNA, 19 nt, Human
gggugggacacccugugau

SEQ ID NO: 3049596 - RNA, 13 nt, Human
ggguggaugccug

SEQ ID NO: 3049597 - RNA, 15 nt, Human
ggguggcaccagcag

SEQ ID NO: 3049598 - RNA, 17 nt, Human
ggguggaugccuggugg

SEQ ID NO: 3049599 - RNA, 13 nt, Human
gguaacaggcaga

SEQ ID NO: 3049600 - RNA, 20 nt, Human
gguaacaggcagauacagga

SEQ ID NO: 3049601 - RNA, 14 nt, Human
gguaacaggcagau

SEQ ID NO: 3049602 - RNA, 17 nt, Human
ggguuucuaaagcugcc

SEQ ID NO: 3049603 - RNA, 20 nt, Human
aaacagucucaggaaaucaa

SEQ ID NO: 3049604 - RNA, 20 nt, Human
aaacaagcacuaaacaaaga

SEQ ID NO: 3049605 - RNA, 16 nt, Human
aaacacauuuuucuua

SEQ ID NO: 3049606 - RNA, 12 nt, Human
aaacacauuuuu

SEQ ID NO: 3049607 - RNA, 20 nt, Human
aaacaagaccacguuucuaa

SEQ ID NO: 3049608 - RNA, 18 nt, Human
aaacaagaccacguuucu

SEQ ID NO: 3049609 - RNA, 15 nt, Human
ggggccucagugcca

SEQ ID NO: 3049610 - RNA, 12 nt, Human
ggggccuggaug

SEQ ID NO: 3049611 - RNA, 20 nt, Human
ggggacagcuccuucugucc

SEQ ID NO: 3049612 - RNA, 14 nt, Human
ggggacagcuccuu

SEQ ID NO: 3049613 - RNA, 12 nt, Human
ggggacagcucc

SEQ ID NO: 3049614 - RNA, 18 nt, Human
gggcugcaugcgggcuuc

SEQ ID NO: 3049615 - RNA, 21 nt, Human
gggcugcaugcgggcuuccuc

SEQ ID NO: 3049616 - RNA, 22 nt, Human
gggcugcaccggcuggccuggc

SEQ ID NO: 3049617 - RNA, 10 nt, Human
gggcucagca

SEQ ID NO: 3049618 - RNA, 20 nt, Human
gggcuggguucuacccaggu

SEQ ID NO: 3049619 - RNA, 12 nt, Human
aaaaugugaagu

SEQ ID NO: 3049620 - RNA, 15 nt, Human
aaaaugugauaugua

SEQ ID NO: 3049621 - RNA, 22 nt, Human
gggcuggguucuacccaggugc

SEQ ID NO: 3049622 - RNA, 22 nt, Human
aaaauuuuuucucuaggaaaua

SEQ ID NO: 3049623 - RNA, 15 nt, Human
gggccaggcuggguc

SEQ ID NO: 3049624 - RNA, 14 nt, Human
gggccaggcugggu

SEQ ID NO: 3049625 - RNA, 21 nt, Human
gggccaggcugggucgcccug

SEQ ID NO: 3049626 - RNA, 13 nt, Human
gggccaggcuggg

SEQ ID NO: 3049627 - RNA, 11 nt, Human
gggccaggagc

SEQ ID NO: 3049628 - RNA, 14 nt, Human
aaaaugagccuggc

SEQ ID NO: 3049629 - RNA, 21 nt, Human
aaaaugagccuggcaagaaug

SEQ ID NO: 3049630 - RNA, 19 nt, Human
aaaaguauguuagugcaaa

SEQ ID NO: 3049631 - RNA, 14 nt, Human
gggccaguuggucc

SEQ ID NO: 3049632 - RNA, 18 nt, Human
gggccaguuggucccccu

SEQ ID NO: 3049633 - RNA, 22 nt, Human
gggccaguuggucccccuucca

SEQ ID NO: 3049634 - RNA, 23 nt, Human
gggccaguuggucccccuuccau

SEQ ID NO: 3049635 - RNA, 15 nt, Human
gggcgggaggauguu

SEQ ID NO: 3049636 - RNA, 18 nt, Human
gggcuaguugggcuuccu

SEQ ID NO: 3049637 - RNA, 15 nt, Human
gggcgugguggugag

SEQ ID NO: 3049638 - RNA, 13 nt, Human
gggccuccugugu

SEQ ID NO: 3049639 - RNA, 15 nt, Human
gggccuccugugugu

SEQ ID NO: 3049640 - RNA, 23 nt, Human
gggccucggaccccacuccggcc

SEQ ID NO: 3049641 - RNA, 20 nt, Human
gggccucuuaugggcugggu

SEQ ID NO: 3049642 - RNA, 19 nt, Human
gggccucuuaugggcuggg

SEQ ID NO: 3049643 - RNA, 15 nt, Human
aaaaauauauuuaau

SEQ ID NO: 3049644 - RNA, 13 nt, Human
aaaaauauauuua

SEQ ID NO: 3049645 - RNA, 19 nt, Human
aaaaauauauuuaaugaua

SEQ ID NO: 3049646 - RNA, 21 nt, Human
gggacagcuccuucuguccua

SEQ ID NO: 3049647 - RNA, 19 nt, Human
gggacauuugcucauggaa

SEQ ID NO: 3049648 - RNA, 20 nt, Human
gggacauuugcucauggaau

SEQ ID NO: 3049649 - RNA, 21 nt, Human
gggacauuugcucauggaauu

SEQ ID NO: 3049650 - RNA, 13 nt, Human
gggacagaggggg

SEQ ID NO: 3049651 - RNA, 22 nt, Human
gggacagaggggguggccuccc

SEQ ID NO: 3049652 - RNA, 23 nt, Human
gggacagaggggguggccuccca

SEQ ID NO: 3049653 - RNA, 16 nt, Human
gggacagcuccuucug

SEQ ID NO: 3049654 - RNA, 13 nt, Human
gggaaggauacaa

SEQ ID NO: 3049655 - RNA, 15 nt, Human
aaaacccagauaaag

SEQ ID NO: 3049656 - RNA, 13 nt, Human
aaaaccacagcag

SEQ ID NO: 3049657 - RNA, 13 nt, Human
aaaagaugcuucu

SEQ ID NO: 3049658 - RNA, 17 nt, Human
aaaagaugaaaauauuu

SEQ ID NO: 3049659 - RNA, 23 nt, Human
aaaacugcugacuguuuucucuu

SEQ ID NO: 3049660 - RNA, 20 nt, Human
aaaacugcugacuguuuucu

SEQ ID NO: 3049661 - RNA, 22 nt, Human
aaaacugcugacuguuuucucu

SEQ ID NO: 3049662 - RNA, 13 nt, Human
aaaacucauuuuu

SEQ ID NO: 3049663 - RNA, 21 nt, Human
aaaaccaauguucucucuucu

SEQ ID NO: 3049664 - RNA, 12 nt, Human
aaaaccacagca

SEQ ID NO: 3049665 - RNA, 15 nt, Human
aaaacaugcuacaca

SEQ ID NO: 3049666 - RNA, 14 nt, Human
aaaaaucucaaauu

SEQ ID NO: 3049667 - RNA, 22 nt, Human
aaaaauggaacauaaaauacaa

SEQ ID NO: 3049668 - RNA, 15 nt, Human
gggaggucgaggcag

SEQ ID NO: 3049669 - RNA, 22 nt, Human
gggaggcucuggagcccacugu

SEQ ID NO: 3049670 - RNA, 14 nt, Human
gggagggcuccaga

SEQ ID NO: 3049671 - RNA, 15 nt, Human
gggagggcuccagac

SEQ ID NO: 3049672 - RNA, 17 nt, Human
gggagggcuccagacac

SEQ ID NO: 3049673 - RNA, 17 nt, Human
gggaggucgaggcagga

SEQ ID NO: 3049674 - RNA, 18 nt, Human
gggagggcuccagacaca

SEQ ID NO: 3049675 - RNA, 18 nt, Human
gggaggucgaggcaggag

SEQ ID NO: 3049676 - RNA, 19 nt, Human
gggaggucgaggcaggagg

SEQ ID NO: 3049677 - RNA, 19 nt, Human
gggaggccaaggugggagg

SEQ ID NO: 3049678 - RNA, 17 nt, Human
gggauugaaggaugcug

SEQ ID NO: 3049679 - RNA, 16 nt, Human
gggauuguaaaauggu

SEQ ID NO: 3049680 - RNA, 17 nt, Human
gggauuguaaaauggug

SEQ ID NO: 3049681 - RNA, 15 nt, Human
gggauuacaggugug

SEQ ID NO: 3049682 - RNA, 17 nt, Human
gggcagagcagagacca

SEQ ID NO: 3049683 - RNA, 22 nt, Human
gggcagagcagagaccaucccu

SEQ ID NO: 3049684 - RNA, 14 nt, Human
gggcagaggaaagc

SEQ ID NO: 3049685 - RNA, 16 nt, Human
gggcagagcagagacc

SEQ ID NO: 3049686 - RNA, 12 nt, Human
gggcagagcaga

SEQ ID NO: 3049687 - RNA, 18 nt, Human
gggcaacccccagccugc

SEQ ID NO: 3049688 - RNA, 16 nt, Human
gggcaacccccagccu

SEQ ID NO: 3049689 - RNA, 19 nt, Human
aaaagggacugagaaauuu

SEQ ID NO: 3049690 - RNA, 16 nt, Human
gaugagaggaaaucac

SEQ ID NO: 3049691 - RNA, 14 nt, Human
gaugaucuuugcag

SEQ ID NO: 3049692 - RNA, 21 nt, Human
gaugaucuuugcagacaggca

SEQ ID NO: 3049693 - RNA, 20 nt, Human
gaugaucuuugcagacaggc

SEQ ID NO: 3049694 - RNA, 12 nt, Human
gaucucuugagc

SEQ ID NO: 3049695 - RNA, 16 nt, Human
gaucucuugagccugg

SEQ ID NO: 3049696 - RNA, 17 nt, Human
gaucucuugagccuggg

SEQ ID NO: 3049697 - RNA, 15 nt, Human
gauauuuuuuucuuu

SEQ ID NO: 3049698 - RNA, 16 nt, Human
gauauuuugcuuugug

SEQ ID NO: 3049699 - RNA, 15 nt, Human
gauauuuugcuuugu

SEQ ID NO: 3049700 - RNA, 17 nt, Human
gauuagggagagaagau

SEQ ID NO: 3049701 - RNA, 18 nt, Human
gauuacugccuauuuuaa

SEQ ID NO: 3049702 - RNA, 14 nt, Human
gauuaccagggacu

SEQ ID NO: 3049703 - RNA, 20 nt, Human
gauuacaggugugaaccacc

SEQ ID NO: 3049704 - RNA, 16 nt, Human
gaugugaacacaucag

SEQ ID NO: 3049705 - RNA, 14 nt, Human
gaugugaacacauc

SEQ ID NO: 3049706 - RNA, 20 nt, Human
gaguuugggguaugggagag

SEQ ID NO: 3049707 - RNA, 20 nt, Human
gaguuguuacauuuuuaagu

SEQ ID NO: 3049708 - RNA, 16 nt, Human
gaguuguuacauuuuu

SEQ ID NO: 3049709 - RNA, 18 nt, Human
gagugccuuacacaaugg

SEQ ID NO: 3049710 - RNA, 21 nt, Human
gagugcucaguagucagacug

SEQ ID NO: 3049711 - RNA, 16 nt, Human
gaguuuaaauuguaau

SEQ ID NO: 3049712 - RNA, 16 nt, Human
gaguuuagcuggaaaa

SEQ ID NO: 3049713 - RNA, 23 nt, Human
gaguugugugaauaccccaagac

SEQ ID NO: 3049714 - RNA, 12 nt, Human
gagugcagugag

SEQ ID NO: 3049715 - RNA, 11 nt, Human
gagugcaguga

SEQ ID NO: 3049716 - RNA, 12 nt, Human
gagugagcuggu

SEQ ID NO: 3049717 - RNA, 13 nt, Human
gagucccaccuug

SEQ ID NO: 3049718 - RNA, 24 nt, Human
gagugagcacuaaggugugcucug

SEQ ID NO: 3049719 - RNA, 20 nt, Human
gagucccaccuuggcugcag

SEQ ID NO: 3049720 - RNA, 16 nt, Human
gagucccaccuuggcu

SEQ ID NO: 3049721 - RNA, 14 nt, Human
gagucaccaagccc

SEQ ID NO: 3049722 - RNA, 13 nt, Human
gagucaccaagcc

SEQ ID NO: 3049723 - RNA, 12 nt, Human
gaggugggaucc

SEQ ID NO: 3049724 - RNA, 11 nt, Human
gaggugggagg

SEQ ID NO: 3049725 - RNA, 14 nt, Human
gaggucuguucuuu

SEQ ID NO: 3049726 - RNA, 13 nt, Human
gaggucuguucuu

SEQ ID NO: 3049727 - RNA, 11 nt, Human
gauacuacagu

SEQ ID NO: 3049728 - RNA, 16 nt, Human
gauacuacaguuuguu

SEQ ID NO: 3049729 - RNA, 13 nt, Human
gauacccauccca

SEQ ID NO: 3049730 - RNA, 14 nt, Human
gauacccaucccau

SEQ ID NO: 3049731 - RNA, 16 nt, Human
gauacuugaaaauuaa

SEQ ID NO: 3049732 - RNA, 20 nt, Human
gauauguaccuaacgaagua

SEQ ID NO: 3049733 - RNA, 13 nt, Human
gauaugugaacag

SEQ ID NO: 3049734 - RNA, 14 nt, Human
gauaugugaacagu

SEQ ID NO: 3049735 - RNA, 13 nt, Human
gcaagugagagcu

SEQ ID NO: 3049736 - RNA, 14 nt, Human
gcacaagcugcacc

SEQ ID NO: 3049737 - RNA, 23 nt, Human
gcacaagcuccaagcucccaggc

SEQ ID NO: 3049738 - RNA, 21 nt, Human
gcacaagcuccaagcucccag

SEQ ID NO: 3049739 - RNA, 22 nt, Human
gcacaagcuccaagcucccagg

SEQ ID NO: 3049740 - RNA, 21 nt, Human
gcaauaaagcagcguuucuau

SEQ ID NO: 3049741 - RNA, 18 nt, Human
gcaccggcuggccuggcc

SEQ ID NO: 3049742 - RNA, 21 nt, Human
gcaccggcuggccuggccccu

SEQ ID NO: 3049743 - RNA, 23 nt, Human
gcaccggcuggccuggccccuca

SEQ ID NO: 3049744 - RNA, 19 nt, Human
gcaccggcuggccuggccc

SEQ ID NO: 3049745 - RNA, 14 nt, Human
gcacaugccucucu

SEQ ID NO: 3049746 - RNA, 17 nt, Human
gcacaugccucucucag

SEQ ID NO: 3049747 - RNA, 18 nt, Human
gcacaugccucucucagg

SEQ ID NO: 3049748 - RNA, 19 nt, Human
gcacaugccucucucaggc

SEQ ID NO: 3049749 - RNA, 20 nt, Human
gcacaugccucucucaggcc

SEQ ID NO: 3049750 - RNA, 21 nt, Human
gcacaugccucucucaggcca

SEQ ID NO: 3049751 - RNA, 20 nt, Human
gcacaucagcacgauuucug

SEQ ID NO: 3049752 - RNA, 19 nt, Human
gcacaucagcacgauuucu

SEQ ID NO: 3049753 - RNA, 21 nt, Human
gcacaucagcacgauuucugu

SEQ ID NO: 3049754 - RNA, 13 nt, Human
gcacaugccucuc

SEQ ID NO: 3049755 - RNA, 21 nt, Human
gcacaugagcuggcgggauug

SEQ ID NO: 3049756 - RNA, 18 nt, Human
gcacaguuuucugagaaa

SEQ ID NO: 3049757 - RNA, 17 nt, Human
gcacaguuuucugagaa

SEQ ID NO: 3049758 - RNA, 14 nt, Human
gcacaguuuucuga

SEQ ID NO: 3049759 - RNA, 17 nt, Human
gcacugacagauuucca

SEQ ID NO: 3049760 - RNA, 12 nt, Human
gcacugacagau

SEQ ID NO: 3049761 - RNA, 12 nt, Human
gcacugacauug

SEQ ID NO: 3049762 - RNA, 19 nt, Human
gcagagcagagaccauccc

SEQ ID NO: 3049763 - RNA, 20 nt, Human
gcagagcagagaccaucccu

SEQ ID NO: 3049764 - RNA, 24 nt, Human
gcagagcaccuuagacagucccug

SEQ ID NO: 3049765 - RNA, 12 nt, Human
gcagagcagaga

SEQ ID NO: 3049766 - RNA, 14 nt, Human
gcagagcagagacc

SEQ ID NO: 3049767 - RNA, 15 nt, Human
gcagagcagagacca

SEQ ID NO: 3049768 - RNA, 22 nt, Human
gcagagcaccuuagacaguccc

SEQ ID NO: 3049769 - RNA, 23 nt, Human
gcagagcaccuuagacagucccu

SEQ ID NO: 3049770 - RNA, 19 nt, Human
gcagagcaccuuagacagu

SEQ ID NO: 3049771 - RNA, 12 nt, Human
gcagccaggcca

SEQ ID NO: 3049772 - RNA, 14 nt, Human
gcagccacuauugu

SEQ ID NO: 3049773 - RNA, 16 nt, Human
gcagccacauuccuga

SEQ ID NO: 3049774 - RNA, 13 nt, Human
gcagccaggccac

SEQ ID NO: 3049775 - RNA, 14 nt, Human
gcagccaggccaca

SEQ ID NO: 3049776 - RNA, 18 nt, Human
gcagcccaccccucaaca

SEQ ID NO: 3049777 - RNA, 16 nt, Human
gcauaccacuuuuguu

SEQ ID NO: 3049778 - RNA, 22 nt, Human
gcauaacguauaaaagccuguu

SEQ ID NO: 3049779 - RNA, 20 nt, Human
gcauaccacuuuuguucuug

SEQ ID NO: 3049780 - RNA, 17 nt, Human
gcauaccacuuuuguuc

SEQ ID NO: 3049781 - RNA, 20 nt, Human
gcaggcucucaggccagcug

SEQ ID NO: 3049782 - RNA, 22 nt, Human
gcaggcucucaggccagcugcu

SEQ ID NO: 3049783 - RNA, 17 nt, Human
gcagcugcgguccaccc

SEQ ID NO: 3049784 - RNA, 23 nt, Human
gcaggcucucaggccagcugcuu

SEQ ID NO: 3049785 - RNA, 18 nt, Human
gcaggcucucaggccagc

SEQ ID NO: 3049786 - RNA, 19 nt, Human
gcagggacuugaacccaua

SEQ ID NO: 3049787 - RNA, 16 nt, Human
gacagaauauguuuca

SEQ ID NO: 3049788 - RNA, 16 nt, Human
gacagaagcagcucuu

SEQ ID NO: 3049789 - RNA, 20 nt, Human
gacagcccgggcucugccuc

SEQ ID NO: 3049790 - RNA, 21 nt, Human
gacagcccgggcucugccucc

SEQ ID NO: 3049791 - RNA, 22 nt, Human
gacagcccgggcucugccuccc

SEQ ID NO: 3049792 - RNA, 23 nt, Human
gacagcccgggcucugccuccca

SEQ ID NO: 3049793 - RNA, 15 nt, Human
gacacugaugggcaa

SEQ ID NO: 3049794 - RNA, 16 nt, Human
gacacuuaaaaauggu

SEQ ID NO: 3049795 - RNA, 13 nt, Human
gacacugaugggc

SEQ ID NO: 3049796 - RNA, 20 nt, Human
gacaguauggcagcuuuccu

SEQ ID NO: 3049797 - RNA, 17 nt, Human
gacagucaccucaugga

SEQ ID NO: 3049798 - RNA, 22 nt, Human
gacaggguuuugccauguuggc

SEQ ID NO: 3049799 - RNA, 20 nt, Human
gacaggguuuugccauguug

SEQ ID NO: 3049800 - RNA, 11 nt, Human
gacagcuccuu

SEQ ID NO: 3049801 - RNA, 21 nt, Human
gacacacagcucuguccuggg

SEQ ID NO: 3049802 - RNA, 12 nt, Human
gacacacaugaa

SEQ ID NO: 3049803 - RNA, 13 nt, Human
gacacacugaaga

SEQ ID NO: 3049804 - RNA, 20 nt, Human
gaauuugugaagguggaaau

SEQ ID NO: 3049805 - RNA, 12 nt, Human
gaauuaugaaac

SEQ ID NO: 3049806 - RNA, 11 nt, Human
gaauuaguuuu

SEQ ID NO: 3049807 - RNA, 19 nt, Human
gaauuuuggcugugucucc

SEQ ID NO: 3049808 - RNA, 19 nt, Human
gacacacagcucuguccug

SEQ ID NO: 3049809 - RNA, 18 nt, Human
gacacacagcucuguccu

SEQ ID NO: 3049810 - RNA, 17 nt, Human
gacacacagcucugucc

SEQ ID NO: 3049811 - RNA, 15 nt, Human
gacacacagcucugu

SEQ ID NO: 3049812 - RNA, 13 nt, Human
gacacacagcucu

SEQ ID NO: 3049813 - RNA, 14 nt, Human
gacacacagcucug

SEQ ID NO: 3049814 - RNA, 15 nt, Human
gacaaaauggaauac

SEQ ID NO: 3049815 - RNA, 20 nt, Human
gaauuuugugcccccaugua

SEQ ID NO: 3049816 - RNA, 23 nt, Human
gaauuuuggcugugucucccuuc

SEQ ID NO: 3049817 - RNA, 21 nt, Human
gaauuuugugcccccauguaa

SEQ ID NO: 3049818 - RNA, 14 nt, Human
gacaaaaagcuacu

SEQ ID NO: 3049819 - RNA, 11 nt, Human
gaaugaauguc

SEQ ID NO: 3049820 - RNA, 14 nt, Human
gaaugaaugucagu

SEQ ID NO: 3049821 - RNA, 18 nt, Human
gaaugaaugucaguguga

SEQ ID NO: 3049822 - RNA, 22 nt, Human
gaaugaaugucagugugacuga

SEQ ID NO: 3049823 - RNA, 20 nt, Human
gaaugaauggcuaagcaaaa

SEQ ID NO: 3049824 - RNA, 20 nt, Human
gaaugagagacacacugaag

SEQ ID NO: 3049825 - RNA, 22 nt, Human
gaaugagagacacacugaagaa

SEQ ID NO: 3049826 - RNA, 23 nt, Human
gaaugagagacacacugaagaag

SEQ ID NO: 3049827 - RNA, 16 nt, Human
gaagcucagggccugg

SEQ ID NO: 3049828 - RNA, 17 nt, Human
gaagcucagggccuggc

SEQ ID NO: 3049829 - RNA, 18 nt, Human
gaagcucagggccuggcu

SEQ ID NO: 3049830 - RNA, 19 nt, Human
gaagcucagggccuggcuc

SEQ ID NO: 3049831 - RNA, 20 nt, Human
gaagcucagggccuggcuca

SEQ ID NO: 3049832 - RNA, 21 nt, Human
gaagcucagggccuggcucag

SEQ ID NO: 3049833 - RNA, 23 nt, Human
gaagcucagggccuggcucaggu

SEQ ID NO: 3049834 - RNA, 14 nt, Human
gaagcucagggccu

SEQ ID NO: 3049835 - RNA, 15 nt, Human
gaagcucagggccug

SEQ ID NO: 3049836 - RNA, 18 nt, Human
gaagucuuuguacagaca

SEQ ID NO: 3049837 - RNA, 19 nt, Human
gaagucuuuguacagacaa

SEQ ID NO: 3049838 - RNA, 20 nt, Human
gaagucuuuguacagacaac

SEQ ID NO: 3049839 - RNA, 16 nt, Human
gaaggcucgagcaugc

SEQ ID NO: 3049840 - RNA, 17 nt, Human
gaaggcucgagcaugcc

SEQ ID NO: 3049841 - RNA, 13 nt, Human
gacuaugacauaa

SEQ ID NO: 3049842 - RNA, 22 nt, Human
gacuauucaaacagucucagga

SEQ ID NO: 3049843 - RNA, 22 nt, Human
gacuaucuaaauguugaaagau

SEQ ID NO: 3049844 - RNA, 12 nt, Human
gacucugucuca

SEQ ID NO: 3049845 - RNA, 17 nt, Human
gacucuuaagaagacug

SEQ ID NO: 3049846 - RNA, 15 nt, Human
gacucuuaagaagac

SEQ ID NO: 3049847 - RNA, 16 nt, Human
gacucuuaagaagacu

SEQ ID NO: 3049848 - RNA, 23 nt, Human
gacuuuucuguccgagcuuugaa

SEQ ID NO: 3049849 - RNA, 23 nt, Human
gacuuuucuuucagccaagaauu

SEQ ID NO: 3049850 - RNA, 21 nt, Human
gacuuuucuuuguggcuuccu

SEQ ID NO: 3049851 - RNA, 12 nt, Human
gagaaggaagcc

SEQ ID NO: 3049852 - RNA, 13 nt, Human
gagaagcggcugg

SEQ ID NO: 3049853 - RNA, 15 nt, Human
gagaagcggcuggca

SEQ ID NO: 3049854 - RNA, 22 nt, Human
gagacguuuuuggaagaguagu

SEQ ID NO: 3049855 - RNA, 14 nt, Human
gagaaucacuugaa

SEQ ID NO: 3049856 - RNA, 15 nt, Human
gagaaucacuugaac

SEQ ID NO: 3049857 - RNA, 14 nt, Human
gagcagggcucagc

SEQ ID NO: 3049858 - RNA, 22 nt, Human
gagcaugccuggauggggcugc

SEQ ID NO: 3049859 - RNA, 21 nt, Human
gagcaugccuggauggggcug

SEQ ID NO: 3049860 - RNA, 12 nt, Human
gagcaucaggcc

SEQ ID NO: 3049861 - RNA, 17 nt, Human
gagccccacccucagau

SEQ ID NO: 3049862 - RNA, 18 nt, Human
gagcugggugucaagagg

SEQ ID NO: 3049863 - RNA, 14 nt, Human
gagccuuccagggg

SEQ ID NO: 3049864 - RNA, 15 nt, Human
gagccuuccaggggu

SEQ ID NO: 3049865 - RNA, 16 nt, Human
gagccuuccaggggug

SEQ ID NO: 3049866 - RNA, 17 nt, Human
gagccuuccaggggugg

SEQ ID NO: 3049867 - RNA, 19 nt, Human
gagccuugaacuuugaccu

SEQ ID NO: 3049868 - RNA, 22 nt, Human
gagccuugaacuuugaccucug

SEQ ID NO: 3049869 - RNA, 22 nt, Human
gagcugccuguucagcuccagc

SEQ ID NO: 3049870 - RNA, 21 nt, Human
gagcugccuguucagcuccag

SEQ ID NO: 3049871 - RNA, 20 nt, Human
gagcugccuguucagcucca

SEQ ID NO: 3049872 - RNA, 18 nt, Human
gagcggagaaaggaaggg

SEQ ID NO: 3049873 - RNA, 21 nt, Human
gagcggagaaaggaagggcug

SEQ ID NO: 3049874 - RNA, 17 nt, Human
gagcggagaaaggaagg

SEQ ID NO: 3049875 - RNA, 14 nt, Human
gagauguagccccu

SEQ ID NO: 3049876 - RNA, 18 nt, Human
gagauugcaccacugcac

SEQ ID NO: 3049877 - RNA, 13 nt, Human
gagauuuacaacu

SEQ ID NO: 3049878 - RNA, 22 nt, Human
gagaggcauccaguaucuugaa

SEQ ID NO: 3049879 - RNA, 21 nt, Human
gagaugaugccaugggcccuc

SEQ ID NO: 3049880 - RNA, 14 nt, Human
gagacuccugcagg

SEQ ID NO: 3049881 - RNA, 15 nt, Human
gagacuccugcaggc

SEQ ID NO: 3049882 - RNA, 16 nt, Human
gagacuccugcaggca

SEQ ID NO: 3049883 - RNA, 17 nt, Human
gagacuccugcaggcag

SEQ ID NO: 3049884 - RNA, 14 nt, Human
gagaggcauccagu

SEQ ID NO: 3049885 - RNA, 18 nt, Human
cuuccucccucccucuuu

SEQ ID NO: 3049886 - RNA, 17 nt, Human
cuuccugcaacaccuug

SEQ ID NO: 3049887 - RNA, 23 nt, Human
cuucuaaguaaaaccacagcagu

SEQ ID NO: 3049888 - RNA, 22 nt, Human
cuucuaaguaaaaccacagcag

SEQ ID NO: 3049889 - RNA, 23 nt, Human
cuucuucagagacuccugcaggc

SEQ ID NO: 3049890 - RNA, 21 nt, Human
cuucugacccaugcugcccug

SEQ ID NO: 3049891 - RNA, 22 nt, Human
cuucugacccaugcugcccugu

SEQ ID NO: 3049892 - RNA, 20 nt, Human
cuucugacccaugcugcccu

SEQ ID NO: 3049893 - RNA, 20 nt, Human
cuuggcgcugccccuggcag

SEQ ID NO: 3049894 - RNA, 14 nt, Human
cuuggcgcugcccc

SEQ ID NO: 3049895 - RNA, 17 nt, Human
cuuggcgcugccccugg

SEQ ID NO: 3049896 - RNA, 12 nt, Human
cuuggcgcugcc

SEQ ID NO: 3049897 - RNA, 12 nt, Human
cuugaugccugg

SEQ ID NO: 3049898 - RNA, 13 nt, Human
cuugaugaagaag

SEQ ID NO: 3049899 - RNA, 16 nt, Human
cuugaagacuuuucuu

SEQ ID NO: 3049900 - RNA, 13 nt, Human
cuugacagggcac

SEQ ID NO: 3049901 - RNA, 15 nt, Human
cuugacagggcacac

SEQ ID NO: 3049902 - RNA, 14 nt, Human
cuugacagggcaca

SEQ ID NO: 3049903 - RNA, 19 nt, Human
cuugaauuguaaggaauga

SEQ ID NO: 3049904 - RNA, 18 nt, Human
cuugaauuguaaggaaug

SEQ ID NO: 3049905 - RNA, 12 nt, Human
cuugaugaagaa

SEQ ID NO: 3049906 - RNA, 11 nt, Human
cuucccaccuc

SEQ ID NO: 3049907 - RNA, 21 nt, Human
cuucccaccucucucacuccu

SEQ ID NO: 3049908 - RNA, 23 nt, Human
cuucccaccucucucacuccuug

SEQ ID NO: 3049909 - RNA, 15 nt, Human
cuucacuguaaaaua

SEQ ID NO: 3049910 - RNA, 17 nt, Human
cuucagagacuccugca

SEQ ID NO: 3049911 - RNA, 18 nt, Human
cuucagagacuccugcag

SEQ ID NO: 3049912 - RNA, 19 nt, Human
cuucagagacuccugcagg

SEQ ID NO: 3049913 - RNA, 20 nt, Human
cuucagagacuccugcaggc

SEQ ID NO: 3049914 - RNA, 21 nt, Human
cuucaucugacuaugacauaa

SEQ ID NO: 3049915 - RNA, 19 nt, Human
cuucaucugacuaugacau

SEQ ID NO: 3049916 - RNA, 20 nt, Human
cuucaugcauagguuuagca

SEQ ID NO: 3049917 - RNA, 21 nt, Human
cuuccagugaggcucugcccu

SEQ ID NO: 3049918 - RNA, 22 nt, Human
cuuccagugaggcucugcccuu

SEQ ID NO: 3049919 - RNA, 23 nt, Human
cuuccagugaggcucugcccuug

SEQ ID NO: 3049920 - RNA, 14 nt, Human
cugugcugagucug

SEQ ID NO: 3049921 - RNA, 12 nt, Human
cugugcugaguc

SEQ ID NO: 3049922 - RNA, 13 nt, Human
cuuauggaacacu

SEQ ID NO: 3049923 - RNA, 16 nt, Human
cuuauggaacacucug

SEQ ID NO: 3049924 - RNA, 21 nt, Human
cuucaccuuuguccccaccgc

SEQ ID NO: 3049925 - RNA, 15 nt, Human
cuucacggaagagcc

SEQ ID NO: 3049926 - RNA, 19 nt, Human
cuucacggaagagccuugc

SEQ ID NO: 3049927 - RNA, 22 nt, Human
cuucaccuuuguccccaccgca

SEQ ID NO: 3049928 - RNA, 20 nt, Human
cuuauuguagcauccuggaa

SEQ ID NO: 3049929 - RNA, 17 nt, Human
cuuauggaacacucuga

SEQ ID NO: 3049930 - RNA, 19 nt, Human
cuuauggaacacucugaga

SEQ ID NO: 3049931 - RNA, 20 nt, Human
cuuauggaacacucugagac

SEQ ID NO: 3049932 - RNA, 22 nt, Human
gaaagggacuuggaagcuccgc

SEQ ID NO: 3049933 - RNA, 20 nt, Human
gaaagggacgcuacccggga

SEQ ID NO: 3049934 - RNA, 19 nt, Human
gaaagggacuuggaagcuc

SEQ ID NO: 3049935 - RNA, 17 nt, Human
gaaauauuuauuuuaau

SEQ ID NO: 3049936 - RNA, 19 nt, Human
gaaaucaccgaaaacgugg

SEQ ID NO: 3049937 - RNA, 20 nt, Human
gaaaucaaauaugcaaagca

SEQ ID NO: 3049938 - RNA, 19 nt, Human
gaaaucaaauaugcaaagc

SEQ ID NO: 3049939 - RNA, 17 nt, Human
gaaaucaaauaugcaaa

SEQ ID NO: 3049940 - RNA, 18 nt, Human
gaaaucaaauaugcaaag

SEQ ID NO: 3049941 - RNA, 18 nt, Human
gaaauauuuauuuuaaua

SEQ ID NO: 3049942 - RNA, 22 nt, Human
gaaauauuuauuuuaauaaugu

SEQ ID NO: 3049943 - RNA, 20 nt, Human
gaaaggcuccaggagcagcc

SEQ ID NO: 3049944 - RNA, 22 nt, Human
gaaaggcuccaggagcagccac

SEQ ID NO: 3049945 - RNA, 21 nt, Human
gaaaggcuccaggagcagcca

SEQ ID NO: 3049946 - RNA, 17 nt, Human
gaaagacuauucaaaca

SEQ ID NO: 3049947 - RNA, 20 nt, Human
gaaagacuaucuaaauguug

SEQ ID NO: 3049948 - RNA, 15 nt, Human
gaaagacuauucaaa

SEQ ID NO: 3049949 - RNA, 14 nt, Human
gaaagacuauucaa

SEQ ID NO: 3049950 - RNA, 13 nt, Human
gaaacuuuuggaa

SEQ ID NO: 3049951 - RNA, 15 nt, Human
gaaacuuuuggaagg

SEQ ID NO: 3049952 - RNA, 23 nt, Human
cuuuugcccacacuugggagcaa

SEQ ID NO: 3049953 - RNA, 18 nt, Human
cuuuuggaagguauuuaa

SEQ ID NO: 3049954 - RNA, 15 nt, Human
cuuuuggcauuuuac

SEQ ID NO: 3049955 - RNA, 18 nt, Human
cuuuugucuaugggacuc

SEQ ID NO: 3049956 - RNA, 13 nt, Human
cuuuugugcauua

SEQ ID NO: 3049957 - RNA, 12 nt, Human
cuuuugugcauu

SEQ ID NO: 3049958 - RNA, 23 nt, Human
cuuuuuuggcugcugaaggcucg

SEQ ID NO: 3049959 - RNA, 15 nt, Human
gaaaauguaugugua

SEQ ID NO: 3049960 - RNA, 19 nt, Human
gaaaauggacguguuauga

SEQ ID NO: 3049961 - RNA, 23 nt, Human
gaaaauggacguguuaugacucc

SEQ ID NO: 3049962 - RNA, 14 nt, Human
gaaaaacugauuuu

SEQ ID NO: 3049963 - RNA, 21 nt, Human
gaaaacuuuaugcuaagugaa

SEQ ID NO: 3049964 - RNA, 21 nt, Human
gaaaauggaagacagcucuua

SEQ ID NO: 3049965 - RNA, 18 nt, Human
gaaaagaaaaaugagccu

SEQ ID NO: 3049966 - RNA, 22 nt, Human
cuuuccugaggcugggcucccu

SEQ ID NO: 3049967 - RNA, 23 nt, Human
cuuucaauaggaaaaacugauuu

SEQ ID NO: 3049968 - RNA, 23 nt, Human
cuuucagccaagaauucuuaaau

SEQ ID NO: 3049969 - RNA, 20 nt, Human
cuuucagccaagaauucuua

SEQ ID NO: 3049970 - RNA, 14 nt, Human
cuuuuaugugaaac

SEQ ID NO: 3049971 - RNA, 13 nt, Human
cuuuuauaaacuu

SEQ ID NO: 3049972 - RNA, 16 nt, Human
cuuucuagccagagga

SEQ ID NO: 3049973 - RNA, 15 nt, Human
cuuucuagccagagg

SEQ ID NO: 3049974 - RNA, 17 nt, Human
cuuucuacccagcgagc

SEQ ID NO: 3049975 - RNA, 17 nt, Human
cuuugggccuggcuccc

SEQ ID NO: 3049976 - RNA, 23 nt, Human
cuggugacuuuccucuuuggucu

SEQ ID NO: 3049977 - RNA, 20 nt, Human
cuggugacuuuccucuuugg

SEQ ID NO: 3049978 - RNA, 21 nt, Human
cuggugacuuuccucuuuggu

SEQ ID NO: 3049979 - RNA, 15 nt, Human
cuggugacuuuccuc

SEQ ID NO: 3049980 - RNA, 14 nt, Human
cuggguucacugca

SEQ ID NO: 3049981 - RNA, 23 nt, Human
cuggguggcaccagcagccugga

SEQ ID NO: 3049982 - RNA, 22 nt, Human
cuggguggcaccagcagccugg

SEQ ID NO: 3049983 - RNA, 17 nt, Human
cuggguguggcgcagca

SEQ ID NO: 3049984 - RNA, 16 nt, Human
cuggguguggcgcagc

SEQ ID NO: 3049985 - RNA, 17 nt, Human
cugggcagaaggaagac

SEQ ID NO: 3049986 - RNA, 18 nt, Human
cuggggccaggcuggguc

SEQ ID NO: 3049987 - RNA, 16 nt, Human
cuggggccgaaagaac

SEQ ID NO: 3049988 - RNA, 16 nt, Human
cugggcagaaggaaga

SEQ ID NO: 3049989 - RNA, 18 nt, Human
cugggcagaaggaagacu

SEQ ID NO: 3049990 - RNA, 16 nt, Human
cuggacugugugcuca

SEQ ID NO: 3049991 - RNA, 12 nt, Human
cuggcagcucag

SEQ ID NO: 3049992 - RNA, 13 nt, Human
cuggcagcucaga

SEQ ID NO: 3049993 - RNA, 14 nt, Human
cuggcagcucagag

SEQ ID NO: 3049994 - RNA, 13 nt, Human
cuggccccucagg

SEQ ID NO: 3049995 - RNA, 13 nt, Human
cugggacacaguu

SEQ ID NO: 3049996 - RNA, 12 nt, Human
cugggacacagu

SEQ ID NO: 3049997 - RNA, 10 nt, Human
cugggacagg

SEQ ID NO: 3049998 - RNA, 17 nt, Human
cuggccccucagggucc

SEQ ID NO: 3049999 - RNA, 18 nt, Human
cuggccccucaggguccc

SEQ ID NO: 3050000 - RNA, 20 nt, Human
cuggccccucagggucccug

SEQ ID NO: 3050001 - RNA, 21 nt, Human
cuggccccucagggucccugg

SEQ ID NO: 3050002 - RNA, 17 nt, Human
cuggcucacccaguccu

SEQ ID NO: 3050003 - RNA, 20 nt, Human
cuggcuccaaacccucgagg

SEQ ID NO: 3050004 - RNA, 19 nt, Human
cuggcuccaaacccucgag

SEQ ID NO: 3050005 - RNA, 19 nt, Human
cugugcucuggacaggcau

SEQ ID NO: 3050006 - RNA, 14 nt, Human
cugugcucuggaca

SEQ ID NO: 3050007 - RNA, 16 nt, Human
cugugagaugcuagaa

SEQ ID NO: 3050008 - RNA, 15 nt, Human
cugugaagagaacca

SEQ ID NO: 3050009 - RNA, 13 nt, Human
cugucgcccaguc

SEQ ID NO: 3050010 - RNA, 23 nt, Human
cuguacuugcucuugaugccugg

SEQ ID NO: 3050011 - RNA, 22 nt, Human
cuguacuugcucuugaugccug

SEQ ID NO: 3050012 - RNA, 21 nt, Human
cuguacuugcucuugaugccu

SEQ ID NO: 3050013 - RNA, 21 nt, Human
cuguaggaagguuaauguuca

SEQ ID NO: 3050014 - RNA, 18 nt, Human
cuguaggaagguuaaugu

SEQ ID NO: 3050015 - RNA, 16 nt, Human
cugucauuugagcagg

SEQ ID NO: 3050016 - RNA, 23 nt, Human
cugucagcuccccucggagaaga

SEQ ID NO: 3050017 - RNA, 18 nt, Human
cugucauuugagcagggc

SEQ ID NO: 3050018 - RNA, 17 nt, Human
cugucauuugagcaggg

SEQ ID NO: 3050019 - RNA, 18 nt, Human
cugucagccauuccuguu

SEQ ID NO: 3050020 - RNA, 21 nt, Human
cugucagcuccccucggagaa

SEQ ID NO: 3050021 - RNA, 14 nt, Human
cugcccugugggcc

SEQ ID NO: 3050022 - RNA, 22 nt, Human
cugccugggaucccucauccuc

SEQ ID NO: 3050023 - RNA, 18 nt, Human
cugccucgaacuggcugc

SEQ ID NO: 3050024 - RNA, 17 nt, Human
cugccucgaacuggcug

SEQ ID NO: 3050025 - RNA, 15 nt, Human
cugccucgaacuggc

SEQ ID NO: 3050026 - RNA, 14 nt, Human
cugccuguucagcu

SEQ ID NO: 3050027 - RNA, 23 nt, Human
cugccugggaucccucauccuca

SEQ ID NO: 3050028 - RNA, 15 nt, Human
cugcuacagagcaga

SEQ ID NO: 3050029 - RNA, 16 nt, Human
cugccuguugggccag

SEQ ID NO: 3050030 - RNA, 14 nt, Human
cugccuguugggcc

SEQ ID NO: 3050031 - RNA, 18 nt, Human
cugccuguugggccagga

SEQ ID NO: 3050032 - RNA, 19 nt, Human
cugccuguugggccaggag

SEQ ID NO: 3050033 - RNA, 16 nt, Human
cugcuaauuccccaga

SEQ ID NO: 3050034 - RNA, 20 nt, Human
cugcugacagacacaggccc

SEQ ID NO: 3050035 - RNA, 19 nt, Human
cugcugacagacacaggcc

SEQ ID NO: 3050036 - RNA, 18 nt, Human
cugcugacagacacaggc

SEQ ID NO: 3050037 - RNA, 15 nt, Human
cugcugacagacaca

SEQ ID NO: 3050038 - RNA, 23 nt, Human
cugcugacagacacaggcccggc

SEQ ID NO: 3050039 - RNA, 21 nt, Human
cugcugacagacacaggcccg

SEQ ID NO: 3050040 - RNA, 17 nt, Human
cugcuuuuuauggccug

SEQ ID NO: 3050041 - RNA, 22 nt, Human
cugcuuuuuaaagaaugcucuu

SEQ ID NO: 3050042 - RNA, 16 nt, Human
cugcuucagccucccg

SEQ ID NO: 3050043 - RNA, 14 nt, Human
cugcuucagccucc

SEQ ID NO: 3050044 - RNA, 17 nt, Human
cugcuuaacuucacaua

SEQ ID NO: 3050045 - RNA, 15 nt, Human
cugcuuaacuucaca

SEQ ID NO: 3050046 - RNA, 13 nt, Human
cugcuucagccuc

SEQ ID NO: 3050047 - RNA, 13 nt, Human
cugcuuaacuuca

SEQ ID NO: 3050048 - RNA, 13 nt, Human
cuggacugugugc

SEQ ID NO: 3050049 - RNA, 18 nt, Human
cugcuuuuuauggccugu

SEQ ID NO: 3050050 - RNA, 16 nt, Human
cuggaaauauuaagaa

SEQ ID NO: 3050051 - RNA, 21 nt, Human
cuggaaaucaggguuaguauu

SEQ ID NO: 3050052 - RNA, 17 nt, Human
cuggaacacuaaugagg

SEQ ID NO: 3050053 - RNA, 17 nt, Human
cugagacucgcgacaau

SEQ ID NO: 3050054 - RNA, 19 nt, Human
cugagacucgcgacaaugc

SEQ ID NO: 3050055 - RNA, 23 nt, Human
cugccauauucuguuggccagug

SEQ ID NO: 3050056 - RNA, 22 nt, Human
cugccauauucuguuggccagu

SEQ ID NO: 3050057 - RNA, 21 nt, Human
cugccauauucuguuggccag

SEQ ID NO: 3050058 - RNA, 20 nt, Human
cugccauauucuguuggcca

SEQ ID NO: 3050059 - RNA, 12 nt, Human
cugccagggaca

SEQ ID NO: 3050060 - RNA, 15 nt, Human
cugccagggacagag

SEQ ID NO: 3050061 - RNA, 11 nt, Human
cugccagggac

SEQ ID NO: 3050062 - RNA, 14 nt, Human
cugccccucaacuc

SEQ ID NO: 3050063 - RNA, 22 nt, Human
cugccccucaacucuccuccag

SEQ ID NO: 3050064 - RNA, 15 nt, Human
cugcccugugggccc

SEQ ID NO: 3050065 - RNA, 16 nt, Human
cugcccugugggcccc

SEQ ID NO: 3050066 - RNA, 18 nt, Human
cugcccugugggccccca

SEQ ID NO: 3050067 - RNA, 12 nt, Human
cugcccugugag

SEQ ID NO: 3050068 - RNA, 18 nt, Human
cugcauuuaaaagauaca

SEQ ID NO: 3050069 - RNA, 22 nt, Human
cugcauuuaaaagauacaguua

SEQ ID NO: 3050070 - RNA, 20 nt, Human
cugcauuuaaaagauacagu

SEQ ID NO: 3050071 - RNA, 13 nt, Human
cugcauguuacau

SEQ ID NO: 3050072 - RNA, 15 nt, Human
cugcauguuugugau

SEQ ID NO: 3050073 - RNA, 15 nt, Human
cugccaaugggagcu

SEQ ID NO: 3050074 - RNA, 17 nt, Human
cugccaaugggagcuca

SEQ ID NO: 3050075 - RNA, 21 nt, Human
auugcaacaggcugggcuuca

SEQ ID NO: 3050076 - RNA, 15 nt, Human
auugcaacaggcugg

SEQ ID NO: 3050077 - RNA, 13 nt, Human
auugaccugaggc

SEQ ID NO: 3050078 - RNA, 21 nt, Human
auugacccacaagaaaugaaa

SEQ ID NO: 3050079 - RNA, 19 nt, Human
auugcggacagccacggcc

SEQ ID NO: 3050080 - RNA, 18 nt, Human
auugcggacagccacggc

SEQ ID NO: 3050081 - RNA, 16 nt, Human
auugcggacagccacg

SEQ ID NO: 3050082 - RNA, 21 nt, Human
auugcccacgcuggagugcag

SEQ ID NO: 3050083 - RNA, 17 nt, Human
auugcccacgcuggagu

SEQ ID NO: 3050084 - RNA, 23 nt, Human
auugccauuucuuccacaagagc

SEQ ID NO: 3050085 - RNA, 16 nt, Human
auucuacuuugagugc

SEQ ID NO: 3050086 - RNA, 13 nt, Human
auucuacuuugag

SEQ ID NO: 3050087 - RNA, 14 nt, Human
auucucagaaucuc

SEQ ID NO: 3050088 - RNA, 19 nt, Human
auucucacagcuccaagaa

SEQ ID NO: 3050089 - RNA, 21 nt, Human
auucucacagcuccaagaauu

SEQ ID NO: 3050090 - RNA, 22 nt, Human
auucucacagcuccaagaauuu

SEQ ID NO: 3050091 - RNA, 16 nt, Human
auucuccaccugccag

SEQ ID NO: 3050092 - RNA, 17 nt, Human
auucuccaccugccagg

SEQ ID NO: 3050093 - RNA, 20 nt, Human
auugacacuuaaaaaugguu

SEQ ID NO: 3050094 - RNA, 20 nt, Human
auucucagaaucucaaauaa

SEQ ID NO: 3050095 - RNA, 18 nt, Human
auucucagaaucucaaau

SEQ ID NO: 3050096 - RNA, 13 nt, Human
auucuccaccugc

SEQ ID NO: 3050097 - RNA, 19 nt, Human
auuuaaagcuuauuaaaac

SEQ ID NO: 3050098 - RNA, 16 nt, Human
auuuaacagaaaugua

SEQ ID NO: 3050099 - RNA, 15 nt, Human
auuuaacagaaaugu

SEQ ID NO: 3050100 - RNA, 20 nt, Human
auuuaacagaaauguacagc

SEQ ID NO: 3050101 - RNA, 19 nt, Human
auuuaacagaaauguacag

SEQ ID NO: 3050102 - RNA, 17 nt, Human
auuuaacagaaauguac

SEQ ID NO: 3050103 - RNA, 16 nt, Human
auuuacaaaugggaaa

SEQ ID NO: 3050104 - RNA, 23 nt, Human
auuuaauuuuuuugagacagagu

SEQ ID NO: 3050105 - RNA, 19 nt, Human
auuuaauuuuuuugagaca

SEQ ID NO: 3050106 - RNA, 18 nt, Human
auuuaaccucuaaauucu

SEQ ID NO: 3050107 - RNA, 16 nt, Human
auuuaaccucuaaauu

SEQ ID NO: 3050108 - RNA, 14 nt, Human
auuguauuacaaau

SEQ ID NO: 3050109 - RNA, 15 nt, Human
auugugaaauuauuc

SEQ ID NO: 3050110 - RNA, 13 nt, Human
auugugccccugc

SEQ ID NO: 3050111 - RNA, 21 nt, Human
auugcuaaucaccaaaggcuc

SEQ ID NO: 3050112 - RNA, 23 nt, Human
auuggcuuuggguugcaggaccu

SEQ ID NO: 3050113 - RNA, 17 nt, Human
auuuuaccuuugacaaa

SEQ ID NO: 3050114 - RNA, 20 nt, Human
auuuuacuguacagacagaa

SEQ ID NO: 3050115 - RNA, 22 nt, Human
auuuuacuguacagacagaaaa

SEQ ID NO: 3050116 - RNA, 15 nt, Human
auuuuaauaauguuu

SEQ ID NO: 3050117 - RNA, 12 nt, Human
auuuuaauaaug

SEQ ID NO: 3050118 - RNA, 14 nt, Human
auuuuaauaauguu

SEQ ID NO: 3050119 - RNA, 15 nt, Human
auuuguaucacaaau

SEQ ID NO: 3050120 - RNA, 21 nt, Human
auuuguauaaaauaauuuuua

SEQ ID NO: 3050121 - RNA, 18 nt, Human
auuuuauguugcauagaa

SEQ ID NO: 3050122 - RNA, 21 nt, Human
auuuuauguugcauagaauaa

SEQ ID NO: 3050123 - RNA, 14 nt, Human
auuuuauguugcau

SEQ ID NO: 3050124 - RNA, 13 nt, Human
auuuuauuaugca

SEQ ID NO: 3050125 - RNA, 15 nt, Human
auuuuauuaugcaug

SEQ ID NO: 3050126 - RNA, 14 nt, Human
auuuuauuaugcau

SEQ ID NO: 3050127 - RNA, 17 nt, Human
auuuuauuaugcaugaa

SEQ ID NO: 3050128 - RNA, 20 nt, Human
auuuggagacacaacuauuu

SEQ ID NO: 3050129 - RNA, 17 nt, Human
auuuggugguuucagaa

SEQ ID NO: 3050130 - RNA, 23 nt, Human
auuugguaaggggaauugaggac

SEQ ID NO: 3050131 - RNA, 20 nt, Human
auuuggugguuucagaaaug

SEQ ID NO: 3050132 - RNA, 18 nt, Human
auuuggugguuucagaaa

SEQ ID NO: 3050133 - RNA, 21 nt, Human
auuugguuuucacauuggaaa

SEQ ID NO: 3050134 - RNA, 22 nt, Human
auuugguuuucacauuggaaac

SEQ ID NO: 3050135 - RNA, 15 nt, Human
auuugguuuucacau

SEQ ID NO: 3050136 - RNA, 17 nt, Human
auuugguuuucacauug

SEQ ID NO: 3050137 - RNA, 18 nt, Human
auuuguaguguuggagaa

SEQ ID NO: 3050138 - RNA, 16 nt, Human
auuugagcagggcuca

SEQ ID NO: 3050139 - RNA, 20 nt, Human
auuucuuuugccguuauuaa

SEQ ID NO: 3050140 - RNA, 22 nt, Human
auuugaggucuguucuuuccaa

SEQ ID NO: 3050141 - RNA, 17 nt, Human
auuugagcagggcucag

SEQ ID NO: 3050142 - RNA, 23 nt, Human
auuugaggucuguucuuuccaaa

SEQ ID NO: 3050143 - RNA, 16 nt, Human
auuuauuauggcacau

SEQ ID NO: 3050144 - RNA, 23 nt, Human
auuuccugggagcuuuuguagaa

SEQ ID NO: 3050145 - RNA, 22 nt, Human
auuuccugggagcuuuuguaga

SEQ ID NO: 3050146 - RNA, 14 nt, Human
auuuccugugucuu

SEQ ID NO: 3050147 - RNA, 13 nt, Human
auuucuaaaucuc

SEQ ID NO: 3050148 - RNA, 12 nt, Human
auuucuaaaucu

SEQ ID NO: 3050149 - RNA, 21 nt, Human
auuucuaaaucuccaaaauaa

SEQ ID NO: 3050150 - RNA, 20 nt, Human
auuuauuaaaugcccagccc

SEQ ID NO: 3050151 - RNA, 22 nt, Human
auuuauuacuguaagaaaauau

SEQ ID NO: 3050152 - RNA, 13 nt, Human
auuuauuauggca

SEQ ID NO: 3050153 - RNA, 23 nt, Human
auuucuuuugccguuauuaaaaa

SEQ ID NO: 3050154 - RNA, 11 nt, Human
uuugcucaugg

SEQ ID NO: 3050155 - RNA, 12 nt, Human
uuugcucaugga

SEQ ID NO: 3050156 - RNA, 19 nt, Human
uuugcuaagcauuccaacu

SEQ ID NO: 3050157 - RNA, 22 nt, Human
uuugcacacuuuggcccagggu

SEQ ID NO: 3050158 - RNA, 22 nt, Human
uuugccauguuggccaggcugg

SEQ ID NO: 3050159 - RNA, 14 nt, Human
uuuggggauauuuu

SEQ ID NO: 3050160 - RNA, 22 nt, Human
uuugggaggccaaggugggagg

SEQ ID NO: 3050161 - RNA, 13 nt, Human
uuuggggaagaac

SEQ ID NO: 3050162 - RNA, 12 nt, Human
uuuggcccaggg

SEQ ID NO: 3050163 - RNA, 21 nt, Human
augucagugugacugaucucu

SEQ ID NO: 3050164 - RNA, 15 nt, Human
augucagugugacug

SEQ ID NO: 3050165 - RNA, 16 nt, Human
augucagugugacuga

SEQ ID NO: 3050166 - RNA, 19 nt, Human
auguccaagaagcccagga

SEQ ID NO: 3050167 - RNA, 18 nt, Human
auguccaagaagcccagg

SEQ ID NO: 3050168 - RNA, 23 nt, Human
auguccaagaagcccaggaaagg

SEQ ID NO: 3050169 - RNA, 23 nt, Human
augucucuuuaaugucacaggca

SEQ ID NO: 3050170 - RNA, 22 nt, Human
augucuauaaaccgaacugaug

SEQ ID NO: 3050171 - RNA, 12 nt, Human
auguauguguaa

SEQ ID NO: 3050172 - RNA, 15 nt, Human
auguaucugagcagg

SEQ ID NO: 3050173 - RNA, 22 nt, Human
uuugggggaaaauuuagaaaua

SEQ ID NO: 3050174 - RNA, 15 nt, Human
auguaucaaugagua

SEQ ID NO: 3050175 - RNA, 11 nt, Human
uuuuaagaaau

SEQ ID NO: 3050176 - RNA, 15 nt, Human
uuuuaagaggcaggg

SEQ ID NO: 3050177 - RNA, 16 nt, Human
uuuuaagaggcagggu

SEQ ID NO: 3050178 - RNA, 16 nt, Human
uuuuaaguaaggaauu

SEQ ID NO: 3050179 - RNA, 15 nt, Human
uuuuaagugcugcau

SEQ ID NO: 3050180 - RNA, 18 nt, Human
uuuguuugaacugauaaa

SEQ ID NO: 3050181 - RNA, 13 nt, Human
uuuuaaaaaagaa

SEQ ID NO: 3050182 - RNA, 21 nt, Human
uuuuaaaaaacugcugacugu

SEQ ID NO: 3050183 - RNA, 14 nt, Human
uuuuaaaagaauga

SEQ ID NO: 3050184 - RNA, 13 nt, Human
uuuguagagccag

SEQ ID NO: 3050185 - RNA, 22 nt, Human
uuuguaaauuaacuuuuauaaa

SEQ ID NO: 3050186 - RNA, 19 nt, Human
uuuguagcacugacagauu

SEQ ID NO: 3050187 - RNA, 17 nt, Human
uuuguagcacugacaga

SEQ ID NO: 3050188 - RNA, 17 nt, Human
uuuguagaagucacauu

SEQ ID NO: 3050189 - RNA, 14 nt, Human
uuuguuugaacuga

SEQ ID NO: 3050190 - RNA, 13 nt, Human
uuuguuugaacug

SEQ ID NO: 3050191 - RNA, 12 nt, Human
uuuguuugaacu

SEQ ID NO: 3050192 - RNA, 18 nt, Human
uuugugaggaagccgcug

SEQ ID NO: 3050193 - RNA, 19 nt, Human
uuugugaggaagccgcugg

SEQ ID NO: 3050194 - RNA, 21 nt, Human
uuuuauucagcucauggacuu

SEQ ID NO: 3050195 - RNA, 16 nt, Human
uuuucuauaauuuaaa

SEQ ID NO: 3050196 - RNA, 19 nt, Human
uuuuccagguuuaagcugu

SEQ ID NO: 3050197 - RNA, 22 nt, Human
uuuuauguugcauagaauaaaa

SEQ ID NO: 3050198 - RNA, 19 nt, Human
uuuuaugugaaacauguuu

SEQ ID NO: 3050199 - RNA, 18 nt, Human
uuuuaugugaaacauguu

SEQ ID NO: 3050200 - RNA, 19 nt, Human
uuuuauggcacuaguauuu

SEQ ID NO: 3050201 - RNA, 23 nt, Human
uuuuauggaggcuuugcauagau

SEQ ID NO: 3050202 - RNA, 17 nt, Human
uuuuauaaacuuuaccu

SEQ ID NO: 3050203 - RNA, 14 nt, Human
uuuuauaaacuuua

SEQ ID NO: 3050204 - RNA, 19 nt, Human
uuuuauaaacuuuaccuuu

SEQ ID NO: 3050205 - RNA, 14 nt, Human
uuuuauaauuuugu

SEQ ID NO: 3050206 - RNA, 19 nt, Human
uuuuaguugcaacuuugua

SEQ ID NO: 3050207 - RNA, 13 nt, Human
uuuuauaaacuuu

SEQ ID NO: 3050208 - RNA, 12 nt, Human
uuuuauaaacuu

SEQ ID NO: 3050209 - RNA, 23 nt, Human
uuuuagaguugauacuacaguuu

SEQ ID NO: 3050210 - RNA, 14 nt, Human
auguuggccaggcu

SEQ ID NO: 3050211 - RNA, 13 nt, Human
auguuggccaggc

SEQ ID NO: 3050212 - RNA, 21 nt, Human
auguucaucauccuaagcuau

SEQ ID NO: 3050213 - RNA, 19 nt, Human
auguucaucaaugaaugaa

SEQ ID NO: 3050214 - RNA, 15 nt, Human
auguugacaugggac

SEQ ID NO: 3050215 - RNA, 17 nt, Human
uuuuaagugcugcauuu

SEQ ID NO: 3050216 - RNA, 16 nt, Human
uuuuaagugcugcauu

SEQ ID NO: 3050217 - RNA, 21 nt, Human
uuuuaagugcugcauuuaaaa

SEQ ID NO: 3050218 - RNA, 15 nt, Human
auguugugauguauu

SEQ ID NO: 3050219 - RNA, 14 nt, Human
auguuuuccaugag

SEQ ID NO: 3050220 - RNA, 18 nt, Human
auguuucaaacauauaua

SEQ ID NO: 3050221 - RNA, 20 nt, Human
auuaaaaaaucaguuguaca

SEQ ID NO: 3050222 - RNA, 18 nt, Human
auguuuuucuucucccuc

SEQ ID NO: 3050223 - RNA, 17 nt, Human
auguuuuucuucucccu

SEQ ID NO: 3050224 - RNA, 16 nt, Human
auuaaaagaauauuuu

SEQ ID NO: 3050225 - RNA, 15 nt, Human
auuaaaagaauauuu

SEQ ID NO: 3050226 - RNA, 20 nt, Human
auuaacuuuuauaaacuuua

SEQ ID NO: 3050227 - RNA, 19 nt, Human
auuaacuuuuauaaacuuu

SEQ ID NO: 3050228 - RNA, 17 nt, Human
auuaacuuuuauaaacu

SEQ ID NO: 3050229 - RNA, 16 nt, Human
auuaacuuuuauaaac

SEQ ID NO: 3050230 - RNA, 12 nt, Human
auuaacuuuuau

SEQ ID NO: 3050231 - RNA, 23 nt, Human
auuaacuuuuauaaacuuuaccu

SEQ ID NO: 3050232 - RNA, 14 nt, Human
auuaagaaagacua

SEQ ID NO: 3050233 - RNA, 13 nt, Human
auuaagaaagacu

SEQ ID NO: 3050234 - RNA, 17 nt, Human
auuaaccacuucagcug

SEQ ID NO: 3050235 - RNA, 18 nt, Human
auuaaccacuucagcuga

SEQ ID NO: 3050236 - RNA, 20 nt, Human
auuaaccacuucagcugacu

SEQ ID NO: 3050237 - RNA, 21 nt, Human
auuaaacuuaaucuaaaugga

SEQ ID NO: 3050238 - RNA, 19 nt, Human
auuaaacuuaaucuaaaug

SEQ ID NO: 3050239 - RNA, 16 nt, Human
auuaaacuuaaucuaa

SEQ ID NO: 3050240 - RNA, 17 nt, Human
auuaaacuuaaucuaaa

SEQ ID NO: 3050241 - RNA, 21 nt, Human
auuaacaugaauauuuagugu

SEQ ID NO: 3050242 - RNA, 14 nt, Human
auucagcucaugga

SEQ ID NO: 3050243 - RNA, 15 nt, Human
auucaaacagucuca

SEQ ID NO: 3050244 - RNA, 14 nt, Human
auucaaacagucuc

SEQ ID NO: 3050245 - RNA, 14 nt, Human
auucagcucugcaa

SEQ ID NO: 3050246 - RNA, 18 nt, Human
auucagcucugcaagaau

SEQ ID NO: 3050247 - RNA, 21 nt, Human
auucaggaagcucagggccug

SEQ ID NO: 3050248 - RNA, 22 nt, Human
auucaggaagcucagggccugg

SEQ ID NO: 3050249 - RNA, 23 nt, Human
auucaggaagcucagggccuggc

SEQ ID NO: 3050250 - RNA, 16 nt, Human
auucaguuguuagugu

SEQ ID NO: 3050251 - RNA, 21 nt, Human
auucaguuguuagugugucuu

SEQ ID NO: 3050252 - RNA, 20 nt, Human
auucaggaagcucagggccu

SEQ ID NO: 3050253 - RNA, 16 nt, Human
auuccccaggaggcca

SEQ ID NO: 3050254 - RNA, 22 nt, Human
auuccccacccugaaagcccug

SEQ ID NO: 3050255 - RNA, 20 nt, Human
auuccccagauugcaacagg

SEQ ID NO: 3050256 - RNA, 20 nt, Human
auuccacuuauaggaauuga

SEQ ID NO: 3050257 - RNA, 15 nt, Human
auuaauauauuucca

SEQ ID NO: 3050258 - RNA, 13 nt, Human
auuaaguaaugau

SEQ ID NO: 3050259 - RNA, 15 nt, Human
auuaaguaaugauaa
